United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 93

SEQ ID NO: 182195 - DNA, 1788 bp, Artificial Sequence
  Description of Artificial Sequence: Synthetic coding sequence
atgtggctgttcttcggcatcaccggcctgctgaccgccgccctgtcgggccaccccagtcctgcaccccccgaccagctgaacacaagtagcgcggaatcggaactgtgggagcccggggagcggttgcctgttaggctgaccaacggctcttcatcttgctctggcacagtcgaagtcagactcgaggcaagttgggaaccagcgtgcggcgccttgtgggattccagggcagccgaagcagtgtgtcgcgccctgggctgtggaggggcggaagccgcaagccagctcgcacctccgacgcccgaattgcctccgccgccagctgctggaaatacctccgtcgccgccaacgccacgctggcgggggctcccgctctgctctgctccggcgccgagtggcgcctgtgcgaagtagttgagcatgcttgcagatcagacgggaggcgagccagagtcacctgcgctgagaaccgcgctctgagactggtggacggcggaggtgcctgtgccgggagggtcgaaatgctcgaacacggagaatggggtagtgtgtgcgacgatacttgggatctcgaggatgctcacgtggtttgccgccagcttgggtgcggatgggccgtgcaggcactccctggcctacactttacccccggacgaggaccgatacatcgtgaccaggtaaactgttcgggagctgaagcttacctctgggattgccccggtctccccggccagcattattgtggtcacaaggaagatgcaggagccgtgtgttctgaacatcaatcctggcgccttaccggcggagccgacagatgcgagggccaggttgaagtccactttagaggtgtgtggaacactgtctgcgattcagaatggtacccgagcgaggccaaagtactgtgtcaaagcctgggatgtgggactgccgtggagagaccgaaagggctaccccactccttatctgggaggatgtactactcatgcaacggggaggagctgacactctcaaactgtagctggcgattcaataactcaaacctttgtagccagtctctcgccgcgcgtgtattgtgcagtgcatcccgttccctgcacaacctgagtacacctgaggtcccagccagcgtgcagaccgtaacaatagagagctctgtgactgtgaagattgaaaacaaagagtccagagagctcatgctccttattccctccatagtcctgggaattctcctgctcgggtccctgattttcattgccttcatcctcctgagaatcaaaggtaagtatgattctcagcggcatagagtgactgatgaggaggtgcagcagtctcggtttcagatgcccccgctggaggaaggcctcgaggaactacacgcctctcatatcccgaccgccaacccaggccattgcatcaccgacccacccagccttggaccccagtaccatcctcgctctaactctgaatcctcaacaagctccggcgaggactattgtaattcacccaagtccaagttgcctccctggaatccccaggtgttttcttccgaaaggagtagctttctggagcagccccctaacctggaacttgctgggactcagcccgctttcagtgctggacccccagcggacgattcgagctcgacttctagcggggaatggtaccagaatttccaaccacccccccaacctccaagcgaagagcagttcggatgtcctgggtctccctctccacagcctgactctacagacaatgacgactacgatgacatctctgctgcatag

SEQ ID NO: 182196 - DNA, 1806 bp, Artificial Sequence
  Description of Artificial Sequence: Synthetic coding sequence
atgtggctgttcttcggcatcaccggcctgctgaccgccgccctgtccgggcaccctagccccgccccccctgatcaacttaatacttcaagcgccgagtccgagctgtgggagcctggagaaagactgcccgtgagactgacgaacggctcctcttcttgctccggcacagtggaagtgcggctggaagcctcctgggaacctgcctgcggtgccctgtgggattcaagggcagctgaggcagtttgcagggcattgggctgcggcggggccgaggccgcctcacagcttgcccctccaactccggagctgcccccaccaccagcagcaggaaatacatctgttgcagcaaatgccacattggctggcgctcccgcgttgctgtgcagtggagccgagtggagactatgtgaagttgtcgagcatgcttgtcggtccgacggcagaagggcaagagtgacatgtgccgaaaatcgagccctacggctggtcgacggcggaggggcctgcgccggacgagtcgaaatgctggagcatggtgagtgggggtccgtgtgcgacgacacatgggacctggaagatgcccacgtggtgtgtcgacagttaggctgcgggtgggcggtccaggccctgcccggccttcatttcaccccggggcgcgggcccatacatcgcgaccaggtcaactgcagcggggcggaggcctacctctgggactgcccaggcttacccggccagcactactgcggacataaagaagacgcaggggcagtatgctctgagcatcaaagctggcgactcaccggcggggctgatagatgtgagggacaggtcgaagtccatttccgtggggtgtggaacacagtatgcgacagcgaatggtacccgtcagaagctaaagtgctctgtcagtcattgggatgtggcaccgccgtggagcgtcctaagggactcccacatagcttaagcggacgcatgtattactcgtgcaatggcgaagaactgaccttgagtaattgctcctggcgtttcaacaacagcaacttgtgctcccagtctctggcggcccgcgtgctttgctcggcctcaagaagtctgcataatcttagtacccctgaggttccagcttccgttcaaactgtgacaattgagtcgtctgtgaccgtgaagatcgaaaataaagagagcagggaacttatgctgctgattccatcgatcgtgctaggcatcctgcttctcggaagcctcatatttattgcgtttatcttgctccgcataaagggaaaatacgtattcatgctgcctatccaggttcaggctccaccacccgaggatagtgactctgggagcgatagtgactatgagcattacgatttttcagctcagcctcccgttgccctgactaccttttataacagccagcgccacagggtcacagatgaggaagttcaacagtcccggttccagatgccgcccctcgaggaggggctcgaagaactgcatgcctctcacatcccaactgcaaatcccggccattgtataacagaccctcccagtcttggccctcagtaccatcctcgttctaatagcgaaagctcaacgtcatcaggggaagactactgtaactcccctaaatccaagctgcctccatggaatccacaagtgttctcgagtgagcgcagcagcttcctggagcaacctcctaatctcgagctggctgggacacaacctgcctttagcggctccccctccccacagccagactccaccgacaatgatgactatgacgatatcagtgctgcttag

SEQ ID NO: 182197 - DNA, 1779 bp, Artificial Sequence
  Description of Artificial Sequence: Synthetic coding sequence
atgtggctgttcttcggcatcaccggcctgctgaccgccgccctgtctgggcatccttccccagcacctcctgaccagctcaacacttccagcgcagaatccgaactgtgggagcccggcgagagactgccagttaggctcaccaacggcagcagctcttgtagcggcactgtcgaggttcgcttggaagcatcttgggaacccgcgtgcggggccctgtgggattcacgagctgccgaggctgtgtgccgcgctctggggtgcggcggagctgaggcagctagccagctagcccctcctacacctgagctaccccccccacctgccgctgggaacacctctgtggcggctaatgccacactggccggggcccctgccctgttatgttctggtgctgagtggaggttatgcgaggtcgtagagcacgcctgccgcagcgatgggcgcagggccagagtgacatgtgccgagaacagggccttgagattagtcgatggcggaggggcctgcgccgggcgggtggaaatgcttgaacatggtgagtggggttctgtgtgcgacgacacatgggacctggaggatgcgcacgtagtttgtcgccagctgggatgtggatgggcagttcaggccctgccaggcttgcactttactccaggccggggaccaattcatagagaccaggtgaactgtagcggagcagaggcctatctgtgggactgtccgggcctaccgggacagcattactgcgggcataaggaggacgcaggagctgtgtgttccgagcatcagagctggagattgaccggcggggctgatcgctgtgaaggacaggttgaagtccatttcaggggagtgtggaacacggtgtgcgactctgaatggtatccttctgaggcaaaggttctgtgtcaatctctcgggtgcgggactgcagtggagcggcccaagggactgcctcactcactttccggtcgcatgtattattcctgcaatggcgaggagctaacgctctcaaactgtagttggaggtttaacaacagtaatctgtgttcccagagccttgccgccagggtgttgtgttctgcttccaggtccttacataatctctctacacctgaagtgcccgcatccgttcagaccgtaacgatcgaaagcagtgttacggtcaaaatcgagaataaggagtcacgcgaactgatgctgctaatcccctcaatcgtcctgggaatcctgctgctgggttccttgatctttatcgcattcattctgctgaggattaagggcaaatacgccctgcctgtgatggtcaatcaccaacacctgccaactactatcccagcgggtagtaatagttatcagccagttccaattacaatccctaaggaggactcgcaacggcatcgagtaaccgacgaggaggttcagcagagtagatttcaaatgcctcccttggaagaggggttagaagagttgcacgcctcccatatcccgaccgcaaacccagggcactgcataaccgacccgccctccctggggccccaataccatccaagaagcaactctgaatctagtacctctagcggggaagattattgcaatagcccaaaatctaagcttcccccatggaacccccaggttttttctagcgaacgatccagtttcctcgagcaacctccaaacttagaactcgcggggacacagccagcgttcagcggatcaccgtccccccagccggacagcacagacaacgacgactatgacgatatttcagctgcctag

SEQ ID NO: 182198 - DNA, 717 bp, Artificial Sequence
  Description of Artificial Sequence: Synthetic coding sequence
atggccgtggagggcggcatgaagtgcgtgaagttcctgctgtacgtgcttctcctagccttttgcgcctgcgccgtcggcttaatagccgtcggcgtgggtgcccaacttgtgctgtctcagactattatccaaggcgccacaccgggcagcctattgcccgttgtgattatcgccgttggagtgtttctgtttctggtcgcatttgtgggctgttgcggagcatgtaaagagaattattgcctcatgataacgttcgccattttcctgagtctcattatgcttgtagaggtcgctgcagcgattgccggttacgtgttcagagataaggttatgtccgagtttaataacaattttcgccaacaaatggaaaactatccaaaaaataaccacactgcatccattctggataggatgcaggcggattttaaatgttgcggtgccgctaactacacagattgggaaaagatcccgagcatgtctaagaaccgcgttcccgattcatgctgtataaacgtgactgttggctgtgggataaattttaacgagaaggctatacacaaggagggttgcgtcgaaaaaattggggggtggctaaggaaaaatgtcctcgtggttgctgccgccgcattgggcatcgctttcgtggaagttcttggcatcgtgttcgcttgttgtctagtgaaatccatcaggagcgggtacgaagttatgtag

SEQ ID NO: 182199 - DNA, 711 bp, Artificial Sequence
  Description of Artificial Sequence: Synthetic coding sequence
atggccgtggagggcggcatgaagtgcgtgaagttcctgctgtacgtgctgctgctggcgttctgcgcctgcgcggtcggacttatcgctgtgggcgtcggtgctcagctcgtgctgagtcagaccattattcagggtgcaaccccaggaagcctgttgccagttgttatcattgcggttggcgtgtttctgttcttagttgcttttgtcggctgttgtggagcctgcaaggaaaactactgtctgatgattacatttgctatttttctttccttgataatgcttgtcgaggtagctgcagcaattgcaggatatgtgttcagggacaaggttatgagtgagttcaacaacaatttccggcagcaaatggagaactatccaaagaacaaccacactgctagtatattagatcgtatgcaggccgatttcaagtgctgtggagcagctaactatacagattgggagaaaatcccatccatgagcaagaatcgcgtccctgactcctgctgtattaacgtgactgttggctgtgggataaattttaatgagaaagctatccataaagaagggtgcgtcgagaaaattggcggctggctaaggaagaacgtgctggttgttgctgccgcagcgctcggcattgccttcgtccttggcatcgttttcgcctgctgtctggtcaaatcaatacgatcagggtatgaagtaatgtag

SEQ ID NO: 182200 - DNA, 402 bp, Artificial Sequence
  Description of Artificial Sequence: Synthetic coding sequence
atggccgtggagggcggcatgaagtgcgtgaagttcctgctgtacgtcttgctgcttgcattttgtgcatgtgctgttgggctcatagccgtgggcgtgggcgcgcaactggtgctgtctcagaccatcattcaaggtgctacacctggttcattactccctgtcgtaataattgcggtaggcgtgttcctctttctggtcgcattcgtcggatgctgtggggcatgtaaagaaaactactgtctaatgataacgtttgctatcttcctttctcttattatgctggtcgaggtggcagccgcgatagccggttacgtgttccgcgacaaggttatgagtgaatttaataataacttccggcagcaaatggaaaattaccccaagaacaaccacactgcatag

SEQ ID NO: 182201 - DNA, 717 bp, Artificial Sequence
  Description of Artificial Sequence: Synthetic coding sequence
atggccgtggagggcggcatgaagtgcgtgaagttcctgctgtacgtactcttgcttgcattctgtgcctgtgcagttggactcatcgccgtcggagtcggtgcccaactggtactctcgcagacaatcatccagggagctacccctgggagtttgctccctgtggtgataattgccgttggggtgttcctgtttctggtcgccttcgtgggctgctgtggcgcgtgcaaggagaattactgtctcatgatcacctttgccatttttctctctcttataatgctggtcgaggtggctgcggctatcgcaggttatgtattcagagacaaagtgatgagcgagtttaacaacaacttccggcagcaaatggaaaactatcccaagaacaaccacaccgcttccatactagacaggatgcaagccgactttaagtgttgtggcgccgcaaattacacagactgggaaaaaattccctcgatgtcaaagaacagggtccctgacagctgctgcatcaacgttaccgtcggatgcggcataaactttaacgaaaaggcgatccataaagagggttgcgtggaaaaaattgggggctggctgcgcaaaaatgtgctcgttgtcgctgccgcggctcttggcatcgctttcgtggaagtgctgggtattgttttcgcctgctgcttggtgaagtctatccgcagcgggtacgaggtcatgtag

SEQ ID NO: 182202 - DNA, 648 bp, Artificial Sequence
  Description of Artificial Sequence: Synthetic coding sequence
atggccgtggagggcggcatgaagtgcgtgaagttcctgctgtacgtgcttttgctggcattctgtgcctgcgcggtgggcctgatcgcggttggcgtgggcgcccagcttgtcttgagccagaccataatccagggtgctacacctggctccctgctaccagtggtgatcatcgcagtcggtgtgttcttatttctggtggccttcgtgggctgctgcggggcctgcaaggagaactattgcctcatgattacgttcgccatttttttgtctctcattatgctggtcgaagtagccgccgccatcgcgggatatgtcttcagagataaggtaatgtccgagttcaacaataacttccggcagcagatggagaactatccaaagaacaatcacaccgcaagcattctggatcggatgcaggccgattttaagtgctgcggtgccgccaactacaccgactgggaaaagatcccctctatgtcaaagaacagggtccccgacagctgctgcatcaatgtcaccgtagggtgtggcatcaactttaacgaaaaggccattcataaagaaggatgcgtggagaaaatcggcggttggttacgtaagaacgtcctagtcgtcgccgccgcagccctgggtattgccttctag

SEQ ID NO: 182203 - DNA, 654 bp, Artificial Sequence
  Description of Artificial Sequence: Synthetic coding sequence
atggccgtggagggcggcatgaagtgcgtgaagttcctgctgtacgtgctgcttcttgctttttgcgcatgcgctgttgggctgatcgccgtgggcgtaggcgcgcagttggtgctgtcccagaccattattcaaggagccacgcccggtagtcttttgcccgtggttatcattgccgtgggcgtcttcctgtttctggtcgctttcgttggatgttgtggagcttgcaaagagaactactgcctgatgattacatttgccatcttcctgtctttgatcatgctagtcgaggtggcagccgcaattgcaggctatgtcttcagggataaggttatgtccgagtttaataacaactttaggcaacagatggagaattaccccaaaaacaaccacactgcatcgattctggatcgaatgcaggccgacttcaaatgctgtggggctgccaattataccgactgggaaaaaattccctctatgagcaagaatcgtgttccagactcatgctgtatcaatgttactgttgggtgcgggatcaattttaatgaaaaggcaatccacaaagaaggatgcgtcgaaaagattggcgggtggctgcggaagaatgtcctagtggtggccgccgctgccttgggaatcgctttcgttgaatag

SEQ ID NO: 182204 - DNA, 717 bp, Artificial Sequence
  Description of Artificial Sequence: Synthetic coding sequence
atggccgtggagggcggcatgaagtgcgtgaagttcctgctgtacgtccttcttttagccttctgtgcctgcgcagtgggtctcatagctgtgggagttggcgcccagctagtactctcccagactatcatccagggggccacccccggcagcctactgcctgtggtcataatcgccgttggcgtgtttctttttctcgtcgcctttgtgggctgctgtggtgcgtgcaaggagaactactgccttatgatcaccttcgctatcttcctatcccttataatgctcgtggaggtggcagccgctatcgctggctacgtctttcgcgacaaggtgatgagcgaatttaataataactttaggcagcagatggaaaattacccgaagaataaccatactgccagtattctggatcgcatgcaggctgattttaagtgctgtggggccgccaattataccgattgggaaaagatcccctccatgtctaaaaatagggtccccgattcttgctgtattaacgtgacagtaggatgcggaatcaactttaatgagaaggctatacataaagaagggtgcgtggagaagatcggcggctggttgcggaaaaacgtgcttgtggtggccgccgctgctctgggaatcgcctttgttgaggtgctgggcatcgtgttcgcatgttgcctggtcaagtccatcagatccggctatgaggtcatgtag

SEQ ID NO: 182205 - DNA, 648 bp, Artificial Sequence
  Description of Artificial Sequence: Synthetic coding sequence
atggccgtggagggcggcatgaagtgcgtgaagttcctgctgtacgttttacttcttgctttttgcggagcaaccccgggcagtctcttgcccgtcgtgattatagccgtcggagtcttcctgttcctggtggcctttgtgggctgttgcggcgcttgtaaagaaaactactgcctcatgatcactttcgctattttcctgtcattaatcatgctcgtcgaagtggcagccgccatcgctggatacgtattccgtgataaggtgatgtccgaattcaacaataactttcggcagcaaatggaaaactaccctaaaaacaatcatacagcttctatccttgaccgcatgcaggcggattttaagtgctgtggagcagctaattatacagactgggaaaaaattccatcaatgagcaaaaatcgagtgcctgattcatgctgcattaatgtaactgttgggtgcggaattaactttaacgaaaaggcaattcacaaagaggggtgcgttgaaaagatcggggggtggctcagaaaaaatgtacttgtggtcgccgcagcagcattaggcattgcattcgtcgaggtgctggggatcgtttttgcctgttgtctggtcaagtcaatcagaagcggttacgaagtaatgtag

SEQ ID NO: 182206 - DNA, 471 bp, Artificial Sequence
  Description of Artificial Sequence: Synthetic coding sequence
atgatcaccttcgccatcttcctgagcctgatcatgctggtggaggtggctgccgctattgccggctacgtgttcagagataaggtgatgtccgagttcaacaataactttaggcagcagatggaaaattatcctaaaaacaaccacacagcctcgatactggaccgcatgcaagctgattttaaatgttgtggggcggctaattataccgattgggaaaaaattccatctatgagtaagaatagagtgccagactcgtgctgcatcaacgtgactgtgggatgcggcatcaattttaacgaaaaggctatccacaaggaaggatgtgtggaaaaaatcggcggatggctccgcaaaaatgtactggttgtcgccgcggcagccctgggcatcgccttcgtagaggtgctcgggattgttttcgcgtgttgcctcgtgaaatcaattcggtccggctacgaggtgatgtag

SEQ ID NO: 182207 - DNA, 471 bp, Artificial Sequence
  Description of Artificial Sequence: Synthetic coding sequence
atgatcaccttcgccatcttcctgagcctgatcatgctggtggaggtagctgcagcaatagctggctacgtgtttagggataaggtaatgagtgagtttaacaataacttcaggcagcaaatggagaattaccctaagaacaaccacaccgcaagcatcctggacaggatgcaggcggactttaaatgttgcggcgccgctaactatacagactgggaaaagatcccaagcatgtctaaaaatagggtcccagacagctgttgcattaatgtaaccgtcggctgcggaataaattttaacgaaaaggccatccacaaagagggatgcgtagagaagatcggagggtggctacgaaagaatgtccttgtggtggctgctgcggcactggggatcgcattcgttgaggtgttagggattgtattcgcatgttgtctcgtgaagagtattagaagcggatacgaagtgatgtag

SEQ ID NO: 182208 - DNA, 1065 bp, Artificial Sequence
  Description of Artificial Sequence: Synthetic coding sequence
atgcggctggccgtgctgttcagcggcgccctgctgggcctgctggctgcccagggtacggggaacgattgtcctcataagaaaagcgctactctcctgccatccttcactgtgacgcccacggtgaccgagagcacaggcaccacaagtcaccggactacgaagtcgcacaagactaccacacaccgtactaccactactggtacaacatcccacggccctaccacagcaacccacaacccaacgacaacttctcacggaaacgtgaccgtgcatcctacctctaacagtactgctactagccaagggccatccaccgcaacccactcccctgccaccacatcccacggaaacgctacagtgcaccccacaagtaacagtactgccacaagccctggcttcacgtctagcgctcaccccgagccccctcctccctccccctcacccagccccacatccaaagagactatcggtgactacacttggactaatggcagtcagccttgcgtgcatctgcaagcacagatacagatacgtgtaatgtatacaacgcagggaggcggcgaggcctggggcattagcgttttaaatccgaacaaaaccaaggtacaggggtcttgcgagggggctcatccgcacctgctgcttagcttcccctacggtcacttgtcctttggattcatgcaggatcttcagcaaaaagtcgtttatttgtcctatatggccgtcgagtataacgtatccttccctcacgccgctcagtggacattttccgcacaaaatgctagtctcagggatcttcaagctcccctgggccagagtttctcctgtagtaacagtagcatcatactgtcacctgcagtgcacctggatttgctatccctgaggctgcaggcggctcaattaccacacactggagtcttcggccagtcattttcctgtccatctgaccgcagcatcctgctgccactcatcatcggcctgatcctgttgggcctgttggcgctggtgctcattgccttttgcattattaggaggcggcctagcgcctatcaagcattgtag

SEQ ID NO: 182209 - DNA, 894 bp, Artificial Sequence
  Description of Artificial Sequence: Synthetic coding sequence
atgcggctggccgtgctgttcagcggcgccctgctgggcctgctggcagagtcaactggaaccacttctcaccggaccactaagtcacacaaaactacaacccatcgcaccacaactacagggacaacatcccatggcccaaccacagccactcacaatcccacaacaacttcccatggaaacgctaccgtgcacccgacgagtaacagtaccgcgacatcccccgggttcacatcttcagcccatcccgagccccctcccccatctccttctcctagccctacttcaaaggagactatcggtgactacacatggacgaatggatcccagccctgcgtgcatctgcaggcccagatacagatacgtgtgatgtacactactcagggcggcggtgaggcctggggcatctcagtcctcaaccccaacaagaccaaggtccagggatcatgtgaaggtgcccatccgcatctccttttgtccttcccctatgggcacctctctttcggatttatgcaggatctacagcagaaggttgtctaccttagttacatggccgtggagtataatgtcagctttcctcacgccgcacaatggaccttcagtgcccagaacgcctctctcagagacttgcaggcaccactgggccagtccttctcatgttcaaactcatctatcatcctgtccccagcagtgcaccttgacctgttgagcttgcgactgcaggcggcgcagctcccgcatactggagtgttcgggcaatcctttagttgccctagcgaccgtagcatactactacctctcattatcggtctgatcctattagggctgttggccttagtcctaatcgcattctgcataattaggcgtcgcccctctgcctaccaggctctatag

SEQ ID NO: 182210 - DNA, 3018 bp, Artificial Sequence
  Description of Artificial Sequence: Synthetic coding sequence
atgatgagcgacgccagcgacatgctggccgccgccctggagcagatggacgggattatcgctgggagtaaagctcttgagtacagcaacggaattttcgattgccagtcaccaacatccccctttatgggcagcctgagagccctccacttggtggaagatctgcgtggactgctggaaatgatggagaccgatgaaaaggagggcttgcgatgtcaaatcccagatagcaccgccgagacgctggtggagtggctacagagccagatgaccaatggccatttgccaggcaatggtgacgtgtatcaggagaggcttgcacgactggagaatgacaaagaaagtttagttctgcaggtcagtgtgctcaccgatcaggtggaggctcagggtgagaaaatcagggatctcgagttctgcctggaggaacacagggagaaggttaatgcaaccgaggagatgctgcagcaggagttactgagccggacatcactggagactcaaaaactggatttgatggctgagatttcaaatctcaagctcaagctgaccgctgtggagaaagataggctagattacgaggacaaatttcgggacacggagggactgattcaggagatcaacgatctccgtctcaaggtatctgaaatggattctgaacgcctccagtacgagaagaagctgaaatcaaccaaagatgagcttgcctcacttaaggagcagctcgaggaaaaagagagtgaagtgaaaagactccaggagaaactcgtctgtaaaatgaagggagagggggttgaaattgtcgatagggacgagaatttcaaaaagaagctgaaggagaagaacatcgaggttcaaaaaatgaaaaaagccgtcgagtcactcatggccgctaacgaggagaaggatcgaaagattgaggacctgcggcagtgtctcaataggtacaagaagatgcaggacactgttgtcctagctcagggcaaaaagggcaaagacggggaatatgaagagctcttaaatagctcatccatcagcagcttgctggacgctcagggattttcagatcttgagaaaagtcctagccccacaccagtaatgggctccccatcatgcgaccccttcaacacgagtgtgcctgaggaatttcacacgaccatcctgcaggtttccattccgtctttgctgcccgctacagtctccatggagaccagtgaaaaatctaagttaacacccaaacctgagacatccttcgaagagaacgacgggaacattatcctgggggccactgtggatacccagctctgcgacaaattgttgacttcctctttgcagaaaagtagctcattgggcaacctaaagaaggaaactagtgatggagagaaggagactatacagaaaacaagtgaagacagagctccggccgaatcacggcctttcgggacgctgccccctagacctcccgggcaggatactagtatggatgacaaccccttcggcaccagaaaggtgcgctcttccttcggccgcggattttttaagataaagtccaataagcggaccgccagcgcccccaacctggaccgtaagcgcagtgcctcggcgcccacgttggccgagacggagaaggagaccgctgagcatctcgatcttgctggtgcctctagcaggcccaaggatagccagcgcaactcccctttccaaatccctccacctagccctgattccaagaaaaagagccgaggcatcatgaagctgtttggaaaactgcgcagaagtcagagtacgacatttaaccccgacgatatgagcgaaccagagttcaaaagaggggggacccgggccacagctggtccacggctgggctggtctcgcgatcttggtcaatccaactctgatctggatatgccgttcgcaaagtggaccaaggagcaggtgtgcaattggctcatggagcaagggctaggtagttatctgaatagcggcaaacactggattgcctccgggcaaacgctgctccaagcttctcagcaggatctcgagaaagagctcggcattaagcacagcttgcaccgaaagaagctccagctcgccttgcaggccctcgggagcgaggaagaaaccaatcacggtaagctggattttaattgggttacgcgctggctcgacgatatcggcctcccgcaatacaaaacccaatttgatgagggccgagtagacggacgtatgctccattatatgactgtcgatgacctcctgagtctgaaggtggtaagcgtgttgcaccacctgtccatcaaacgcgctattcaggtgctcaggattaacaatttcgagcctaactgtctgaggcggcggccctccgacgagaacacaattgccccaagcgaagtgcagaagtggactaatcaccgggtcatggagtggctgcggagcgtcgaccttgcggaatacgccccaaacctgcgggggagcggcgttcacgggggcttaatggtcctggaaccaagatttaatgtggaaaccatggcccagctgctgaatatccctccaaataaaactcttttacggcggcacttagctactcatttcaacctgctgatcggtgccgaggcccagcaccagaagcgggatgctatggagttacctgattatgtgttgctgactgctactgccaaggtgaagccgaaaaaactcgctttttccaacttcggaaatctgagaaaaaagaaacaagaagacggggaggaatacgtgtgcccaatggaactggggcaggcttccggaagtgcaagcaaaaaggggttcaagcccggtcttgacatgcgattgtatgaggaggacgaccttgacagattggagcagatggaggactctgaaggcacggtccggcagatcggcgcattcagcgagggcatcaacaatctgactcacatgttgaaagaggacgacatgttcaaggactttgctgcccgctctcctagtgcctccattacagacgaagacagcaatgtctag

SEQ ID NO: 182211 - DNA, 495 bp, Artificial Sequence
  Description of Artificial Sequence: Synthetic coding sequence
atgagcagcgagaactgcttcgtggccgagaacagcagcctgcacccagaaagcgggcaggaaaacgatgccacgtctccacactttagcactagacacgagggaagttttcaggtgccagtgctttgcgcagtgatgaatgtcgtgtttattacaatactgattatcgcattgattgccctgagtgtcggtcagtacaattgtcccggccaatatactttctctatgccctctgatagccacgtttcatcctgctcagaagattgggtggggtatcagcgcaagtgttattttatttcaacagttaaaagaagttggacctctgctcaaaatgcctgttcggagcacggcgctacactggcggtgatcgattcagagaaagatatgaactttttgaagcgctacgctgggcgggaagagcactgggtcggcctgaagaaagagcccggtcacccctggaagtggagcaacggcaaggaattcaacaattggtag

SEQ ID NO: 182212 - DNA, 723 bp, Artificial Sequence
  Description of Artificial Sequence: Synthetic coding sequence
atggccggccccccccggctgctgctgctgcccctgctgctggccctggcccgcggattaccaggagcactcgcagctcaggaagttcaacaatcacctcactgtaccacagtccccgtaggggccagcgttaacatcacttgttctacgtccggtggcctcagaggaatttatttacggcagcttggacctcaaccccaggatattatttattatgaggacggcgtagtgcctaccacggaccgccgattcagagggcgcattgactttagcggcagccaggataacctaaccattaccatgcataggcttcagctgtccgatacgggaacttacacgtgtcaggccataaccgaagtgaatgtttacgggtccggaaccttggtgctggtcaccgaggagcagtcacagggatggcatcgctgctccgatgcaccgccacgagcctctgctctcccggctccacccactggcagtgcccttcccgacccccagaccgccagtgcgctgccggacccccctgcagcttccgctcttcctgccgctctggctgtcatttcattcctattgggcctgggtctgggcgtagcgtgtgtgctggcacgtacacagattaaaaagctgtgttcttggcgggacaaaaattctgcggcttgcgtggtgtatgaggatatgtctcatagccgttgtaatacactgtcttctcccaaccaatatcagtag

SEQ ID NO: 182213 - DNA, 1080 bp, Artificial Sequence
  Description of Artificial Sequence: Synthetic coding sequence
atggccgaggccatcacctacgccgacctgcggttcgtgaaggccccccttaagaaatctatctccagccggttagggcaggacccgggagccgacgatgacggcgagattacatacgagaatgtacaggtgcccgccgtcctcggagtcccgagttctcttgccagtagtgtgctcggcgacaaggcagccgttaaatccgaacaacccaccgcatcctggcgggctgtcacttcccccgccgtgggacgcatcctgccctgcaggactacgtgtttgaggtacctgttgcttggacttctcctgacctgtctattacttggcgtgactgcgatttgtctgggcgtccgttatttgcaggtttcccagcagctgcaacagaccaacagggtcctggaggtaaccaacagcagtctgcggcagcaactgcggttgaagatcacgcaacttggccagtcagctgaggacctgcagggcagcagaagggagttggctcaaagccaggaagcattgcaggtggagcaacgagcacaccaggcagcagaaggtcagctgcaagcttgtcaggccgaccggcagaagacaaaggagactcttcagagtgaggagcagcaacgcagagctcttgagcagaagctgtccaacatggaaaatagactgaaaccattttttacatgcggctccgccgacacatgttgcccaagcggatggatcatgcaccaaaaaagttgtttttatatctcactcacaagcaagaactggcaggaaagtcagaagcagtgcgaaacgctgagcagtaagctcgcaacttttagcgagatctaccctcagtcccacagctattattttttgaacagccttttaccaaatggaggcagcggcaattcttactggactggactgtcctcaaataaggattggaaacttacagatgatacacagcgtacgcgcacctatgcacagtcatcaaagtgcaataaggtgcataagacgtggtcatggtggacattggaatccgagagctgtcgatcctctctgccctacatttgtgaaatgaccgctttccgattccctgattag

SEQ ID NO: 182214 - DNA, 363 bp, Artificial Sequence
  Description of Artificial Sequence: Synthetic coding sequence
atggccgaggccatcacctacgccgacctgcggttcgtgaaggccccgttgaagaagagtatctcctctcgcctaggccaggacccaggggccgacgatgatggcgagatcacctatgaaaacgtgcaggtgccagctgttttgggcgtccccagtagcctcgcctcttctgtgctgggagacaaagcggccgtgaagtctgaacagcccacagcgagttggagggccgtgacctctcccgctgtggggagaatactcccttgtgagtgtgcatgcgccggccagccaaggggccaagttcttgcaccagtacccgctgccgatggagctggaccgaggggagtgcagttgctgcccgggtag

SEQ ID NO: 182215 - DNA, 360 bp, Artificial Sequence
  Description of Artificial Sequence: Synthetic coding sequence
atggccgaggccatcacctacgccgacctgcggttcgtgaaggccccgctcaagaagagcatttcaagccgacttggacaggacccgggggctgacgatgatggggaaattacctatgagaatgttcaagtacccgctgtgctgggcgtgcctagctctcttgcaagctcagtgctgggtgataaagccgcagtgaagtcggagcagcctaccgccagctggcgcgcggttacgtccccagcagtaggccgcatcctgccttgtaggacgacatgccttcgctacctgttgttgggtctgctcctgacatgcttgctgctgggcgtcactgctatttgcctgggggttaggtgtgaatag

SEQ ID NO: 182216 - DNA, 1080 bp, Artificial Sequence
  Description of Artificial Sequence: Synthetic coding sequence
atggccgaggccatcacctacgccgacctgcggttcgtgaaggccccactcaagaaatccatctcctcacgactcggacaggaccctggcgctgacgatgacggggaaatcacatacgagaacgtgcaggtgccagcagttctaggtgtgcccagctccctggcttctagcgtgttgggcgataaagccgcggtgaagagcgaacagcccactgcctcttggcgggcagtcacgagtcctgcagtggggcgtatcctgccttgtcgcactacctgcctaagatatctgctgttggggttgctccttacttgcctgctgctaggggttacagccatatgcctcggagttaggtaccttcaggtttcgcagcaactgcaacagacgaatcgcgttctcgaagtcaccaactcatccctccggcagcagctgcggctcaagatcacacagttgggccagtccgccgaggacctccagggctcacgaagagaactcgctcaaagccaagaagctctccaggtggaacagcgagcccatcaagccgctgaggggcagctgcaagcctgtcaggctgacagacaaaagacgaaagagaccctgcaaagcgaagagcagcagcggagagccctcgaacagaagctttccaatatggagaaccgcctgaagccttttttcacgtgcggcagtgccgacacatgctgtccctccggatggatcatgcaccagaaaagctgtttctacattagcttgacctcaaagaattggcaggaaagtcaaaagcagtgtgagacacttagcagcaagctggcaactttttccgagatctatcctcagtcgcattcctactatttcctgaactcattgttgcctaatgggggatcaggcaatagctactggaccgggctgtcatccaataaggactggaagctgacagatgatactcagcgaactcgtacctacgctcagtccagcaaatgcaataaagtccataaaacgtggtcttggtggaccctagaatcagagtcatgtaggtcgtcactgccttacatatgtgaaatgacagctttccgcttccctgattag

SEQ ID NO: 182217 - DNA, 1080 bp, Artificial Sequence
  Description of Artificial Sequence: Synthetic coding sequence
atgcagacccggaacccccagagccacggcgagaacggcgccagcccttggtcatggggggatagactgggacctggacccgatcctggggcggacgacgacggagaaattacttacgaaaacgtccaagtccccgccgtgctgggcgtccccagcagccttgcatcttccgtgctgggcgacaaggccgctgtcaagagcgagcagcctacagctagctggagagcggtgactagccccgcagtgggaagaatacttccttgtcgcacaacatgcttacgctacttgctgctgggtttactgttgacttgtctgctgctgggagtcaccgctatatgtctgggagtgaggtacttgcaggtttctcagcaactccagcagaccaaccgcgtgctggaggtgacaaactcatcgctacgacagcagctgcgtctgaaaatcactcagctgggacagagtgctgaggacttgcagggctccagaagggaactggcccagagtcaggaagccctccaggttgaacagcgagcacaccaggctgctgaaggccagttacaggcctgccaggctgacaggcaaaagaccaaagagaccctgcagtctgaagagcagcaacgcagggcgctggagcagaaactgagcaatatggagaaccggctcaagccattctttacatgcggcagtgctgatacttgttgccccagtgggtggatcatgcatcagaagagttgtttttatatctctctcacaagcaaaaattggcaggagtcacagaagcaatgcgagaccctcagttccaaactggctaccttctccgaaatctacccacaatcccactcctactacttcttaaacagtcttctgcctaatggggggagcggaaactcttattggactggcctcagcagtaacaaggattggaaactgactgacgatactcagcgcacccgtacttacgcccaaagctctaaatgtaataaagtccataaaacttggagctggtggacccttgaaagtgagtcctgtcggagtagcctgccgtacatctgcgagatgacggcctttcgtttccccgattag

SEQ ID NO: 182218 - DNA, 891 bp, Artificial Sequence
  Description of Artificial Sequence: Synthetic coding sequence
atgcaccggcggcggagccggagctgccgggaggaccagaagcccgtaatggatgaccagagggatctaatctccaacaacgaacagttacccatgctgggcagaaggcctggggccccagagagcaaatgcagccggggagcgctgtatacagggttctccatcctcgtcacccttctcctggccgggcaggccaccacagcttactttttgtaccaacagcaaggcagacttgacaagctgacagtcacatcacagaacctccagttggagaacctccgcatgaagctgccaaaaccaccaaaacctgtcagcaagatgcgcatggccacacctttactgatgcaggctctcccgatgggagccttgccgcagggacccatgcagaatgcgaccaaatatggaaacatgaccgaggatcacgtcatgcacctcctccagaatgccgaccccctcaaggtgtatccccccctgaaaggcagttttccagaaaaccttcggcatctgaaaaataccatggaaacgattgattggaaggtgtttgaatcatggatgcatcactggctgctgttcgaaatgtctcgccactctcttgaacagaagcccacggatgctcctccaaaagtcctaacgaagtgccaagaggaagtgagccatatccccgcagtccaccccggatcgtttaggcccaaatgcgacgaaaacggcaattatctccccctgcagtgttatggaagcattgggtactgttggtgtgtgttcccaaatggcacggaggttcctaatactagatcaagggggcaccacaattgctccgagagcctggagctcgaggatccctctagtggactcggagttacaaaacaagatctcggccctgttcctatgtag

SEQ ID NO: 182219 - DNA, 699 bp, Artificial Sequence
  Description of Artificial Sequence: Synthetic coding sequence
atgcaccggcggcggagccggagctgccgggaggaccagaagcccgttatggacgaccagcgcgacttgatttccaacaacgagcagcttcctatgttaggcaggcgcccaggagctcccgagtcaaaatgctcacgtggtgccttgtacacagggtttagcatcctcgtgactctactactggcaggacaggccaccaccgcctactttctctatcagcagcagggcaggctggataaactgaccgtcacctctcagaatcttcagcttgagaaccttagaatgaagctgcccaagccacctaagcccgttagtaaaatgagaatggcaaccccacttctaatgcaggccctgcccatgggggccctcccccagggacctatgcaaaatgcaacgaaatacggcaacatgacggaggatcacgtaatgcatcttttacaaaatgcggatcctttaaaagtctacccgcccttaaaagggagtttcccagagaatctgaggcaccttaagaatacaatggaaacgatcgattggaaagtgttcgagagttggatgcaccactggttactgtttgagatgtccaggcactccctggagcagaagcctaccgacgcccctccgaaggaatccctggagctggaagacccttcttcaggtctcggcgtgacaaagcaggatttggggcccgtgcccatgtag

SEQ ID NO: 182220 - DNA, 483 bp, Artificial Sequence
  Description of Artificial Sequence: Synthetic coding sequence
atgcaccggcggcggagccggagctgccgggaggaccagaagcccgtgatggacgaccaaagagacctcatctccaataatgagcagctgcctatgctgggccggcgccctggtgcaccagagtcaaagtgtagtagaggtgcattgtacacaggttttagtattctggttactctgctcttggccggccaagctactacggcatattttttataccagcagcagggcaggctggacaagctgaccgtcacatcacagaacttacagcttgaaaacctcaggatgaaactaccgaaacctccgaagccggttagcaagatgagaatggctaccccccttctcatgcaagcgttgcctatgggagccctccctcaggggcctatgcagaacgcgacaaaatacggaaacatgaccgaggatcacgtcatgcacctcctgcagtcccactggaactggagaacaagactcctcggctgggtgtag

SEQ ID NO: 182221 - DNA, 951 bp, Artificial Sequence
  Description of Artificial Sequence: Synthetic coding sequence
tgacggagctgccgggaggaccagaagcccgtgatggacgaccagcgagacctgatcagcaataatgaacagctgccaatgctgggccggcgccctggggcacccgaatcaaagtgttctcgtggagccctttacacaggcttctctattctcgtcacccttctccttgccggtcaggccactacggcatatttcctctatcagcagcagggcaggcttgataagcttacggtgacatcacagaatttacagctggaaaatctgcgcatgaaactccctaagccgccaaagccagtttctaagatgaggatggccacgccgctccttatgcaggcactccccatgggggctcttccgcagggacccatgcagaatgcaacgaagtacggtaacatgacggaggatcatgtcatgcatttgctgcagaacgcagaccctctcaaagtctacccacccttaaagggctccttccccgagaatcttcgccacctgaagaacaccatggagacaatcgactggaaggtgttcgagagttggatgcatcactggctcctctttgaaatgtctaggcatagtcttgagcagaagcccactgacgctcccccaaaagtactaaccaaatgtcaagaagaggtttcacacatacccgccgtccacccaggctcctttagaccaaaatgcgacgagaacggcaattacctcccactgcagtgctatggtagtataggatactgttggtgtgtgttccccaatggaaccgaagtgcctaatactagatctaggggccaccacaattgtagcgagtctttagagctcgaggatccatcctcaggactgggtgtgacaaaacaggacctggggcctggcaaggggcttgcagaaggtcacctcgtgacaagtagtagcagtccagccgggcctgctccactctgggctggggagggcgtttag

SEQ ID NO: 182222 - DNA, 369 bp, Artificial Sequence
  Description of Artificial Sequence: Synthetic coding sequence
atgcaccggcggcggagccggagctgccgggaggaccagaagcccgtgatggatgatcagcgagacctcatttcgaacaacgagcagctgcccatgcttggacgccgcccaggcgctccggagtccaagtgctcgcgcggtgcactctacacgggatttagcatcctggtgacattattgctcgcgggacaagcgacaaccgcctactttctctaccagcagcagggcaggttggataagttaaccgtgacctctcaaaacctacagttagagaacctgagaatgaagctccctaagccacacgcagaatgccatcaggtctggcagcacgatcggggtccatgtgatgcccctgctcctgaatgttag

SEQ ID NO: 182223 - DNA, 459 bp, Artificial Sequence
  Description of Artificial Sequence: Synthetic coding sequence
atgcaccggcggcggagccggagctgccgggaggaccagaagcccgtgatggacgaccagcgggatctcatctccaataacgaacaactgcccatgttgggccgccgcccaggcgcaccggagtcaaagtgtagtcggggggccctgtacaccggcttttctatcctagtgacactcctgctcgccggccaagccactactgcctacttcctgtaccagcagcaagggaggctggataagctcactgttaccagtcaaaacctgcaacttgaaaacctgcgtatgaagttgcccaaacccccaaagcccgtgagcaagatgaggatggccactccactgctcatgcaggcactcccgatgggggccctcccacagggacccatgcagaatgcgactaagtacggtaacatgacagaggatcatgtgatgcacttgcttcaggaggttgctaagtcatag

SEQ ID NO: 182224 - DNA, 690 bp, Artificial Sequence
  Description of Artificial Sequence: Synthetic coding sequence
atggcccggctggccctgagccccgtgcccagccactggatggtggcgcttctcctccttctgtccgccgaacctgtacccgcggcgcgttccgaggaccgttatcggaatcccaaagggagcgcttgtagtagaatctggcaatctccgcgctttatagcccgaaagagagggtttactgttaaaatgcactgttatatgaatagcgcctccggcaatgtaagctggttgtggaagcaagagatggacgagaatccccagcagctgaaactcgaaaaagggcggatggaagagagccagaatgaatccctggcaaccttaactatacaaggaatcaggttcgaggataatggtatttatttctgtcagcagaagtgcaacaacacatctgaagtctatcaaggctgtggcaccgaattgcgcgtgatggggtttagtacactggcccagctgaagcaaagaaacacccttaaggacggaattatcatgattcagaccctgctcatcatcctgtttattattgtccccatctttctccttctcgataaagacgattccaaggccggcatggaggaggaccatacatacgaaggcctggatattgatcagacagctacttacgaagacatcgtgactctccgaaccggcgaagtgaagtggagtgtgggggagcatccaggtcaggagtag

SEQ ID NO: 182225 - DNA, 378 bp, Artificial Sequence
  Description of Artificial Sequence: Synthetic coding sequence
atggcccggctggccctgagccccgtgcccagccactggatggtggccctgctgctgctgctgagtgccgagccagttccagctgcacgcagtgaggaccgctaccgaaatccaaagggatttagcaccctggcccagctgaagcaacggaatacactgaaagacggtatcatcatgatccaaactcttcttattatactctttatcattgtgccaatcttcctcctcctcgacaaggacgattctaaggcgggcatggaagaggaccatacttatgaaggcctggacatcgatcagacagcaacgtacgaggacatagtgactctccgaacgggtgaggtcaagtggtcggttggagagcatcccgggcaggaatag

SEQ ID NO: 182226 - DNA, 693 bp, Artificial Sequence
  Description of Artificial Sequence: Synthetic coding sequence
atggcccggctggccctgagccccgtgcccagccactggatggtggcgttgttgcttcttctgtccgccgctgaacccgtccctgcagccaggtcagaagatcggtatagaaacccaaagggttcagcttgctcgcgaatctggcagagcccacgcttcatcgctagaaaaagaggcttcacagtgaagatgcactgctacatgaactccgcctccgggaacgtctcctggctatggaaacaggagatggatgagaatccgcagcagctcaaactcgagaagggaaggatggaagaatcccagaacgagtctctcgctaccctgacaattcagggaattcgcttcgaggataatggcatatacttctgccagcagaagtgcaataatacaagcgaagtgtaccagggctgcggaacagagttaagagtgatgggattttcaacgttagcccagcttaaacagcggaataccctaaaggacggcataataatgattcagacactcctgatcatcctcttcatcatcgtgccgatcttccttctactggacaaggatgatagcaaagcgggtatggaggaggaccacacatacgagggactggacatcgatcaaaccgccacttacgaggacatagtgaccctgcgtaccggcgaagtcaaatggagcgttggggaacacccagggcaggagtag

SEQ ID NO: 182227 - DNA, 711 bp, Artificial Sequence
  Description of Artificial Sequence: Synthetic coding sequence
atgggcgtggagggctgcaccaagtgcatcaagtacctgctgttcgtattcaatttcgtattctggctagctggcggggtgattctaggtgtggccctttggctcagacacgatcctcaaaccacaaacctactgtatctagaactgggtgataagcccgctcctaacaccttttatgtaggcatctacattctcattgccgtgggtgcagtgatgatgtttgtgggcttcctcggctgttacggtgccatccaggagtcacagtgtctcttggggaccttcttcacatgcctggtgattctcttcgcatgtgaagtggccgcgggaatttggggtttcgtaaataaagaccagattgcaaaggacgtgaaacagttctacgatcaagcccttcagcaggccgtggtagacgatgatgcaaataacgcaaaggccgttgtgaaaacctttcacgagacactggattgttgtggcagcagtacattgaccgccttgacaacaagcgtccttaaaaacaatctgtgcccctcaggatcgaacatcatttcaaacctgtttaaggaagactgtcatcagaaaattgacgatctcttttccgggaaactgtatctgatcgggatagctgccatagtagtggctgtgattatgatttttgagatgattctcagtatggtgctgtgctgtggcattcgcaatagctctgtgtactag

SEQ ID NO: 182228 - DNA, 618 bp, Artificial Sequence
  Description of Artificial Sequence: Synthetic coding sequence
atgagccggggcctgcagctgctgctgctgagctgcgcctacagcctcgcacccgcgactccagaagtcaaagtcgcttgctcagaagacgtcgatctgccgtgcacggcaccatgggacccacaggttccttataccgtttcttgggtgaaactccttgaaggtggggaagaacgtatggaaaccccccaagaagaccacctgcgaggacagcactatcatcagaaagggcagaatggctcattcgatgcacccaatgaaagaccttatagcctgaagattcgaaacacaacaagttgcaattccgggacatatcggtgtactctgcaggaccctgacggccagagaaatctgtccggcaaagtgattctgcgggtgactgggtgcccagcccagcgcaaagaagagacgtttaagaagtacagagccgaaatcgttctgctcctcgctcttgtgatcttctacctgactctgattatttttacttgcaagttcgcccgacttcaaagcatattcccagacttcagcaaggcaggcatggaacgggccttcctacctgtgaccagccctaataagcaccttggactggtcactccccacaagacggagctggtgtag

SEQ ID NO: 182229 - DNA, 351 bp, Artificial Sequence
  Description of Artificial Sequence: Synthetic coding sequence
atggacccccagtgcaccatgggcctgagcaacatcctgttcgtgatggcttttctgttgagtgaattggaggatcctcagccccctccagaccacatcccatggatcaccgcagtgctgccaacagtcattatatgtgtcatggtgttctgtctgattctgtggaaatggaagaagaaaaaacggccaaggaattcctacaagtgcggaaccaatacaatggaaagggaagagtccgaacaaacaaaaaaaagggagaaaatacatattcctgaacgctccgacgaggcccaaagagtattcaaatcatccaaaacatctagttgcgataaaagcgacacttgcttttag

SEQ ID NO: 182230 - DNA, 990 bp, Artificial Sequence
  Description of Artificial Sequence: Synthetic coding sequence
atggacccccagtgcaccatgggcctgagcaacatcctgttcgtgatggctttcttactcagtggagcggcccccctcaagatccaggcctactttaacgagactgccgacctaccttgccagtttgccaattcccagaatcagtccctctccgagttggtggtgttttggcaggaccaggaaaatctcgtgcttaacgaggtttatctgggtaaagagaagttcgactccgtccatagcaagtacatgggcaggacctctttcgactcagatagctggactcttcgcctacataatttgcaaattaaggacaaggggctctaccaatgtatcattcaccataaaaaacctactggtatgatacgcattcaccagatgaacagcgaactctctgttctggctaatttcagccagccggagatcgtgccaatatcaaatattaccgaaaacgtctacattaacttaacctgcagcagtatccacggataccctgaacctaagaagatgagcgtcctcttacgtaccaagaattctaccatcgaatacgatggagtcatgcaaaaatcacaggataacgtgactgagctttacgacgtgagtatatcactcagtgtctcctttccagatgtgacctcgaatatgaccatattctgcatcttggaaacagacaagacacgcttgctatcgagcccttttagcattgagttggaagatccccagccccctccagaccatatcccctggatcaccgccgttctgcctaccgtaattatttgtgtgatggtattctgcctcatcctctggaagtggaaaaagaagaaaagaccaaggaatagctataagtgtgggaccaacacaatggagagagaagaatcagagcagacgaaaaaaagggaaaagattcacattccagagagatcagatgaggcccaaagagttttcaagtcaagtaaaactagcagctgcgacaagagcgatacctgcttttag

SEQ ID NO: 182231 - DNA, 972 bp, Artificial Sequence
  Description of Artificial Sequence: Synthetic coding sequence
atgggcctgagcaacatcctgttcgtgatggccttcctgctgagcggcgcagcacccttaaagattcaggcctattttaacgagactgccgatctgccctgtcagttcgcaaattcccagaatcaatctctctctgagcttgtggtgttttggcaagaccaggaaaacctggtcctcaatgaagtatatctgggaaaggagaaattcgatagtgtccatagtaaatatatggggaggacttctttcgattctgattcctggactctcagactgcataatttgcaaatcaaagacaaagggctgtaccagtgtatcattcaccataaaaagcccactggaatgattcgcattcaccaaatgaactcggagttgtccgtgttagccaatttctctcagccagagatcgtcccaatcagcaacattaccgaaaacgtctatataaatcttacttgcagttctatccacggctaccccgagccaaaaaaaatgtccgtgctccttcgtacaaaaaacagtactatagagtatgacggtgtgatgcagaagagccaggataacgttactgagctgtacgacgtgagcatctcgctgagtgtatcattccctgacgtcacctcaaatatgacaattttctgcatcctggaaacagataagaccaggctcttgtcctcaccctttagcattgaactggaggatccacagccacctccagaccatataccgtggattaccgcagttttgccaaccgtgattatctgtgtcatggtgttctgcttgattctatggaagtggaagaaaaaaaagcgcccaaggaattcatacaaatgtggcacaaatactatggagcgagaagagagcgagcagaccaagaaacgcgaaaaaatacacatccccgaacggtccgacgaggcacagagggtctttaaatcctctaagacaagctcgtgtgataagtccgatacttgtttctag

SEQ ID NO: 182232 - DNA, 504 bp, Artificial Sequence
  Description of Artificial Sequence: Synthetic coding sequence
atgggcctgagcaacatcctgttcgtgatggccttcctgctgagcggagccgctccactcaagattcaggcctactttaacgagaccgccgatctgccttgccagttcgccaatagtcaaaatcagtcgttaagcgaactggtcgtgttttggcaagatcaagagaatcttgtgttgaatgaggtctatctcggaaaagagaaatttgattccgtccactctaaatacatgggccgcactagttttgatagcgattcttggacgctacggctgcataacctacagatcaaagacaagggactctaccagtgtatcatccatcacaaaaagccgacaggtatgatccggatccatcaaatgaatagcgagctgtccgtgctggctaacttctctcagcccgagatcgtgccgattagtaatatcaccgagaacgtatacatcaatctgacatgcagttcaatccacggctatccagagcctaagaaaatgagtgtccttttgtag

SEQ ID NO: 182233 - DNA, 744 bp, Artificial Sequence
  Description of Artificial Sequence: Synthetic coding sequence
atgggccggaccagcttcgacagcgacagctggaccctgcggctgcacaaccttcagattaaggacaagggactataccagtgtatcattcatcataaaaaacccaccggtatgattcgaatccaccaaatgaatagcgagctgagtgtactggccaactttagccaacccgagattgtaccaatttctaatatcactgagaacgtgtatattaacctcacttgcagcagcattcatgggtaccccgagcccaaaaaaatgagcgtcctattgaggaccaagaacagcaccattgaatatgacggtgtcatgcagaagagtcaagacaatgtgactgaactctatgacgtgagcatttctctgtcagtatccttccccgacgttaccagcaacatgacaatattctgcatcctggagaccgacaagactcgcctgttatctagccctttttccatcgaattggaggatccacaacctcccccagatcacataccctggataacagctgtgttgcccacggtgattatctgtgttatggtcttttgtttgatactgtggaagtggaagaagaagaagcggccaaggaatagttataaatgtggcacaaacacaatggagagggaggaaagcgagcagacaaagaaacgggagaagatccatatccccgaacgctccgatgaggcccagcgggtgttcaaatcaagcaagactagtagctgcgacaaatctgatacatgcttttag

SEQ ID NO: 182234 - DNA, 654 bp, Artificial Sequence
  Description of Artificial Sequence: Synthetic coding sequence
atggacccccagtgcaccatgggcctgagcaacatcctgttcgtgatggccttcctgctctcagccaatttctcacagcctgaaatcgttcctatcagcaatataacggagaatgtctacataaacctgacttgcagctcgattcacggttaccctgagccaaaaaagatgtcagtcctgctacggacaaaaaacagcacgattgagtatgatggcgtgatgcagaagagccaggataatgtaaccgaactgtacgacgtctcgatttcgttatccgtctccttcccagacgtgacttccaatatgacaatcttctgtatcctcgagactgataagacgcggttattgagctcacctttcagcatcgagttggaagatccccagcccccccccgatcacattccctggatcaccgccgtgctgcccacggtgatcatatgcgtgatggtgttttgcctgattttgtggaaatggaagaaaaaaaaacgcccccggaactcttataagtgtggcacaaacacgatggagagggaagagtccgaacagacgaagaagcgcgaaaaaattcacattccggagaggtctgatgaggcgcagagagtgtttaaatcttctaagaccagttcatgtgacaagtccgacacatgtttctag

SEQ ID NO: 182235 - DNA, 732 bp, Artificial Sequence
  Description of Artificial Sequence: Synthetic coding sequence
atgcggccccggctgtggctgctgctggccgcccagctgaccgtgctgcatggcaacagcgtgcttcagcagaccccggcctatatcaaagtgcagaccaataagatggtgatgctgtcatgtgaggccaaaatttctctgtcaaatatgcggatctattggcttaggcagcggcaagcacctagctccgattcacaccatgagtttttggctctttgggactctgcaaaggggacaatccacggcgaggaagtcgagcaggaaaaaatagctgtcttccgtgatgcgtcccggtttatcctgaacttgacttcagtcaaacctgaggactctgggatttacttctgtatgattgttgggagtccggagttaacattcggaaaaggcacccaactgagcgtggtggacttcctgccaaccacagctcagcctacgaagaagagcacactgaaaaaacgagtatgccggcttccacgcccagagacccaaaaggggccattatgctcgcccataacactcggactgctggtagccggtgtattggtgctgctcgtgagtctaggcgtggctatacatttgtgttgtaggaggaggcgcgcccgtctaagattcatgaagcaaccccagggggagggaataagcgggaccttcgtgcctcagtgtctgcacgggtattacagcaataccacaacctcacagaagctgctcaatccctggatactgaagacgtag

SEQ ID NO: 182236 - DNA, 642 bp, Artificial Sequence
  Description of Artificial Sequence: Synthetic coding sequence
atgcggccccggctgtggctgctgctggccgcccagctgaccgtgctccacggcaattccgtgctgcaacagactcctgcatacatcaaagtgcagaccaacaagatggtcatgctgtcatgcgaggccaaaatctctctctcaaatatgagaatttattggctgcggcagcgacaggcaccctcctcggattcgcaccatgaatttctcgcactttgggactccgccaagggcacgatacacggtgaggaagtcgaacaggaaaagatcgctgtcttccgggatgcatcgcgcttcatcttgaacctgacctctgtgaagcctgaggactctggaatttatttctgcatgattgtgggcagccccgagctgacgttcggaaagggtacgcagctctctgtcgttgactttctgcccacaaccgcccagcctaccaagaagtcaactctcaagaagcgtgtttgcagacttccacggcctgaaacccagaaaggaaggcggcggagggctagactgagatttatgaagcaacctcagggagaaggaatctcagggaccttcgtcccacagtgtcttcatgggtactacagtaacactaccacgtcccaaaaactactgaacccctggatcctgaagacctag

SEQ ID NO: 182237 - DNA, 633 bp, Artificial Sequence
  Description of Artificial Sequence: Synthetic coding sequence
atgcggccccggctgtggctgctgctggccgcccagctgaccgtgctccacggaaactcggtcttgcagcaaacacccgcctacattaaagtgcaaaccaacaaaatggtcatgctctcgtgcgaggctaaaatctctctgagcaacatgcgcatttactggctgcgccagcggcaggccccaagttccgatagtcaccacgaatttctagccctctgggattctgcaaaagggactatccacggagaagaagtcgaacaggagaaaattgctgtcttcagagatgcttccagatttattctcaatctgacctcggtgaagccagaagacagtgggatctacttctgcatgatcgtgggatctcccgagttgactttcgggaaagggacccagctgagcgttgtggacttcctgccaactaccgcccagcccactaagaagagtaccctcaaaaaacgcgtttgcagactccctcggccagagactcagaagggcccgctgtgtagccctatcactctgggtctgctagtggctggggtattggtgcttctagtaagcctcggcgtggctattcacctgtgttgtaggaggcgtcgggctaggcttaggtttatgaagcaattctacaaatag

SEQ ID NO: 182238 - DNA, 666 bp, Artificial Sequence
  Description of Artificial Sequence: Synthetic coding sequence
atgcggccccggctgtggctgctgctggccgcccagctgaccgtgttacacggcaattcggttttgcaacaaactccagcgtatattaaggtgcagacaaataaaatggttatgctcagctgtgaagcaaagattagcctgtccaatatgaggatttattggctgcgccagagacaagcaccgtccagtgattcccaccacgaattcctcgcactatgggattcagctaagggtacgattcatggcgaggaggtggagcaagagaagatcgcggttttccgtgacgcttcaagatttatcctcaatctgaccagcgtgaagcccgaggacagcggcatctacttctgcatgatcgtgggctctccggaattgacattcgggaagggtacgcaactcagtgtggtggactttctcccaacaaccgctcagcccacgaagaagtccacactgaagaagagagtctgtcggttaccccggcccgagacacagaaagggccgctgtgtagccccattacacttggtctcctggtggcgggcgtgttggtgctgcttgtgagtttgggagtggcaatacatctctgttgtcggcgtaggcgggctaggctgcggtttatgaaacagttgcggctgcaccctctcgagaaatgctcaagaatggactattag

SEQ ID NO: 182239 - DNA, 597 bp, Artificial Sequence
  Description of Artificial Sequence: Synthetic coding sequence
atgcggccccggctgtggctgctgctggccgcccagctgaccgtgttgcatgggaactcggtgctgcaacagacccccgcatatatcaaagtgcagacaaataaaatggtaatgttatcttgcgaggccaagatctctctgagcaacatgcgcatctactggctacggcaacgccaggccccctcatctgactcgcaccatgagttcctcgcactgtgggactctgctaaaggaactatccacggggaagaggtcgaacaagagaagatcgccgtttttagggatgcttctaggtttatccttaatttaacatctgtgaagcccgaggattcaggtatctacttctgtatgatagtcggatcccctgaactgacattcggtaaaggaacacagctaagtgtagtggacttccttccaaccaccgcccaacccacaaaaaagtctactttgaagaagagggtttgccgcctgccacggccagagactcagaaggggctgaaagggaaggtgtaccaggaacctctaagcccaaacgcctgcatggacaccactgctatcttgcagccacatcgctcttgcctaacccacggtagttag

SEQ ID NO: 182240 - DNA, 93 bp, Artificial Sequence
  Description of Artificial Sequence: Synthetic coding sequence
atgcggccccggctgtggctgctgctggccgcccagctgaccggccgtcgccgacgggcgagactgcgcttcatgaaacaattatataagtag

SEQ ID NO: 182241 - DNA, 624 bp, Artificial Sequence
  Description of Artificial Sequence: Synthetic coding sequence
atgcggccccggctgtggctgctgctggccgcccagctgaccgtgttgcacggcaattccgtccttcagcaaactcctgcctatatcaaggtacagaccaataaaatggtcatgctaagctgcgaggctaaaatcagtctgtcgaacatgcgtatctactggctccgacagagacaagcaccttcatcagacagtcatcacgaattcctggccctctgggacagcgctaaaggtaccatacacggtgaggaagttgaacaggaaaagattgccgtctttcgtgatgcctcacgcttcattctaaatctaacaagtgtgaaaccagaggatagcggtatttatttttgcatgattgtgggaagccccgaactgacattcggtaagggaacacagttatcagtagtagattttcttcctaccactgctcagcctacgaagaagagtactctaaaaaagagagtgtgcaggctgccgcggccggaaacacagaaagggcccttgtgcagccctattacccttggcctcttggtcgccggtgtgctagttcttctggtaagcctgggcgtagctattcacctgtgctgcaggcgtcggcgtgcccgactgcggttcatgaaacagtag

SEQ ID NO: 182242 - DNA, 153 bp, Artificial Sequence
  Description of Artificial Sequence: Synthetic coding sequence
gagcggggccgggagcggcgggtgaagctgcggttcagcgcccggcctcaaggggaagggatcagcggcaccttcgtgccacaatgcctgcacggctattatagtaatacaaccacaagtcaaaagctgctgaatccgtggatcttaaaatag

SEQ ID NO: 182243 - DNA, 687 bp, Artificial Sequence
  Description of Artificial Sequence: Synthetic coding sequence
atgcccgtgaagggcggcaccaagtgcatcaagtacctgctgttcggcttcaactttattttttggctggccggaattgccgtgttggccatagggctgtggttacgtttcgattcacagacgaagtctatcttcgagcaggaaaccaacaacaacaactccagtttttacactggtgtatacattcttattggcgcaggtgcgctcatgatgctggtgggatttcttggatgttgtggcgcagtgcaggaatcccagtgcatgctcggcctgttcttcggcttcctgctggttattttcgcaatcgaaattgcggccgccatctggggctactctcataaggacgaggtgattaaggaggtgcaggaattttacaaggacacgtacaataagctgaagacaaaagacgagcctcagcgtgaaactttaaaagccatccattatgccttgaattgctgtggcctggcagggggagttgaacagtttatttccgacatttgtcctaaaaaggatgttttggagacctttacggtaaagagttgtcccgatgcaatcaaggaggtgttcgataataagttccacataattggagcggtcggaatcggaatcgcggtggtcatgatctttgggatgatctttagtatgattctgtgttgcgctattagacgtaacagggagatggtatag

SEQ ID NO: 182244 - DNA, 480 bp, Artificial Sequence
  Description of Artificial Sequence: Synthetic coding sequence
atgatgctggtgggcttcctgggctgctgcggcgccgtgcaggagtcccagtgcatgttgggcctgttttttggtttcctcctcgtgattttcgcaatagagatagccgctgccatctgggggtactcacacaaagacgaggttattaaagaagtccaggagttctataaagatacttataataagctgaagacaaaggacgagcctcaacgtgagaccctaaaggccatacattacgccctgaactgctgcggcctggccggtggtgtggagcaattcatctctgacatatgtcccaagaaagacgtgctggaaactttcacagtcaaatcctgccccgatgcgattaaggaagtgtttgacaacaagtttcacatcataggcgccgttgggataggcatagccgtggtgatgatctttgggatgattttttcgatgattctctgctgcgccatccgcaggaatcgagaaatggtgtag

SEQ ID NO: 182245 - DNA, 687 bp, Artificial Sequence
  Description of Artificial Sequence: Synthetic coding sequence
atgcccgtgaagggcggcaccaagtgcatcaagtacctgctgttcggcttcaactttatcttttggcttgctggcatcgcagtgttagccattggtctttggctgaggttcgatagtcagaccaagagcatttttgagcaggagaccaataataacaactcttcattttacaccggtgtctacatactcattggcgctggggccctgatgatgctagtggggttcctcggatgctgtggcgcagttcaggagtcccagtgtatgctcggactgttttttggcttccttttggtgattttcgccatcgagatcgctgcagctatctggggttattcccacaaagacgaggtcattaaagaggtccaggagttttataaagatacctacaacaagttgaaaactaaagacgagccccagcgcgaaactctgaaggccatacactatgccttgaattgttgcggactggcaggaggagtggagcagttcatctctgatatttgtccaaagaaggatgtactggagacctttacggtgaagtcttgcccggatgctatcaaggaggttttcgataataagttccatatcataggcgccgtgggtataggcatagctgttgtcatgatttttgggatgattttctccatgattctctgctgcgccatacggaggaaccgagaaatggtgtag

SEQ ID NO: 182246 - DNA, 687 bp, Artificial Sequence
  Description of Artificial Sequence: Synthetic coding sequence
atgcccgtgaagggcggcaccaagtgcatcaagtacctgctgttcgggttcaactttatcttctggctggctggcatcgcagtcttggcaatagggctctggctccgctttgatagtcagaccaagtccatttttgagcaggagacaaacaacaataactcaagcttttacaccggtgtgtacatcctgattggcgcaggggccttaatgatgttagtcgggtttctcggttgttgcggcgccgtgcaggagtcacagtgtatgcttggtctcgctactaagcgaactatgtttcctcccttcctggaggaccacgtatgtttctttagcttgaacccccaattctttggattcttgctagtgattttcgcgattgagatcgccgcagcgatttggggatacagtcacaaggacgaggtgatcaaggaagttcaggagttttataaggacacatacaacaagcttaaaacgaaggacgagccccagagggagaccctgaaggcaatacattacgctctgaactgttgcggcctggctgggggcgtcgaacagtttatctccgacatttgcccaaagaaagacgtcttagagacctttacggtgaagtcctgccccgacgcgatcaaggaggtgtttgacaacaaatttcatatcattggtgccgtgggaattgggattgctgtgtag

SEQ ID NO: 182247 - DNA, 546 bp, Artificial Sequence
  Description of Artificial Sequence: Synthetic coding sequence
atgcccgtgaagggcggcaccaagtgcatcaagtacctgctgttcggtttcaacttcatcttctggctggctggaatcgccgttttggcgataggactgtggctgaggttcgattcccagactaagagtatcttcgaacaggaaactaacaataacaatagttccttctacacgggcgtgtacatactgataggggctggtgccttaatgatgcttgttgggttccttggatgttgcggcgccgtgcaggaatcgcaatgtatgctgggactcttttttggcttcctgcttgtaatctttgccatcgaaattgcagccgcgatctgggggtattcccataaggatgaagtgatcaaggaagtgcaggagttctacaaagatacttataataagttgaagacaaaagacgaacctcagcgagaaactctgaaagctatccattatgctctcaacctttggtttggttggggcagaggcaccgtatacctccggcacctgcctcaagaaggacgcaccagaaacctgcatagagaggtcctgtcttag

SEQ ID NO: 182248 - DNA, 426 bp, Artificial Sequence
  Description of Artificial Sequence: Synthetic coding sequence
atgctgggcctgttcttcggcttcctgctggtgatcttcgccatcgaaatcgccgctgctatatggggatactcacacaaagatgaggtcatcaaggaagtgcaggagttttacaaggatacatataataagctcaaaactaaggacgaaccccagagggagaccctgaaggccattcattatgccctcaattgctgcggtcttgcaggaggtgtcgagcagtttatatcagatatttgtcctaaaaaggacgtgcttgaaacttttactgtgaaatcgtgtcccgacgcgatcaaggaggtgttcgataataagttccacataattggagccgtaggaatcggaatcgccgtagtgatgatttttggaatgatcttcagcatgatcttatgctgcgcgatcaggcggaatcgggaaatggtgtag

SEQ ID NO: 182249 - DNA, 1758 bp, Artificial Sequence
  Description of Artificial Sequence: Synthetic coding sequence
atggagaagaagtggaagtactgcgccgtgtactacatcatccagattcattttgttaagggcgtgtgggagaagactgtgaataccgaagagaatgtgtacgccacattaggctcagacgtcaacttgacctgccagacccagactgtgggcttttttgtgcagatgcaatggtctaaagttaccaacaagatcgatcttatcgctgtgtatcatccacagtacggcttctattgtgcatatggaagaccctgtgagagcctcgtgaccttcaccgaaacaccagaaaacggatcaaagtggacactccatctgagaaatatgtcttgtagtgtgagtggccggtacgaatgcatgctggttttatatcctgaggggattcaaacaaagatatacaacctgttaatccagacacatgtgacagcagacgaatggaatagcaatcacaccattgagatagaaatcaaccagaccttagagatcccttgttttcagaatagcagcagtaagatctcctcagagtttacgtatgcttggtcggtggagaacagtagtaccgattcttgggtgctgttgtctaaaggcattaaggaggacaacggcacacaggagacattaatcagtcagaaccatctgatctctaattcaacacttctgaaggaccgcgtgaaactcggtacagactacaggctccatctaagccctgtacaaatcttcgatgacggcaggaagttcagctgtcacataagagtcggtccgaacaaaatcctgaggtcttcaacgacagtgaaagtgtttgccaaaccggaaataccagtgattgtggagaataattctactgatgtgctggtggagagaagatttacatgtttactgaagaatgtcttccccaaggctaacattacttggttcattgacggcagtttcctccatgatgagaaggagggaatttatataacgaacgaggagcgtaagggcaaggacggtttcttggagcttaagtcagtcttgaccagggtacacagcaataaacctgcgcagagtgacaacctcaccatttggtgcatggctctctccccggtcccaggaaacaaggtatggaacatctctagcgagaagattacattcctgctgggatccgagattagctctacagacccacccctcagtgtcacagagtccaccctggacacacagccatcccccgcctcctcagtgtcgcctgccaggtatccggctactagctcagtcacacttgttgatgtgagcgctcttagaccaaacacaaccccacaacccagcaacagcagtatgactacgcgcgggttcaattacccctggacctcttccggcacagacaccaagaaatcggtgtccagaattccatcagaaacatatagctcatccccctctggcgctggctccactctgcatgacaacgtgttcactagtacagcccgggcgttcagcgaagtgccaacaaccgctaatggctcaaccaagacaaatcacgtgcacataactggaatcgtcgtgaacaagccaaaagatgggatgtcctggcctgtgatagttgcagctctattattctgctgcatgattctgttcggacttggggttcgcaagtggtgtcaataccaaaaagaaatcatggagagacctcctccattcaagcccccccccccgcccatcaagtacacctgcattcaagagccgaacgaatcggacttaccttaccacgagatggagacgctgtag

SEQ ID NO: 182250 - DNA, 1710 bp, Artificial Sequence
  Description of Artificial Sequence: Synthetic coding sequence
atggagaagaagtggaagtactgcgccgtgtactacatcatccagattcattttgttaagggtgtgtgggaaaagaccgtaaacactgaagagaacgtgtatgcgactttggggtcagatgtaaatctgacatgccagactcagactgttggcttcttcgttcagatgcagtggagcaaggtaaccaacaaaatcgacctgatagccgtctaccatcctcaatacggattctactgcgcttatggacgaccttgtgagtcgctggtcacctttacggaaacaccagaaaacggctctaagtggacgctgcatttgaggaacatgtcctgctctgtgagcggccgctatgaatgcatgctggtcctgtaccctgagggcatccagacaaaaatttataatctgctaattcaaacccacgtgaccgccgatgaatggaattctaaccataccatcgaaatagagattaatcaaactttggaaattccctgcttccagaactcctccagcaaaattagctccgaattcacgtacgcttggagtgtagaggacaacggaacgcaagagactcttattagccagaatcacttgatcagcaattctacattgctgaaggacagagtcaagcttggcaccgactacagacttcatttatccccagtgcagatttttgatgatgggcggaagtttagctgccacatcagggtaggaccaaacaagatacttcgcagttccacaaccgtgaaagtattcgccaagccagagattcccgtcatcgtggaaaataactctacagacgtcctcgtcgagcggcggtttacttgcttgctgaagaacgttttccccaaagctaacatcacatggtttatagatgggtctttcctgcatgatgagaaggaagggatctacatcactaatgaggaacggaaagggaaggatggatttctggagctcaagtcggtgttgacgagggtgcactccaataagcccgcccaatcagataacctgaccatctggtgcatggctctgagcccagtgcccggcaataaggtatggaacatttccagcgaaaagatcacatttctactgggcagtgagatttcttcaaccgacccccctctgtcagtgactgagtctacgctggatactcagcccagccccgccagtagcgtgagccctgcaaggtacccagccacgtcttccgttacgctggtggacgtctctgcccttagacctaacacaaccccacagcccagcaatagctcaatgaccacgcgcggatttaactacccctggaccagctcaggcacagataccaaaaagtccgttagccgaatacctagcgagacgtattcttcgtcaccatctggagcaggctccacacttcatgataacgtgttcacctccacggcccgcgcgttttccgaggtgcccacaacggctaacggaagcacaaaaacaaaccatgtacatattactggaattgtggttaacaagcccaaagacgggatgtcctggcccgtgatcgtcgccgcgctgcttttctgttgtatgatcctgttcggactcggcgtccgaaagtggtgccaataccagaaggaaatcatggaacgaccccctcctttcaagccccctccaccacctatcaagtatacatgcattcaggagccaaatgaatcagatctgccatatcacgaaatggagaccctgtag

SEQ ID NO: 182251 - DNA, 2508 bp, Artificial Sequence
  Description of Artificial Sequence: Synthetic coding sequence
atgggcggccgggtgttcctggccttctgcgtgtggctgaccctgccaggtgctgagacacaggattcaagaggttgcgctaggtggtgtccacagaactcttcatgcgtgaacgcgaccgcatgcagatgtaaccccggcttttccagcttcagtgaaatcataacaacacctacggagacttgcgatgatattaatgaatgtgctacacctagcaaagtgagctgcggaaaattcagtgactgttggaacacggagggatcatatgattgcgtgtgcagccccggatacgagcctgtctccggcgcaaaaacgtttaagaacgagtctgaaaacacctgtcaagacgtcgatgagtgccaacagaatccacgtctgtgtaaatcctacgggacatgcgtgaacacgctgggatcgtacacatgccaatgtctaccaggttttaagtttatcccagaggatcccaaggtgtgcaccgacgtgaacgagtgtaccagcgggcagaatccatgccactccagtactcactgtcttaataacgtgggatcctaccagtgtcgctgccgccccggctggcagcccattcccggctcacctaacggtcctaataataccgtgtgtgaagacgtggacgagtgttctagtggacagcatcagtgcgactctagtacagtttgcttcaacaccgtgggtagctattcttgccgctgtcgtccagggtggaaaccgagacatgggataccaaacaaccagaaggacactgtgtgcgaggatatgaccttttctacctggaccccgccccccggcgtgcattctcagacactgtcccgctttttcgataaggtgcaggacctgggaagagactctaagaccagctccgcagaagtgaccatccaaaacgtcatcaaactggttgacgagcttatggaagctcctggagacgtggaagccctggcgccccccgtacgacatcttatcgctacccaattgctcagtaatcttgaagatatcatgagaatcctggcgaaatctctccccaagggcccattcacgtacatctccccatccaacacagagttgacactgatgatccaggagaggggtgataagaatgtgacaatggggcagagttccgcccggatgaaactcaattgggctgttgctgccggggcggaggacccaggcccggcagtagccgggatcctgtcaatccagaatatgaccaccctgctagccaacgctagcctgaacctacactccaaaaaacaggctgagctggaggaaatatacgaaagttccattagaggcgtgcaacttcggcgcttgagcgccgtgaatagtatattcttgagccacaacaacactaaagagttgaacagtccaattttgttcgcattctctcacctggaaagcagtgacggagaggcaggcagagatccacccgctaaggatgtcatgcctggcccgcgccaagagctgctgtgtgcattctggaagagtgatagcgaccgtggcggccactgggcaaccgagggttgtcaggttctgggctctaagaatggatccacaacctgtcagtgttcacatctcagcagcttcgccatcctgatggcccactacgacgtggaggactggaagctgacgctgattaccagagtaggactcgctctatccctgttctgccttcttctctgtatcctcacgtttctgctggtgaggcctatacagggtagtcggacaactatccatctgcatttatgcatatgcctatttgtgggcagtactatctttctggccggaatcgaaaacgagggtggccaggtgggcttaaggtgccgactcgtggccggcttgctgcattattgtttcttggcagctttctgttggatgagtttagaagggctggagctctactttctggtggtgcgcgtgtttcaaggacaggggctttccacccgatggctgtgtctcattggttatggcgtcccactgctgattgtaggggtatcggctgctatttattccaaaggctacgggagaccccgttactgctggctagatttcgaacagggttttctgtggtctttcctgggccctgtgacctttattatcctgtgcaacgcagtcatcttcgttacaaccgtttggaagctcacccagaagttttcagagataaatccagacatgaaaaagttgaagaaagctcgagcgttaaccattacggcaatagcccagttgttcctgctgggctgtacatgggtgttcggcttgtttatctttgatgatcgcagcctggtgctaacctacgttttcactattctgaactgtctacaaggagcattcttatatctcctacattgcttgttgaacaagaaggtgcgggaagaatatagaaagtgggcctgccttgtggctggcggaagcaagtatagtgagtttacaagcaccacttctgggaccgggcataatcagacccgcgctttgagggcttccgaatcgggcatctag

SEQ ID NO: 182252 - DNA, 2361 bp, Artificial Sequence
  Description of Artificial Sequence: Synthetic coding sequence
atgggcggccgggtgttcctggccttctgcgtgtggctgaccctgcctggcgcagagacacaggactccaggggatgtgcccgctggtgtccacagaattcttcatgcgtcaacgctactgcctgcaggtgcaacccaggcttttcctccttctctgagatcattacaaccccaacagagacctgcgacgatattaacgaatgcgctacccctagtaaggtgagctgtggaaaattcagtgactgttggaatacggagggctcgtatgattgtgtgtgttccccagggtacgagccagtcagtggggcgaagacttttaagaacgaaagcgaaaatacctgtcaggacgtcgacgagtgccagcagaaccctcggctctgcaagagctacggaacatgtgtgaacaccctcggctcatacacatgccagtgtttgcccggctttaagttcattccagaggacccgaaagtgtgcacggatgtggacgagtgctcttcgggccagcaccagtgtgatagttcaactgtctgtttcaatacagtcgggtcttattcttgtagatgccgcccagggtggaagccgcgccacggcatacctaacaaccaaaaggacaccgtgtgtgaggatatgacatttagcacgtggacaccaccaccaggggtgcatagtcagaccttgtcaagattcttcgataaagtccaggatctcggcagagattctaaaacatcttctgcggaggtcaccatccagaatgtcataaagttagtggatgagctgatggaggcacccggagacgttgaagccctcgcaccacccgtgcgacacttaatagccacacagctactttcaaacttggaggatataatgcgcatcctggcaaaatccctgcctaagggccccttcacttacatcagccctagcaataccgagctaaccctgatgattcaggagcggggggataagaacgtcacgatggggcagtcttctgcgaggatgaagctgaactgggctgttgctgctggcgcagaggatccagggcccgctgtcgccggaatactgtccatccagaatatgacgacgcttcttgctaacgccagtcttaacttgcactctaagaagcaagcagaactggaagaaatttatgagtcctctatccggggggtccagctgagacgtctatctgccgtaaattcgatctttctgagtcataataataccaaggagcttaattcccctatcctcttcgccttttcccaccttgaatcctccgacggggaggccggacgagatcccccagctaaggacgtaatgcctggaccacgtcaggaactcctgtgcgctttctggaagagcgacagcgatcgtggcggtcactgggctaccgaaggttgtcaagtcctggggagcaagaatggtagtaccacgtgtcaatgttctcacttgagttcctttgcaatccttatggcacattacgacgtggaagactggaagctgactctgatcacgagggtcgggctcgccctcagcctcttttgtctcttgttgtgcatacttaccttcctgttggtccggcctatacaggggtcacgcactacaatacatctccacttgtgtatctgtctctttgtcggcagtacaatttttctggccggcatcgagaatgaagggggccaggtgggcctaaggtgcagacttgttgccggcctattgcactattgtttccttgcagccttttgttggatgtccttggagggactcgagttgtactttctggtcgtgagggtgtttcaaggccaaggtttgtctacacgctggctgtgcctgataggctacggtgtgcctttgctgattgttggcgttagcgccgccatctacagcaaggggtacggtaggcccaggtattgctggctggatttcgagcagggattcctgtggagctttcttgggcctgttacttttatcattctttgcaacgccgtcatctttgtaacaacggtatggaagcttacccagaagttttcagaaatcaaccctgatatgaaaaaactgaaaaaggcgagggccttaactattaccgcaatcgcgcagctcttcctcttgggttgtacgtgggtgttcgggttgtttatctttgatgaccggtcacttgtgctgacctatgtttttaccattctcaattgcctgcagggtgccttcctgtatttattacactgcttgttgaataagaaggttcgagaggaatacaggaaatgggcctgtctagttgccggggggtccaagtactccgagttcacatctacaacgtctggtactgggcataatcagactcgggctttaagagcgagtgaatccggtatatag

SEQ ID NO: 182253 - DNA, 2229 bp, Artificial Sequence
  Description of Artificial Sequence: Synthetic coding sequence
atgggcggccgggtgttcctggccttctgcgtgtggctgaccctgccaggtgctgagacccaagattcacgtggatgcgctcggtggtgtccacaaaatagctcctgtgttaacgccactgcctgcagatgcaacccaggcttctcaagcttcagtgagattattacaaccccaacagagacatgcgatgacatcaacgagtgcgccacccctagtaaggtctcctgtggtaaattcagcgactgttggaacacggaagggtcatatgattgcgtgtgcagtcccggctatgaacctgtgtctggcgcaaaaacattcaagaacgagagtgaaaatacttgccaggatgtggacgagtgctctagcgggcagcaccagtgtgacagctcaacagtgtgtttcaataccgtcggcagctacagctgcaggtgccgccccggatggaaaccaaggcacggcattcctaacaatcagaaggacacagtctgcgaggacatgacttttagcacctggaccccccctccaggagtccactctcagacgctgagcaggtttttcgacaaggtgcaggacctaggccgagattcgaaaacatcgagcgctgaagtcacaatccagaacgttattaagctggtagacgagctcatggaggctcctggcgacgtcgaagctctggcccccccggtgagacatctcattgcgacccagctcctttctaacttagaggacatcatgcgaatcctggccaagtctctacctaaagggcccttcacctatatcagccccagcaataccgagcttaccctcatgattcaggaacggggagacaaaaatgtgacaatgggccagtcttccgccagaatgaagctgaattgggccgttgcagctggggcagaggatcccggcccagccgttgctggtatcctgagcatccagaatatgacgactctcctcgccaatgcctccctcaatctgcattccaagaagcaagcagaactggaagaaatttacgagtcttctatcagaggcgtgcaactacgaagactgagcgccgtaaattccatctttctgtcacacaacaacaccaaggaactaaattcgcctattctttttgccttctctcacttagagagctccgacggggaggctggtagagacccaccagcaaaagacgtgatgccagggccccggcaggaactcttatgcgctttctggaaaagcgacagcgatcgcggtgggcactgggccacagagggctgtcaagtcttagggtcaaaaaatggctctacaacgtgccaatgcagccatttgagctcctttgctatccttatggcacactatgatgtagaggactggaaactcaccctgatcacacgagttggcctggcactcagcctcttctgccttctgctgtgtattctgacattcttactggtgaggcctatccaggggagcagaactaccatacatctgcacctttgcatctgccttttcgtagggtccaccatttttttggccggaatcgagaacgagggaggccaagtcgggttacggtgccggctcgttgccgggttgctgcactattgtttcctcgcagccttttgctggatgagtctcgagggactcgagctatattttctcgtggtgagggtcttccagggacagggcctcagcacccggtggctctgtcttatcggttacggcgtacctctcctcattgtcggagtcagtgctgccatatactcaaagggatatggaagacctaggtactgttggctggactttgaacaggggttcctgtggtctttcctgggtcccgtaacctttatcatcttatgcaatgctgtcattttcgtgacaacagtttggaaactgacacagaaattcagcgagatcaatccagacatgaaaaagttaaagaaagcgcgagcactgactatcactgccatcgcgcaactctttttattgggatgtacatgggtttttggtttgtttatttttgatgaccgaagcctagtcctgacttacgtgtttaccatactcaattgcctgcagggcgcatttttatatctcctccactgtctcttaaataagaaagtcagagaagaatacaggaagtgggcctgtctggtggcaggcggatctaagtactcagagtttacatcgaccacctcaggcacaggtcataaccaaacaagggccctcagagcttccgagtctggcatttag

SEQ ID NO: 182254 - DNA, 2358 bp, Artificial Sequence
  Description of Artificial Sequence: Synthetic coding sequence
ggcggccggatcatgcgggccttctgcgtgtggctgaccctgcccggcgctgagacgcaagacagcagagggtgtgctcgatggtgcccccaaaattcaagttgtgtaaatgccaccgcatgtagatgtaaccccggtttcagcagctttagcgagatcatcacgacaccgaccgagacatgcgacgacattaatgaatgcgccactccctccaaagtctcctgcggtaagttctccgattgctggaatacagaggggagctatgattgtgtgtgctcccccggctacgaaccagtgagcggagccaaaactttcaaaaatgagtcagagaatacttgtcaggatgtagacgaatgccagcaaaatcccaggctgtgcaagagttacggtacatgcgtaaatacgctcggctcttacacttgccagtgtttacccggcttcaagtttatccccgaggaccccaaagtctgtacagacgtcgacgagtgcagctccggacagcaccagtgcgacagttctacagtgtgtttcaacacagtgggttcctactcttgcaggtgcagacccggctggaagcctaggcatggcattccaaataaccagaaggatacagtgtgcgaggatatgacattttctacttggacacccccgccgggagtccactctcagaccctgtctcgctttttcgacaaggtccaagacctaggcagagactccaagacatcttccgctgaggtgaccatccaaaacgtaatcaagctggtggacgaacttatggaggccccaggagatgtcgaagctctcgctcctccagtgagacatctcatagccacacagcttctgagcaatctggaggacattatgcggattctcgcgaaatcactccccaaaggacctttcacctatatatccccgtctaacaccgagctgacgcttatgatccaggaacgcggcgataagaacgtgactatgggccagtcttcagcgcggatgaagctgaactgggccgtcgcagccggagcagaggaccctggacctgctgttgccggtatcctgagcatacagaacatgactaccctgctagcaaatgcctctttgaatctacattccaagaagcaggccgagctagaggagatttacgagtccagtattagaggcgtccagctccgtagattgagtgccgttaacagtatcttcctgtcccacaataacacaaaggaactgaactctcccattctctttgcttttagtcacttagagagttccgacggggaggccggcagggatcctccagccaaagacgtcatgcccggaccccgacaggagctgctttgcgccttttggaaaagtgattcagatcgagggggccactgggccaccgaggggtgccaggttcttgggtccaaaaacggtagtactacttgccagtgcagccacctgagtagtttcgcaatccttatggcgcactatgacgttgaggattggaaactgaccctgatcactagagtcggactggcactgtcactattttgcctacttctgtgtattctgacctttctcttggtgaggcccattcaaggcagccgcacgactattcacctccatctgtgcatatgcctttttgtgggttccacgattttcctggcaggcatcgagaacgaaggagggcaagtgggactgagatgccggctcgttgccgggcttttgcattactgtttccttgctgcgttttgctggatgagcctcgagggactggaattgtatttcctcgtggtccgagtgttccaaggccaaggcttgtccacccgctggttatgtctcattggctacggtgtcccattgctgatcgtcggagtctccgcagccatatactcaaagggctacggtcgaccacggtactgttggctcgatttcgaacagggattcctgtggtccttcctgggacccgtcactttcatcattttgtgcaatgctgtgatctttgtcactaccgtctggaagttgacccaaaagtttagcgaaattaatccagatatgaaaaagctcaagaaagcaagagcacttaccattaccgccattgcccagctgttcttgctgggctgtacctgggttttcgggctctttatcttcgacgaccgtagcctggtgcttacctacgtgtttactatattgaactgtctgcagggtgccttcctgtatctcttgcattgcttgctgaataaaaaggtcagggaggagtatcgcaagtgggcctgcttagtggccggcgggagcaagtactcagaatttacctcaacgacttctggaacaggccataaccaaaccagggccctgagggcctccgagagtggcatctag

SEQ ID NO: 182255 - DNA, 297 bp, Artificial Sequence
  Description of Artificial Sequence: Synthetic coding sequence
atgagcgtgcggctgcacgtgcccagcggcagccggggcagcgagctttccgctttaatccaggcaatcggagcctccaccagtgggaagcccaaatgttttgtgtgtatacttagatccgggctgtccgttgccctctcactgtccgtctattttctcctgctcttttcacggacccgcggaggcggacacggcgaaccgcccgaatgtcagagaagggcctcttgttcagcctacagcttcagagagattgaggattgtaggcagaagcagcctcggcgatggcaacaaggttag

SEQ ID NO: 182256 - DNA, 231 bp, Artificial Sequence
  Description of Artificial Sequence: Synthetic coding sequence
atggcccggggcgccgccctggccctgctgctgttcggcctgctgggcgtgctcgtggctgccccagggtttggtgacctgcgtttgcaggcagcacggggcggacgtcctggcgttgcctgtcatagccacgccctgcggcctggccccaagtttggtatcgcgcggtccctgagacctggatggtggggggaagggaaggagaagttagaaaaaaatttcgaaccctag

SEQ ID NO: 182257 - DNA, 534 bp, Artificial Sequence
  Description of Artificial Sequence: Synthetic coding sequence
atggcccggggcgccgccctggccctgctgctgttcggcctgctgggcgttctggtagccgcccccgatggcggctttgacctatccgacgcactgcccgacaatgagaataaaaagccgaccgcaatcccaaagaagccatccgccggagacgatttcgacttgggagatgcggtagtcgatggagagaacgacgaccctaggccaccgaacccgcctaagccgatgccgaatcctaacccgaatcacccatcttcctccggctcttttagtgatgccgatctggccgatggggtatccggaggcgaggggaaaggagggtcagacggtggaggctcccacaggaaagagggggaggaggccgacgccccaggtgtgattcccgggattgtgggtgccgtggtggtagccgtggcgggtgctatctctagtttcattgcatatcagaaaaagaagctgtgctttaaggagaacggccaactggccggttccctcgggccctgtatcggaattcggcgcgaggccgacggctag

SEQ ID NO: 182258 - DNA, 510 bp, Artificial Sequence
  Description of Artificial Sequence: Synthetic coding sequence
atggcccggggcgccgccctggccctgctgctgttcggcctgctgggagtgctagttgccgcgccagacgggggatttgatctttctgacgcacttcccggggatgactttgatctcggcgatgccgtggtcgacggggagaacgacgatccacggccgccgaatcctcctaagcccatgcccaaccccaatccaaatcacccctctagtagcggatccttctccgacgccgacctcgctgatggagtgtcaggaggtgaaggcaaaggtggttctgacggcggtggtagtcatagaaaggagggggaggaggcagacgcacccggtgtgatccccggcatcgtaggcgccgtcgtggtcgccgtcgcaggcgccatctcttcttttatagcctaccagaaaaagaagttgtgtttcaaagaaaatgcagagcagggcgaggtcgacatggaaagccacaggaacgcaaatgcggaacccgccgtgcaaaggactctcctcgagaagtag

SEQ ID NO: 182259 - DNA, 558 bp, Artificial Sequence
  Description of Artificial Sequence: Synthetic coding sequence
atggcccggggcgccgccctggccctgctgctgttcggcctgctgggagtgctggtggcagcaccagatggagggtttgacctctccgacgcactacctgataatgaaaataagaagcccaccgcaattcctaagaaaccaagcgccggtgacgattttgaccttggcgatgcagtcgtggacggcgagaacgacgatcctcgccccccaaatccccctaagccaatgcccaaccctaatcctaatcatccttcctcaagtggttctttttctgatgctgatcttgcagatggcgtctccgggggcgagggcaaaggcgggtcagacggtggcggctctcacagaaaggaaggcgaagaagctgacgctccaggagtcatccctgggattgtaggtgctgtggttgttgcagtggcaggtgcaatctcctctttcattgcatatcagaaaaagaaactttgctttaaggagaatgctgagcagggcgaggtggatatggaatcccataggaacgccaatgcggaaccagccgttcaacgaactcttcttgagaagtag

SEQ ID NO: 182260 - DNA, 606 bp, Artificial Sequence
  Description of Artificial Sequence: Synthetic coding sequence
cggcggtggggccggcccgccggcacccccggcgccagcagcctgcctggccggaccaggtgtgcccacggaggaccgggtcctgaggaagctccaactttcagccccactctcttccttgaaccctttcagcgggaaaagtctgcctttgtagtgggcgtcgcaaactcctacatgtggggtggactcggtcgagacggcgggttcgatttatccgatgctctgcctgataacgaaaacaagaagcctacggcaattcccaagaaaccgtctgccggcgacgacttcgatctgggtgacgctgtggtggatggcgagaatgacgacccgcgcccccctaatcccccgaagccaatgcctaatcctaaccctaatcatccctctagcagcggctctttttctgatgccgatcttgcagacggcgtctcagggggagaggggaaaggcggatcagacggtggtggcagtcacagaaaggagggcgaagaagccgatgcaccgggcgtaattcctggtatcgtgggggcagtggtggttgctgtcgctggcgctattagttcgtttatcgcctatcagaagaagaagttatgcttcaaagaaaactag

SEQ ID NO: 182261 - DNA, 438 bp, Artificial Sequence
  Description of Artificial Sequence: Synthetic coding sequence
atggtggcctggcggagcgccttcctggtgtgcctggccttcagcttggccaccttagtgcagcgtgggagtggggacttcgatgactttaatttggaagacgccgtgaaggaaaccagcagcgtcaagccagcactcggcatgtatcataaactggacgggctgaagcagcagaattttatcctgtccctgttctggatgctcgaggtgctctaccaaggggtggggtgggccacattcagtctgaaagccctgggcaaaaacctgtcactgacattcccaaccagcggcggaagccggtgttctcttgtttgcggatgcatcactccaatttccgccagcgtggtgacctggtgctctcctttctgcgtgagcctcctcagtctcaccaaaatgttggtgagcggatttaaggcccatttagataatcccggctag

SEQ ID NO: 182262 - DNA, 573 bp, Artificial Sequence
  Description of Artificial Sequence: Synthetic coding sequence
atggtggcctggcggagcgccttcctggtgtgcctggccttcagcctcgcgaccttagtccagaggggttcaggtgatttcgatgactttaatctggaagacgccgtcaaagagacatcttccgtcaagagaaatgactttgacttagccgatgccttggacgatagaaacgacagagatgacggccgccggaagcccatagccggtggtggcggcttttctgataaggacctcgaagacatcgtaggcggcggcgagtataaacccgacaagggaaagggcgacggccgctatggaagtaacgacgatccaggaagcggtatggttgcagaaccaggaacaatcgcaggtgttgcctcagcactggctatggctttaataggtgctgtctcttcttacatttcctatcagcagaaaaagttctgcttttcgattcagcaaggtctgaatgctgattatgttaaaggagaaaacctcgaggccgtggtgtgcgaagagcctcaggtgaaatattcgactctgcatactcagtcagcggaacctccccccccccctgaaccagcgagaatttag

SEQ ID NO: 182263 - DNA, 789 bp, Artificial Sequence
  Description of Artificial Sequence: Synthetic coding sequence
atggtggcctggcggagcgccttcctggtgtgcctggccttcagcctcgccacgctcgtgcagcgcggcagtggggacttcgacgacttcaatttagaagatgcggtcaaggaaacctcaagcgtcaagcagccctgggatcataccacgaccacaacaaccaatcgacccgggacaacacgggccccagcaaaacctcccggaagcggactcgatttagctgatgccttggatgaccaggatgatggaaggagaaaacctggaatagggggaagagaacgttggaatcacgtgactacgactaccaagaggcctgtgaccacccgtgctccagccaacacgctaggcaatgattttgatctggctgatgcactggatgatcgcaacgatagagacgacgggagacggaagccgatcgcgggaggtggggggttcagcgataaggatttggaggatatcgtcggcggtggcgagtacaagcctgataagggaaagggtgacggtagatatggtagcaatgatgacccggggtctggaatggtagctgaacccggaactatcgccggcgtagctagcgcactggcgatggctctcatcggcgctgtttctagctacatctcctaccagcagaagaaattctgtttcagcatacagcaaggactcaatgcagactatgtgaagggggagaatctggaagctgtggtgtgtgaggagcctcaagtgaagtactccactctgcacacccagtcagctgagcctccacctccccccgaacccgctcggatttag

SEQ ID NO: 182264 - DNA, 474 bp, Artificial Sequence
  Description of Artificial Sequence: Synthetic coding sequence
gagaccagcagcgtgaagcagccctgggaccacaccaccaccaccaccacaaatagacccgggacaacaagggctcctgccaagccacccggcagcggcctggatctcgcggacgccctggacgatcaggacgacgggaggcggaagcctggcattggtggcagagaacggtggaaccatgtgactactacgactaaacggccagtgacgacacgggcgcccgccaataccctcggcaacgacttcgacctggcagacgctttagacgatcgcaatgatagggatgatggccgaagaaagcccatagctggtggggggggattttctgataaggatctcgaagacattgtggggggtggagaatataagcccgacaaagggaagggtgatgggcgctatggatcaaatgacgatccaggcagcggcgggtttctcaaccccgaggcgcctgtcggccacgtcaagggtaagtag

SEQ ID NO: 182265 - DNA, 570 bp, Artificial Sequence
  Description of Artificial Sequence: Synthetic coding sequence
atggtggcctggcggagcgccttcctggtgtgcctggccttcagcctagccacgttggttcagcgcggatcaggggatttcgacgacttcaacctggaagacgctgtgaaagagacaagctctgtgaagcagccatgggatcacactaccactactacaactaacaggccagggaccacccgagcaccagcaaaacctccgggatccgggctggacctggctgacgccctggacgatcaggatgacggccggagaaagcccgggattggcgggagaggcgacggtcgctatggctcaaatgacgacccagggtcgggcatggtagccgagcccggaaccatcgccggcgtggccagcgccttggccatggctttaatcggtgccgtgagttcgtacatttcatatcagcagaagaagttctgtttcagtattcagcagggcttgaatgctgattatgttaagggtgaaaacctggaagctgttgtttgtgaggaaccacaagttaaatactcaacactgcacacacagagcgctgaacccccccctcctcccgagcctgctcgaatctag

SEQ ID NO: 182266 - DNA, 819 bp, Artificial Sequence
  Description of Artificial Sequence: Synthetic coding sequence
atggtggcctggcggagcgccttcctggtgtgcctggccttcagcttagctacattggtgcagagagggtccggagacttcgatgactttaatctcgaggacgccgtgaaagagacaagtagtgtaaagcaaccatgggaccatacaactactacaaccaccaatcgccctgggactacacgggcccctgccaagccgcctggaccaactgagggctcaggcctcgatctcgccgatgctctcgacgatcaggacgatggcagacgaaagcccggcataggaggaagggaaagatggaatcatgtcacaaccacaacgaaaagacctgtgactactagggccccagctaatactctggggaacgactttgacttagccgacgcactcgatgaccgcaatgacagggatgacggtcgtcggaagccaatcgcaggcggaggcgggtttagcgacaaagatctggaagatatcgttgggggaggtgagtataagccagacaaaggaaagggcgatggacgatacgggagcaacgacgacccaggcagcgggatggtggcagagcccggcactattgccggtgtcgcctccgcactggcgatggccttaattggcgccgtctcttcctatatatcataccaacagaaaaagttctgtttctcaatccagcatgccgcagcgggacaggaaggtctgaacgccgactatgtgaagggggagaacctggaagctgtggtgtgcgaagagccacaagtgaaatattcaactctgcacacccaatcggcagagcccccgccccctcctgagcccgctcgcatctag

SEQ ID NO: 182267 - DNA, 642 bp, Artificial Sequence
  Description of Artificial Sequence: Synthetic coding sequence
atggtggcctggcggagcgccttcctggtgtgcctggccttcagcctggccactctggtgcagcgggggtccggagactttgatgatttcaatctggaggacgcggttaaagagacatctagcgtgaagcagcggtggaatcatgtgaccacaacaactaagaggccggttacaactagagcacctgccaacactctcgggaacgacttcgatctggcagatgctctggatgacagaaatgaccgtgatgacggacgcaggaagccaatagcgggaggaggcggctttagtgataaggatctagaagatatcgtcggaggcggcgagtacaaacctgataagggcaaaggcgatgggcggtacggctctaacgatgatcccgggtcggggatggtcgcagagcctggaaccatcgcaggggttgccagcgcgctagccatggccctgatcggggcagtttcctcctatatctcgtaccagcagaagaagttttgctttagcatccagcaaggactgaatgcggactacgtcaaaggggagaacctggaagcagtggtctgcgaggaacctcaggtcaaatatagcaccttacatacacaatctgccgagcccccacccccgccggaacccgccaggatctag

SEQ ID NO: 182268 - DNA, 1785 bp, Artificial Sequence
  Description of Artificial Sequence: Synthetic coding sequence
atggccgccgagagcggcgagctgatcggcgcctgcgagttcatgaaggatagactttacttcgccaccctccgcaaccggcccaagtcaaccgttaatacacactatttctccatcgacgaggaactcgtttatgagaatttctacgccgattttggtcctctgaatctggcaatggtctaccgctattgttgcaagctcaataaaaaactcaagtcctatagcctctctcggaagaagatagtgcactatacatgtttcgaccagcgtaaacgagcgaatgccgcttttctgattggcgcctacgcagttatttacctgaaaaagactcctgaggaggcttacagagccctactcagtgggagcaaccccccatacctgcctttccgcgatgcaagctttggaaactgtacttacaatttgaccatattggattgccttcaggggatccggaagggattacagcacggattcttcgatttcgagactttcgatgtggacgagtacgagcattatgagcgggtggagaacggagattttaactggatagtccctggaaagtttcttgccttttcaggcccacaccccaaaagcaaaatcgagaatggataccctttgcatgcgcctgaggcctacttcccctattttaagaaacacaacgtgactgctgtggtccggctcaataaaaagatctatgaagcgaaaagattcacagacgctggttttgaacactatgacctcttttttatcgacggctccacccctagcgacaatatagtccgtcgcttcctcaatatctgtgagaacaccgaaggtgctattgcagtgcattgcaaagcaggtttgggaagaaccggaaccctgattgcctgttacgtaatgaagcattaccgatttacccacgccgaaattattgcttggatacgaatttgcagaccaggatccatcatcggcccacagcaacattttttggaagagaagcaggctagtttatgggtgcagggcgatattttcagatcgaagctgaagaaccgcccttcaagcgaaggatctatcaataagatcctgagtgggttggacgatatgtcgatcggcggcaaccttagcaagacacagaatatggagcgcttcggagaggacaacctggaagacgatgacgttgaaatgaagaatgggattacccagggggataaactgagagcgctgaaaagtcagcgccaaccgaggacatcaccttcctgtgcctttagatccgacgacaccaagggacacccacgtgctgtgtcccaaccttttcgtctgagttccagccttcagggcagcgcagtgaccttaaagacatccaagatggcattgagccccagtgccaccgctaagcggattaacaggacaagcttaagctccggcgcaacagtgagatccttcagcataaattccaggctggcttcaagtctaggaaacctgaacgccgcaaccgacgaccccgagaacaagaagacgagctcaagtagcaaagcgggctttactgcgagccctttcaccaatttattaaatggtagcagtcagcctactaccaggaattaccccgagttgaataacaatcagtataaccggtcctctaattccaacggtggtaacctgaactcacctcctggtccccatagtgctaagacggaggagcacacaactatcctgagaccgtcatatactgggctcagctcttccagtgcccggtttctgagccggtctattcctagcctgcagtcggagtacgttcattattag

SEQ ID NO: 182269 - DNA, 1872 bp, Artificial Sequence
  Description of Artificial Sequence: Synthetic coding sequence
atggccgccgagagcggcgagctgatcggcgcctgcgagttcatgaaagacagactgtattttgcaactctccgaaaccgcccaaaatccaccgtcaatacgcattacttcagcatcgatgaagaactcgtgtacgagaacttttacgcagatttcggccccttaaatttggccatggtgtaccggtactgctgtaaactgaacaagaagctgaaaagctactcattgtcaagaaaaaagatcgtccactacacttgttttgaccagcgaaagagagcaaacgcagcatttcttatcggggcctacgcggtgatctatctgaagaaaacccctgaagaggcctatagagcactcctgtccgggtccaaccccccctatctgcccttcagagatgcctcctttggaaactgtacctacaacctgaccattctggattgtctccaggggatacggaaggggctgcagcacgggttcttcgattttgaaacgtttgacgttgatgaatacgaacattatgagcgagtggaaaacggagacttcaattggatagtgcctgggaaatttcttgccttcagcggtccccatcctaaaagtaaaattgaaaacggatacccattacatgcccctgaggcatacttcccgtacttcaagaaacacaatgtgaccgctgtggtgagactgaataaaaaaatttatgaggcaaagcgtttcaccgatgccgggtttgagcactacgatctgttttttattgacggctccacgcctagtgataacatcgtgcgccgcttcctaaacatctgcgaaaatacagaaggcgcaattgcagttcactgtaaagcagggctcggccggactggaacgttgattgcatgctatgtgatgaaacattacagatttactcatgcggagattattgcctggatccggatatgccgaccaggctccatcattggccctcagcagcacttcttggaggagaagcaggcctcactctgggtgcagggggacatattccgttccaagctgaaaaatcgccctagttccgagggttcgattaacaaaatcctgtcgggcctggacgatatgtcaatcggaggtaacctgtctaagacccaaaacatggagcggtttggagaggacaatctcgaggacgacgatgtcgagatgaagaacggtataacccagggcgacaaactccgcgccctcaagagtcagcgccaaccccggacatctccttcatgtgctttcaggtcagatgatacgaaaggccaccctagggccgtgtcccagcctttccgtctgagctcctccctccagggatccgccgtgactctgaaaacttcaaagatggcactgagtccaagtgcaaccgcaaaaagaatcaatcgcaccagtttatcgagcggcgctaccgtacggtccttctccatcaattctcgactcgcctcaagtctaggtaacctgaacgctgccactgatgatcctgagaacaagaagacaagctcctcatccaaagccgggttcaccgcctctccatttacaaatctgttgaatggctcaagtcagcccacaacgcgaaactaccccgagctcaacaacaatcagtataataggagttcaaacagcaatggcggtaacctgaacagtcccccgggccctcactcagccaagaccgaagaacatacgaccatcctccgccccagctatacgggattatccagctctagtgcccgctttcttagcaggtctatacctgtgtccgctcagacaccacccccaggtccacagaatcccgaatgcaacttttgcgccttgccctctcagccccgactccctcctaaaaagttcaatagcgctaaggaggcgttctag

SEQ ID NO: 182270 - DNA, 1152 bp, Artificial Sequence
  Description of Artificial Sequence: Synthetic coding sequence
atggccgccgagagcggcgagctgatcggcgcctgcgagttcatgaaagatagactatacttcgctaccctgcgcaatcggcccaagtcaacagtcaatacccattacttctcaatcgacgaagaactagtgtacgagaatttctacgccgattttgggccactgaacctcgcaatggtatatcggtattgttgtaagctgaacaagaagctgaagtcctattctctgagccgcaaaaagattgtgcattacacctgttttgaccaacggaagcgggcaaatgccgcttttttgatcggggcctacgccgtcatctacttgaagaaaaccccggaggaggcctacagggccctgctctcagggtcaaatccaccctatctcccattcagagatgcaagctttggcaactgtacatacaacctgaccattttggactgtctgcaaggcattcgcaaagggctgcagcacggtttctttgattttgagacattcgatgttgatgagtatgaacattacgaacgagtcgagaacggtgacttcaactggattgttccaggaaaattcctggctttctctggccctcaccctaaaagcaaaatcgagaatggatacccgctgcacgcgccagaggcttactttccctatttcaaaaagcacaacgtgactgcagtggtgaggctcaacaaaaagatctatgaagcaaagcgcttcacagatgccgggttcgaacactatgacctattcttcattgacggtagcacaccatccgataatatcgtgaggagattcctgaacatctgcgaaaatacagagggagctattgccgttcattgtaaggccggcctgggtcgcaccggtaccctgatcgcttgctatgtcatgaagcactataggtttacccacgccgaaatcatcgcttggattcggatttgtcggcctggctcaattattgggccccagcagcattttctagaagagaaacaagcctctctctgggtacagggcgacattttccggtctaaactcaaaaaccgaccgtcttccgaaggttccataaacaagatattgagtgggctggacgatatgagcatcggcggcaacttatctaagacccaaaacatggagaggtttggcgaggtgtcatttccgtag

SEQ ID NO: 182271 - DNA, 576 bp, Artificial Sequence
  Description of Artificial Sequence: Synthetic coding sequence
atggccgccgagagcggcgagctgatcggcgcctgcgagttcatgaaagaccgtctctacttcgcaactcttcgcaaccgccccaagagtacagtaaatacgcattatttttctatcgacgaggagttggtatacgaaaatttctatgccgatttcggtcctctaaacctagctatggtgtatcgctactgttgcaagctgaacaagaagctaaagtcatattcactgagccggaagaagatcgtgcactacacctgcttcgatcagagaaaacgggcaaacgctgctttcctgatcggcgcctatgcagtcatctacctgaagaaaacccccgaggaagcctatagggcactactgagtggcagtaaccccccttatttgccctttcgcgatgcctcattcggaaactgtacgtacaacctgacaattctggactgcctgcaggggattaggaagggtctacaacatggcttcttcgactttgaaacctttgatgtggatgagtacgaacactatgaagttattttattcacccccctgaagcctacttttttgattagtaagtctattatgtag

SEQ ID NO: 182272 - DNA, 822 bp, Artificial Sequence
  Description of Artificial Sequence: Synthetic coding sequence
atgggcaacttcctgagccgggagaacaaggtgcaggtgatcagcgaaagcgatcggctgtattttgcaacgcttcggaataggccaaaatctacagtcaacacacattacttctccatcgacgaggagcttgtctatgaaaatttctatgccgactttggacctctcaatcttgctatggtctacaggtactgctgtaagctgaataaaaagctgaagagctactccttatccagaaagaagatcgtgcactatacatgcttcgatcagcggaaacgggcgaatgccgcctttttgatcggggcatatgccgtcatctatttgaaaaaaacacccgaagaagcatacagggctcttctgtcaggaagcaacccgccatatctgccctttcgagatgcttcgttcggcaactgtacatataatctaaccattctagactgcctgcaaggtatccgcaagggccttcagcatggcttctttgatttcgagactttcgacgtcgatgagtatgagcactatgaacgggttgaaaacggagatttcaactggattgtgcccggcaaatttctggcattctctggaccacacccaaagtctaaaatcgaaaacggctaccctctgcacgcacctgaagcatacttcccctactttaagaaacataatgtcaccgccgtggtcagactgaacaaaaagatatatgaggctaagaggttcacagacgccggatttgaacattatgatctgtttttcatagacggctctacacctagtgacaatatcgtgaggcgctttctgaatatctgcgagaacactgaagggtag

SEQ ID NO: 182273 - DNA, 1698 bp, Artificial Sequence
  Description of Artificial Sequence: Synthetic coding sequence
atggtgtaccggtactgctgcaagctgaacaagaagctgaagagctacagccttagccgcaaaaaaatcgtacactatacctgctttgatcagcggaagcgggcaaacgccgccttcctgattggagcctatgccgtgatttacctcaaaaagactcccgaagaggcctacagagctctgttgagcggatctaaccctccataccttccattcagggacgcctcctttggcaattgtacttataatctgaccattctcgactgcttgcagggaatacggaagggcctccagcatggattttttgacttcgagacttttgatgtggatgagtatgagcattatgagagagtggagaacggggatttcaactggatcgtgcctggaaagttcttagcattctcagggcctcacccaaaatccaaaatcgaaaacggctatccattgcacgccccagaagcctattttccatacttcaaaaaacacaacgtcacagcagtggttcggttaaataaaaaaatctacgaagccaaacgctttactgacgctggatttgaacattatgacctctttttcatcgacgggagcaccccctcagataacatcgtgcgacgtttcctaaacatctgtgaaaatacagaaggcgcgatcgcagtgcattgcaaggccgggttaggacgaacaggaacactcattgcttgctatgtgatgaagcactatcgcttcactcacgctgaaataatcgcctggattcggatttgcaggcctggaagcatcatcggtccacaacagcacttcctagaggaaaagcaggcgagcctctgggtccaaggcgatattttccggtctaagctgaaaaatcggccaagtagcgagggtagtatcaacaagatcctgagcgggcttgatgatatgtccattggtggtaatctatcaaagacacaaaatatggaaaggttcggagaggacaatctggaggacgatgacgtggagatgaaaaatggtataacccaaggagacaagcttcgggcgctaaagtcgcagcgccaaccaagaaccagcccttcttgcgcattcaggagtgacgatacaaaggggcatccacgggcagtgtctcaacccttccgcctgtcctcttcactgcaaggcagcgcggtgactctgaagaccagcaaaatggccctcagtccaagtgccaccgcaaagaggataaacaggacaagtctgtcttccggcgctacagtgcgctcgttttccattaacagtcgcctggcctcctcactgggcaatctgaatgcggcaacagatgatcctgagaacaagaagacctcctccagctccaaagccggctttaccgctagcccatttactaacctgctcaacggttcctcccagccgaccacccgcaactacccagagttgaacaacaaccagtacaatcggagctccaactctaatggcgggaatctcaatagcccacccggaccgcattcagcaaagaccgaggagcacacaacaatcctcaggccgtcctacaccggcctgtcgtcttccagtgcaaggttcctttccaggtcaatccccgtgtccgcacagacacctcctccaggtccccagaatccagaatgtaatttttgcgctctgccgagtcagccaagactgcctccgaagaagttcaactccgccaaagaggcattttag

SEQ ID NO: 182274 - DNA, 1833 bp, Artificial Sequence
  Description of Artificial Sequence: Synthetic coding sequence
atggccgccgagagcggcgagctgatcggcgcctgcgagttcatgaaggaccggctttatttcgctaccctccgtaaccggcctaagagtactgtgaacactcattatttctctattgatgaggagctcgtctacgagaacttctacgctgacttcgggccgctgaacctggcgatggtttacagatactgttgcaaattgaacaagaagctaaagagctatagcctgtcaagaaagaagatcgttcactatacttgcttcgaccagcgaaagcgcgcaaatgccgcgtttctgatcggagcatacgcagtcatctacctgaaaaaaacaccagaagaggcgtatagggccctcttatcaggatcaaaccccccctatctccccttccgtgacgcaagctttggcaactgtacctacaaccttaccatactggactgcctccagggcatcaggaaaggtctgcaacacgggttctttgacttcgagaccttcgatgtggatgagtacgagcactacgaaagagtggaaaacggagattttaactggattgtacctggtaagttcctagcgttctctggaccgcaccctaagtctaagatcgaaaatggctatccactgcatgcacccgaggcctattttccgtatttcaagaagcacaacgtgaccgccgtcgtgaggctgaacaaaaaaatatacgaggctaaaaggttcactgacgccggcttcgaacactacgatctgttctttatcgatggctcaacgccatcagacaatatagtgcggcgcttcctgaatatttgtgagaacactgaaggtgctatcgccgttcactgcaaggctgggttggggaggaccgggaccctcatcgcctgttatgttatgaagcattaccgcttcacccatgccgaaataatcgcttggatccgcatctgccggcctggttctatcatcggacctcagcaacactttctcgaagaaaagcaggcttccctctgggttcagggagatatatttcggtccaaactgaaaaaccgacctagctccgagggctccattaataaaatcttatcagggcttgatgatatgagcattggcgggaatctgtcaaagacgcagaacatggaacggtttggagaagataacctcgaggatgatgacgtggaaatgaagaatggcattactcagggagacaagctaagagcactgaagagccagagacagccacggaccagcccaagttgcgcctttcgttcagacgatacaaagggacacccacgagccgtaagccagcctttccgcttgtccagcagtttacagggatctgctgtgaccttaaagacttctaagatggccttgagtcccagcgctacggccaagcgcattaatcgcacgagcctgtcctcaggcgccactgtccgcagcttcagtatcaactccagacttgccagctccctgggcaacctgaacgctgccactgacgacccagaaaataaaaagaccagctctagttctaaagctggcttcaccgcctctcccttcactaacctgctcaacgggagctctcagcctaccactaggaattacccggaactgaacaacaatcagtacaatcgatcttcaaactcaaatggaggtaatctgaacagtccccccggacctcatagtgcaaaaaccgaagaacacacaaccatcctcagaccaagctacaccggtctcagcagttctagtgccaggtttctgagccggagtataccatgctcgtgtctacttctcgtgtttaggaagccattcctgggcagcccccttctcagcctccccatatctcacctgtag

SEQ ID NO: 182275 - DNA, 1416 bp, Artificial Sequence
  Description of Artificial Sequence: Synthetic coding sequence
atgaagcggaagagcgagcggcggagcagctgggccgccgcccccccatgttcaaggagatgttctagcacttccccaggcgtgaagaaaattcggtcaagtacccagcaggacccaagacgcagagatccccaggacgatgtgtaccttgatatcacagaccgcttatgcttcgccattctctattcacgcccaaagagtgcgagcaatgtgcattacttctcaatagacaacgagctcgagtatgagaatttctacgctgacttcggccccctaaatctggccatggtgtataggtactgttgtaaaatcaacaagaaattgaaaagtattacaatgctgcgcaagaaaattgtgcactttacgggtagcgatcagagaaagcaggcaaacgcagcctttttggtaggatgttacatggtgatttaccttggtagaacgccagaggaagcctaccggattctaatctttggagagacaagctacatcccgttcagggatgcagcctatgggtcctgcaacttctacatcacccttcttgattgcttccacgctgtgaaaaaggctatgcagtacggattcctcaacttcaattcttttaatctcgacgagtatgagcattacgaaaaagcagaaaacggggatctcaactggattatccccgaccgattcattgcgttttgcggcccgcacagccgtgctagactggagtctgggtatcatcagcattcacccgaaacttatatccaatatttcaaaaatcataacgttacaacaattatccgcttaaataagcgaatgtacgacgcaaagcggtttacagatgcaggctttgaccatcacgatctcttttttgcagacgggtctaccccaacagacgcgattgtcaaggagtttcttgatatttgtgaaaacgcagagggcgcaatcgccgtgcattgcaaagcgggtcttggacggaccggaacgcttatcgcctgttatatcatgaaacactacaggatgacagcggccgaaactatcgcttgggtgagaatttgccgcccaggcagtgtgattggcccgcaacaacagttccttgtgatgaaacaaacaaacctgtggctagaaggcgactactttaggcagaaactgaaaggtcaggaaaatggtcagcatcgcgccgccttctctaaactgctctccggagtggacgacatatctatcaatggtgtcgagaatcaggaccagcaggagcccgaaccctatagcgacgacgacgagatcaatggcgtgactcagggcgacagactgcgggccctgaagtctcgacggcagtccaaaacgaacgcaatccctctcaccgacggctggttgtcgcaagctgtaacctttctggaccgcttgctcatctggctgggcatccataaggactag

SEQ ID NO: 182276 - DNA, 1458 bp, Artificial Sequence
  Description of Artificial Sequence: Synthetic coding sequence
atgaagcggaagagcgagcggcggagcagctgggccgccgcccccccatgttcaagacgctgcagcagcactagtccaggggtgaagaagattcgaagtagtacacagcaggaccctaggaggcgagatccacaggacgatgtttacctcgacatcactgaccgcctctgcttcgctatactttacagtaggcctaaatccgcctccaatgtgcactatttctctatcgacaacgaactggagtacgagaacttctacgcagattttggcccactgaatctcgcaatggtgtacagatactgttgcaaaatcaataaaaaactcaaaagcatcaccatgttgcgaaagaagattgttcattttactggctccgaccagaggaaacaggcaaacgctgcattcctggtgggttgctatatggtaatatatctgggacggacccctgaggaggcttaccgtattctcatctttggcgagacctcttatattccatttcgagatgcagcctacggaagctgcaacttctacattactttgcttgattgcttccatgctgtgaagaaagctatgcaatacggctttctcaacttcaattctttcaatcttgacgagtatgagcactatgagaaagccgagaacggggatctgaattggatcatccctgatcgattcattgcattttgtggtccccactcccgagctcggctggagtctggctaccatcagcactctcccgagacctacattcagtattttaaaaaccacaatgtgacaaccatcataaggctaaacaaacggatgtatgacgccaagcggttcactgacgctggctttgatcaccacgacctatttttcgctgacgggtccacaccaacagatgccatcgtcaaggagtttttggacatatgcgaaaacgccgaaggtgcgatcgcagtacattgcaaggccggcctgggtcgcacagggactctgatcgcctgctacataatgaaacattaccgcatgacagccgctgagactatagcctgggtgaggatatgtcggcccggttcagtcattggtccacagcagcagttcctggtgatgaagcaaaccaacctgtggctcgagggagattacttccgccagaaactgaaaggccaggaaaacgggcagcatagggccgccttctcaaaactactgagtggcgtggatgacatatccattaacggcgtagagaatcaggatcaacaagagccagagccatacagtgacgatgatgagatcaacggagttacccagggggataggctgagggccttgaagtccaggaggcagagcaaaacgaacgcgatacctctgacatgtccgctggccgtgctcacctctgcactgtgctctgtggtgatctggtggatcgtttgcgactatattttgcccatcctcctgttttgccttgatgggttcaggacccagtag

SEQ ID NO: 182277 - DNA, 1380 bp, Artificial Sequence
  Description of Artificial Sequence: Synthetic coding sequence
atgaagcggaagagcgagcggcggagcagctgggccgccgcccccccctgctcccgccgctgctcttccacctcaccgggggtgaagaaaatcaggtcgagcacccagcaggatccccgtcgtcgggatcctcaggatgatgtttatctggatatcaccgatcgcctgtgctttgcaatcctgtattcacgaccgaaatctgctagtaacgtgcactacttctccattgacaatgaactcgagtatgagaacttctacgcagacttcggtccactgaacctagccatggtgtataggtattgctgcaagattaacaaaaagcttaagtccataaccatgctgagaaaaaaaatagtgcacttcactggaagcgaccagcggaaacaagctaatgctgcatttcttgttggttgctacatggtaatatacttgggtcggactcctgaagaggcctaccggatccttatctttggcgaaacgagctacatcccctttcgcgacgccgcgtacggctcatgtaatttttacataaccctgctggattgctttcatgccgtaaagaaggcaatgcagtatgggtttctgaatttcaactcttttaatctggatgagtatgaacattacgagaaggcggagaatggggatttgaactggattattcctgataggttcattgctttctgcgggccgcactcccgggcaagattagaatctggctaccatcaacactcgccagagacctacatccagtactttaaaaatcacaatgtaacaacaatcatcagacttaacaagcgaatgtacgatgccaagaggttcactgacgcggggtttgaccaccacgatctgttcttcgctgatggatcaaccccaacggatgccattgtcaaagaatttttggacatttgtgaaaatgcggaaggcgctattgctgtgcactgtaaagccgggctgggtaggacaggcaccctgatcgcatgttacattatgaagcattatagaatgactgctgcagagaccattgcatgggtgcggatatgcagacctggaagcgttattggtccacagcagcagtttctagtgatgaaacaaacaaacctgtggctcgaaggcgattatttcaggcaaaagctgaaagggcaggagaacggccagcacagagccgcattttcgaaattgctgagtggggtcgatgacatctcaataaatggagtcgagaatcaggaccagcaggagccagagccctactcagacgacgacgagatcaatggcgtcacccagggggaccgattaagggctctgaagagtagacgccaatccaagaccaacgcgatacctctgactctttcaatcagtcgaaccaagaccgtcctccgttag

SEQ ID NO: 182278 - DNA, 1497 bp, Artificial Sequence
  Description of Artificial Sequence: Synthetic coding sequence
atgaagcggaagagcgagcggcggagcagctgggccgccgcccccccttgcagccggcgatgttccagcaccagcccaggcgtgaaaaagatacggagtagtacacaacaggacccccgtcgtcgcgacccccaggacgacgtgtacctggacatcacagacagactgtgtttcgccatattatacagtcgacccaagtctgccagtaacgtccactacttttctattgacaacgagctcgagtatgagaacttttatgccgatttcggtcctctgaacctggcaatggtctaccgctattgctgtaaaatcaacaaaaaattaaagtcaatcaccatgctgagaaaaaaaatagtccatttcacaggaagtgaccagcgtaagcaagctaacgccgctttcttagtgggctgctacatggtcatctaccttgggagaactccagaggaggcctacaggattctcatctttggcgagacgtcttatatacccttccgcgacgctgcttacggatcttgcaatttctacattaccctccttgattgcttccacgcggtcaagaaggccatgcagtacggttttctaaacttcaatagcttcaatctggatgagtatgaacattacgagaaagccgaaaacggggacctcaactggattataccggaccgctttatagcgttttgtggtcctcactctagggcccggctggaatcgggttaccaccagcatagccctgaaacttacattcagtacttcaaaaaccataacgttaccacgattataagactcaacaagcgcatgtatgacgcgaagagatttacggatgctggcttcgatcatcacgacctttttttcgcagacggtagcaccccaactgatgcaattgtaaaagagttcctcgatatatgcgaaaacgccgaaggcgccattgcagtccattgcaaggccgggctcgggagaactggcaccctaatcgcctgttatattatgaaacattatcgtatgaccgccgccgagaccattgcttgggttcgaatttgtagaccaggcagcgtgataggtccccagcaacagttcctggtcatgaaacagaccaacctttggctggaaggtgactattttcgccagaagctgaaaggacaagagaacggacagcacagagccgcctttagcaagctcctctcaggggtagatgacatctccataaatggcgtagagaatcaagaccagcaggaacccgaaccctactctgatgacgatgagattaatggagtcacacaaggggacagactgagggcgctgaagtcccgcaggcagtcaaagacaaacgccattccgctgacagtcatcctgcagtcctctgttcagtcttgtaagacttcagagcctaatatctccgggtctgcgggtatcactaaacgtacgactaggtcagcaagtcgcaagagcagcgtgaaatctctgagtatctctcgcaccaaaaccgtactgaggtag

SEQ ID NO: 182279 - DNA, 1386 bp, Artificial Sequence
  Description of Artificial Sequence: Synthetic coding sequence
atgagccgggagggcgccggcgccgccctggtggccgaggtgatcaaggaccgtttatgctttgcaattctgtacagtcggcccaagtcagctagcaacgtacattatttttccattgacaatgaactcgagtatgaaaatttttatgctgatttcggcccattaaatctggccatggtttaccgttattgttgtaagataaataaaaagctgaagagcattactatgcttaggaaaaagatcgttcattttacagggtcggatcagcgaaagcaggccaatgcagcattcttggtgggctgctatatggtgatctacctaggtcggacaccggaggaagcgtatcgaattttgatattcggcgagacatcctacatcccgttcagagatgccgcttacgggagttgtaatttctacataaccctgctcgactgcttccacgcagtgaaaaaggccatgcagtacgggttcctgaacttcaactcattcaatctggatgagtatgaacactacgagaaagcagaaaatggagacttgaattggatcatccctgatcgatttattgccttttgcggtccccactcccgcgcaagattggagtccggataccaccagcactcacctgagacctacatacagtattttaagaaccataatgtgaccacgattatacgcctcaataagagaatgtatgatgcaaagcggtttacagacgcgggtttcgaccatcacgatctgtttttcgccgacgggagcacaccaacagacgccatcgtcaaggagttcttagatatctgcgagaatgcagagggggcaattgcggtgcattgcaaggcagggctgggacgcacagggacgctgatcgcgtgctatattatgaaacattacagaatgacggccgccgaaaccatagcttgggtgcgcatatgcagacctggatccgtcattgggccccagcagcagttcttggtgatgaagcaaactaatctgtggctcgagggagactatttccggcagaaactaaaaggtcaggaaaacgggcagcatcgggctgcgtttagtaagctcctctcgggggttgacgacatctcgattaatggcgtcgagaaccaggatcagcaggaacctgaaccctattcagacgatgatgagatcaatggagtgacacagggggacaggctccgcgcactgaagagtcgccgccagagtaaaacaaacgcaatcccccttacagtgatcctgcagtcttctgtacaaagctgcaaaaccagtgagcctaacatttccgggtccgccgggatcacgaagaggacgacacgaagcgcaagccgtaagtcaagcgtgaaatctctgagtatctcccgaaccaagacggtgttgcggtag

SEQ ID NO: 182280 - DNA, 1458 bp, Artificial Sequence
  Description of Artificial Sequence: Synthetic coding sequence
atgaagcggaagagcgagcggcggagcagctgggccgccgcccccccatgttcacggcgctgctcctccacttctcctggagtcaagaaaattcgtagctctactcaacaggacccgcgcaggcgggatccccaggacgatgtttacctagacattactgaccgtttgtgttttgctatattatacagccggcctaagtcagcttcaaatgttcattactttagcattgataatgagcttgaatatgaaaatttttacgccgacttcggtccgcttaacctggctatggtgtatcggtactgttgtaaaatcaacaagaagctgaagagtataacaatgctcaggaaaaaaatagtgcactttacgggctcagaccagaggaagcaagctaatgccgcatttttggtcgggtgttacatggtgatctacctcggccgaacccctgaagaggcataccgcatcctcatatttggagagacctcctacattccttttagagatgcagcctacgggagttgcaatttttacatcacgctgcttgactgtttccatgccgtcaagaaggcaatgcagtacggatttctgaatttcaattcattcaacctcgatgagtatgagcactacgagaaagcagagaacggggacttgaactggatcatccccgacagattcattgctttctgtggaccccactccagggctagactggaatctgggtaccatcaacattccccggaaacttacatacaatattttaagaaccataacgttaccaccatcataagattgaataagcgcatgtacgatgccaagcgttttactgacgctggatttgatcatcatgaccttttctttgctgatggatctactcccacagatgctattgtgaaggagttcctagatatttgtgagaacgcagagggggccattgcagttcattgtaaagccgggctggggcggaccggcacgttaatagcatgttatatcatgaagcattatcggatgaccgccgcagaaaccattgcttgggtgaggatctgtcggcccgggtcagtgattgggccacagcagcagttcttggttatgaaacagactaacctctggttggagggagactatttccgacagaagctgaaggggcaggagaatggacagcaccgagcagccttttcaaaactgctctccggagtcgacgacatcagcataaatggcgtggaaaatcaagaccaacaggagccggagccgtattctgatgacgacgaaatcaatggagtgactcagggcgacaggctccgtgccctcaagtcccggcgacagtccaagacaaatgcaatccctctcacatgtccgttggctgtccttaccagtgcgctttgtagcgtggtcatctggtggattgtttgtgactatatactgcctatccttctgttttgtctcgatggattcaggacccagtag

SEQ ID NO: 182281 - DNA, 5346 bp, Artificial Sequence
  Description of Artificial Sequence: Synthetic coding sequence
atgagcggcgaggtgcggctgcggcagctggagcagttcatcctggacggccccgcacaaactaacgggcagtgcttcagtgtagagactttgcttgatatattaatctgcttatacgacgaatgtaacaactcaccattgaggagggagaaaaatatcctggaatatctggagtgggcgaagccatttacttcaaaagtgaagcagatgagactccaccgcgaggactttgagattctaaaggttataggcaggggggccttcggcgaggtcgctgtagtaaagctgaaaaacgccgataaagtttttgccatgaagattctgaacaagtgggaaatgctcaagagagctgaaacggcctgttttcgggaagagcgcgacgtgttggtcaacggggataacaagtggatcaccacactgcactatgcttttcaggacgataacaacctctatttagtgatggactactacgtgggcggggacctgctgacgctgctgtcaaagttcgaggataggctacccgaggacatggcccggttctatctcgctgagatggttattgcaattgatagcgtacatcagctacattacgtacacagagacataaaaccagacaatatacttatggacatgaacggtcatattcgtttggctgactttggctcatgtctcaagctgatggaagacgggactgtgcagtccagcgtggcagtgggcacaccagactacatttccccagaaatccttcaggccatggaggatggtaaggggcgctatggaccagaatgtgattggtggtctctgggggtgtgcatgtacgaaatgctctatggggagactcctttctatgccgaatccctcgtcgaaacctacgggaagatcatgaaccataaagaacgcttccagttccctgcacaggttacggacgtgagcgagaatgcgaaggatctaattcgaagactgatctgttcaagagagcaccggctcggccagaatgggatcgaggactttaagaagcatccattcttcagcgggatcgattgggacaacattcggaattgtgaggccccgtacatccccgaggtttcctcccccacggatacctccaattttgatgtggacgatgattgtttgaagaactccgaaacaatgccaccaccaacccacacggcattctccggccatcatctgccgtttgtgggatttacctatacaagcagctgtgtgttgagcgataggagctgtttgagagtgacagccggcccaacctctctcgacttagatgtaaatgtccagcgcacattggacaataatctggccaccgaagcatatgaaagacgtatcaaacgactagaacaggagaaactggagctgagtcgcaagttgcaggaatctacccagactgtgcaggccttacagtattccaccgtagatggtccgttgacagcaagtaaagacttggagatcaagaacctcaaggaggaaatagagaagctgagaaagcaggtgacagagtccagccaccttgagcaacagctcgaagaggcgaacgctgtgagacaggagctcgacgacgctttccgccaaattaaggcgtacgagaaacaaattaaaacgctgcagcaggaacgcgaggaccttaataaggagcttgtgcaggcgtccgagcgtctgaaaaatcagtcgaaggagctgaaagatgcacattgtcagagaaaattggctatgcaagaatttatggagatcaacgaacgccttactgaactccacacgcagaagcagaaactggcccgtcatgtgcgtgacaaggaggaggaagtggatcttgtgatgcagaaagtagaatctctcagacaagaactgcggcgtaccgagagggcaaagaaagaactggaagtgcataccgaagctctggccgccgaagccagcaaagatcgcaagctacgagagcagtctgaacactatagcaagcagttagagaatgagctggagggactgaaacagaaacagatcagctactcaccgggtgtgtgttctatcgaacaccagcaggagataaccaagctgaagacagatttggaaaaaaagtctatcttttatgaagaagagctctccaaacgtgaagggattcacgccaacgagataaaaaatcttaaaaaggaactgcatgattcagagggtcagcagcttgctttaaataaagagattatgatcctgaaagacaagctcgagaagactcgccgtgagtcccagtctgagcgggaggaatttgagagcgagtttaaacagcaatatgagagggagaaggttctcctgacagaggagaacaaaaaactaacctccgagctagataaactgacaacgttgtacgagaatcttagtatccacaaccagcagctggaggaggaggtgaaggatttggcggacaagaaggaaagcgtggcccactgggaagcccaaatcaccgagatcatccaatgggtgtctgacgagaaggacgcccgtgggtatctgcaggcactcgcatctaaaatgacagaagagctggaagctctgcgaaattcctcattaggtactagggctacagatatgccctggaaaatgcgccggtttgccaaactcgacatgtcagcacgcctggagctgcagagtgccttggatgctgagatcagggccaagcaggcgatccaggaagaactcaataaagtgaaagcgagcaacattatcaccgagtgcaagcttaaggattctgaaaagaaaaatctcgagctcttgagtgaaattgagcaactcatcaaagacacagaagagttacggtcagaaaagggcattgaacatcaggatagtcagcatagtttcctagcctttctgaatactcctactgatgccctggaccagtttgagaccgttgattccactcccctctctgtgcacacccccacccttcggaaaaaaggctgcccaggatctacaggatttcctccaaaacggaaaacgcaccaattcttcgttaaatctttcacaacaccaaccaaatgtcaccagtgcacttctttgatggtgggactcattcgtcaaggctgcagctgtgaagtgtgtggtttttcctgtcatatcacatgtgtgaacaaagcccccacaacatgccctgtgccgcctgagcagacgaagggccctcttggaatcgaccctcagaaagggattggcactgcctacgaaggacatgtgcgtatcccgaagccagctggcgttaaaaaggggtggcagcgggccctggcgattgtctgtgactttaagttgtttctgtacgacatagccgagggcaaagccagtcagccttctgtagtgatttcccaggtgattgatatgagggacgaggagttcagcgtgtcaagtgtgctggcctccgacgttatccacgcctcccgaaaagacatcccatgcatcttccgcgttacagcctcgcagctgtcagccagcaataataaatgctctattctgatgctggccgacactgagaatgaaaaaaacaagtgggtgggcgtgctttctgagctgcacaagatcttgaaaaagaataagtttagagaccgcagcgtgtacgtgcctaaagaggcttacgatagcactttgcctctaatcaagaccacgcaagctgctgcaataattgatcacgagcgcatagcactaggaaatgaagaaggactgttcgtggtgcacgtaactaaagacgagataattcgcgtaggggacaataaaaagatccaccaaatagaactgatccctaacgatcagcttgtagccgtcatttctgggcggaatagacatgtcagactgttccccatgagtgccctggacgggagggagacagatttttataagctgagtgaaaccaagggctgccaaactgttacgtctggcaaggttcggcacggagctcttacttgtttgtgcgtggctatgaaacgacaagtgttatgctatgagctgttccagagcaaaacacggcaccggaagtttaaggaaattcaagtaccgtataatgttcagtggatggcgatcttctctgaacagctatgtgtagggtttcagtctgggttcctgaggtatccccttaatggagaaggtaatccatacagcatgttgcactcgaacgaccatacactgtccttcattgctcaccagccaatggatgcaatctgtgcagttgagatttcatctaaagagtacttgctgtgctttaactctatcgggatctacacagattgtcaaggcaggcgctcaagacagcaagagctcatgtggcctgccaatccctctagctgttgttataatgccccatatctttcagtctattccgagaatgccgtcgacattttcgacgttaacagtatggagtggatccaaaccctgccgctcaaaaaggtccgccctcttaataacgagggcagtctcaatttgctgggcctcgagaccattcgattgatctatttcaaaaataagatggctgagggcgacgaattggttgtcccagagaccagtgataattctcgtaagcagatggtccgtaacatcaataacaagcgtcgctattctttccgagtacctgaagaagaacgaatgcaacaaagacgcgagatgctcagggaccctgaaatgcggaacaagttgatatctaatccaactaacttcaatcacattgcccatatgggaccaggagacggcattcaaatcttgaaagatctgcccatgccggggttcccgtatcctagcccccatcatcacagtggcttaatttcctcccctattaacttcgagcatatctaccacatgaccgtgaactcagccgaaaagttcctatcacctgactccatcaatcccgaatattcacctagcctgagatctgtgcctggcaccccgtccttcatgaccctgagaaatccccgacctcaggaatctcgtacagtctttagcggtagtgtgtctatcccttcaattaccaagtctcgcccggaacctggacgatccatgagcgcatcctcgggcctgagtgcacgctcttccgcccagaacggcagcgcacttaaacgcgaattctcaggaggcagctattctgcgaaaagacagccaatgccaagtccatcagagggctcgctgagttcaggggggatggaccaggggagcgatgcccctgctagggatttcgatggggaagattctgattcacctcggcattcaacagcgagtaacagtagcaatctcagctcgccaccaagccccgcctcaccacgaaagaccaagagtctttccctcgaatccactgatcgcgggtcttgggacccatag

SEQ ID NO: 182282 - DNA, 2457 bp, Artificial Sequence
  Description of Artificial Sequence: Synthetic coding sequence
atgatcctgaaggacaagctggagaagacccggcgggagagccagagcgaacgggaagaatttgagtctgagtttaagcagcaatacgagcgtgagaaggtgcttctcacagaagaaaataagaaactcacttctgagcttgacaaattaacaacattatacgagaatctttccattcacaaccaacagctcgaagaggaagtcaaggatctggccgacaagaaggagagcgttgcacattgggaagcacagataacggagatcatccaatgggtgtccgacgagaaggatgcccgcggatatcttcaggcattagccagcaagatgaccgaggagctcgaggccctgcggaattcctcgttggggaccagagccactgatatgccctggaagatgcggagatttgccaagttagacatgagtgcccggcttgagcttcagtcagcactggacgccgagatccgagcgaaacaggccattcaggaagagctgaacaaggtgaaagcaagtaacattatcactgaatgcaagttaaaggactcagagaagaagaatttggaacttttatcagagatcgagcagttgatcaaagataccgaggagcttcgaagtgagaaaggcattgaacatcaagattcccagcattctttcttagcattcctaaacacaccgacggacgctctcgatcagtttgaggactctttcagttcttcgagctctagcctgattgatttcctggatgataccgatccagtggaaaatacgtacgtctggaatccgagtgttaagttccatatccagtcccgttcaacttcccccagcacttctagcgaagcagaacctgtgaagacagtggactccacacccttaagtgtgcatactcctaccttgcggaagaagggatgcccaggcagtacgggattccctcctaaacgaaagacacatcagttctttgtcaagtcctttactactccaactaagtgtcaccaatgtaccagcctgatggtggggctgatcaggcagggctgcagttgcgaagtgtgtgggtttagctgccatattacatgtgtgaacaaggcaccgacgacatgtccagtgccaccagagcagacaaaaggtcccctgggtatcgaccctcaaaaaggcattggaacagcctatgagggacacgtgcgaatcccgaaacctgccggcgtcaaaaaaggctggcagagggccttggctattgtgtgtgattttaaactctttctgtatgacattgccgagggcaaagcttcccagccatctgtggtgatcagccaggtaatagatatgagagacgaagaattcagtgtgagctcagtcctcgcttctgacgtgattcacgctagtagaaaggatataccttgtatatttcgagtcactgcctcacagctctctgcctccaataacaaatgtagcatactgatgctggcggatactgaaaatgagaaaaacaagtgggtgggcgtcctgagcgaactgcacaaaattctgaagaaaaataaatttcgggatagatcagtatacgtgccgaaggaagcctacgactcaactctcccgttgatcaagaccactcaagcggccgcaatcattgatcacgagaggattgccctcggcaacgaagaagggctgttcgttgtgcacgtgacaaaggatgaaatcattcgggtgggcgacaataagaagatccaccaaatcgagctgatcccgaatgatcaactggttgccgtcatctctggcagaaatcgacacgtgaggctttttccaatgtcagccctggatggcagagaaaccgacttctataagctgtccgagacaaaaggatgtcagaccgtgacgtcaggaaaggtccgtcatggcgcactcacatgcctgtgtgtggccatgaaacggcaggttttgtgctacgagctctttcagtctaaaacccgacatcgaaaattcaaagagattcaggtgccctataacgtccagtggatggccattttctctgaacagttgtgcgtaggattccagtcaggattcctgaggtatccattgaatggggaaggcaacccctacagcatgctccatagtaacgaccacacgctcagtttcattgcccatcagcccatggacgctatttgcgccgtagagatttcctctaaagagtacctgttgtgctttaatagcatcggaatttacaccgattgtcagggacgcagatccagacagcaggagcttatgtggccagccaacccctcttcttgctgctataacgccccttacctgtctgtgtactccgaaaatgctgtggacatcttcgacgtaaattcgatggagtggatacagaccctacccctgaagaaagtgaggccattgaacaatgagggaagtttgaacctcctggggctagaaactattcggttgatatattttaaaaataaaatggcttag

SEQ ID NO: 182283 - DNA, 5076 bp, Artificial Sequence
  Description of Artificial Sequence: Synthetic coding sequence
atgagcggcgaggtgcggctgcggcagctggagcagttcatcctggacggacccgctcagactaatggacaatgtttttccgtggagacacttctggacatcctgatatgtttgtatgatgaatgtaataattcacccctgcgccgggagaaaaacatcttagagtatttagaatgggcgaagcccttcacctcaaaggtgaaacaaatgcgactgcacagagaggattttgaaattctcaaggtcataggacgtggcgcttttggcgaggttgccgtggtgaagttgaaaaatgccgacaaggtctttgccatgaaaatccttaacaagtgggaaatgcttaaacgtgcggaaaccgcctgttttcgagaagaaagggatgtccttgtcaatggggataataagtggatcacgacactgcactacgcctttcaagacgacaataatttgtacctcgtgatggattactatgtgggcggcgacttgctgacactcttgtcgaagtttgaagatagactgcccgaggatatggctaggttctacctggctgagatggtgatagccattgattctgtccaccagctgcattatgttcaccgcgatataaagccggacaatatactcatggatatgaatgggcacatccggttggctgattttgggagttgccttaagctgatggaagacggtaccgttcagagcagcgtggcagtgggaacacctgattacataagtcccgaaattctccaggccatggaagatggcaagggccgatatggccctgagtgcgactggtggtccttaggagtatgtatgtacgagatgctgtacggggaaacccctttctacgccgaaagtttggtggagacgtacgggaaaatcatgaaccataaagagcgatttcagttcccagcacaggttacggacgtttctgagaacgcaaaggatctgattcgtcgcttgatctgctctcgcgagcacagactcggtcagaatggaatcgaggatttcaaaaagcatcccttcttctccggcattgactgggataacattagaaactgtgaggccccatacattcctgaggtgtcctcgcccacagatacaagtaactttgacgtggatgatgattgcttgaagaactcagaaactatgcctcctcccacccacacggctttctccggtcaccacctcccctttgtgggctttacgtacacatcttcctgcgtgctctctgaccggtcttgcctccgagtcacagcgggccccacctcgctggacctggacgtgaacgtgcaaaggacccttgataacaatcttgccacagaagcatatgagagacggattaaaagactagagcaagagaagctggaactcagccggaaactgcaggaaagcacccagactgtccaggcactgcagtattccacagtagatggccccctaacagctagcaaggacctggaaataaaaaacctcaaggaggagatcgagaaattgaggaagcaagtgacggaatcctcccatctcgagcagcagttggaggaagcaaatgccgtgcgtcaggagcttgacgatgcattccgtcaaatcaaggcctatgagaagcagatcaaaactctccagcaggagcgcgaggatctgaataaagagctagttcaagcaagcgaaagactgaagaaccagtcgaaagaacttaaagacgcccattgccagcgcaaattggccatgcaagaatttatggaaattaacgaaagactgactgagctgcacacacagaagcagaagctcgcacgacacgtgcgagataaggaagaggaggtggatctggtgatgcaaaaggtggagagcttgcggcaggaactgcggaggactgagcgagccaaaaaggagttggaggtgcatacagaagcactggctgccgaggcctccaaggaccggaagctcagggaacaatctgagcactacagcaagcagttagagaacgagctagagggtctgaaacagaaacaaataagttatagtccaggggtgtgttcaattgagcaccagcaggagattacaaagttgaaaacggacctggaaaaaaagtccatcttctatgaggaagaactgagcaagcgggagggaatacacgccaacgagatcaagaacctgaaaaaagagctgcatgactccgagggacaacagcttgcactgaataaggaaattatgatcctgaaagacaagctggaaaaaacgagacgagagagtcagagcgagagggaggagttcgagtctgagtttaagcagcagtatgaacgcgaaaaagtgctgttgacggaggagaacaagaagcttacttctgaactggataagctcacgaccctctacgaaaatttatccatccacaatcagcaacttgaggaggaggttaaggacctagccgacaagaaggagtcggttgcccattgggaagcacagattactgagataatccaatgggtgtcagatgaaaaagatgctcgggggtacctccaggctcttgcatcgaagatgactgaagagctggaggccttaaggaatagctctcttgggacacgcgccactgatatgccctggaagatgcgaaggttcgccaaactcgacatgtctgctaggttggaactgcaaagcgccctcgacgccgagatccgcgcgaagcaggctatacaggaagagctgaataaagtgaaagcatctaacatcatcaccgagtgcaagttgaaggactcagagaagaagaatttagagctgctgtctgaaattgagcagctcataaaggacaccgaggaactcagaagtgagaagggaatagaacaccaggattcccagcattctttcttggcttttttgaatactccaaccgacgccttggatcaatttgaacgcaagacccaccagttcttcgttaaatcctttacaactcccacgaagtgccatcaatgtacaagcctgatggtggggctcatcaggcagggatgctcatgtgaagtgtgcggcttcagctgccacataacttgcgtgaacaaagcacctaccacctgcccagttcctcccgagcaaacaaagggacccctaggaatcgacccccagaaaggaatcgggacagcatatgaggggcacgtccggatccccaagcccgccggtgtgaagaaaggctggcaacgtgcgttggccatcgtttgcgacttcaagttatttctgtacgatattgccgagggtaaagcctcacagccaagtgtggtgataagccaagttatagacatgcgcgacgaagaattctccgtctcctcagtgctggccagtgatgtgatccacgccagtcgaaaagatatcccttgcatttttcgagtgactgctagccagctcagcgccagtaacaataagtgtagcattctcatgctggcagataccgagaacgagaagaataaatgggtgggagtcctgagtgaactccataaaatcctgaagaagaacaagttcagagatcggtcagtgtacgtgcccaaagaggcatatgactcgacactgccattgatcaagaccacgcaagccgccgctatcatcgatcatgagcggatcgccctcgggaacgaggaaggcctgttcgtcgtccacgtgactaaggacgaaatcataagggtcggagacaacaagaaaatccaccagatagagcttatcccgaatgatcagctggtcgcggtcatcagtggacgaaaccgccacgttcgcctgtttccaatgtccgccctagacgggcgagaaactgatttttacaaactttcagaaacgaaggggtgtcagaccgtcacctctggaaaagtgagacatggagctctgacttgcctgtgcgttgctatgaagcgtcaggtgctctgttatgagctttttcagagcaagacccggcaccgcaaattcaaagaaatccaagtgccctataacgtgcaatggatggctatttttagcgagcagctctgcgtaggattccaatcaggattcctcaggtatccccttaacggtgaaggcaatccttactccatgctccacagcaatgatcatactctctcttttattgcacaccagcctatggacgcgatctgtgcagtcgaaatttcttctaaggagtacttactgtgctttaacagtattgggatatacactgactgtcagggacgacggtcgcgccagcaggaactgatgtggccagccaatccctcgtcctgctgttacaacgccccctacctgtctgtgtactcagagaacgccgttgacatcttcgacgtcaattccatggaatggattcaaactctgcccctgaagaaggtgcgacccctgaacaacgaggggagtctgaacctgctcggcctcgagactattagactgatctatttcaaaaacaagatggctgagggcgacgagttggttgtgccggagaccagtgacaactctaggaagcagatggtccgtaatattaacaacaaacggcggtattcttttcgcgtccctgaagaggaacgcatgcagcaacggagagaaatgcttcgagatcccgagatgcggaacaaactcatatcaaaccccaccaattttaaccatatcgcccatatgggccccggggatggaatccaaatcctgaaggaccttcccatgaacccacggccacaggagagccgcaccgtgttttcgggttccgtgagcatcccgtccataacaaagagccggcccgagccaggcagatcaatgtctgcttcttcagggttgtctgccaggtcctctgcccagaatggcagcgctctgaaaagagaattctctgggggatcgtattccgccaagcgacaacccatgcccagtcctagcgagggcagcctctcatctggaggtatggatcaagggtcagatgcccctgctagagacttcgatggtgaggactcagactctcccagacactccaccgcatccaacagcagtaatcttagtagcccacctagcccagctagcccgaggaaaaccaaaagtctgagcctggaaagtaccgaccgcggcagttgggacccatag

SEQ ID NO: 182284 - DNA, 5199 bp, Artificial Sequence
  Description of Artificial Sequence: Synthetic coding sequence
atgagcggcgaggtgcggctgcggcagctggagcagttcatcctggatggacccgcacagacaaacgggcagtgctttagcgtcgaaacattgctagatatcttaatttgcttatacgacgagtgtaacaattctcctctccgccgggaaaaaaacattctggaatatctcgagtgggccaagccctttacctctaaggtcaagcagatgaggctgcatcgggaagatttcgaaatcctgaaggtcatcgggagaggcgctttcggtgaggttgccgttgtgaagctcaagaacgctgataaggtgttcgctatgaagatcctcaataagtgggagatgctaaagagggctgagaccgcttgttttagagaagagagagatgtgctggtgaacggggacaataagtggataaccaccctacactacgctttccaggatgacaacaatttatacctggtgatggattactatgtcgggggggacctgttgactttactgagtaagttcgaagacagactgcctgaggatatggccaggttttacctcgccgaaatggtcatcgccattgattcagtgcatcagctccactacgtgcaccgtgatatcaagcctgacaatattttgatggacatgaacggccatattcggctcgctgattttggatcatgtctgaagttaatggaagatggaactgtgcagtcttcagtcgctgtcggtacccccgattacataagccccgagattctccaggccatggaggatggaaaaggcagatacggcccggagtgcgattggtggtccctaggagtgtgcatgtatgagatgctgtacggcgaaacgcctttttacgcggagtctttagtggagacatacggcaaaatcatgaaccacaaggaaagattccagtttccagcccaggtcaccgatgtgtccgaaaacgccaaagatttgatcaggcgtttgatctgcagccgagagcatcgactcgggcagaatggaatcgaagactttaaaaagcaccccttcttctctggtattgattgggataacattaggaattgtgaggctccttacatccccgaggtgtccagtccaacagatacctctaacttcgatgtagacgatgattgtctcaaaaacagcgagaccatgcccccaccaactcacaccgcttttagcggccatcacctgccattcgttggctttacctacactagctcttgtgtgctgtcagacagatcctgccttagggtaaccgctggaccaacatccctggacctcgatgtcaacgtgcaaagaacactggataacaacctggcaactgaggcatacgagaggagaatcaagaggctagagcaggagaagcttgaattgagccgaaagctccaggaatccacgcaaacagtacaggcgcttcagtatagcaccgtggatggcccactcacagctagcaaggatttagaaatcaagaatctcaaggaagaaatagagaaactaaggaagcaggtaaccgagtcctcacacctggaacagcagctggaggaagccaacgcagtacgtcaggaactggatgacgctttccggcagatcaaggcgtacgagaaacagataaaaaccttacaacaggaacgcgaggatttgaataaggaattggtgcaggctagcgagcgactgaagaaccagagcaaggaattgaaggatgctcactgccagagaaaattagctatgcaggaatttatggagattaatgagcgacttacagagctgcatacccagaagcagaaactcgcacgccatgttcgggacaaggaggaggaggttgatctggttatgcaaaaggtggagtctcttcggcaggagcttcgaagaactgagcgagctaaaaaggaactagaagttcataccgaggctctggccgccgaagcatccaaggatcgcaagcttagggaacagagcgagcactactcaaaacagttggagaatgagttagaagggctgaagcagaagcagatcagctacagccctggagtgtgtagcattgagcaccaacaggagatcaccaaactcaagaccgacctggagaaaaagagtatcttttacgaggaagagctgagtaaacgggaaggaattcacgcgaatgagataaagaatctcaaaaaagaacttcacgacagtgaaggtcaacaactggcacttaataaggaaatcatgattctaaaggacaagctcgagaagacacggcgtgagtcacagtcagaaagggaggaattcgagtccgagttcaagcaacagtatgagagagaaaaggtactgctgactgaagagaacaaaaagctcacaagcgaactcgataagctgaccaccttgtatgaaaacctgtccatacataaccagcagctcgaagaggaggtaaaggacctagcagataaaaaggagtctgtggcgcactgggaggcccagatcacggagattatccagtgggtcagtgatgaaaaagacgctcgggggtatctgcaggcactggcctcaaagatgaccgaggagttggaggcactccgcaattcgagcctggggacaagagcaacagacatgccttggaaaatgaggaggttcgccaagcttgatatgtccgctcgactcgaactgcagtctgctctggatgctgagattcgggccaagcaggctatccaggaggaactcaataaggtgaaggccagtaacattattacagaatgtaagcttaaggattccgagaaaaaaaacctggaactcctgtctgagatcgaacagttaattaaggacaccgaggagctgcgaagtgaaaaggggatcgaacatcaagactcccaacattccttcttagctttcctcaacactcccacggacgcacttgaccagtttgaacggtcaccgtcatgtacaccagcctccaagggcaggcgcactgtcgactccacgccactatctgtacatactccgaccttgcgcaaaaagggctgccctggctcaactggatttccacctaaacggaaaactcaccagttttttgtcaagtcctttacaacccctacgaagtgccaccagtgcacctccctgatggtgggcctgatacgccaaggctgcagctgcgaagtgtgtggcttctcttgtcatataacatgtgtgaataaggcaccgactacctgtcccgtccctccagagcagaccaaaggccctcttgggatcgatccacaaaagggtattggaacagcttatgaagggcatgtgcgaatcccgaagcctgcaggcgtaaagaaggggtggcagcgggccctggctatcgtgtgtgacttcaaactatttctctatgatatcgctgaaggtaaagcctcacaaccatcggtagtgatctctcaggtcatcgatatgcgcgatgaagagtttagcgtgtcatcagtgcttgcctccgatgtcattcacgcaagccgtaaagacattccgtgcattttccgcgtcactgcctctcagctgagcgccagtaataataagtgctctattctcatgctggccgataccgaaaacgaaaagaacaagtgggtgggagtgctgtcagagctacataaaatactgaagaaaaataaattccgcgaccggtctgtctatgtacccaaggaagcttatgactccactctccctctgataaagaccacccaagccgcagccatcatcgaccatgaacgcattgccctaggcaacgaggagggcctgttcgtggttcacgtaaccaaggatgagataatccgagttggcgataataagaaaatccaccaaatcgaactaatccccaatgaccagttagtggctgtgataagtggaagaaatagacatgtgcggttgtttccaatgagcgcgctggatggacgagaaactgacttctacaagctttcagagaccaagggatgccagaccgtcacgtctgggaaggtccgccacggcgccctgacttgcctgtgtgtcgcaatgaagaggcaagtgctctgttatgagttgttccagagtaagactaggcaccggaagtttaaggagatacaggtgccctacaatgtgcagtggatggctatcttcagcgaacaattgtgcgtagggttccagtccggtttcctcagatatccactgaacggcgaaggcaacccatactccatgctacattcgaacgatcacacattatcctttatagcgcaccagcccatggatgctatttgcgctgttgaaatctcttcgaaagagtacctcctgtgctttaatagcataggtatctacaccgattgccagggccgcagaagtaggcaacaagagttaatgtggccagccaacccaagctcctgctgctacaacgccccctatctgtccgtgtattctgaaaatgcagtagacatttttgatgttaatagcatggagtggatccagactcttccccttaagaaagtgcgacctctcaataacgagggctccttgaatctgttaggtcttgaaactataagattgatttacttcaaaaataagatggctgagggggacgaattagttgtgccggagacatcagataatagtcgaaagcagatggtgcggaatatcaacaataagaggaggtacagcttcagggtccctgaagaggaaaggatgcagcagcgaagagagatgttgagagaccccgagatgcgcaacaagttaatcagtaatcccactaactttaatcatatagctcacatgggcccaggcgacggtattcagatactgaaggacctgcccatgaacccaagaccgcaggagagccggacggtgtttagtggctccgtatcgattcccagcatcaccaagtccagacccgagccgggccgcagcatgtccgcctctagtggcctcagcgcacgttccagcgcacagaacggttccgccctgaagcgcgagtttagtggcgggagctacagcgccaagcggcagcccatgccttctccctctgagggatctctgagctctgggggcatggaccagggttccgatgcaccagcacgggactttgacggcgaggactctgatagccctaggcattccactgcatcaaattcaagtaatctttcgtctccgcctagcccagcttccccaaggaagacaaaaagcctgagcctagagagcaccgaccgtggcagctgggatccttag

SEQ ID NO: 182285 - DNA, 5265 bp, Artificial Sequence
  Description of Artificial Sequence: Synthetic coding sequence
atgagcggcgaggtgcggctgcggcagctggagcagttcatcctggatgggccggcacagacaaacggacagtgcttttctgttgagaccctgctggatattcttatttgcctctatgatgaatgtaacaacagccctctcagaagggagaaaaacatattagagtatttagagtgggcaaagccctttaccagtaaagtaaagcagatgagactgcacagagaggatttcgaaatactgaaggtgattgggagaggtgcattcggggaggtagccgtggtaaagctcaagaacgctgacaaggtgtttgctatgaagattctgaacaaatgggagatgctgaagcgagctgagacagcttgtttccgcgaggaaagggatgtgttagtgaacggcgataacaagtggattacgacactgcactacgcttttcaggacgataataatttgtatctcgttatggactattacgtgggtggagatctgctgacactgctgagtaagttcgaagataggctgcccgaggacatggccagattctacctggcagagatggtcatcgccatcgactccgtgcatcagctccactacgtacaccgggacatcaagccagataatatcctaatggacatgaatggccatattcggctggctgacttcggaagttgtttgaagctgatggaggatggaactgttcaatctagtgtagccgtggggacccccgattacatcagcccagagatcttacaggctatggaggatggcaaaggaaggtacgggcccgaatgtgactggtggtctctgggcgtatgcatgtacgaaatgctgtacggcgagacccccttttacgcggagtccctggttgagacttatggcaagatcatgaatcacaaggagcgatttcaatttcccgcccaggttacggatgtttctgaaaacgcaaaggacctgatacgacgcctgatatgctccagggagcatcgcctagggcaaaatggaattgaagatttcaaaaagcatcccttcttctcggggatagattgggacaacatcagaaattgtgaagcgccatatattcccgaggtgtcgtcccccaccgacacctccaacttcgatgtcgatgacgactgcttgaaaaactctgaaacaatgcctccacctactcataccgccttctccgggcaccatttaccatttgtggggtttacctatactagttcttgtgtgctaagtgatcgtagctgcttaagggtgaccgccggacccacatccctggatttggatgtgaacgtgcagcgcactttggataacaatcttgcgaccgaagcatatgaaagacgaatcaagagactggaacaggagaagcttgagctgagccgaaaacttcaggaatccactcagaccgtgcaagccctccagtactcaactgtggacgggcccttgaccgcgtcaaaggatctggagatcaaaaacctgaaggaagagatcgagaaactccggaaacaggtgacagagtctagccatctcgagcagcagttggaggaggctaacgcagtgcgccaggagctggatgacgcctttcgccagattaaagcgtacgaaaaacagatcaagacactgcagcaagaacgagaagacctgaacaaggagctggttcaggctagtgagaggctgaaaaatcaaagcaaggagctcaaagacgcacactgccagaggaagttggcaatgcaggagtttatggaaattaatgagaggttgacagagctccacacccagaaacagaaactcgctagacatgtgcgggataaagaggaggaagtggaccttgtgatgcagaaggtggagtccttgaggcaggagctaagaagaacggagagagcaaagaaagagctcgaagtgcatacagaagccctggctgcggaggcctccaaagacagaaaactgcgcgaacaatcggagcattatagtaaacagcttgagaacgaactggagggcctgaagcagaagcaaatctcctacagcccaggagtatgctccattgagcaccagcaagaaatcaccaaactcaagacggacttggagaagaaatcaatcttctacgaggaagagcttagcaaaagggaaggaatacatgctaatgagataaagaatctgaaaaaggaattgcacgactccgaaggccagcagctggctcttaataaggagatcatgattctcaaggataagttggagaagacccgcagggagtcccagtcggagcgggaagaatttgaatccgaatttaagcagcagtatgaacgcgaaaaggtcctgctgacagaggagaacaagaagcttaccagtgaactcgacaagctgactacgctctacgaaaacttgtctatccacaatcagcagctcgaggaagaagtgaaggatctggcagacaaaaaagagagtgtagcccactgggaagcccagataaccgaaataatccagtgggtgtcagatgagaaagacgcgcgaggatatctgcaggccctggcttccaagatgactgaagaactggaagcgttgcggaactcatccctgggaacaagagcgaccgacatgccatggaagatgcggaggtttgctaagcttgatatgtccgcacggctggaacttcagagcgccctagacgctgagataagggccaagcaggccatccaggaggagctgaacaaagtcaaagccagcaacatcataactgaatgcaagttgaaggatagcgagaaaaaaaacttggagttgctcagtgagatagagcagttaatcaaggataccgaggagctgcggagcgagaagggcatagagcatcaggatagccagcactcatttctcgcctttctcaacacacctaccgacgcgttggaccagttcgaaaccgacccagtggagaacacatacgtgtggaacccctcggttaagttccacatccagagccgaagcaccagcccgtctacttctagtgaggccgagcccgtaaaaactgtggacagtacccccctgagtgtccataccccaacactgaggaagaaaggctgtcctggcagcacaggctttccccccaagagaaaaacacaccagttcttcgttaagtctttcacgacacccactaaatgtcatcagtgcacttcattgatggtaggtttgataaggcaaggatgctcatgtgaggtatgcggattttcctgtcacataacttgtgttaataaggctcctacaacttgtcccgtgccaccagaacagaccaaagggccattgggcatcgaccctcaaaagggtatcggcaccgcgtacgagggtcacgttagaattccaaaaccggccggggtaaaaaagggatggcagcgggcgctggcgattgtgtgtgactttaagctgttcctttatgacatcgctgagggcaaggcttcacagccttcagttgtgatcagccaggtgatcgatatgcgcgatgaggagttttctgtaagcagcgtcttggcttccgacgtgatccatgcaagtcgtaaggatataccttgtatctttcgcgtaacggcctcccaactcagtgcttctaacaataagtgcagcattttaatgcttgcagatacagaaaacgagaagaataagtgggtaggagtgctgtccgagctgcataaaatacttaaaaaaaacaagtttcgcgacaggagtgtctacgtgcccaaggaagcttatgacagcaccctgcccttaattaagactacccaggccgcggccatcatcgaccacgagaggatcgcccttggcaatgaagagggcctcttcgtggtccatgttaccaaagatgagataatccgtgtgggggataacaagaagatacatcagatcgagcttattccaaatgaccagctagtagcagtcatcagcggccggaatcggcatgtgagactgtttcctatgagtgcactggatggacgggagacagacttctacaagctttcggagacgaaaggctgtcaaaccgttacaagcggaaaagtgaggcacggcgcactgacttgcttatgcgttgccatgaagcgccaggtcctgtgttacgaactgttccagtccaaaacacgacaccggaagtttaaggaaattcaggtaccctataacgttcagtggatggcgatcttttcagagcagctctgcgtggggttccagagcgggtttctgagatatccactgaacggagaaggtaacccgtatagcatgttacactccaacgaccataccctgtctttcatagctcaccaacccatggatgccatttgtgcagtcgagatttccagtaaagaatacctgttgtgctttaattctatcggcatttatactgattgtcagggccgtcgatcccgtcaacaggaactgatgtggccagctaacccctcatcatgctgttacaacgcaccttatctgagcgtgtattccgagaacgccgtggacatatttgacgtgaacagtatggaatggattcagactttgcccctgaagaaggtgcgacccctcaataacgagggttctctgaatttgttgggactggagactatccgcctcatatatttcaagaacaagatggcagaaggcgacgagttggtggttcccgagacttcagacaattccagaaaacaaatggtcagaaatatcaacaataagcgacgctactccttcagggttcctgaagaagaacgtatgcagcaacggcgggagatgctccgcgatcctgagatgaggaataaactgatttcaaaccccaccaactttaatcacatcgcccacatgggacccggtgacggcatccagatcctgaaggacctgcccatgaatccgcggcctcaggagagcaggaccgtcttctccggtagcgtgagtattcccagcatcaccaagagtagacctgagcctgggcggtctatgtcagcctccagcgggctttctgctagaagcagtgcccagaacggcagcgctttgaagagagaattttcaggcggcagctacagtgcaaagcggcagcctatgccctctcccagtgaagggagcctgagtagtggcggcatggatcagggctccgatgcccccgcccgtgactttgacggcgaagatagcgattcacccaggcattcaaccgccagcaactctagtaacctcagttctcccccttctccggcctcgcctcgtaagaccaaatctctttcactagaatcgaccgatagaggctcctgggatccatag

SEQ ID NO: 182286 - DNA, 4917 bp, Artificial Sequence
  Description of Artificial Sequence: Synthetic coding sequence
atgagcggcgaggtgcggctgcggcagctggagcagttcatcctggacggtcctgcccagacgaatggccagtgtttcagcgtcgagacccttttggacattctgatatgtctgtatgatgagtgcaataacagcccattgcgccgcgagaaaaatatcctcgaataccttgagtgggctaaaccctttaccagtaaggttaagcagatgagattacatagggaggactttgaaatcttgaaagttattgggcgcggggcctttggggaggtggctgttgtaaaactcaaaaatgctgataaagtgttcgctatgaagatcctgaacaagtgggagatgttaaagcgtgccgagacagcgtgcttccgagaagagcgcgacgtacttgttaatggagacaacaagtggattacaaccctccactacgccttccaggacgacaataacttgtaccttgtcatggactattacgtcggaggtgatcttctgaccctcctgtcaaagtttgaagatagattgccagaggatatggcacggttctatcttgccgaaatggtgatagccattgacagcgtgcatcaattacactacgtgcatcgcgatatcaagcccgacaatatcttgatggatatgaacggccacatccggttggccgatttcggaagttgcctcaaactgatggaagatgggacggtacagtccagtgtggctgttggtacccccgattacatctcccctgagatacttcaagcaatggaggatggcaagggacgttacggccccgagtgcgattggtggtctctcggggtttgtatgtacgagatgctctatggcgaaacccccttttatgcagaatccctggtagaaacttacggcaaaatcatgaaccacaaagagcggtttcaattccccgcccaggttaccgacgtgtccgagaatgccaaagacctcatcagacggctgatttgttcgcgggaacacagacttgggcaaaacggaatagaagactttaagaagcatccattcttcagtggcattgactgggataacattcgaaactgtgaagctccttacatccccgaagtgagcagtcccactgacacaagcaattttgacgtcgacgacgattgtttgaagaactctgaaactatgcctcctcccactcacactgccttcagcggccatcaccttccgttcgttggttttacttatacaagtagctgtgtgctgtctgaccggtcctgcctcagggtcacagccggcccaacctccctagatctggacgtaaacgtgcaaagaacactagataacaacctggcaacagaggcctatgaacggaggattaaacgactcgagcaggaaaagctcgaactcagtagaaagttgcaggagtccacgcagaccgtgcaagcgctgcagtactccactgtagacgggccgctgaccgcatccaaggacctggagattaaaaacctcaaggaggaaattgagaaacttcgcaaacaagtcacagagtcatcacacttagagcaacaacttgaggaagccaatgccgtgcgccaagagcttgacgatgccttccgccagattaaggcctatgagaaacagatcaagactttgcagcaggaaagagaagatctgaacaaactggaggttcacacggaagcactcgccgcagaggctagcaaggaccgaaaactccgggaacaatcagaacactactctaagcagctggaaaatgagctggagggcctgaaacaaaagcagatatcctactcccccggtgtgtgcagtatcgagcaccagcaggaaataaccaagcttaagacagacctggagaaaaaatccatattttatgaggaagaattgtcgaaaagggaaggaattcacgcaaacgaaatcaaaaacttgaaaaaggagctgcatgacagcgaaggacagcagttggctttgaacaaggaaataatgattctcaaagataagttggagaagactcgaagggagtcacagtcagagcgagaggaattcgagtctgaatttaagcagcaatatgagagagagaaagtcctcctgacagaggaaaacaaaaaactcaccagtgagttggacaagctgactacactctatgaaaatctgtcaattcataatcagcagcttgaagaagaagttaaggatttggcggataaaaaggagtcggtggctcactgggaggcccaaatcaccgaaattattcagtgggtttctgacgaaaaagatgcacgagggtatctgcaggctttggccagcaagatgactgaggaacttgaggctctcaggaatagcagcctgggtaccagagccaccgacatgccctggaagatgaggcgatttgccaagctcgacatgtctgcccggttggagcttcagtcagcgctggacgctgagatccgggccaagcaggctatccaagaagaactgaacaaggtgaaagccagcaacatcatcactgagtgtaagcttaaggactccgaaaaaaagaatctcgagctcctctccgagatcgagcagctaatcaaggacactgaagagctaaggtctgaaaaaggcattgagcatcaggacagtcaacatagtttcctggccttcctgaacacacccacagatgccctggatcaattcgaaacggtcgacagtacacccctctcagttcacaccccaaccttgcggaaaaagggatgccccggcagtaccggattccctcccaagcgtaaaacgcatcagttcttcgtaaagagcttcaccactcccacaaagtgccatcaatgtacgagcttaatggttggcctgatccgccagggatgttcttgcgaggtctgtggattctcctgccatatcacgtgtgtgaataaggcccccaccacatgcccagtcccacctgaacagacaaaaggacctttagggattgaccctcagaaagggataggcaccgcttatgagggccacgttcggatccctaaaccagcaggagtgaaaaagggctggcagagggcactggccattgtgtgtgattttaaattgttcctgtatgatattgccgagggcaaagcctcgcaacctagtgttgtcattagccaggtaatcgatatgcgcgatgaagagttctcggtcagtagtgtactcgccagtgacgtgattcatgctagcagaaaggatatcccttgcatcttcagagtcactgcttctcaactttcagcctcaaacaacaaatgctcaatcctgatgctggctgataccgagaatgaaaaaaataagtgggtaggggtcctgtctgagttacataaaatcctgaagaaaaataaatttcgggacagaagtgtgtacgttccgaaggaggcctacgacagcactttgcctttgatcaaaacaacacaggcagcagctatcattgaccacgagaggatcgcattaggcaacgaggaaggactgttcgtggtgcacgtgaccaaggacgaaatcatccgcgtgggcgacaacaagaagattcatcagatcgaacttatccccaacgaccagctggtagcagtaatcagtggaagaaaccgccacgtacggttgttcccaatgtctgctttggatggccgggaaactgacttctataaactctcagagacaaagggatgccagacggtcacctctggaaaagtacgtcatggggccctgacttgcctctgtgtcgcgatgaaacggcaggtgctctgctacgagttatttcagtcaaagacgcgccatagaaagttcaaggaaatccaagttccatacaatgtccagtggatggcaatcttctctgagcagttgtgtgttggattccagagcggtttccttcggtacccacttaatggcgaaggtaacccctattcaatgttgcacagtaacgaccatactctaagttttatagcccatcaacccatggatgccatctgcgcggtggagatttccagcaaggagtacctcttgtgcttcaattcaataggtatttatactgactgtcagggtcgcaggtcacgacagcaggagctgatgtggcctgctaatccttcctcctgctgctacaacgcgccatatttgagtgtgtattccgaaaatgccgtggacatcttcgacgttaattccatggaatggatccaaaccctgccgctcaaaaaagtgcgaccattaaataatgaaggcagcctgaatctgctgggtctggaaacaatcagactgatctactttaagaacaagatggccgagggcgacgaattggtcgtaccggagactagtgataactccagaaagcagatggtacgaaacatcaacaacaaaagacgatactcattccgggtaccagaagaagaacgaatgcagcagaggagggagatgctgagggatcctgagatgaggaataaactgatctccaaccccaccaattttaaccacattgctcacatgggcccgggagacggtatccagatcctgaaggacctgcctatgaacccccgtcctcaggaatcaaggaccgtgttcagcggctccgtaagcattccttcaataacgaagagccggcctgaacccggtaggagtatgagtgcttccagcggactgagcgcccggtcttcagcccaaaacgggtcagcactgaagagggaatttagcggcggctcctatagcgccaagcgtcagccgatgccatccccatctgagggaagtctgtcctctggcggcatggaccagggctcagatgcacctgcaagagacttcgatggggaggactccgactcacctcgccatagcaccgctagcaattcatccaaccttagctcccccccttctccagctagcccaagaaaaacgaaaagcctctctctagagtctacagatcgagggagctgggatccctag

SEQ ID NO: 182287 - DNA, 5160 bp, Artificial Sequence
  Description of Artificial Sequence: Synthetic coding sequence
atgagcggcgaggtgcggctgcggcagctggagcagttcatcctggacggccccgcacaaactaacgggcaatgtttttctgtcgaaaccttattggacattcttatttgtctctatgatgaatgcaacaatagtcctttgaggcgcgagaagaatattctagaataccttgagtgggctaagcctttcactagtaaggttaagcaaatgaggctccaccgggaagatttcgagattctgaaggtaatcggccggggagccttcggcgaggtggctgtggtgaaactgaagaacgcagacaaagtgttcgccatgaagattctgaacaagtgggaaatgctgaaacgagcagaaacagcctgttttcgggaggaacgggatgtgttggtgaacggtgacaacaagtggatcaccaccttgcactatgccttccaggacgacaataatctttacctggtgatggattactatgttgggggcgatcttctgacactcctgtcgaaattcgaggaccggttacctgaggatatggctagattctacctggccgagatggtgattgccattgattcagttcaccagttgcattacgtacacagggacatcaaacccgacaatattctgatggatatgaacggacacataagactggcggattttggttcttgtctgaaactgatggaggatggcacggtgcagagcagcgtcgccgttgggaccccagattatatttcaccagagatattgcaagccatggaagatggaaaaggcaggtacggtccggagtgcgattggtggagtctcggggtctgtatgtacgagatgctctatggcgaaaccccattttacgctgaaagcctggtcgagacatatggcaaaattatgaaccacaaagaaaggttccagttccccgcgcaggtgactgacgtttccgagaatgctaaggaccttatacggcgactcatctgcagtcgcgagcatcgtctgggccagaatgggatcgaggatttcaagaagcatccatttttcagcggaattgattgggacaatataagaaattgcgaggctccatacatccccgaggtcagttccccaactgacactagtaactttgatgtcgatgacgactgtctcaagaactcagaaaccatgccgcccccgactcacacggcttttagtggtcatcatctgccctttgtgggattcacttatacctccagctgcgtgctctcagatagatcctgcctccgcgtgacggctggccctacgagccttgacctcgatgttaacgtgcagaggaccctcgacaataatcttgcaacagaggcttacgaaaggaggattaagcgcctcgagcaggagaagctggaactgtctagaaagttgcaggagagcacccagactgtgcaggcccttcaatactctaccgtggacggacccctcaccgctagcaaagatctggaaatcaagaacctcaaggaggagatcgaaaaactgcgaaagcaagtgacagaaagcagccacctcgagcagcaactcgaagaggctaatgccgtgagacaagaactcgatgatgcattcaggcaaatcaaggcatatgaaaagcagatcaagactctccagcaagaacgagaggatctgaataaggagcttgtgcaggctagcgagcgattgaaaaaccagtcgaaagaactcaaggatgcccattgccaacgcaagctcgcaatgcaggagttcatggagattaacgagagactgaccgaacttcatacccaaaagcagaaactggcaaggcatgtgcgagataaggaggaagaagtggatcttgtcatgcaaaaagtcgaaagcctgcgccaagagctgcgcaggactgaaagagccaagaaggaacttgaggtacacacagaagctttggccgccgaggccagcaaagataggaagcttcgggagcagagtgaacattattctaagcagttggagaacgagctggagggtctgaaacagaagcagatctcttactcccctggagtgtgttccatcgagcatcagcaggagatcacaaaactgaagacagatttggaaaagaaatccattttctatgaagaggagctgtcaaagagagaagggatacatgccaatgaaatcaagaacttgaaaaaggaattgcatgatagcgagggccagcagctcgcactcaacaaggaaataatgattctgaaagataaacttgagaaaacccggcgtgagtcacaatccgaacgggaagagttcgaatctgaatttaaacaacaatacgaacgagagaaggtgctgttgactgaagaaaataagaaactaacaagtgagctggacaaattgacgacattgtatgagaacctgtctatccacaaccagcaactggaagaggaggtcaaagatctggcagataagaaagagtcagtggcccattgggaagcacagatcaccgaaatcatccagtgggtcagtgacgaaaaagatgctaggggttatcttcaggccctcgcaagcaaaatgactgaggaacttgaggccctgcgcaacagctcactgggcacacgcgctacagatatgccctggaagatgaggcgatttgcgaaattggacatgtctgcccgcctcgaactgcagagcgccctggacgcagagatccgcgccaagcaggccatccaggaggaactaaacaaagtcaaagcctccaacatcattacagagtgcaagctgaaggactccgagaaaaaaaacctggaattgctgtccgaaatcgaacagctaatcaaagataccgaggagctgaggagcgagaaaggaatagagcatcaggatagccagcactcattcttggcctttctaaatacaccgacagatgcccttgaccagtttgaaacggtggacagcaccccactgtctgtgcatacacccaccctaagaaagaagggctgccccggttccactggtttcccccccaaacggaaaactcaccagttctttgtgaagagtttcactacgcctacaaaatgccaccagtgtacatctctcatggtgggcttgattcggcaaggttgctcttgtgaagtgtgtggtttctcttgtcacattacttgcgtcaacaaggcgcctacaacctgtcctgtgcctcccgagcagacaaaaggcccattaggcatcgatccacagaagggcataggcaccgcctacgaaggacacgttcgcattcccaaaccagcgggggtaaagaaggggtggcagagagccctcgccatcgtctgcgacttcaagctcttcctgtatgacattgccgagggaaaggcaagtcagccatccgttgttataagtcaggtgattgatatgagagatgaggagttcagtgtgtccagtgtgctcgcttctgacgtgattcatgccagccggaaagatatcccttgcatcttcagggtgactgccagccaactgtccgcgagcaataataagtgctcaatattaatgctggccgatactgaaaacgaaaaaaacaagtgggtgggcgtcttatccgaactccacaaaatcttaaaaaagaacaaattccgcgatcggtccgtgtacgtacccaaagaggcgtatgactccaccctgccccttatcaagactacccaagctgccgctatcatcgatcacgaaaggatcgcactgggtaacgaagagggcctcttcgtagtgcatgtgacaaaggatgaaataatccgagtcggagacaacaaaaagatacaccaaattgagctcatacctaatgaccagttggtggctgtaattagcggaagaaaccgacatgtacgattgttcccgatgtctgccctggacgggagggagaccgacttctacaagcttagtgaaacgaagggctgtcaaaccgtcactagtggaaaggtcagacatggagctctcacttgcctgtgcgtggcaatgaaacgccaggtgttgtgctacgagttgtttcaatccaagacccggcacaggaaatttaaggaaattcaagtcccttacaacgtgcagtggatggcaattttttccgagcagttatgcgtggggtttcaaagtggcttcctgaggtacccactcaatggggaagggaatccatatagcatgctccatagcaatgatcataccctgtcatttatcgcccaccaacccatggatgcaatatgcgccgtagagatctcatccaaggagtatttattgtgcttcaactctattggaatctacaccgactgtcagggcaggaggtcccgccaacaggagctgatgtggcctgccaaccccagcagctgctgttacaacgcgccatatctatcagtgtatagtgaaaacgcagtagatatcttcgatgttaactcaatggaatggattcagaccctcccattgaaaaaggtcagaccactgaataatgaagggagcctgaatcttctcggtctggagactatacgattgatttatttcaaaaataagatggctgaaggcgatgagttggtggtgcccgagacatcagacaatagccgtaaacaaatggtccggaatataaataacaagagacggtactctttcagagtgcctgaggaggaaagaatgcagcaaagacgagaaatgctacgcgatcccgagatgcgcaataagcttattagcaacccaacaaactttaaccacatcgctcatatgggccctggcgatggtatccaaatcttaaaagacctgcccatgaacccgcgccctcaggagtcgcgcacggtgttttcaggcagcgtgtccattccctcaatcaccaagtccaggcctgagcctggaagatccatgagtgctagctctggactgtctgcccgttcctctgctcagaacggttccgctctcaaaagagagttttctggcggtagctactcagctaagcgtcagcctatgccatctcctagtgaaggcagcctgagctctggcggcatggaccagggctctgatgctccggcgcgagattttgatggcgaggattctgactctccacggcactcgactgcttctaattcttccaacttatcctcgccaccctcacctgcctctccaaggaaaaccaagtccttaagcctcgagtctacggacagagggtcttgggacccttag

SEQ ID NO: 182288 - DNA, 1641 bp, Artificial Sequence
  Description of Artificial Sequence: Synthetic coding sequence
tgagacatcgccgagggcaaggccagccagcccagcgtggtgatctctcaagtaatagatatgagagacgaggagttttcagtaagctcagttctggcttcagacgtgatccatgcctcgcgtaaagatataccttgcatattcagggtgactgcctctcagctgagtgctagtaacaacaaatgttcaatcctgatgttagccgataccgagaatgaaaaaaataagtgggtgggtgtgctctccgagctccataaaatcttgaagaaaaataaatttagagacagaagcgtctatgtccctaaggaagcctacgactctaccctgccattgatcaagacaacccaagcagcggctatcatcgaccatgagagaattgcccttggcaatgaagagggactgttcgtcgtccacgtcactaaggacgaaattattagagtcggggacaataaaaagatccatcagatcgaactaattcccaacgatcaactagtcgcagtcatatcaggccgcaaccgacacgtccggctcttccccatgtctgccctggatgggagagaaacagatttttacaagttgtctgagacaaagggctgtcagacggtgaccagtgggaaagtgcggcatggcgcgttgacatgcctttgcgtagctatgaagagacaggtgctctgttatgaactgttccaatccaaaacccgccatagaaagttcaaggagatccaggttccatataacgtccaatggatggccatattttcggagcagctgtgtgttggcttccaatccggtttcctgcgatatcctttgaatggtgagggcaatccatattctatgctgcattcaaatgaccataccctgagttttattgcgcatcagccgatggatgcaatatgcgccgttgagattagtagcaaagagtacctcctttgctttaattctattggcatctacaccgactgccagggccgccgctctagacagcaagagctcatgtggccagccaacccctctagttgctgctacaacgccccatatcttagtgtgtactccgaaaatgcggtcgatatcttcgacgtaaattccatggagtggatccagacccttccactgaaaaaagtccgaccactcaacaacgagggatctctcaatttactgggactggagacgatccggctgatttactttaaaaacaagatggctgaaggagacgaactggtcgtaccagagacctctgataattcgagaaagcagatggttagaaacatcaataataagcgaaggtacagcttccgcgtgccggaggaggagcgcatgcagcaacgaagggagatgctcagggaccctgaaatgcggaacaagctgatatctaaccctactaatttcaatcacattgcgcatatgggccccggcgacggcatacagattctgaaggacctccctatgaatccccggccccaggaatctagaaccgtgttctccggctctgtcagtattccgtcgatcaccaaatccaggcccgaaccggggcggtccatgtctgcatcctcgggtctgtctgcctcgaaatgccgaggctacaggaaggtcccactgcgccagggggatccccagttgcccccccttttatctagggggtag

SEQ ID NO: 182289 - DNA, 2187 bp, Artificial Sequence
  Description of Artificial Sequence: Synthetic coding sequence
tgagtgagcgacgagaaggacgcccggggctacctgcaggccctggcctctaagatgacagaggaattggaagcgctaaggaacagcagtttgggtaccagggctacagacatgccatggaagatgagacggttcgctaagctggacatgagtgccaggctggaacttcagtctgcccttgacgctgaaataagggccaagcaggcaatccaggaggagctgaacaaggtaaaggcctccaatatcattaccgaatgtaagctcaaggactccgagaagaagaatcttgaactcctgagcgagattgaacagctgattaaggacacggaggagttgcggagcgaaaaaggtattgagcaccaggactctcagcatagtttcttagcatttctgaacaccccaacggatgcactcgatcaatttgaagatagcttctcttcctcgtcatccagcttaatagatttccttgacgacaccgaccctgtagaaaatacctacgtatggaacccgtctgtgaaatttcatattcagtcacggagtactagcccctctacaagctcagaggctgaaccagttaaaactgtcgatagcactcctctgagcgtccatacacctacgttgcggaaaaagggatgtcccgggtccaccgggttcccgccaaaacgtaagactcatcagttctttgtaaagtccttcacgactcccactaagtgtcatcagtgtacctctctaatggtcggtctgataaggcagggatgttcctgtgaggtgtgcggctttagttgccacatcacatgtgtgaacaaagcccctaccacttgccctgtgccaccagagcagactaagggtcccttgggaatcgatccccaaaaagggattgggacagcatatgaaggacacgtacgcattccaaagccagcaggtgtgaagaaaggatggcaaagagccctagctatcgtgtgtgacttcaagttatttttgtatgacatagcagagggaaaagcttctcagccctctgttgtcatatcgcaagtcatcgacatgagggacgaggaattttccgtgagcagtgtgctggcatccgatgtgatccacgcctccaggaaagatattccttgcattttcagggttacggcgtcccagttgagtgccagcaacaacaagtgtagcattctaatgctcgctgacaccgaaaatgaaaaaaacaaatgggtgggagtgctgtcagagttgcacaaaatcctgaagaagaataaattcagagatcggagcgtgtacgtccccaaagaagcctacgattccactctccccctgataaaaacaacccaagctgctgcgatcattgatcacgagcgaatcgctctaggcaacgaggaaggcctgttcgtggtgcacgtgactaaggatgagattatcagagtaggcgacaacaaaaagattcaccagattgaacttatcccaaatgatcagttggttgctgttataagcggtcgcaataggcatgtcagactattccccatgagcgccttagacggtagggagacagacttctataagctgagcgagacaaaaggatgccagaccgtgacatctggcaaagtacggcatggcgcgttaacctgcttgtgcgtcgcaatgaaacgccaggtcctgtgctacgagctgttccaatctaagactcggcaccgtaagtttaaggagatccaggttccctacaacgtacagtggatggcaatattctccgaacaactctgcgtggggttccagtcagggtttctgaggtatccgctgaatggagaaggtaatccatacagcatgctgcatagtaacgatcacacattgagtttcattgcccatcagccaatggacgcaatttgcgccgtggaaatttcttccaaagagtatttgctatgctttaatagtattggcatttatacagactgccagggcagacggtcccgacaacaggagctgatgtggcccgctaacccaagctcatgttgttacaacgctccctacctcagtgtttacagcgaaaacgccgtggacatatttgatgtgaattctatggaatggatacagacgcttcccttgaagaaagtccgacctctgaacaacgaggggagtctgaacttactgggactggaaacaattagattgatctacttcaaaaataaaatggcctag

SEQ ID NO: 182290 - DNA, 3147 bp, Artificial Sequence
  Description of Artificial Sequence: Synthetic coding sequence
tgagagggcatccacgccaacgagatcaagaacctgaagaaggagctgcacgatagcgagggccagcagctggcactcaataaagaaatcatgattcttaaagacaagctagaaaaaactcgccgggagagtcaaagcgagcgcgaagaattcgaaagtgagtttaaacagcagtacgaaagagaaaaggttctccttaccgaggaaaacaaaaagctgactagtgagttagataagctaaccacactctatgagaacctgagtatccataaccaacagcttgaggaagaggtgaaagatctcgcagataagaaggagagcgttgcccattgggaagcacagatcactgaaattatccagtgggtttcagatgagaaggacgcacgcggctacctgcaagcgttggccagcaagatgacagaggaactggaggccctgcgtaattccagcctcgggacaagggccaccgatatgccttggaagatgaggcggttcgccaaattggatatgtcagccagactagaactccagagtgcacttgatgccgagatcagagcaaagcaggctatccaagaagagctcaacaaggttaaggcaagcaatatcatcactgaatgcaaactcaaagatagcgagaaaaaaaacctagagctcttaagcgagattgaacagctcatcaaggacactgaagaacttagatccgaaaaaggtatcgagcatcaagatagccagcattccttcttagctttcctgaacacacctactgacgcactggatcagtttgaaaccgatcccgtggagaacacgtatgtctggaacccctctgttaagtttcatattcaatcaaggtctacctccccctcaacatcttctgaggcagaaccggttaagacagtggatagtacgccactcagcgtgcacaccccaacattgcgcaagaagggctgtccgggttccacggggtttccacccaaaagaaaaactcaccagttcttcgtgaaatcatttaccaccccgacaaagtgccaccaatgcaccagcctcatggttgggctgatacgccagggttgctcctgcgaggtatgcggcttctcctgtcacattacatgcgttaataaggctcctaccacctgtcccgttccgcctgagcagacaaaaggtccacttggcatagacccacagaagggcataggaactgcttacgagggccacgtgcgtattccaaaaccagctggggttaaaaaaggctggcaaagggccctggcgatcgtgtgtgactttaagctctttctgtatgacatcgcggagggcaaggcgtctcagccatctgttgtgatctcccaagtcatcgacatgcgcgatgaggagttctcagtcagttctgtccttgcgagcgacgtcatacacgcttctaggaaggatatcccgtgcatattcagagtcactgcctctcagttgtccgcttccaacaacaaatgctcgattctgatgctggctgatacagagaacgagaagaataagtgggtcggtgtcctgtccgaactgcataagatcctaaagaagaacaagtttcgagataggtcggtctatgtccctaaagaagcctatgacagcacgttgcctttgatcaagaccacacaggcagctgcgattattgatcatgagcggatcgcactgggaaacgaagaaggactgtttgtggtgcatgtcaccaaagatgagattattagagtcggggacaacaagaaaatccaccaaatcgagctcataccaaatgatcagctggtggccgttatatccggccgcaatcgacacgtccgcttgtttcccatgtctgcactggatggacgagaaaccgacttttacaaactgagcgagaccaagggctgccagaccgtcacttctggtaaggtgcggcacggggcactcacatgtctttgcgtggcaatgaaaaggcaggtcttgtgctacgaactctttcagagcaagactagacacaggaaatttaaggaaatccaggtcccgtacaatgttcaatggatggccatcttcagcgagcagttatgcgttggattccagagcggctttcttaggtatcccctgaatggtgaaggcaatccctattctatgctgcatagtaacgatcatactctctccttcattgcacaccagccgatggatgcaatctgtgccgtcgagatttcctccaaggaataccttttgtgcttcaactcaattgggatctacacagactgccaggggaggcgaagtcggcaacaggagttgatgtggcccgctaatccctcaagctgttgctataatgcaccctacctttctgtatattccgagaatgccgtcgatatcttcgacgtgaattcaatggagtggatccagacacttccacttaagaaggtgaggccccttaacaatgaagggtctctaaacctactgggactggaaaccattagactgatctattttaagaacaagatggcagaaggagacgaactggtcgtacccgaaacatctgataattcccgaaagcagatggtgaggaacatcaacaacaaacgcagatactcatttcgcgttcccgaagaggagcgcatgcagcagcggcgtgaaatgcttagggatcccgaaatgagaaacaagctgatctctaacccaactaattttaaccatatcgctcacatggggccaggcgacggcatccaaatcctaaaagatctcccgatgaatccccgcccccaggagagcaggactgtgttctctggcagcgtgtcaatccctagtatcacaaagagccgccccgaacccggcagaagtatgtccgcttctagcggactcagcgcccggagtagcgctcagaacgggagtgctctgaagcgcgagttctcaggcggctcctattctgctaaaagacagccaatgccctcaccatccgagggctcactttctagtggtgggatggaccagggatcagacgctcccgcacgcgatttcgacggcgaggactccgacagcccacggcattctacagctagcaattcctcaaacctttctagtcccccgagcccggcaagcccaagaaaaacaaagagcctctctcttgaaagcacggatcgaggcagttgggatccatag

SEQ ID NO: 182291 - DNA, 2955 bp, Artificial Sequence
  Description of Artificial Sequence: Synthetic coding sequence
tgacagctggaggaggaggtgaaggacctggccgacaagaaggagtccgtggcccattgggaagcacagattaccgagatcatacagtgggtctccgacgaaaaagatgccagaggctatctccaagccctggctagcaagatgacagaagagcttgaggcactgcgtaacagcagtttggggacgcgggctaccgatatgccttggaagatgcgccgcttcgccaagcttgacatgagcgcacgcctggaactgcagtcggccttggacgctgagattagagccaaacaggctatccaggaagaattaaataaggtcaaggcttccaatatcatcacggaatgtaaacttaaggatagcgagaagaagaatttggaactgctgtctgagatcgagcaacttataaaggacacagaggagctgaggagcgagaaaggcattgaacaccaagattctcagcattcattccttgcattcctcaacaccccaacagacgccctggatcagttcgagacagtagattccactccactatcagtgcacacccccacattgagaaagaagggatgcccgggatcaaccggattcccccccaagagaaaaacccaccagttttttgtaaaaagtttcactactcctaccaaatgccaccagtgtacaagcttgatggtcggactgatcaggcagggatgtagttgtgaggtgtgtggattcagctgccacatcacgtgtgtaaataaggctcccacgacctgtccagtaccccctgagcagactaagggacctctgggaatcgacccacagaagggaatcggaacagcttatgaggggcacgtaaggatcccaaaaccagctggggtcaagaagggatggcagcgagctttggcaatagtgtgcgatttcaaactctttttgtacgacattgcagaggggaaggcgtcccaaccttctgtggtgatcagccaagtcattgacatgagggatgaggaatttagcgttagctccgtgctcgcaagcgacgttatccatgcgtctcggaaagatatcccttgtatcttcagagtaacggcctcccagctgtccgcatctaataacaagtgttcgatcctcatgcttgctgacacggagaatgaaaagaataagtgggtcggagttctgtctgagcttcacaagatcttaaagaaaaacaaatttagagaccgtagcgtgtacgtgcccaaggaggcctacgacagcactctaccactcatcaagaccacccaggccgcagccattatagatcatgagcggatcgccttgggcaacgaagaaggcctgttcgtcgtgcatgtcactaaagacgaaatcattagggtcggggacaacaaaaaaatacatcaaattgaattaattcctaacgatcaactggtggccgtcatttccggacgtaacagacacgtgagactgtttcccatgtcagccctcgatgggagagagacagatttctataagttaagcgagacaaaggggtgccagaccgtaacatccgggaaagtaaggcacggcgccctgacttgtctgtgcgtcgccatgaaaaggcaagtcctgtgttacgagctgttccagtctaaaaccagacaccgcaaattcaaagaaattcaggttccatacaatgtgcagtggatggcaatatttagcgaacagctttgcgtggggttccagtcaggcttcctgcgttatccactcaacggggaggggaacccttactccatgctgcactcgaatgatcacacgttgagtttcattgcgcaccagcccatggacgccatctgcgccgtggagatcagttccaaggaatacctcctgtgctttaactctattggcatctacacagactgtcaagggagacgcagccggcaacaggaactgatgtggcccgctaatccctccagctgctgttataatgcaccctacctaagcgtttactctgaaaatgcagtcgacatattcgacgtgaacagcatggagtggattcaaaccctcccactgaagaaggtccgcccattgaacaacgagggaagcctcaatctgctgggcttagaaaccatccggcttatttactttaagaacaagatggctgaaggtgacgaactggtagtgcccgagactagcgacaactctcgcaagcagatggtgcggaatattaacaataaacgccgatactcatttcgggtgcccgaggaagaaagaatgcaacagaggcgtgagatgctgcgcgatcctgaaatgagaaacaaactgatctcaaaccctactaacttcaatcacatagcccacatggggccaggggatgggatccagattctaaaagacctgcccatgcctggatttccctaccccagtccacatcatcactcaggattaatcagcagccccattaacttcgagcatatctaccacatgactgtgaactccgccgagaaattcctctctcctgacagtattaatccagagtacagccctagtttaaggtccgtgcccggcaccccaagcttcatgacgctcagaaatccaaggccccaggagtccaggacggtgttcagcgggtctgtgagtatcccctctatcaccaagtcacggccagaaccgggtaggtctatgagcgcttcatctggactctcagctcgtagctctgcccagaacggatcggcgttgaaaagagagttcagtggtggatcttatagtgccaaacggcagcccatgccgagtcccagtgagggatccttgtcatccggcgggatggatcagggaagcgacgcccctgcaagagacttcgacggagaggactccgattccccacgccatagtactgcctcgaattctagcaacctgtcaagccccccttcgcctgcgtccccaagaaaaacaaagtctctcagtttagagtctactgaccgcggcagctgggacccgtag

SEQ ID NO: 182292 - DNA, 5100 bp, Artificial Sequence
  Description of Artificial Sequence: Synthetic coding sequence
atgagcggcgaggtgcggctgcggcagctggagcagttcatcctggatgggcccgcccagacaaacggacagtgtttctctgtagagacccttctcgatatcctgatctgcttgtacgacgagtgtaacaactcacctctgcggcgcgagaaaaatattctagaatacttagaatgggccaaaccttttaccagtaaagtgaaacagatgagattacacagagaggatttcgaaattttgaaagtgattggccggggcgcattcggagaggtagctgttgtgaagcttaaaaacgccgacaaagtctttgccatgaagatcctgaacaagtgggagatgctgaaacgggcagagacagcttgctttcgggaggaacgcgatgttctggtcaacggcgacaacaaatggataacaactctccactacgccttccaggatgacaataatctgtacctggtcatggattactatgtgggcggagaccttctgacactcctttctaagttcgaggaccgcttacccgaagatatggcccgcttctacctagctgaaatggttatcgcgatcgacagcgtgcaccagctgcattacgtacaccgtgatataaagccagacaatatcttaatggatatgaatggtcacatcaggctcgctgacttcggatcctgcctgaaattgatggaggatgggacggtccagagttccgtggccgttggaactcctgactacatcagtcctgaaatcctgcaggccatggaggacggtaaagggcggtatggtcctgaatgcgattggtggtccctgggggtgtgcatgtacgaaatgctgtacggggagacaccattttacgcagaatccctggtggagacctacgggaaaattatgaatcataaggagcggttccaattcccagcccaggtgacagacgtctctgaaaacgcaaaagacctaatcaggcgcctgatttgttcacgcgagcatcggctcggacagaacggcattgaagactttaaaaaacaccctttcttcagcggaatagattgggacaacatacgtaactgtgaagcaccgtacattccagaggtgtcaagtcctaccgatacctccaacttcgacgtcgatgacgattgcctgaagaattccgaaactatgcccccgcctactcatacagcctttagtgggcatcatcttccatttgtggggttcacatacacatccagctgcgtgctcagcgatcggagctgtttgcgcgttaccgctggccctacatccctggacctggatgtgaatgtgcagagaacattagataataacctggccacagaggcttacgagcggaggatcaaacgtctcgaacaggaaaaattggagctttcacggaaactccaggaatctacgcagaccgtacaggccttgcaatattctactgtggatggccccctgaccgctagcaaagacctcgagattaaaaatctgaaggaggaaatcgagaaactacggaagcaggttacagagtcctcgcacctggaacagcagttggaagaggctaatgctgtgcggcaggagcttgacgacgcgtttcggcaaattaaggcctacgaaaagcagatcaaaactctgcagcaggagagggaggatctgaataaggaactcgttcaagcttccgaacgacttaaaaaccagagcaaggagctcaaagacgcgcactgtcaaagaaagctggccatgcaggagttcatggaaatcaacgaaaggcttacagaacttcacacacagaagcagaaacttgcgaggcatgtaagggacaaggaggaggaggtggacctggtgatgcagaaggttgaatctctgaggcaggaattgaggaggactgaaagggccaagaaagagttagaggttcacactgaagcactcgcagcggaagcaagcaaggacaggaagttacgcgaacagagcgaacactattctaagcaactcgagaatgagctggagggtctgaagcagaaacaaatttcatattcccctggcgtttgctctatagaacaccaacaggaaataacgaagctgaaaacagatctcgaaaagaaaagtatcttttatgaagaggaactctccaagagggaaggcatccatgctaatgagattaaaaacctcaaaaaagagttgcatgatagcgagggacagcaactcgccctcaataaggagatcatgatactgaaggacaaactagagaagaccagacgggaaagccagagtgagcgggaggaatttgaatcagagttcaagcagcagtatgagcgggaaaaggttctcctgaccgaagagaataagaagctaacttctgaactagacaagctgacgacactctacgaaaacctgtccattcataaccagcagctcgaggaagaggtgaaggacctagctgataaaaaggagagtgtcgctcactgggaagcccagatcacggaaataatccagtgggtttctgatgaaaaggacgcaagaggttatttgcaagccctggcctcgaaaatgacagaagaacttgaggctcttcgaaactcttctctaggcacgagagcaacagatatgccttggaagatgcgaagattcgccaagttggacatgtctgcaagactcgagctccaaagcgcattggacgccgaaattagagctaaacaggctattcaagaagaacttaataaggtgaaggcaagtaacattattaccgaatgcaaactgaaagacagtgaaaagaaaaacttggagcttctctctgaaatcgaacagttgatcaaggacacagaggaattgaggagtgaaaaagcttccaaggggaggaggacagtggactccactcctctgtcggttcatactccaaccctgaggaagaaggggtgcccaggctctactggtttcccccccaagaggaagacacaccaattcttcgtcaagagcttcaccacacctacaaagtgtcatcagtgtaccagcttgatggtggggctaatccgacaggggtgcagttgcgaagtttgtggcttctcctgccacatcacatgcgttaacaaggcgccgaccacttgtccagttccgcctgagcaaaccaagggcccgttaggcattgacccccagaaggggataggcaccgcttatgaaggacacgtcaggatcccgaagcctgcaggggtgaaaaaaggctggcaaagagctctggcaatcgtctgtgactttaaactgtttttatacgatatagccgaagggaaagctagccagcctagcgtagtgatatcccaggtgattgacatgcgtgatgaagagttttcagtgtcctctgttctggcctctgatgtgattcatgcttcaaggaaagatattccttgcatttttcgggtaaccgctagtcagttaagtgccagcaataataagtgtagcattctcatgctcgcggatacggagaacgaaaagaacaaatgggtcggggtgctgagcgagttgcacaagatcctgaaaaagaataaattccgtgaccggtcagtctacgttcctaaggaagcatacgatagtactcttcctctgataaaaacaactcaggcagccgctattatcgatcacgagagaattgctctgggcaacgaagagggcttatttgtggttcacgtaacaaaggacgaaatcattagagtcggcgataacaaaaagattcaccagattgaactgatcccaaatgaccagcttgtggcagtaatcagcggacggaaccgccacgtccgactgttcccaatgtccgccttagacggaagagaaaccgacttttataagctgtccgaaactaagggatgccagacggttacaagcgggaaggtccggcacggtgccctgacctgtctatgcgtcgcaatgaagcgccaggtgctctgctacgaattgtttcaaagcaaaacaagacatcggaagttcaaggagatccaggttccttacaacgtccagtggatggcaatctttagcgagcagctgtgcgtcggattccagtccggctttcttcggtatcctctgaatggggagggaaacccatactcaatgctgcatagcaacgatcatacactctccttcatcgcgcaccagcctatggacgctatttgcgcagtggagatctcaagcaaggagtatctgctgtgcttcaattcaataggtatttacacagactgtcagggacgcagatcacggcagcaagaactgatgtggcccgccaatccttcgagctgttgctataatgccccgtacttatctgtttatagcgaaaatgccgttgacatcttcgatgtgaactcaatggaatggattcaaaccctccctcttaagaaggtgcgccccctcaataacgaaggtagtctgaacttgctgggcctggagaccattcgactgatatactttaagaacaagatggctgagggggatgaactcgtggtccctgagacatccgataatagcaggaaacaaatggttcggaatattaataacaagcggcgatattccttcagggtcccagaggaagaacgaatgcagcagaggcgcgaaatgctaagagatcccgaaatgcgcaataaactgatctcaaatcctactaacttcaatcacatcgctcacatggggcccggcgatggcatacagattctgaaggacctgcctatgaacccgcggccacaagaatctcggacggtcttttcaggctcagtctctattccatccattaccaaatctcggcctgagcccgggaggtcgatgagcgcatccagtgggctgagcgccaggtcctccgcccaaaacggcagtgccctcaagagggaattttcaggcggtagctatagcgcaaagcgccaaccgatgccatccccatctgaaggaagcctctctagtggcggaatggaccagggcagcgacgctcccgcccgggacttcgacggcgaggacagtgacagcccaaggcactccactgcctcgaactcttctaacctgagttccccaccaagccccgccagccctagaaaaaccaagtccttgtctctggaaagcacagacagaggctcctgggacccctag

SEQ ID NO: 182293 - DNA, 5136 bp, Artificial Sequence
  Description of Artificial Sequence: Synthetic coding sequence
atgagcgccaaggtgcggctgaagaagctggagcagctgctgctggacggcccgtggaggaacgaatcagccctgagcgtggaaactctgctggatgtgttggtgtgtctgtacacggagtgtagccacagtgccttacggagggacaaatacgttgctgaatttcttgaatgggcaaaaccctttactcaactagtcaaggaaatgcagctgcacagggaggacttcgaaattatcaaggtcatcggtaggggggcattcggcgaggtggccgtggtgaagatgaagaacaccgagaggatatacgccatgaaaatccttaacaagtgggaaatgctcaaacgtgctgaaacagcctgcttcagagaggaacgcgacgtactcgttaatggggattgtcagtggatcactgccctccattacgcttttcaggacgaaaatcacctgtacctggtgatggactattatgtcggcggggaccttcttacccttctatccaagtttgaggacaagctgccagaagacatggcgcgtttttatattggagaaatggtactggccatcgattctatccaccagttacactatgtgcaccgtgacatcaagcctgacaatgtgctccttgacgtgaacgggcatatacgacttgcggacttcggctcatgtctgaaaatgaatgatgatggaacggtgcaaagctctgtcgccgtcgggacacccgactacatctctcccgaaatcctgcaggcaatggaagatggcatgggcaaatatggacctgaatgtgactggtggagcctaggagtgtgtatgtacgagatgctatacggcgaaacccccttttacgctgagtcactcgtcgagacgtacggtaagatcatgaatcacgaagaaaggtttcaatttccttcccacgtgaccgacgtgagtgaagaggctaaggacctgatccagcggctgatttgttctcgagaacgtcgtctgggtcaaaacgggatcgaggattttaagaagcatgccttcttcgaaggtctgaattgggaaaacattcgcaatctggaagctccttatatccctgatgttagctctcccagcgacacctcaaacttcgatgtcgatgacgatgtactgagaaacacagagatccttcctcccggcagtcatacaggctttagtggtcttcacctcccattcattgggtttaccttcacaaccgaatcatgcttttccgatcgcggctccttgaagtccatcatgcagagtaatacattgacaaaagacgaggatgtgcagcgggacctggaacactccctccagatggaagcctatgaaagacgaatcaggagattggagcaggagaaactggagctttcaagaaagttacaagagtcaacacaaaccgtgcagtctctgcacggtagtagccgagccctgtctaactccaaccgggacaaggagattaaaaaattgaacgaagaaatcgagagattgaagaataaaattgcagatagcaataggctagagaggcagctcgaggacacagtggcactgagacaggagcgagaggacagcacccagcgtcttagaggcctggagaagcagcaccgtgtggtgcgccaagagaaggaggagctccacaagcaattggttgaggcctcagaaaggctgaagtcacaagcgaaggagctcaaagatgcccatcagcaacgtaagttagctttacaggaattttccgagctgaatgaaaggatggctgagctgagggcacagaaacagaaagtcagtagacagttaagagacaaggaggaggaaatggaggtcgcaacccagaaagttgatgcaatgagacaggagatgcgacgcgcagaaaaattacggaaggaacttgaagcccagcttgacgacgccgtcgccgaggcctcgaaagaacgcaaactccgagagcattctgaaaatttttgcaaacagatggagagtgagctggaggcccttaaggtgaaacagggaggacggggcgctggcgctaccctggaacaccagcaggagatctccaagatcaaatcggagctcgaaaaaaaggtcctgttttatgaagaggagctggtcaggcgtgaggctagtcacgtgcttgaagtgaagaacgttaagaaggaggtccatgatagcgagtcccatcagctggccttacagaaggagatcctcatgctgaaagataagctggagaagagcaagagagaacggcacaatgaaatggaagaggccgtggggacgattaaggacaaatatgagcgtgaacgtgcaatgttgtttgatgagaataaaaagctcactgccgagaacgagaaattatgctcattcgtggacaagctcacggctcagaaccgccaactggaagacgagcttcaggatttagccgccaaaaaggagtcggttgctcattgggaagctcagatagcggagataatccaatgggttagcgatgaaaaagatgcccgcggttatctgcaggcactggctagcaaaatgaccgaagagctggaggctctgagaagttcctctcttggctcccggaccctggaccctctgtggaaagtgagaaggtcccagaagttagacatgtcagccagactagagctgcagtctgctctcgaagctgagatccgggcaaaacagctagttcaagaggaattgagaaaggtaaaggacgccaatttgaccttagaaagcaagcttaaggattcagaagctaagaatcgcgagctcctggaggaaatggaaattctgaaaaaaaaaatggaggagaagtttagagcggacacgggccttaaattaccagactttcaggactcaatatttgaatatttcaacacggctcctttagcccacgatcttacatttcggacttctagcgccagtgaacaagaaacccaagcccctaagcccgaggcttcacccagtatgtctgttgctgccagtgaacagcaggaggatatggcaagaccccctcagcgcccttctgctgtgcctctgccaacgactcaggctctagctctcgccggacccaaaccaaaggcacatcaatttagtattaaatctttttcctccccgactcaatgttcccactgcacaagccttatggttggtcttatccggcagggctacgcctgcgaggtctgcagcttcgcctgccacgttagttgcaaagacggggctcctcaggtgtgtcccattcctcctgaacaaagcaagcgaccccttggcgtggatgtacaacgcggcataggtaccgcttacaaggggcacgtgaaagtgccaaagccgacaggtgtcaagaagggatggcagagggcctacgccgtcgtttgtgattgcaaactcttcttgtacgatcttcccgagggcaagtcaactcaacccggagtcatagcctcacaggtcctggatttacgggacgatgaattctcagtctcttctgtactggccagcgatgtcattcacgctacacggagagacataccgtgcatcttccgcgtcaccgccagcctgctaggggcccccagcaagacatcaagccttctgattctgaccgaaaacgagaatgagaagcgaaaatgggtgggcattctcgagggcttacagagtatcctgcataaaaataggctgaggaatcaggtcgtacacgtaccactcgaggcctacgactcttccttgccccttatcaaagcgatactgaccgccgccatcgtggacgccgatagaatcgccgtgggcctagaggaggggctgtacgtcatcgaggtgaccagagacgtgattgtcagagccgccgactgtaaaaaggtgcaccaaatcgagctagctccacgggagaaaatcgtaattctcctctgtggcagaaatcatcacgttcacttgtacccttggagctctctcgatggcgctgaaggctcttttgacatcaagctaccagagaccaaggggtgccagttgatggccactgcgacacttaagcgaaactccggaacttgtctgttcgtcgcggtgaagcgcctaatcctgtgctacgaaatacagcggacaaaaccatttcaccgcaagtttaacgagatcgttgcaccaggctctgtacagtgtctggctgtgctcagagataggctgtgtgtggggtaccctagcgggttttgcctgctgagtatccagggcgacgggcagccgttgaacctcgtaaaccctaacgacccctcactagcttttctctcacaacaaagttttgacgctttatgcgcagtggagctcgaatctgaagagtacttgctttgcttctctcacatgggcttatacgtcgacccacagggacggagggctcgtgcgcaggagctgatgtggcccgctgcacctgtggcatgctcttgctcacccacgcacgtgactgtgtactcagagtacggcgttgatgttttcgatgtgagaaccatggaatgggttcagaccatcggcctgcgtcgcatccggcccctgaactccgagggaaccctcaacctcctaaattgtgagccgcctagactgatatattttaagagcaagtttagtggagcagtcctgaacgttccagacacctctgacaattcgaagaaacaaatgcttagaacacgcagtaaaagaaggttcgtcttcaaggtccccgaggaggaacggttgcaacagagacgggaaatgttgagggaccccgagctgcgcagtaaaatgatcagtaatcctactaatttcaatcatgtcgcgcacatgggccctggtgatggaatgcaggtccttatggacctgcccttatctgctgtcccgcctagtcaggaggaaaggccaggccccgcaccaacgaatctggcgcgccagcctccatcgagaaataagccctacatctcctggccctcttctggaggctctgagccctctgtcactgtgccgctacgcagcatgtcagatcctgaccaggatttcgacaaggagccggactccgacagtaccaaacattccacccctagcaattcctcgaatccctctggacccccaagtcctaacagcccgcaccggagccagttgcccctggagggactggagcagcccgcctgcgacacctag

SEQ ID NO: 182294 - DNA, 1593 bp, Artificial Sequence
  Description of Artificial Sequence: Synthetic coding sequence
aaggtgcggcggagccagaagctggacatgagcgcccggctggagctgcagagcgccttggaagccgaaatccgtgccaagcaactggtgcaggaagagctgagaaaagtgaaggacgcgaatttaacactggaatccaagttgaaggattctgaggctaagaatagagagcttcttgaggagatggagatcctgaaaaaaaagatggaagagaagttcagggctgacaccgggctgaaactgcctgactttcaggacagtatctttgagtatttcaataccgctcctctggcccatgacctgaccttccgcacctccagtgccagcgagcaggaaacacaggcccctaagcccgaggcatctccttccatgtccgtcgccgctagcgaacagcaggagccaaaggcccaccaattttctatcaagtcgtttagcagcccaacccagtgttcccattgcacctccttaatggtgggcctgatccgacagggctacgcatgcgaggtttgtagtttcgcatgccacgtttcctgcaaggatggggccccccaggtgtgtcccattccaccagaacagtctaaaaggcctttaggagtagatgtccaacgcggcatcggcactgcgtacaagggccatgtcaaggtcccgaaacccactggtgtgaaaaagggatggcagcgtgcctatgcagtagtatgtgattgcaaactcttcctgtacgacctgccagagggcaaaagcactcagcccggagtgatagcttctcaggtcctggacctgcgggacgatgaattttccgtatcttcggtccttgccagcgatgttatacacgccactcggcgggacatcccctgtatctttcgagtcacagccagccttctcggcgcgcccagcaagacctcatccctgctaatactgacagaaaatgaaaacgaaaaaaggaagtgggttgggatattagagggtctgcaaagcatcttgcataagaacagactccggaatcaggtggtgcacgtgcccttggaagcctatgactccagcctgcccctgatcaaggcaatcctcacagctgctatcgtcgacgccgacaggatcgccgtgggcttggaggaggggctgtacgtgattgaagtaaccagagacgtgatcgtccgagcagcagactgtaagaaagttcaccagatcgagttggctccccgcgaaaaaatagttatcctcctgtgtgggagaaaccaccatgtgcatttatatccttggtcatccctggatggagcagagggtagcttcgatattaagctcccagagacgaagggttgccagctcatggccacagctactttgaagcggaacagcggcacttgcctcttcgtggctgttaaacgactgattctgtgttacgaaattcagcgcacgaaacctttccatcgcaagttcaatgaaatcgttgctcctggctctgtacagtgcttggcggtcctcagagaccgactgtgcgtcggttaccccagcgggttctgcttactgtctattcagggcgacggccagcctttaaacttggtgaatcccaacgatcccagcttagccttcctttag

SEQ ID NO: 182295 - DNA, 4656 bp, Artificial Sequence
  Description of Artificial Sequence: Synthetic coding sequence
atggagcggcggctgcgggccctggagcagctggcccggggcgaggctggaggctgccctggattggacggcctgctagacctgctactcgcactgcaccacgagttgagtagtgggccactcagaagggagaggagtgtggcccagttcttaagctgggcctctccatttgtctccaaggtgaaggaactgcggcttcagcgggatgacttcgagatcctgaaggtgataggtaggggcgccttcggagaagtcactgtggtgagacaacgcgatacaggtcagatattcgccatgaagatgcttcacaagtgggagatgctcaagcgggccgagacagcatgtttcagagaagagcgcgatgtattagtcaagggagactccagatgggttaccaccctgcattatgcatttcaggatgaggaatacctgtatctggtgatggactattatgccgggggtgatttactgacgctgctaagccgtttcgaagataggctccctcccgagctcgcgcagttctatctggcggaaatggtcttggccattcattcccttcatcaactaggctatgttcatagggacgttaaacctgataatgtattgctggacgtcaacggccatatcaggctcgctgactttggcagctgcctccggcttaacactaacggcatggtggatagtagcgtcgcagtcggaacccccgattatattagccctgaaatcctccaggctatggaagaagggaagggtcattatggaccccagtgcgattggtggagcctgggcgtttgtgcctatgaactcttgttcggcgagactcccttctacgcagagagccttgtcgagacctacggaaagatcatgaaccacgaagatcacttgcaatttccccccgatgtcccagatgttccagcttccgcccaagaccttattcgacagctcctgtgtcgccaggaagagaggcttgggaggggcggcttagacgatttcaggaatcaccctttctttgagggggtcgactgggaaagattggcctctagtactgctccgtatatcccagagcttcgtggtccaatggacacatccaatttcgacgtcgacgacgatacactgaaccaccctgggactctgccccccccctcacatggcgcgttttctggccaccacctaccatttgtgggctttacctacacaagtggctcccactcgccagaaagtagcagcgaagcatgggccgccctggagcggaagttgcaatgccttgaacaggaaaaggtggaactcagtcggaaacatcaggaagccctgcacgcgccaaccgaccatcgcgagttggaacagttaaggaaagaggtccagaccctgcgagatcgtctcccagagatgctgagggacaaagcctccctttcgcagacagacggacctccagccggaagccctggccaggactccgatctaagacaggagctcgaccgcttgcaccgggagctcgctgagggaagggctggcctccaggcacaggaacaagagttgtgtcgggcacagggccagcaagaggagctactacaaaggctgcaggaagctcaagaacgggaggctgcgaccgccagtcagaccagggctttatcgtcccaactcgaggaagcccgtgctgcccagagggaactggaggcgcaggtatctagcttgtctcggcaagtgacccaactccaaggacagtgggagcaacggctggaggaaagcagccaagccaagacaatccatacggcgagcgaaaccaatggaatgggcccccccgaaggcggacctcaagaagcgcagctgaggaaagaagtggccgctttgcgtgaacagctcgagcaggcccactcccacagaccttctggaaaagaggaagctctctgtcagctgcaggaggagaaccgacggctgagcagagaacaggagcgcttggaagccgagttagcgcaggagcaggagtcgaagcagcggcttgagggcgagcgcagagaaaccgagtccaactgggaagcgcagctggcagatatcctgtcctgggtcaacgatgaaaaggtgagtagagggtacttgcaggcacttgcaacaaagatggccgaagaactggagagcttacggaacgttggcactcagaccttacctgcccgtccgctggatcaccaatggaaggcacgccgattacagaaaatggaagcttctgctagactagaactgcaatctgcacttgaagctgagatacgagccaaacaggggttgcaggagaggcttacacaagtgcaggaagcccagcttcaggcggagagaaggctacaggaagctgagaaacagtcacaagccctacaacaggagcttgccatgctacgggaggagctacgcgccaggggccccgtcgacaccaaacccagtaactcgcttatcccattcctgagctttcggtcaagtgagaaggattccgccaaagaccccggtatcagcggcgaggccacgcgccatggcggtgagccagatttgcggcctgagggtcgcaggtctctcaggatgggggccgtgttccccagagcccccaccgcaaacacggcctctaccgagggtctacccgctaaacctggaagccataccctgcgacccaggagcttcccgagccccaccaagtgtcttcgatgtacttcgcttatgctgggactgggcagacaaggcctggggtgcgacgcgtgtggttatttttgccacactacttgcgctccccaggcaccaccttgtccagtccccccggacctgctgcggactgccctgggggtacaccccgaaaccggaaccggaaccgcttacgagggtttcctgtctgtgcccagaccatctggagtccgtcgtgggtggcagagagtctttgccgccctatctgattcacgcctcctcctgttcgacgctcctgacctgcgactttcgcccccatctggcgcgttactccaagtgttagacttacgagatcctcagttctcagccacaccagtcctggcaagtgatgtgatccacgcccagtcacgcgacctgcctcgtatatttcgggtgaccacgagtcagctggcggtgccacctactacatgcactgttctgctcttggccgagagcgaaggtgagagggagcgttggctacaggtgctcggcgagctgcagcgactactactggatgcaaggcctagacctagacctgtatacactctgaaagaggcttacgataatgggctgcctctgctccctcatactctgtgcgcagctattctcgatcaggatcgcctcgctctgggaacggaggaaggcctattcgtgatacacctcagatctaacgatatcttccaggttggcgagtgtagacgggtgcagcagttgacactctcccccagcgctggccttctggttgtcctgtgtggacgcgggccatccgtacgactgttcgctcttgctgagctggaaaacattgaagtggcgggcgctaagattcctgaatcccgggggtgtcaggttttagccgccggcagtatactgcaggcaagaacgccggtcttgtgtgtggcagtcaaacggcaggtcctatgctaccagctgggacctggacccggaccatggcagcgacgcatccgagaactgcaagcaccagctacagtgcagtctttaggcttgttaggcgatcgtctctgcgtgggcgctgcgggcggcttcgctctctacccgctgctgaacgaagccgctccgttggctttgggggccggccttgtgcctgaggaacttccgcccagcaggggtgggctcggagaagccctgggcgctgtcgagctctccctcagtgaatttctacttctcttcaccacagcaggaatttatgtggatggggcaggtcgcaaatccagaggccacgagctgctgtggcccgctgcaccgatgggctggggctacgccgccccctatctgaccgtgttcagcgagaactctattgacgttttcgacgtacgcagggctgaatgggtgcagaccgtccccctgaagaaggttcgcccacttaatcctgaaggcagtctatttctttacggcacagagaaagtgcgactcacatatcttcggaaccagctggcagagaaggatgaatttgatatccctgacttaacagacaactcacgcaggcagctgttccggacgaaatccaaacgccggttttttttcagggtttctgaagagcagcagaagcaacaaagaagagagatgttgaaggatcccttcgtgcggtccaaactgatatccccgcccacgaatttcaatcatctggtgcacgtggggccagccaacggccggcccggagcacgtgacaaatcccctgcccccgaggaaaagggacgcgtcgcacgtggtagtgggccccaaaggcctcattcattttcggaagcccttcgtcgtcccgccagcatggggtcagaaggcctcggtggcgatgccgacccaatgaaaagaaaaccttggacatccctatcaagtgagtcggttagttgccctcagggcagcctgtcacctgctacatcattaatgcaggtatccgagcggcctcgcagtttaccgctctcacccgagctggagagttcaccttag

SEQ ID NO: 182296 - DNA, 1176 bp, Artificial Sequence
  Description of Artificial Sequence: Synthetic coding sequence
atgcccggcccccagggcggccggggcgccgccaccatgagcctgggtaaactgtcccctgttggctgggtttcttcatctcaaggcaaaagaaggcttacagccgacatgatttcacatcctctgggggacttcaggcatacgatgcatgtgggtcggggcggcgacgtgtttggtgatacaagctttctgtctaatcatgggggatcctccggatccacccatcgctccccccgttcctttcttgctaagaaactgcagttggtccgacgagttggagcacccccccgaagaatggctagcccacctgccccaagtccagcaccgcctgcaatttctcctattattaagaatgctatttccctgccacagttgaaccaggctgcctacgactccctggtggttggcaagctgtcatttgacagtagccctacgagtagcacagacggacacagcagctatggacttgactcaggattttgcactatctcaaggttgccgagatctgaaaagccccacgatagggatcgggacggttcgttcccatctgagccaggcctgcgtaggagcgattctttactcagttttcggctggatttagacttggggccttctctgctctcggagctgctgggcgtgatgtctctgcctgaagcccccgccgccgaaacaccagcgcctgctgctaatccaccagcccctacagcaaaccctacagggcccgctgcaaatccacctgccaccaccgccaaccctccagcgccggctgctaacccctcggcacccgccgccacgcccacgggaccagccgctaacccccccgctcccgccgcatcctctaccccacacggtcactgtcctaacggagtcacagcaggactgggccccgtagccgaggttaagtcttcaccagtcggaggggggccccggggacccgccgggcccgctctgggtcgtcattggggcgcggggtgggacgggggacaccactatcccgaaatggatgcacggcaggagagggtagaggtgctgccccaggccagggcatcgtgggagtcactcgatgaggagtggagggccccccaggctgggagccgaacccctgtcccctccactgtgcaggccaacacttttgaattcgcggatgccgaagaagacgacgaggtaaaagtgtag

SEQ ID NO: 182297 - DNA, 183 bp, Artificial Sequence
  Description of Artificial Sequence: Synthetic coding sequence
atgcccggcccccagggcggccggggcgccgccaccatgagcctgggcaagctgtcccccgtgggatgggtttcgtcctcacaggggaaacgccggctgaccgctgacatgatcagccatccacttggtgatttcagacatactatgcacgtggggcggggcggtgacgtattcggcgactag

SEQ ID NO: 182298 - DNA, 213 bp, Artificial Sequence
  Description of Artificial Sequence: Synthetic coding sequence
atgcccggcccccagggcggccggggcgccgccaccatgagcctggggaagctgagtccggtgggatgggtgtcatccagtcagggcaaaaggcgcctgactgctgatatgatatctcaccccttaggcgacttcaggcacaccatgcacgtcggaaggggaggcgacgtctttggcgacacctccttcctgtctaatcacggaggatcctag

SEQ ID NO: 182299 - DNA, 147 bp, Artificial Sequence
  Description of Artificial Sequence: Synthetic coding sequence
atgcccggcccccagggcggccggggcgccgccaccatgagcctgggaaagctttcacctgtcggatgggtgagttcgagtcaaggcaagaggaggctgactgccgacatgatctctcacccattaggggacttccgccacacctag

SEQ ID NO: 182300 - DNA, 633 bp, Artificial Sequence
  Description of Artificial Sequence: Synthetic coding sequence
atgagcaccaaggtgcccatctacctgaagcggggcagccggaagggaaagaaggaaaaattgcgggatttactgtcctctgacatgatttccccgcccctgggagattttagacatactatccacattgggtcgggggggggctctgatatgttcggcgatatctcctttctgcagggcaaattccatcttctgcctggcactatggtggaagggccagaggaggatgggaccttcgatctgccctttcagttcacgcggaccgccacagtatgtgggagggagctgccggatggcccctcccccctgctcaagaacgcaatttcgcttccagtcattggcggtccacaggctttgactctgcctacagctcaggcccctccaaagccacctaggctccatctggaaacaccacagccatctcctcaggaaggcggcagcgtggatatctggagaataccagagaccggttcccctaattcaggtctcacacccgagtccggcgccgaagagccatttctgtcaaatgcgtcttccctcctgtcactgcacgttgatttgggaccttccatattggatgatgtccttcaaattatggaccaggatttggactcaatgcaaattcccacctag

SEQ ID NO: 182301 - DNA, 633 bp, Artificial Sequence
  Description of Artificial Sequence: Synthetic coding sequence
atgagcaccaaggtgcccatctacctgaagcggggcagccggaagggcaagaaggagaaactgagagatttactctcatccgacatgatctcacccccacttggcgatttccgtcacaccatccacatcggatctggcggaggcagtgatatgtttggggacatctcttttctgcaaggaaaatttcacctgcttccaggaacaatggtggagggaccagaagaggatggtaccttcgacctgcctttccagttcaccaggacagcgactgtctgcggccgggaactgccagatggtccatcacctctcctaaagaacgccattagcctgccggtgattgggggcccccaggccctcaccttgccaacggcccaggctccgcccaagccgcctcgattgcatctcgagactccccagcccagccctcaagagggcgggtctgtcgacatctggaggatacctgagacaggatctcctaacagcggactgaccccagagtctggagcagaagaacccttcttaagcaatgcgtcatctttgctgtctctgcacgtcgatctaggcccaagcattttagacgacgtgctgcagatcatggatcaggaccttgacagcatgcaaatcccaacgtag

SEQ ID NO: 182302 - DNA, 633 bp, Artificial Sequence
  Description of Artificial Sequence: Synthetic coding sequence
atgagcaccaaggtgcccatctacctgaagcggggcagccggaagggcaagaaggagaaactgcgggatctcctgagttccgacatgatcagcccgcccctgggggacttccggcacaccatacatattggcagcggcgggggcagtgacatgttcggagatatttcctttctgcagggcaagttccatctactacccggcactatggttgaaggacccgaggaggacgggaccttcgatctgccttttcagttcactcgcaccgcaactgtgtgcggcagggagcttcccgacggacccagcccattactgaaaaatgcaatatctctgcctgttattggggggccccaagccctgactttaccgacggctcaggcaccccccaagcctcctaggctgcacctcgagaccccgcagccctctcctcaggaaggcggctcagtggacatatggcggattcccgaaaccggttctccaaattccgggttgaccccagagtcaggggcggaagagccctttctgagcaacgcctcctcactgttatctctgcacgtcgacctggggccctccatcctggatgatgtgttgcaaattatggatcaagatttagactctatgcagattccgacgtag

SEQ ID NO: 182303 - DNA, 765 bp, Artificial Sequence
  Description of Artificial Sequence: Synthetic coding sequence
atgcccgccaagacccccatctacctgaaggccgccaacaacaagaagggtaagaaatttaaattaagggacattctgagtccagatatgatttcacctccattgggtgatttcaggcacacaattcacattggaaaagaaggacagcacgacgtgtttggtgacattagcttcctccaagggaactacgaattactgcctggtaatcaggaaaaagcgcacctggggcagttcccaggacacaacgaattcttccgtgccaactcaacctctgactcagtctttacggagaccccatcaccagtgctgaagaatgctatttcactgcccacaattggaggatcacaggcattgatgctgccactcctgagtccagtcacattcaacagcaagcaggagagtttcggacctgctaaactgcccagactcagctgtgaaccagtaatggaggaaaaggcccaggagaaatcgagcctattggaaaacggcaccgtgcatcagggggacacaagctggggctcgtccggttcagcaagccagtcttcacagggaagggactcacactcctcatcactctctgaacagtacccagactggcctgcagaggatatgttcgatcatcctaccccctgcgaactcatcaaaggtaagacgaagtccgaggagagtctcagcgatctcaccggcagcctcctgtccctgcagttggacctggggccgagcctgctcgatgaggtcttgaacgttatggacaaaaataaatag

SEQ ID NO: 182304 - DNA, 45 bp, Artificial Sequence; identical to SEQ ID NO: 76110
  Description of Artificial Sequence: Synthetic coding sequence

SEQ ID NO: 182305 - DNA, 108 bp, Artificial Sequence
  Description of Artificial Sequence: Synthetic coding sequence
atgcccgccaagacccccatctacctgaaggccgccaacaacaagaaaggcaaaaagttcaagctgagagatatactctcaccagacatgatcagccctccgctgtag

SEQ ID NO: 182306 - DNA, 651 bp, Artificial Sequence
  Description of Artificial Sequence: Synthetic coding sequence
atgcccgccaagacccccatctacctgaaggccgccaacaacaagaaagggaagaagttcaaactgcgcgacattctgtcgccagacatgatctcccctccactcggggatttcagacacacaatccatataggaaaagaaggccaacacgacgtctttggcgatattagcttcttgcagggcaattacgagttactccctggcaaccaagagaaagctcacctgggacagttcccaggacataatgaatttttcagagccaacagtactagcgactccgtgtttacagaaaccccctcaccagtgcttaagaacgcaattagcctgccaaccatcggaggttcccaggccttaatgctccccctcctgtccccagtcacattcaactcaaagcaagaatcctttggaccagctaaattacctcgtctgtcatgcgagcctgtaatggaagagaaagcacaggaaaaatcctccctgttggaaaatggcaccgtgcatcaaggagacacatcgtggggttctagcgggtccgctagtcaaagctcccaggggagagattcacactcaagctccctgagcgagcagtatccagattggccggctgaagacatgtttgaccacccaaccccatgtgagctgatcaagggttag

SEQ ID NO: 182307 - DNA, 1071 bp, Artificial Sequence
  Description of Artificial Sequence: Synthetic coding sequence
atgcccatcctgaagcagctggtgagcagcagcgtgcacagcaagcgtcgttctcgagctgatcttacggcagagatgatttccgctcctctgggcgattttaggcatactatgcatgtggggagagcaggggatgcgttcggagatacatccttcctgaattctaaggcgggagaaccggatggcgagagcctagatgagcaaccatcaagttcaagcagcaagcgcagcctgcttagcagaaagtttcggggctccaaacggtcacagagtgtcaccaggggcgagcgcgagcagagggatatgcttggcagccttagagactccgctctgttcgtgaagaacgcaatgagtcttccccagcttaatgagaaggaggctgcagagaagggcacgtccaagttacctaaatctctgtctagttctccagtgaaaaaagctaatgatggcgagggcggcgacgaagaggccggcactgaagaggctgtgcctcgccggaatggggcagccggcccacacagcccagatccgttgctggacgagcaagcgttcggagacctgaccgaccttcctgtcgtgcccaaggcaacatatgggcttaagcatgctgagtctataatgtcatttcatatagacctaggaccctccatgctgggggacgttctttccatcatggacaaggaggaatgggacccagaagagggagaggggggctatcacggggacgagggggcggccgggaccatcacgcaggccccaccttacgccgttgctgcaccacccctcgcgcgacaagaaggcaaagccgggccagacctcccttctcttccatctcatgctcttgaggatgaaggctgggccgccgccgccccgagtccgggttccgcccgttccatgggatcccataccaccagagattcctcttctctgtcttcgtgtacgtcaggcattctggaggagagaagcccagccttcagaggtccagatcgcgctagagcggccgtttcacggcagcctgataaggaattttccttcatggatgaggaggaggaagatgaaatccgagtgtag

SEQ ID NO: 182308 - DNA, 861 bp, Artificial Sequence
  Description of Artificial Sequence: Synthetic coding sequence
atgcccatcctgaagcagctggtgagcagcagcgtgcacagcaagagacgctcccgcgccgatctgactgccgaaatgattagtgccccgcttggggactttcggcacactatgcacgtgggacgggcaggggatgcttttggagacaccagcttccttaactccaaagctgcagagaaaggaacctcaaaattgcctaagagcctcagctcttcccctgtgaaaaaagccaatgacggcgaagggggggacgaggaggcagggactgaagaagctgttccacggagaaatggtgctgctgggccacattctcctgatcccctcctggacgagcaggcttttggagatctgaccgacctgccggtggtacctaaagctacttacggcctcaagcatgctgagtctatcatgtccttccatatcgatttagggccaagcatgctgggagacgtgctttctattatggataaggaggaatgggatccagaggagggtgaaggaggctaccacggggacgagggggccgccggcactataactcaggctcctccgtacgctgtggccgccccccctctggcccgccaagagggcaaagccggccctgatctgccctcacttccctctcacgcccttgaagatgaggggtgggccgcggcagccccgtctccaggcagcgcccggagcatggggtcccataccacaagggactccagtagtctttccagctgcacttctggcattctggaagagcggagtcctgcctttcggggccctgatagggccagagcagccgtgagtcggcaacccgataaggagttttctttcatggatgaagaagaggaagatgagatccgggtttag

SEQ ID NO: 182309 - DNA, 1551 bp, Artificial Sequence
  Description of Artificial Sequence: Synthetic coding sequence
atgaccctgctgatcaccggcgacagcatcgtgagcgccgaggccgtttgggatcatgtgactatggcaaaccgtgagcttgccttcaaggccggcgacgtcattaaggtactggacgcttcaaacaaggattggtggtggggccagattgacgacgaggaaggttggttccctgcctctttcgtaagactctgggttaatcaagaagatgaagtggaggaaggcccgtccgatgtacaaaacggacaccttgatcctaactccgactgcctgtgtttggggcgccctctgcagaacagagatcagatgcgcgcgaacgtgattaacgagattatgagcacggaacgacattacataaagcatctcaaggatatctgcgaggggtacctcaaacagtgccgaaagcgcagagacatgttttcggacgagcagttgaaggtgatatttggcaacatcgaagacatctacagatttcagatggggtttgtgagggacctggagaagcagtacaataatgacgatccccacctgtccgaaatcggcccctgtttcctggaacaccaggacggattctggatctattctgaatactgcaataaccatctcgatgcttgtatggaactatctaaattaatgaaagattccaggtaccagcatttttttgaagcgtgccgtctactccaacagatgattgacatagctatcgatggattcctgctcacccctgtccagaagatttgtaagtaccctcttcaactagcagagcttctcaagtataccgctcaggaccattctgattaccgatacgtcgctgctgctcttgcagtgatgcggaacgtgacgcaacaaattaacgaacgcaagaggaggctcgagaatatcgataagatcgctcaatggcaggccagcgtcttagactgggagggcgaagacattctggatcggagttctgagctaatttatactggggagatggcttggatctaccaaccgtatggacgaaatcagcagcgcgtattttttctgtttgatcaccagatggtgttatgcaagaaggacctgattcgtcgggatattctctactacaaagggcggattgatatggataagtatgaggtagtcgacatcgaagatgggcgagatgacgattttaatgtgtccatgaagaatgctttcaagctgcacaataaggagaccgaggaaatacaccttttttttgctaaaaagctagaggaaaaaatccgttggctccgggcctttagagaggagcgcaaaatggtgcaagaagacgagaaaatcggcttcgaaattagcgagaatcagaagcggcaagccgcaatgacagtccggaaggtccctaagcagaaaggtgtcaattccgctcggtcagtacctcctagttatcctcctcctcaggatcccctgaaccacggacagtatctagtccctgacggcatcgcacaatcccaggtcttcgagtttactgaacccaaaagatctcagtctccattctggcaaaacttttccaggctcactccttttaagaagtag

SEQ ID NO: 182310 - DNA, 1245 bp, Artificial Sequence
  Description of Artificial Sequence: Synthetic coding sequence
atgcgggccaacgtgatcaacgagatcatgagcaccgagcggcactatatcaagcatctcaaggacatctgcgagggttacctgaagcagtgtcggaaaaggcgagacatgttcagtgatgagcaactaaaagttatcttcggaaacatcgaggacatctacagatttcagatgggattcgtacgggacctcgagaaacagtacaataatgatgacccacacctgtcagaaatcgggccttgcttcctcgagcatcaggacggtttctggatttatagtgagtactgcaacaaccatttggatgcttgcatggagctctccaaacttatgaaggactccagataccagcacttcttcgaggcttgtcgcctgctgcagcagatgatcgacatcgctattgacgggttccttctcacaccagtgcagaaaatatgtaagtatcccctgcaactggcggaacttcttaagtataccgcgcaagatcatagcgattaccgctacgtggcagccgcccttgccgtaatgcggaatgttacacagcaaataaatgagagaaaacggaggctggagaacatcgacaaaatcgctcagtggcaagcctctgtcctggattgggagggggaagacatccttgaccgcagcagtgagttaatctatacaggcgaaatggcatggatttatcagccatatggccgcaaccaacagagagtgttcttcctttttgaccaccagatggtactctgcaaaaaggaccttattagacgagatattctttactataagggacgtatcgatatggacaagtatgaagttgttgacattgaagacggccgggatgatgactttaacgtttcaatgaagaacgcattcaagcttcataataaggagaccgaagagatccacctgttcttcgccaaaaagcttgaggagaaaattcgctggctgagggcattcagagaagagaggaagatggtgcaagaggacgagaaaatcggattcgagatcagtgagaatcagaagaggcaggcagctatgaccgtgcgaaaagttcccaagcaaaaaggtgtgaatagcgctcgatcagtaccaccctcctacccccctccacaggaccctctaaaccatggacagtaccttgtccctgacggtatcgctcagtcccaagtgtttgagtttacggagcctaaaagatcgcaaagtcctttctggcagaactttagtaggcttacccctttcaagaaatag

SEQ ID NO: 182311 - DNA, 1488 bp, Artificial Sequence
  Description of Artificial Sequence: Synthetic coding sequence
atggccaaccgggagctggccttcaaggccggcgacgtgatcaaggtgttggatgcctctaacaaggattggtggtgggggcagatcgatgacgaagaaggctggttccctgctagctttgtgcgattatgggtgaaccaagaagatgaggtcgaggaggggccgtcagatgttcagaacggacacctagatccaaattctgactgtttatgtttgggcaggcctctgcagaacagggatcaaatgagggccaatgttatcaacgagataatgagtacggagcggcactatattaaacacctcaaagatatttgtgaaggctacctgaaacaatgtaggaagcggagggatatgttcagcgacgagcaacttaaggtaattttcggcaatattgaagatatatacaggttccagatgggatttgtgagggatctcgagaaacagtacaacaacgacgacccacatctgtctgagatagggccttgttttcttgagcaccaggacggtttctggatctactcggagtattgtaataatcatcttgatgcctgcatggaactcagcaaactcatgaaggattctcgctatcaacacttttttgaggcctgtaggctgctgcagcagatgatcgacatcgcaatagacggctttctgctgactcctgtgcagaagatctgcaagtaccctcttcagttggcagagcttctcaagtacacagcacaagaccactcggactatcgatatgtcgcagcagccctggccgttatgagaaacgttacacagcagatcaatgagcggaaaagaagactggaaaacatcgataaaattgctcagtggcaagcttctgtgctcgactgggagggcgaagacattctcgatcggagtagcgaactgatttatacaggcgagatggcgtggatttatcagccgtacggtcggaaccagcagagggttttttttctatttgaccaccagatggtgctctgtaagaaggatctcattcgaagagatatcttatattataagggccgtatcgatatggacaagtacgaggtagtggacatcgaggatggcagagatgatgactttaatgtctccatgaagaacgcattcaagttgcacaacaaagaaacagaagaaatccacctgttttttgccaagaagctcgaagaaaaaatcaggtggctgagagcattcagggaagagcgcaaaatggttcaagaggacgagaagataggctttgagatttcagagaatcaaaagcgccaggcggctatgacagttcggaaagtcccaaagcagaagggcgtcaattccgcgaggtcagtgcccccatcatatccacccccccaggaccccctgaaccacggtcagtacttggttccagacggaatcgcccagtcgcaagtgttcgaatttacggaaccaaagagaagtcagagtccattctggcaaaatttcagccgattaaccccattcaaaaagtag

SEQ ID NO: 182312 - DNA, 1437 bp, Artificial Sequence
  Description of Artificial Sequence: Synthetic coding sequence
atgctgatcaccggcgacagcatcgtgagcgccgaggccgtgtgggatcacgtcacaatggctaatcgcgagctggctttcaaggccggggacgtgataaaagtgctcgacgcctccaacaaagactggtggtggggccaaattgacgacgaggagggctggtttccagcatccttcgttcgactctgggtgaaccaagaggatgaggtggaagaggggcccagcgatgttcagaacggtcacctcgacccgaatagtgactgcctgtgtctgggaaggccgttacagaatcgtgatcagatgcgcgctaacgtgataaatgagattatgtctacagaacggcattacataaagcacctaaaggacatttgtgaggggtatctgaaacagtgccgaaagcgtcgcgatatgttttctgatgaacaacttaaagttatcttcggtaacatcgaagacatctatcgattccagatgggatttgttcgggatttggaaaaacagtacaataacgatgacccacacttgtcagagattggcccatgttttctcgagcaccaggatggattctggatctactccgagtactgcaacaaccatctggatgcatgcatggagctgagtaaactgatgaaagattcgaggtatcaacacttttttgaggcgtgtcgattgctccaacagatgattgatatcgcaatcgacggcttcttgctcacaccggtgcagaagatctgcaaatatccattacaactcgctgagttactcaagtatacagcgcaggaccactccgactacagatatgtggccgcggccctagctgtcatgaggaatgtgactcagcaaattaatgaaaggaaacggcgattggagaatattgacaaaattgctcaatggcaggcttctgttttggattgggaaggtgaggatatactggaccggtcgtcggagctgatttataccggggagatggcctggatttaccagccctatggtcgaaatcagcagcgggtcttctttctgttcgaccatcaaatggtcctctgcaaaaaggaccttataagacgcgatatcctgtattacaaaggacgcattgatatggacaagtatgaagttgtcgacattgaggacggaagggatgatgactttaatgtttctatgaaaaatgcctttaaattgcacaataaggagactgaggagattcatcttttttttgccaagaaattggaagagaagatccggtggttgcgcgcgtttagggaggaacggaaaatggttcaggaagacgaaaagatcggattcgagatctccgaaaatcagaagaggcaggccgcgatgaccgtgagaaagctccccttcccgcaactttccgaagctcggatctgctcaccaaaaggatttgctagcgtgtttaacggtacatgttgtggcgaatcttag

SEQ ID NO: 182313 - DNA, 732 bp, Artificial Sequence
  Description of Artificial Sequence: Synthetic coding sequence
atgatcgacatcgccatcgacggcttcctgctgacccccgtgcagaaaatatgcaagtatcctctgcagctggccgagctactgaagtataccgcccaagatcactcggattataggtatgtcgccgctgccctcgccgttatgcgcaacgtaacacagcagatcaatgagcgtaagaggcggctggaaaacattgacaaaattgctcagtggcaggcttcggtgctcgattgggaggatctgatcagacgggacattctctattataaggggaggatagacatggacaagtacgaggtggtggacatcgaggacgggagagacgacgatttcaacgtgtcgatgaaaaacgccttcaagctgcacaataaagagaccgaagaaatacatctgttctttgccaagaaacttgaagagaaaatccgatggctgagggcgtttcgggaagaacgaaaaatggtgcaggaagatgagaaaattggttttgagatctctgaaaatcaaaagcggcaggccgcgatgacagtccggaaggtcccgaaacagaaaggagttaactccgcccggtcggtgccccctagttaccctcccccacaagatcccctcaaccacggtcagtaccttgtgccagacggaatcgcacagagtcaggtctttgagttcactgaacctaaacggtcacagtcccccttctggcagaatttcagcaggttaaccccctttaagaaatag

SEQ ID NO: 182314 - DNA, 1392 bp, Artificial Sequence
  Description of Artificial Sequence: Synthetic coding sequence
atgcagtggatccggggcggcagcggcatgctgtgggtgaaccaggaagatgaggtggaagaaggcccctctgatgtacaaaatggacatctggatccaaattctgattgcctttgcctgggtcgcccccttcagaaccgcgaccagatgagagcgaatgtgataaacgaaatcatgtcaaccgaacggcattacattaagcacctgaaagatatctgcgaaggttatctgaagcagtgtcggaagcgccgggatatgttttccgatgaacaactgaaggtgatttttgggaacatagaagacatttaccggtttcagatggggttcgttagggatcttgagaaacagtacaataatgatgatccgcatctctccgagattgggccatgctttcttgaacaccaagacgggttctggatctactccgagtactgtaacaaccacctggatgcctgtatggaactttccaaattgatgaaggatagtaggtaccaacacttcttcgaggcatgccgcctcctgcaacagatgatcgacattgcaatcgacggattcttgctgacgcccgtgcagaagatctgtaaatatccactgcagctggccgaactgctgaaatacacagcccaggaccacagtgactaccgctatgtagccgcagccctggctgtcatgcggaacgtgacccagcaaattaacgagcggaagagaagacttgaaaacattgataagattgcccaatggcaagcatcagttctagattgggagggcgaagatatcttggacagatcgtccgagctgatttacactggcgagatggcctggatctatcaaccgtacggcagaaaccagcagagagtgtttttcctgtttgatcatcagatggtgctgtgtaagaaagacctcataagacgcgacatcctgtactacaaagggagaatcgacatggacaaatatgaagtggtggacatcgaggatggaagagacgacgatttcaacgtgtcaatgaaaaacgcatttaagttacacaacaaagagacagaagagatccaccttttcttcgccaagaaattggaggagaagataaggtggctcagagccttccgcgaggagaggaagatggtacaggaggacgagaaaatcggctttgaaatctccgaaaatcagaagcgccaggctgccatgactgtccgcaaggttcccaagcagaaaggtgtgaatagcgccaggtctgtgcccccgtcatatccacctccacaggacccactcaaccacgggcagtacttggtgcctgacggaattgcacagagccaagtgtttgagtttactgagcctaaacgatcccaatctcccttttggcagaatttttctcgcctgacgcccttcaaaaagtag

SEQ ID NO: 182315 - DNA, 2409 bp, Artificial Sequence
  Description of Artificial Sequence: Synthetic coding sequence
atgccccggatcatgatcaagggcggcgtgtggcggaacaccgaggacgagatcctcaaagcagccgttatgaagtacggtaagaaccagtggagtcgtatagccagtctactccaccgtaaatctgccaagcaatgcaaggcgcgctggtacgaatggctggacccctcaattaagaaaacagagtggtctcgtgaagaagaagaaaaattgcttcacctggcgaaattgatgcctacccagtggcgcaccatcgcccccatcatcggcaggaccgccgcacagtgtcttgagcactatgaatttctactcgacaaggctgcgcagcgggacaacgaagaagaaacaactgatgaccctaggaaactcaagcccggggagatagacccaaatcccgagaccaagcccgccaggccggatccaatagacatggatgaggacgaattggagatgttgagcgaagcgagggccaggcttgccaacacgcagggtaagaaggcaaaaaggaaggcccgcgagaagcaacttgaagaggctcgacggctggcagctcttcagaaacgccgtgaactgagagcagctgggattgaaatccagaagaaaagaaagaggaagaggggagtggactataatgcagaaataccttttgaaaagaaacccgcactcggattttacgatacaagtgaagagaactaccaggccttagacgctgacttcaggaagttaaggcagcaggacctcgatggcgaactccggtcagaaaaagaagggcgtgatagaaagaaggataaacagcacctaaagagaaagaaagaatccgacctcccttctgccatactgcagacttcaggggtgagtgaattcaccaaaaagaggagcaagctggtgctgccagcgcctcaaatcagcgacgcggaacttcaggaggttgtaaaggtgggacaggcctcagaaatcgctcgccagacagccgaagaatctgggatcaccaacagtgccagctctactctgctgagcgaatataacgtcaccaataatagtgtggcactcaggaccccaaggaccccagcctcacaggaccgaatactgcaagaggcacaaaatctaatggctttgacaaacgttgacacaccactgaaggggggtctgaatacaccactgcacgagagtgatttttcaggtgtcaccccacaaaggcaagtggtccagacccctaatacggtgctcagcaccccattccggactccgtcaaacggggctgaagggctgaccccccggagcggtaccactccaaaaccagtcataaactctacaccaggtcgcacaccactcagggacaaactgaacatcaatccagaggacgggatggctgactattccgacccttcgtacgtgaagcagatggaacgcgaatcccgagaacacctgcgattgggccttcttgggctacccgcccctaagaacgatttcgagatcgtgctgcctgagaatgctgagaaagaactggaggagagggaaattgatgatacttacatagaggatgcagcagacgtggacgcaaggaagcaggccatcagggacgctgagcgtgtgaaagaaatgaaaagaatgcataaggcggtgcagaaggacttgccacggccctccgaagtaaatgagactatcttgcgccctttgaacgtcgagcccccactcaccgatttacagaagagcgaagagctaatcaagaaggagatgatcaccatgttgcactacgatctcctgcaccacccctatgagccaagcgggaacaagaagggtaagaccgtgggattcggaaccaacaactcagagcatatcacatacctggagcacaacccctatgaaaagttctctaaggaggaattgaaaaaggcacaagacgtgctcgtgcaggagatggaggtggtgaagcagggcatgtctcatggtgagctcagcagcgaagcgtataatcaggtttgggaggagtgttactcccaagtgttgtatttgcctggtcagtccagatataccagagcaaaccttgctagcaaaaaagaccggattgagtccttagagaaacggctggagattaatagggggcatatgacgactgaggccaaacgggcagccaagatggagaagaagatgaaaatactgttgggtggataccagtcccgcgccatgggtcttatgaaacagctcaacgatctttgggaccagatcgaacaggcccatttggaactccggacctttgaggagcttaagaagcatgaggattccgcgataccacggcgtttggaatgccttaaggaggacgtgcagcgccagcaggagagggagaaggaactgcagcaccgctacgccgatctgttgctagagaaagaaactctaaaatccaaattttag

SEQ ID NO: 182316 - DNA, 1455 bp, Artificial Sequence
  Description of Artificial Sequence: Synthetic coding sequence
atgcggcacagcaagcggacctactgccccgactgggacgacaaggactgggactacggaaaatggcggtctagctcctcacataagcgccgtaagaggtctcactcctccgcacaagagaacaagcgctgtaagtacaaccactctaaaatgtgtgacagccattatcttgagtcacggtccattaacgaaaaggattatcattcccggaggtatatcgacgaatacaggaacgactacacacaggggtgtgaacctgggcaccgccagagagatcacgagagtcgctatcaaaaccactcatccaagagctctgggaggtctggcagatcctcctacaagagcaagcatcgaatccatcattcaacctcccatcgtagaagtcatggcaaatctcatcgtagaaagaggacgcggagtgtcgaggacgacgaagagggccacctgatatgtcagtcaggtgacgtgctgagcgcccgctatgagattgtggacactctgggtgaaggtgcattcggaaaggttgtggagtgtatcgaccataaggccggtggaagacacgtggcagttaaaattgtgaagaacgtggaccgctattgcgaagccgcccggtcagaaatccaggtccttgagcaccttaatactaccgatcccaattccacctttcgatgcgtgcagatgctcgaatggttcgaacaccatggacatatatgtatcgtgttcgagctgcttggactgtctacctatgatttcataaaggaaaacggctttctccccttccgactggaccacatccgaaaaatggcttaccaaatatgcaagtccgttaactttttacacagcaacaagctgacccatacggatctgaagccggagaacatcctgtttgttcagagcgactatactgaagcatacaatccaaaaataaagcgggacgaacgcaccctcatcaatcccgatataaaagtggttgacttcggcagcgctacatacgatgatgaacaccacagcacgctggtctccacaagacactacagggctccagaagtcatcctcgcactagggtggagccagccctgcgatgtttggtctatcggttgcatattgattgagtactaccttggttttacagtgtttccgacacacgattccaaagagcacctcgctatgatggagcgcattcttggacccctgcccaagcatatgattcagaagacaaggaaacgaaagtatttccatcacgaccgtcttgactgggatgaacattcaagcgccggcaggtacgtcagcagacggtgtaaaccgcttaaggaattcatgttgagtcaggacgtggaacacgagcggctgttcgatctgatccagaagatgctcgaatatgatccagctaaacgaatcaccctgcgggaggccctcaagcacccatttttcgacctcctaaaaaagagtatttag

SEQ ID NO: 182317 - DNA, 1365 bp, Artificial Sequence
  Description of Artificial Sequence: Synthetic coding sequence
atgcggcacagcaagcggacctactgccccgactgggacgacaaggactgggattacggcaaatggcgatcatctagcagtcacaagaggaggaagcgcagccatagttccgcgcaggaaaacaagcgttgcaagtacaatcattcaaagatgtgtgattctcactatctggagagtcgtagcataaacgaaaaagattaccacagcagacgctatatagatgagtaccggaatgattacacccaaggatgtgaaccaggacacagacaacgggatcacgaaagtcggtatcagaatcattcctctaagtcgtcaggccgctctggaagaagttcgtataaatctaaacatcgcatccaccattcaacatcccaccgcagaagtcatggtgacgagattgtggatacactgggggaaggtgccttcgggaaggtggttgagtgcattgatcataaggccgggggcagacatgtggctgtaaaaattgtgaaaaacgtggatagatattgcgaagccgccaggtcagaaattcaggtcctcgaacacctgaataccacagacccaaactccacctttaggtgcgttcagatgttggaatggttcgaacaccacggacatatctgtatcgtttttgagttactcggtctgagcacctatgactttataaaagaaaatggctttcttcccttcaggctggaccatatcagaaaaatggcctatcaaatttgtaaatcagtgaattttttgcactcaaataaactaacacataccgatctgaagcctgagaacattctatttgtgcaaagcgattataccgaagcatacaaccccaagattaaaagggacgaacggactctcataaatccagacattaaggttgtggactttggtagcgcgacctacgatgacgaacatcatagtaccctcgtctccacccgacactaccgcgcccctgaggtcatcctcgcactgggatggagtcagccatgtgatgtttggtcaattggctgtatccttattgagtactaccttggattcaccgtctttcccacgcacgacagtaaggaacatctggccatgatggaaaggatcctgggtcctctgcccaaacacatgattcaaaaaactaggaagaggaaatatttccatcacgatcggttggattgggacgaacactcttcagcggggaggtatgtctctaggcgatgcaaacctctgaaggagtttatgctaagccaagacgtcgaacatgagaggctctttgacctcattcagaaaatgcttgagtacgacccggcaaaacgaatcacgcttagggaggcactgaagcatccattctttgatctgctaaaaaaaagcatctag

SEQ ID NO: 182318 - DNA, 1581 bp, Artificial Sequence
  Description of Artificial Sequence: Synthetic coding sequence
atggccgccggccggcggcccgccagcgccctgtggcccgagcggaggggcagtcctttgcgcggcgacttactggggttccaaaatgtgagggaaccttcttcttgcggtgaaacccttagcggcatgaggcacagtaagcggacatactgcccagattgggacgacaaggattgggactatggcaaatggagaagcagcagctctcacaagaggcgcaagagaagtcattcttcagctcaggagaataaaagatgtaaatataaccattctaagatgtgtgactctcactatctcgagtcccggtctattaatgagaaagactatcattctcgcaggtacatcgacgaataccgcaatgactatacccagggctgtgagcccggccacagacagcgggatcacgaaagcaggtaccagaatcattcctctaagagctccggcaggagcggaaggtcctcttacaaatctaaacacagaatccaccattcgacaagccaccggcgcagccacgggaagagtcatcgacgcaagaggacccgcagtgtcgaagatgacgaggaaggtcatctgatctgtcagagcggggatgtgttgtcagcgcggtacgaaatcgtggatactcttggtgaaggggccttcggcaaggtagttgagtgtattgatcacaaagcaggcggtcggcatgtcgctgttaagatcgttaaaaatgttgatcgctactgtgaagcggccaggtcagagatccaggttctcgagcatcttaacacaaccgacccaaattcgacgtttcgttgcgtgcagatgctggaatggtttgagcaccacggccatatttgtatcgtattcgagctattgggactctctacatatgacttcattaaagagaacggcttcctcccatttcgtctggatcacatccgcaagatggcctaccagatttgcaagtccgttaactttttgcacagtaacaagttgactcataccgacttgaagcccgaaaacatcctattcgtgcagagtgactacaccgaagcgtataaccccaagatcaaacgggacgagagaacactgattaaccctgatatcaaagtggtggattttggaagcgcgacttatgatgatgagcatcactcaacactggtgtcaacccgccattaccgcgcgcctgaggttatcctcgctcttggatggtcccaaccgtgcgacgtctggagtatcggctgcattctgatcgagtactatctggggttcacagtgtttccaacccatgatagcaaggagcacctcgcgatgatggagcgaattctgggaccactgccaaagcacatgattcagaagacaagaaaacggaaatatttccatcacgatcgacttgactgggacgagcatagttcagctggccggtacgtctcacgtcgatgcaagcctctgaaggagtttatgctttctcaggatgtggaacacgagaggctcttcgatcttatacagaaaatgctagagtacgacccagcgaagagaataacactgagagaagcccttaaacacccattcttcgatctgcttaaaaagtcaatctag

SEQ ID NO: 182319 - DNA, 1494 bp, Artificial Sequence
  Description of Artificial Sequence: Synthetic coding sequence
atgccccacccccggcggtaccacagcagcgagcggggcagccggggttcctatcgcgagcattacagatcgaggaaacacaagcgccgcaggagtaggtcttggtctagttcatctgataggactagacggcgacgacgcgaggatagctaccacgtgaggagcaggtcttacgatgaccggagtagtgaccgacgcgtttacgacaggcgatattgtgggtcttatagacgaaacgactatagcagggacaggggtgatgcttattatgataccgactataggcattcatacgagtatcagagagagaatagcagctaccgttcacaaagatccagtagacggaagcacagaaggcggcgtaggagatctcgaaccttctcccggagttcttcccacagttccagacgtgcaaaaagcgtggaggatgacgccgaaggtcacttgatataccacgttggcgactggctgcaagagagatatgagattgtttcgacccttggagaagggaccttcgggcgcgtcgttcagtgcgtggaccacagacgtggaggagcaagagtggcactgaaaatcattaaaaatgttgaaaagtataaggaagctgctcgtctcgagattaatgtcttggaaaagatcaatgagaaggatccagacaacaagaatctgtgcgtccagatgtttgattggtttgattatcatggacacatgtgtatttcgtttgagctgctcggcctgtcaacctttgattttctgaaagataacaattacctgccatacccgatacaccaggttaggcacatggcttttcagctgtgtcaggcggttaagttcctccatgataacaaattgacgcacactgacctgaaacccgaaaatatcctgttcgtcaatagcgattatgaattaacttacaacctggaaaagaagcgcgacgaacggagcgtgaagtccaccgctgtccgggtggtggacttcggctcagccacctttgatcatgagcaccactcgacaatcgtttctaccaggcactatcgcgcacccgaagtgatcctggaactcggttggagccagccctgtgacgtatggagcattggctgcatcatcttcgaatactatgtggggtttacgctgttccagacccacgacaatcgcgagcacctcgcgatgatggagaggattctgggaccaatcccaagcagaatgattcgtaagacacggaagcagaagtacttttatcgcgggaggctggactgggacgaaaacacctctgctggccggtatgttagggaaaattgtaaacccctgcgccggtatctgactagcgaggccgaggaacatcaccagctgtttgacctgattgaatctatgctggagtacgaacctgccaaaaggttgaccctgggagaggccctgcagcacccgttcttcgctagactgcgggcagagccgcctaacaagctgtgggactccagccgcgacatatcaaggtag

SEQ ID NO: 182320 - DNA, 1497 bp, Artificial Sequence
  Description of Artificial Sequence: Synthetic coding sequence
atgccccacccccggcggtaccacagcagcgagcggggcagccggggaagctacagggaacattaccgctcacggaaacacaaaaggcgcaggtcccgcagctggtcatcgtctagtgaccggacccgccggcgaagaagggaggattcttaccatgtcagatcacgctccagctacgatgatcgaagtagtgacagaagggtgtacgatcgcaggtattgcgggtcctatcggaggaacgattatagccgagaccgcggtgacgcctattatgacacagactatagacatagctatgagtatcaacgtgagaacagtagctatagaagtcagaggtctagcagacgaaaacaccgacggaggcggaggcggagtcgcacattctctcggtcttcgtctcactcctctcgcagggccaagagcgtcgaagatgatgccgagggacatctgatataccatgtcggagattggctacaagaacgttacgagattgtgtccactctgggagaaggcacctttggtagagtggtccagtgtgtggatcaccggaggggcggggcaagggtcgctctcaaaatcatcaaaaatgtcgagaaatataaggaggccgcacgcttggagataaacgtgctggagaaaattaacgaaaaagatccagacaacaaaaatctctgtgtccaaatgtttgactggtttgactaccacggccacatgtgtatctctttcgagctcctgggccttagcaccttcgacttcctgaaagataacaactatttgccctacccaatccaccaggtgagacatatggctttccagctttgtcaagccgtgaagttcctgcacgacaacaagctgacccacactgatctgaagccagaaaacattcttttcgtcaactccgactacgagcttacttacaacctcgagaagaaaagagacgagaggtcagtcaaatccactgcggtccgggtggtggacttcgggtccgctacctttgatcatgagcatcacagcacaattgtgtctaccaggcactatcgcgcacccgaagtaatccttgagctaggatggagccagccgtgtgacgtgtggtcaataggatgcataatctttgaatattatgtcggattcacactttttcagacccatgacaaccgcgaacacctggcgatgatggagaggattttgggccctattccatcaagaatgatccgcaaaacaagaaagcagaagtatttttacagaggaaggcttgattgggacgagaacactagtgccggtaggtatgtgcgggagaattgtaaacccctgcgccgatacttgaccagcgaggccgaggaacaccaccagctgttcgatctcatcgagagcatgttagagtacgaacctgccaaaaggcttaccctaggagaggcacttcagcaccccttcttcgccaggcttcgagccgaaccaccgaataagctgtgggacagtagccgggacatttccagatag

SEQ ID NO: 182321 - DNA, 1500 bp, Artificial Sequence
  Description of Artificial Sequence: Synthetic coding sequence
atgccccacccccggcggtaccacagcagcgagcggggcagccggggctcttaccgcgagcattaccgcagccgtaagcacaagcggaggcggtctagatcttggtcttcctctagcgaccggactcgccgccgtcggagggaagacagctaccatgttcgatcccggtcttcctacgatgacagatcatctgaccgtcgagtgtacgatcgtaggtactgcggctcataccggaggaatgactattcacgggacagaggcgacgcatactacgacacggattataggcattcttatgagtaccagcgcgaaaatagctcgtatagaagtcagcggtcgagtcgccgcaagcacaggagacggcgaaggcggtctaggacattctccagaagctcctcgcagcattcttcacgcagagcaaagtcagtagaagacgatgccgaggggcacttgatctatcacgtgggggattggttacaggagcgctacgaaatagtgagcaccctgggcgagggaaccttcggtcgggtggtgcagtgtgtggatcacaggagaggcggagcacgcgtggcgctaaaaatcatcaaaaatgtcgagaagtacaaggaggcggctagactggagataaacgtactcgagaagatcaatgaaaaagatcccgataacaaaaacttatgtgtccaaatgttcgactggttcgattatcacggccatatgtgcatatccttcgagttattagggctgagtacctttgatttcctgaaggacaataactacctgccctaccccattcaccaggtgcgccatatggcctttcagctctgccaggcggtgaagttcctgcacgacaataaactaacacacaccgacctcaaacccgaaaacatcctcttcgtcaatagtgactatgagctgacttataatctggagaagaagagagatgagcggtccgtgaaatcaactgccgttcgcgtggtagacttcggctccgctacatttgatcacgagcaccatagcacaatcgtgtcaaccagacactaccgtgcacctgaggtaattctcgagctggggtggagtcagccatgtgatgtgtggtcaataggctgcattatttttgagtattacgtagggtttacactgttccagacccatgataatcgtgaacatctcgccatgatggagagaatcctgggacctataccctcccgaatgattcggaaaactcgaaaacagaagtacttctaccgcggcagactggactgggatgagaacacatccgcgggccgctacgtacgagagaactgcaagcctctccggcgctacctgacaagtgaggcggaggagcaccaccaactatttgatctgattgaaagcatgctcgagtatgaacccgccaagcggctcaccctgggcgaagccttacagcatcccttctttgctcgcctgcgagctgaaccacctaataaactctgggatagctcgcgcgacattagccgttag

SEQ ID NO: 182322 - DNA, 816 bp, Artificial Sequence
  Description of Artificial Sequence: Synthetic coding sequence
atgttcgactggttcgactaccacggccacatgtgcatcagcttcgaactactcgggttgagcactttcgatttcctgaaagacaacaactacctcccttatccaatacatcaggtgcggcatatggcatttcagttgtgccaggctgtgaagtttctgcatgataataaactgacacacaccgatcttaagccagaaaatattctgtttgtaaatagtgactacgagttgacttacaacctggagaagaaaagagacgagagaagcgttaaaagtactgcagtgcgcgtcgtggacttcggctccgcgaccttcgaccacgaacaccactccaccatcgtgtcaactaggcactatagggcgccggaggttatactggaactcggttggtcgcagccctgcgacgtttggagtatagggtgcataatttttgaatattacgtcggctttacactgtttcaaacacacgataatagagagcatctcgccatgatggaacggatactgggaccaataccaagtaggatgatacggaagacgagaaagcagaaatacttttacaggggcaggctggattgggatgagaatacgagcgctgggcggtacgtgcgggagaattgcaagcccttgaggagatacttaacctctgaagccgaagaacaccatcagctgttcgatctcatagaaagcatgctggagtatgagccagccaagcgcctgaccttaggagaggcacttcagcaccctttctttgctcggttaagagccgagcctcctaacaagctctgggacagtagccgggacatctcccggtag

SEQ ID NO: 182323 - DNA, 1500 bp, Artificial Sequence
  Description of Artificial Sequence: Synthetic coding sequence
atgccccacccccggcggtaccacagcagcgagcggggcagccggggaagttaccgggagcactatagaagcaggaagcataagcgccggagatctcgcagctggagttccagcagcgacaggactcggagaagaaggcgggaagattcttatcatgtccgtagtcggtcgagctatgacgatcggtccagcgatcgtagagtttatgatcgaaggtactgcggctcatacaggagaaacgactattcccgcgaccggggggacgcatactatgacacggattatcgacatagctatgaataccaaagagaaaatagttcctatagatcccaaaggagctcaaggaggaagcatagacgcaggaggcgacgtagccggacattctctcggagtagttcccagcatagttcgcgaagggccaagtctgtcgaggacgacgccgagggtcacctgatttatcacgttggcgattggttacaggagaggtacgagatcgtgtcaactctaggggaaggcacctttggacgagtcgtccaatgtgttgaccacagacgcggaggagctagagtagccctcaaaataataaagaacgttgagaaatataaggaggccgctcggttggagatcaatgtgctggaaaaaatcaacgaaaaagaccctgacaataaaaatctttgtgtgcagatgttcgactggttcgactatcacggccatatgtgcattagcttcgagctgctggggttgtccaccttcgatttcctcaaggataataattatctgccgtatcccatacaccaggtacgtcatatggccttccagttatgccaggccgtcaagtttcttcacgataataagttgacgcatacggacttaaagcctgagaacattctctttgtgaatagcgattatgagctcacctacaatttagaaaaaaagcgggatgagcgctctgtgaagagcactgccgtgcgggttgtggactttggcagcgcaactttcgaccatgagcaccactcgaccatcgtctcaacacgtcactaccgagcgcctgaggtgatcctcgagttaggatggtctcaaccctgtgacgtctggtctatcggctgtatcatatttgagtattatgttggctttaccctgttccagacccatgataatcgggaacacctggctatgatggaacgcattttaggccctatcccctcaagaatgatacgtaaaactaggaagcaaaaatatttctatcggggtcggttggattgggacgaaaacacttccgccggtcggtatgtgcgcgaaaactgcaagccactgaggcgctacttgaccagtgaggctgaagaacatcatcagctctttgatctaatcgaatccatgctggagtatgaacctgccaaacgtctcactctgggcgaggctctccaacatcccttttttgccagattgagggccgagccacctaacaagctgtgggactcaagtagggatatttctaggtag

SEQ ID NO: 182324 - DNA, 1473 bp, Artificial Sequence
  Description of Artificial Sequence: Synthetic coding sequence
atgcaccactgcaagcggtaccggagccccgagcccgacccctacctctcctatagatggaagaggcgcagatcttactccagggaacacgagggccggctgagatacccctcccgccgggagcctccaccacggcgctcccggtcacgctctcatgaccggctaccctatcagaggcgatatcgcgagcgaagggactctgatacctatagatgcgaagaaagatctccatcctttggtgaggattactacggcccttctagaagccgacatagaagacgctcccgcgagcgcgggccttataggacacggaagcacgctcaccattgccacaaaaggcgcacacgttcatgttcttcagcatccagcagatcgcaacagtcaagtaagagaagctcaaggagtgtcgaagatgataaagaaggccatctggtgtgtagaattggagattggctccaagaaagatacgaaattgtgggaaacttgggcgaaggtacctttgggaaagtggtggaatgtcttgaccatgcaagaggaaaatctcaagtggccttaaagatcatcagaaatgtaggcaaataccgcgaagccgctaggcttgagatcaacgtgcttaagaaaatcaaggaaaaggataaggagaacaaattcctatgtgttctgatgtctgactggtttaacttccacggccatatgtgcatcgctttcgaactcctcggaaagaatacgttcgagttccttaaggagaataatttccaaccctaccccctgccccacgtaagacatatggcttaccagctgtgccacgcgctgcggttcctccatgaaaatcagttgactcatactgaccttaagcccgagaacatactgtttgtgaactccgaattcgagaccttgtacaacgaacacaagagctgcgaggagaaaagtgtaaagaacacttcaataagggttgccgacttcggctcagccacctttgaccacgaacatcacaccactattgtcgccacccggcattatcgccctccagaggttatactcgagctgggctgggcccagccttgtgatgtttggtctatcgggtgtattcttttcgagtattaccggggtttcactctgttccagactcacgaaaacagagaacaccttgtaatgatggaaaaaatactggggcccatcccctctcatatgattcaccgcaccaggaaacagaagtacttttataagggaggcctcgtgtgggacgaaaacagctctgatggtagatacgtgaaggagaactgtaagccactgaaatcctatatgctacaggatagcctggagcacgtgcaactgtttgacctgatgcggcggatgcttgagtttgacccggcccaacgcattactttggccgaagcgctgctccacccattctttgcgggcttaaccccagaagagagaagctttcacacgtcaaggaatccttccaggtag

SEQ ID NO: 182325 - DNA, 459 bp, Artificial Sequence
  Description of Artificial Sequence: Synthetic coding sequence
atgcaccactgcaagcggtaccggagccccgagcccgacccctacttaagctatcggtggaaaagacgaagatcctatagccgtgagcacgagggtagattaagatatccttcccggagggaacctccccccaggcgatcacggtccaggtcccacgatcggctgccatatcagcggcgttatcgcgagaggagggactccgatacttaccgctgtgaggaacgatcgcccagtttcggagaagactactacggtcctagccgatccaggcatagacggcgtagtcgtgaaagaggcccgtacagaactaggaagcacgctcatcactgtcataaacggcgcacgagaagctgctcctcagcctcgtcaatgcggctctggggcacctgggtgaaggctccgctagcccgatggtggtcggcatggacaatgcctgaggggagtcttcgacttccctag

SEQ ID NO: 182326 - DNA, 1404 bp, Artificial Sequence
  Description of Artificial Sequence: Synthetic coding sequence
atgcaccactgcaagcggtaccggagccccgagcccgacccctacctatcatatcggtggaaacgacggcgttcctacagccgcgagcacgagggcaggctgcgctacccatccagacgcgaacccccaccaagacgttctaggtcgcggtcacatgaccgtctcccttatcagaggcgctaccgggaacgtcgtgacagcgatacctatcgctgcgaggaacggagcccatcatttggtgaggactactacgggccttctcgcagcaggcataggcgccgcagtcgcgagaggggtccgtacagaacaaggaagcacgcgcatcattgccataaaaggcggactcgcagctgcagtagcgcctcctctcgctctcagcaatcctctaagcggtcttctcgtagcgtggaggacgacaaggagggacacctcgtgtgtagaataggagattggttgcaagagagatggaaatcccaggtggccttaaaaattatcagaaacgtcggaaagtaccgcgaggccgcccgacttgaaattaatgtattgaagaagataaaagagaaagacaaggaaaacaagtttctatgtgtgctgatgtctgactggtttaactttcatgggcacatgtgtattgcgtttgagttgttaggaaaaaatacgttcgagtttttaaaggaaaataatttccagccctatccactgccgcacgtgcggcatatggcctaccagctgtgccacgccctgcgtttcctgcatgaaaatcagctcacacacacggatctcaagcctgagaatattctgttcgtgaattctgagtttgagaccctttacaatgaacataagtcctgtgaagagaagtcagtaaaaaacaccagtataagagtcgctgacttcggatcagcgacattcgatcacgagcatcatacaaccatcgtggccactcgacactacaggccccccgaggtgatcttggagttaggctgggcccagccatgcgatgtttggtcaattggatgcatcctattcgagtactaccgaggctttaccttgtttcagacccatgagaacagggagcatttagtaatgatggaaaagattctgggacctattccatcccacatgatacataggacaagaaaacaaaaatatttctacaaggggggcttagtttgggacgagaatagttcagacgggagatacgtgaaggagaactgcaagcctctgaaaagttacatgctgcaggattctttggaacatgttcagttgtttgacctgatgcggcggatgctggaattcgatcccgcgcagcgcatcaccctcgctgaggccctcctccatccgttctttgctggattgacccccgaggaacggtccttccatacttctaggaatccaagcaggtag

SEQ ID NO: 182327 - DNA, 1473 bp, Artificial Sequence
  Description of Artificial Sequence: Synthetic coding sequence
atgcaccactgcaagcggtaccggagccccgagcccgacccctacttgtcctatcggtggaagaggcgaaggtcatatagcagagagcatgagggcagattgcgttacccttcgcgacgtgagcccccaccccgcagaagcaggagccgcagccatgaccggctcccgtaccagcggcgttatcgcgaaaggagggatagtgacacatatcgctgtgaggaacgaagcccctcattcggcgaggattattacggcccgagtcgcagccgacaccggcgccgaagcagagaaaggggcccctaccgcactagaaagcacgctcaccactgccataaacgaagaaccaggagctgctcgagcgcttcgagtcggtcccagcagagctccaagaggtccagccgttcagtggaagatgacaaggaggggcatctggtgtgtcgcatcggagattggcttcaagagagatacgagatagtgggaaatttgggagagggcaccttcgggaaggtggtggaatgcttggaccacgccagaggaaaatctcaagtggccctcaaaattattcggaatgtgggaaaatacagggaggcggccaggctggaaattaacgtcctcaagaagattaaagaaaaagacaaggaaaacaaattcctctgcgtcctgatgagcgactggttcaattttcacggacacatgtgcattgcttttgagctgcttggtaagaacacttttgaattcctgaaggagaataatttccaaccgtaccctcttccccacgttaggcacatggcctatcagttgtgccacgctctgcggttcctacatgagaatcaactgactcatacagatttgaagcctgaaaatattcttttcgttaatagtgaattcgaaactttgtataacgaacacaagtcttgcgaggagaagtcagttaagaacacaagcattagggtcgcagattttggctcagcgacgtttgaccatgagcaccacactacaatcgtcgccactaggcattatcgcccgcctgaagtgatacttgagctgggttgggcccagccttgcgatgtttggtctattggatgcatcctgttcgagtactacagggggttcacccttttccagactcatgagaaccgggagcatttggtcatgatggaaaaaatactggggccgattccctctcacatgatacacaggacgcgtaagcagaaatatttttacaaaggcggtctagtgtgggacgagaattcttcagacggccgttacgtcaaagaaaattgtaaacctctgaaatcctatatgctccaggacagtcttgagcatgtgcaactgttcgacttgatgagaagaatgctcgaattcgaccccgctcagcggattactctggctgaggctctcttgcaccctttcttcgccgggctgaccccagaggaaagatcttttcatacttcccgaaacccttctagatag

SEQ ID NO: 182328 - DNA, 1917 bp, Artificial Sequence
  Description of Artificial Sequence: Synthetic coding sequence
atgcccgtgctgagcgcccggcggcgggagctggccgaccacgccggaagcggccggcgcagcggccctagccccacagcgcggtctggaccgcacctgagtgcccttcgggcccagcccgcccgtgcggctcacctgtccggacgcggcacatacgtccgaagagacacagctggcggcggccctggacaggccagacccctcgggcccccaggtacctcccttttgggcagaggagcccgtagatctggagaaggttggtgtcctggcgccttcgaatcaggagccagagccgcaagacccccttcaagagtggaaccccggctcgctactgccgcatctcgggaaggcgccgggctgcctcgtgcagaggttgctgcaggctctggccgtggagcccggagtggggagtggggcttggcagccgctggggcctgggaaactatgcaccactgcaaacggtaccgctccccagaaccagacccatatctgagctatcgctggaaacgccgcaggtcctacagcagggaacatgagggccgtctgcgttatccaagccgcagggaacctccgcccagacgcagtagaagtaggagtcatgaccggctgccctatcagagacgataccgggaacgcagggattccgatacctatcgttgtgaagaaagaagcccatcattcggagaggactactacggcccgtcacggagtaggcatagaaggcggagccgggagcgcggtccttatcggacgcgcaaacacgcccatcactgtcataaaagaagaactcgttcctgtagttccgctagttccaggtcccagcagtcttccaagcggagcagcaggtcagtcgaagacgacaaagaaggccacctggtgtgtcggatcggggattggctacaggagcggtatgagatcgtaggaaacttgggagagggtacctttgggaaagtcgttgagtgtttggatcacgcacgggggaagagtcaagtggccctgaaaattatacgcaatgttggcaagtatagggaagcagctcgattagaaattaacgtgctaaaaaaaattaaagaaaaagataaagaaaataaattcttatgtgtattaatgtcggactggtttaacttccatggccatatgtgtatcgcatttgagctactcggaaagaataccttcgagttccttaaagagaataatttccagccctatcctctgccccacgtgagacatatggcctaccagctgtgccatgctctccgtttcctgcacgagaatcagctgactcacaccgatctgaagccagaaaatatactgtttgtgaatagcgaattcgaaaccctgtataacgagcacaagagctgtgaagagaagagtgtgaaaaacaccagtatccgagtggcagatttcggctccgccaccttcgaccacgagcaccacaccaccatagtggctactcgacactaccgcccaccagaggtcattctcgaactgggctgggctcagccgtgcgatgtatggtctatcggatgtatcctgtttgaatattaccgcggcttcacactgttccagacacatgagaacagggagcacctggtgatgatggagaagatacttggacccattccgtcccacatgatacatcgcaccagaaaacaaaaatatttttataagggcggcttagtgtgggacgagaactcatcagacggaagatacgtgaaagagaattgcaagccactcaagagttatatgctgcaagactcactggagcacgtacagttgtttgatctgatgcgcaggatgcttgaattcgatcccgcacagcgcattacattggcagaggcactactgcacccatttttcgccggattgacccccgaagaaaggtcatttcatactagccgcaacccatccagatag

SEQ ID NO: 182329 - DNA, 327 bp, Artificial Sequence
  Description of Artificial Sequence: Synthetic coding sequence
atgagcctgaccagcagcagcagcgtgcgggtggagtggatcgccgctgtaacgatcgccgctggaactgcagctattgggtacctggcctacaaaaggttctacgtgaaggaccacaggaataaggcaatgatcaaccttcacatccaaaaagacaatcccaagatagtgcacgcctttgatatggaggacttgggggacaaagctgtctattgccggtgttggcggtcaaaaaagttccctttttgcgatggcgctcacaccaaacacaatgaagaaaccggtgataacgtcggtcccctgatcataaaaaaaaaagagacttag

SEQ ID NO: 182330 - DNA, 408 bp, Artificial Sequence
  Description of Artificial Sequence: Synthetic coding sequence
atggtgctggagagcgtggcccggatcgtgaaggtgcagctgcccgcatacctgaaacgtctcccagtcccagagagtataactgggttcgcgcgcctcaccgtgagcgagtggctacgacttctgccctttctgggggtgctggctctactgggatatctggccgtgaggccatttttgcccaagaagaagcaacagaaagatagccttatcaatcttaagatccagaaagaaaatcccaaggttgtgaatgaaattaacatcgaagacctttgtttgacaaaggctgcctattgccgctgttggcggagcaaaaccttccccgcgtgcgatggcagccacaataagcacaacgagctaaccggagataacgtgggaccacttatcctaaaaaaaaaagaggtctag

SEQ ID NO: 182331 - DNA, 384 bp, Artificial Sequence
  Description of Artificial Sequence: Synthetic coding sequence
atgcggggcgccggcgccatcctgcggcccgccgcccggggcgccagggacctgaatccacgcagagacataagtagctggctggcacagtggtttcctcggacccccgcacgcagtgttgtggctctcaagacgcccatcaaggtggagctcgtggctggtaagacttatagatggtgtgtgtgtggaaggagcaagaagcaacctttctgcgacggatctcacttctttcaaaggaccggcctgtccccactgaaattcaaggctcaagaaacacgtatggtggctctgtgcacttgtaaagccacccagagacccccttattgcgatggcacccacaggtcggaaagggtgcaaaaagccgaggtcggttcccccctgtag

SEQ ID NO: 182332 - DNA, 1740 bp, Artificial Sequence
  Description of Artificial Sequence: Synthetic coding sequence
atgcccagcgccagctgcgacaccctgctggacgacatcgaggacattgtcagccaagaagacagcaagccacaggataggcacttcgtaaggaaagatgtcgtgcccaaggtgaggcggcgtaacacacagaagtatctccaggaagaggagaactcaccaccgtccgacagcacaataccaggcatccagaaaatctggatacgtacctggggatgctcccataacaactcggacggagagtatatggccggacaattggctgcttacggatataaaataactgagaacgcttctgatgctgatctatggctgttaaactcttgcacagtcaaaaaccctgcggaagaccactttcgtaatagcataaaaaaagcccaggaggaaaacaagaaaatcgtgttagcaggttgtgttccacaagctcagcctaggcaggactatctgaaaggcttgagcataattggcgttcagcaaattgatagggtcgtggaagtggtcgaggagaccataaaggggcacagcgtccgtctacttggccagaagaaggacaacgggaggaggttgggtggtgctaggttagatctccctaagatacggaagaacccccttattgagattatatccattaacactggctgtttgaacgcgtgcacttattgcaaaacaaaacacgcccgtggcaacctggcgagttacccaatcgatgaattggtcgatagggccaagcagtcattccaggagggcgtctgtgaaatctggttaacgagtgaagatactggggcatacggtagagatatcggaaccaacctgcctacccttctgtggaaactggtggaggtaatccctgaaggggccatgctgcgcttgggcatgactaatcccccctacatcctggagcatcttgaagagatggctaaaatcttaaaccatccgagagtgtatgcgtttctgcacatccctgtacagtcagccagtgattcggttctgatggaaatgaagcgggaatattgcgtggcagacttcaaaagagtggttgacttcctgaaagaaaaagttcccgggattactatagcaaccgacattatctgtgggtttcctggagagacggatcaggactttcaggagaccgttaagttggtggaagaatataaatttcccagcctctttattaaccaattctatcctcgacctggcaccccggccgccaaaatggagcaggtgccagcccaggtgaaaaaacagcgtaccaaggatctgagccgagtctttcactcttactctccttatgatcacaaaatcggagagcggcaacaagtgctagtgaccgaggaaagcttcgattctaaattctatgttgcccacaaccaattttacgagcaagtgctggttcccaagaaccccgccttcatgggcaagatggttgaggtggacatctacgagtcgggcaagcacttcatgaaaggccagcctgtgagtgacgcaaaggtgtacaccccttccatttccaagcccctcgctaagggtgaggtttcaggtctcaccaaagattttaggaatggactgggaaatcagctatcatctggctcccacacaagcgcagcctcccagtgcgactctgcaagttctagaatggtgctgccgatgccccgcctccatcaagattgtgctcttcgtatgtctgttggactagcattgctgggactgctgtttgcgttcttcgtcaaggtgtacaattag

SEQ ID NO: 182333 - DNA, 1740 bp, Artificial Sequence
  Description of Artificial Sequence: Synthetic coding sequence
atgcccagcgccagctgcgacaccctgctggacgacatcgaggacattgttagccaggaagattcaaagccacaggacagacacttcgtgagaaaagatgtggtgcccaaggtgagacgccggaacacccaaaaatatctacaggaagaggagaatagtcccccctcagattcaaccatcccagggatccagaagatttggatccgcacatgggggtgctcccacaataactcagacggcgagtacatggccggccagctggctgcttatgggtacaagataactgagaatgccagtgacgctgatctgtggcttctaaattcgtgcacagtcaaaaatccggctgaagaccacttcaggaacagcatcaagaaggctcaggaagagaacaaaaagatcgtcctggccggatgcgtgccgcaagcccagcccaggcaggattacctcaaagggctgtcgataatcggagtgcagcaaattgatcgggtggtggaggtggtggaagaaaccatcaaaggacactcagttagactgctaggccagaagaaggacaatggtcggcggctgggcggtgcccgattggacctcccgaagattcggaaaaatcctttaatcgagatcattagcattaatactggctgtctaaatgcatgcacctactgcaagaccaagcatgcaaggggaaatctagccagttatccaattgatgaactagtagacagggctaaacaatcatttcaggagggcgtgtgcgaaatctggctcacatccgaagacaccggcgcatatggcagagacatcgggaccaacctacctactctgctgtggaagctggtggaggtcatcccagagggagccatgttacggctgggcatgaccaaccccccctacattctggagcacctcgaagaaatggccaagatcctgaaccaccccagagtttacgcctttttgcacatcccagttcaaagcgcttccgattctgtgctgatggagatgaaaagagagtactgcgtggctgattttaagcgtgtggtcgattttcttaaagaaaaagttccaggcataactattgccacggatatcatatgcggcttccctggcgagactgatcaggacttccaggagacagttaaactcgtagaagagtacaaattcccttccctgttcatcaatcagttttaccccagaccaggaactcccgcagccaagatggagcaggtcccggcgcaggtcaaaaaacagagaactaaggacctgtcacgtgtgttccacagttactcgccctatgatcacaagatcggggagagacagcaggtgctggtgaccgaagagtctttcgactcaaaattttacgtggcccacaatcagttctacgagcaggtgcttgttccgaaaaatcccgctttcatggggaagatggtggaagtggacatctatgaaagcggtaagcactttatgaaaggccagcccgtgtctgacgccaaagtctacactccatctattagcaaacccttagccaagggcgaagtttctggcctaacgaaggacttcagaaatggcctcggcaaccagctgtcttccggatcccatacaagtgctgcaagccaatgtgactcagcctcatctcgaatggtattgcctatgccccgccttcatcaggactgtgcactgagaatgtctgtgggcctggccctcttaggtctgctgttcgccttcttcgtgaaagtttataactag

SEQ ID NO: 182334 - DNA, 1467 bp, Artificial Sequence
  Description of Artificial Sequence: Synthetic coding sequence
atgctgagccggcggtacgagggcgagatccccaagaacatctgcaaacgcaaaaaaaccgtgcatcaggtcactgagaatgctagtgatgccgatctttggcttttgaacagctgcacagtgaaaaatccagctgaagaccatttccgcaattcgatcaagaaggcacaggaagagaacaagaagatcgtattggcaggatgtgtcccacaggctcagccaagacaggattatctgaagggtttatcaatcatcggcgtccagcagattgatcgggtcgtagaggtggtggaagagacaatcaagggccactctgttcgacttcttggccagaaaaaggataatgggcggcgactaggcggtgcgcgcttagacctacccaaaatccgtaagaatccactgattgaaatcatctcaattaacactggttgcctgaatgcctgcacctactgcaagactaaacatgcccggggaaacctggctagctatcctatcgatgaactcgtggatcgggccaagcagagctttcaggagggcgtgtgtgagatctggttgacatccgaggatacaggagcttatggcagagacatcggcactaatctgcctaccctgttatggaaactcgtcgaagttatacctgagggtgcgatgttgcgtttggggatgactaacccaccatatatccttgagcatcttgaagaaatggccaaaatcctcaaccacccacgggtgtatgcatttctccacatccccgttcagtcagctagtgactcagtcttgatggaaatgaagcgcgagtattgtgtcgctgactttaaaagagtggtcgattttctgaaggagaaggtgcccggcatcacgattgcgaccgatatcatctgtgggttccccggtgagacagaccaggattttcaggagaccgtgaagctagttgaggagtacaagttcccatccctttttatcaaccagttctatccaaggccgggcacccctgccgccaagatggagcaggttccagcacaggtgatcggagaacgacagcaggtcctggtcaccgaagaatccttcgattccaagttctacgtcgcacataaccaattttatgaacaggtgctggtgccgaaaaaccccgcttttatggggaaaatggttgaggtggacatttatgagagtggcaagcacttcatgaagggacaacccgtgtccgatgccaaagtgtatactccttcaatctccaagcctcttgccaagggggaggtctccgggttgaccaaggacttccggaacggcctcgggaatcagttgtccagcggctctcatacatcagctgcgtcacagtgcgatagtgcctcctccagaatggtgctgccgatgccgcggctacaccaagactgcgcattgcggatgagcgtggggctggcactcctagggcttctctttgcattttttgtcaaggtctacaactag

SEQ ID NO: 182335 - DNA, 4824 bp, Artificial Sequence
  Description of Artificial Sequence: Synthetic coding sequence
atgatggacctggtgctggaggaggacgtgaccgtgcccggcaccctcagcggctgcagtggtctagttcctagtgtaccagacgatctggacggaattaacccaaacgccggcctgggcaatgggcttctccccaacgtgtccgaggagaccgtgagccccacgagggccaggaatatgaaggactttgagaaccagataacagagctgaagaaggagaatttcaacctaaagttgaggatctattttctggaggaaaggatgcaacaagagtttcacggtccaacagaacatatatacaagaccaacattgaactgaaagtcgaggtggagagccttaagcgggagctacaggagagagagcagctgttgataaaggcatccaaggccgttgaatctctcgccgaggccgggggctctgagatacagagagtcaaggaggacgcgaggaagaaagtgcaacaagtggaggatctactcacaaaacggattctcctgctcgaaaaagccaaggacgtgacagctgcgcaggctgaacttgagaaggccttcgccggcacagaaactgagaaggccttacgactgagactcgaaagtaagctgagtgaaatgaagaaaatgcatgagggagacctggcaatggcattagtgctagacgaaaaagataggttgatcgaagagctgaagctgagtcttaagagtaaagaagccctcattcagtgtcttaaggaagaaaagagccagatggcatgtcctgatgaaaatgtgtcttccggtgagctgcgcgggctgtgtgcagcccctagggaagagaaagaacgagaaacagaagccgcacagatggagcatcagaaagagcgcaattccttcgaggagcgcatccaggcacttgaagaggatctgagagaaaaagagagagagatagctacagagaagaaaaacagtttgaagagggacaaagccatccagggcctgacgatggccctgaagtctaaggagaagaaggtggaggaattgaattcagaaattgagaagctctccgctgcctttgctaaagcacgcgaggcccttcagaaggcccagacacaggagtttcagggctcagaagactatgagaccgccctgtcaggcaaggaggccttatccgcagctctgcggagccagaacctgacaaagtcaactgagaaccaccgcctgcgccgatccatcaagaaaataacccaggagttgagcgatttgcagcaggagagagaacgcctggagaaagatctggaggaggcgcaccgggagaaatccaaaggagactgtaccatccgcgacctgaggaatgaggtggagaagctccgtaacgaagtgaacgaaagagaaaaagccatggaaaacagatataagagtcttctcagtgaatctaacaaaaaactgcacaatcaggagcaagttatcaagcacctcactgaaagtacaaaccagaaagatgtgctgcttcagaagtttaacgagaaagacctcgaggttatccagcagaactgttaccttatggcagccgaggacctcgagctcagatccgagggcctcattactgaaaaatgttccagccaacagccccccggctcaaagaccatcttttcaaaggaaaagaagcaaagttcagattacgaggagctgatccaggtgttgaaaaaggagcaggatatctatacccatctggtgaagagtctgcaggaatcagacagtatcaacaatctgcaagcagagctgaacaagatctttgcactgagaaaacaacttgagcaagatgtgttaagctaccagaacttgaggaagaccctcgaagagcagattagcgaaatccggagaagggaggagtctttcagcctgtattccgatcagacttcttacctgagtatctgcttggaagagaacaatcggttccaggtagaacacttctcccaagaggaactcaagaagaaggtctccgacctaattcagttggtgaaggagctgtatacagacaaccagcatctcaagaagacgatcttcgacctttcatgcatgggatttcagggcaatggcttcccagacaggttggcctcgaccgaacaaactgaggaggccaagaagtcccgacttcccattctgattaagcctagtcgaagcctcggcaacatgtacagactgccagcgactcaggaggtggtgacgcagttgcagtcgcagattctagaactgcagggcgaactcaaagagtttaagacctgtaacaagcagctccatcagaagctcatactagcagaagccgtcatggaaggcaggccgactcccgacaagactctgctcaacgctcaacccccagtgggagctgcctatcaggacagccccggggagcagaagggtattaaaaccacatccagcgtgtggcgggacaaagagatggattctgatcagcaacgctcctacgagatcgatagtgagatctgtcccccagatgacttggctagccttccgtcttgtaaggagaaccctgaggacgtgttgagcccaactagcgtggcgacttatttgtcatcaaagtctcagccatctgccaaggtgagcgtcatgggcacagaccagagcgagtccatcaatacctcaaacgaaaccgaatatctgaagcagaaaattcatgacttagaaacggaactcgaggggtaccaaaacttcattttccagctgcagaaacactcccagtgcagtgaggctataatcacggttctctgcggcacagagggagcccaagacggactgtcgaagccaaagaatggaagtgatggggaggaaatgaccttctccagcctacaccaggtccggtacgtgaagcatgtcaagattcttggacccctcgccccagaaatgatagatagcagagtattagaaaatctcaaacagcagctggaggagcaggagtacaagctccagaaggagcagaatttgaatatgcagctcttttcagagatccacaatctgcagaataaatttcgggatctttcaccaccaagatatgactcgctggtgcaaagccaagccagggagctgagcttacagagacagcagatcaaagatggacacggcatctgcgttattagcagacagcacatgaacaccatgatcaaagcttttgaggagctactgcaggccagtgatgtggactactgcgtggccgaaggatttcaggaacaactgaaccagtgcgctgagttgctggagaagcttgagaagctcttcctcaacggtaagagcgtcggcgtggagatgaacactcagaacgaattgatggaaagaatagaggaggacaacctgacctatcaacatctgctcccagaatctccagaacctagtgcgtcccatgctttgagtgactatgagaccagcgagaaatcatttttctcacgcgaccaaaagcaggataatgaaactgagaagaccagcgtcatggttaattcattctctcaggatttactgatggagcatatccaggaaattcggacacttcgtaagaggcttgaggaaagcataaagacgaatgaaaaattaaggaaacagctcgagcgccagggatctgaattcgtacagggatctaccagcatctttgcctccggctccgaactgcactcgtcccttacgtctgaaatccattttctgcggaaacagaatcaggccttgaatgccatgctgattaaaggctcacgcgataagcaaaaagaaaacgataagctgcgggaaagtcttagccgcaagacagtaagtctagaacacctgcaacgggagtacgcctccgtgaaagaggagaatgaaaggttgcaaaaagagggatcagaaaaggagagacacaatcaacaactgatccaggaggtgagatgctccgggcaagagctgagcagagttcaagaggaagtgaaactgagacagcagctactgtcccagaacgataaactcctgcagagcctccgggtggaacttaaagcctatgaaaaactggacgaggaacatcggcgcctaagagaggcttccggcgaaggatggaaagggcaggatcctttccgggatctgcattctttattgatggagatccaggccttgagactacagctcgaaaggtcaattgaaacatcttccaccctgcagtcaagattgaaggaacagctcgcacgcggtgcagagaaagcccaggagggggccctgactctggccgtgcaggcggtcagcatccctgaagtgccactgcagcccgataaacacgatggagataaatatccaatggaatcagataacagctttgatctttttgactcaagtcaggctgtgacccccaaaagtgtcagcgaaacaccgcccctgagcggcaatgatacagattcactatcttgcgacagcggtagcagtgcgacatcaacaccctgtgtgagcagactggtaactggtcatcatttgtgggcatcaaaaaatggccgtcatgtccttggactgatcgaagactatgaggcactcctgaagcaaattagtcagggacagcgcttgcttgccgaaatggacatccagacccaggaagcaccaagcagcacttctcaggaacttggcactaaagggcctcatcctgctcccctcagtaagtttgtgagctctgtgagcaccgctaagctgacgctggaggaagcttaccggcgcctgaaactcctctggagagtctcattgcccgaagatggacagtgtccccttcactgtgaacaaatcggcgaaatgaaggcagaggtgaccaagctacacaaaaagttgaaaaagtcctag

SEQ ID NO: 182336 - DNA, 5682 bp, Artificial Sequence
  Description of Artificial Sequence: Synthetic coding sequence
atgatggacctggtgctggaggaggacgtgaccgtgcccggcaccctctcagggtgtagtgggttagtgccttctgttcctgacgatctcgatggcattaatcctaacgcaggtctgggaaatgggctactgcccaatgtaagcgaggagacggtgtcccccacacgggctagaaacatgaaggactttgaaaaccaaatcacagaactcaagaaagaaaactttaatctcaagctgaggatctatttccttgaagaacggatgcaacaggaatttcatggcccgaccgagcatatctataagactaacatcgaattgaaagtggaggtagagtctcttaaacgagagctgcaggaaagggaacagctgttgatcaaagctagtaaggccgtggagagcctcgccgaggccggagggtctgaaattcagcgggtcaaggaggacgctcgtaaaaaggtgcagcaggtagaagatcttctgacaaagagaattctgcttctggagaaggatgttaccgctgctcaggcagagctggagaaagcttttgcgggcaccgaaacggagaaagccttacgcttaagactggagtctaaacttagcgaaatgaaaaaaatgcacgaaggggacctggctatggctcttgtcttggacgagaaagatcgtttaatcgaggaactcaagttaagcttgaaaagcaaggaagcccttatccaatgtctaaaggaagagaaatcccagatggcttgtcctgatgaaaacgtgtcttccggcgagctgcgcggactgtgcgccgcaccgcgtgaagagaaggagagggaaacagaagcagcccagatggaacatcaaaaagagcgcaactctttcgaagagcgtattcaggcattggaagaagacctgagggaaaaggaaagggaaatcgcaactgagaagaagaactcactcaaacgcgataaagccatccaggggttaactatggccctgaaaagtaaagagaagaaagtggaggagttgaacagcgagatcgagaaactaagtgcggcttttgccaaggcacgggaggctctccagaaagcccaaacacaggagtttcaggggtccgaggactatgaaactgccctctccgggaaggaagccctgagtgctgccctgcgaagtcaaaatctcacaaagtcaacggagaatcaccggctgcgccggtcaattaaaaagataacccaagaacttagtgacctgcaacaggaaagggagcgccttgaaaaggacctagaagaggcccaccgtgagaaaagtaagggagactgtaccatccgagatctacgaaacgaagttgaaaagctgagaaacgaagtgaacgagagagagaaggcaatggagaatcgatataaatcactgctttcagaaagcaacaaaaagctccacaaccaggagcaggtgatcaagcacctcacagaaagtactaatcagaaggacgtgctgcttcaaaagttcaatgagaaagatttggaagtcatccaacagaattgctatctgatggctgctgaggacctggaactaagatcggagggtctgataacagagaagtgttcatcccagcagccccctggcagtaaaactatattcagcaaggaaaagaaacagtcttcagattatgaggaattaattcaggtcctgaaaaaagagcaggacatctacacacatttagtgaaatctctgcaggaatccgactcaataaacaacctccaggccgaactgaacaaaattttcgcccttcgcaagcagttggagcaagacgtactgagctatcagaatctgaggaaaactctggaagaacagatcagtgagattagacgcagggaagaggagtctttttccctttacagcgatcagacaagctatttgtcaatatgtctcgaggagaacaaccgattccaagtagagcatttcagtcaagaagagctcaagaaaaaggtaagcgatttaatccagctggtgaaggaattgtacacagataatcagcatcttaagaagactatctttgatctcagctgtatgggatttcagggcaacgggttcccggacaggctcgcttctactgaacaaacagaactcctagcgagtaaggaggacgaagataccatcaaaatcggcgaggacgatgagataaattttttgtcagatcagcatctccagcaaagcaacgagattatgaaggacttgtctaaggggggctgtaaaaatgggtatctgcgacatactgagtctaaaatctctgactgcgatggtgcgcacgcgccaggctgtttagaggagggcgcgttcattaacttactggcccccctgtttaatgaaaaggccacattacttctggagagccgccccgacctgctgaaggttgttagggagcttctgctgggccagctcttcctgactgaacaagaagtgtcgggggagcacctcgatgggaaaacagaaaaaacacccaaacagaaaggcgagctcgtccacttcgtccagacaaactcattctccaagccccacgatgaactgaaattatcctgcgaggcccagttggtgaaggccggggaggttcccaaagttggccttaaggatgcatccgtgcaaaccgtggcaaccgagggcgatctgctgcgctttaaacacgaagctactcgcgaagcttgggaggagaagcctattaacacagccctgtcagccgaacaccgccccgagaacctgcacggtgttcccggctggcaggccgcccttctatccttaccaggaataaccaatcgcgaagctaagaagtcacgcctccctatcctgattaaaccaagtcgatccttgggcaatatgtatcgcctcccggccacacaggaggtagtcactcagctgcaaagccagatactcgagttacagggcgagcttaaggagttcaagacctgcaataagcagctgcatcaaaagttaattctggccgaggcagtcatggaagggaggcccacccctgataaaaccctgctgaatgcccagccccccgtgggagccgcctatcaggactcaccaggggaacaaaaggggatcaaaaccacatctagtgtttggagggacaaagaaatggattccgaccagcagagatcctatgagattgactccgaaatttgtccacccgacgatcttgcctccctcccttcttgtaaagagaatccagaggacgtcttgtctccaactagcgtggcaacctatctaagctctaagtcccagccatccgcaaaggtgtctgtgatggggactgaccaatctgaaagcataaataccagcaacgaaactgagtacctgaagcagaagatccacgacctggagactgagctcgagggttaccagaactttatctttcagttgcagaagcacagtcaatgttcggaagctattattacggtgctgtgcggtacagaaggcgcccaggacggattgtctaagccaaaaaacggctccgacggggaggaaatgaccttctcctcattacaccaagttcgctatgtgaagcacgttaaaatcctgggaccacttgctccagagatgatagattccagggtgctcgagaatctgaaacagcaactcgaagagcaggagtacaaacttcagaaagagcagaatttgaacatgcagctgtttagcgagatccataatttgcagaataagtttagggatctttccccccctcggtacgacagtttagtccaatcccaggccagagaattaagcctccagcgacagcagataaaagatggacatggaatctgtgtaatctcacgacagcatatgaacaccatgataaaagccttcgaagagttgcttcaggctagtgatgtcgactattgcgtggcagagggattccaggagcagctgaatcagtgtgcggagttgttagagaagctcgaaaagctgttcttaaacggaaaatctgtgggagtagagatgaacacgcaaaacgagctcatggaacgcatcgaggaggacaatttgacgtatcagcacctgctccccgagtcaccagagcctagtgccagccatgcactcagtgactacgagacttcagagaaatcctttttctcccgagaccagaaacaggataacgagactgaaaagacctccgtgatggtcaactctttcagtcaagatttactcatggagcacattcaagaaatacgtaccctgcgtaaaaggctggaggagagcatcaaaactaacgagaaactgcgcaaacaactcgagcggcaaggtagtgagttcgtgcaaggaagtacatcaatattcgctagcggaagcgagcttcacagtagtctgacatctgagattcactttctccggaagcagaaccaggcgctgaacgccatgctgatcaagggtagcagggataagcagaaagagaatgacaagctaagagaaagcctgtcgaggaagacagtttcccttgagcacctgcaacgagaatacgccagtgtgaaagaggagaatgagcgattacagaaggaggggtccgagaaggagcgacacaaccagcaactcatacaggaggttagatgttcgggtcaggaactctctcgcgtgcaggaagaggtcaagctccgccagcaactcttgtcccagaatgacaagctgctccaatccctcagggtagagcttaaagcctacgagaagctagacgaagagcacaggcggctgcgagaggccagcggggaagggtggaaaggccaggatccgttcagggatctgcattctttgttgatggaaattcaagccctgcgcctgcaattggagcgaagtattgagactagcagcactttacagagcagactgaaggagcagctcgccagaggggctgaaaaagcccaagagggggccctgacactcgctgtgcaggcagtgtctatacccgaggtacctttacaaccagacaaacacgacggggataagtatccgatggagtcagacaattcttttgacctcttcgatagttctcaggccgtcacccccaaatcggtgagcgagaccccccctctctctggaaacgacaccgatagcctgtcctgcgatagcggaagcagcgctacctccaccccttgtgtgtcgcggctcgtgaccggccaccatctgtgggccagcaaaaatggccgtcacgtgctcggactcatcgaggactatgaggcccttctaaagcagatatcgcagggtcagagattgctcgcggagatggacatccagacacaggaggctccgtcctccacatcacaggagctcggcaccaaggggcctcacccagccccactctctaagttcgtgtcatccgtgagcaccgccaagctgaccctggaagaggcatacaggcgcctgaaattgctgtggcgcgtgtccctgcctgaagacgggcaatgtccactccattgtgagcagataggtgaaatgaaagccgaggtcaccaagctacacaagaagttgtttgaacaggaaaagaaacttcagaataccatgaagcttctacagctgagtaagcgtcaagaaaaagtgatctttgatcagttggttgtgacgcacaagatcctgcggaaagcacggggtaatctagagcttcgacctggcggcgcccacccgggcacctgctccccttcccgccccgggagttag

SEQ ID NO: 182337 - DNA, 5559 bp, Artificial Sequence
  Description of Artificial Sequence: Synthetic coding sequence
atgatggacctggtgctggaggaggacgtgaccgtgcccggcaccctgtcaggctgttctggcttggtgccctccgttcctgacgacctcgatgggatcaaccccaatgccggcttgggcaatggcctactgcctaatgttagcgaagagactgttagcccaacccgagctagaaatatgaaagactttgagaatcagatcactgagctcaagaaagagaactttaacctgaagttacgcatctatttcctggaggaacgcatgcagcaggaattccacgggccaacagagcacatttacaaaactaatatcgagctgaaagtggaggtggaatctctcaaacgggaattacaggagcgcgagcagctcctcattaaagcctcaaaagccgtggaaagcctcgccgaagccggtggcagtgagatccagcgggttaaggaggacgcccgcaaaaaagtgcaacaggttgaggatctgttgactaaaaggatccttctgctcgagaaagatgtcactgccgcacaggccgaactagaaaaagcgtttgcaggaactgagaccgaaaaggcccttcggctccggctagagtccaaactcagcgagatgaagaagatgcatgaaggagatcttgctatggctcttgtgttagatgagaaggacagactgattgaagagctcaagctgagtttgaaatctaaggaggctcttattcaatgcctgaaggaggagaagtcgcagatggcgtgcccagatgaaaacgtctcctctggagagctcaggggcctctgtgctgcgccccgcgaggaaaaagagagggagacagaggcagcccagatggagcatcaaaaggagagaaactcctttgaggagcgcatacaggctctggaagaggatctccgcgaaaaggagcgcgaaatcgccaccgagaaaaaaaatagtttaaagagagataaagcgatccagggactgactatggcgttgaagtccaaggaaaagaaggtcgaagagttgaactctgaaatagaaaagttaagcgccgcatttgccaaagctagagaagcgctgcagaaagcgcagacacaggagttccagggatctgaagactatgagacagccctgtctggcaaagaagcgctcagcgcagcgttgcgaagccagaatctaacaaaaagtaccgagaatcaccgcttgcgaagatccataaagaagatcacccaggagctgtcagatctgcaacaggagagagagcgtttggaaaaagatctggaagaagcacatcgcgaaaaaagcaagggagattgcaccattcgcgacctgaggaacgaagtggaaaagctgagaaatgaagtaaatgaacgggagaaggctatggagaacaggtataagtctctcctctcagagagtaataaaaagctgcacaaccaagagcaggtgataaaacatctcactgagtccacgaaccagaaagatgtgctgttgcagaaatttaatgaaaaggatctcgaagtcatccagcagaattgctatctgatggctgctgaagacctggagcttcgctccgagggcttgatcacagagaagtgttccagtcagcagccgccgggtagcaaaactattttttccaaggaaaaaaagcagtcctctgactacgaggaactcattcaggtgctgaaaaaggagcaagacatctatacgcatttggttaagtccttacaggagtctgactctattaataatctgcaggccgagctgaataaaattttcgccctacggaagcagctggaacaggatgttctctcttatcagaatttgagaaaaaccttggaggagcagattagtgagattcggaggagagaggaagaatcctttagcctgtactcagatcaaacctcttatctgtcaatctgccttgaggaaaataacaggttccaggttgagcatttctcccaggaagaactcaagaaaaaggtgagtgaccttatccagttggttaaggaactctataccgacaaccagcatctgaagaaaactatctttgacttgtcctgcatggggtttcagggaaacgggtttcctgatcggcttgccagtaccgagcaaactgaattgctagctagtaaagaggacgaagatacaattaaaatcggggaggacgacgaaatcaatttcctgtctgatcaacatctccagcagagcaacgaaatcatgaaggacttatctaaaggcgggtgcaaaaacggctaccttaggcatacagaaagtaaaatttcagattgcgacggggctcacgctcctggatgtctcgaggagggagcctttataaatctgctcgcacctctgtttaacgagaaagccaccctcctcctggagtcgcggcctgatctgctaaaagtggtccgcgagctgctacttggccagctattcctgaccgagcaggaggtgtcaggcgaacacttggacggcaaaacagagaagaccccaaagcagaaaggcgaattggtccactttgtacagaccaatagcttcagcaaacctcacgatgagctgaaactgagctgcgaagctcagctcgtgaaagccggagaggtcccaaaggtaggcctgaaggatgcgtccgtgcagaccgttgccacagagggggacctgctgagattcaagcacgaggcgacccgggaagcatgggaggagaaacccatcaacaccgcgctgtccgccgagcatcgaccagagaatctgcacggagtgccaggctggcaagccgctctgctgagtctgcctggtattacaaatcgggaggctaagaaaagtcgcctcccaatcttgataaagccatcaagatcattgggcaatatgtataggttgccggcaactcaagaggtggtcacacaactgcagtctcagatcttggagcttcagggcgagcttaaagagttcaagacatgcaataaacaactgcatcagaagcttattctcgccgaagcagtgatggaggggcggcctaccccggataaaactctccttaatgactctgagatctgcccccccgatgacctcgcttctctaccaagttgtaaggagaacccggaggacgtgctctcccccacctccgtcgcaacctacttgagcagtaaaagtcaacctagcgcaaaagtctcagtgatgggcactgaccagtctgaatctattaataccagcaatgaaacagagtatcttaagcaaaagatccatgatcttgaaacggaattggaaggctatcagaatttcatcttccaacttcaaaagcactcccaatgcagtgaggccatcatcaccgtgctgtgtggaactgaaggcgctcaggacggactgagcaagccaaagaatggatcagacggtgaagaaatgactttttcttctctgcaccaggttcggtatgtgaagcatgtgaaaattctcggtccactcgccccggagatgatcgactctagggtgctggaaaacttgaagcaacagctagaagaacaagagtacaagctccagaaagagcagaacctgaacatgcagctgttttcggaaattcacaacttgcagaataagtttagagacctgtctcccccaaggtatgactcgttggtgcaaagccaggcccgagaacttagcctacaaagacaacagatcaaggacggccatgggatttgcgttatctcccgccagcacatgaacacgatgatcaaagccttcgaagagctgctgcaggctagtgacgttgactactgcgtcgccgaaggatttcaagagcagctcaatcagtgcgctgagctgctggagaaacttgaaaagttgtttttaaacggcaagagcgtcggcgtcgagatgaacacccagaacgagctcatggaaaggatcgaggaggataatcttacctatcagcacttattgcctgagtctccagagccttcagcgagtcatgctctgagtgattatgaaacttcagagaaatcattcttctctcgggaccagaaacaagataacgaaactgaaaaaacatccgtgatggttaacagtttttcccaggacctcctaatggaacatatacaggagattcggactctgcggaagcggctggaggagagtatcaaaactaacgagaagctgcggaagcagttggaacgtcagggaagcgagttcgtccagggcagtacttcaatttttgcatctggttcggagctccatagctctttaaccagtgagattcactttttaaggaagcagaatcaggctctgaacgccatgctaatcaaagggtctagagataagcagaaagagaacgataaactgcgtgaaagcctcagccgcaaaaccgtttctttggagcacctccaacgggagtacgcgagcgtgaaggaagagaacgagagattacaaaaagaggggtctgaaaaggaaagacacaatcagcagctcatccaagaggtgcggtgtagtgggcaggagctgtccagggttcaggaagaagtcaaattaaggcagcagctgctgtctcaaaatgataagttgctccagtccctaagagtcgaattgaaggcttatgagaaactggacgaagaacatagacggctacgagaagcctccggagaagggtggaaagggcaggatcctttcagagatcttcatagccttcttatggagattcaggctctgaggctgcaactggagaggagcattgagacgtcctccacactgcagtcccggctcaaagagcagctagcgagaggtgccgagaaggcccaggaaggggctttaactctggctgtgcaggctgtgagcattcctgaagttcctctgcagcctgacaagcacgatggggacaagtatcctatggagtccgacaattcttttgacctctttgacagctctcaggcggtaactccaaaatctgtatcggaaacacctcctctctccggcaatgacacagactccttaagctgtgattctggctcctcagcaacctctacgccttgcgttagccgcctcgtgacaggccaccatctatgggcgtctaagaacggacgccatgtgctgggtttgatcgaagattacgaggcgttgctgaagcagatatctcaaggacaacgcctgttagctgagatggatattcagacgcaagaggctccctcaagtacctcacaagagctgggaacaaaaggaccccaccccgcacccctgtcaaagtttgtatcgagcgtgagcaccgcaaagctcacgttagaagaagcttaccgacgcctaaaactgttatggagagtgtccctgcctgaggatgggcagtgccccttgcactgtgaacagataggcgaaatgaaggccgaggtcactaaattgcataagaaactgttcgagcaagaaaagaaactccaaaacacaatgaaattgctgcagctcagtaagaggcaggagaaagtgatcttcgaccagttggtcgtaacacataagattctgaggaaagctcgcggcaacctggagttgaggccaggcggcgcacacccaggaacatgctcacccagcagacctgggtcgtag

SEQ ID NO: 182338 - DNA, 5445 bp, Artificial Sequence
  Description of Artificial Sequence: Synthetic coding sequence
atgatggacctggtgctggaggaggacgtgaccgtgcccggcaccctctccgggtgcagcggactggttccctcagtgcccgatgatctggacggcattaacccaaacgccggtttgggaaatggcctgctgcctaatgtgtcagaagagactgtcagccctacccgcgcaagaaatatgaaagatttcgaaaaccaaataactgagctgaagaaggagaatttcaatctgaagctgcgaatctattttctcgaggaacggatgcagcaggaatttcatggacctactgaacacatctataagacaaatattgaattaaaagtggaggtagaaagcttgaagagggagcttcaagaaagagaacagctgctgataaaggcaagcaaggccgttgaatcactcgccgaggctgggggttccgagattcagagagtcaaggaggatgcaaggaaaaaggtgcagcaggtcgaggacttactgacgaagagaatcctgctgctcgaaaaagacgtcaccgctgctcaggcagagctggagaaagcctttgccggcacggaaacagagaaagctctgaggctgcgcttagagagtaagctgtctgaaatgaaaaagatgcatgagggcgatctcgcaatggcattggtgctcgatgaaaaggatcggctaatcgaggagctgaagctttccctcaagagtaaagaggctttgatccagtgcctgaaggaagagaaatcacagatggcatgcccggacgaaaatgtctcttccggggaactgcggggattatgcgccgcacctagggaggaaaaagagcgcgaaacagaagcagcccaaatggagcatcaaaaagagagaaactctttcgaagagaggattcaagctctggaagaggatttacgggagaaagagcgcgagatcgcgacagaaaagaagaattccctgaaaagagataaagctattcaggggctcacaatggccctcaagagtaaggaaaaaaaagtcgaggaactgaactctgagatcgaaaagttgtcagcagcatttgccaaggctcgcgaagccctgcagaaagcacagacccaggagttccaggggagtgaggattacgaaactgcccttagtggaaaggaagccttatccgccgcactccgttcacagaatctaacaaagtccaccgagaaccatcgtctccgcagatctatcaagaagatcacacaggagctgtccgacctccagcaggagcgggaacgcctggaaaaggacctggaagaggctcatcgggaaaagtcaaagggcgactgcaccatccgagatctgagaaacgaggtcgagaagttgcggaatgaggttaacgaaagggagaaagctatggagaacaggtacaagagcctgctgtctgagtccaacaaaaaactgcacaaccaggaacaggtgattaagcacctcaccgaatctacaaaccagaaggacgttctcctgcagaagtttaatgaaaaggatctagaagtgatacagcaaaattgttaccttatggcagcggaagatcttgaactgagatcagaggggctgattaccgaaaaatgttcctcccaacagccgcccgggagcaaaaccatattttccaaggagaagaaacaaagctctgattatgaagagcttatccaagtgctgaagaaagagcaggacatttatacacaccttgtgaaatcgctgcaagagtcagattctattaacaacctgcaagctgagctgaacaagatttttgctctcagaaaacagttggaacaggacgtattgtcctaccagaacctgcgtaagaccctggaggagcaaattagtgagattagacggagagaggaggagtctttctctctatacagtgaccagacgagctacctgtcaatctgtttggaagagaataaccgattccaggttgaacatttcagccaggaggaactgaagaagaaagttagcgatttaatccaactggttaaggagctctacacggataatcagcacttaaaaaaaaccatctttgatttgagctgtatggggtttcagggtaatggattccccgatcggctggcaagcacagaacagacagagttactggcctctaaagaggacgaggacaccatcaaaattggcgaagacgacgagattaactttctctctgaccaacaccttcaacagtctaacgaaatcatgaaggacctcagcaagggcggatgcaagaacggatacctgcgccacacagagagtaaaatcagcgattgtgacggggcacacgcccccggctgcttggaagagggcgcattcataaacctgctggcaccactgttcaacgaaaaggctactctccttctggagagcagacccgacctattaaaagttgtgcgggagctcctcctgggccagctctttttgacagagcaggaggtcagcggtgagcacctggacgggaagacagaaaagacacctaaacagaaaggtgagttagtgcatttcgtacaaacaaattcgttttctaagccccacgatgaattgaaactcagctgcgaggcccagcttgtcaaggctggcgaggtgccaaaggtcggccttaaagatgcctccgtccagactgtcgctactgagggagacctcctccgtttcaaacatgaggccactcgagaagcttgggaggagaagccgatcaatacggccctctcagccgagcaccgacctgagaaccttcatggcgtgccgggttggcaagcagccctcctatcactcccaggcattacgaatagagaggcgaagaagagcaggctccctatcctgattaagccaagtaggtccctgggcaacatgtatagactgccagctacacaggaggtcgtgacacagctgcaaagccaaattctggaactccagggagaactcaaagagtttaagacgtgtaacaagcagctccatcagaagctgattctagctgaggccgttatggaaggacggcccaccccagacaagacactgctgaacgcccagccccccgtgggtgccgcctatcaggacagccctggagagcagaaaggcatcaagacgactagtagtgtgtggagggataaggagatggattccgatcaacagagaagttacgaaatcgattctgaaatatgtccacctgacgacctggcctctctgccctcctgcaaggagaaccctgaggacgtgctgtctcccacttcagtggccacctacctaagtagtaaaagccagccatccgcaaaagtttcagtgatggggacggatcaatccgagagcatcaacactagcaatgagactgagtacctcaaacagaaaattcacgacctcgagaccgaactagagggttatcagaacttcatttttcaattacagaagcacagccagtgcagtgaagcaatcatcactgtgctatgcgggacagaaggggcgcaggatggcctgagcaaacctaagaatggaagcgatggagaggagatgacgttttccagtctgcaccaggtcagatacgtaaagcatgtgaagatcttaggccccctcgcgcccgagatgatcgactcacgagttctggagaacttaaaacaacagttggaagaacaagagtacaaattgcagaaggaacagaacttgaatatgcagctcttctcagaaattcacaacctgcagaataagttccgagaccttagcccgcctcgatatgatagcctggtccaatcccaggcacgggaactgagcttacagagacagcagattaaggacgggcatggaatctgtgtcatttccaggcagcacatgaatactatgataaaggctttcgaggaactgctgcaagcgagtgatgttgattattgcgtggccgaaggttttcaagaacagctgaaccagtgtgctgagctgctcgagaagctagagaagcttttcttgaacgggaagagcgtaggggttgaaatgaacactcaaaatgagctaatggagcgaattgaggaggacaacctgacataccaacatttgctgcctgagtccccagaaccctctgcttctcatgctctctctgactacgagacttccgaaaagtccttcttctctcgggaccagaaacaagacaatgaaaccgaaaagacatcagtgatggtgaattcgtttagtcaggatttgctcatggaacatattcaagagattagaacgctgcggaaaaggcttgaggaatccataaaaactaatgagaagttgagaaaacagctcgaaaggcaggggtccgaattcgtccagggatccacttcgatatttgccagcggctcagaacttcatagttcactgacaagcgaaattcacttccttcgcaagcagaaccaggcacttaacgccatgttgatcaagggcagcagagataaacagaaagagaatgataagctgcgtgagagcctatcccgcaaaaccgtgtcccttgagcatttacagcgcgaatacgcctcggtgaaagaggagaacgaacggctacagaaggagggaagcgagaaagaacgccataatcagcagctgatccaggaagtcagatgcagtggacaggagctgtcccgggtgcaagaagaggtaaaattaaggcagcagttactgagtcagaacgacaaactgctgcaatccttaagggttgagcttaaggcgtatgaaaaacttgatgaggaacatagaagactgcgtgatggggacaagtatccgatggagtcagacaactcttttgacctgttcgatagtagccaggccgttaccccaaagtcagtcagcgagactcctccactcagcggtaacgacactgactcactgtcatgcgatagcgggagcagcgcaacttcaaccccttgcgtttcgcggttggtcaccggccatcacttgtgggcctccaagaacggacgtcatgttctaggactcattgaagactacgaggccttgttgaaacagattagccagggccagagattgctggccgaaatggatattcaaacccaggaggcacccagctctacttctcaggaactaggtacaaaaggtcctcacccagccccccttagcaagttcgtgtcctcagtgtcaaccgccaagctgacgctggaagaggcttacagaaggctcaagttgctttggcgcgtgtccttgccggaggatggccagtgtcctctgcactgcgaacagattggcgaaatgaaggccgaggtgacgaagttgcacaagaagttgttcgaacaggaaaaaaagctccagaatacgatgaagctgctccaattaagtaaacgccaggaaaaggtgatatttgatcagctcgtggtgacacataaaattctgagaaaggctcggggaaatctggaactgcgcccaggcggcgcccatcccgggacgtgctccccaagtcgtccaggatcatag

SEQ ID NO: 182339 - DNA, 5586 bp, Artificial Sequence
  Description of Artificial Sequence: Synthetic coding sequence
atgatggacctggtgctggaggaggacgtgaccgtgcccggcaccctctccgggtgtagtggcctggttcctagcgtgcccgacgaccttgacgggattaaccccaatgcaggcctggggaatgggctgcttccgaatgtgtctgaggaaactgtcagccccacccgggcccggaatatgaaagacttcgaaaatcagattacagaactgaagaaggaaaacttcaacctgaaactacgcatctatttcctagaggagagaatgcagcaggaatttcacgggccaaccgagcacatctacaagacaaatatcgaattgaaggtggaagtggaaagtctgaagcgtgagctccaagagcgggagcagttgctgatcaaagcatccaaggccgtcgaatccttggccgaagctggaggcagcgaaatacagcgcgtaaaagaggacgcacggaagaaagttcagcaggtggaggatctgttgacaaagcggatcctgctgctggagaaagatgtgactgctgcacaggcggaattagagaaggcttttgctggaactgagactgagaaggcactgcgcctcagactggagtctaaactgtctgagatgaaaaagatgcatgaaggcgatctcgctatggcactcgttttggatgaaaaagatcgactgattgaagagctcaaattgtccctaaaatccaaggaggctttaatccagtgcctgaaggaagagaagtcccagatggcctgtcccgatgaaaacgtgagctcaggagaactgaggggcctctgcgccgctccacgagaagaaaaggaacgcgaaacggaggccgcgcagatggagcatcagaaagaacgtaatagcttcgaagagcgcattcaagctctcgaggaggacctgcgagagaaggagagggagattgccaccgaaaaaaaaaactcactcaagagggacaaagccattcaggggctcacaatggcactgaagagcaaggagaaaaaggtcgaagagctcaatagcgaaatcgaaaaattatctgcagcgtttgccaaggccagggaggccctgcagaaggctcaaactcaggagtttcagggttcggaggactacgagaccgctttgtccggcaaagaagccctgtctgcggccttgcgttctcagaatctgacaaaaagtacggagaaccatcgcttgcggcggtctatcaagaaaattactcaggagctcagtgacctgcaacaagagcgcgaacggctggaaaaggaccttgaagaggctcaccgcgaaaaatcaaaaggggactgcacgatccgggatctgcggaacgaagtggaaaaactgcggaacgaggtaaatgagcgggaaaaagccatggaaaatcgatataagtccctgctgtcggagagtaacaaaaaactgcataatcaggagcaagtgattaagcatctgacagagtccactaaccagaaagacgtgctgcttcagaaattcaacgaaaaggatttggaggtcatccagcagaattgctacctcatggctgcagaggacttggagcttcgatccgagggccttatcaccgaaaagtgctcctcacagcaaccgcctgggagcaaaactatcttttccaaggagaagaaacagagctctgattatgaggaactcatccaggttctgaaaaaagagcaggatatctacacgcacctcgttaaatcactccaggaatctgactcaatcaataacctacaagccgaactcaacaaaatatttgctctgcgaaaacagctggagcaggacgtcctcagctatcagaatctaagaaaaaccctagaggagcaaattagtgagatcaggcgtcgagaggaagaatcattctccttatactccgaccagacctcctatctcagtatctgcctggaggagaataatcgcttccaggttgagcatttctcacaggaggaactgaaaaaaaaagtcagcgacctcattcagctggtgaaggaactctacacagataatcagcatctgaaaaaaactatattcgatctatcctgcatggggttccaggggaatggctttcctgatcggttagcctccaccgagcagacagaaatcatgaaggacctctctaaaggagggtgtaaaaatggctatctgcgccacacggaaagtaaaatatcggactgcgatggggcacacgccccgggctgcctggaggagggggcttttataaatctcctggctcctctgttcaatgagaaggctaccctgctcctcgagtcgcgtccagatcttctcaaagtggtgcgtgaactactgctgggtcagctgttcttgactgaacaagaggtttctggcgagcacctggacggaaaaactgagaaaactccaaagcagaaaggcgagctcgtccactttgtgcagactaatagcttctcaaaacctcatgatgaactcaaattgtcttgtgaagcacaactggtaaaagcaggggaggtccccaaagttggacttaaggatgccagcgtgcaaaccgtcgcaaccgagggtgatttgctgcgatttaaacatgaagccacccgtgaagcatgggaggagaaacctatcaatactgccctaagcgccgaacatcggccagagaacttacacggagtgcccggatggcaggccgcgttgctcagtctacctggcatcactaacagggaggctaagaaaagccggcttcccatcctgattaaaccttccagatcccttggcaatatgtatcggttgccagccacgcaggaggtcgtcacacagcttcagagccagatcctggaactccagggagaactcaaagagtttaagacatgcaataaacagcttcatcagaagctgattctcgccgaggccgtgatggagggacggccaacaccagataaaacactgctgaacgcgcagccgccagttggagcagcttatcaggatagtcccggggagcagaagggcatcaagacgacttcaagcgtttggcgagacaaggagatggattcagaccaacagaggtcttacgagatcgactccgagatctgtccccctgatgatttagctagtttgccctcatgcaaagagaacccagaagacgttctctctcccacttccgtcgccacttacctctcttccaaaagtcaacccagcgccaaggtgtccgtcatgggcacggatcagtctgagagcataaatacctcaaacgagaccgagtacctcaagcagaagattcacgatttggaaactgagttagagggctaccagaattttatcttccagctccagaaacactcccagtgcagcgaagctatcattaccgtgttgtgcggcaccgaaggtgcacaggatggtttaagtaaaccaaagaatggttctgacggggaagagatgaccttttcctcgctccaccaggtgcgctacgtcaagcatgtcaaaatcctgggacctcttgcccctgaaatgatagactcccgtgtgctggaaaatctcaaacagcaactcgaagagcaggagtataagctgcagaaggagcagaatcttaatatgcagctcttcagcgaaatccacaatctgcagaacaagttcagagacctgagtcctccacggtatgacagcctcgtgcaatcccaagccagagaattgtctctacagaggcagcaaataaaagatggacatggcatttgcgttatcagcaggcagcatatgaacacaatgatcaaagccttcgaagagctactacaggccagtgatgttgactactgcgttgcggagggtttccaggaacagctgaaccagtgtgccgagttattagagaagctggaaaaactctttctgaacgggaagagcgtcggagtagagatgaatacgcaaaacgagttgatggagaggattgaggaggataaccttacatatcagcatttactgcctgaatctccagaacccagcgcctctcatgcgctgtccgactatgaaacctctgagaaaagtttcttttcccgagaccaaaagcaggacaatgaaacggagaagacatccgtcatggtcaatagcttctctcaagacctattgatggagcacattcaagagatacggaccctgcggaagcgcttggaagagtctataaagactaatgagaagctacgtaagcaactggaaagacagggaagtgaattcgtgcaagggagtactagcatttttgcctcagggagcgagctgcacagctctctgacaagcgagatccacttcctccgaaagcagaaccaagccctgaacgctatgttgattaagggcagtcgagacaaacagaaggagaatgacaagctacgtgagagcctatcacggaaaactgtatcactcgagcatttacagagagagtatgcctctgtcaaggaggaaaatgaaagactgcaaaaagagggatcagagaaagaacgacataaccagcaattgattcaggaggttaggtgctctgggcaagaacttagtcgggtgcaggaagaagtcaaactgcggcagcagttgctgtcccagaacgataagctgctacaatcactgcgggtagaactaaaggcctacgagaagctggacgaggaacaccggagattacgcgaagcttcaggagaaggatggaaaggacaagacccctttcgggacctgcattctctgctcatggaaatacaggcactacggctacagctggaaagatcaatcgaaacttcgtcgactctgcaatcccgcctcaaggaacagctggcaagaggggccgaaaaggcgcaagagggagcccttacactggcggttcaggccgtgagtattcccgaggttccgctccagccggacaagcacgacggcgacaagtatcctatggagtccgacaacagcttcgatttgtttgattctagtcaggccgtaactcctaaaagcgtcagcgaaacaccaccactgagtggtaatgacactgactctctgagctgcgacagtgggagcagcgctacgagtaccccttgtgtaagccggctcgtgacaggtcaccatctgtgggcaagcaagaatggtaggcacgtcttaggactaatcgaggattatgaggcactgcttaaacagatctcacagggccaaagactcctggcagaaatggatattcagactcaggaggctccatcctctacaagtcaggagttaggaaccaagggcccccaccctgcacccttaagtaagtttgttagtagtgtctctacagctaagctgactctggaagaggcctaccgcagactgaagctactttggcgtgtgtctctacccgaagacggccaatgccccctccactgcgagcaaatcggagagatgaaggccgaggtgactaaacttcataagaagctgttcgagcaagagaaaaaacttcaaaacaccatgaaattattgcagctgtccaaaaggcaggagaaggttatttttgaccagctcgtagtgactcacaaaatactgaggaaagcaagaggtaaccttgagctgaggcctggaggtgcacatcccggtacctgctctccctccagaccgggaagctag

SEQ ID NO: 182340 - DNA, 1521 bp, Artificial Sequence
  Description of Artificial Sequence: Synthetic coding sequence
atggaggaccaccagcacgtgcccatcgacatccagaccagcaagctgcttgactggctggtggacaggcgccattgctctctcaaatggcagagtttggtgctcacgattagggagaagatcaatgcggctatacaggacatgcctgagagtgaggaaattgcacaattgctgtccggcagctatattcactatttccattgtctgcgaattcttgacttgctgaaggggaccgaggcttcaaccaaaaacatctttggtcggtacagttcccagaggatgaaggactggcaggaaataatcgcactttacgaaaaggataatacatacctcgtggagctttcctccctgctggttcgaaatgttaactacgagatacctagcctcaaaaagcagattgcaaaatgtcaacaactgcagcaggagtacagcagaaaagaagaagaatgccaagccggggccgccgaaatgcgagaacagttctaccattcctgcaagcagtacgggatcactggtgagaacgtgcggggagagttactggctctggtcaaggatctgccatcccagctcgcggagataggagccgctgcacagcagagtctgggggaggctatcgacgtctaccaagcctctgtgggatttgtctgcgaatcccctactgaacaagtgttacccatgctgcgattcgtccagaaacgaggcaacagcaccgtttacgagtggagaaccggtactgagccttcagtggtggaacgaccccacctggaggagctacctgaacaggtggccgaagacgccattgattggggagacttcggggtggaagccgtgtccgaagggaccgacagcggaatatccgctgaagcggctggtattgattggggtattttccccgaatctgattcaaaggacccgggaggggacggcatagactggggggatgatgcggttgcgttgcagattaccgtcttggaagccgggactcaggctcctgagggagtggccaggggccctgatgcactaacactgctggaatacaccgagacccgtaaccagttcctggacgagttaatggagcttgagatttttctagcccaaagagccgtggagctgagtgaggaagccgatgtactgtcagtatctcagtttcagttggctcctgccatcctgcaaggacaaactaaggaaaagatggtaactatggtgtcggtgcttgaagatctgataggcaagttaacaagcctgcaactgcagcatttgttcatgatcttggcgagtccgcggtatgtggaccgggtgaccgagttcctgcagcagaagctgaaacagtctcagctgctggccctgaagaaggagctaatggtgcaaaaacagcaggaagccctagaggaacaggctgctctggaaccaaagctagacctattgctcgagaagaccaaagaattacaaaagctgattgaggccgacatctctaaacgatactctgggcgtccggtgaatctgatgggcacctctctgtag

SEQ ID NO: 182341 - DNA, 1596 bp, Artificial Sequence
  Description of Artificial Sequence: Synthetic coding sequence
atgcggcggcagagcatgaccagcgccacccgggacctgcacaccgccctggacggcaaggcaactcagggcggtaaaaaggaccaccagcatgtcccaatcgacattcaaaccagcaagctgctggactggctcgtcgaccgccgtcactgctcactgaaatggcagagtctggtcctcacgattagagaaaagatcaatgccgcaattcaggacatgcccgaaagtgaggagattgcccaacttcttagcggcagctatattcactacttccattgtttgaggatccttgatctgctaaaagggacggaagcctccacaaagaatatctttggaagatactcttcccagagaatgaaagactggcaagagattatcgccctctatgaaaaggataacacatatttggtggaactatcttcactgctggtgcgaaatgtcaactacgagattcccagtcttaaaaagcaaatcgctaaatgtcagcagctgcagcaggagtactctaggaaagaagaagaatgtcaggctggggctgcagaaatgcgagagcagttttaccatagctgcaagcaatacggcattaccggcgaaaacgtgcggggggagctgctggcgttggttaaagatctcccctcacagctcgctgaaatcggtgccgccgcccagcagagtctcggggaagccatagacgtgtatcaggcatcagtcggcttcgtctgcgaaagcccaaccgagcaggtattgcccatgctgcggttcgtccagaagcgtggaaattcaaccgtgtacgaatggcggactggcaccgagccttctgtggtggagcgcccccacttggaggagttaccggaacaggtggcagaagatgcaattgattggggggatttcggtgtcgaagcggtttccgaaggcacagacagcgggatcagcgctgaagcagcgggaatcgattggggaattttcccagagtccgactccaaggatccaggaggcgacggtatagattggggagacgacgcagtggcactgcagattacagtccttgaggcgggaactcaagctcctgagggggtcgctcgcggcccggacgccttaaccttgctggagtacacggaaacccggaatcaatttctggacgagctgatggagctcgaaatattcttggctcaacgagcagtagaactctccgaggaagccgacgtgctgagcgtctcacagtttcagctagctccggctatactccagggacaaacgaaggagaagatggtgaccatggtcagcgtgcttgaagatctgatcggtaaattaacatctttgcagcttcagcatctctttatgatcctggcaagcccccgttacgttgaccgagtcaccgagtttttgcagcaaaaattgaagcaatcacagcttcttgcactcaaaaaagagctgatggtgcagaagcaacaggaggccttggaggagcaggcagctctcgaaccgaagctggacctgctgctcgagaagaccaaggagttgcagaaactcattgaagctgatattagtaaacggtatagcggtagacccgtcaacctgatgggaacatccctatag

SEQ ID NO: 182342 - DNA, 3864 bp, Artificial Sequence
  Description of Artificial Sequence: Synthetic coding sequence
atgcaccccgacctgggccccctgtgcaccctgctgtacgtgaccttaaccatcttgtgttcttccgtgagctctgacctagcgccttattttacctcggagccccttagtgccgtgcaaaagcttggcggccccgtagtgctccattgttcagctcaacccgtcacaacccggatttcatggctgcacaacggaaaaacattggacggtaatctggaacacgtaaagatccatcagggtactctgacgattctgtcattaaactcttctctgttgggttactatcagtgtctggcaaataattccataggtgccatcgttagcggtccagcaacagtctccgtggccgtgctgggcgacttcggctcttctacgaaacacgtgattaccgccgaggaaaagagtgcaggcttcataggctgcagggtgccagaatcaaatcctaaggcggaagttcggtacaagatccgaggcaagtggctagagcattccaccgaaaactatttgatcctgccaagtggcaacctccagatattgaatgtgagcctggaggataagggatcgtataaatgcgccgcctataatccagtcacccaccagttaaaagtggagcctattgggaggaagttactggtatctcggccatcttcagacgatgtccatattttacaccccacgcactcacaggctttagcagtcctaagtcgttccccggtgacgttggaatgcgtggtgtccggggtgcctgccccccaggtgtattggcttaaggacggacaggacattgcgcccggatcaaactggcgacgcttgtactcccacctggccactgattcggtggatcccgctgattcaggcaattattcttgcatggcgggtaataaaagtggggacgttaagtatgtaacctatatggttaacgtcctcgagcacgcttcaatttcaaagggactccaggaccaaatcgtctccttaggagccacagtccatttcacgtgcgacgtccacggtaaccctgcccctaattgtacctggttccacaatgcccagcccattcatccctctgcccgccatcttaccgctgggaatggtcttaaaatctccggcgtaactgtagaggacgtggggatgtaccagtgcgtcgcggataacgggattggatttatgcattccacaggtaggctggaaatagaaaacgacggcggatttaaaccagttataatcacggccccagtttccgcgaaagtagccgatggcgattttgtcacattgagttgcaatgcatccggtctgccagtgcctgtgatcaggtggtacgattctcacggtctgattacaagccacccaagccaggtcttacgctcaaagagtcgaaagagccagctgagtcggccagaaggccttaacctggagcctgtttacttcgtcctcagtcaagccggagcctcctcccttcatattcaggctgtcacacaggaacatgccggcaaatatatctgcgaagctgccaacgagcacggcactactcaggccgaggctagtctgatggttgtacctttcgagactaatacaaaggctgaaactgtgactttgccagatgctgctcaaaacgatgatagatcaaaaagggatgggtcggaaacgggattgttgtcttccttcccggtcaaggtgcacccttccgcagtggaatctgcaccagagaagaacgcgtctgggattagcgtcccggacgccccaatcatactcagtcctccccaaacgcatacacccgatacatacaatctcgtatggcgcgccggaaaggacggtggtctgccgatcaacgcttatttcgttaagtaccgaaaattggacgacggtgttgggatgctcggctcttggcatacagtgagagtgccaggtagcgagaatgagctgcacctggcagagctggagcccagtagcctttacgaagttctgatggttgccaggagtgccgccggagagggtcagcccgctatgcttacattcagaacctcaaaggagaagactgcctcttccaaaaacacccaggcttcctcccctccagtgggaattcccaagtatcccgttgtgagcgaagccgccaataataatttcggcgtggtgctgaccgattcaagtaggcactcaggcgtgccagaggcacctgaccgcccaactatctccaccgcctccgagacttcggtctatgtgacctggattcctagagcgaacggcggatctccaatcaccgcctttaaggttgaatacaagagaatgagaacctctaattggctcgtagccgccgaggacatacccccgtctaagctaagcgtggaagtccgttctctggagcccggatccacctataagtttagagtgatagccatcaatcactatggggagtccttccgctcatctgccagccggccctatcaagtagtcggcttcccaaaccgtttttcctctcggcctattaccggcccacatattgcttatacagaggctgttagcgacactcagatcatgctcaagtggacctatatcccctctagtaataataatacacctattcaaggattttacatttattaccgcccaactgattcggataacgacagcgattacaagcgagacgttgtggagggatcaaaacagtggcacatgattggacacctgcaacccgagacctcttacgacatcaaaatgcagtgctttaatgagggcggagagagcgaattttctaacgtgatgatctgcgagacaaaggtgaagagagttccaggggcttctgaatacccagtgaaggacctgagtaccccaccgaactcgctcggctccggcggaaacgtgggcccagccactagcccagcgcgaagtagcgacatgctttacctcatcgtcggctgcgtcctgggcgtgatggtcctaattcttatggtgtttatcgctatgtgcctgtggaagaaccgacagcagaacactatacagaagtatgatccgccaggttatctgtaccaagggagtgacatgaatggtcagatggtggattacactacactgtccggcgcatctcaaattaatggaaatgtacacgggggcttccttactaatggagggctgagctccggctactcacatctgcatcacaaagtcccaaatgcggttaatggtattgttaatggcagtctgaatggtggcctgtactcaggccacagcaacagcctgaccagaactcacgtggattttgaacaccctcatcacctcgtaaacggggggggtatgtatacagctgttcctcagattgaccccctggaatgtgtgaattgcaggaattgtagaaataacaacaggtgcttcaccaagaccaactcaacatttagtagcagtcctccacccgtcgtgcccgttgtggccccatatccgcaggacggtcttgaaatgaagcctctgtctcacgtgaaagtgcccgtgtgcctgaccagtgccgttcccgactgtggccagcttcccgaggaatccgtaaaagacaacgtggagcccgttccgacacaacgtacttgttgccaggatatcgtgaacgacgtcagcagtgacgggagcgaggaccccgctgaatttagcagagggcaggaaggtatgattaatttacgcatccctgatcatttgcagctcgcgaagtcgtgcgtgtgggagggagatagctgtgcccatagtgagacagagatcaatatagtatcctggaacgctctgatcttgccccctgtgccagagggatgcgccgagaaaacaatgtggagtccaccaggcatccctctcgactctcccaccgaagtcctacagcagccacgtgaaacttag

SEQ ID NO: 182343 - DNA, 3795 bp, Artificial Sequence
  Description of Artificial Sequence: Synthetic coding sequence
atgcaccccgacctgggccccctgtgcaccctgctgtacgtgaccctgactatcctatgttcttcagtatcctcagacctggctccttatttcactagcgagccattgtcagccgttcagaaattgggggggccggtggttttacactgctctgcccagcctgttaccactaggatctcttggctgcacaatgggaaaactttggacgggaaccttgagcacgtgaaaattcaccagggcactcttaccatcctcagcctcaactcatccctgctggggtattaccaatgcctggccaataactctattggcgctatcgtgtctgggcccgctaccgttagcgtggccgtgcttggggacttcgggtcgtctaccaaacacgtgattacagccgaagagaaatcagccgggtttattggctgtagagtacctgaaagcaatccaaaggccgaagtccgatacaagatccgaggtaagtggctggaacatagtacagaaaactacctcatcctaccttccggaaacctgcagatccttaatgtgagtctcgaggataagggtagctacaaatgcgcagcttacaatcctgttacacatcagcttaaggttgaacctattggcagaaaactactcgtttccagacccagttccgacgacgtacatatattgcacccaacccatagccaagcattggcagtgctgtctcggtcacctgtgacactggagtgcgtggtgagcggagtgcccgccccacaggtctactggctgaaggacggccaggatatagccccaggctctaattggaggcgcctgtatagccatctagccacagattctgtcgaccctgcagatagtggtaactacagttgcatggccgggaataaaagtggcgatgtaaagtacgtgacctatatggtcaacgtcttggagcacgcatccatttcaaaaggcctgcaggatcaaattgttagcctcggcgcaaccgtccacttcacatgtgatgtgcacggtaatcctgcacctaactgcacatggttccataatgcccagccgattcatccgagtgcgcgccatttgaccgccggcaatggtctcaagatctccggtgttaccgttgaagacgtggggatgtaccagtgtgtggccgacaacggcatcggcttcatgcacagcacaggccggctagaaattgagaatgatgggggattcaagcctgtgatcatcaccgctcccgtgtcagctaaggtagccgatggagacttcgtgactctgtcatgcaatgccagtggcctacccgtgcccgtcatcaggtggtacgatagccacggtttgatcaccagccacccatcccaggtactgcgctctaaatccaggaagtctcagctgagtcgacccgaaggactgaacctcgaaccagtctacttcgttctgtcacaagccggtgcatctagcttgcacatccaagcagtgacccaggagcacgccggcaagtatatctgcgaggcggcaaacgagcatggaaccacgcaagccgaggcctcactcatggtggtgccgttcgaaactaataccaaggccgaaacagtgacgctgcctgatgcagctcagaacgacgaccgcagcaagagggacggctccgagacgggcctacttagctcttttccagtcaaggtgcatccaagtgccgtggagtccgcaccagagaagaatgcaagtggcattagcgtgcctgatgcaccaattattttgagtcccccgcagacacatactcccgacacctacaatctggtgtggagagcgggaaaagatggcggtctgcctatcaatgcgtacttcgtgaagtatcgcaagctggatgacggagtgggtatgctcggatcttggcacacagtgcgagtgccagggtcagaaaacgagctccacctggctgaactggagccctccagcctctacgaagtcctgatggtggcaagatccgccgccggtgagggacagcctgcaatgttaaccttcagaacttcaaaggagaaaacagccagcagtaagaacacccaggcttcaagccccccagttggaataccaaagtacccagtcgtaagtgaggcagctaacaataatttcggagtggtgcttactgattcctcacgccattctggagtcccagaagccccagataggccaactattagtacggcctcagaaaccagcgtctatgtgacttggatacctcgcgcaaacggggggtccccgatcaccgcttttaaagtcgagtacaagagaatgcgaacttccaattggctggtcgctgctgaggacatcccacctagcaaactctcagtggaggtgcgcagcttggagcccggtagcacgtacaagtttagagtcattgcgataaaccactacggagagtcctttagatcaagcgcctctaggccataccaagtcgtaggatttcctaaccgtttctcctccaggccaataaccggcccgcacatcgcctacacggaggctgtgagtgacactcagattatgctgaaatggacatacatcccctcgtcaaacaacaacacacctatccaaggtttttacatttactatcgccccaccgattccgataacgactccgactacaaacgagacgtcgtggaaggatccaaacagtggcacatgatcgggcatctccagccagaaaccagttatgacattaaaatgcagtgtttcaatgagggcggagaatcagaattttctaatgtaatgatatgcgaaaccaaggttaagcgggtgcctggggcgtcagaatatccagtgaaagatctctccacaccgcctaattccctgggcagcggagggaacgtcggcccagccacgtccccagctagatccagcgacatgttgtacctgatcgtgggatgcgtccttggcgtcatggtgctcattcttatggtttttatcgcgatgtgtttgtggaaaaacagacagcagaacacaatccagaaatacgatcctcctgggtatttataccagggatccgacatgaatggacagatggtcgactataccaccctctctggagcctcacagataaatggcaatgtgcacggcggcttcctgacaaatggtggtctttctagcggatacagtcacttgcatcacaaggttccaaatgctgtgaacggcatcgtaaatggatccctgaacggagggttgtattcaggccactcaaactccctgacgcggacacacgtggactttgagcatccacaccacctggtgaatggcggtggaatgtatacagccgtgccacagatagaccctctcgagtgtgtgaactgccggaattgccgcaacaacaataggtgttttactaaaacgaacagtaccttcagttcttcccctcctcctgtggttccggtggtggccccctatccccaagatgggctggagatgaaaccattatcacatgtgaaggtccctgtttgtctaacctcggctgttcctgattgcgggcaactacccgaagagtcggttaaagacaacgtggaaccggtccctacacagaggacatgctgccaggatatagtaaacgacgtaagttctgacggatcagaggatcctgccgaattttcacgtggtgacagctgtgctcactccgagacagagattaacatagtaagctggaatgcactgatcctgccccctgtgccagaaggctgtgcagaaaaaacgatgtggtctcctccgggcatccccctagatagtcctacagaagtgctccagcagccacgggaaacctag

SEQ ID NO: 182344 - DNA, 1386 bp, Artificial Sequence
  Description of Artificial Sequence: Synthetic coding sequence
atgctggagctgcggcaccggggcagctgccccggcccccgggaggccgtgtcgcctccacatagagaaggagaggcagctggaggggaccacgagacagagagtacctctgataaggagactgacatcgacgacaggtatggggatcttgactccagaaccgactcagatatccccgagatacctccttctagtgataggaccccagaaattttaaaaaaggccctttcaggactaagctcaagatggaaaaactggtggatcaggggcattttgactcttacgatgatatctctctttttcctcatcatatacatgggatcctttatgctcatgctgttggtgctgggtatccaggtgaagtgcttccatgagatcattaccattggatacagggtttaccactcctatgatttgccctggttcagaactctgtcatggtattttctgctttgcgtaaactatttcttctatggcgagacagttgccgactattttgcaaccttcgtacaaagagaagaacaattacagttcctcatccgttaccaccggttcatctcatttgctctgtatctggctgggttttgcatgtttgtcctgtccctggtgaagaagcactaccgccttcagttttacatgtttgcatggactcatgtaaccctcctgatcaccgtgactcaaagccatctagtgattcagaatcttttcgagggcatgatttggtttctcgtccctattagctctgtgatttgtaacgacattacagcctacctctttggttttttcttcggcagaactccgctgattaaactctctcctaaaaaaacatgggaaggcttcataggtggttttttttcaacggtagtgtttggcttcatagcggcatacgtgctgagcaaatatcagtattttgtttgtcccgtggagtaccgaagcgatgtcaactccttcgttaccgagtgtgaaccctccgagctattccagctgcagacttattcgctcccccccttcttaaaggcagtactgcgccaggagcgggtgagcctctaccctttccaaatccactctattgccctgagtacattcgcctctctcatcggacccttcggagggttctttgcttcgggcttcaaacgcgcttttaaaatcaaggatttcgccaacactatccccggccacggcgggattatggacaggttcgactgccagtatctcatggcgactttcgtgcacgtgtatattacatccttcattcgcggacccaatccctccaaagtgctgcagcagctcttggtgttgcagcctgaacagcagcttaatatttacaagacgctgaagacccacctgatcgaaaaagggatccttcagccgaccttgaaggtatag

SEQ ID NO: 182345 - DNA, 978 bp, Artificial Sequence
  Description of Artificial Sequence: Synthetic coding sequence
atgagccggctgcggcacccccggacccggtacttcctgctgtgcgtgaactactttttctatggcgagacggtaacagattatttcttcacactcgtccagcgcgaggaaccgttgcgcatactgagcaaataccaccgcttcattagcttcactctgtatctgataggattttgcatgttcgtgttgtcactggtcaagaaacactaccggctgcagttttacatgttcgggtggacacacgttacattgctcatcgtagtgactcaaagccacctagtgattcataacctgttcgaaggaatgatttggttcattgttccgatctcctgcgtcatttgcaacgatatcatggcctacatgtttggcttctttttcgggagaactcctctaattaaactatcccccaagaagacctgggagggcttcataggcggcttttttgccactgtggtcttcgggttactgcttagttacgtgatgtctggatatcgatgcttcgtgtgcccagtagaatacaacaatgatacgaattctttcactgtcgattgcgagccatccgatctcttcaggctgcaggagtacaatattcccggcgtcatccagagcgtcatcggctggaagacagtgcggatgtatccgtttcagatccacagtatcgcattatccactttcgcatcgttgatcggtccatttgggggcttcttcgcgtcaggatttaagcgggcatttaagattaaagacttcgccaatactatccccggccatggtggcattatggaccggttcgattgccaatatttgatggccactttcgtgaacgtctacatcgcaagctttatccggggtcccaacccctctaagttgatccaacagttcctcactttaaggcctgatcagcagctccatatttttaacactctgcgaagtcatctgattgacaaggggatgcttacctccaccacagaggacgagtag

SEQ ID NO: 182346 - DNA, 753 bp, Artificial Sequence
  Description of Artificial Sequence: Synthetic coding sequence
atgagccggctgcggcacccccggacccggtggaagaactggtgggtacgcggtatccttaccctcgccatgatcgcttttttttttattatcatatacctgggtccaatggtgttaatgatcattgtcatgtgcgttcagatcaaatgtttccacgagatcatcaccatcgggtataacgtgtaccactcttacgatctgccctggtttcgcacgttatcctggtattttcttctatgtgtgaactatttcttttatggagagaccgtgaccgactatttcttcactctggttcagagagaggagccgctgcggattcttagcaagtaccacaggttcatcagctttacactgtatctcatagggttttgcatgtttgtcctgagtctagtcaagaagcactaccgccttcaattctacatgtttggttggactcacgtcaccttactgatagttgtgacacaatctcacctggtgatccataatctgtttgaaggtatgatttggttcatagtcccgatctcctgtgttatttgtaatgacatcatggcgtatatgttcggtttcttctttggacgtacccccctgattaagctcagccctaagaaaacatgggagggtttcatcggcggctttttcgcaacagtggtgtttggtctactactgagctacgttatgagtggctaccgatgcttcgtgtgtcccgttgagtataacaatgacaccaattcattcactgtcgactgcgaatag

SEQ ID NO: 182347 - DNA, 1338 bp, Artificial Sequence
  Description of Artificial Sequence: Synthetic coding sequence
atgaccgagctgcggcagcgggtggcccacgagcccgtggccccccccgaagacaaggagagcgaaagcgaggcgaaggttgacggggagaccgcctcagactctgaatcccgggcggagtccgctccacttccggtgtcggccgatgacactcctgaagtgttaaatagggccctgtcaaacctgtcttctcgatggaaaaactggtgggtcagaggcattttgactctggccatgatcgcttttttttttatcattatataccttggccccatggttttgatgatcatagtcatgtgtgtacagattaaatgcttccatgagatcatcacgataggatataacgtgtatcactcttatgacctgccatggtttaggactctatcctggtactttctcctatgtgtcaattacttcttctatggagaaactgtgactgattatttcttcaccttggtgcaacgggaagagcctcttcgtatcctttcaaaatatcatagatttatttcctttacactttatctgatcgggttctgtatgtttgttctgagcctggtcaaaaagcactacaggctgcaattctatatgtttggttggacacacgtaacccttctgattgtggtcacccagtcccacttagttatccataacctgtttgaaggtatgatttggttcatcgtccctatcagttgcgtcatctgcaatgacattatggcatacatgttcgggttcttctttggccgtactcctctgattaaactgtcacctaaaaaaacctgggagggcttcattgggggattttttgctactgtggtgttcggtttgttgctatcctacgttatgtccggctaccggtgttttgtgtgtcctgtcgaatacaacaacgacactaatagtttcactgtcgactgcgagccctccgacttgtttcgcctgcaggagtataacatccccggcgtgattcagtctgtgattggatggaagacagtgcgtatgtatccattccagattcactcaattgccctttccacttttgccagccttattggcccctttgggggatttttcgcgagtggatttaagagagcatttaagatcaaagacttcgccaatactatccctggacacggaggcatcatggacaggttcgattgccagtacctgatggctacattcgtcaatgtgtacatcgcgagttttatcagaggacctaacccatccaaactcattcagcaattcttaacactgagacccgatcagcagcttcacattttcaacacgctcagatcacatcttatcgacaagggcatgttgacctctactaccgaggatgagtag

SEQ ID NO: 182348 - DNA, 648 bp, Artificial Sequence
  Description of Artificial Sequence: Synthetic coding sequence
atgttcgtgctgagcctggtgaagaagcactaccggctgcagttctatatgtttggatggacacacgtgacattgctaattgtggtgacccagtcccatctcgtcatacataatctatttgagggcatgatatggttcattgtgcccatttcttgtgttatctgtaacgacattatggcctatatgtttggttttttcttcgggcgcacgcccttgattaaactgtcccctaagaaaacatgggagggattcatcggcggtttcttcgcgaccgtggtcttcggcttgctgaaaactgtcaggatgtaccctttccagattcatagtatcgccctatctacgtttgctagccttattggtccattcggtggatttttcgcctctggattcaaacgagcctttaagatcaaagactttgcaaacaccatcccgggccacggcggcattatggatagattcgattgccaatacctaatggccacgttcgtaaacgtgtacattgcaagctttattcgtggacccaatccatctaagctcatccagcaattccttacccttaggcccgaccaacagttacacatctttaacaccttgaggtcccacctgattgacaaggggatgttgacctctacaaccgaagatgagtag

SEQ ID NO: 182349 - DNA, 3675 bp, Artificial Sequence
  Description of Artificial Sequence: Synthetic coding sequence
atggagcccctgctgctgggccggggcctgatcgtgtacctgatgtttcttctgcttaaattctcgaaggcaatcgagattccctcatctgtccagcaggtccccaccatcatcaaacagtccaaggtgcaagtggctttccccttcgacgaatacttccagattgagtgtgaggcgaaggggaatcctgagccaaccttttcatggaccaaagatggaaatcccttctattttactgatcataggatcatccccagtaataattccgggacatttaggatcccaaacgagggacacataagccatttccaaggaaaataccggtgcttcgcatcaaataagctgggaattgccatgtccgaagagatcgagttcatcgttccgagcgtgccaaagttccccaaagaaaagatcgaccccctggaggttgaagaaggggatccaatcgtcctcccttgcaatcccccaaaggggcttccgccactgcatatatattggatgaacatcgagctggaacacattgagcaggacgagagagtgtacatgtcccaaaaaggtgacctttacttcgccaacgttgaggagaaagattcgaggaacgactattgctgctttgcggccttcccccgcctgaggacaatagttcagaaaatgcctatgaaattaactgtgaacagccttaaacacgcaaacgacagctcatcatccacagagatagggtccaaggctaactctattaagcagcggaaacccaaactgctcctgccccccaccgagtcgggatcagagtcctccatcaccattctcaaaggtgagatcctgctgctggaatgctttgccgaaggtcttcccacaccccaggttgattggaataagattggcggtgacctacctaagggccgtgaaacaaaagagaactatggtaaaacactgaagattgagaacgtgagttatcaggacaagggcaactaccgctgcaccgctagcaacttccttggtaccgcaacccatgatttccatgttatcgtcgaggaaccccctaggtggacaaagaaaccccagagcgctgtgtattccaccggatccaatgggatcctgctttgcgaggccgaaggggaaccccagccgaccatcaagtggcgcgtgaacggcagcccagttgataatcatcccttcgccggggacgttgtatttccgagagagataagtttcacaaatttacagcctaaccatacagctgtatatcagtgtgaagcctccaacgtccacggcaccatcctggcaaacgcaaacatcgatgtagttgacgtgcggcccctaattcagacaaaggatggcgaaaactacgcgaccgtcgtcgggtacagcgctttcctccattgtgagttctttgcctcaccagaggctgttgtctcctggcaaaaggtagaggaagttaagccccttgaggggcgccgctatcatatttacgaaaatggcaccctacaaatcaacaggaccactgaggaggacgcaggatcatactcctgctgggttgagaatgctattggtaagacagcagtgacggctaatctggacattcgaaacgctacgaaactccgagtgagtcctaagaaccctcggatcccaaaactgcacatgctggaactgcactgcgaatctaagtgtgattcccacctcaagcattcactcaagctcagctggtctaaagatggagaggcattcgaaatcaatgggaccgaagatggccggatcattatcgacggcgccaaccttacaattagcaacgtaacgctggaagaccaaggcatttattgttgctcagcccacacggcactggacagcgcggctgacatcacccaggtcacagtgctagacgttccggacccaccagagaacctgcacctgtctgaacgtcagaaccgatccgtgaggctcacatgggaggccggcgccgatcataattccaacatctccgagtacattgttgagtttgaggggaataaggaagaacccggtagatgggaggaactgacacgcgtgcaagggaaaaaaacaactgtcattttgccccttgctcccttcgttcgctaccagtttagagtgattgccgtgaatgaagtgggtagaagccaaccaagccagcccagtgaccatcacgagacacctccggctgctcctgatcgaaatcctcagaacatcagggtgcaagcaagccagcccaaagaaatgattattaagtgggagcccttgaagtccatggagcagaatggccccgggttggagtacagggtcacgtggaagccacagggcgccccggtggaatgggaagaagaaacggtgacaaaccacacccttagggtcatgacgcctgctgtttacgctccatatgacgtgaaagtccaggcgattaaccagcttggctccgggcccgatcctcaaagcgtgaccctgtactctggagaggactatcctgatacggcgcctgtgatacacggagtagacgtcatcaattcaacactggtaaaggtgacttggtctactgtaccaaaggatcgggtacatggcagattgaaaggctatcagataaactggtggaagaccaaatctctgctggacggtaggacgcacccaaaggaagtgaacatcttgagattttcaggccagcgcaattctgggatggttccatcactcgatgcattttcagaatttcacctgactgtgttggcctataactccaagggcgcaggccctgagtcagagccttacatctttcagaccccggaaggcgtcccagagcaacctacattcctcaaggtgatcaaagtggataaggataccgcaaccttgagctgggggctgcctaagaagcttaacggtaacttgactgggtatctactgcaatatcagatcattaatgacacctacgagatcggtgagctgaacgacatcaacattactaccccctcgaaaccttcgtggcacttgtccaacctcaatgctaccacaaagtacaaattttatcttcgggcgtgcacatctcagggctgtggtaaacccattactgaagagtccagtaccctgggcgagggctcaaagggaattgggaaaatctcaggagtgaacttgacacaaaagactcacccaattgaggtgtttgagccgggggcagagcacattgtgcgccttatgacgaaaaactggggggacaacgatagcattttccaggacgtgatcgagacccggggcagggagtatgcagggctgtacgatgatatttccactcaaggctggtttatcgggctaatgtgcgctattgctctcctcactcttctgctcctcacggtgtgcttcgtgaagcgcaatcggggaggaaagtattcagtgaaggagaaagaagacttgcacccagaccccgagattcagtctgtgaaggatgagacctttggcgaatacagcgattccgatgaaaaacccctgaaggggtcactgcgctccctcaaccgcgacatgcaacccaccgaatctgcagactcactcgtggagtacggtgaaggcgatcatgggctctttagcgaggatgggtcctttataggtgcttatgctggcagcaaagaaaaagggtctgttgaatcaaacggctcctccactgcaaccttccctctacgcgcgtag

SEQ ID NO: 182350 - DNA, 3627 bp, Artificial Sequence
  Description of Artificial Sequence: Synthetic coding sequence
atggagcccctgctgctgggccggggcctgatcgtgtacctgatgtttttactgttaaagttctccaaagccattgagatccctagcagtgttcagcaagtcccgacaattattaaacagtccaaggtgcaagttgccttcccatttgacgaatactttcagattgaatgtgaggctaaaggtaatcccgaacccacattctcttggactaaggacggcaatcctttttactttacggatcacagaatcatcccctcaaataattctgggacattccgaatccctaatgagggacatatatcccactttcaaggtaaatatcgatgcttcgcttcgaacaagcttgggattgcgatgtccgaagagatagaatttatcgtgcccagcgtacccaagttccccaaagaaaaaatagatccgctggaagttgaagaaggcgatcctatagtcttaccttgtaacccacctaaggggctcccgcccctacacatttactggatgaatatcgagctcgagcacatcgaacaagatgagcgggtgtacatgagtcaaaaaggtgatttgtatttcgccaacgtggaagaaaaggattcacggaacgactactgttgtttcgccgcatttcctcgcctccgcaccattgtgcagaagatgcccatgaagctcacagtcaactcctctaacagcattaagcaacgtaagcctaaactactgctgcctcctactgaaagcggttcagagagcagcatcacaattctcaaaggtgagatcctgctgctggagtgctttgctgaagggctgccaacgccccaggtcgactggaacaaaatcggcggagatctacctaaaggccgcgagacaaaggaaaactatggcaagactcttaagatcgaaaatgtctcttaccaggataaagggaattatcgctgcacagccagcaacttcttaggaacggcaacgcacgatttccacgttatcgtggaggaacctccccggtggacaaagaagccccagtcagctgtatactcaactgggagcaatgggatcctcctgtgtgaggccgaaggcgaaccgcaacctacaattaagtggagggtgaacgggagtccagtggacaatcatcccttcgcaggtgacgtcgttttccctcgcgagatctcttttaccaaccttcaacccaatcacacagcagtctaccagtgcgaagcttctaacgtgcacgggacaattctggctaatgctaatatcgacgtggttgacgtacgtcctttaatccagacaaaagatggtgaaaactatgctaccgtggtgggttacagcgctttcctgcactgtgagtttttcgccagtcccgaggctgttgtgagttggcagaaagtggaagaggtcaaaccactagagggccgccgctaccatatctacgagaatggcactctccagatcaacaggacgacggaggaggacgccggttcctatagttgttgggtagaaaacgctataggcaagactgctgtgaccgctaacctggatattagaaatgccacaaagttaagagtttctccaaagaaccccaggattccaaaattacacatgctggaacttcactgcgaatccaaatgcgactctcatcttaagcactctctcaagttgtcatggagtaaggacggagaagcattcgaaatcaatggtaccgaggatggaagaatcataatcgatggggcaaatttgacaatcagcaacgtgaccttagaggaccagggaatctactgctgttctgcccacaccgcgcttgattccgccgccgacattacccaggtgaccgtgctcgatgtccccgacccacctgagaacctacacctttccgagcggcaaaacagatcagtgagattaacttgggaagctggagccgatcacaatagtaacattagcgaatacatcgtggagtttgagggcaataaagaagaaccagggagatgggaggaactgactcgcgtgcaaggaaagaaaactactgttattctccctctggcgccatttgttcgttatcagtttcgggtcattgccgttaacgaagtgggcagaagtcagccctctcagcccagcgaccatcacgagaccccgcctgctgcacccgatcgcaaccctcagaatatccgtgttcaggcctcccaacctaaagaaatgattattaagtgggagcccctgaaaagtatggagcagaatgggccaggtctggaatatcgtgtgacttggaagccacaaggcgctcccgtcgagtgggaggaagaaactgtgacgaatcacactctgagagtcatgacgcccgccgtttatgcaccttacgacgtgaaagtacaggccataaatcagctgggctcgggtcccgatccacaatccgtgactctgtatagcggagaggattacccagatactgcacccgtcattcatggagttgatgttatcaactctacattggtcaaggtcacgtggtctaccgttccaaaagacagagtccatggcaggctgaaaggataccaaatcaattggtggaagacaaagtcactgcttgatgggcgaacacatcctaaggaggtaaatatcttaagattctccggccagaggaattctgggatggtcccttcattggatgcattctccgaattccacctaactgtccttgcatataacagcaagggagccggtccggagtccgaaccttatatctttcagacccccgaaggggtccccgaacagcctactttcttgaaagttatcaaagtggacaaggacacagccaccctgagctggggtttgcccaaaaagctcaacgggaatctgactggctacctccttcaataccagattattaatgacacttatgagattggggagctgaatgacataaatatcaccacaccctcaaagccatcctggcatttaagcaacctgaatgcaacaaccaagtataagttctacttgcgtgcatgcacaagccagggctgtggaaagcccattaccgaggaatcttctacactcggcgagggaagtaagggaattggcaaaataagcggagtcaacctcacccaaaaaactcacccgattgaggtgtttgaaccaggggctgaacacattgtgcgtcttatgactaagaactggggcgataatgattctatctttcaggatgtgatcgaaacacgagggagagagtatgccgggctgtatgatgacatcagcacacaaggatggtttatcggcctgatgtgcgccattgccctgctcaccctcctgttgttaaccgtttgctttgtgaagaggaacagaggcggcaaatactcagtgaaggagaaggaagacctgcacccagatcccgagattcaaagcgtgaaggatgagacctttggcgaatacagcgactcggacgagaagccactgaaaggttcccttagaagtttgaatagggacatgcaacctactgagtccgctgattccctagtggagtacggcgagggcgatcacggtctgttcagcgaggacggcagtttcatcggtgcctacgcaggctccaaagaaaaggggtcagtcgaatctaacgggtcttcaacagcgacctttcctctgcgtgcctag

SEQ ID NO: 182351 - DNA, 291 bp, Artificial Sequence
  Description of Artificial Sequence: Synthetic coding sequence
atggagcccctgctgctgggccggggcctgatcgtgtacctgatgtttttgctgcttaagttttcgaaggctattgagattccaagtagcgtccagcaagtgccgacgatcattaagcagagcaaggtgcaggtggccttcccctttgatgaatatttccaaatcgagtgcgaagcaaagggaaacccggagcctaccttttcctggactaaagacgggaaccctttttattttactgaccaccgaataatcccctccaataactcaggtacattccgaatccctaattag

SEQ ID NO: 182352 - DNA, 201 bp, Artificial Sequence
  Description of Artificial Sequence: Synthetic coding sequence
atggagcccctgctgctgggccggggcctgatcgtgtacctgatgttcctactactgaaattctctaaggccatcgaaatcccctcatctgttcagcaagtacccacaatcatcaagcaatccaaggtgcaagtcgcatttcccttcgatgaatactttcagatcgagtgcgaagccaaggggaacccggaacccacttag

SEQ ID NO: 182353 - DNA, 546 bp, Artificial Sequence
  Description of Artificial Sequence: Synthetic coding sequence
atggagcccctgctgctgggccggggcctgatcgtgtacctgatgttcctcctgctgaagttctcgaaggccatcgagatcccatcaagcgtacagcaggtgcccaccattattaaacagtccaaagtccaggtagcattcccctttgatgagtatttccaaattgaatgcgaagccaagggcaacccagaacccaccttttcctggaccaaggatggcaatcccttttattttaccgatcaccgtattatcccgagcaacaattctgggacattccgaatcccaaatgagggtcacatatcccactttcagggcaagtacaggtgtttcgcctcaaacaaacttggaattgccatgtccgaagagatagagttcatcgtgccatcagtcccaaagttccctaaggaaaagatcgatcctttagaggtcgaggagggcgatcctatcgtgctgccttgtaatcctcccaaaggcctgccccccctgcacatatactggatgaacattgaacttgaacatatagagcaggacgagcgtgtctactag

SEQ ID NO: 182354 - DNA, 954 bp, Artificial Sequence
  Description of Artificial Sequence: Synthetic coding sequence
tgaagcgtgaccctgtacagcggcgaggactaccccgacaccgcccccgtcattcacggggttgacgtaatcaattctacacttgtcaaagtaacgtggtccacagtgccaaaagaccgggtgcacggaaggctgaagggctatcagataaactggtggaagacgaagtctctacttgatggccgaacgcaccctaaggaggtcaacatactaagatttagcggacagcgcaacagcggaatggttccgagcctggatgctttctctgagttccacctcacagtgctcgcctataacagcaaaggagccggccccgagtcagaaccatatatattccagacccccgagggggttcctgagcagcccacattcctgaaggttatcaaggtcgataaagacactgcaactctgtcctgggggttgcccaaaaagttaaacggaaatctaacaggttatctgttacagtaccagattattaacgacacctacgaaataggtgagctgaacgatattaacatcactaccccctcaaagccatcttggcaccttagtaacttaaacgccaccactaagtataagttctatcttagagcatgcacctctcagggttgtggaaagcccattactgaggagtccagtacgctcggagaaggaaagtacgcgggtctctatgatgatatttctacgcagggttggttcatagggcttatgtgcgcaattgctcttctcaccttattgctccttaccgtctgtttcgttaaaaggaaccggggcgggaagtacagcgtgaaggaaaaagaagatctgcatccggatcctgagattcagtctgtgaaggacgagacattcggggaatatagcgatagtgatgaaaagcccctgaaagggtcgttgcggtctctcaaccgagatatgcaacccacggagagcgcggactccctagtggagtattag

SEQ ID NO: 182355 - DNA, 258 bp, Artificial Sequence
  Description of Artificial Sequence: Synthetic coding sequence
atggagcccctgctgctgggccggggcctgatcgtgtacctgatgtttcttctgcttaaatttagtaaggccatcgaaattccctccagcgttcagcaagtgcccactattattaaacagagcaaggtgcaggtcgcattccctttcgacgagtatttccagatcgaatgtgaggccaagggcaatcctgaaccaactttttcatggactaaggatgggaaccccttttacttcactgaccaccgcatcatcccctag

SEQ ID NO: 182356 - DNA, 450 bp, Artificial Sequence
  Description of Artificial Sequence: Synthetic coding sequence
atggagagccggggcaagagcgccagcagccccaagcccgacaccaaggtgccgcaggtaacaactgaggccaaagtgcccccggccgcagatgggaaggcccctctcaccaagccatctaaaaaggaggctcccgccgagaaacagcagcctcctgccgcccctaccacagcacctgcgaagaagacatccgctaaggctgatcctgctttgctgaataaccacagtaatttaaagcctgccccaaccgttccgtcttccccagacgcaacacctgagcctaaagggcccggagatggagccgaggaagatgaagccgcgtccggaggtcccggaggccggggtccctggagttgtgagaacttcaaccccctactcgtggccggcggggttgcagtcgcggccatcgctctaatactcggcgttgcttttctggtccgcaaaaagtag

SEQ ID NO: 182357 - DNA, 627 bp, Artificial Sequence
  Description of Artificial Sequence: Synthetic coding sequence
atgagcagcgagcccccccccccctaccccggcggccccaccgcccctttgctagaggagaagtctggcgcccctccaacccccgggcgatccagccctgccgtaatgcagcccccaccaggtatgccgctgccacctgctgacattggtccaccgccttacgagccacccggacacccaatgccccaaccagggtttataccaccccatatgagcgcagacgggacctatatgcctcccggcttctatccaccccctgggccgcatcctcccatggggtactatccaccgggaccttataccccaggaccctatcccggacctggcgggcacaccgccaccgtgcttgtgccttccggagcggctactacagtcaccgtcctacagggtgagatctttgagggagccccagtgcagaccgtgtgcccgcactgccagcaggctattactacaaaaattagctatgagatcggcctcatgaattttgtgctgggctttttttgctgtttcatgggatgcgaccttggttgctgcctcatcccttgcttgatcaacgacttcaaggatgtcactcatacctgtccctcatgcaaagcatacatctatacttacaaacgcctttgttag

SEQ ID NO: 182358 - DNA, 456 bp, Artificial Sequence
  Description of Artificial Sequence: Synthetic coding sequence
atggccgccagcaccagcatggtgcccgtggccgtgaccgccgccgtagcccctgtgctgagcatcaactctgacttctcagatctgagagaaattaagaagcagctattgctaatagcaggactgactagggaaaggggtttgctgcactcttctaagtggtctgcagagctcgccttctcgttgcccgctctcccccttgccgagttgcagcctccaccaccaatcacagaagaagatgctcaagatatggatgcttacacactggctaaagcatatttcgatgttaaagagtacgatcgagctgcgcacttcttacatgggtgcaatagcaagaaggcatatttcctctatatgtacagtcggtatctcgtgcgggccattctcaagtgccacagcgctttttctgaaacctctatcttcaggactaatggtaaagttaagtctttcaaatag

SEQ ID NO: 182359 - DNA, 1794 bp, Artificial Sequence
  Description of Artificial Sequence: Synthetic coding sequence
atggccgccagcaccagcatggtgcccgtggccgtgaccgccgccgtcgccccagtgctcagcattaactccgatttctcagatttacgcgagattaagaagcagctgctgctcatagccggcctgacccgggagcgcgggctcttgcattcttcaaaatggtcggccgagttggccttctcgctccctgcattgcctttggcggaactgcagcctccacctccaattaccgaagaggacgcccaagatatggatgcatacaccttggctaaagcctactttgacgtaaaggaatatgacagagctgcacatttcctccatggctgtaattcaaagaaggcatacttcctgtatatgtacagtaggtacctaagtggcgaaaaaaagaaagatgacgaaacggtcgattccctgggccctctggaaaaaggtcaggtgaagaacgaagcattaagagagttacgcgtggagctgtccaaaaagcaccaggcccgtgagctcgacgggtttggactttatctgtatggggtggtgctccggaaattggacctggtgaaggaagctatcgacgtgttcgtggaggcaacccatgtgctgcctcttcattggggagcttggttagagctgtgcaacctaattacggataaggagatgctgaagttcctttctctaccagatacttggatgaaagaattcttccttgcgcatatctatacagaattgcagctgatagaagaggcactccagaaatatcagaatttgattgatgtaggtttttctaaatcaagctatatcgtctcacagattgcagtggcataccataacatccgggatattgacaaagctctgagcatatttaacgagctccggaaacaggatccttaccgtattgagaatatggacacttttagtaacttgctgtatgtgcggtcaatgaagtctgagttgagctatctggctcacaacttatgcgagattgataaatacagagtggagacctgttgtgtgatcggcaattattactctctgagaagccagcatgaaaaggctgcgctctactttcagcgggccctgaaactcaacccgagatatctaggtgcatggacacttatgggccacgagtatatggagatgaaaaacaccagcgcagcaatccaggcttatcgccatgcaatcgaggtcaataagagagattacagagcctggtacggcctcggccagacatatgagatacttaaaatgccattttactgcttgtactattacaggcgcgcgcatcagctgcggccgaatgatagtcggatgctcgtggccctaggtgagtgttatgagaaactcaatcaacttgtggaggccaagaaatgttactggcgcgcttacgccgttggtgacgttgaaaagatggctctggtgaagctagcgaagctgcacgaacagctgaccgagtcagaacaggctgctcaatgttacattaagtacatacaggacatctactcatgcggtgaaatagtggaacaccttgaggagagcaccgctttccggtacctggctcagtactattttaagtgcaaactgtgggacgaggccagtacctgcgcccagaaatgttgtgccttcaatgatacccgagaggagggtaaggcccttctgcgacagattctgcagctgaggaaccagggcgagacccccacgaccgaggtacccgctcccttttttttgccagcatccctgagtgccaacaacacacccacccggcgggtatccccactaaatttgagttctgtcacaccatag

SEQ ID NO: 182360 - DNA, 1575 bp, Artificial Sequence
  Description of Artificial Sequence: Synthetic coding sequence
atggagctgggccccgagcccccccaccggcggcggctgctgttcgcctgtagccccccgcccgcaagtcagccagtagtaaaagcgctgttcggggcgagcgctgcaggaggcctaagccctgtcactaatctaaccgtgaccatggaccagctgcaaggactagggtccgattatgaacagcccctcgaggttaaaaataatagcaacttgcagcggatgggtagttccgaaagcacagactccggattctgcctcgactcgcctggccctcttgacagcaaggagaatcttgagaacccgatgcgccgcattcatagtttacctcagaaactactgggctgcagccccgctctgaagaggagtcatagcgatagtctagaccacgacatcttccagctaattgacccagatgagaacaaggaaaatgaagccttcgaatttaaaaaaccagtcagaccggtgagccgcggctgcctgcattctcacggcctacaggaggggaaagatctttttactcagcggcaaaattcggctcctgcacgaatgctgtcttcaaacgagagagactctagcgagcctgggaacttcataccgctgttcacaccccagtcccccgttaccgccacactttccgacgaagacgatggattcgtggacctcctggatggcgaaaatctgaagaatgaggaagagacaccatcatgtatggctagcttgtggaccgctcctctggttatgaggaccaccaacctcgataatcgatgcaaactgttcgactctccctctctatgctcttctagtaccagaagtgtcctcaagaggccagagcgctctcaagaagagtccccgcctgggagcacaaagaggagaaaatcaatgtctggcgcttctcctaaggaaagcacaaacccggaaaaagcccacgagacgttgcaccagtcgctttccctggccagtagtccaaagggcactatcgaaaacattctggacaacgaccctagagatctgataggggatttctctaagggatatctctttcacactgtagccggcaagcaccaagacttgaagtatatatcacctgaaatcatggcctcggtcttgaacggaaaattcgccaacctgattaaggagtttgtgattattgactgtagatacccttacgagtatgaaggtgggcacattaaaggagccgttaacctccacatggaggaggaagtggaagactttctcctcaaaaagcccatcgtgccgacagacgggaagcgcgttatcgtggtatttcattgtgagttctcatctgaacgggggcctcgtatgtgccgctatgtgagggaaagagaccgtttgggtaatgagtaccctaaactgcactaccccgagctgtacgtgctaaagggtggctataaggaattttttatgaaatgccagtcttactgtgaaccccctagttacagacccatgcatcatgaagattttaaggaagacctgaaaaagtttcgcacgaagtcccggacctgggcgggcgagaaaagcaaaagagagatgtattctcgactaaaaaaactgtag

SEQ ID NO: 182361 - DNA, 1455 bp, Artificial Sequence
  Description of Artificial Sequence: Synthetic coding sequence
atggagctgggccccgagcccccccaccggcggcggctgctgttcgcctgctccccaccacccgcgagtcaacccgtggttaaggcactttttggcgcgagcgcagcgggcggattgtcccctgtgacgaacttgacggtcaccatggaccagttgcaggggttggggtcagattatgagcaaccactggaagtcaagaataatagtaacctccagaggatgggaagcagtgagtctacagactccggcttctgcttggacagcccagggccactcgactccaaggagaacctggaaaatccaatgaggcggattcactccctaccccaaaaacttctgggctgttctcccgcgctgaaaagaagccattcagatagcctggaccatgatatattccagctaattgatcccgatgaaaacaaggagaacttgagctccaacgaaagggacagctctgaacccggcaatttcatcccactgttcacaccccaatcccccgtgaccgccacactcagcgacgaggacgacgggtttgtcgacctgctcgacggggagaatctcaagaacgaggaggaaaccccaagttgcatggcctccttgtggaccgccccactggtgatgcggacaactaacctggacaatagatgcaaattgttcgatagtccgagcctgtgctcgagctcaacccggagcgtcctgaaacgacccgaaaggtcccaggaagagagtccacctgggagcacaaagcgacgcaagagtatgtctggagcctcccccaaagagtctacaaatccagagaaggcccatgagacacttcatcagtcactgtcgctggctagttcccctaagggaacaatagagaacatattagataatgatcccagagacctgatcggggatttcagcaaagggtatctcttccacacagtcgctggaaaacaccaggacttgaaatacatttcaccggaaattatggcctcagtgctcaacggcaaatttgccaacctgatcaaagagtttgtcattatagactgccggtacccctacgaatacgaaggagggcatatcaagggggctgttaatctgcatatggaggaagaagttgaggacttcctgttaaagaagcctattgttcctacggatgggaaacgagttatcgtagtgttccactgcgaattcagctcagagcggggtccacgtatgtgtcgatatgttcgagagagggatagactcggcaatgaatatcctaaactccactatccggaactttatgtcctgaaaggtggatacaaagagttctttatgaagtgccagagctactgtgaacccccctcctaccggcccatgcatcatgaagacttcaaagaagacttaaagaaattccgaaccaaatctcgcacgtgggcaggagagaaatcaaagagggagatgtactcccgccttaagaagctgtag

SEQ ID NO: 182362 - DNA, 432 bp, Artificial Sequence
  Description of Artificial Sequence: Synthetic coding sequence
atggagctgggccccgagcccccccaccggcggcggctgctgttcgcgtgtagcccacccccagcttcacagcccgtcgtaaaagccctgttcggggcctcagccgcagggggtttgtctccagtgaccaatcttacagtgacaatggaccagcttcaagggcttgggagcgattacgagcagcctctggaagtcaaaaataattccaacttgcagcgaatgggcagctccgaaagcaccgattcgggattttgtctggactcacctggccctctggatagcaaggagaatctggaaaatcccatgaggaggatacacagcctcccgcagaagctcctcggatgttctcctgccctgaaacgcagtcattcagattcgttagaccatgatatttttcagctgatcgaccccgacgagaataaagagaactag

SEQ ID NO: 182363 - DNA, 1743 bp, Artificial Sequence
  Description of Artificial Sequence: Synthetic coding sequence
atggaggtgccccagcccgagcccgcccccggcagcgccctgagccccgccggtgtttgtggcggagcccagcggccagggcaccttcccggccttctccttggctcacacgggctgttgggcagtcctgttagagctgcagcaagtagcccggtcacgactctcacccagactatgcatgatttggccggattaggttctgagacccccaaatcccaggtgggaactctcctgtttcgcagtaggtctaggttaacacacctgtcacttagcagaagagcatcagaaagctccctgtcatccgaatcttccgagtcttccgacgcagggttgtgcatggacagtccctctcctatggatccccacatggctgagcagaccttcgaacaagccatccaggcggctagccggatcattcgaaacgaacagtttgccattcgaaggtttcagtctatgcccgtcaggttgctcggccattcaccagtgctgcgcaatataaccaattcacaggctccagacggacgtcggaagagtgaggcagggtccggggctgcttcaagctcaggcgaagacaaggaaaatgacggctttgtgtttaaaatgccgtggaagccaacacacccaagcagcacgcacgcactcgcagagtgggcctctcgccgagaggccttcgctcagaggccttcctcagccccagacttgatgtgcctaagtcccgatagaaaaatggaagttgaggaactgtctccattggccttggggaggtttagcctgaccccggccgaaggcgacacagaggaagacgacggcttcgtggacattctcgagtcggatctcaaggacgacgatgccgtgccgccggggatggagtccctgattagcgcccctcttgtaaagactcttgagaaggaggaagaaaaagatctggtgatgtattctaagtgtcagcgtcttttcagaagcccgtctatgccatgtagcgtgatcaggcccattctcaagaggctggaaaggccacaagatagggatacacccgttcaaaacaaaagacgacggtccgtcacacctcccgaggagcagcaggaggccgaggagcccaaggctcgggttctgcgctccaagtcgctgtgccacgatgaaatcgaaaatctgctggactccgaccaccgtgagctgatcggggactactcgaaggcattcctgctccagactgttgacgggaagcaccaggacttgaaatacatctccccggaaacgatggtggctctcctcacagggaaatttagtaacatagtggataaattcgtcatcgtggactgccggtacccatacgaatacgaaggaggccatatcaagactgctgtgaatttgcctcttgaacgggatgctgaatcattcttgctgaagagtccaattgctccatgttcactggataagagagtcatcctgatttttcactgcgaatttagctcggagagggggccgaggatgtgtcgattcatcagagagcgcgacagagcagtgaatgactaccccagtctttattacccagaaatgtatattcttaaaggcggttataaggaattctttcctcagcatcctaacttttgcgaaccacaggactatcgtcccatgaaccacgaggctttcaaggatgagctgaaaacatttcgtctgaagacacggtcctgggcgggagaaagatcccgcagagagttgtgtagccgcctccaggaccagtag

SEQ ID NO: 182364 - DNA, 1620 bp, Artificial Sequence
  Description of Artificial Sequence: Synthetic coding sequence
atggaggtgccccagcccgagcccgcccccggcagcgccctgagcccagctggcgtgtgcggcggtgctcagcggccaggacacctacccggactgctgctaggttcccatgggctgttgggtagcccagtgcgcgctgccgcgagctcacctgttacaaccttaacccagactatgcatgatctggccggactgggtagtgagacgccaaagtcacaagtcgggaccctgctattcagatcccggtcccgcctgacccatctttcactgtcccgccgggcatcagagagctccctgtcaagcgaatcatctgaaagctccgatgccggcctgtgtatggacagcccgagccctatggacccccacatggcggagcaaacctttgaacaagccattcaggccgctagcagaattattcgaaacgaacagttcgccattcgaaggttccagagcatgccggatggtttcgtcttcaagatgccctggaagcctacccatccctcttctacccacgccttggccgagtgggccagcagacgcgaagctttcgctcagcgccccagtagcgcccccgacctcatgtgtcttagccccgatcgcaagatggaagtggaggaattatccccactcgctctcggcagattttcactcaccccagccgagggggacacagaggaggacgatggctttgtggatattctggaatcagatctgaaagacgatgatgctgtgccccctggaatggagagtcttatttcagcgccactcgtgaagaccctagagaaggaggaagaaaaagatttagtcatgtatagcaaatgccaacgcctcttcaggtcaccctctatgccctgctcggtgatccgcccaatcctgaagcggctcgaacgccctcaggaccgggacacacctgtgcagaataagcgtagacgctccgtgacaccacccgaggagcagcaggaggccgaggaacccaaagctagagtcctgaggtcgaagtctctgtgtcatgacgaaattgagaaccttctggattcagaccacagagaactgatcggggattacagtaaggctttcttgctgcaaaccgttgatggaaagcatcaggaccttaagtatataagtcccgaaactatggttgccctcttgactggtaaattctctaacatcgttgataagttcgttattgttgactgccgatatccatatgaatatgaaggcggacatattaaaaccgccgtgaacctcccattggagagggacgccgaatcatttctgctgaaatcccctatcgctccctgtagcctggataaaagggtcattctgatttttcactgtgagttctcttccgaaagaggaccgcggatgtgcagatttatccgggagagggatcgtgccgtcaacgactacccatccctgtactacccagagatgtatatcctgaaaggcggatataaagaatttttcccacagcatccaaatttttgtgaaccccaggattatcgccccatgaatcacgaggccttcaaagacgagttaaagaccttcagactgaagacaaggagctgggctggtgagaggtccaggcgcgaactgtgttcgcgcctacaagatcagtag

SEQ ID NO: 182365 - DNA, 1551 bp, Artificial Sequence
  Description of Artificial Sequence: Synthetic coding sequence
atgcacagcgagacccccaagagccaggtgggcaccctgctgttcagaagccgcagcagactgactcacctgtccctcagtcgtcgggcaagtgaatcctcgctgtcctctgagagttcagagagttccgacgctggactctgtatggattctccctcccctatggacccccacatggcagagcagacatttgaacaggccatacaggcagcttccaggatcatcaggaatgagcagttcgctattcgtaggtttcaaagcatgccagttcgcctactgggacattccccagttctaaggaatattactaattctcaggccccggatggtcggaggaaatccgaagctggttccggggcggcatcttcctcaggagaggataaggaaaatgatgggttcgtgttcaagatgccatggaaaccaacacatcccagctctacacacgccctggctgagtgggcgagtagaagagaggcatttgcgcagagaccatcgagcgctcctgacctgatgtgtctgtcacctgaccgtaagatggaagtggaggagctgtcacctctggccctggggaggttttctctcactccagctgaaggtgacactgaagaggacgacggtttcgtggacattctggagtctgaccttaaggatgatgacgcggtgccacccggcatggaatccctaatctctgcacccttagtgaagacactggaaaaggaagaagagaaggacctggttatgtattcaaagtgtcagaggctgttccgcagcccttcaatgccctgttccgtcatcaggcccattctcaaacggctggagagacctcaggatagggacacacccgttcagaataagcggcgccggtccgtgaccccccccgaggaacaacaagaggctgaggaaccaaaggcgcgggtgttgcggtcgaaatccctgtgccacgacgagatcgagaacctactggatagcgaccaccgggaattaatcggcgattactccaaggcttttctgctgcagactgttgacgggaaacatcaagaccttaaatatatctcgcctgaaaccatggtagccttactgactgggaaattttctaacatagtggacaaattcgtgattgtggactgccggtacccctatgagtacgagggaggacacatcaagaccgctgtgaacttaccgctggaaagagacgcagaatccttcctgctgaagtcccccattgcaccctgctctctggataagagagtcatcctgatatttcactgtgagttttcaagtgaacgcggcccacgtatgtgtcgcttcatcagggaacgcgatcgcgccgtcaatgactaccctagcctgtactatcctgagatgtatatcctcaaaggcggatacaaggagttctttccacagcatccgaacttctgcgagccacaggattatcggccaatgaatcatgaagcatttaaggatgagcttaagaccttccgcttaaaaaccagatcttgggctggagagaggagtcggagagaactgtgttctagactgcaggatcaatag

SEQ ID NO: 182366 - DNA, 1470 bp, Artificial Sequence
  Description of Artificial Sequence: Synthetic coding sequence
atgcacagcgagacccccaagagccaggtgggcaccctgctgttccgcagtcgttctcgcctgacccacctgagtctctcaagacgggctagcgaaagcagcctctcttccgaatctagcgagtcttcagacgcaggcctttgtatggacagtcccagccccatggaccctcatatggcagaacagacctttgaacaggcaatccaggccgcttcacggatcatcagaaacgaacagtttgctattcggcggttccagtctatgcctgtgaggttgctgggtcatagccccgtcctacgcaacatcacgaacagccaagcaccagacggcagaagaaaatcagaggccggctcgggagccgccagtagtagtggcgaagataaagaaaatgacggcttcgtttttaagatgccatggaaacctacccacccaagtagtacacacgccctagcagagtgggcttctagaagagaggccttcgcccagagaccgtcttctgcgcccgatctcatgtgtttatcccccgacagaaagatggaggttgaagagttgtccccattggctctcggacggttctccctcacccccgctgagggagatacagaggaggacgacggttttgtcgatatacttgagtccgatctgaaggatctggtgatgtacagcaaatgtcagaggctctttcgcagcccaagcatgccttgctctgttattagacctatactcaaaaggctggagaggccccaagaccgtgacacccctgtccagaacaagcggagaagaagcgttacacccccagaagaacaacaggaggccgaggaacccaaggctcgggtactcagatcgaagtcgctctgtcatgacgagatcgagaatctccttgactccgatcatagggaactgatcggagactattcaaaagcttttttgttgcagacggtcgacgggaagcatcaggatctgaagtacatctcccccgagaccatggtcgcgctgctgaccgggaaattcagcaatatagtagataaattcgtgattgtggactgtaggtacccatacgaatacgagggtggccacataaagactgcagtcaacctgccactggagcgtgacgccgagagctttttactaaaatccccaattgctccctgtagcctggataagcgcgtgatcctgatttttcattgcgaatttagctcagagaggggaccacgcatgtgtagattcattagagagagggacagagccgtgaacgactatcctagcctgtactaccccgagatgtatattctgaagggcggatataaagaatttttcccacagcatccaaacttttgtgaacctcaggattatcgcccaatgaaccacgaagcttttaaagatgaactgaaaacctttaggctcaaaaccagatcatgggccggagaacgttctcgcagagaactgtgtagccgcctccaggatcagtag

SEQ ID NO: 182367 - DNA, 1701 bp, Artificial Sequence
  Description of Artificial Sequence: Synthetic coding sequence
atggaggtgccccagcccgagcccgcccccggcagcgccctgagcccggccggggtgtgtgggggcgcccagcgccccgggcacttgccaggcctgttactgggttcgcacggactccttggcagcccagtgagggccgctgcatcatcccccgttaccactctgacacagaccatgcacgacctcgccggccttgggtcccgctcccgtctgactcacctttcactgtcaaggagagcgtctgaatcctccctgtcatctgagtctagtgagagcagcgatgctggcctctgcatggactctcctagcccaatggatcctcatatggccgaacagaccttcgaacaggctattcaggcggcctcacggattattaggaatgagcaatttgcaatccgccgctttcagtctatgccagtccggctattaggccacagcccggtcctccggaatatcactaactcgcaggcacccgacgggcgcagaaaatccgaagctggatccggagccgcaagctcatccggtgaagacaaggaaaatgatggattcgttttcaagatgccatggaagcccacccacccaagtagcacacacgcccttgcggaatgggccagtagacgagaggcattcgcccagcgcccgtcttcagcaccagacctgatgtgcctgtcccctgacagaaagatggaggttgaagaactgtcaccacttgcacttggccggttctccctgaccccagctgaaggagatactgaggaagacgatggctttgtggatatactagagagtgatttgaaggacgatgatgctgtgccccctggcatggagagccttatcagcgcccctctggtgaaaaccctggaaaaggaagaagaaaaggaccttgttatgtacagtaaatgccaacggttgttccgcagtccaagcatgccttgctccgtcattaggcctatcctgaaacgcctcgaacggcctcaggatcgggatactcctgtacagaacaaacgaaggaggtccgtgactcctcccgaggagcagcaggaagcagaggagcccaaggcaagagttctgaggagcaagtcattgtgccacgatgagatcgagaatctgcttgactcggaccacagagaactgattggggattattccaaagccttcctacttcagaccgtagatggcaagcaccaggacctgaagtacataagtcccgagaccatggtggctttgctaactggcaaattctcaaacatcgtggataaattcgtaattgttgactgtaggtatccatacgaatatgagggcggtcacataaagaccgcggttaacctccccttagaacgagacgccgagtctttcttgctaaagagcccaatcgccccctgttccttggacaagcgcgtcatcttgattttccattgcgagttctcctcagagcgaggtccccgcatgtgtagattcattagagagcgcgaccgggcggttaacgactaccctagcttgtattatcccgagatgtacatcctgaaggggggatacaaagaatttttccctcagcaccccaacttttgcgagccacaggattaccgccccatgaaccatgaagcttttaaagatgaactgaagacctttcgcctgaaaacaagatcatgggcaggcgagcgaagtcgccgcgaactgtgttctcgtctgcaagaccagtag

SEQ ID NO: 182368 - DNA, 2475 bp, Artificial Sequence
  Description of Artificial Sequence: Synthetic coding sequence
atgaccgtgctgcaggagcccgtgcaggccgccatctggcaggccctcaatcactatgcctaccgtgacgccgtgttcctggccgaacgcctgtatgccgaggtgcactctgaggaggcgctgttcttactggcaacctgctactatcgctcaggaaaagcatacaaagcctataggctactgaaggggcactcttgcactacccctcagtgcaagtacctgcttgcaaaatgttgtgtggatttgagtaagctcgccgagggggaacagatcctgagcggaggcgtatttaacaaacagaaaagccacgacgatatcgtgactgagtttggggatagcgcctgtttcacgttatccctgctgggccatgtctactgtaagaccgacaggctggccaaaggtagtgagtgttaccaaaagtctctgagcctgaatccattcctgtggtcacccttcgagagcttgtgtgagattggcgaaaagcccgaccctgatcagactttcaagttcacctccctccagaacttcagcaactgcttgcccaattcatgcactactcaagtgccaaaccacagcctgagccacaggcagcctgaaactgtgttaacagaaacccctcaggacaccattgagctgaacagactaaacttggaatcatctaattccaagtatagcctgaatactgattccagcgtaagctacattgatagcgctgtgatatcccctgacacagtgccccttggcaccggaacaagcatcctgtcgaagcaggttcagaacaaaccaaagacaggtaggtccctgttggggggccctgccgcactgtctcctctcacccccagcttcggtattcttcccctcgagaccccgtctcctggggatggctcctatctacagaactacaccaatacccctcctgtgattgacgtgccaagcacgggagcaccaagtaaaaagagtgttgcaagaattgggcagacaggtactaagtctgtcttttcccaatctggcaatagtcgcgaggtgactcccatcttggctcagacacagtccagcgggccccagacctctacgactcctcaagtgctgagtcctactattacgtctccaccaaacgcacttccccgcagaagcagccgcctgttcacatcagattcttctaccaccaaagaaaattcgaaaaaattgaaaatgaaatttcccccgaaaattccaaataggaaaaccaagagcaaaaccaacaagggcgggatcacgcagcctaacatcaacgattccctggagattacaaagcttgatagttcgattatttccgaaggaaagataagtaccatcactcctcaaattcaggcttttaatctacagaaggcagcagctgaaggcttaatgagccttttacgcgagatgggcaaggggtacctcgccctctgttcttacaactgtaaggaagcaattaatatattatctcacctgccgtcccatcattataacaccgggtgggtactctgccagatcgggcgcgcctacttcgaactgtcagagtatatgcaggcagagagaatcttctccgaagtgcgccggatcgagaactacagggtagaagggatggaaatctattcaactaccctgtggcacctgcagaaggatgtcgccctgtctgtcctgtccaaggatctgacagacatggacaaaaactcacctgaggcctggtgcgctgccggcaactgtttctcactgcagcgtgagcacgatatcgcaattaagttcttccagagggcaatccaggtggaccctaactatgcatatgcctacacgctgcttgggcacgagtttgtactgacagaggagctcgataaggcattagcgtgcttcaggaacgccatacgcgtgaacccgaggcattacaacgcttggtatggcctgggtatgatttattataaacaggagaaattctctctcgcagagatgcattttcaaaaagctctggacatcaatccccagtcctccgttctcctctgtcacataggggtggtgcagcacgccctgaagaagagtgagaaagctctcgatactctaaacaaagctatcgtgatcgatccaaaaaaccctctgtgcaagttccacagagcatccgtccttttcgcaaacgaaaagtataaaagtgccctgcaagagctggaagaactcaagcaaattgtaccaaaggaatccctggtttacttcctaataggcaaagtgtataaaaagctgggacagacgcatctcgccctaatgaacttttcatgggccatggacctggaccctaagggcgccaataaccagattaaggaggcaatcgacaagcgctatcttcccgacgatgaggagcccattactcaggaggagcaaataatgggcaccgacgagtcccaggaatcctcgatgacagatgcggacgatacccaactccatgccgcagagtctgatgaattctag

SEQ ID NO: 182369 - DNA, 2292 bp, Artificial Sequence
  Description of Artificial Sequence: Synthetic coding sequence
atggccagcaccaagcccctgtgcctgccccggtgcggcttcccccgtaggacacccttgtgccggcggttggctgaaggagaacaaattctgtcagggggtgtgttcaataaacagaagtcgcacgatgatatcgtgacagaatttggcgactctgcttgctttactttgtctctcctggggcacgtgtattgtaaaaccgatcgactcgctaagggtagcgagtgctaccaaaagagcctgagcctgaatccgtttctttggtcacctttcgaatccctatgcgaaattggagagaagccagatcccgatcagactttcaaattcaccagcctgcagaacttcagcaattgccttccaaactcttgcaccacacaggttccgaaccattctttgtctcaccgacagcctgagacagtgctgactgagacacctcaggataccatcgagctgaatcgccttaatctcgagtcctcaaactctaagtattcactgaacactgactcttctgttagctacatagattcagccgtgatctctccagatacagtacccctgggtaccggaacctccatcttgtctaagcaggttcaaaacaaaccaaagactggtaggtcgctgctgggcggccctgccgcgctgtcgccactgacacctagtttcgggattctccccctggagacacctagccccggagacggatcctatctgcagaactataccaatacccctccagtgatcgacgtgccaagcactggtgcgcctagtaagaagtctgtggcgaggattggtcagacgggaaccaagtccgttttcagccagagcggcaactctagagaggttacccctatcctggcacagactcagtcctccgggccacagacatcaactactcctcaggttctcagtcccacaattacttcccctccaaatgctctcccccgaaggagttccagactattcacatcggatagctccaccacaaaagagaatagcaaaaagctgaagatgaagttcccccctaaaatacctaacaggaagaccaaatctaagacaaataaaggaggcattacacaacccaacatcaatgattccttagagattaccaagttggactcatcaattattagcgaaggcaagatctccaccattaccccccaaatccaggccttcaatttacagaaagccgcagcagaaggactcatgtctcttctcagggagatggggaaaggctacctcgccctatgctcctataattgtaaggaagccattaatattctgagccatcttccctcacatcattataacaccggttgggtgctgtgccagataggccgcgcctatttcgagttatcagagtacatgcaagctgagcgtattttcagcgaagtgaggcggatcgagaattaccgggtagaggggatggagatctactccaccacactttggcatcttcagaaagatgtcgcgctgtcagtactgagtaaagacctcacggatatggataaaaattcacccgaggcatggtgcgcagcgggtaactgcttcagtctgcaacgggagcacgatattgccatcaagtttttccaacgggctatccaggtggatcctaactatgcctatgcatatactttgctcgggcatgagttcgtactgacagaagagctcgacaaggcactcgcctgctttcgcaacgccatcagggtcaacccgcgtcattacaatgcctggtatggcctaggcatgatttattacaagcaggagaaatttagcctggccgagatgcacttccagaaagctctagacataaatccacagtcttccgtgttgttgtgtcacatcggggttgtgcagcatgctctgaagaagtccgagaaagcacttgacacattaaacaaagcgattgtgatagacccaaagaaccccctttgcaaatttcatagagcaagcgtcctgtttgccaatgagaagtataagagcgcactacaggaactagaggaactgaaacagattgttcctaaagaatctcttgtctactttcttataggaaaagtgtataaaaagttggggcagacacacctagccctgatgaattttagctgggcgatggatcttgacccgaagggcgccaacaatcaaatcaaggaggcgatcgataagaggtatctaccagacgacgaagagcccattactcaagaagaacagatcatgggaacagatgaatctcaggagtccagcatgactgatgctgacgacacacagctgcacgccgccgaatcagacgagttctag

SEQ ID NO: 182370 - DNA, 2472 bp, Artificial Sequence
  Description of Artificial Sequence: Synthetic coding sequence
atgaccgtgctgcaggagcccgtgcaggccgccatctggcaggccctgaaccactacgcctatagggatgccgttttcctggccgaaagattatatgcagaagtgcatagcgaagaggccttgttcctgctggcaacatgttattacaggtccggaaaagcatataaagcataccggctgctgaagggccattcatgtactactccccaatgtaagtacctgctcgcgaagtgctgtgtggacctgtccaaactcgcagagggagaacaaatactatcgggcggggtgtttaataagcaaaagagtcacgatgatatcgtaactgaattcggcgactccgcctgcttcaccctctccctactgggccatgtctactgcaagacagataggctggccaaagggtccgaatgctaccagaaaagcttaagtttaaatccatttttgtggtcgccattcgagtcgttatgtgagataggagaaaaaccggaccccgaccagaccttcaaatttactagcctgcaaaattttagcaactgtctgccaaattcctgtaccacgcaggttcccaatcactcacttagtcaccgccagcccgaaactgtgctcactgaaactccacaggacacaatcgagctcaacagactcaatctggaatcctcaaactctaagtattccttgaacaccgatagcagcgttagctacattgactccgctgtcatttctccagacactgtcccacttggaactggaacctctattctgtccaagcaagtgcagaacaagcccaagaccggacgcagcctcttgggaggacctgccgctttgtcacccctcacccccagtttcggtattctccccctggaaacacctagtcctggagacggaagttacttgcagaattataccaacacccctccggtcatcgacgtaccttcaacgggggcgccatccaagaagtctgtggcacgaattggccagaccggaacaaaaagtgtcttcagtcagtccggtaactcgagagaggttacgcctatcttagcacagacacaatcatctgggcctcagactagtactactccccaggtgctgtctcctactattacctcacccccgaatgcccttcccaggcggagttcacggttatttacctcggacagtagcacgacgaaggagaattccaaaaagctcaaaatgaagttccccccgaagattcccaaccggaaaacaaagtctaaaactaacaaaggagggattactcaaccaaatataaacgattcccttgaaataaccaaactcgactcaagcatcatcagcgagggtaagatctcgacaataacccctcaaattcaggcttttaatcttcagaaggccgccgccggactgatgtcactgctgcgcgaaatggggaagggttatctggccttatgtagctacaattgtaaggaagccatcaatattctgtctcatcttccctctcaccattacaatactggctgggtcctatgccagatcggacgcgcttatttcgaactttcggaatatatgcaggcggagaggattttcagcgaagtgcggagaatcgagaactacagggtcgaagggatggaaatctattccactactctgtggcacctccaaaaggacgttgccctcagtgtgctgtctaaggacctcacagacatggacaaaaatagtcctgaggcatggtgcgccgccggaaactgtttttccctgcaacgggaacatgatattgcaatcaagttcttccaaagggccatccaggtggatccgaattacgcttacgcttacactctgctgggccatgaatttgtgcttactgaggaactggacaaggccttggcctgtttccggaacgcaatccgcgtaaacccacggcattacaatgcatggtacggattaggcatgatttactataagcaagagaagttcagccttgcagagatgcactttcagaaggctctggacatcaatccacagtccagcgtcttgctgtgccatattggcgtcgtccagcacgcactcaagaaaagcgagaaggcgctcgataccctgaataaagccattgtaatcgacccgaaaaacccactttgtaaatttcaccgggcttctgttctgttcgctaatgagaaatataaatccgcactccaggaactggaggagttgaaacagatcgttcccaaagaatccctggtctacttcctgattggaaaggtctataaaaagttgggtcaaacacacttagcattaatgaatttcagctgggcgatggatttggatcctaagggggctaataaccaaatcaaagaggctatcgacaaacggtatttgcccgacgatgaggagcccatcactcaggaggagcagatcatggggacagacgaaagtcaggagagttctatgaccgacgctgatgatacacagctccatgctgccgaaagtgacgaattctag

SEQ ID NO: 182371 - DNA, 2493 bp, Artificial Sequence
  Description of Artificial Sequence: Synthetic coding sequence
atgaccgtgctgcaggagcccgtgcaggccgccatctggcaggccctgaatcattacgcctatagagatgcagtgtttttggctgaacgactctatgctgaggtgcacagtgaagaggctctatttctgctggccacttgttactatcgaagcgggaaggcatacaaggcctaccgtctgctgaagggccacagctgcaccacgcctcaatgtaagtacctgctagccaaatgctgcgttgacctgtccaaacttgcagaaggcgagcagatcctcagtggtggggtgtttaacaagcaaaaatcccatgacgatatcgttacagaatttggagactcagcttgcttcaccctgtccctgctagggcacgtctactgcaagacggataggttggcaaaggggagcgaatgctaccagaagagcttatcacttaatcccttcctgtggtctcccttcgaatcactctgcgaaattggcgagaaaccggatccagatcagacctttaagttcacaagcctgcagaacttctccaactgcctgcctaactcttgcacaacacaggtccctaatcacagcctcagccacagacagcctgagactgtgttgacagaaacccctcaggatacaattgagctaaatcgactgaacctggaaagttctaatagtaagtactccctgaatactgacagctccgtgtcgtacatcgacagtgccgtgatctccccagacacggtaccattaggcaccgggaccagtatcctaagtaaacaggtgcagaataagccgaagaccggccgcagcctgcttggcggtcctgccgcattatctcccctgactccatctttcgggatactccctttagagaccccttcccccggcgacgggagctatctacaaaactacacgaacacgccgcctgtcatagatgtcccatctaccggcgcaccatctaagaaaacatttcgggttctgcagagcgtagcaagaataggccaaaccggaaccaagtccgtattctctcagtcaggtaacagccgcgaggtgacacccatcttggctcagacccagtccagcgggccccagacttcaacgacacctcaggtgctttcacccactataacgagtccacctaatgcactgccccgtaggagttccaggctttttacctctgacagctccaccaccaaagagaattctaaaaaactgaagatgaaattcccacccaaaatcccaaaccgcaagacaaagtccaagactaataagggcggcattactcagcctaacatcaatgactctttggagatcacaaaattggattcatccatcatcagcgaagggaagattagcaccattacacctcagattcaggctttcaacctgcagaaagccgccgcagagggactgatgagcctcctgagggagatgggaaaagggtacttggccctctgttcatataattgcaaagaggcaataaacatcctgagccatctgccatctcaccattacaataccggctgggtactttgccagatcgggagggcttatttcgagctctccgagtacatgcaggctgagcgaatcttcagtgaagtccgtcggattgagaactatcgcgtcgagggtatggagatctattcaacaaccctctggcacttgcaaaaggatgtggccttgtccgtcctgtctaaggatctgacggacatggacaagaactctccagaggcctggtgcgcagccggaaactgcttttcactccagcgggagcacgacattgccatcaaattctttcagcgggccatccaggtcgatcctaactatgcctacgcttatacactcttaggccacgaatttgtcctcaccgaggagctcgacaaagcactggcgtgttttcggaacgcaatcagggtaaatcctcggcattacaacgcctggtatggactgggcatgatatactacaagcaggagaaattttccctggccgagatgcactttcagaaagctctcgacatcaacccacaatcttctgtgttgttatgtcatatcggcgtggttcaacacgcgctcaagaaatcagaaaaagctctggataccttgaataaggcgatcgtcattgatcccaagaatccgctgtgcaaatttcacagagcgtcggtcctctttgctaatgagaaatacaaatcagccctgcaggaactcgaagagctgaaacagatcgtgccaaaagagagcctggtttattttctgatcgggaaggtttataagaagttgggccagacccacctagccctgatgaacttttcatgggccatggatctcgacccaaagggcgccaacaatcagattaaagaggccatcgacaagcgctacctgccggatgatgaagagcccatcacccaggaggaacaaataatggggaccgacgaaagccaagaatcctcgatgaccgatgctgacgatactcaactgcacgccgcggagtccgacgagttctag

SEQ ID NO: 182372 - DNA, 1740 bp, Artificial Sequence
  Description of Artificial Sequence: Synthetic coding sequence
atgagcgccgccatcgccgccctggccgccagctacggcagcggctctgggagtgagagtgatagcgattccgaatcctcaagatgtcctctgcccgcggccgacagtctcatgcacctaaccaaatccccaagctcaaaaccatcactggcggtggccgtggactccgcacctgaagtggcggttaaggaagatttggaaacaggtgtacatctggatccagcagtgaaggaagttcaatataaccctacctacgagaccatgtttgcccctgagttcggtcccgagaacccgttcagaacccagcagatggcagcgccccgtaacatgctcagcggctatgcggaaccggcgcacattaacgattttatgtttgagcaacagcgacgcactttcgccacctacggctacgccctggatccttccctcgataaccaccaggtgtccgcaaagtacattggatctgtcgaagaggccgagaaaaaccagggcctgacagtatttgagaccggtcaaaagaagacggaaaagaggaaaaagtttaaggagaacgacgcgtctaacatcgacggctttctcggtccctgggccaagtacgtggacgaaaaggacgtggccaagccttccgaagaagaacagaaagaactggacgaaatcaccgcgaaacgccaaaaaaaaggaaaacaagaagaagagaagcctggggaggaaaagaccattcttcacgtgaaagaaatgtacgactaccagggccgatcatatcttcacattccccaggatgttggagtgaaccttagatccactatgcctcccgagaagtgctatttacctaagaagcagattcacgtctggtcggggcataccaaaggagtttccgctgtccggttgtttcctctgtctggacaccttcttctctcttgcagtatggattgcaaaatcaaactgtgggaggtctacggcgaaagacgctgcttacgaacattcataggacattccaaagctgtcagggatatttgcttcaacacagcaggcacccaatttctgtcagcagcgtatgaccgttatctaaaactctgggatacagaaacgggacagtgcataagtaggttcactaatcgcaaggttccttattgcgtcaaatttaacccagacgaagataaacaaaacctgttcgtagcggggatgtcggataagaagatcgtgcagtgggacattagaagcggggaaattgtgcaagagtacgataggcacctgggggctgtcaacaccatcgtgttcgtggacgaaaataggcggttcgtttctacttcagatgataagtctctgcgagtttgggaatgggatattccagtggactttaagtatatcgctgagcctagcatgcacagcatgcctgcggtgacgctgtcccccaatggaaagtggctcgcttgccagtccatggataaccagatcctcatttttggggcgcagaatagatttcgactgaacaaaaaaaaaatcttcaaaggtcacatggttgcaggttacgcttgtcaggtggacttttcccccgacatgtcttatgtgatcagcggtgacgggaacggaaagctgaacatatgggattggaaaactactaagctgtatagtcggtttaaggcgcatgataaggtgtgcattggggccgtgtggcatcctcatgaaacctctaaagttatcacctgcggatgggacgggctgatcaagctatgggattag

SEQ ID NO: 182373 - DNA, 1620 bp, Artificial Sequence
  Description of Artificial Sequence: Synthetic coding sequence
atgagcgccgccatcgccgccctggccgccagctacggcagcggctcagggtctgagagcgacagtgactccgagagttcccgctgtccacttccagctgccgacagccttatgcacctgactaagtccccatcatcaaagccgagtcttgctgttgccgtcgatagcgctcccgaagtcgctgtgaaggaggatctcgagactggggtccacctagacccagccgtcaaagaggtgcaatataatccgacttatgagactatgtttgcacctgagtttgggcctgaaaatccctttagaacccaacagatggcggcccctcggaatatgttgagtggatacgcagaacctgctcatattaacgattttatgttcgagcagcagcgccgtacattcgccacatatggctacgccttggatccctctcttgacaatcaccaggttagtgcgaagtatatcggctccgtggaagaagcagagaaaaaccagggtctaaccgtctttgagacaggacaaaagaaaacagaaaaacgcaagaaatttaaggaaaatgacgccagcaatatagacgggtttctcggtccctgggctaaatatgtggacgaaaaagacgtggctaagccgagtgaggaagaacaaaaggaactggacgagatcactgccaagcgccagaagaagggcaagcaggaagaagaaaaacccggcgaagagaagactattctgcacgttaaggagatgtatgattaccagggaagatcatatttgcacatccctcaggacgttggggtaaatttaaggagcacaatgccgccagaaaagtgttacctgccaaaaaagcagatccatgtctggagcggccataccaagggcgtaagtgctgtgaggctgttcccactgagcgggcacttacttctgagctgcagtatggattgtaagattaagctgtgggaagtatacggggagcggaggtgtcttcgcacatttatcggccacagtaaagctgtgcgtgatatatgctttaacaccgcaggaactcagtttttgagtgcagcctatgacaggtaccttaaactatgggatacagagaccgggcagtgcatctctcggtttacaaacagaaaggtgccctactgtgtcaagtttaaccctgatgaggataagcagaacctgttcgtcgctggcatgtcagataaaaagatcgtgcaatgggacatcaggtctggggagatcgtccaggagtatgacaggcatctgggagcggtgaacaccattgtcttcgtggacgaaaaccggaggttcgtcagcacatccgatgataaatctcttagagtgtgggaatgggatattccagtggacttcaagtatatcgcagaacctagcatgcattcaatgccagcggtcacgctgagtccaaatggcaagtggctggcctgtcagtcgatggataaccagatactaattttcggggctcagaatagatttcgacttaataagaagaaaatcttcaaaggtcatatggtggccggctacgcctgtcaggtcgatttctcaccagatatgcgggtgccccaatccttccaaaacttgaaggaggtcactgcaggcccacaggagggatag

SEQ ID NO: 182374 - DNA, 1740 bp, Artificial Sequence
  Description of Artificial Sequence: Synthetic coding sequence
atgagcgccgccatcgccgccctggccgccagctacggcagcggcagtggcagtgagagtgactccgattccgaaagctcaaggtgccccctgccagcagctgattcattaatgcatttgacaaagtcaccttcctcaaagccctccctcgccgtggcagtagattctgcacccgaagtggctgtcaaggaagacctcgagaccggcgtccacctggatccagcagtgaaggaggtccaatacaatcctacatacgagacaatgttcgcgccggaatttgggccagagaacccgtttaggacacaacagatggccgcgcctcgtaacatgctttccggctacgccgagcccgcacacatcaatgatttcatgtttgagcagcagaggcgcacctttgctacttatgggtatgcgctggaccccagtttggacaaccatcaggtaagcgccaaatacattgggtccgtggaagaagcggagaagaatcagggccttaccgtgttcgagacaggtcagaagaagacagaaaaaagaaagaagttcaaggagaacgatgcgtctaatattgatggcttcctcggtccatgggccaagtatgttgacgagaaggacgttgccaaacccagcgaagaggagcaaaaggagctggacgaaattacggccaagaggcagaagaagggaaagcaggaggaggaaaagcctggtgaggagaagacaattctccatgtgaaagagatgtacgactatcaaggcagatcgtacctccatataccccaggacgtcggcgtcaacctcagaagtacaatgcccccagaaaagtgttatctccccaaaaagcagatccatgtctggagcggccatactaagggggtgagcgctgtgaggttatttcctctgtccggccatctgctgctcagttgcagcatggactgcaagattaaattgtgggaagtctatggggagagacgctgtctaagaacctttattggccactcaaaggctgtgcgcgacatctgctttaataccgctggcacccaatttctgtccgccgcttacgacagatatctcaaattgtgggacacggaaaccgggcagtgtatttctcggttcacaaaccgcaaagtgccatattgcgtaaagtttaatccagacgaagacaagcaaaatttgttcgtggctggaatgtctgataagaagatcgttcaatgggacatccggagtggcgaaatcgtccaagagtacgaccggcatttaggagcagtgaataccatcgtttttgtagatgagaatcggagatttgtatcgacaagcgacgacaaatccttacgggtgtgggaatgggatatccctgtagactttaagtacatcgccgagcctagcatgcatagcatgcccgctgtcaccctgtctcccaatggaaagtggcttgcctgccagtcaatggacaatcagatcctgatctttggggcccagaaccgctttcggctcaataagaagaagatattcaagggccacatggtggccggatatgcatgccaagtcgacttctcgccagatatgtcttacgtcatcagcggcgatggaaatggcaagctcaatatctgggactggaaaaccacaaagctctatagcaggttcaaggcccatgacaaggtctgcatcggggccgtgtggcatccacacgaaacaagtaaggtgattacatgtggctgggacggtctgatcaagctgtgggactag

SEQ ID NO: 182375 - DNA, 1620 bp, Artificial Sequence
  Description of Artificial Sequence: Synthetic coding sequence
atgagcgccgccatcgccgccctggccgccagctacggcagcggctctgggtccgagtcagacagcgattccgagtcttcccgttgccctcttcccgccgccgacagcctgatgcacttgaccaaatcccctagctctaaaccatccttagctgtggccgtggatagcgcacccgaggtggccgtgaaagaagatttggaaactggagtgcatttagaccccgcagtgaaggaggtgcagtataaccccacctacgagacaatgttcgctcccgaatttgggcctgagaatccgttcaggacgcagcagatggccgcacctagaaacatgctgtcagggtatgccgaaccagcccacatcaacgacttcatgtttgaacagcagcgtagaaccttcgccacctatggctatgcgttggatcccagtttagataatcaccaagtgtctgccaagtatattgggagtgtggaggaagccgagaaaaatcagggcctcactgtgtttgaaactggtcagaaaaagacagagaaacgaaaaaagttcaaggagaacgacgcctccaatattgacgggttcctgggtccttgggcaaagtacgtggatgagaaggacgtggccaagccgtccgaggaggaacagaaggagctcgacgaaataactgcgaagcgtcagaagaaggggaagcaggaggaagagaagccaggggaggagaagaccatactccacgtcaaagagatgtacgattaccagggtagatcttacctgcacattccacaagacgtgggcgtgaatctccgctccacgatgccacctgaaaagtgctatctgccgaagaaacagatccatgtctggtccggccacaccaagggggtcagcgccgtgaggctgtttcccctttctggccacttgctgctgagctgctcaatggactgcaagatcaaactctgggaggtgtacggagaaagaaggtgtctgagaacttttataggccacagtaaggccgttcgcgatatctgtttcaacactgcgggtacacagtttctgagtgccgcctacgaccgctacctcaaactgtgggacaccgaaaccggccagtgtatcagccgcttcacaaatcggaaagtgccttactgtgtgaagtttaacccagacgaagataagcagaacctcttcgttgctggaatgagcgacaaaaaaatcgtgcagtgggacattcgctccggagagattgtgcaggagtatgatagacatctcggggctgtgaatactattgtgtttgtggacgagaataggcgatttgtgagtactagcgacgacaaatcgcttagagtctgggagtgggacatacccgtggattttaagtacatcgcagagccctctatgcacagcatgcccgccgtgaccctcagcccaaacggcaaatggctagcttgccaatcaatggataaccagattctgatcttcggtgctcaaaaccgatttaggctaaacaaaaagaaaattttcaaaggccatatggttgccggctacgcctgtcaagtggatttcagtcccgacatgagggtgccccagtcttttcagaacctcaaggaagtcacggcaggacctcaggaggggtag

SEQ ID NO: 182376 - DNA, 378 bp, Artificial Sequence
  Description of Artificial Sequence: Synthetic coding sequence
tgaaacatgctgagcggctacgccgagcccgcccacatcaacgactttatgtttgagcagcagcgtagaacattcgcaacctacggctacgccctggatcccagtctggacaaccatcaggtgagtgccaaatacattggatccgtcgaagaggcagagaaaaatcaagggctgaccgtgtttgagaccgggcagaagaagactgaaaagcgaaaaaaatttaaagagaatgacgccagtaatatcgacggttttctgggcccttgggcaaagtacgtggacgagaaagatgtggccaagcccagcgaggtgagctttgatgtgttcaactgccagtttcgctatacattgtatctctacgaaggctacctccattag

SEQ ID NO: 182377 - DNA, 495 bp, Artificial Sequence
  Description of Artificial Sequence: Synthetic coding sequence
atgagcgccgccatcgccgccctggccgccagctacggcagcggctctgggtccgagagtgactcagattcagaatcctctcgctgccctcttcctgcagctgattctttgatgcacctcactaaaagtccatccagcaagcccagcttggccgtggccgtggacagtgcccccgaggtggccgtgaaagaagacctcgaaacaggagtgcacctggaccctgctgtgaaagaagtgcagtataatcccacctacgaaaccatgtttgctccggagtttggaccagagaatccctttcgcacacagcagatggccgctcctcgtaatatgctctctgggtatgccgagcctgctcatattaacgatttcatgttcgaacagcagcgtcggacctttgcaacatacggctacgccttagaccctagtttagacaatcaccaggtctcggcaaagtacattgggtctgtagaagaagcagaaaaaatcaaggtctag

SEQ ID NO: 182378 - DNA, 213 bp, Artificial Sequence
  Description of Artificial Sequence: Synthetic coding sequence
atggccgccccccggaacatgctgagcggctacgccgagcccgcccatatcaacgacttcatgttcgagcagcagcgtagaacattcgctacttacggctatgcgctcgacccgtctttagataaccaccaagtgtcggccaaatacattgggtctgtggaagaggccgagaagaaccaaggcctgactgtattcgagaccggacagaagtag

SEQ ID NO: 182379 - DNA, 1305 bp, Artificial Sequence
  Description of Artificial Sequence: Synthetic coding sequence
atgagcatcctgaagatccacgcccgggagatcttcgacagccggggcaaccccactgttgaagttgacttgttcactagtaagggcctgttccgagccgccgttccttcaggggcaagtacaggtatctatgaagccctggaacttagggacaacgataagacaagatacatgggcaagggcgtttcgaaagctgtcgaacacataaataaaacaattgctcctgcacttgtgtcaaagaagctcaatgttaccgagcaggagaaaattgacaaactgatgattgagatggatggtaccgagaacaaaagtaagtttggcgcaaatgcgatccttggtgtttcacttgcagtttgcaaagccggggctgtggagaaaggggtccccttgtacaggcacatcgcagacctggccgggaactctgaagtcatcctgcctgtacccgcttttaatgtgattaatggagggagccacgcaggcaacaaattggcgatgcaggaatttatgattcttccagtgggagcagcaaattttagagaggcaatgcggatcggcgctgaagtgtaccacaatctgaagaatgtcataaaagagaaatacggcaaagatgccacaaacgttggagacgaaggagggttcgctcctaatattttggagaacaaggagggcctcgaattacttaagacggctataggcaaggcaggatataccgacaaagttgtcatcggtatggacgtagcagcttcagagttcttcaggtcagggaaatacgacctcgatttcaagtctccagacgatccatcccggtacatctcgcctgaccagctggccgatctatacaagtccttcattaaggattaccccgtggtttcaattgaggacccttttgatcaagacgactggggcgcttggcaaaaattcactgcgtctgccgggatccaggtggttggggacgacctcacagtgaccaaccctaagcggatcgcaaaggccgttaatgagaagtcatgcaattgtctcttattgaaggtcaatcagattggatcagtaactgagagccttcaggcgtgtaaactggcccaggctaacggttggggggtgatggtgagccatagatctggcgaaaccgaggacaccttcatagcagacttagtagtcggcttgtgcaccggccagattaaaacaggggccccctgtcggagtgaacgtttagccaaatacaatcagttactcagaatcgaggaggaactgggttcaaaggccaaatttgccggacgaaactttcgcaatcctctcgccaagtag

SEQ ID NO: 182380 - DNA, 360 bp, Artificial Sequence
  Description of Artificial Sequence: Synthetic coding sequence
atgcggaagaccgccagcagctgccccgccagcctgacctgcgactgttatgccaccgataaggtctgctccatttgtctgagcagaagacaacaagtcgctccaagggccggaacccctggctttcgagcccccgaggtccttaccaaatgccctaatcagaccactggcaagagcatcttatgctcaaaagaagtacctgcccaggacctgagaaaactgtgcgaacggttgagaggcatggactctagcaccccaaaactgacctccgatatccaaggtcacgcaagtcaccaacccgccatcagcgagaaaactgaccacaaggctagttgtctcgtgcagacgccacctggctag

SEQ ID NO: 182381 - DNA, 474 bp, Artificial Sequence
  Description of Artificial Sequence: Synthetic coding sequence
atggaggccagcctgggcatccagatggacgagcccatggccttctcaccccagagagacaggttccaggccgaaggttctctgaaaaaaaatgagcagaactttaaactggccggggtgaagaaggatattgagaagttgtatgaagccgtgccccagctcagcaatgtttttaaaattgaagataaaataggggaaggcaccttttcgtccgtttacctggctactgcccaactccaggttgggcccgaagagaaaatcgctctgaaacatttaataccgacttcccaccctattcgcatagccgctgaactccagtgtttgactgtggctgggggacaggataatgtcatgggagtgaaatattgcttccgaaagaatgaccatgtagtgattgctatgccttaccttgagcacgagagcttccttgacatcctgaatagcctctccttccaagaagttcgcgaatactag

SEQ ID NO: 182382 - DNA, 1725 bp, Artificial Sequence
  Description of Artificial Sequence: Synthetic coding sequence
atggaggccagcctgggcatccagatggacgagcccatggccttctctcctcagcgggacagattccaggctgagggttctttgaaaaaaaacgagcaaaactttaagctggccggagtgaagaaagatatcgaaaagttgtatgaggctgtgccccagctgagtaatgtgtttaagatcgaagataaaatcggggaaggcacctttagctccgtgtacctcgcaactgctcagctgcaggtgggccccgaagaaaaaattgcactaaaacatctgattccgacctcccaccccatccgcatagccgccgaactccagtgccttactgtggccgggggccaagacaatgtcatgggggtcaagtactgttttcggaaaaatgaccatgtcgtgatcgccatgccatatctggaacacgaatcattcttggatatactaaactcattgagttttcaagaggtgcgcgaatacatgctcaatttgtttaaggcactgaagcggatacaccagttcggtattgttcacagggacgtgaagccaagcaacttcctttacaaccgcagactaaagaagtacgccttggtcgacttcggccttgctcaggggacacatgacacaaagatcgaactccttaaatttgtgcagtccgaagctcaacaggagagatgcagccaaaacaagtcccatataattacaggcaacaagattccactgtcaggccctgtgcctaaggagttagatcaacagtcgaccactaaagcaagtgtgaagaggccatacaccaatgcccagattcagatcaagcagggaaaggatgggaaagaaggatctgtcggcctgtccgtgcagcgctccgtcttcggagaacgcaactttaacatacactcctccatatcccatgagtcccccgcagtgaagctgatgaagcagtctaagacagtcgatgttctctcccggaagctggctaccaagaagaaggcaataagtaccaaggtgatgaattctgccgtcatgcggaagaccgcgagcagttgtcctgccagccttacttgcgattgttacgccacagacaaagtgtgttctatctgtctctcacggcggcagcaagttgcaccaagagcgggcactcccggatttcgagctcccgaggtgttaacgaagtgccctaatcagacgaccgcaatcgatatgtggtccgccggcgtcatctttctcagtctgctgagcggtcgctaccctttctacaaggccagcgatgacctcacagcgctggcccaaattatgactatcaggggatcgagggagacgatccaggcagcaaagaccttcggcaaatcaattctgtgcagcaaagaggttccagcgcaggacctgcgaaagctgtgcgagcgtctcaggggaatggacagctccactccaaaactgacttcagatatacagggtcacgcaagccaccaacccgccatcagcgaaaaaaccgatcacaaggccagctgcttggtgcaaacccctcccggccagtatagcggtaactcttttaaaaaaggcgatagtaactcttgcgagcattgcttcgacgaatataacacaaacctcgagggctggaatgaggtgccagacgaagcctatgatctgctggacaaacttctggatctgaaccccgcctcccgtattaccgctgaagaggccctcttgcaccccttctttaaagatatgagtctttag

SEQ ID NO: 182383 - DNA, 1641 bp, Artificial Sequence
  Description of Artificial Sequence: Synthetic coding sequence
atggaggccagcctgggcatccagatggacgagcccatggccttcagcccccagagagaccgcttccaggccgaaggaagcctcaaaaagaacgagcagaatttcaaattagcaggtacattttcatcagtctacctggccaccgcacaactccaggttggtccggaggagaagattgctctgaaacatctcattcctacctcacaccccattcgcatcgccgctgagctccagtgcctgaccgtagcgggagggcaggacaacgtaatgggggtgaagtactgctttaggaaaaatgaccatgtcgtgattgcaatgccctatctcgaacacgagtcctttctggatatattaaactccctgtctttccaggaagttcgcgaatatatgctgaacctgtttaaggcattgaagaggattcaccagttcggaatcgttcacagggatgtgaagccaagcaacttcctgtacaatagaaggttaaaaaagtatgctttagtggatttcggactagcccagggaactcacgatacaaaaatcgagctgttgaagtttgtgcagagtgaggcgcagcaggaacggtgttcccagaacaagtctcacattattaccggaaataagatccctcttagtggacccgtccccaaggagcttgaccagcaaagcaccacaaaggcgagtgtcaagcgcccctacacaaatgcccagatacagataaagcagggcaaagacggaaaagaaggaagcgtgggactgtctgtgcaaagaagtgtttttggagagcgtaatttcaatatccatagttccatcagccatgagtcgccggccgtgaagcttatgaagcagagtaagaccgtggacgtactgtcacggaaactggccacaaaaaaaaaggcgataagcacaaaggtgatgaatagcgccgtgatgcgaaagaccgcaagctcatgtcctgccagcctcacgtgcgactgctatgccaccgacaaggtgtgctcaatttgtctatccaggcgtcagcaggtggcccctcgcgctgggacgcccgggttcagggccccggaggtgttaaccaagtgccccaatcagacgaccgccatcgacatgtggtccgcgggagtaattttccttagtttgctcagcggcaggtaccctttctacaaggcaagcgacgacttaaccgccctcgcccagattatgaccatcagggggtctagagagactatacaggccgcgaaaacctttggtaagtcaatcctgtgttctaaggaggtgccagcccaagacttgcgaaagctgtgcgaacgtttaaggggcatggactcaagcaccccaaagcttacgtccgacatccaaggacacgcgtcgcatcagccggccattagtgaaaaaaccgatcacaaagcctcttgcctcgtgcagacaccccccggacagtactctgggaactcatttaagaagggcgactctaactcttgtgagcattgttttgatgagtacaacaccaatctggaggggtggaacgaggtgcctgacgaggcttacgacctactggataaactgttggacctgaacccagcctctagaattacagccgaagaagcactcctccaccccttctttaaggatatgtctttgtag

SEQ ID NO: 182384 - DNA, 3453 bp, Artificial Sequence
  Description of Artificial Sequence: Synthetic coding sequence
atggcccagttcggcggccagaagaaccccccctgggccacccagtttacagccaccgccgttagccagcccgctgccttgggtgtccaacaaccttcccttctcggcgccagccctactatctacactcagcagactgccctggccgcggccggcctcactacacaaactcctgccaattatcagctgacccagacagctgccctgcagcagcaagccgccgctgccgccgccgccctgcagcagcaatatagtcaaccccaacaggctctgtactctgtgcagcaacagcttcagcagcctcagcaaacgctccttacccagcctgccgttgccctgcccacttcattatctcttagcactccgcagccaacagcccagattaccgtgtcttatcctaccccgcgatcgtcccaacagcagacccagcctcagaaacagcgagtgttcaccggagtcgtcacaaagctccacgatacttttggattcgtggatgaagatgtattcttccagttgtccgcggtgaaaggaaagacgccccaagtcggcgatagagtcctcgtagaggccacatacaacccgaatatgccctttaaatggaacgcccagcggatacaaactctgccgaaccaaaaccagagtcaaacccaacctctgctcaagacacccccggccgtcttgcagcctattgcaccacaaacaacctttggtgtgcagactcaacctcagccgcaatcactattgcaagcccagatctcagctgcctccattacgcctctgctccagacccagccccagcctctgcttcagcaaccacagcagaaagccggtctgctgcagcccccggttcggattgtttcccagccccagcctgcaaggcgcttggatcctccctctaggttttcaggccggaatgatcgcggggatcaggtccccaacaggaaggatgaccgttctcgagagagggaaagagagaggaggagaagtcgggaacgctctccacagcgaaagagatcccgggagagatcacccaggagagagagggagaggtcaccccgccgggtgaggcgggttgtcccccggtacaccgttcagttcagcaagttttcactcgattgcccttcttgcgatatgatggagctgagaagaaggtaccagaatctctacattccttcagattttttcgacgcacagttcacatgggttgatgccttcccgctgagccggccatttcaactcggcaactactgtaacttctatgtgatgcaccgcgaagtggaatcactggaaaagaatatggccatcctggatcccccagacgccgatcacctctatagtgccaaggtaatgttgatggcctcgccatcaatggaagatctctaccacaagagctgcgcgctggcggaggacccacaagagctcagagacggatttcagcatccggccagactggttaagtttctcgtgggaatgaaaggcaaagatgaagctatggcgatcggtgggcattggtccccatctctcgacgggccagatcccgaaaaggaccctagcgttctaattaagacggcgatccgctgttgcaaagcgctgactggtatcgacttgtctgtgtgcactcagtggtaccggtttgccgaaattcgataccataggccagaggaaactcataaggggaggaccgttccggcgcatgtggagactgtagttctgttttttccagatgtgtggcactgcttaccaacacgcagcgaatgggagaccctgtcccggggatataaacagcagctggtggaaaaactgcagggtgaaaggaaagaagctgacggggagcaggacgaagaggagaaagatgacggtgaagcaaaagaaatttccacgcctactcattggtcgaaactggatcctaaaaccatgaaggtgaatgatctgcgcaaagagcttgaaagtcgggctctgagcagtaaaggattgaagagtcagcttattgcacgattgactaaacagctcaaggtggaggagcagaaggaggagcagaaggagctcgagaagagcgagaaggaagaagacgaagatgacgaccggaagtccgaggacgacaaggaagaggaagagcggaaaaggcaggaagagatcgagcgacaacgcagggaacgacgttatatcctgcccgatgagccagcaattattgtacaccctaattgggcagctaagtctgggaagttcgattgtagcattatgtctcttagcgtgctgctagattaccggttggaggacaacaaagagcatagcttcgaggtaagtctgttcgcagaattgtttaacgaaatgctgcaacgagacttcggcgtacgtatctacaaatcattgctatctctgcctgagaaagaggataagaaggagaaggataagaaatctaaaaaagacgaaagaaaggataaaaaagaggaacgagacgacgagactgacgagcccaaaccgaagaggcgcaagtctggggacgataaggataaaaaggaggatcgtgacgaacgtaagaaggaggataagagaaaagatgactcaaaggatgatgatgaaaccgaggaggataacaatcaggatgagtacgatcccatggaggcagaagaggccgaggatgaagaggatgatcgggatgaagaggagatgactaaaagggacgataagcgggacataaatcggtactgcaaggagcggcctagcaaagataaggagaaggagaaaacacaaatgataactattaaccgggatctgctcatggcattcgtgtactttgatcaaagtcactgtggctatctgttggaaaaggatctggaagagattctctatactctggggttacatcttagtcgggcccaggtcaaaaaactgctaaacaaagtggtgctgcgcgagtcttgcttttacagaaagctaacagatacatccaaggacgaagaaaatcatgaggagtccgaaagcttacaggaggatatgctgggtaataggctgctattacctacccctacagtgaagcaagagtccaaagacgtggaagagaacgtggggcttattgtttacaacggtgccatggtggatgtgggttctctgcttcagaaactggaaaaatctgaaaaggtccgggctgaggtggaacagaaactccagttgcttgaggagaagactgacgaagatgaaaagacaatcctgaatctcgagaattctaacaagagcctctctggtgagctccgtgaggtcaagaaggatctatcacaacttcaggaaaatcttaagatctcagaaaacatgaacctgcagtttgagaaccagatgaataagacaattagaaacctctctactgtgatggatgagatccatacggtactgaaaaaagacaatgtgaaaaacgaggacaaggaccaaaagtctaaggaaaatggagctagtgtttag

SEQ ID NO: 182385 - DNA, 3408 bp, Artificial Sequence
  Description of Artificial Sequence: Synthetic coding sequence
atggcccagttcggcggccagaagaaccccccctgggccacccagttcaccgcgacagccgtgtcccaaccagccgctctcggagttcagcagccctctctactcggcgcttcaccaactatctacacacagcagacagctcttgcagctgccggactgactacacagactcctgcaaattatcagctcacacaaactgcagccctacagcagcaggcagcggccgccgctgccgccctgcaacagctgcagcagcctcagcagactctgctgacacagcccgcagtcgcattgcctacttcactgtcattatccaccccacagcctacagcacagataactgtctcttatccgactccgaggtcctcacagcagcagacccaaccacaaaaacaaagggttttcaccggtgtggtgactaagctgcacgacacttttgggtttgtggatgaggacgtcttctttcagctgtctgccgtgaaggggaaaactcctcaagtaggagatcgcgtgcttgtagaggcaacctacaaccccaatatgccctttaagtggaatgctcagaggatccagactctgcctaaccagaatcaatctcagacacaacccctcctgaagacaccgccggccgtcctccaacccatcgcgccacagactacattcggagtgcagacgcagccgcagccccagagcctgcttcaggcccagatttcagccgcatcgattactccactgctccaaacacagccccagccattattgcagcaaccacagcagaaggccgggttgctgcagccaccagttagaatcgtcagtcaaccccaacctgctagacgcctggaccccccgtcaagattctctgggcggaatgataggggagatcaggtgcctaataggaaagacgatcgatcccgagaacgtgaacgtgaacggagaaggagcagagagcggtccccccaacggaagcgttcccgggaacggtccccacggcgcgagcgcgaacgatcgccccgcagagtccgaagagtggtgccgcggtatacggtgcaattcagcaagttttctctggactgcccaagctgtgatatgatggaattgaggcgaaggtatcagaacctgtacattccatccgactttttcgacgctcagtttacttgggtggacgcattcccacttagccggccttttcagctaggtaattactgcaacttttatgtaatgcaccgggaggtggaatccctagagaaaaacatggccatcctagaccccccagacgctgatcatctgtattccgcaaaggtcatgctaatggcaagcccctctatggaggatctatatcataagtcttgcgcgctcgcagaagacccccaggagcttcgcgacggatttcagcaccccgcgagactcgtcaaattccttgtgggtatgaagggcaaggatgaggccatggccattggcggtcactggtccccgagcttagatggcccggatccggagaaggatcccagtgtgctcataaagaccgccatccggtgctgtaaggctttgacaggtatcgacttgtctgtctgtacccagtggtatcggtttgctgagatccggtatcacagaccggaagaaactcacaaaggcagaacagtgcctgcccatgtcgagactgtggtgctcttcttccccgatgtctggcactgtctccccaccagatctgaatgggaaacactatcgcggggctataaacagcagctggtggaaaaacttcagggcgagcggaaagaggctgacggcgagcaggatgaagaagagaaggatgacggggaagccaaggaaataagcaccccaacccattggagcaaactggatcccaaaacaatgaaggtcaacgacctgcgtaaagagctggagtctagagctctgtcaagcaagggcttaaagagccagctgattgccaggctcactaaacagcttaaggtagaggaacagaaggaggaacaaaaggagctggagaagtccgaaaaggaggaggatgaagatgacgatcgcaagtccgaagatgataaagaagaagaggaacgaaagcgccaagaagaaatagaacggcagagaagggagcgccgctatatcttacctgatgaaccagcaattatcgttcaccctaactgggctgccaagagcgggaaattcgactgttcaattatgtccctgtcagtgctgcttgattatcggttggaggataacaaagagcatagtttcgaagtgtctctgtttgccgaactctttaatgagatgctgcaaagggactttggggttaggatctacaagagtcttctgtctctcccggaaaaggaggacaagaaagaaaaggacaagaagtctaaaaaggacgagcggaaggataagaaagaagaacgcgacgatgagacagacgagcccaagcctaaaagaagaaaatcaggcgacgacaaagacaaaaaggaagaccgcgacgagcggaagaaggaggacaagcgaaaagatgactccaaggatgacgacgagacagaagaagacaacaaccaggatgaatacgacccaatggaagcagaggaggccgaggatgaagaagatgatagagatgaagaggagatgactaaacgcgatgacaagagagacatcaatcgctactgtaaagagcgaccctccaaggataaagagaaggagaaaactcaaatgataactatcaaccgggacctactgatggcattcgtctattttgatcagtctcactgtggctacctgctcgagaaggatctggaagaaatcttatatacacttggactacatctctcccgggcacaggtgaaaaaactccttaataaggttgtgcttagagagtcatgcttttacagaaagctgaccgatacctctaaggacgaagaaaaccacgaagagagtgagtccctgcaggaggacatgctcggaaaccggctgcttcttcctacacccacagtgaaacaggaatccaaggacgtcgaggagaatgtgggtctgattgtttacaatggagccatggtggatgtgggctcactgctccaaaaactcgaaaagtccgagaaggtgcgggcagaagtagagcagaaactgcagctgctggaggagaagacagatgaggatgagaagacgattttgaaccttgagaatagtaataagtccctaagcggtgagcttagagaggttaagaaggatttgtcccaactacaggaaaacctgaaaatctccgagaatatgaatttacagtttgagaaccaaatgaataagacaatcaggaacctttccacagtgatggacgagattcatacagtgttaaaaaaggacaatgtcaagaatgaagataaagatcagaagagcaaagagaatggcgcgtctgtgtag

SEQ ID NO: 182386 - DNA, 360 bp, Artificial Sequence
  Description of Artificial Sequence: Synthetic coding sequence
atggcccagttcggcggccagaagaaccccccctgggccacccagttcactgctacggccgtgagtcaaccagcagcgctgggtgtgcagcagccatcactgctcggagcaagtcccaccatctatactcagcaaacggcgctggctgctgccggcctcacaacccagactccagcgaattatcaactgacccagacagctgcacttcagcaacaagccgcagctgcggcagccgctctgcagcaacagtacagccagcctcaacaggctttatactctgtccagcagcagctgcagcaacctcagcagacactgttgacccaacctgcagtggctctgccaacaagcttgtcactctag

SEQ ID NO: 182387 - DNA, 516 bp, Artificial Sequence
  Description of Artificial Sequence: Synthetic coding sequence
atggcccagttcggcggccagaagaaccccccctgggccacccagtttaccgcgaccgccgtctctcaacctgctgcacttggggtacagcagcctagcctcctgggagcttctcccactatctacacacagcagacagctcttgccgcggcaggcctaacaacccagactcccgcaaactatcagctcactcagactgccgccctccagcaacaggcagccgcagccgctgcagccttacagcaacagtactctcagccacagcaggccctatattccgtccagcagcagctccagcagccccagcagaccctgcttacccaaccagctgttgccctgcctacctccttgtccttatctacacctcagcccaccgcccagattacggtgtcataccctacaccacggtcatcccagcagcagacacagccccagaagcagcgagttttcactggggtagtgaccaaactgcacgatacctttggtttcgtcgacgaggatgtgtttttccagtag

SEQ ID NO: 182388 - DNA, 3132 bp, Artificial Sequence
  Description of Artificial Sequence: Synthetic coding sequence
atggcccagttcggcggccagaagaaccccccctgggccacccagtttaccgccaccgctgtgtcacaacccgccgctttgggtgtgcagcagccttctcttctgggcgcatccccaacgatctacacccaacagactgccctggccgccgctggactgacaactcagacccccgcgaactatcagctgacacagaccgccgctttacagcagcaggccgcagcagccgctgcagcgcttcagcagctgcagcagccgcagcaaacactgctgacccagccagcggtcgcacttccgaccagcctgagcctttccacgcctcagccaaccgctcagattacagtgtcttatccgaccccccgatcctcccaacagcagacacaaccacaaaaacagcgggtcttcacaggagttgtaacgaaattacatgacacattcggtttcgtcgacgaggatgtcttctttcaattgtctgcagtcaagggcaaaaccccccaggtcggcgaccgtgtgctcgtcgaagctacctacaatcccaacatgccttttaaatggaacgctcagaggattcagacactacctaatcagaatcagtctcaaactcaacccctacttaagacaccacctgcagtcctgcagcctatcgcaccacagacaactttcggggtccagacccagccccagccccagtctctattacaagcgcagatctctgccgcttccattaccccattgctccagacacagcctcagccactccttcaacagcctcaacagaaagcaggcctgctgcagccacctgtgaggatcgtatctcagcctcagcctgcgaggcgtcttgatccacccagtagattttccggtaggaatgatcggggggaccaggtgcccaaccggaaagatgatcgatcgcgggaacgggagagagaacgccggcgatcccgggaacgaagcccccagagaaagcggtctagagagcgcagccctagacgagagcgcgaacggagccctcgacgtgtccggagggtggtgccacgctacacggtgcagttctctaagtttagcctagattgtccaagctgtgacatgatggaactgcgtcgaagatatcaaaatctctacattccttcggatttttttgacgcgcaattcacgtgggtggacgcctttccgttaagtagaccattccagcttggcaattactgcaatttctacgtcatgcaccgcgaagtagagagtctcgaaaagaacatggcaattcttgatccaccagatgcggatcatctgtacagcgcaaaggtcatgctcatggcctctccctctatggaagatctgtaccataaatcgtgcgctcttgccgaggacccacaggagctgagggatgggttccagcacccagctagactggtcaagttcctggtgggaatgaagggcaaggatgaggccatggctattggaggccactggtcacctagcctcgacggtccagaccctgaaaaggatccgagcgtattgatcaaaaccgctatccggtgctgtaaagcattgactggaatcgatctgagcgtgtgcacacagtggtacaggttcgctgagatccgttatcaccgaccagaagaaacacataagggtcgtaccgtccctgcacacgtggaaacagtggtgctctttttccctgatgtatggcactgcctgcctacccgaagtgaatgggaaactctgagtcgggggtataaacagcaactggtggaaaagcttcagggggagcgcaaagaagccgacggtgaacaggatgaagaagagaaggatgatggggaggcaaaagagatcagcacccctacccactggagtaaactcgatccaaaaactatgaaagtgaatgatctgagaaaggaactggagtcccgtgccctgtcctctaaggggttgaagtcccagctgatcgcgcggctgactaaacagctgaaagtggaagagcagaaagaagaacagaaggagctggagaaatctgagaaagaagaagacgaggatgatgaccgcaaaagcgaggatgacaaggaagaagaagaaaggaagaggcaggaggaaatcgaaaggcaacggcgggagcgacgctatattctacccgacgaacctgccattatcgtccatccgaactgggccgccaagtccggtaagttcgattgcagcatcatgtctctttctgtactcctggactacagactagaagataataaggaacactcttttgaggtttcactctttgccgagcttttcaacgaaatgctgcagagagactttggggtccgcatctataagagtctgctatctcttccggagaaggaggataaaaaggagaaggacaagaaatccaagaaggatgaacggaaggataagaaggaagagcgagatgacgaaacggacgaacccaaacctaaaagaaggaaatccggggacgataaggacaagaaggaggacagggacgagcggaaaaaagaggacaagcgtaaagacgacagtaaagacgacgacgagactgaagaggataacaaccaggacgaatacgaccctatggaggctgaggaagctgaagatgaagaagatgaccgtgacgaagaggaaatgaccaagcgcgacgataagagagacatcaatcgttattgtaaggagcggcctagcaaggataaagaaaaggaaaaaacacagatgatcaccatcaaccgtgatttactcatggcttttgtgtactttgatcagtcacattgcggatatctcctcgagaaagaccttgaagaaatcctgtataccctcggccttcatctcagccgggcccaggttaagaaattgctcaataaagtggtcctacgggagagctgcttttaccggaagcttacagacaccagtaaagacgaagagaaccatgaggagtctgagtctcttcaggaagacatgctaggaaacagactactgctgccaacccctacagttaaacaagagtctaaagacgtggaggaaaacgtcggactaatagtgtataacggagccatggtggacgtgggctccctgctgcagaagctagaaaagtctgaaaaagttcgcgcggaggtcgaacaaaaactgcagctgctctag

SEQ ID NO: 182389 - DNA, 726 bp, Artificial Sequence
  Description of Artificial Sequence: Synthetic coding sequence
atgttcgcccggggcctgaagcggaagtgcgtgggccacgaggaggacgtggaaggggcattagcggggttgaagacagtatccagctactctttgcagaggcagtctctccttgatatgtccctggtcaagctgcagctctgccatatgctggtggagccgaatctgtgtaggtccgtgctgatagccaatacggttagacagattcaggaggagatgacacaggacggaacttggcggactgtggcgccccaggccgcggaacgagcccctcttgatcggctagtcagcactgaaattctctgccgtgctgcatggggacaggagggcgctcatcccgcacctggcctcggagatggtcatacacagggccctgtctctgatctgtgtcctgttacttccgcccaggccccccgtcatctacagtcttctgcatgggaaatggacggccctcgcgagaatagaggcagttttcacaagtctttggatcaaattttcgaaactctcgaaacaaagaatcccagctgcatggaggaactcttctccgatgttgatagtccttattacgatctcgatacagtgctgactgggatgatgggcggagcacggcctggaccttgtgaggggctcgaagggctggctcctgccacacccggcccatcctcttcttgtaagtcggacctgggggaactggaccatgtggtagagatcctggtcgagacatag

SEQ ID NO: 182390 - DNA, 726 bp, Artificial Sequence
  Description of Artificial Sequence: Synthetic coding sequence
atgttcgcccggggcctgaagcggaagtgcgtgggccacgaggaggacgttgagggggcactggccggcttgaagaccgttagctcgtattcccttcagagacagtccctgctggacatgagcctggtcaagcttcagctatgccacatgctcgtggaacctaacctctgtcgtagtgtgctcatcgcaaatactgtccgacaaatacaggaggaaatgacacaagatgggacctggagaaccgtcgcaccacaggccgcagagcgcgcgcccctggacagactcgtatcgaccgaaattttgtgccgtgctgcatggggacaggagggcgctcaccccgccccagggcttggggacggccacacccaagggcccgtctccgacttgtgtccagtaaccagcgcccaggccccaaggcacctgcagagtagcgcttgggagatggatggccctcgcgagaatcggggttctttccataagagcctggatcaaattttcgaaactctcgagactaagaatccctcatgcatggaagaactcttctccgacgtcgatagcccctattatgatctagataccgtgcttacgggcatgatgggtggggctaggccaggcccctgtgagggattggaaggccttgcccctgccactccgggcccaagtagctcgtgtaagtctgacctcggagagcttgaccatgtcgtggaaattctggtggaaacttag

SEQ ID NO: 182391 - DNA, 759 bp, Artificial Sequence
  Description of Artificial Sequence: Synthetic coding sequence
atgagcggccggcggacccggagcggcggcgccgcccagcggagcggaccaagagctccgagccctaccaaaccattgcgaagaagccaaaggaagtccggttccgagttaccatccattctacctgaaatttggcctaaaaccccgagcgcagctgccgtgcgaaaaccaattgtgctcaagcggattgttgcacacgctgtcgaggtgcccgcagtgcagagcccacggagatcaccgaggatatcattcttcctagaaaaggaaaacgagcccccaggcagggagttaacaaaggaagatctgttcaaaacccatagtgtgcccgctacacccactagcacccctgtcccaaaccctgaagctgaatcaagcagtaaagagggggagcttgatgctagggacctggagatgagtaagaaggtcagaaggtcttacagccggctggagacactggggtccgcttcaacttctaccccggggcggcggtcatgcttcgggtttgagggactccttggcgctgaggatctgtcaggggtgtctccagtagtctgttccaagttgacagaagtaccgcgtgtttgtgccaagccttgggctcctgacatgaccctgcctggcatttcccccccgcccgaaaagcagaagaggaagaagaagaagatgccagaaattcttaagacagagctggacgaatgggccgcagcaatgaatgccgaatttgaggcggccgagcagtttgatttgctggttgaatag

SEQ ID NO: 182392 - DNA, 216 bp, Artificial Sequence
  Description of Artificial Sequence: Synthetic coding sequence
cagttcctggaccaggaggactggggcccccagcggaccagcaaggagattaggcaacttcagaatgactgcatgagactgcgagagtctttgaacaccacccaggtgcataacctggccctgggcgaaaaactccagaatctgccaaccctgctctacaagtcacttaaagaaggagcacaagcaatccaagaagaagcacaagctatacaatag

SEQ ID NO: 182393 - DNA, 1353 bp, Artificial Sequence
  Description of Artificial Sequence: Synthetic coding sequence
atggacgcccggcgggtgccccagaaggacctgcgggtgaagaagaacctgaaaaaattcaggtatgtgaaactaatttctatggagacatctagtagcagtgatgacagctgcgactccttcgctagcgacaacttcgccaatactaaaccgaaattccggtccgacatttctgaagaactggcaaatgtgttttatgaagatagtgataacgagtctttctgtggcttctctgagtccgaagtccaggacgtgctcgaccattgcgggttcctacagaagccccggccagacgtcaccaacgagctggcaggaatctttcacgccgactctgacgatgagagtttttgtgggttcagcgaatccgaaatccaggatggaatgcggctgcagagcgtgcgggaaggttgtcgaacaagatcccagtgtagacactcagggcccctaagagtcgccatgaaattccccgcgcggtctactcgcggcgccaccaacaagaaggccgagtcacggcagccgtctgagaactctgtgacggactcaaattccgactccgaagatgagtcaggcatgaactttctcgagaagcgggcattaaatattaaacaaaataaggcgatgctagctaagctgatgtccgaacttgagagctttccaggttcatttcgagggagacacccactgccaggcagtgactcacagagtcgtaggcctaggagacgtacgttcccaggcgttgcctcacgcaggaatcccgagaggcgcgcacggccactgacaaggagccgatcgcggatcttgggaagcctcgacgctctccctatggaggaggaagaggaggaagataaatacatgttggtcagaaaaagaaagaccgtagacgggtatatgaatgaggacgatctcccaagaagccgtcgctctcgaagctccgttaccttaccccacattatacgaccagttgaggaaataactgaggaggaactagagaacgtgtgcagcaatagtagagaaaaaatttacaatcggtccttgggttctacttgccatcaatgtaggcagaaaactatcgatacgaagacgaattgccgcaacccagattgttggggtgttaggggccagttctgcggtccttgcctgcgtaataggtacggggaggaggttcgagatgccctgttggacccgaactggcactgccccccttgccgtggaatctgcaattgttctttctgcagacagcgcgacggtcgttgtgccacaggggtgctggtttatcttgcgaagtatcacggcttcgggaacgtgcatgcgtatctgaaaagcctgaaacaggaatttgaaatgcaggcttag

SEQ ID NO: 182394 - DNA, 1116 bp, Artificial Sequence
  Description of Artificial Sequence: Synthetic coding sequence
atggacgcccggcgggtgccccagaaggacctgcgggtgaagaagaatctgaaaaagttcaggtacgttaagctgatctcaatggagaccagcagtagctcagacgacagttgcgactccttcgcatcggacaattttgctaacactagacttcagtctgtgcgagagggctgtcgtactaggtctcagtgccgccactccgggcctctgcgggttgctatgaagtttcctgcgcgctctaccaggggggccaccaataagaaggcggagagcaggcaaccatctgaaaatagtgtgaccgactcaaactctgactctgaagacgaaagtggcatgaacttcctggaaaaaagggcgctgaatataaagcagaataaggctatgctggctaagttgatgagcgagttggagagctttccgggctcatttcgtggtcggcacccactccccgggagcgactctcaatctcgaaggccccgccgacgcacctttcccggagtggcaagcaggcgcaaccccgagcgccgggcccgacctctaaccagatccaggtctcgaatactgggctccctggacgcccttcctatggaggaagaagaggaagaggacaaatatatgctggtgagaaaaaggaagaccgtggatggctacatgaatgaggacgatcttcctagaagtcgcagaagtagatcctccgttacactcccccacatcattcggccagtcgaagagataacagaggaggaactggagaacgtttgtagcaatagcagagagaaaatttacaatcggtcactaggaagtacctgtcaccagtgtaggcagaagacaatagatacgaaaactaattgcagaaaccccgattgctggggtgttcgggggcagttctgtgggccctgcctgagaaaccggtacggtgaggaggttagagatgctctgttagatcccaattggcactgcccaccctgccggggaatctgcaattgcagcttctgcagacagagagacggacggtgtgcaacaggagtcctagtgtatctggccaagtatcacggcttcggaaatgttcatgcatatctcaagtccctgaagcaggagttcgagatgcaggcttag

SEQ ID NO: 182395 - DNA, 966 bp, Artificial Sequence
  Description of Artificial Sequence: Synthetic coding sequence
atggacgcccggcgggtgccccagaaggacctgcgggtgaagaagaatctgaaaaagtttcgatatgtcaagctcatcagcatggagacctcctcatctagcgacgattcctgcgactccttcgcctccgataattttgccaacacacggctgcagagcgttagggaggggtgtaggactcgctcacagtgtagacactccgggcccctccgcgtggctatgaaatttccggccagatctaccagaggcgcaaccaataagaaggccgagagcagacagccctccgaaaattctgtgactgactctaatagcgatagcgaagacgaatccggcatgaatttccttgagaagcgcgcactgaacataaagcagaacaaggccatgctagcaaagttaatgagtgaactggaatcctttccaggatcttttcgcggccggcatcccctgcctgggtccgacagtcagtctcggcggcctagacggaggacctttccaggggtggctagccggcgcaatcccgagcgtcgggcccgcccactcaccaggtcgaggtctcggatcctgggctctctcgacgcgctgcctatggaagaggaggaagaggaggataaatatatgttggtgagaaagaggaagaccgtggatggctatatgaacgaggatgacttgccacgttctaggaggtcgcgcagcagcgttacccttcctcacattattagaccagtggaagagattacagaggaggaacttgagaacgtatgtagcaattcaagggaaaagatctataatcgctctcttaactggcactgtccaccatgtcgagggatctgcaattgtagcttctgtaggcaacgagatggtcggtgcgcaactggtgtcctcgtgtacctggccaaataccacggtttcggaaatgtccatgcgtatctcaaatccctcaaacaggaattcgaaatgcaagcgtag

SEQ ID NO: 182396 - DNA, 1263 bp, Artificial Sequence
  Description of Artificial Sequence: Synthetic coding sequence
atggagaccctgagcagcgaggagagctgcgacagcttcgacagcctagagagcgggaaacagcaggacgtaaggtttcatagtaagtattttaccgaagaactgcgtagaatatttatcgaggacacggatagcgaaacggaagactttgctgggttcacccaatcagaccttaacggcaagacaaacccagaagttatggttgtggaaagcgacctgtcggacgacggcaaagcaagtttggtgtctgaggaagaggaagacgaagaggaagataaggccactcctcgcagatcccgatcaagacgcagctccatagggcttcgtgtggcttttcagtttcccacaaagaagctcgcgaataaacctgataagaattctagtagcgaacaacttttttcatccgcacgtttacaaaacgagaagaagacaatacttgagaggaaaaaagactgtagacaggtgattcagcgcgaggattctacaagtgaatccgaagacgattctagagatgaaagtcaggagagctcagatgccttgctgaagcggaccatgaacattaaagaaaataaagccatgctcgcccaactgttagccgagttaaacagcatgcccgattttttccccgtgaggacgcctaccagtgcctctagaaagaagaccgtgagaagagcctttagtgagggccaaattacccgtaggatgaaccccacacgaagtgccagaccgcccgaaaaattcgctcttgaaaactttacagtgtcagccgcaaagttcgctgaggaattctactctttcaggcgccgcaaaacgatcggaggaaagtgcagggagtatcggcgaagacacagaatatcctctttccggccagtggaagacatcaccgaagaagatctggaaaacgttgccatcaccgtgagggataaaatctatgataaggtcctgggcaacacgtgccaccagtgcaggcagaagaccatagatactaaaaccgtctgtcgcaaccagggctgctgtggcgtccggggccaattttgcgggccctgcctccgcaatcgctacggagaggatgtgagatcagctctgctggaccccgattgggtgtgcccgccttgtcgcggcatttgcaactgttcgtactgtagaaagcgtgacgggcgttgcgccactggcattctgatccatcttgcaaagttctatggctatgataacgtcaaggaatacctggagagcctacagaaggaactggttgaagataactag

SEQ ID NO: 182397 - DNA, 1227 bp, Artificial Sequence
  Description of Artificial Sequence: Synthetic coding sequence
atggagctggccacccggtaccagatccccaaggaggtggccgacatttttaacgcaccatctgatgacgaggaattcgtaggcttcagggatgacgtacctatggaaacattgagcagtgaggaatcctgtgactcttttgatagtttggagtctgggaagcaggttgttgaaagcgatttgagcgatgacggaaaggcgagtctggtgtccgaagaggaagaggacgaagaggaagataaagccactcctcgacggagccgttctagaagaagctctatcgggctacgggtggcatttcaattcccaactaaaaaattagctaacaagcccgacaaaaatagttcctcggagcaactcttcagtagcgctcgactccaaaacgaaaagaaaaccattctggagcggaagaaggactgcaggcaagttatccagagggaagattccacttctgaaagcgaggatgattctagggatgagtctcaagagagctctgacgcactgcttaagaggactatgaatatcaaagaaaataaggcaatgctggcccagctcttggccgaattaaacagtatgccggatttttttcctgtgaggacacccacatcagccagccggaagaaaacagtgaggagagcgttttccgagggacagatcactcggagaatgaacccaacccgaagcgcccgaccgcccgagaagtttgccctcgagaacttcaccgtctcagcagctaaatttgcagaggagttctactcgttccggagaagaaaaaccataggggggaagtgtcgggagtataggcggaggcatcggatttcatcgttcagacccgttgaggatattactgaggaagatctcgagaatgtggcaataactgttagggacaaaatctatgacaaggtgctgggcaacacttgccatcagtgccgtcaaaagacgattgacaccaaaaccgtctgcagaaaccagggctgttgcggagtgaggggccaattttgtggcccctgcctcaggaatcgctatggggaggacgtgcggagtgcacttctggaccccgattgggtttgccctccttgtaggggaatctgtaactgtagctactgtaggaaacgtgacggcagatgtgccactgggattctgatccatctggctaaattctacgggtacgataatgttaaggagtacctggaatccttacagaaggagctggtcgaggacaattag

SEQ ID NO: 182398 - DNA, 1365 bp, Artificial Sequence
  Description of Artificial Sequence: Synthetic coding sequence
atggagctggccacccggtaccagatccccaaggaggtggccgacatcttcaacgcaccaagcgacgatgaagaattcgtgggtttcagagacgatgtgccgatggaaacgctgagctctgaggaatcttgcgattcattcgattcccttgaatcaggtaagcagcaggatgttagattccactcaaaatatttcaccgaagaactgaggcgcatattcatagaagacactgactctgagactgaggatttcgcaggcttcacccagagcgacctgaacggtaaaaccaatcctgaagtcatggtggtggaaagcgacttgtccgatgatggaaaggccagtctcgtctccgaagaggaggaggatgaggaggaggacaaggcaacacccaggcgctcccgtagtcggcgttcctccattgggctcagagtggcatttcagttcccgacaaaaaagcttgcgaacaaacctgacaagaatagtagtagcgaacagctgttttcaagtgctagattgcagaatgagaagaagaccattctggagaggaaaaaggattgccgacaggtcattcagcgggaggattccactagcgagtctgaggatgactccagagatgagtcacaggaaagctcagatgccctgctgaaacgcacaatgaacatcaaggaaaataaggccatgctggcacagctgctagccgaactgaactccatgcctgatttctttcccgttaggacccccacctctgcttctcgaaaaaagacagtccgccgcgcgttttccgagggacagatcacacgccgcatgaatccaacgagaagcgcgaggccccctgaaaagttcgcccttgagaatttcactgtctccgctgcaaagtttgccgaggagttttactcttttcgccgcaggaagactattggaggtaagtgccgggagtatcgcagaagacaccggatatcttctttccgacctgtcgaggacatcacagaagaggacttggaaaatgtggctatcactgtccgcgataaaatatatgataaggtgttgggcaacacctgccatcagtgccgacagaagacaatcgacaccaagacagtgtgtcggaaccagggctgttgtggggttcgcgggcagttttgcggaccgtgcctgcgcaacagatacggggaggacgtgaggtccgcccttctggatcccgattgggtgtgccccccgtgtaggggcatctgtaattgcagctactgtagaaagcgggatggtcgatgcgctactggtatcctgatccatctggccaagttctacggttatgacaatgtaaaagaatatctggaaagcctgcagaaggagctcgtcgaagataattag

SEQ ID NO: 182399 - DNA, 291 bp, Artificial Sequence
  Description of Artificial Sequence: Synthetic coding sequence
atggagaccctgagcagcgaggagagctgcgacagcttcgacagcctggaatctggaaagcaacaggacgtgcgcttccatagcaagtatttcacagaggaattgaggagaatttttatcgaagatacagactctgaaacagaagattttgccggtttcacccagtccgacttgaacggaaagaccaaccccgaagtgatggtggtggagagcgacttaagcgatgacggcaaggcatcgctggtgagtgaggaagaagaggacgaagaagaggataaggccacgccatag

SEQ ID NO: 182400 - DNA, 843 bp, Artificial Sequence
  Description of Artificial Sequence: Synthetic coding sequence
atggccccccggaagggcagcagccgggtggccaagaccaacagcctcagacggaggaagctggcctcattcctaaaggactttgacagagaggtggaaatacgaatcaaacagattgagtcagacagacaaaatctcttaaaagaggtggataacctctataacattgagatcctacgcctgccaaaggccctccgggagatgaactggcttgactactttgctctcggtgggaataaacaggccttggaagaggccgcaactgctgatctcgacataactgagattaataagctgacggcagaagccatacagacaccgctcaagtccgctaagactcgcaaagtgattcaggtagacgagatgatcgtggaggaggaagaggaagaagagaacgaaagaaagaacctgcagaccgcccgggtgaaacgctgtcctccctccaagaagcgcactcagagcattcagggaaagggtaaagggaaaagatcctctcgtgccaacaccgtaacgcccgccgtgggcaggctcgaggtttccatggtaaaaccaactcctggcctcacacctagatttgatagcagggtgttcaaaactcccggcctccgcaccccagccgccggcgaacgcatttacaatatttctggaaacgggtcacctttggctgactcgaaagaaatcttcctaaccgtacccgtaggcggtggggaatctttaagactcctggcgagcgaccttcagcgccattcaattgcccagctcgaccccgaggccctcggtaatattaagaagctcagcaacaggcttgcccaaatctgttcatctatacgtacgcataagtag

SEQ ID NO: 182401 - DNA, 843 bp, Artificial Sequence
  Description of Artificial Sequence: Synthetic coding sequence
atggccccccggaagggcagcagccgggtggccaagaccaacagcctcaggcggcgcaagctagcctcctttctcaaggacttcgatcgcgaggtggagatcagaattaagcagatagaaagtgaccgccagaatctgctcaaggaggtggataacctgtacaacatagagattctcaggcttcccaaagccctccgagagatgaactggctggattacttcgccctgggtggcaacaagcaggccttagaggaggctgccacagccgacctggatatcacggaaattaacaaactaaccgcagaagcaatacagacaccactgaaatctgcgaaaacacggaaggttatccaggttgatgaaatgatcgttgaggaggaggaggaggaagagaacgagagaaaaaacctccaaactgcccgggtcaagcgatgcccgccatcaaaaaaaagaacgcagtcaatccaggggaaggggaaaggaaaacgcagctctcgggcaaacacagtgacccccgcggtcggaagactcgaagtgtcaatggttaagcccacgccggggctcacccccaggtttgacagcagggtcttcaagacaccaggattgcggactcccgcagccggcgagaggatatataatatctccggtaacggttcaccactcgcagactccaaggagatctttctgaccgtgcctgtgggaggcggagaaagtctgcgacttttagcctccgacttgcaaagacatagtatagcccaactagaccctgaggccctgggtaacatcaagaagctgtcgaaccgccttgcccagatctgctctagcatccggacccataagtag

SEQ ID NO: 182402 - DNA, 414 bp, Artificial Sequence
  Description of Artificial Sequence: Synthetic coding sequence
atgcccaacttcgccggcacctggaagatgcggagcagcgagaactttgacgagctacttaaagccctaggcgtgaacgctatgctccgaaaggtagccgtcgcggccgcatcaaaaccacacgtagaaataaggcaggatggcgatcagttctacattaaaacaagcactacagtgcggacaaccgagattaacttcaaagtaggcgaaggattcgaagaggagacagtggatgggcgcaagtgccgctctctggcaacttgggagaacgaaaacaagatccactgcacccaaaccctgcttgagggtgacggccccaaaacctactggacgagagaactggctaatgatgagttgattcttactttcggcgcagacgatgtggtttgtacgcgcatatacgttagagagtag

SEQ ID NO: 182403 - DNA, 249 bp, Artificial Sequence
  Description of Artificial Sequence: Synthetic coding sequence
atgcccaacttcagcggcaactggaagatcatccggagcgagaactttgaagagttgttgaaggttctgggcgtgaacgtaatgctgagaaaaattgcggtcgccgctgccagtaaaccagcagtggagatcaaacaagagggagatactttttacatcaaaacctcaacaaccgtgagaacaaccgaaataaattttaaggtcggtgaagaatttgaggaacagaccgtggacggcaggccctgctag

SEQ ID NO: 182404 - DNA, 417 bp, Artificial Sequence
  Description of Artificial Sequence: Synthetic coding sequence
atgcccaacttcagcggcaactggaagatcatccggagcgagaacttcgaggagctgctcaaagtgctgggtgtgaacgtgatgctcagaaaaatcgctgtggccgcggcctccaaacctgctgtggagattaaacaggagggtgacacattttacattaagacctcgacgacagtgagaactaccgagattaactttaaggtaggggaagagttcgaagaacagaccgtggatggacgaccatgtaaatccttagtgaaatgggaatctgaaaacaagatggtttgcgaacagaaattgttgaagggtgaaggccccaagacctcgtggacacgggagctgactaatgacggagagctgatcctgacaatgacggcagacgatgtggtttgcacccgggtttacgtgagagaatag

SEQ ID NO: 182405 - DNA, 417 bp, Artificial Sequence
  Description of Artificial Sequence: Synthetic coding sequence
atgcccaacttcagcggcaactggaagatcatccggagcgagaacttcgaagaacttctcaaggtcctcggcgttaatgtgatgctgaggaagatagctgtcgccgcagcctctaagccggcagtggaaatcaaacaagagggggacactttctatatcaaaacctcaacaactgtgcggactactgagatcaactttaaggttggcgaggagttcgaagagcagacggtcgatggacgtccctgtaagagtttggtgaaatgggagtcggaaaataaaatggtgtgtgaacagaagttgttgaaaggcgaaggtccgaagactagctggacacgagagctgaccaacgacggcgagctcattctgacaatgacagccgatgacgtggtgtgcaccagggtttacgtgcgcgaatag

SEQ ID NO: 182406 - DNA, 744 bp, Artificial Sequence
  Description of Artificial Sequence: Synthetic coding sequence
atgggcaccagcagcaccgacagccagcaggccggccaccggcggtgctccacatctaatacatctgctgagaacttgacatgcctttctctccccggaagtcccggcaaaaccgccccccttcccggcccagcccaggccggagcgggacagcctctcccaaaaggatgcgccgctgtcaaagccgaggtgggaataccagcacctcacacaagccaggaggtgcgcattcatattagaagactgctcagctgggcggcccccggagcttgcggccttcggtccacgccatgcgcactgccccaggccctcccacaagcacgtccttgtcctggtaggtggtttttcccgggctgctccctgcccaccggcggagctcagactatactctctctctggacctggagacattttctcaactgggcgctccagcagagagaggagaatagcggacgcgcgcgtagggttccgcctgtgcctcggaccgctcctgtgtccaaaggcgagggatctcacccgccacagaactccaatggcgagaaggtgaaaactataacacctgatgtaggattgcaccagtcactgacctctgaccctactgttgccgtgctgagagccaagcgagctccggaggcccatcctcccaggagctgcagtggatccttgacagccagggtttgccacatgggtgtgtgtcagggccaaggtgatacagaggacgggcggatgacactgatggggtag

SEQ ID NO: 182407 - DNA, 744 bp, Artificial Sequence
  Description of Artificial Sequence: Synthetic coding sequence
atgggcaccagcagcaccgacagccagcaggccggccaccggcggtgctcaaccagcaacacttcggctgagaatctcacctgcctgtcactcccgggctcgccgggcaagacagctcctctgccgggaccggcccaggctggtgctggacagccactcccaaagggttgtgctgccgttaaggcagaggtggggatccccgcccctcatacgagtcaggaagtcaggatacatattcggcgtctgcttagctgggccgctcctggtgcatgcggcttgcgctctacaccatgcgcgctgccccaggccttgcctcaggcacggccctgtccaggtcggtggttctttcccggatgtagcctaccaacaggcggagcgcagactatcttatcactgtggacttggcggcactttcttaactgggccctgcaacagagagaggagaacagcggcagggcgagacgggtgccgccggtacccagaacggccccagtcagtaagggcgagggcagccatcctccccaaaactccaacggagaaaaggtgaagacaattacccccgatgtgggactccaccagtctcttacctctgatcccactgttgcggttctgagggcaaaaagagctcctgaagcacacccgcctcgctcctgttccggctcactcacagcccgtgtgtgccacatgggcgtatgccaaggtcaaggagacaccgaggatgggagaatgaccctaatgggttag

SEQ ID NO: 182408 - DNA, 4218 bp, Artificial Sequence
  Description of Artificial Sequence: Synthetic coding sequence
atggccgcccggagcccccccagcccccaccccagcccccccgcccggcagcttggtccccgctccccacgggtggggcgtggcgcggaagtgcacgctatgcgttcagaggcttctggctttgcaggcgcagccagagaggtggttgctgacgaatcggataagatatgggtgggagaggaggggagtggtggcagacgtggccctggcggagccgcacccgctcatgcccccttacttagcgcccccatggggagccgccgcctggagggcattagtgtcgaggaagcgatggtgactcgcactcagcttctcgaagaggaactgagctcactcaaggaagaactagccctgtgtcaggctgacaaggagttcgtgtggagtctctggaagaggttgcaagtgactaacccagatcttacccaagtagtctctctagtcgtagagagagagaagcagaagtccgaagcaaaggaccggaaagtcttagaaatactgcaggttaaggatgccaagatccaggagtttgaacagagagaatccgttctgaagcaagagatcaatgatcttgtgaagcgaaaaatcgctgtcgacgaagagaatgcttttctccggaaggagttcagcgaccttgagaaaaagttcaaagataagtcacaagaaatcaaagacacaaaggaatgcgtccaaaacaaggaggagcagaaccggctggtcattaaaaatctggaagaggagaataaaaagctctcgacccgatgtactgatctgctcaatgatctggaaaagttgagaaagcaggaggcccacctgaggaaggagaagtacagtactgatgcaaagattaagacattcgaggataacctaattgaagctcggaaggaggtggaagtttctcagagcaagtataacgccctgtcattgcaactgtccaataaacagaccgaattgatccaaaaagatatggacattactctcgtaagacaagaactccaggagctacagaatttatataagcagaactcaacgcacactgctcagcaggctgagctaatccaacagctgcaggtgttgaacatggatactcagaaagtgctgagaaatcaggaggacgtccacacagccgaatctatctcctaccagaagctgtacaacgaactccatatctgtttcgagactacaaaaagtaatgaagccatgctgagacaatcagtgactaacctacaggaccagctactccagaaggagcaggagaatgcaaagttaaaagagaaactgcaggagagtcagggggctccactgccactgcctcaagagagcgaccccgattactctgctcaagtccctcacagaccttctctatcttcactggagacattgatggtgagtcagaagagcgagatagaatatcttcaggaaaagctcaagatcgcgaacgaaaaattgagcgaaaatataagtgccaataaaggtttttctagaaagtcgataatgacatctgcagagggcaagcacaaggagcctccagtaaagagaagtcgctcgctgagcccaaagagcagtttcacagatagtgaggagctccagaaattacgcaaggccgagcgtaagattgagaatctggagaaggccctgcagttgaaatctcaggaaaacgacgagctgcgcgatgctcatgagaaaaggaaggaacgcttacagatgctccagaccaactatcgtgctgtgaaggagcaactgaaacagtgggaggagggctccggtatgacagagatcaggaaaataaagcgggcagaccctcagcaacttagacaggaagatagtgacgcagtctggaatgagcttgcctatttcaaaagggagaaccaggagctcatgatccaaaagatgaatcttgaggaagaactagacgagctcaaggtgcacatctctattgataaggccgcaatccaggaactgaataggtgtgtggctgagcgtcgcgaagagcagctgtttagatctggcgaagacgatgaggtaaagaggtcaaccccggaaaaaaatggcaaagagatgcttgagcagacgctgcaaaaagtcactgagttagagaaccgcctaaagtccttcgagaaaaggtccaggaaactgaaggaaggtaacaaaaaactgatgaaggaaaacgattttcttaagagcctgcttaaacagcagcaggaggacaccgagacccgggagaaagagcttgagcagatcattaagggatccaaggatgtcgagaaggaaaacactgagcttcaggttaagatttccgaattggaaaccgaagtcacgagcttgaggcgtcaagtcgctgaagccaacgccctccggaacgaaaacgaggaactcatcaatccaatggagaaatctcaccaatctgctgacagagccaagtcagaaatggctactatgaaagtcagatctggacggtatgactgcaaaacaactatgaccaaggttaagttcaaggctgcgaaaaaaaactgttccgtcggccggcaccacacagtgctgaaccacagtattaaagtgatgagcaatgtctttgaaaacctctctaaagacggatgggaggacgtgagcgaaagctcctctgacagtgaggcccagacatcgcagaccctgggcacaattatcgttgagactagtcagaagatttccccgacggaggatggaaaggaccagaaagagtccgacccaactgaggattcacagacccagggcaaagaaatcgttcaaacatacctgaatattgatgggaaaactcccaaggactattttcatgacaaaaacgccaagaaaccaacttttcagaaaaaaaactgcaagatgcagaaaagtagccataccgctgtgcccacccgggtcaacagggagaaatacaaaaacattacagcccagaaatcaagcagtaacattattctgttacgagaaaggattatatctcttcaacaacagaattctgtgttgcagaatgctaagaagacagctgagttgtccgtgaaggagtataaggaggtgaacgaaaaactcttgcatcagcagcaggtgtccgaccagcgctttcagacatctaggcagactattaaaaaactgaatcttgacctggctggcctgcgtaaggagaaggaggacctgttaaaaaaattggaaagcagtagtgagataacctcgctggccgaagagaacagccaagtgacattcccaagaatacaggttactagccttagccctagccgaagtatggatttggagatgaaacaactgcagtataaattgaaaaacgccacaaatgaacttacgaagcagtcctctaacgtgaaaaccctcaagtttgaacttcttgcaaaagaggaacatattaaggagatgcatgagaagatctcacggatggagagggatatcaccatgaagagacatttgattgaagatctgaagtttcggcagaaagtgaacctggaaagcaacaaatcatttagcgagatgctgcaaaatctggacaagaaagtcaagacactgaccgaagagtgtagcaacaaaaaagttagtatcgattcccttaaacagagattgaacgttgccgtcaaagaaaaatcccaatacgaacagatgtaccaaaaatccaaagaggaactcgagaagaaagatctgaagctgactttgcttgtctccagaatttccgaaaccgaaagcgctatggcggagattgagaccgcagccagtaaacagcttcaggagctggcgcttcagtcggagcaagtcttagagggcgcacagaaaacgctgctcctcgccaacgaaaaggtggaagagttcaccacattcgtcaaggcactggctaaagaactgcaaaatgatgttcacgttgtgcggaggcagataagagagctaaagaagatgaaaaaaaaccgcgatgcatgcaagactagcacacataaagcacagacacttgccgcttccattctgaatataagtcgcagcgatctggaagagattctcgacaccgaggatcaggtggagattgaaaaaaccaagatcgacgctgaaaatgacaaggaatggatgctctatatccagaagttacttgagggacaatccctggccctaagtccaagattgaagtgcaacggtgctattgtcgcccaccagaaccttcggctgccggactcctctagcagcgccagtgcttcatag

SEQ ID NO: 182409 - DNA, 1176 bp, Artificial Sequence
  Description of Artificial Sequence: Synthetic coding sequence
atggccgcccggagcccccccagcccccaccccagcccccccgcccgccagctgggtcccagatctccacgagtgggaagaggagcggaggtgcatgctatgcgttctgaagcatctggatttgccggggcagccagggaggtggttgccgacgagtctgataagatctgggtgggcgaggagggctcaggtggccggcgagggcccgggggggctgcacccgcccatgcacctctccttagcgccccaatggggagcaggaggcttgaaggaatctccgtggaggaggccatggtaacccgcacccagttgctcgaggaggaactgtctagcctaaaggaagaactggcactgtgtcaggccgataaagagttcgtgtggagtctttggaaacgcctacaggtgacaaatcccgacttaacacaggtggtttcccttgtcgttgaacgggagaaacaaaagtctgaagcaaaagaccggaaggtgcttgagatccttcaggtcaaggatgctaagattcaggagtttgagcaacgggagtcggtgctgaagcaagagatcaacgatttggtgaagaggaagattgccgtcgatgaggagaatgctttcctcaggaaagaattcagtgatctcgaaaaaaaattcaaggataaatcacaggagatcaaggatacgaaggaatgcgtgcaaaacaaggaggagcagaacaggttggtgattaagaacttggaagaggaaaataaaaagctgtcaacaagatgtactgacctcttgaacgatctcgagaaactgcggaagcaggaggcgcaccttcgcaaggaaaagtactccacagacgcgaaaattaagacatttgaggataacctcatcgaagcccggaaggaagttgaagtcagtcagagcaagtacaacgccttgagtctgcagctcagcaacaagcagacggagctcatccagaaggacatggatatcactctggtgagaaaagagctccaggaactgcaaaatctgtacaaacagaactcaacccatacagctcagcaggcagagcttattcaacaactgcaggtgctgaacatggacactcaaaaggtgttgcgaaaccaggaggacgtccatactgccgaaagcatttcctaccagaaagtctgcttttattccgtgattaaaatgtag

SEQ ID NO: 182410 - DNA, 4221 bp, Artificial Sequence
  Description of Artificial Sequence: Synthetic coding sequence
atggccgcccggagcccccccagcccccaccccagcccccccgcccgccaactcggccctcgaagtccacgcgtcggccgcggcgctgaggtgcatgccatgcgttcagaggcctctggcttcgctggcgcagctcgggaagttgtggctgacgaatcggataaaatctgggtaggagaggagggatcaggagggcggcgaggacccggcggggccgcccccgcacatgcaccattactgtctgctccaatgggtagccgacgcctggaagggatcagtgtggaggaggccatggtaacgagaacacaactactggaagaggagctgtcaagcctgaaagaggagctggcattatgtcaggccgacaaggagtttgtatggtccctctggaaacgcctgcaggtgacgaatccagacctgactcaggttgtctccctggtcgtagagagagaaaaacagaaaagcgaagccaaggataggaaggtgcttgaaatcctgcaggttaaagatgccaagatacaggagtttgagcaacgggaaagcgtgttgaaacaggaaatcaacgacctggttaaacgcaagattgccgtggacgaagaaaacgctttcctgaggaaggagttttcggatctcgaaaaaaaattcaaggataagtcgcaggagattaaagacacgaaagagtgtgtgcagaacaaggaggaacagaatagattagtgatcaaaaatctggaggaggaaaacaaaaagttgagtaccagatgcacagatctattgaacgatctggagaagctaaggaagcaagaggcacacctaaggaaggaaaaatactcaaccgacgccaagataaaaactttcgaagacaacctgatcgaggcccgtaaggaggtggaggtttcacagtctaagtacaacgctctctccctgcagctctccaacaaacagactgaattgatccaaaaggacatggacatcactcttgtacgaaaggagctgcaggaactccagaatctttataaacagaattccactcacaccgcccagcaggcggagcttattcagcaattgcaggtgctgaacatggatactcagaaagtcctgcgcaaccaggaggacgtccacactgccgagtcgatctcttatcagaaactgtataacgagttacatatttgctttgagactactaagtcaaacgaggcaatgctgcggcagtcggtgacaaacttacaagaccagctcttacaaaaggagcaagagaacgccaaactgaaggagaaactccaagagtcgcagggagctcccctgcctctgcctcaggaatccgatcccgattacagcgcacaggttccacatcgaccatccctgtcttcccttgagacactgatggtgtctcagaagagtgagatcgagtacctgcaagagaaactgaagatagcaaacgagaaactgagcgagaatatctccgcaaataagggtttctcccggaaaagtattatgacttccgccgaggggaagcacaaggagccacctgtaaaaagatcgcgctctctgagcccgaagtcatcatttacagattccgaagaactccagaagcttcgcaaggctgagcgtaaaatagagaacctggaaaaagccctccaactaaagagccaagagaatgacgaattgagggatgctcatgaaaaaagaaaggaacgattgcagatgctccagaccaactatcgtgctgtgaaagagcaactcaagcaatgggaggaggggtcgggtatgacggagataaggaagattaaacgggccgatccccaacagttgcgacaggaagactcagatgccgtttggaacgagctcgcctattttaaaagggaaaaccaagaactgatgattcagaagatgaacctggaggaagagttggacgagctgaaggtgcacatttcaattgacaaggctgccattcaggagctgaatcggtgcgtagccgaaagacgagaagagcagttgttccgcagtggggaggatgatgaggtgaagagaagcacaccagagaaaaatgggaaggaaatgcttgaacagaccttacagaaagtcaccgaacttgagaatcgcttaaagagtttcgagaagagatcacggaagctgaaggaaggtaacaaaaagttgatgaaggaaaacgacttcctgaagagtctcctcaagcagcaacaggaggacaccgaaacgcgcgaaaaggaattagagcagattattaaaggatccaaagatgttgagaaggagaataccgaattacaggtcaagatttcggagctggaaactgaggtgacgtctctaaggcgtcaggtggccgaagcaaacgctcttcgcaatgaaaacgaggaactcattaatcctatggagaagtcccaccaatcagcggatcgcgcaaagtccgagatggccacaatgaaagtgagatctggaaggtatgactgcaagacaactatgaccaaggtgaagtttaaagcggcaaagaagaactgctcagtgggacgccaccacactgttctgaatcatagcatcaaggtgatgtccaatgtctttgagaacctgagcaaggatggttgggaagacgtttctgagagtagcagcgatagtgaagcacagactagccagacccttggtacaataatcgttgaaacatcccaaaaaatcagcccgaccgaggatgggaaagatcagaaggagtcagatccaacagaagactcacagacccaaggcaaggaaattgttcagacctatctgaacatcgacggtaaaacacccaaggactacttccacgataaaaacgcgaaaaagccgaccttccaaaagaaaaattgtaaaatgcaaaagagcagtcacacagcggtgcccactagggtgaatcgcgagaagtataaaaatattaccgcccaaaagtcatcttctaatatcatccttctccgggaacgtatcatctcgctgcagcaacagaacagcgttctgcagaacgccaagaaaacagctgagctctctgtcaaggagtataaggaagtgaacgagaaattattgcatcagcagcaggtgagcgaccagcgctttcagacctcgcggcagaccatcaagaaactgaacttggacctggccggactgagaaaagagaaggaggacctactgaagaagttagaatcctcaagtgaaatcacatctttggctgaagagaatagccaagtgacctttcctcgcatacaggttacatctctgtctccgagcaggtctatggacttggaaatgaagcagctgcagtacaaacttaagaatgccaccaacgaattaacaaaacagtcatccaacgtcaaaactttaaagttcgagcttctcgcaaaagaggagcatattaaagagatgcacgagaagatttctcgcatggagagggatatcacaatgaaaagacacctgattgaggatctcaaattccgtcaaaaagtgaatttagagagcaacaagtcctttagcgagatgctccagaacctggacaaaaaagtaaagactctaaccgaggagtgttcaaataaaaaagtctcgattgattccctcaagcagaggctgaatgtggcggtgaaggagaagtcccagtatgaacagatgtaccagaagtctaaggaggagcttgaaaagaaagatctgaagctcaccctactcgtgagccgcatttccgaaacagagtcggcgatggcagaaatagagactgccgcttccaagcagctgcaagagctggcattacagagcgagcaggttcttgagggtgcgcagaagactctgctgctcgccaacgaaaaagtggaagagttcacaacctttgttaaagccctggccaaggagctccagaacgacgtccacgtggtaagacgccagatacgtgaattgaaaaagatgaagaagaaccgagatgcctgtaagacctctacacacaaagctcagacactggctgctagcattctgaatatctcccggagtgacctggaggagattctggataccgaggaccaagtagagatcgagaaaactaagatcgatgctgagaacgacaaggagtggatgctttatatccaaaaattgctggaaggtcaattgcctttcgcctcatatttgttggaggctgtgctggagaaaattaatgaaaaaaaaaagctcgtagaagggtatttcacgattatgaaggacatccggtag

SEQ ID NO: 182411 - DNA, 4221 bp, Artificial Sequence
  Description of Artificial Sequence: Synthetic coding sequence
atggccgcccggagcccccccagcccccaccccagcccccccgcccggcagctaggacctagatctccgcgagtgggacgtggtgccgaggtgcacgccatgaggtccgaggcatcaggattcgccggagccgcccgtgaggtggttgcagacgagtccgacaaaatctgggtgggcgaggaagggtcaggaggccggagggggcccggaggggccgcccccgctcacgcccctctgctatctgccccaatgggctcccgaaggcttgagggcatctctgtggaggaggccatggtcacaagaacgcagctgcttgaggaagaactcagtagcctgaaggaggaactggccttatgccaagccgacaaggagtttgtttggtctttatggaaaaggctgcaggtcaccaatccagacctgactcaggtggttagcctggttgttgagcgggaaaaacaaaagtcggaggctaaggataggaaggtactcgaaattctgcaagtaaaggatgctaagatccaggagtttgaacagcgtgaatcggtcctcaaacaggaaattaacgaccttgtgaagcgcaagatagccgtcgacgaagaaaacgctttccttcgtaaagagttcagcgatctagagaaaaagttcaaggataagagccaggagataaaggacacaaaagagtgcgtgcagaacaaggaagaacagaacagactggtgatcaaaaacctggaagaggagaataagaagctcagcactaggtgcactgatttgctcaatgacctagagaaactgagaaagcaagaggctcacctcagaaaagaaaagtactccacagacgccaagatcaagacctttgaggataatttaattgaggctagaaaggaggtggaggtcagccagtctaagtataatgcattgtccttgcaactgagcaacaagcagacagagctcatccagaaagatatggatattaccttagttagacaggagctgcaggagctgcagaatctgtataaacagaattcaacacacaccgcgcagcaggccgaattaattcagcagctccaggttctcaatatggacacacagaaggttttgcggaatcaggaagacgttcatacggcggaatcaatctcataccagaagttatacaatgaactacatatctgcttcgaaaccactaagtcaaacgaggccatgctaaggcagtcagtgaccaatctccaagaccagctgttgcaaaaagaacaggagaacgcgaaactgaaggagaagctgcaagaatcacagggggcccctctgcctcttcctcaggaatccgaccccgattactccgcacaggtgcctcaccgtccctccctgagcagcctggaaactttgatggtgtcgcagaaatctgagatcgaatacctgcaggagaaactgaagattgcaaacgagaaattgagtgagaacatcagtgctaacaaagggttctcccgcaaatcaataatgacttccgccgaaggaaaacacaaggagcctcccgtaaagcggtctcgcagcctgtcacccaagtccagttttaccgattcagaagaactacagaagttgcgtaaggcggagagaaagatagaaaaccttgagaaagctctgcagctcaaatcacaggagaacgacgagctgcgggacgctcacgaaaaaaggaaggagaggctgcagatgttacaaactaactatagagccgttaaagaacagctcaagcagtgggaagaaggctcagggatgacagagataagaaagatcaagcgcgccgacccgcagcaactgcggcaagaagactctgatgcagtgtggaacgagctcgcatattttaaaagggaaaaccaggagctcatgattcagaagatgaacctcgaagaagaactcgatgagctgaaggtgcacatcagcatcgataaagccgccattcaggagttgaaccggtgtgtagctgagaggcgggaggaacagttgtttagaagcggagaggatgatgaggtgaaaaggagtacgcccgagaaaaatggaaaagagatgcttgagcagacgctgcagaaagtaaccgaactagagaatcgcttaaaaagctttgaaaagagatctcggaagctcaaggagggaaataaaaaactgatgaaagaaaatgattttctcaagtcccttctgaagcagcagcaagaagacaccgaaacccgagagaaagagttggagcagatcattaagggcagcaaggatgtggagaaggagaacaccgaactccaggtgaagattagtgaacttgaaacggaggtaacgtcacttcggcgacaggtagctgaggctaacgcactgaggaacgaaaacgaggagctgatcaacccaatggagaaatctcatcagtccgctgatcgggcaaagtcggaaatggctaccatgaaagtacgaagtggcagatacgattgtaagacaacgatgacaaaagtgaagttcaaggcagccaagaagaattgttctgtgggtcgacaccataccgttctaaatcacagtatcaaagtgatgtcgaatgtgtttgagaatctctctaaggatggttgggaggatgtgtcagaatcatcgtccgattctgaagcacaaacctcccagactttaggcactataatcgtcgagacctcacaaaaaatctcgcctactgaggatggaaaggaccaaaaggaatcggatcccacagaggattcacagacgcaggggaaagagatagtgcaaacttatctgaatattgacggcaaaacacctaaggactatttccacgacaaaaacgctaagaagcccaccttccagaaaaagaactgcaagatgcaaaagtcctctcacacagccgtgcccacgcgggtgaacagggagaagtacaagaatatcacggcccagaagtcctcctccaacattatcctactgagagagcggatcatttctcttcagcagcagaacagcgtgctgcagaacgccaagaaaaccgccgaactgtctgtgaaggagtataaggaggtgaatgagaaactactccaccagcaacaggtgtctgaccaaaggttccagactagcagacagactataaagaaattaaatctggatctagcaggactgcggaaagaaaaggaggacttacttaaaaaactggaatcgagttcagagatcaccagcctcgctgaagaaaactctcaagtcacatttcctagaatccaggtgacatctctgagtccgtcacggtccatggacctggaaatgaaacaattgcaatacaagctgaaaaacgccacgaacgagctaactaagcaaagctccaacgttaagactctgaaatttgagctgctggcaaaagaggagcatataaaggagatgcatgagaaaatctctcggatggaacgtgatatcacgatgaagcggcacctaattgaagatcttaaatttcgccagaaggtgaatctagagagtaataagtctttctctgaaatgctccagaacctcgataagaaggtgaagactttaaccgaagaatgtagcaataaaaaggtttcaattgactctctaaagcaaagattgaacgttgcagtcaaggaaaagtcacagtacgagcagatgtaccagaagagcaaggaggagctggagaaaaaggatctgaaactgacattactggtgtctcgcatctcagaaaccgaaagcgcgatggctgagatagaaacagcggcctctaaacagctgcaggaactggccctgcagtcagagcaagtcctggaaggcgctcagaaaactcttttactggccaatgagaaagttgaagaattcactacattcgtgaaagctcttgctaaggagctgcagaatgatgtacacgtagtgcgcagacaaattcgcgagctgaagaagatgaaaaaaaaccgggatgcctgcaaaacctctacacataaggcacagactctcgctgcgtccatccttaatataagcagaagcgatctggaagaaattctggacaccgaggaccaagtcgagattgagaagactaaaattgatgccgagaacgacaaggaatggatgctgtatattcagaagctgctagaaggacagctgcctttcgcaagctacctccttgaggccgtcctggagaagattaatgagaagaaaaaacttgtggaagggtacttcaccatcatgaaggacatccgatag

SEQ ID NO: 182412 - DNA, 519 bp, Artificial Sequence
  Description of Artificial Sequence: Synthetic coding sequence
atggccagcggcttcaagaagcccagcgccgccagcaccggccagaaaagaaaggtggccccaaaacccgaactcaccgaggatcagaaacaggaggtgagagaggctttcgacctctttgatgtggatggctccggtacaattgatgcaaaggaactcaaggtggctatgagggctctgggttttgaacctcgcaaggaggaaatgaagaagatgattagcgaggtcgaccgagaaggcaccggaaaaatctcttttaacgactttctggcagtgatgacccagaaaatgtcagaaaaggatactaaggaggaaatcctaaaggctttccgtctgttcgatgacgatgaaactggcaaaataagcttcaagaacctgaaaagagtggcgaatgagttgggcgagaacctgaccgacgaagaactgcaggagatgattgacgaagcagaccgggacggagacggcgaagttaatgaagaagagttcctgcgcatcatgaagaaaacctccctttattag

SEQ ID NO: 182413 - DNA, 519 bp, Artificial Sequence
  Description of Artificial Sequence: Synthetic coding sequence
atggccagcaacttcaagaaggccaacatggccagcagcagccagcgcaagagaatgtcacctaagcccgaactgactgaagagcaaaagcaggaaattcgagaggctttcgatctgtttgacgcagacgggactggtaccattgacgtcaaagagctcaaggtggctatgcgagccctgggctttgaacctaaaaaggaagagattaagaagatgataagtgagatagataaggagggcacaggcaagatgaattttggagattttctgaccgtgatgacacagaagatgtctgagaaggacactaaagaagagatccttaaggcttttaaactgttcgatgatgatgagaccggtaaaatctcctttaaaaacctgaagcgtgttgcaaaggagctgggtgagaacctaacagacgaagagctacaggaaatgatagacgaggccgaccgcgatggagatggagaagtgtcagaacaggagtttttgcgaataatgaaaaaaacttcactgtactag

SEQ ID NO: 182414 - DNA, 378 bp, Artificial Sequence
  Description of Artificial Sequence: Synthetic coding sequence
atggccatgcaggccgccaagcgggccaacatccggctgccccccgaagtcaatcggatcctgtatatcagaaacctgccctacaagataacagccgaggagatgtacgacatctttgggaaatacggccctatcagacagatccgggttggtaacacacccgagacacgggggaccgcctatgtcgtttacgaagatatcttcgacgccaaaaacgcttgcgatcatctgagcggtttcaatgtgtgcaatcgctatctggtggtcctctattataatgcgaacagagcgttccagaagatggacacgaagaaaaaagaggagcagctgaagctgctgaaagaaaaatatggcatcaacaccgaccctcccaagtag

SEQ ID NO: 182415 - DNA, 423 bp, Artificial Sequence
  Description of Artificial Sequence: Synthetic coding sequence
atgggcccccggcggcggagccggaagcccgaggccccccggcggcgcagccctagtcctacccctacccccgggcctagccggcgtgggccatctctgggcgcaagcagtcaccagcacagtcgaaggagacaggggtggctgaaggaaatccgcaagctccagaaatccacccacttactgataagaaagctccctttttcaaggctggcaagagagatctgcgtaaaattcacccgcggtgtggacttcaattggcaggcacaagcccttttagccctgcaagaagccgctgaagccttcttggttcacctgtttgaggatgcttatctcttgactttgcatgctggtcgcgtgacactgtttccaaaggacgtgcagctagccagacggattagaggcctcgaagagggcctggggtag

SEQ ID NO: 182416 - DNA, 1800 bp, Artificial Sequence
  Description of Artificial Sequence: Synthetic coding sequence
atgggccccaagcggcggcagctgaccttccgggagaagagccggattattcaggaagtggaagaaaacccagatcttcggaaaggtgaaattgccaggcggttcaacatccctccgagtactctgagtaccattctgaaaaataagcgcgctattcttgccagtgaacgaaagtacggggtggcctctacatgtaggaaaacaaataaactgtccccgtacgacaaacttgaaggcctgctgattgcctggtttcagcagataagggctgccggtttaccagttaaagggatcattctgaaagagaaggctctgcggatcgctgaggagttggggatggacgattttaccgcctcaaatgggtggctagaccgctttcgaaggagacacggcgtagtgtcatgttctggcgtagcgcgtgctcgggcacgaaatgcggcgcctagaactccagctgcaccggctagtccagctgccgtgccaagtgaggggtcagggggctcaacaacggggtggagggcacgagaggagcagcctcctagtgttgcagagggatatgcatcccaggacgtcttctccgcgacggaaaccagtttatggtatgatttcttaccagatcaggccgccggtttgtgtggcggggatggaaggccgagacaggccactcagcgtctctctgtactactatgtgccaatgcggacggaagcgagaagctgccccctctggttgcagggaaaagtgcgaaaccaagagccggacaggcaggactcccctgcgactatactgcgaactccaaaggaggggtcacgacgcaagccctcgctaagtacctgaaagcactcgacactaggatggctgcagaatctagaagggtgcttctactagctggacgactggccgctcagtcactggacacaagtggcttgcgacatgtgcaattggcgttcttcccgcctgggaccgttcaccctctggagaggggcgtggtccagcaggtgaaaggccactaccggcaggcaatgctgctgaaagcaatggccgccctagaaggacaggatccctcaggactccagcttggcctgacagaggcattacattttgtggccgccgcatggcaggccgttgagccaagcgacatagccgcctgtttcagagaagcaggctttggcggtggccctaacgccactataaccaccagcctgaaatccgaaggggaagaagaagaggaggaggaggaggaagaggaggaggaggagggcgaaggagaggaagaggaagaggaaggggaagaagaggaggaagagggcggcgagggggaggagcttggagaagaggaggaggtggaggaagaaggcgatgtcgacagcgatgaagaggaggaggaggacgaagagagctcttccgaaggcctggaggctgaagattgggctcagggagttgtagaagcaggagggagctttggagcgtatggcgcgcaagaggaagcccaatgtcccacactccacttcctggaaggcggggaggactctgactctgatagtgaggaagaggatgatgaagaagaagatgatgaagacgaagatgatgatgatgacgaagaggacggagatgaggtgcccgttcctagcttcggcgaggccatggcttatttcgccatggtgaaaagatacctgacctcattccccatagacgatcgcgtacagtctcacattctccaccttgaacacgacctggtgcacgtaacgcgaaaaaaccatgcacggcaagccggagttcgtgggctaggccaccagtcctag

SEQ ID NO: 182417 - DNA, 417 bp, Artificial Sequence
  Description of Artificial Sequence: Synthetic coding sequence
gaggacgaggagagcagcagcgagggcctggaggccgaggactgggcccagggggtggtggaggctggcggaagtttcggagcatatggagcccaggaggaggctcaatgtcccactttacacttcctggagggtggtgaagacagcgattccgactctgaggaggaggatgacgaagaggaagatgacgaagatgaagacgacgacgatgacgaggaagacggcgacgaagtgccagtgccgtcttttggagaagccatggcttactttgcaatggtcaagcgctatctgacgagttttcctatagacgaccgcgtgcaaagccatatcctgcatctcgagcacgacttagttcacgttacaaggaagaatcacgcccggcaagccggggtcagaggcttgggccatcagtcctag

SEQ ID NO: 182418 - DNA, 2832 bp, Artificial Sequence
  Description of Artificial Sequence: Synthetic coding sequence
atggccgccagcggcctggaccacctgaagaacggctaccggcggcggttctgtaggccatcgagggcacgtgatatcaacaccgagcagggtcagaatgttctcgagattctccaagactgctttgaggaaaaatccctcgccaacgatttcagtacgaattcaactaaatccgtgccgaattccaccagaaagataaaggacacatgcatccagagcccgtcaaaggaatgtcagaaatcccaccccaagtctgtgccagtctcaagtaagaagaaggaagcgagccttcaattcgtagtcgagccaagcgaggctaccaatcggagcgttcaggcgcatgaagtgcaccagaagatcctcgccacagatgtctcctctaaaaatacaccagacagtaaaaagatttcaagtcgaaatatcaacgaccatcacagcgaggctgatgaggaattttacctgagcgtgggctctccttcagttttgctagatgctaaaacatccgtttctcagaacgtcatcccatcctctgcccagaagcgcgagacttacactttcgagaacagcgtgaatatgttgccttcctctaccgaggtgtcagtgaaaacaaagaaacgactgaactttgacgacaaggtgatgctgaaaaaaatcgagattgataacaaggtgtcagatgaggaggataaaacctccgaggggcaggagcgcaagccaagcggatcatcccagaatcggattagagactctgaatacgagattcaaaggcaagccaagaagtcatttagcacgctctttctggaaacagtaaaaaggaagtcggagtcttctcccatcgtgagacacgccgcaacggcccccccacacagttgcccgcccgacgacaccaagcttatagaggatgagtttattatagacgaatcagatcaatctttcgcatctcgttcgtggattaccatccctagaaaggccggcagccttaagcagaggacgattagtcctgccgagagcactgcactgctgcagggacgtaagtcacgcgagaaacatcataatatcctgcccaaaactctagctaacgataagcatagccataagcctcaccctgttgagacctcccagccctcggataagacggtgctagatacctcctacgcactaataggagagacagtaaataactatcgatccaccaaatatgagatgtacagtaagaacgccgagaaaccttcccgctctaagcgcactatcaaacagaagcaacgacgtaagttcatggctaaaccagctgaggaacaactggacgtggggcagtctaaagacgagaacattcacacctcccatatcacccaggatgagtttcagcggaactcagaccgcaatatggaggaacacgaagaaatggggaatgactgtgtgtcgaagaagcagatgcctcctgtgggctctaagaagagctctactcggaaagacaaagaagagtcaaaaaagaaaaggttttcaagtgaaagcaagaataagctggttcccgaggaggtgacctctactgtcacaaagtctcgcagaatttctaggagaccatctgactggtgggtggtcaagagtgaagagtctcctgtctactctaactcctcagtgcggaacgagcttcccatgcaccacaattcttcccggaaaagtactaaaaaaaccaaccaatcatccaaaaatatacgaaagaagaccatacccctgaaacgccaaaagaccgctacaaaggggaaccagagggttcagaaattcttgaacgccgagggcagcggggggatcgtcggccatgatgaaattagtcgttgttccctaagcgagccattagaatccgacgaggccgatctcgccaaaaaaaaaaacttagactgttctagatctacccgctcgagcaaaaatgaggataatatcatgaccgcgcagaatgtgcctctcaagccccagaccagcggatacacgtgcaatatcccaaccgagtccaatttagattctggagagcacaaaacgtctgtcctcgaggagagcggcccaagtagacttaacaataactatttgatgtccggtaaaaatgatgtagacgatgaggaagtccatggctcatcggacgacagcaagcagagtaaagtcatcccaaaaaatcgtatccatcacaagttggtgctgccttcaaatactccgaatgtacgccgcaccaagcgtacccgcttgaagccacttgaatactggaggggtgagcggatcgattaccaggggaggccatctggaggatttgtcattagcggtgtcctgtccccggacacaatcagttctaagagaaaggctaaagaaaacataggcaaggtgaacaagaagagcaataaaaagcgtatatgtctggacaacgacgaacgaaagaccaacctgatggtaaatctgggtattcctcttggagacccactgcagccaacaagagtcaaggacccggaaacaagggagatcattttgatggatctggtcagaccccaggatacttatcagtttttcgtgaagcatggcgagctgaaagtatataaaactctggacacaccctttttttcaacgggtaaattgattttaggacctcaggaagaaaaaggcaagcagcacgtaggacaggacatcttggtcttttacgtcaatttcggcgatctgctttgcacactccatgagaccccatatatcttgtccaccggagatagcttttatgtgccaagtgggaactactacaatatcaagaacctcaggaatgaggaatccgtactcctcttcactcagataaagcgctag

SEQ ID NO: 182419 - DNA, 8106 bp, Artificial Sequence
  Description of Artificial Sequence: Synthetic coding sequence
atggccgaggagggcgccgtggccgtgtgcgtgcgggtgcggcccttaaatagccgagaggagtccctgggagagacggctcaagtgtattggaagacggataacaatgtgatctatcaggtagatggtagcaaaagttttaatttcgatagggtcttccacgggaatgagacaacgaaaaacgtttacgaagagattgccgctccaatcatcgatagcgcaattcagggatataatggcacaatatttgcctatggccagaccgcttctggtaaaacttatacgatgatgggatctgaagatcatctgggcgtcatccctcgcgccatccatgatatcttccagaaaattaagaagtttccggacagggagttcctcctacgagtctcttatatggagatttacaacgagaccattaccgacttactctgtggaactcaaaaaatgaaaccgctgattatcagagaggacgtgaaccgcaacgtgtacgtggccgacctgactgaagaagtggtgtatacaagtgaaatggctctaaagtggatcacaaagggggaaaaaagccggcactacggcgagacaaagatgaaccagcgctcttctaggtcccatactattttccgaatgattctcgagtctagagagaagggtgaaccctctaattgcgaggggtcagtgaaagtgagccatcttaatttggtggatctggccggcagcgagagagcggcacagaccggagctgctggggtacggctaaaagaaggctgcaatatcaaccgttccctgttcatcctgggccaggtgataaaaaagcttagcgatggacaggtgggaggtttcattaactatcgtgatagcaagctgactcgcattctacagaatagcttgggagggaacgccaagactcgcatcatttgtacaataacacccgtaagcttcgacgaaacactgacggccttgcaatttgcttccaccgctaagtatatgaaaaatacgccctacgtgaatgaggtctccacagacgaggcactgttgaaaaggtatcgaaaggagatcatggacctgaagaagcagctcgaggaagtctcgctggaaacacgcgcgcaggcgatggagaaggaccagttggctcagctgctggaggagaaagatctgcttcaaaaagtccagaacgaaaagatagagaatttgacccggatgctcgttacatcaagcagcctaaccttgcagcaggaactcaaggctaagaggaaaagaagagtcacttggtgtcttgggaaaatcaataaaatgaagaatagtaactatgctgatcaatttaacatccccacaaatatcaccacaaaaacacacaaactttccattaatctgttgcgggaaatcgacgaaagcgtgtgtagcgagagcgacgtcttcagcaacaccctggacacgctctccgaaatcgagtggaacccagccaccaagttgctaaaccaggaaaacattgaaagcgaactaaactctcttagggcagactatgacaacctcgtgttagattatgaacagctccgtactgagaaagaagagatggagctgaagctcaaggaaaagaatgacctcgatgaatttgaggcattagagcgcaagactaagaaagaccaggagatgcagctcattcacgagatctccaacttaaagaatctggtgaagcacgccgaggtgtacaatcaggacttagaaaacgaactctcatccaaggtcgaattgctgcgagaaaaggaggatcagataaagaaactgcaggagtacattgactcccagaagctggaaaatatcaagatggacttatcttactcattagaaagcatcgaggacccgaagcagatgaaacagactctctttgatgctgagaccgtagcgctcgatgcaaagcgcgaatccgccttcctgagaagtgagaacctggaactgaaagagaagatgaaagagctggccacaacttacaaacagatggagaatgacatacaattgtaccaatctcagcttgaagctaaaaagaaaatgcaggtggaccttgaaaaggaactgcagagcgctttcaatgaaatcaccaagctgactagcctcatcgacggtaaagttcctaaggatctcctttgcaatctggagcttgagggaaagatcacagatttgcagaaggaactaaacaaggaggtggaggagaacgaagctctgagagaggaggtcatattactcagcgaactcaagtcactcccctcagaagtcgagcgcctgcgcaaagaaatccaggacaagtctgaggaactgcacattatcacttccgagaaagataagttattctccgaggttgtccacaaggaaagcagggtgcaaggactgctcgaggagattggcaagactaaagacgacctggctacgactcaaagtaactataagagtacagatcaggaatttcagaattttaagacattgcatatggatttcgagcagaagtataaaatggtgttggaggaaaacgaacgaatgaaccaagagatcgttaatctgtcgaaggaagcccagaagtttgacagtagcctgggagccctgaagaccgagctgagttacaaaacacaggagctgcaagaaaagacacgggaagtgcaggagagactgaacgagatggagcagctcaaagagcaactcgaaaaccgcgattctacactgcagactgttgagcgcgagaagacgctcatcaccgaaaaactccagcagacgcttgaagaagttaaaaccctcacccaagagaaggatgacctgaagcagctccaggagtctcttcagattgagcgcgatcagctcaagtcagacattcacgatactgtcaacatgaacatagatacacaagagcagctacgcaacgcactagaatcactcaaacagcatcaagagacaattaacacgctgaaatccaagatctccgaagaggttagccgcaatcttcacatggaagaaaatactggtgagacaaaggatgagttccagcagaagatggtgggcatcgacaagaaacaagacctcgaagctaagaacactcagacattaactgcagatgttaaggacaatgagatcattgagcagcagaggaagattttttccctcatccaggaaaaaaatgaactgcagcagatgctagaaagcgttatagcagaaaaagagcagttaaagactgatctgaaggagaatatagagatgaccattgagaaccaggaggagttacggctcctgggagatgaactgaagaagcagcaggagattgtggctcaggaaaaaaaccatgcaattaaaaaagagggcgagttgtcaaggacctgtgacagactggcagaagtcgaggagaaactgaaagagaagtctcagcagctgcaggagaaacagcaacaactactcaacgtacaggaggaaatgagcgagatgcaaaaaaaaataaacgaaatcgaaaaccttaaaaatgaacttaagaataaagagctgacgttggagcatatggagacagaacggctggagttggcccagaagctaaacgagaattacgaggaagtcaagtcgatcacgaaggagcggaaagtgctcaaggagctacagaaatccttcgagactgagagagatcacctgaggggatacatccgcgagattgaagcaaccggcctgcagaccaaggaggagctcaagatcgcccacattcatctcaaggagcatcaagagacgattgacgaacttcgcaggtctgtgtctgaaaagaccgcgcagatcatcaacacacaggatctggagaaatcgcacacaaaattgcaagaagaaatcccagttctgcatgaggagcaggagctgctgccaaatgtaaaggaagtcagcgaaacccaggaaaccatgaatgagcttgaactactcaccgaacaaagtactaccaaggacagcacaactctagcaaggatcgagatggagcgcctgcggctcaacgaaaagtttcaggagtcccaggaagagattaagagtctaacaaaagaacgggacaatttgaagacaataaaagaagccctcgaggtgaaacacgatcagctgaaggaacacattcgcgagaccttagcaaagatccaggaaagtcagtcaaagcaggagcagtctcttaatatgaaggagaaagacaatgaaacaacaaagattgtgtcggaaatggagcagtttaaacccaaggattccgctctgttgcggatcgagattgagatgctgggcttatccaagcgcctccaggagtctcacgatgagatgaagtccgtggccaaagagaaagacgacctccaaagactgcaagaggtcctgcagtctgaatctgaccaactgaaggagaatataaaagaaatcgtggctaagcatctcgaaacagaggaagaactcaaggttgcccactgctgcctaaaggagcaggaagagaccattaatgagctaagggtgaatttatcagagaaagagaccgaaatttccactatccagaaacagctggaggccatcaatgataagctgcagaataaaatccaagagatatatgagaaggaggagcagttcaacattaagcaaatcagcgaagtgcaggagaaagtgaacgaactgaagcaattcaaggaacacagaaaggccaaggacagcgcattgcagtctatagaaagcaagatgctagaactgactaaccggctgcaagaaagccaggaggagattcagatcatgatcaaagagaaagaagaaatgaagcgagtgcaggaggccctgcagattgagcgtgaccagctgaaggaaaatacgaaggaaattgtcgcaaaaatgaaggagtcacaggagaaagagtaccagttcctgaaaatgactgctgttaacgagacccaggaaaagatgtgtgagattgagcacttgaaagagcagttcgaaacccagaaactaaacctggagaacatcgaaacagagaatattcggctgacccagatattgcatgagaacctcgaggaaatgcgctccgttactaaagagagagacgatttgcgctcagtagaggaaaccctgaaagtggaaagggatcagttgaaggagaatcttagggagacaatcacccgcgatctcgaaaagcaggaggagctgaaaatcgtgcatatgcacttgaaagaacatcaggaaacaattgataagttacggggcatcgtaagcgagaagacaaatgaaatttctaacatgcagaaagacctggagcatagcaatgatgctctgaaagctcaggatctgaaaatccaagaagaactcaggatcgctcacatgcacttaaaagaacagcaagaaaccattgacaagctgcgtggcattgtgtccgaaaagacagacaaactaagtaatatgcagaaggacttggaaaactccaacgccaagctccaagagaaaatccaagagctgaaggccaatgaacaccaactgataactctgaagaaggatgtcaatgaaacccagaaaaaagtatctgaaatggagcagctcaagaagcagattaaagaccaaagtttaaccctgtccaagttggaaatcgagaacttgaacctcgcccagaaacttcatgagaatctcgaggaaatgaaaagcgtgatgaaagagcgggataaccttcgcagggttgaggagacattgaagcttgaacgcgatcagctcaaagagtctctgcaagaaaccaaggctagggatctggaaatccaacaagaattgaagaccgctcggatgctgagtaaggagcataaagaaaccgttgacaagctgcgagaaaaaatttcggaaaaaacaatccaaatctccgatattcaaaaggacttggataaatcaaaagatgagttgcagaagaagattcaggaactgcagaaaaaggagctgcagttgctcagagtgaaggaggacgttaacatgtcccacaaaaagatcaacgaaatggaacagctcaagaaacagtttgaggcacagaatctcagcatgcaatctgtgcgcatggacaactttcagctcactaagaagctgcacgaatcactggaggagatccgaatcgttgcaaaagagagagatgaactgcgcagaataaaagagagtctgaaaatggagagggaccaattcatcgcaaccctgcgcgagatgatcgctcgcgatcgccaaaaccaccaagtgaagcctgagaagagactgctctccgacggacagcagcacctgactgagtcattacgagagaagtgcagtcgcataaaagagctgctgaaacgatactctgaaatggacgatcactacgagtgcctaaataggttgagcctagaccttgaaaaagaaattgaattccagaaagagctgagcatgagggtgaaggctaacctgagcttaccataccttcagactaaacacatagaaaagttgtttacagccaatcagcgctgtagtatggaattccacagaatcatgaaaaaactcaagtacgtgctgtcctacgtaaccaaaatcaaggaagagcagcatgagagcattaataaatttgaaatggattttatcgatgaggtggagaaacagaaggaactattaatcaagatccagcatctccagcaggactgcgacgtcccttcacgggaacttcgggacctcaaattgaatcagaatatggacctgcacatcgaagagatattaaaggacttctccgagtctgaatttccaagcattaaaacagagtttcagcaggtactgtccaatagaaaagagatgacccagtttttagaggaatggctgaacacccgatttgatatagaaaagttaaagaatggcatccaaaaagaaaatgaccgcatctgtcaggtgaacaacttcttcaataacaggataatcgctatcatgaacgagtctaccgagttcgaggagcgttctgcgaccatcagcaaggaatgggagcaagatttgaagtcactgaaggaaaagaatgagaagctgtttaaaaactatcagacactcaaaacctctttggcctccggagcccaggtcaatcctaccactcaggataacaagaaccctcacgtgacgagccgagcaacccaattaaccactgaaaagataagggagttggaaaatagcctccatgaagcgaaggaaagtgctatgcataaggaatctaagattattaaaatgcagaaggaactggaagtgactaatgacatcatagccaagttacaggcaaaagtgcacgagagtaacaagtgtctcgagaagaccaaggaaaccatacaagtgttacaggacaaggtcgcactcggggctaaaccgtataaggaggagatcgaggacctgaaaatgaagctagtgaagatagacctcgagaagatgaagaatgcaaaggagtttgagaaggagatatcggccaccaaggccacagtggagtaccagaaagaggtgattaggctgctgcgcgagaacctacggaggtcacaacaggcgcaggacacaagcgtcattagcgaacacacagacccacagccatctaacaaacccctgacttgcggtggcgggagcgggatcgtccaaaacaccaaagcactcattctcaagagcgaacatatccgtctggaaaaagaaatttcaaaattgaaacagcagaacgagcagctaattaagcagaagaatgagctcctgagcaataaccagcacctctctaacgaggttaaaacttggaaggagcggactctgaaaagggaagcgcataaacaggttacttgcgagaacagccctaaatctcctaaggtcactggcaccgcttcgaagaagaagcagataactccaagccagtgcaaagaaagaaatctgcaggatcccgttcctaaggagagcccgaaatcttgctttttcgacagcaggagcaagagcttaccctctccacaccccgtccggtattttgacaattccagcctcggcctgtgtccagaggtacagaatgcgggggctgaaagcgtggattctcagccaggaccctggcacgcttcttctgggaaggacgtgcccgagtgtaagacccagtag

SEQ ID NO: 182420 - DNA, 7743 bp, Artificial Sequence
  Description of Artificial Sequence: Synthetic coding sequence
atggccgaggagggcgccgtggccgtgtgcgtgcgggtgcggcccctcaactcacgagaggaatcgctgggagaaaccgcccaggtgtactggaagacagataataacgtgatatatcaggtcgacggatctaaatccttcaatttcgacagagtcttccacggaaacgaaaccactaagaacgtttacgaagagatcgctgctccgattatagattccgcaattcagggctacaatggcaccattttcgcctatggccagaccgccagtggcaagacttatacaatgatgggctccgaagatcatctgggagtcatccctcgtgctattcacgacatcttccagaaaataaaaaagttccccgatcgggagttcctgctgagggtctcctatatggaaatttataatgaaacaataacagatttgctgtgtgggacgcagaagatgaaacccctgatcatcagggaggatgtgaataggaacgtgtatgtggctgacctgactgaagaggttgtgtatacctcggagatggctcttaagtggattactaagggtgaaaagagtcgccactatggcgagacaaaaatgaaccaacggagcagccggagccatacgatcttccggatgattctcgaatcccgggagaaaggcgagcccagcaactgcgagggatctgtgaaagtcagccatctgaatctggtagatcttgcagggtccgaacgcgccgctcagaccggcgctgctggggttcgccttaaagaaggctgcaatatcaatcggtccctgttcatcctgggacaggttattaaaaaactatcggacgggcaggtgggaggcttcatcaactatagggacagcaaacttacccgtatccttcagaattccttggggggcaatgctaaaactcgaatcatttgtactatcacccccgtatccttcgatgagacgctgacggcgcttcagtttgcttcaactgctaaatacatgaagaacacaccatatgtcaacgaagtatcaaccgacgaggccttgctgaaaaggtacagaaaggaaattatggacctgaaaaaacagctggaggaggtgagtctcgagactagagcccaagcaatggagaaggatcagctggcccaactgctggaggaaaaggacctgttgcagaaagtgcagaatgaaaagatcgagaatctgacccggatgctagtgacgagcagcagccttaccttgcagcaggaactgaaggctaaacggaaaaggcgggtcacatggtgcctgggaaaaatcaataagatgaagaattctaactatgctgatcagtttaatatcccaactaatatcaccaccaagacccataaacttagcataaatttgctccgggagatcgatgaaagcgtctgcagtgaaagtgatgtgttcagtaacacccttgacaccctttctgagattgaatggaaccccgcgacaaagctgctgaatcaagagaacattgagtccgagctcaacagcctaagagctgactatgataatctagtgctggattacgaacagctgaggaccgagaaagaggagatggaactgaaactgaaggaaaagaacgacctggacgagttcgaagctctagaacgaaagacaaagaaggatcaggagaacgagctctcaagtaaagtggaacttttgcgggagaaggaggatcagattaagaagctgcaggaatacatagacagtcagaaacttgaaaatataaaaatggacctgagctactccttggagagtattgaggatcccaagcagatgaaacaaaccttatttgacgcagagaccgtagccttagatgccaaacgtgagtctgcctttctgagatctgaaaatctggagctgaaagaaaaaatgaaggaattggccaccacctataagcagatggaaaacgatatccaattgtatcagtcccagctggaggcgaaaaaaaaaatgcaggttgaccttgagaaagagctgcaatccgcattcaatgagataaccaagttgacctctctgattgatggaaaggttcccaaggaccttctatgtaatctggagctggaggggaaaattaccgatttgcaaaaagaattgaacaaggaagttgaggagaatgaggctttgcgagaggaagtgatcctgctctccgaactgaagagcctccccagtgaggtggagagattgcggaaggagatccaggataaatccgaggagctacacatcataacctctgagaaagacaaattgttttccgaggtagtgcataaagaatcccgggtgcagggcctcttggaagagatcggtaagaccaaagacgatctggctaccacccaatccaactataagagtaccgaccaagagtttcagaacttcaaaacactccatatggactttgaacagaagtacaagatggtcctggaggaaaatgagaggatgaatcaggagattgttaacctgagtaaggaagctcagaagtttgacagctctctcggcgctttgaagactgaattgtcctacaagacccaggaactgcaggagaagactagggaagtccaagagcgacttaatgagatggaacagctgaaggagcaactggagaaccgagatagcacactgcaaacagtagaaagagagaagactctgattaccgaaaaacttcaacagactctagaagaagttaaaacccttacccaggagaaggacgacctcaaacaactccaggaatccctccagatcgagcgcgaccaattaaaatctgatattcacgacacagttaacatgaatattgacacgcaggagcagcttcgcaacgctttggagtcactgaaacaacaccaggagacaattaacactctgaaaagtaaaatctccgaggaagtctcgcggaacttacatatggaagaaaatacaggcgaaactaaggatgaatttcaacagaaaatggtcgggatagacaaaaagcaggaccttgaggcaaagaacacacagacccttacggcagacgtaaaagataatgaaattatagaacagcagcgcaagatttttagtctgatccaagagaagaacgaattgcagcagatgctcgagtccgttatagccgaaaaagagcagttgaagacagaccttaaggaaaatatagaaatgacaattgagaaccaagaagaactgcgacttctgggcgatgagctgaagaagcagcaggagattgtggcccaagagaaaaatcacgccatcaaaaaagaaggggagttgagcaggacttgcgataggctcgcagaagtggaggaaaaattgaaggagaagagtcagcagttacaggagaaacaacagcagctgctgaatgttcaggaggagatgtcagaaatgcagaaaaaaatcaacgagattgagaatctgaaaaacgagttgaagaataaggagctaacacttgaacacatggagactgaacgactcgaactagcccaaaagctgaatgaaaattatgaagaagtcaaatctatcacaaaagaaagaaaagtgctcaaggaactccagaagtccttcgagacagaacgggaccacctcagggggtatatccgtgaaattgaggcaaccgggctgcaaactaaagaggaactcaagatcgcccacatccacctaaaagaacaccaagagacaatagacgagcttcggcggtccgtgagcgagaagactgcccaaatcattaacacacaggacttagagaagtcccacactaaactgcaagaggagatcccagtcctgcacgaagagcaggaactgttacccaatgtgaaggaagttagcgaaacccaggaaactatgaatgaattagaactattgacagagcaaagtactacaaaggatagcaccactctggcccgtatagaaatggagaggttgaggctgaacgagaagttccaagagagtcaggaagaaatcaaaagcctgaccaaggaacgagataatttgaaaaccattaaagaggcccttgaagtgaaacatgatcagctaaaggagcatattcgggaaacccttgcaaaaatccaggagtcccagtccaagcaggaacagtccctaaatatgaaggagaaggacaacgaaactacaaaaattgtcagtgagatggaacagttcaagccgaaggattccgccctgcttagaatagaaattgaaatgttgggattgagcaagcgactccaggagtcacacgatgagatgaaatctgtggcgaaagagaaggacgatctccaacgcctccaggaagtcctgcagtcagaatccgatcaactcaaggagaacattaaggaaattgttgctaagcacttggagactgaggaagaactaaaggtggctcattgttgtttgaaagaacaagaggagacgatcaatgagctcagggtcaatctctccgagaaagagacagagatctcgaccattcagaagcaactggaagctatcaacgacaagcttcagaataaaattcaagagatctatgagaaggaagagcagttcaacattaagcagatctccgaagtgcaggaaaaagtcaatgagctaaagcagttcaaggaacacaggaaggctaaagactcggcactgcagagcattgaatcaaaaatgctggagctcacaaaccggctgcaggagtctcaagaggagatccaaattatgattaaggaaaaggaggagatgaagagagtgcaggaggccctgcagatcgagcgagaccagttaaaggaaaatacaaaggagattgttgctaaaatgaaagagagccaggaaaaagagtaccagttcctgaagatgacggctgtaaacgaaacccaagagaagatgtgcgaaatagagcatttaaaagagcagtttgaaacgcagaagctcaaccttgagaacatcgagaccgaaaacattcgccttactcagattctacacgagaatctggaggaaatgaggtctgtcactaaggaaagagatgacctgcggtcagtcgaagagaccctgaaagttgagagggaccagcttaaggaaaacctgcgcgagaccatcacccgggatcttgagaaacaggaagagctcaagatcgttcatatgcacctgaaggaacaccaggagactattgataagctgcggggcatcgtgtcagagaaaacaaatgagatttccaacatgcagaaggatctcgagcacagcaatgacgcacttaaagcacaagacttgaagatacaggaggagttgagaatagcccatatgcacttaaaagaacagcaggaaacgatcgataagctgcgggggatcgtgtctgagaaaacagataagctgtctaacatgcaaaaggacctggagaatagtaatgcaaagctgcaggagaaaatccaggagcttaaggcgaatgaacaccagctgattaccctgaagaaagacgtgaacgaaacccaaaagaaggtgtcggagatggagcaactcaaaaaacagattaaagatcagtcactgacactgtcaaagctggaaattgagaacctgaatcttgctcaaaaattgcacgagaacctcgaagagatgaagtcggtgatgaaggagagggataaccttagacgggtggaggagaccttgaagttagagcgtgatcagcttaaagagagtctccaggagacaaaagcgagagacttggagatccaacaggaactgaaaaccgcaagaatgcttagtaaagagcacaaggagactgtggacaagctgagggagaagatctctgagaagaccattcagattagcgacattcaaaaggacctggacaaaagcaaggacgaactgcaaaaaaagcaggacaggcagaaccaccaagtaaaacctgagaagaggctcctgagcgatggccaacagcacctgactgagtccctccgagaaaagtgttctcggattaaagagctgctgaagcggtattcagaaatggacgaccattatgagtgcctgaatcgcctgtccctagacctggaaaaagaaattgagtttcagaaagaactctccatgcgggtgaaggccaatctgagcctgccctaccttcagaccaaacatatcgaaaaactgtttactgcgaatcaacggtgttccatggaatttcatagaatcatgaaaaaacttaagtatgttctttcatacgtgaccaaaattaaggaggaacagcacgagtctatcaacaagttcgagatggattttatcgacgaggttgagaaacaaaaggaactcctgatcaagatccagcatctccagcaggattgtgacgtgcctagccgcgaactccgcgacctcaaactgaaccaaaatatggacctgcatattgaggaaatactgaaggatttctctgagtcagagttccctagtattaaaaccgagtttcagcaagtgttgagcaaccggaaagaaatgacacagttcctggaagaatggttgaacacccgcttcgacattgagaagcttaagaacggaatccagaaagaaaatgaccgaatttgccaggtgaataacttcttcaataaccgtatcatcgccattatgaacgagagcacagagtttgaagagagaagcgctacaatttcaaaagagtgggaacaagatctaaagtctctgaaagagaaaaacgaaaagctctttaagaactaccaaacgttgaagacaagtctcgccagcggagctcaggtgaatccaacaacacaggacaataaaaaccctcatgtgacctcgagggccacgcagctgactaccgagaagatccgcgaattggaaaactcattgcacgaggcgaaagagtccgcaatgcataaagagagcaagatcatcaagatgcagaaggagctggaagtaacgaacgatatcatagctaaactgcaagctaaagtacatgagtccaataaatgtctcgagaagactaaggaaaccattcaagtcctacaggacaaagtggctctgggagccaaaccttacaaagaggaaattgaggatcttaagatgaagctggtcaagatcgacttggaaaagatgaaaaacgccaaagagttcgaaaaagaaatctctgccaccaaggctacagttgaatatcaaaaagaggtcattaggctgctgagagagaacctaaggcggtcgcagcaggcccaggatacttctgttatctccgagcatactgaccctcagccctctaataaacccctgacttgtgggggcggatccgggatcgttcagaacacaaaagctctgattctgaagagcgagcacatccgcctggagaaagagatttcaaagctcaagcagcagaacgaacagctaattaagcaaaaaaacgagctactttctaacaaccagcatctgagcaatgaggtgaagacatggaaagaacgaaccctcaaacgggaggcccataagcaggtcacctgcgagaactctcctaaaagccccaaggtgacaggcaccgctagcaagaagaagcagatcacaccatctcagtgcaaggagcggaatctgcaggatcctgtgcctaaagagagcccaaaaagctgtttctttgacagcagatcaaaatcattgcctagcccccatccagtacgttactttgacaacagctctttgggtttgtgtccagaagtgcaaaatgctggtgctgaaagtgtcgactcgcagcccggaccgtggcacgctagctccgggaaagacgtgcccgagtgcaagacacaatag

SEQ ID NO: 182421 - DNA, 7038 bp, Artificial Sequence
  Description of Artificial Sequence: Synthetic coding sequence
atggccgaggagggcgccgtggccgtgtgcgtgcgggtgcggcccttgaattcgagagaagaaagtctaggtgagacagcccaggtttattggaaaaccgataacaacgtgatctaccaggtggatggcagcaaatcttttaatttcgaccgggtatttcacggtaatgagacaaccaagaacgtttatgaagaaatcgctgcccctatcatcgattcagctatccagggctacaatggaaccatcttcgcctacggacagactgccagcggaaagacatatactatgatgggatccgaggatcatttaggcgtaatccctagagccattcatgatatcttccaaaaaattaaaaagttcccggaccgagagtttctcttgcgggtctcgtacatggaaatctacaacgagactattaccgacctgctttgtggaactcagaagatgaaacccctcataatcagggaagatgttaatcggaacgtgtacgttgctgatcttaccgaagaggtagtgtacacgtccgagatggccttaaagtggattactaagggggaaaaatcccggcactatggtgaaacaaaaatgaaccagcgcagtagtcgatctcacaccatctttcgaatgatcctagagagcagagagaaaggcgaacctagtaattgtgaaggaagcgtcaaggtaagtcacctcaatcttgtcgacctcgccgggagcgaaagagcggcccagactggggcagccggggtgcgcctgaaagagggctgtaatatcaaccgatcattgttcattctaggacaggtcatcaaaaagctctcggacggtcaggtgggggggttcatcaactatcgtgattctaagttaaccagaattctgcagaacagcctcggcggcaatgccaagacacgtatcatatgcacgatcaccccagtctctttcgatgagacactgactgctttacaattcgcttccaccgcaaagtatatgaagaacacaccttatgtgaacgaggtgtcaacagatgaggccctactaaagagataccgcaaggagatcatggaccttaaaaagcaactggaagaggtgtccttagaaacccgggctcaggcaatggagaaggatcagttggcccagttgctggaagagaaggaccttctccagaaagtgcagaatgagaagatcgagaatctcacaaggatgcttgtcacctcctccagtctgactctccaacaggagctgaaggctaaacgtaagcgaagggtgacctggtgcttgggtaagatcaacaagatgaagaattcaaactatgcagatcagttcaacattccaacaaatatcacaaccaagacgcacaagttatccattaacctcctgcgggagattgatgagagcgtctgctcagagagtgatgtattttctaacaccctcgacacgctgtccgaaattgagtggaacccggcaacgaagctgctcaatcaagaaaatatagagagcgagctgaatagtctccgcgctgactatgacaatttggtgctggactatgagcagctcaggacagagaaggaggagatggagctgaagctgaaggagaaaaatgacctggacgagtttgaagctctggaaaggaaaacaaagaaggaccaggagatgcagttgatccacgagataagtaacttgaagaatctagtcaaacacgctgaagtgtataatcaggacctcgaaaatgaactaagctctaaagtggagttgcttcgggagaaggaagatcagatcaagaagcttcaggagtacatcgactcccagaaacttgagaacataaagatggacctgtcctactctctggaatccatcgaagaccctaagcagatgaagcaaactctgtttgacgccgagaccgtggctctagacgctaagcgggaatcagcgtttctcagaagcgaaaacttagaacttaaggagaagatgaaggagctggccaccacttataagcaaatggagaatgacattcagctgtatcagtctcaactggaggctaaaaagaagatgcaggtggacttagagaaagagctgcaaagtgcctttaacgaaattactaaactcacaagccttattgatggaaaagttcccaaagacctgctctgtaatctagagttggaaggaaagatcacagacctacagaaagagctgaacaaggaggttgaagaaaacgaagcattgcgagaggaggtgatactgctgtctgaactcaaaagcttgccaagtgaagtggaacggctcaggaaagaaatccaggataaatccgaagagctccacataatcacttctgagaaggacaaactctttagcgaggtcgtacacaaggagtctagagttcaggggctgctggaagaaataggcaagactaaagacgatctagctacgacacaaagtaattacaaatccactgatcaagagttccaaaactttaaaactttgcatatggactttgagcagaaatacaagatggtcttggaagagaacgagcgcatgaaccaggagatcgtcaacctttcaaaggaggcccagaagttcgattcttccctgggggcgttaaagactgagctctcttataagacacaagagctgcaagaaaaaacgcgtgaggtgcaggaaagacttaacgaaatggagcaactcaaggagcagctcgaaaatagggattccaccttgcagactgtggaaagagaaaagaccctcatcacagagaagctccagcagaccctggaagaggtcaaaactctgacccaggaaaaagatgacctgaagcagctacaggagagtctccagatagagagagatcagctgaagtcagacatacacgacacggtgaatatgaacattgacacacaggagcagctgcgcaatgccctagaaagtttgaagcagcaccaggagaccatcaacaccctgaaaagcaagatctctgaggaagtgtcccggaatttgcatatggaagagaatacaggcgaaactaaggatgagttccaacagaagatggtcggtatagacaagaagcaggacctagaggcgaaaaatactcagacactaacagcagacgtgaaagacaacgaaatcattgagcagcagcggaagatctttagtcttatccaggaaaaaaacgagctgcagcagatgctggagagcgtgattgctgagaaggaacagcttaaaacagacctgaaggagaatatcgagatgactattgaaaaccaagaggagctcaggctgttgggtgacgaactaaaaaagcagcaggaaatcgtcgcacaggagaagaaccatgccataaaaaaagaaggagagctaagccgtacatgcgacagactggcggaggtggaagaaaaactcaaagaaaagtctcagcagcttcaggaaaaacagcagcagctactcaacgtacaggaagagatgagtgaaatgcagaagaaaattaacgagatagagaacctgaagaatgagctcaagaacaaggagctgacacttgagcacatggagactgagcgcctcgagcttgcccagaaactcaacgaaaattacgaagaggtaaagagtatcacgaaggaacgtaaagtgctgaaagagcttcagaaatcttttgagactgagcgggaccacttgcggggatacattagggagatcgaagctactggcctgcagacgaaagaggagcttaaaattgcccacatccatcttaaggaacaccaggagacgattgacgaactcagacgctctgttagtgaaaaaacagcacaaattatcaatacacaggatcttgagaagtcccataccaagttgcaggaggaaataccagtcttgcatgaggaacaggagctgctgcctaatgtgaaagaagtatctgagactcaggagaccatgaatgagctagaactcttgacagaacagagcaccaccaaggattccactactctggcacgaattgagatggagcggctgagactcaatgagaagttccaggagtctcaagaggaaattaagtctctgacaaaagaaagagacaatctgaaaacgattaaagaagccttagaagtgaagcacgatcaactgaaagagcacatcagagagacactggcaaagatccaagaatctcagtctaagcaggaacaaagcctgaatatgaaagaaaaggataacgaaactaccaaaatcgtgtcggaaatggaacagttcaagcccaaagacagcgccctactaagaattgagatcgaaatgctgggtctctccaaaagattgcaggaatctcacgacgagatgaaaagtgtggcaaaggagaaggacgaccttcaacggcttcaggaagtgctgcaaagtgaaagcgatcaacttaaggaaaacattaaggagattgtggccaagcacttggagacagaggaagaacttaaggtggcccactgctgcctcaaagagcaggaggagacgataaacgaactgcgcgtcaacctgtcagagaaagaaaccgagatttctacgattcagaagcagctggaggccattaatgataaactccaaaacaagattcaggaaatttatgagaaggaagagcaattcaatattaagcagatctcggaggtgcaagaaaaagtcaacgaactgaagcagtttaaagagcacaggaaggctaaagactccgcactccaatcgattgaatcaaagatgctggagttaacaaacagactgcaggagagtcaagaagaaattcagatcatgatcaaggaaaaggaggaaatgaagcgtgttcaggaggccctgcagattgaacgcgatcagctgaaggaaaacactaaagagattgttgccaagatgaaagagagccaggaaaaggaataccagttcctcaagatgacggccgtgaatgaaacgcaagagaagatgtgcgaaatcgagcacttaaaagaacaatttgagactcagaaacttaacttagagaacattgaaacagagaacatccgcctcacccagattctgcacgagaatctcgaagagatgagatcagtaactaaggaacgagacgacttgcggtctgtagaggaaaccctcaaggtcgagcgagaccagctgaaagaaaatctgagagagacaattacccgtgacctcgagaaacaggaggagctgaaaatcgttcacatgcatctgaaggaacatcaggagaccattgataagctgcgcggcatcgtgagtgaaaagactaatgagatctcgaacatgcagaaggacttggaacattcaaacgacgccttaaaagctcaggatctgaaaatccaggaagagctccggatagctcatatgcacctgaaagagcagcaagaaacaattgacaaattacggggcatcgtgagcgaaaagaccgacaaactgtctaacatgcaaaaagatctggagaacagcaacgcaaagttacaagaaaagattcaggaactcaaagccaatgagcaccaactcatcactctgaagaaagatgtgaacgaaacacagaagaaagtcagcgaaatggaacaattgaaaaagcaaatcaaggatcaaagtctgactctgtcaaagttagagattgagaacctaaacctcgcacagaagctgcatgaaaacctggaggagatgaagagcgtgatgaaggagcgggataacttgcgcagggtcgaagaaacgttgaagctggagagagatcagctgaaggaatccctccaggagactaaggccagagatcttgagatccagcaagaactgaaaaccgccaggatgctctcaaaggaacacaaagagaccgttgacaagctgagggaaaaaatctcagagaagaccattcagatctccgatattcagaaggatctggacaaatccaaggatgaactacagaaaaagatacaggagctgcagaagaaggaactccagctactcagggtgaaagaagacgtgaacatgtctcataagaaaattaatgaaatggagcagctcaaaaagcagttcgaggcgcaaaatctcagcatgcaatcagtgcggatggacaactttcaactgactaaaaagttacacgagtcactagaggagatccgaatcgtggcaaaggagcgcgatgaactgcggaggatcaaagagtctctcaagatggaaagggaccagtttattgctacactgcgcgagatgatagcccgggaccgtcaaaatcaccaggtgaaaccagagaagcgcctgctttctgatgggcaacagcacctcacagaatcccttcgtgaaaaatgttctcggatcaaagagttgttaaaacgttatagcgagatggacgaccactacgaatgccttaatcgcctgagtctggatctcgagaaggaaattgaatttcaccgcattatgaaaaaactgaagtatgtgctgtcctacgtgacaaagatcaaagaggaacagcatgaaagcataaataaatttgaaatggacttcattgacgaagtggagaagcaaaaagagctcctcattaagattcaacacctgcagcaggactgtgacgtcccaagtagagaactgagagacctgaagcttaatcagaatatggatctccacattgaggagatcctgaaagatttctccgagagcgaatttccatctattaaaacagagtttcaacaggtactcagcaatcggaaagagatgacccagtttctggaggagtggctaaacactaggttcgacattgagaagctgaagaacgggatccagaaggaaaatgataggatttgccaggtgaataatttcttcaacaaccggatcatcgctatcatgaacgagtcgacagagttcgaagaaaggagtgctacgatttcaaaagaatgggagcaggacctgaagagtctgaaggaaaagaacgagaagttgttcaaaaactaccagacactgaagacctccttagcaagcggcgcacaagtgaacccaaccacccaggacaacaagaacccccatgttacaagccgtgccacacaattgacaacagaatag

SEQ ID NO: 182422 - DNA, 9345 bp, Artificial Sequence
  Description of Artificial Sequence: Synthetic coding sequence
atgagctgggccctggaggagtggaaggagggcctgcccacccgggccctacaaaagatacaggaactggaaggccaactggataaattaaaaaaggaaaagcagcagcgccaatttcagctggactccctcgaggcagccctgcaaaaacaaaaacagaaggtcgagaatgagaaaaccgaaggaaccaatctgaaacgggagaaccaaaggctcatggagatttgcgagtcacttgaaaagaccaagcaaaagatcagtcacgagcttcaggttaaggagagtcaagtaaatttccaggaaggccagctcaactcgggtaagaagcagatcgaaaagctggaacaggagttaaaaagatgcaagtcggaactagagcgcagccaacaggctgcacagtcagctgacgtgtctctgaacccctgcaacaccccgcaaaagatattcaccacccccctgacacccagtcaatattacagtgggtccaagtacgaggatctgaaggaaaaatataacaaggaggtcgaggagagaaagcggttggaggcagaggtcaaagccctgcaagcgaaaaaggcgtcacagacgttacctcaagctaccatgaaccaccgggacatcgctaggcaccaagcgtccagtagcgtattttcttggcagcaagaaaagacaccttctcatctttcatcaaatagccagagaacaccgatccggcgggacttctccgccagctatttttccggagaacaagaggttaccccttcccggtctacactccagattggcaaacgagacgcaaacagttccttttttgataattcctcctcccctcacctgcttgaccaactgaaggcgcagaatcaggagctccgaaataagatcaacgagctagagttacggctccagggtcatgaaaaagaaatgaaaggacaggtgaataagttccaggaactgcagctacagctggagaaggccaaggtggaactcatagagaaagaaaaagtcctgaataaatgtcgcgatgagctggtgcggaccaccgcccagtatgaccaagccagcaccaagtacaccgccctggagcaaaagctgaagaaactcaccgaggacctatcttgccagaggcaaaacgcggaatccgctcggtgttctctggaacagaaaatcaaggagaaagaaaaggagttccaagaggagctgtcaagacagcagaggtctttccagactctcgaccaagaatgtatccagatgaaagcccggctgacccaagagctgcagcaagccaaaaacatgcataacgttctccaggccgaattagacaaactgactagcgttaagcagcagctagagaataatctagaggaattcaagcaaaagctgtgcagggctgagcaagccttccaggcctctcagataaaggagaatgaactccggagaagcatggaggagatgaagaaagagaataatctgttgaaaagtcattcagagcagaaggcccgtgaggtatgccacctcgaagcggagctaaagaacatcaaacagtgcctcaatcagagtcagaacttcgctgaagaaatgaaagcgaaaaacacctctcaggagactatgttgagagacctgcaggaaaaaataaatcagcaggagaactcgctgacactcgaaaaactgaagctggcagtagcagatttagaaaagcagcgggattgttctcaggacttacttaaaaagcgcgaacaccacatagaacagctcaacgacaaactgagtaagacggagaaggagagcaaagcactgctctctgccctggagttaaaaaaaaaagaatatgaagagctcaaggaagagaagaccctttttagttgttggaagtctgaaaacgaaaaactgctgactcagatggagtcagagaaggagaacttacagagcaagattaaccatctggagacatgcctcaagactcaacaaatcaagagccacgaatataatgagcgggtccggacacttgagatggatagagaaaaccttagtgtcgagattaggaatcttcacaacgttcttgactccaaatctgtggaggttgagacgcagaagttagcctatatggaactgcagcagaaagcagaatttagtgatcagaagcatcagaaagagatcgagaacatgtgtctgaagacaagccagctgacaggtcaggtggaagatttggagcataagttgcaacttctatccaatgagatcatggataaagacaggtgttaccaagacctacatgcagagtacgaatcccttcgcgacttattgaagtcaaaggacgcttctctcgtcactaacgaggaccatcagagatcattgctggcattcgatcagcagcccgctatgcatcactccttcgctaacatcattggggagcaggggtcaatgccgagtgagcgctcggaatgtaggctggaggcagatcaatcacccaagaacagcgctattcttcaaaaccgcgttgactctttggagttctctctggagtcgcagaaacagatgaactccgatctccagaaacagtgtgaagaacttgtccaaataaagggcgagatcgaggaaaatctgatgaaggctgagcaaatgcaccagagcttcgtggccgaaactagccagcgaataagcaagctgcaagaagatacttcggcacatcagaatgtggtcgctgagacactctccgcattggaaaataaagagaaagaactccagctgctaaacgataaggtcgagaccgaacaagcagagattcaggagctgaagaaatccaaccatcttctcgaagactcactgaaagagttgcagctgctaagtgaaaccttgagcctggagaaaaaggagatgagcagcataatcagtctgaataagagggagatagaagaactgacccaggaaaacgggacattaaaagaaataaatgcctctctaaatcaggaaaagatgaaccttatacagaagtcagaaagttttgctaattacatcgatgagcgcgagaaatccatctcagagctctctgatcagtataagcaagaaaaactgatcctgctgcagcgatgtgaagagaccggaaacgcatatgaggatttgtctcagaagtataaagctgcacaagagaaaaattccaagctggagtgccttcttaacgaatgcactagtctgtgcgagaaccgtaagaatgaactggagcagctgaaggaggcatttgccaaggagcaccaggagttcctgacaaagcttgctttcgcagaggagaggaatcaaaatcttatgctggaacttgagacagtgcagcaagctctcagaagcgagatgacagacaatcagaacaacagcaaatcagaggcaggagggctcaagcaagagataatgacgctcaaagaagaacagaacaaaatgcaaaaggaagtaaacgacctgctgcaagagaacgaacaactaatgaaggtcatgaaaacgaaacacgagtgccagaatctggagtctgaaccaataaggaattcagtcaaagaaagggagtccgagcggaatcagtgcaacttcaagccccagatggacctcgaggtcaaggagatttcactcgactcgtataatgcacagttggtccagttggaggcaatgttgagaaacaaagaattaaagctacaggagagtgaaaaggaaaaagagtgtttgcagcacgaactccaaaccattcggggtgatttggaaacctcaaatctgcaggatatgcagtcacaggagatctctgggttaaaggactgcgagattgatgccgaggagaaatacatctcaggtccacacgagctgagtacgagtcaaaatgataatgcacacctgcagtgcagtctgcagactaccatgaacaaattgaatgaactcgagaagatttgcgagattctccaggccgagaaatacgaacttgtcaccgaattgaacgacagcagaagcgaatgtatcaccgccacgagaaagatggccgaggaagtcggcaaactcctgaacgaggttaagattttgaacgatgatagtggtctgctgcacggggagctggtcgaggatatccccggaggggagttcggagagcaacccaatgagcaacacccagttagtctcgctccactcgacgagtcaaactcctatgaacaccttaccctgagcgataaagaggtccagatgcactttgccgagcttcaggaaaagttcttatctctgcagtccgaacataagattcttcacgatcagcactgccagatgtcttcaaagatgtcagagctccagacctatgtcgatagcctgaaggctgagaatcttgtgctgtctaccaatctcaggaatttccagggtgatctggtcaaggaaatgcagctcggactggaggaagggttggtcccttcattgtcgtccagctgcgtccccgattccagcagcctcagcagtttaggcgatagctcattctaccgagctctacttgagcagaccggggacatgagcctgctgagcaatcttgagggggcagtgagcgccaaccaatgttcagttgatgaggtcttttgcagctctctccaggaggaaaacttgactcggaaggagactccttcggcgcccgctaaaggggtggaggagctggagagcctgtgcgaggtctaccgccagagtctcgagaagctcgaagagaagatggaatcacagggcatcatgaaaaacaaagagatccaggagctggaacaactgctttcttctgaacgccaagaactagactgccttcgcaagcagtacttgtcagagaatgaacagtggcagcagaaactcacgtcagtgaccctggaaatggagagtaaattggccgcagagaagaagcagacagaacagctgtcactggagctggaagtggctcgtctccagctgcagggtttggatctgtcatcaaggagcctacttgggatagatactgaggacgctatacaagggcgcaacgagagctgcgacatttctaaggagcatacttccgaaacgaccgagcgaacacccaaacatgatgttcaccagatctgcgataaagatgctcagcaagacctaaacctggacatcgagaagataactgagacaggagcagttaaacctaccggcgaatgcagcggcgagcagtcaccagacactaactacgaaccgcccggtgaggacaagacacagggcagctctgaatgtatcagtgaattgagcttttctggccccaacgctctcgtgcctatggacttcctcgggaaccaggaggatatccacaacttgcagctgcgagttaaagagacatcgaacgaaaatctccggctgcttcatgtaatcgaggatcgtgaccgcaaagtcgagagcctgctcaatgagatgaaagaactagattctaagctgcatcttcaggaggtgcagctgatgaccaagatagaggcttgcattgaacttgagaaaattgtcggagaactgaagaaagagaattccgacctgagcgaaaagctcgagtacttcagttgcgaccaccaggagttactgcagagagtggaaacctccgaagggctcaactctgaccttgagatgcacgctgacaaatcttcccgggaggacataggcgacaatgtggctaaggtaaatgacagttggaaggagagatttttagacgtggaaaatgagttgtctcggatccgcagcgagaaagcctcgatcgaacatgaggcactgtatcttgaagcagatctagaggtggtgcagactgaaaaactctgcctggagaaagataacgaaaacaagcaaaaggtgatagtgtgcctcgaagaagagctgagcgttgtaacatccgagaggaatcagttaaggggcgagctcgatacaatgtcaaagaagaccacggccttagatcagctgtctgagaagatgaaggagaagactcaagaactggagtctcaccagagtgaatgcctccattgcatacaggtggctgaggccgaggtaaaagagaaaactgaactactgcagactttgtcatcagacgtcagcgagctcttaaaggataagactcatctccaggagaagctacagtcccttgagaaagattcacaagctctgtccctgactaagtgcgagctggagaatcagatcgcacagttgaacaaagaaaaagaactcctggttaaggaaagcgagtctttacaggctcgactatctgaatctgactatgaaaaattgaatgtgtctaaagctctggaagccgccctggtcgaaaagggagaatttgctctgcgcctatcctcgacgcaggaggaggttcaccagctgcggcgcggcatcgaaaaactaagagtaaggatcgaggccgatgaaaagaagcagttacacattgccgaaaagctgaaggaacgggagcgcgagaatgactccctgaaagacaaggtagagaacttggagcgagagctccagatgagcgaagagaatcaagagctcgtgatactggatgccgagaactcaaaagcggaagtggaaacactcaagactcagatcgaagaaatggcccggtcactgaaagtgttcgagctcgatctcgtgacactccggtccgaaaaggagaacctgaccaaacagatccaggagaagcaaggacagctcagtgaattggacaagctcctttcctcctttaaatcgctcttggaagaaaaggagcaggcagagatccaaattaaagaagagtctaagaccgccgtggaaatgttgcagaaccagcttaaagagctgaatgaggcagttgccgcactttgcggcgatcaagagattatgaaggctaccgaacaatctttggacccaccgatcgaggaagagcatcagctcagaaactcaatcgaaaaactgagagccagactggaagccgacgaaaagaagcagctgtgtgttctccagcaattgaaggagtctgagcatcatgcagacctgctcaaaggccgggtggagaatctcgagagagaactcgagatcgccaggactaatcaggaacacgccgccctcgaagctgagaacagcaagggagaagtggagacactcaaagccaagattgaggggatgactcagtcccttcgtggtctcgaacttgatgtggtgacaattagatcagagaaggagaacctcactaatgagttgcagaaggagcaggagcggatcagcgaactagagatcataaattcaagtttcgagaacatccttcaggaaaaggaacaagaaaaggtgcagatgaaagaaaaatcctccaccgcaatggagatgctgcagacacaactgaaggagctgaatgagagggtcgcagccctgcataatgatcaggaggcttgcaaagcgaaggagcagaacttatcatcgcaggtagaatgtctggaattggagaaagcccaactgctgcaggggctcgacgaagcaaagaataactacatcgtcctccagtcatccgtgaatggcctcatccaagaggtagaagacggaaaacagaagttagaaaaaaaagacgaggagatctccagactgaagaaccagatccaggatcaagagcaactagttagcaaactgtctcaggtggaaggggagcaccagctatggaaagaacagaacctggaactccggaatctgacagtcgagctggaacaaaagatccaagtgttgcagtctaagaacgcttctctgcaggataccctggaggtgttgcaaagttcctataagaatttggaaaatgaactggaactcacgaagatggacaaaatgtcatttgtcgaaaaagtgaacaagatgaccgccaaagaaaccgaactccagagagaaatgcacgagatggcccaaaaaaccgccgaactgcaggaggaactgtccggagagaaaaaccgtctggccggggaactccagctgctcctggaagaaatcaaatcatctaaagaccagttgaaggaactgaccttggagaatagtgaacttaagaagtctctcgactgtatgcacaaagatcaggtggagaaggagggcaaagtgcgagaggagattgctgagtatcagctcaggcttcacgaagcggaaaaaaaacatcaggcccttttactggacaccaataaacagtacgaagttgaaatccagacatacagagaaaagctgacctctaaagaagagtgcctttctagccagaaactcgaaatcgatctccttaaaagctctaaggaggaattgaacaactcgctaaaggccacaacccaaattttggaggaactaaagaagactaaaatggataaccttaagtacgtcaatcagcttaaaaaggaaaacgagcgcgctcagggcaaaatgaagcttctcataaagagctgtaagcagttggaggaagaaaaagaaatcttgcagaaagagttgtcacaacttcaggcagcccaggaaaaacagaaaaccggaacagtgatggacactaaagtggacgaactgacaactgagatcaaagagctgaaagagactctggaggaaaagactaaagaagccgatgagtaccttgataaatattgcagccttctgattagccacgagaaactggaaaaagctaaggaaatgttggaaacccaggttgcccacctctgcagtcagcaaagcaagcaggatagcagagggagccctttgttaggacccgtggtgcccggtccgagccccatcccgagcgtcacagagaagcgcttgtccagcgggcaaaataaagcctccgggaaaagacaacgctcctccggcatttgggagaatggccgaggcccaacccctgcaactcctgagagtttctctaagaaatccaagaaagcggttatgtcaggcatccaccccgccgaggacaccgaaggaactgagttcgaaccggagggattacctgaggttgttaaaaaggggttcgcggatatcccaaccgggaaaacgtcaccttatatcctccgacgcacaactatggccacaagaacctcaccacgactggccgcacaaaaactcgccctcagccctctgagcttaggcaaggagaacctggccgaaagctctaagccaactgccggtgggagtcgatcacagaaagtgaaagttgctcagcggagtccggttgacagtggcaccattcttcgcgaaccaaccactaagtccgtcccagtgaataacctgcccgaacgttcccctacggatagtcctcgcgagggacttcgggttaaaagaggccgcttggtacctagccctaaggccgggcttgagagcaacggctctgagaactgcaaggtgcaatag

SEQ ID NO: 182423 - DNA, 528 bp, Artificial Sequence
  Description of Artificial Sequence: Synthetic coding sequence
ctgatgatcaagggccggaagggcaaggtgaacaagatgaccgccaaagaaacagagcttcaaagggagatgcatgaaatggctcaaaaaacagccgagctccaggaagagctgtccggagaaaaaaaccgcttagccggggagctgcaactgttgttagaagagatcaaaagttccaaagaccaattaaaagaactcactcttgaaaactctgaactgaagaagtctctggattgtatgcacaaagaccaggtcgaaaaggaagggaaggtccgtgaagagatagcagaatatcagctgcgactgcacgaggctgagaagaagcaccaggcccttcttctcgacacgaacaaacagtacgaggtcgagatccagacatatagggagaaactgactagcaaagaagagtgtctgtcttcacagaaacttgagatcgacctgctcaagagttctaaggaggagttaaacaattctctcaaggctacaacgcagatactggaggagcttaaaaaaaccaaggaaaactag

SEQ ID NO: 182424 - DNA, 4017 bp, Artificial Sequence
  Description of Artificial Sequence: Synthetic coding sequence
atgttcctgatgcccaccagcagcgagctgaacagcggccagaacttcctgacccagtggatgacaaaccctagccgagccggcgttatcttaaacaggggctttccaatcctggaggctgataaagagaaaagagcggcagttgatatatcaacctcctttccaattaagggtacccattttagtgatagtttttctttcatcaatgaggaagactcgctcctagaagaacagaagctagaatccaataacccctataagcctcagtccgataagtccgaaacgcacaccgccttcccctgcataaaaaagggtccacaggtagccgcttgccatagcgctcccggccaccaggaagaaaacaaaaacgacttcatcccggatctcgcctctgaatttaaggagggtgcttacaaggatcccttgttcaaaaaactcgagcagcttaaggaagtgcagcagaagaagcaggagcagctaaaacgccagcagttggaacagctccagaggcttatggaagaacaggagaaactgttaaccatggtgagcggccagtgcacccttcctggtttgtccctgctgcctgacgaccagagccaaaagcaccgatccccgggaaacactactacaggtgaacgtgccacctgttgtttcccatcatacgtgtaccctgatccaactcaggaagagacatacccttccaacatcctgtcacatgaacaatctaatttttgtcgcacagctcatggggacttcgtgctaacttctaagagagcgtcaccaaacctgttttcggaggcccagtaccaggaagccccagtggagaagaacaaccttaaggaggagaatcggaatcatcctacaggcgagagtatcctgtgttgggagaaagtcactgaacaaatccaggaagccaacgacaagaatctgcagaaacatgacgactcatcagaggtggccaatatagaggaacgtcctatcaaggccgctatcggtgagcgaaaacagacattcgaggattacctcgaggaacagatccaactcgaggaacaggagctgaagcagaaacagctgaaagaggctgaggggccccttccaatcaaggcaaagcctaagcaaccatttctgaagcggggggagggattggctaggttcactaatgctaagtccaaatttcaaaagggcaaggagagcaaactagtgactaatcagagcacttctgaagatcagcctttgttcaagatggaccgtcagcagcttcaacgtaaaacggctctaaaaaataaagaactgtgtgctgataatcctattctgaagaaggatagtaaggcgcgaacgaaatccggaagtgtgactctctctcaaaaaccgaaaatgcttaagtgctcaaatcggaaatctttatctccttcagggctcaagatccaaaccggcaaaaagtgcgatggacagttccgggaccagatcaaattcgagaacaaggtcacttccaataacaaggagaacgtgaccgaatgccccaaaccttgcgacaccggctgtacaggctggaataagactcagggaaaagataggctgcctctgagcacgggacctgcatctcgccttgccgctaagtcaccaattagagagactatgaaggaatctgaaagctcactggatgtctctctccagaagaagctcgaaacatgggagagagaaaaggagaaagaaaacctggagctcgacgagtttctgttcctggagcaagctgccgatgagatcagctttagttctaacagttcattcgttttgaagattctggagagggatcagcagatctgcaaaggccatcggatgtcctctacccccgtcaaggccgtgccgcagaaaactaatccagccgaccctataagccactgtaacagaagcgaggatttagaccacacggcgagagaaaaagagtccgaatgtgaggtggctcccaaacagttacattctctcagcagcgctgatgagctacgggagcaaccttgtaaaattaggaaggctgttcagaagtccacttccgaaaaccagacagaatggaatgctcgcgatgatgagggagtgccaaactccgactccagtacggattccgaggaacagcttgacgttaccataaagcctagcactgaagacagggaacggggcatatcatctagagaggattctccacaggtgtgcgacgataaaggcccttttaaggataccagaacccaggaagataagcgcagggacgttgaccttgatttgagtgataaggattactctagtgacgagtctattatggagagcatcaaacacaaggtctccgagcccagtaggagtagctcgctctccctcagcaagatggactttgacgatgagcgaacttggaccgacctggaggaaaacctgtgcaatcacgacgtggtcctggggaacgaatcgacttacggcactccccagacttgttaccccaataatgagattgggattctagataagacaatcaaaaggaagattgcgcctgtcaagagaggcgaggacctgtccaagagtcgccgctccagatccccacccacctcagaactgatgatgaagttttttccatctttgaaacctaaaccgaaaagtgacagtcatctggggaatgagcttaaactgaacatatcccaggaccagccccccggggacaacgctagatcccaggtgcttcgcgagaagatcatagaactcgaaacagagattgagaaatttaaggcagaaaacgcgtccctggccaaactgcgaattgagcgtgagagcgcccttgagaagctgagaaaggagatcgcagactttgagcagcaaaaggcaaaagagctggcgcggatcgaagaattcaagaaagaggagatgagaaaactacagaaagagaggaaggttttcgaaaagtacactacagctgctcggacattccctgataaaaaagagcgggaagagatccaaactctcaagcagcagatcgccgacttaagagaagacctgaaacgaaaagagacaaaatggtcctcgactcatagtcgactcaggagtcagatccagatgttagtgagagagaacacagaccttcgcgaagagattaaggtgatggagaggtttcgacttgatgcctggaaaagggctgaggccatcgaatcctctttggaagttgaaaaaaaggataaactcgccaacacttctgttaggtttcagaatagccagatctcaagcggtacccaagtggagaagtacaaaaagaattatctgccaatgcagggcaatcctcctagaagatcaaagagtgctccacccagagacctcgggaatctggacaaggggcaggctgcaagtccgcgggagcccctcgagccactcaacttcccagatcccgaatacaaagaggaggaggaggaccaggatatccagggtgaaatcagccacccagatggaaaggtggaaaaagtctataagaacgggtgcagagtgatcctgtttccgaatggaacccgaaaggaggtgtctgctgatggcaagaccatcactgtgacctttttcaatggggacgtgaagcaagtgatgcctgaccagcgcgtcatctattactacgctgcggcacagacaacgcatactacatatccagaagggctggaggtactgcatttctccagcgggcagattgagaagcattaccctgatggccgcaaggagattaccttcccggaccaaactgttaaaaacctcttccccgatggccaggaagagtcaatcttccccgatgggactatagtgagagttcagagggatggtaacaagttgattgaattcaacaacggccagcgcgaactccacaccgcccagttcaaacgtcgcgagtatccagacggcactgtgaaaaccgtgtatgccaatggccaccaggaaactaagtatcgctcagggcgaatccgcgtcaaggataaggaaggtaatgtactgatggatactgagctctag

SEQ ID NO: 182425 - DNA, 3411 bp, Artificial Sequence
  Description of Artificial Sequence: Synthetic coding sequence
atgttcctgatgcccaccagcagcgagctgaacagcggccagaactttctgacccaatggatgacaaacccatctagagccggagtgatcctaaaccggggattcccaattctggaagccgataaggaaaaaagagcagcggttgatatcagcacctctttccctattaagggtacccattttagcgacagcttttcctttattaacgaagaagattcgctgctggaagagcagaagctggagagcaacaacccatataagcctcaatcagacaagtccgaaacccataccgccttcccttgtataaaaaaggggcctcaggttgctgcttgccactccgcgcccggccatcaggaggagaacaaaaacgattttatcccggatttggcaagcgagtttaaagaaggggcctacaaggatccgctgttcaagaagctggaacagctcaaagaagttcaacaaaagaagcaggagcagctgaaaagacagcagctcgaacaacttcagagactgatggaggaacaggaaaagcttctcactatggttagtggccagtgcaccctgccaggactgtctcttctgcccgatgatcagagccaaaaacacagatctccaggcaataccaccacaggcgagcgtgccacttgctgcttcccaagttatgtctatcctgaccccacacaggaagaaacctatccttcaaatatcctcagtcatgagcagagcaatttttgcagaaccgcacacggagactttgtattgacgtctaaaagagctagcccgaatttatttagcgaggcccagtaccaggaggcacccgtggagaagaataacttgaaagaggagaatcgcaatcatcccacgggggagagcattctgtgctgggagaaagttacagagcaaattcaggaggcaaacgataagaacttacaaaagcacgacgattccagcgaagtagccaacattgaggagaggcccataaaagcagcaattggcgagcgaaagcagactttcgaggattacctggaagaacagatccagcttgaagagcaggagctgaaacagaagcagctcaaggaggcagaggggccattgccgattaaagcgaagcctaaacaacccttcttaaagcgaggagaagggctggcgagatttaccaacgcgaagagtaagttccagaagggcaaagagagcaaactggtcacgaaccagagcaccagtgaggaccaaccgctttttaaaatggatagacagcagctgcagaggaagaccgcccttaaaaataaggagctgtgcgccgataatccaatccttaaaaaagattccaaggctcgcacaaaaagcggatccgtaaccctgtcccagaagcccaagatgctgaagtgcagcaaccgcaaaagtctgtctccaagcgggctcaaaattcagacagggaagaagtgtgacgggcagttccgcgaccagataaagttcgaaaacaaggtgacctcaaataataaggaaaacgtaactgagtgccctaaaccatgtgacactggatgcacagggtggaataagacccagggtaaagatcgactgcccctgagtaccggtcctgcgagtagactggcagcaaaaagcccaattagagagacaatgaaggagtctgaaagtagcctggacgtgtctctgcagaagaagctggagacttgggagcgagagaaggagaaggaaaatttagagctcgatgaattcctgtttctggaacaggccgcggacgaaatcagtttctcgagcaactctagcttcgtgctgaaaatcctggaacgggaccaacagatctgtaagggtcaccggatgtcaagcacacccgtcaaagccgtgccacaaaagaccaatccagcggacccaatcagtcattgcaatcgctccgaggacctcgaccatacagctagagaaaaagagagtgaatgcgaagtggctccaaaacagctccatagcctgtcttccgccgacgagcttagggagcagccttgcaagatccgtaaagccgtccagaaaagcacctcagagaatcagaccgagtggaacgcaagggatgatgaaggtgtcccaaactcagacagctctacagacagtgaagaacagctggatgtgaccataaagccgtccacggaggacagggaacgcggaatttctagtcgagaggacagccctcaggtgtgtgatgacaagggaccttttaaggacacgcgcacgcaagaggacaaacggagggatgtggatttggatctcagcgataaagactattcctcagatgagtccatcatggaatcgattaaacataaagtctccgaacccagtagatccagcagtttatccctgagtaaaatggacttcgatgatgagcggacatggacagacctcgaggagaatctctgtaatcacgatgtcgttctgggcaatgagtccacttacggcactccacagacctgttatcccaataacgagatcggcatcctggataagactataaagagaaaaattgctcccgttaaaaggggcgaagatctctccaagagtcgcaggtccaggagtccacccacctctgaactcatgatgaagttcttcccgagcctgaaacctaagcctaaatcggacagccacctgggcaatgaactcaaactgaatatttcacaggaccagcccccgggggataacgcccgctcacaggtcctgagagaaaagataatcgagctagagaccgagattgaaaaattcaaggctgagaacgcctcgcttgcaaagcttcggatcgagcgcgagagcgcgctagagaagctgcgcaaagagatagccgactttgagcagcagaaggcaaaggagttagcgaggattgaggaatttaagaaggaagagatgcggaagctgcagaaagagcgaaaagttttcgagaaatatacgactgcggcacgaacctttccagacaagaaagaaagagaagagatccagacgctcaagcaacagattgcagatttacgggaagatctcaagcggaaggaaacgaaatggtcctccacacattcccggctgcgatcccagattcagatgctagtgcgagaaaacacagatttgagagaggagatcaaagtgatggaacgttttagactggatgcttggaagagggccgaagccatcgaatcttcgcttgaggtcgaaaagaaggataaacttgcaaataccagcgtgaggtttcaaaacagccaaatctcttcggggacacaggtagagaagtacaaaaagaactacctgccgatgcaggggacagctcagcccccacatacccctagtagcctgctagccgatcacctccctccgttgagctcgtttcggccatttagcagaaatatacagctgtgttacaccttttag

SEQ ID NO: 182426 - DNA, 3261 bp, Artificial Sequence
  Description of Artificial Sequence: Synthetic coding sequence
atgttcctgatgcccaccagcagcgagctgaacagcggccagaactttctgacccagtggatgaccaatccatcccgggccggcgttatcttaaatcgcgggtttccaatcctggaggctgacaaagagaaaagggcagcagtagatatcagcacttctttccccatcaagggaacacatttttcagattcattcagtttcatcaatgaagaggatagcttgctcgaagaacaaaaactggagagcaacaacccatataagcctcaatcagataagtcagaaacacacacggctttcccttgcatcaagaagggaccccaggtcgctgcttgtcacagcgcccctggacaccaggaggagaataagaatgactttatccctgatcttgcatcggagtttaaagaaggtgcttataaagacccactgtttaagaagctggagcagttaaaggaggttcagcagaaaaagcaggagcaattgaagaggcagcaacttgagcagctgcagaggcttatggaggaacaggaaaagctgcttaccatggtgagcggacagtgtacccttccagggctaagtctcctgcccgacgatcaaagccaaaaacaccgatccccaggcaatactacaacgggggaaagagcgacttgttgcttcccatcatacgtgtatcccgacccgactcaagaggaaacatacccctctaacattctatcacatgagcaaagtaacttttgccgaaccgcccatggagactttgtgttgacaagtaaaagagccagccccaatctcttctccgaggcccagtaccaggaagctccagtcgagaagaacaacttgaaggaagaaaaccggaaccaccctacaggcgagagcattttatgctgggagaaggtcaccgagcagatacaggaagccaacgataaaaacctgcaaaaacatgacgatagcagtgaggtagccaacattgaagaacggcccatcaaggcagccattggggaaaggaagcagaccttcgaggattacctggaggaacaaatccagttggaagagcaagagctcaagcagaaacaactgaaggaggctgaagggccacttccaattaaagcaaagcccaagcagcctttcctgaaacgcggcgaggggttggctcggttcaccaacgctaaaagcaagttccaaaaggggaaggaaagtaagctagtgaccaatcagtctacatccgaggatcagcctctgttcaaaatggatcgccaacagcttcagcgcaagacggcactgaagaacaaagagctgtgcgccgacaacccaatccttaagaaagactcaaaggcgagaacaaagagcgggagcgtgaccttgtcacagaaacccaaaatgcttaaatgtagcaatcggaaatctctctctcctagtgggttaaaaatacaaaccggaaagaagtgcgacgggcagtttcgagatcagataaagtttgaaaataaagtcacaagtaataataaggaaaacgtgacagagtgtcccaaaccttgtgatactggatgtactgggtggaacaaaactcagggaaaggacagacttcccttgagcaccggccccgccagtaggctagccgctaagtcacccatcagggagaccatgaaagagtcagaaagcagcctggatgtttctctgcagaagaaactggaaacctgggagcgcgagaaggagaaagagaacctcgagctggatgagttcctgtttctggagcaggcagctgatgagataagcttctcttctaattcttctttcgtgctaaaaatcttggagcgcgaccagcagatttgtaagggacaccgaatgtcgagcacccccgtcaaagcggtcccccaaaagacaaatcccgccgaccctattagtcattgtaatcgctctgaggatctggatcatacggcacgtgagaaagaatctgagtgcgaggtcgcccccaagcagttacacagtttatcttccgccgacgagttacgcgagcagccgtgcaagatacgcaaagctgtgcagaaatcaaccagcgaaaatcagaccgagtggaatgcaagggatgatgagggggtgcctaactcagactcctccactgacagcgaggagcagctggacgtgaccattaaaccctcaactgaggaccgtgaacgtggtatttcttcccgcgaagatagtccacaggtctgtgacgacaagggcccgttcaaggatacaaggacacaggaagacaaacgaagggatgtagacttagacctttctgacaaggattacagttccgacgaatctataatggagagtatcaagcataaagtttcagagcccagcaggtcaagcagtctgtctttgagcaagatggattttgacgacgagcggacgtggactgatcttgaggagaacctttgtaaccacgacgtcgtattagggaacgagtccacctacgggactccccagacatgttatccaaataatgaaataggtattctggataagactatcaagcgaaagattgcccctgttaaaagaggcgaggacctgtcaaagtcacggcgctctcggtctccacctacctcggagctaatgatgaagttttttccatcccttaagcctaaacctaaatcggatagccacctaggaaacgaattgaagcttaacatcagccaagaccagccccccggagataatgctcggagccaggtgttgcgagaaaagataattgaactggaaacggaaatcgagaagtttaaagcggaaaacgcaagcctcgccaaactccggatcgaacgtgaatctgctctcgagaaactgagaaaggaaatagcggattttgagcagcagaaagcaaaagagctggcacgtatagaggaatttaagaaagaggagatgcgtaagctgcaaaaagagcggaaagtttttgagaaatatacaaccgccgcgcgtacatttcctgataaaaaagagagagaagaaattcagaccctgaaacagcagatcgctgacttgcgggaagacctgaaacgcaaggaaacaaaatggtctagcacacatagccgtttaagaagtcagatccagatgctcgtccgcgaaaacacagacctaagagaggagatcaaggttatggagagattcagacttgatgcatggaagcgcgccgaggccattgagagcagccttgaagtggaaaaaaaggacaagttggcggcgatccaccttgaggatccatctctgcacttactggttatttag

SEQ ID NO: 182427 - DNA, 1035 bp, Artificial Sequence
  Description of Artificial Sequence: Synthetic coding sequence
atggacagctacagcgcccccgagagcacccccagcgccagcagcagacccgaggactacttcatcggagcaactcctctccagaagcgccttgaatccgtccggaagcagagttctttcatcctcacccccccaagacgcaaaattcctcagtgtagtcagctccaagaggatgtcgatccacagaaggttgcctttcttctccataaacagtggacattatatagtttgacccctttgtataaattcagctatagcaatttgaaagaatattctcgtctgctgaatgcttttatagtggcagaaaaacagaaaggactggcagtcgaagtcggtgaagacttcaacataaaggtcattttcagcacactgctcggcatgaagggaacccagagggaccccgaagcctttttggtgcagatcgtgagcaaaagccagctcccgtccgaaaatcgggagggaaaggttttgtggacagggtggttctgttgtgtgtttggtgattccttattggaaaccgtgtcagaggattttacatgtttacctctgttcctggccaacggagcagaatctaatacagcaatcatcggcacgtggtttcagaagactttcgactgttacttttctcccctggctattaatgcctttaacttgagttggatggcagccatgtggactgcttgcaagatggatcattacgtggccacgacagagttcctgtggtcggtaccctgcagtccccaatctttggacatttcctttgccattcatccagaggatgcgaaggctctctgggacagcgttcataaaacccccggcgaggtgacccaagaagaggttgatttgtttatggactgtctttacagccatttccatcgacatttcaagattcacctgtccgctacaaggctggttcgagtgagtacttcagtcgcctcagcccacaccgacgggaaaatcaagattctgtgccataagtacctgatcggcgtgctggcatacttgactgagcttgccatcttccagattgaatag

SEQ ID NO: 182428 - DNA, 1173 bp, Artificial Sequence
  Description of Artificial Sequence: Synthetic coding sequence
atggacagctacagcgcccccgagagcacccccagcgccagcagcagaccggaggattacttcataggcgctactcccctccagaaacggttggaatcggtgcgcaagcagagctccttcattctgaccccacctagaagaaaaatccctcagtgcagccagctgcaagaggatgtcgatcctcaaaaggtggcattcctactgcacaagcagtggaccttgtatagtctgacccctctgtataaattctcatattctaatttgaaagagtactcccgcctcctgaacgccttcatcgtggcggagaaacaaaaaggtctcgcagtggaagtcggcgaagacttcaacataaaagtgattttttcgacactgctcggaatgaaaggaacccagcgggacccggaggcatttctggtgcaaggactaatcctcagtccccgcctggaatacagcggtacaatcctcgtggattgcaacctgtgcctcttgggcagcagcgacccctcaactctcgctttccaggtcgcgggcactgctggcgcatgccaccacacaaggattgtgtctaagagtcagctgccaagtgaaaaccgagagggcaaggttctatggaccgggtggttttgttgtgttttcggcgactctctactggagaccgtgtccgaagacttcacctgccttcctttgtttcttgccaacggcgcagagtccaacaccgccatcatcgggacgtggtttcagaagaccttcgactgttacttcagtcccttagccattaatgcgtttaacctcagttggatggctgccatgtggacagcctgcaaaatggaccattatgttgccactactgagtttctgtggtccgtgccttgctccccgcagtctttggacatcagcttcgctatacaccctgaggatgcaaaagccctgtgggactcagtccacaaaactccaggagaagtgacccaggaggaagtagatctgttcatggactgtctctactcgcacttccaccgccattttaaaattcatctctccgccacccgactggtgcgcgtgtcgacctcggtcgccagcgcacatacagatggcaagataaaaatcctgtgtcataaatatctcattggcgtcctggcttatcttaccgagctcgctatcttccagatagagtag

SEQ ID NO: 182429 - DNA, 1035 bp, Artificial Sequence
  Description of Artificial Sequence: Synthetic coding sequence
atggacagctacagcgcccccgagagcacccccagcgccagcagcagacctgaggactactttattggagctactcctcttcagaagagactcgaaagcgtgaggaagcagtcatctttcattcttactcctccacgaagaaagatccctcagtgcagccagcttcaggaagatgtggatcctcagaaggttgccttccttctacacaaacagtggaccctgtatagtctcacgcctctgtacaagttctcctattctaacctgaaagagtacagtcgcctactgaatgcctttatcgtggccgagaagcagaagggactggccgtggaggtaggcgaagattttaacattaaggtcatattcagcactctcctgggtatgaaaggaactcagcgagatcctgaagccttcttggtccagatcgtgtccaaaagccagctcccgagtgagaatagagagggaaaagttctgtggactggatggttttgctgtgtgttcggagacagcctgctggagacagtaagcgaggatttcacttgcttgccactcttcttagccaatggcgccgaaagtaacaccgccataatcggaacatggtttcagaagacctttgattgctacttctctcccctcgcgataaacgcattcaacttatcttggatggcagccatgtggacagcttgtaagatggaccattatgtcgcaactactgagttcctgtggagcgtgccttgttctccgcaatccctcgacatctccttcgccatccacccagaggatgccaaggccctttgggattcggtgcacaagacaccgggcgaggtgacccaggaggaggtggacctttttatggactgcctgtactctcatttccatcggcatttcaagatccacctgtccgctaccaggctggtgagagtttccacttctgtggcttctgcccatacagacggcaagatcaaaattctgtgtcacaagtacctaattggagtgctggcttacctgacggagctggccatcttccagattgaatag

SEQ ID NO: 182430 - DNA, 615 bp, Artificial Sequence
  Description of Artificial Sequence: Synthetic coding sequence
atggacgagaccgtggccgagttcatcaagcggaccatcctgaagatacctatgaacgaattgacgaccatcctcaaggcatgggactttctctccgagaatcagttacagactgtcaattttaggcagagaaaagagtccgttgtgcagcacctgatacatctctgtgaagagaagagggcgtcaatttccgacgctgcattgttagacatcatttacatgcaattccaccaacatcaaaaagtctgggaggtgtttcagatgtcaaagggcccgggcgaggatgtggacctcttcgacatgaaacagttcaaaaactcatttaagaagattctgcaaagagcacttaaaaacgtgactgtgagctttagagagactgaagagaacgcagtctggatccgcattgcgtggggaacacaatatacaaaacccaatcagtataagccaacatatgtagtttactactcccaaactccctatgccttcacctctagtagcatgctgagacgaaacactccattgctgggccaggagttagaggctaccggcaagatctacctgaggcaggaagaaattatactcgatattaccgaaatgaaaaaggcctgcaactag

SEQ ID NO: 182431 - DNA, 1020 bp, Artificial Sequence
  Description of Artificial Sequence: Synthetic coding sequence
atggacgagaccgtggccgagttcatcaagcggaccatcctgaagattcccatgaacgagctcacaaccatcctcaaggcttgggattttctctctgaaaatcaactgcagaccgtgaattttagacagcgaaaggagagcgtcgtgcagcatttaatccacctttgcgaggagaaacgggcgagcattagtgacgcagccttgctggatatcatatacatgcagttccaccagcaccagaaagtgtgggaggtgtttcagatgagtaagggtccaggcgaggatgtggacctgtttgatatgaagcaattcaaaaattcttttaagaagattctccagcgtgctcttaaaaatgtgaccgttagtttcagagagactgaggagaacgcagtctggatacgtatcgcctgggggactcaatacaccaaaccaaaccaatacaagcccacctatgtcgtgtattactcgcagaccccatacgccttcactagcagtagcatgttacgaaggaacactcccctcctcgggcaggcccttactatcgctagcaaacaccaccaaattgtgaaaatggacctgcgcagcaggtacctcgatagtctcaaggctattgtctttaagcagtacaaccagacatttgagactcataatagcacaaccccattgcaggagaggtccctggggctggacattaatatggatagccggattatccacgagaacattgtggaaaaagagagagtgcagcggatcacgcaggaaaccttcggggattacccacagccacagctagaatttgcccagtacaagctggagacgaaatttaaatctggcctgaacgggtccatcctggctgagagagaggagccattgcggtgtctgattaaattctcctctccccacttgttggaggcactgaaatcccttgcgccagctgggatcgcagatgcgccccttagccctctgctcacctgcattccgaataaacgcatgaactactttaagatccgcgacaagtag

SEQ ID NO: 182432 - DNA, 918 bp, Artificial Sequence
  Description of Artificial Sequence: Synthetic coding sequence
atggacgagaccgtggccgagttcatcaagcggaccatcctgaagatccctatgaacgaactgacaaccatcctgaaggcctgggacttcctgagcgagaaccagttacagaccgtgaactttagacagaggaaggagtctgtcgtccagcacttgatccacctttgtgaggagaagcgcgccagcatctcggacgcagctctgctcgacatcatctacatgcagttccatcaacaccaaaaggtgtgggaggtgtttcagatgagcaaggggcctggagaagacgtggacttgttcgatatgaaacagttcaaaaacagctttaaaaaaatactccagcgagcgttgaaaaatgtgacggtaagtttccgggagaccgaagagaatgcagtctggatccggattgcctggggcacacagtacaccaagcctaaccaatataaacccacatacgtggtgtactatagccagacaccatatgcatttacctcatctagcatgctacgccgcaacactccactgcttggtcagacctttgagacccacaacagtactactccgctccaggagagaagcttgggactcgatatcaatatggacagcagaatcatccatgagaacatcgtcgagaaagaaagggtacagcggattacacaagagactttcggcgactatccacagccccagttggagttcgcccaatataaattggaaacaaaatttaaatctgggctgaatggttcgattctcgccgagcgtgaggagcctctacgctgcctgattaaattctcatcgccccatctgttggaagccctcaagagccttgcccctgccgggattgccgatgctccgctctctcctcttctcacttgcatcccaaacaagcggatgaattatttcaagatccgcgacaaatag

SEQ ID NO: 182433 - DNA, 960 bp, Artificial Sequence
  Description of Artificial Sequence: Synthetic coding sequence
atggacgagaccgtggccgagttcatcaagcggaccatcctgaagatccccatgaacgagttgaccaccatcctgaaagcctgggattttctgtccgaaaaccagttgcagaccgtgaatttccgccagagaaaagagtccgtggtccagcacttaattcatttgtgcgaagagaaacgggcaagtatttctgatgcagccctgttggatattatctgtgaagacgttgatctgttcgacatgaaacaattcaaaaactcctttaagaagatcctgcagagggcactcaagaacgtgacagtatcttttagggaaacggaagagaatgctgtttggattcgtatagcgtggggcacacagtatacaaaacctaaccagtacaaacctacttatgtagtgtattactctcaaacaccctacgcgtttacatcctcctctatgctgcggcgcaatacccctctgttaggtcaggccctgactattgcttcaaagcatcaccaaatagtgaaaatggacctaagatctaggtacctggatagtttgaaagcaatcgtgttcaagcaatataatcaaacgtttgaaacccacaatagcacgaccccacttcaggagagatctctgggcctggatatcaatatggacagtagaattatccacgaaaatatagttgagaaagaacgtgtccaaagaatcacacaagaaactttcggagattacccacaaccacagcttgagtttgcccagtacaaattagagacaaagtttaagagcggtttgaacggatccattttagccgagagagaggagcctctgagatgcttgataaagttctcgtccccgcacctgctggaagcgctgaaaagccttgctccggccggaattgccgatgctcccctttcacccctgctaacgtgtattccaaataaacgtatgaattattttaagatcagggataaatag

SEQ ID NO: 182434 - DNA, 1062 bp, Artificial Sequence
  Description of Artificial Sequence: Synthetic coding sequence
atggacgagaccgtggccgagttcatcaagcggaccatcctgaagatccctatgaacgaactaacgaccatcttgaaagcttgggacttcctctcagagaatcaactacagacagttaattttcggcaacgtaaggagtctgtggtacagcatctgatccatctctgcgaagagaaacgagcttctattagtgacgccgcgctgctggacatcatttatatgcagttccatcaacatcagaaagtctgggaggtgtttcagatgtctaaagggcctggcgaagacgtggatctgtttgatatgaagcagttcaaaaatagcttcaaaaagatcctccagcgtgccttaaagaatgtaactgtatcattcagagagaccgaagaaaacgccgtctggatcaggattgcgtgggggacccagtacaccaagcctaatcaatataagcccacatacgtcgtctactactcccagaccccgtatgcctttacaagctcatctatgctgcgtcgcaatacgcccttactcggacaggctctgactattgcatccaaacatcaccagattgtgaaaatggatttgcgatcgagatatctggattcactgaaagctatcgtcttcaaacagtacaatcaaacatttgagacacataatagtacgacgcctcttcaggagcggtcactgggactggacatcaacatggattcccggataattcatgaaaatatcgttgagaaggagcgtgttcagcgaattacccaagagacttttggggactacccccagccacagctggagttcgcccagtacaagctagaaacgaaattcaagtccgggctgaatggctctatattggcagaaagagaagagccactgaggtgcttaattaagttttccagtccacacctgctggaggcgctgaagagtctggctcccgccgctctggtgtgccggatccagaaacttctctgctattctggttcacattcccaagggactcaagatcctagctcttggcagaaggatctatatctgctgttcgttcctctatacccgcgttgttag

SEQ ID NO: 182435 - DNA, 903 bp, Artificial Sequence
  Description of Artificial Sequence: Synthetic coding sequence
atggagcaggccaaccccctgcggcccgacggcgagagcaagggcggtgtgttggcccatttggagcgcctggagactcaggtgtcacggtctcggaagcagagtgaagagctacagtctgtccaagcgcaggagggagctctgggtacgaagatccacaagctccgcaggctgcgcgacgagcttcgtgccgtcgtgcgacatcggagagcaagcgtgaaggcctgcatcgcaaacgtagagcccaatcaaactgtggagattaacgagcaagaggccctcgaagaaaaattggagaatgttaaagccatccttcaggcttaccactttacaggcctttcaggcaagctgacgagcaggggcgtctgcgtttgcatatccactgcgtttgaaggcaacctcctggacagctactttgtcgacctggtaattcagaagccactacgaattcaccaccactcagttcccgtttttattccactcgaagagatcgctgccaagtatcttcagaccaacattcagcatttcttgttcagcctttgcgagtacctgaatgcgtactcaggacgtaagtaccaggctgatagactgcagagcgacttcgccgctctgctgacaggccctttgcagcgaaatcccctatgtaacctgttatcttttacctacaaactcgatccgggagggcagtcttttcccttctgcgctagactgctctataaggacctgactgcaacccttccaacagatgtgaccgtgacctgccagggcgtggaagtcctcagtacctcttgggaggaacagagagccagccatgaaaccctattctgcaccaaacctttgcaccaggtgtttgcctccttcactaggaaaggggaaaagcttgatatgtctttggtcagttag

SEQ ID NO: 182436 - DNA, 903 bp, Artificial Sequence
  Description of Artificial Sequence: Synthetic coding sequence
atggagcaggccaaccccctgcggcccgacggcgagagcaagggcggcgttctcgcccatctggagcgcctggagacgcaggtctctcgtagtcgaaagcagagcgaagagctccagagcgtgcaagcccaggagggggccttggggacgaagatccataagctgcggagactgcgggacgaacttcgagcagttgttcgccacaggcgcgcctctgttaaggcatgtatagccaatgtggagcccaatcagacagttgagataaatgagcaagaggccctggaagagaagctggagaacgtaaaagccatacttcaagcctatcatttcactggcctgtctggcaagcttacctctagaggggtgtgcgtgtgcatctcgacagcttttgaagggaaccttcttgactcttatttcgtcgatttggtcatacaaaaaccacttcgtattcaccaccatagcgtgcctgtatttatcccccttgaggagatagctgcaaagtacctgcagaccaatattcagcatttccttttttcattgtgcgagtatctcaatgcttactccgggagaaaatatcaagcagatagactgcaaagcgattttgccgcactgctcaccggcccactccagagaaacccactgtgtaacctgctgagctttacctacaagctggacccgggaggccagtcctttccgttctgcgctcgcctgctgtacaaggatttaaccgccacattacccaccgacgtgactgtgacgtgccagggggtggaggtgctcagcacgtcctgggaggaacagcgagcatctcatgagacccttttttgcacaaaacccttacaccaagtcttcgcctcttttacccgtaagggtgagaagctggatatgtctcttgtgtcttag

SEQ ID NO: 182437 - DNA, 885 bp, Artificial Sequence
  Description of Artificial Sequence: Synthetic coding sequence
atggccggcatcctggccagcggcctgggcgtgctggcccacctggagcgccttgaaacacaggtaagccgctcgagaaaacagagtgaagagctgcaaagtgttcaggctcaagaaggggccctgggaacaaagatccacaagctgaggcgtttgagggatgaactgagggctgtggtcagacatcggcgagcctcggtgaaggcgtgtattgccaatgtggaaccgaatcagacagtggagatcaacgagcaggaggccctcgaagagaagctcgagaatgtcaaggctatactgcaggcctaccattttacaggcctcagcggcaaactgacaagccgtggggtatgcgtgtgtatttcaaccgcctttgagggcaacctactggattcatacttcgtggatctcgtgatacagaaaccattaaggattcatcaccacagtgtgccggtttttatccctctagaagaaattgcagccaagtatctgcaaaccaacatccagcactttctcttttccttgtgcgagtacctcaacgcttacagcggacgcaaatatcaagcagaccgcctgcagtccgactttgcggccctgctaactgggccgctgcaaaggaacccactgtgcaacctcctaagtttcacttacaagctggaccctggggggcagagcttccccttctgtgctcggctcctgtataaagacctcaccgctactttgccaacggacgttaccgtgacctgccagggggtggaggttttgagtacgtcatgggaggaacaaagagctagtcatgaaacattgttctgcacgaagcccctgcatcaagtgtttgcaagctttacacggaaaggcgagaagctggacatgagcctggtgtcctag

SEQ ID NO: 182438 - DNA, 309 bp, Artificial Sequence
  Description of Artificial Sequence: Synthetic coding sequence
atgcaggagaagtaccccgacgccgtgtacctgagcgagggccccagtagctgctcaatgggcataagatccgcaagccgcccaggctttgagctggtgattgtgtggcggatccagattgacgaagacgggaaggtgtttcccaagctggacctcctcaccaaggttccccagcgagccctggagctcgataagaaccgggccatcgaaactgctcccctgagctttcgcaccctggtcggactgcttgggattgaagctgcgctggaatctctgattaagagcctctgtgccgaggagaacaactag

SEQ ID NO: 182439 - DNA, 348 bp, Artificial Sequence
  Description of Artificial Sequence: Synthetic coding sequence
atggaggcccccagctggagcgtgctgcagcggagcggcgacgaggagaagtaccccgatgccgtgtatctctctgaaggaccttcgtcatgcagcatgggaatacgctccgccagccgacctgggttcgagctggtgatcgtgtggaggatccagatagatgaggatggcaaagtgtttccgaagctggacttgctcaccaaagttccacagcgggctctggaattggacaagaatcgggcgatcgagacagctcctctgagtttccggactctggtgggtctcctgggcatagaggctgccctcgagtctctgattaagtccctgtgtgccgaggagaacaattag

SEQ ID NO: 182440 - DNA, 867 bp, Artificial Sequence
  Description of Artificial Sequence: Synthetic coding sequence
atggacgccgagctggccgaggtgcgggccctgcaggccgagatcgccgcactcaggcgcgcttgtgaggaccctccagccccttgggaagagaagtccagagttcagaaatcatttcaggctattcaccagttcaacctggagggctggaagagctctaaagatctcaagaaccagctgggccaccttgagtcagaactgagcttcctgagcacattgactggaattaatatccgcaaccattctaagcaaacagaagacctgacgtcaacagagatgacagagaaatccatcaggaaagtactccagagacacaggctgtcaggtaactgtcatatggtaacgtttcagttggaatttcagattctggagatccagaataaggaacggctttcttcagcggtgactgatttaaatattatcatggagcctacagagtgttccgagttgtcagagtttgtcagccgcgccgaagaacgaaaggacctgttcatgttctttagatccctgcacttctttgtggaatggtttgaatacagaaaaagaacctttaaacaccttaaggaaaagtatcccgatgcagtctacctctcggagggaccttcctcctgttccatgggcatccgctctgcctcccgcccggggttcgaattggtgattgtatggagaatccaaattgacgaggacggtaaagtgtttccgaagctggacctgctgacaaaagttccacaaagggctctcgaactggacaagaacagggcaattgagactgccccattgtcattcaggactctggttggactgctgggaattgaggctgccctggaaagcttgatcaagagcctgtgcgctgaagaaaacaattag

SEQ ID NO: 182441 - DNA, 744 bp, Artificial Sequence
  Description of Artificial Sequence: Synthetic coding sequence
aagcgggccggccggagcgacagctgcgccgccggccccgccgccgtaagcaatgcaccctggacccagagctggcagcgctgtgcgccatgcaagttacggagcaggccttgtggagagcgcgtgagaacgcatcgcaggcccggcaaacgaagtcctgaaagcagcatcaggaaagtgctccagcgccacaggctctcaggcaattgccatatggtgacattccagttggaatttcaaattttagaaattcagaacaaggagcgcctatcctcagctgtgaccgatctcaatatcatcatggagccaactgaatgctccgagctatcggaatttgtctcaagggccgaggaaagaaaggacctgttcatgtttttccggtctttgcattttttcgttgagtggtttgaataccggaaaaggacatttaagcacttaaaagagaaataccctgacgcagtgtatctgagtgaaggtccgtctagctgtagtatgggtattcgtagtgcatctaggcctggattcgaattagtgatagtctggagaatccagattgatgaggatggtaaggtgttcccaaagctagacctgctcacaaaggtgccgcaacgtgccctagagctcgacaaaaacagggccatagagaccgcccctctcagctttcgcaccctagtgggcttgttgggcatcgaagccgctctggaaagcctgataaaaagcttgtgtgcagaggaaaacaactag

SEQ ID NO: 182442 - DNA, 807 bp, Artificial Sequence
  Description of Artificial Sequence: Synthetic coding sequence
atgagcggcaaggccaacgccagcaagaagaacgcccagcagctgaaacggaatcccaaaagaaagaaggacaacgaagaggtcgtgctctccgaaaacaaggttcgaaacacagttaaaaagaacaagaatcatttaaaggacttatcctcagaaggtcagacaaagcataccaacctgaagcatgggaagaccgctgccagcaagagaaaaacatggcagccattgagtaagagtacaagagaccatctccagacaatgatggagtccgtaataatgaccatcttgagcaacagtataaaagaaaaggaggagatacagtaccaccttaatttcttgaaaaagcggctgttacagcagtgtgagactttgaaggttccccccaagaaaatggaggatctgaccaatgtaagctctctgctgaatatggaaagagccagagataaggccaatgaggaaggcctggctctcttgcaggaggaaattgacaagatggttgaaactacagaactgatgactggtaacatccaatctctaaagaacaagatccagatccttgcttctgaggtcgaagaagaggaagagcgagtcaagcagatgcaccagattaactctagtggcgttctcagcctaccagaattatcacagaaaacactgaaagctccgactttgcagaaagaaatactggcgctcattcccaaccaaaatgcattactaaaagacctggacatcctgcataatagttctcagatgaagtcgatgtctacctttattgaagaagcctataaaaagttagatgcatcctag

SEQ ID NO: 182443 - DNA, 807 bp, Artificial Sequence
  Description of Artificial Sequence: Synthetic coding sequence
atgagcggcaaggccaacgccagcaagaagaacgcccagcagctgaaaagaaacccgaagaggaagaaggataatgaggaggttgttctgagcgagaataaggtacggaacactgtgaagaaaaataagaatcacctcaaagaccttagttcggagggccagacaaaacacaccaacctaaagcacggaaaaactgccgcttcgaaaagaaagacatggcagcctttgtctaaaagtaccagagaccacctgcagaccatgatggaatctgtgattatgactatactcagcaactcgatcaaagagaaagaggaaatccagtatcatttaaacttcttaaaaaagcgcctgctccagcagtgcgagaccctcaaggtaccgcccaagaaaatggaagatctcactaacgtttcaagcttactaaacatggaacgggcccgcgacaaagcaaacgaggagggattagcactgctacaagaggagattgacaaaatggtggagacaaccgaattaatgaccggcaatattcagtccctaaagaataaaatccaaatattagcctcagaggtggaggaggaggaagagcgcgttaagcaaatgcaccagattaattcgtctggtgtgctgtctctcccggagcttagtcagaaaacactgaaggctccgaccctgcagaaggagattctagctttgatccctaaccaaaacgctctacttaaggatctggatatcctgcataatagttcacaaatgaaatccatgtctacctttatcgaggaggcttataagaagctagacgcgtcctag

SEQ ID NO: 182444 - DNA, 384 bp, Artificial Sequence
  Description of Artificial Sequence: Synthetic coding sequence
atgggcgacaagcccatctgggagcagatcggcagcagcttcatccagcattattatcaacttttcgacaacgacaggactcagctcggagcgatctatatcgacgcttcctgcctgacgtgggagggccagcagttccagggaaaagctgctatcgtagaaaagctctcatcccttccgttccaaaaaatccagcattctattaccgcacaggatcatcagcccaccccagactcctgcataatcagtatggtggtggggcagcttaaggcagatgaggacccaatcatgggctttcatcaaatgttccttcttaaaaacatcaacgacgcctgggtttgcactaacgatatgttcaggttagccctgcataattttggatag

SEQ ID NO: 182445 - DNA, 786 bp, Artificial Sequence
  Description of Artificial Sequence: Synthetic coding sequence
atgagctggtgctgcctgtggctgtgcctgagcagcgtgggccggaccggttctgccggaccctcactgcccttttccgaactgtgcagcctcggcctcctgagactccgccccgtcttctcaccgttgcacagtggccccggcaagcccgcacaattcctagccggcgaggcagaagaagttaacgcatttgccctcggcttcctgtccacctccagtggcgtaagtggggaagacgaagttgagcctttgcacgacggcgtcgaggaagctgagaagaaaatggaagaggagggcgtgagcgtgagcgaaatggaagctactggggcacaaggcccttcacgcgtagaggaagccgaaggccacaccgaagtgacagaggccgaaggctcccagggcaccgccgaggcggatggcccaggggctagctcaggcgacgaagacgcttcaggtagagcggcttcccctgagtcggctagttctacacctgagagtctgcaggcccgcagacatcaccaatttttggagccagctccagcacctggcgcagcagtgctgagttccgagccagccgagccacttctggttagacatccgcctaggccccgcaccacaggtcctaggccacggcaggaccctcacaaggccggactcagtcattacgtcaagctcttctccttctatgccaagatgccaatggagcgaaaagcccttgaaatggtagagaaatgcatttttgtcatgatttggcgatatcttctcttaatgctggccgcgagactgtag

SEQ ID NO: 182446 - DNA, 1686 bp, Artificial Sequence
  Description of Artificial Sequence: Synthetic coding sequence
atggccgaccacaaccccgacagcgacagcaccccccggaccctgctgcggagagtgttagacacagccgacccccgcacaccgaggagacccaggagcgcccgagctggcgcaagaagagctctccttgaaacagctagtccacgcaagctcagcggacagactaggaccattgcgagaggccggtcccatggcgcgcgcagcgtgggtcgctcagctcatattcaggcttccggccacctagaggagcagaccccaaggacactgcttaagaatattctgctgaccgccccggaatcctccatcttgatgcccgaatctgtggttaagccagtgcctgctccacaggccgtccagcctagcagacaagaaagctcatgtgggtcactggagctgcagctgccggagctcgagccccctacgaccctggcccctggcttactggcccccgggagacgcaaacagcgtctgaggttgtccgtgttccagcagggggttgatcagggactgtctctaagccaggaaccccagggtaacgctgacgctagctccctgacgcggtcactaaaccttaccttcgcgactcctctgcagccccagagcgttcagagacctggattggcgagaaggcctcctgccagacgcgcagtcgacgtaggagctttccttcgtgatttgcgggacactagtcttgcccccccgaatatcgtgttagaggacacccaacccttttcccagcccatggtggggagccccaacgtatatcacagtttaccctgcacaccccacacaggagcagaagacgccgagcaggccgcagggcgtaaaacccagtcatcagggcctggcctccaaaaaaacagtcctggaaaacccgctcagttcctggccggggaggctgaggaagtaaatgccttcgctttggggtttttatcaacctccagcggcgtgtccggcgaggacgaggtggagccactacacgacggagtcgaggaagccgagaaaaaaatggaagaggagggtgtgtcagtgagcgaaatggaagcaacgggggcacagggacctagcagagtcgaagaagccgagggccacaccgaagtcaccgaggccgaaggttcccagggaaccgccgaagccgatggcccaggcgcgagtagcggggatgaggacgcctcgggcagggccgcctcacccgaatctgcctcaagcacccctgagtccctgcaagccagacggcaccaccagttcttagaacccgcgccagccccaggcgcggctgtgttgtcctcagaacctgcagagcccttgttggtgcgccaccccccacgccctcgcacgacgggcccacgccccaggcaggacccccacaaggcggggttgagccactacgtaaaactgttctcattttatgctaaaatgcctatggagaggaaggctttagagatggtcgaaaaatgccttgacaaatactttcagcacctgtgtgacgacctggaagtcttcgcggctcacgccgggcggaaaacagtgaaaccagaggatctggagttgttgatgaggcgacagggcttggtaaccgatcaggtgtccttgcacgtgctggtggagcggcaccttcctctggagtaccgccaattgctaatcccgtgtgcttattccgggaacagtgtcttccccgctcagtag

SEQ ID NO: 182447 - DNA, 447 bp, Artificial Sequence
  Description of Artificial Sequence: Synthetic coding sequence
atgcccgagagcgtggtgaagcccgtgcccgccccccaggccgtgcagccctcacgtcaggaaagcagttgcgggtcgctggagctacagttacccgaactggagccgcctactactctggccccagggttactcgctcccgggaggaggaagcagcgactgcgcttgagtgtatttcagcaaggggttgaccagggcctgtctcttagtcaagaacctcagggtaacgctgacgcgagctcactaacaaggtccttgaacttgactttcgcgacacccctccaaccacagtcggtgcagcggcccggactcgccaggagacccccagcccggagagcggtcgatgtaggagccttcttaagagaccttcgtgatactagccttgcccccccctctaaagtgggctttagtcctgctggtctgtggggaaagcttagcccgctctag

SEQ ID NO: 182448 - DNA, 1686 bp, Artificial Sequence
  Description of Artificial Sequence: Synthetic coding sequence
atggccgaccacaaccccgacagcgacagcaccccccggaccctgcttcgcagggtgctcgacactgcagacccaaggacacctcgccggccgcgatctgcccgcgccggcgcacgaagggcgctattagaaaccgcaagtccaagaaaattgtctggtcaaacccgcactattgcgagaggacgcagccacggcgcgagaagtgtgggccggtctgcacacattcaagcttccggtcacttggaagagcagacaccacgcaccctgttgaaaaacatactgttgacagctccagagtcgtccatcttaatgccagagagcgtggtaaagcctgttcccgccccccaagctgttcagcccagtcgacaggagtccagctgtggctcccttgagcttcagctgcctgagctagagcctcctactaccctcgctcctgggctactcgcaccaggaaggcgtaaacagagacttcggctcagtgtgtttcagcagggtgtggatcaaggacttagcctgtcccaggagccccaggggaacgcagatgcttcaagcctgacacggagtctgaacctaacttttgcgactcccctgcagcctcagtccgtgcagcgccctggcttggcgcgtcgcccccccgctcgtcgcgctgttgacgtgggagctttcctgcgagacctgagagacacttccctggccccacctaacattgttttggaagacactcagccatttagtcagcccatggtgggctctcctaatgtgtatcactcactaccctgcaccccacacactggagccgaggacgcagaacaggctgcaggcaggaagactcaatcgagtgggcctggtctgcaaaagaactcacctggaaagccagcgcaattcctggccggcgaagccgaggaggtgaatgcgtttgcactaggctttttgtctaccagctccggcgtgtcaggggaagatgaggttgaacccttgcacgatggggtcgaggaggcagagaaaaagatggaagaggagggtgtctctgtctcagagatggaagcaacaggcgctcaagggccttcacgcgtggaggaggctgagggtcacactgaggtgacagaggcagaaggctcacaggggacagccgaagccgacgggcctggagccagcagcggcgacgaggacgcatcaggtagagccgcttctcctgaaagcgccagtagcacccccgagtcactccaggcaaggaggcatcaccagtttcttgagcctgcacctgctccgggagccgcagtcttatcttctgaacctgctgaaccacttctcgtcaggcaccccccccgcccaaggactaccggccctaggcctcgccaggacccccataaggccggtctgtcacactacgttaagctgttttccttctacgccaagatgccaatggaacgcaaagcgctagagatggtggaaaagtgcctcgacaagtacttccagcacctatgcgatgatttggaggtgttcgcggcccatgctggccgcaaaaccgtgaaacctgaggacctcgaactcttgatgaggcgacagggcctggtgactgatcaggtgtccctgcacgtgctggttgagcggcacctcccactcgagtaccggcagctgctgatcccctgtgcatactccggcaatagtgttttccccgcccagtag

SEQ ID NO: 182449 - DNA, 819 bp, Artificial Sequence
  Description of Artificial Sequence: Synthetic coding sequence
atgcggcggagccggagcagcgccgccgccaagctgcggggccagaagagatccggggcatctgccgcccccgccgcatcagccgcagccgccctggctccatcagccacccggaccaggaggagtgcaagtcaggctggatctaagtcccaagctgtggaaaaacctccatctgaaaagccacgcctgaggaggtcctctcctcgtgcgcaggaagagggtcccggcgaaccacccccccctgaactggctctacttccgccccctccccccccccccccaacgcccgcaacaccgacttcgagtgcatcgaatctcgatttaggcgagcagcgggaaaggtgggagactttccaaaaaaggcagaagttgactagcgagggagccgctaaactgctgctggacacttttgaatatcaaggactcgtaaaacatacaggcggatgtcattgtggagccgtgaggttcgaggtatgggcatcggccgatctccacattttcgactgtaattgtagcatttgcaaaaagaagcagaaccggcatttcatcgtgcccgcttcaaggttcaagcttctgaaaggcgctgagcatattacgacgtatacattcaacacgcacaaggctcaacatacattctgtaagcgatgcggcgtgcaatccttttatacccccaggtcgaaccccggcgggtttgggatcgctccccactgtttggacgaaggtacggtgcgatcaatggtaacagaggagtttaacggttccgactgggagaaagccatgaaagaacataagaccattaaaaatatgtcaaaggagtag

SEQ ID NO: 182450 - DNA, 2961 bp, Artificial Sequence
  Description of Artificial Sequence: Synthetic coding sequence
atggtgagcaagagcgaccagctgctgatcgtggtgagcatcctggaaggcagacacttccctaagaggcctaaacacatgctggtcgtcgaggccaaattcgacggagagcagctggctaccgatcctgtggaccataccgaccagcctgagtttgcgacagaactggcatgggagattgatagaaaggccctgcaccagcacagactgcagagaacacctatcaagttgcagtgctttgccctggaccccgtcaccagtgcaaaagagaccattggctatatagtgctggatctccgcaccgctcaggaaactaagcaggccccaaaatggtaccagctcttgtctaacaaatacactaagttcaaatcggaaattcagatatctatagctctggagaccgataccaaacccccagttgactcttttaaggccaaaggagcaccaccgcgggatgggaaggtgcccgccattctcgccgggcttgacccgagggacatcgtagccgtgctgaacgaggagggcggataccatcaaattggccccgccgaatattgtacagactccttcattatgtccgtaaccatcgccttcgccactcagctagagcagttgatcccgtgcacgatgaagcttcccgagcgacaacctgaattttttttctattattcccttctcggcaacgacgtgaccaacgaaccttttaatgacctaataaaccccaacttcgagcctgaacgcgcatcagtgcgcatacggtcaagtgtggagattctgcgagtctaccttgcccttcagtcaaagctgcagattcacctgtgttgtggagaccagagtctaggatcaacagagatccctcttacggggctcctcaagaaaggcagcacagagatcaaccagcacccagtcaccgtcgagggggctttcaccctggacccgcccaaccgggccaagcaaaagctggcgcctattcctgtcgagctggcaccaaccgtgggcgtgtctgtggctcttcagagggagggaatcgactcacaatccctcatcgagttgaagacccagaatgaacacgagcctgaacattcgaagaagaaggtactaacccctattaaggagaagactctgacgggacccaagtctccaacggtttcccctgtgccaagccacaaccaatccccccccacaaaagatgacgctaccgaaagcgaggtggagagtctgcaatatgataaagacaccaaacccaatccaaaagcaagttcgtccgttcccgccagccttgcacagctggtgaccactagcaacgcttccgaggtggcaagcgggcaaaaaattgctgtgcccgctactagtcatcacttctgtttctccattgaccttcggagcattcatgccctggagattggattccccattaactgcatcctgcgatattcctatccctttttcggtagcgctgctccaatcatgaccaacccaccagtggaagtccgcaagaacatggaggtgtttctcccccagtcctactgtgcgtttgactttgcgactatgcctcaccaactgcaggacacttttctccgcataccgctcctcgtagaactgtggcacaaggataagatgagcaaggatctcttactgggtatagccaggattcagctgtcaaacatcctcagcagcgagaaaacaagattcttggggtccaacggcgagcagtgctggcgccagacctacagtgaaagtgtgcctgttatcgcggctcaggggagcaacaatcggatcgctgacctctcctacaccgtgaccctggaggattatggcctggtgaaaatgagggagatctttatatccgatagctcccagggagtgagcgctgttcagcagaagcctagtagtttgcctcccgctccttgtccatctgaaatccagactgaaccacgcgaaactctagaatataaagcagccttggaattagaaatgtggaaagaaatgcaggaggacatttttgagaatcaattaaagcagaaagagctggcgcacatgcaggccctggccgaggagtggaaaaaaagagaccgcgaaagggaatcacttgtgaagaaaaaggtggccgaatataccatcctggagggcaaactgcagaagacactaattgatctcgagaaacgagagcaacagctagccagcgttgagagcgagctgcagagagagaagaaggagttgcagagcgagcggcaaaggaatctacaggaactccaggactctatcaggcgggccaaggaggactgtatccatcaagtggaactggagcggctgaaaatcaaacaattagaagaagataaacatcgattgcagcagcaacttaacgacgctgagaataagtataaaatcttggagaaagagttccagcaattcaaggatcagcagaacaacaagcccgagattcgtctgcagagcgagatcaatctcctgaccctcgagaaggtagaactagaaagaaagcttgaaagcgccaccaaatctaaattgcactataaacaacaatggggaagagccctgaaagagctcgctaggctgaaacagagagagcaggagtctcagatggccaggctcaaaaaacaacaggaagagctggaacagatgcgcctccggtaccttgcagccgaggaaaaggacaccgtcaaaactgagcgacaggagctgctggatattagaaatgagctgaaccggctccgacaacaggaacagaagcagtaccaagacagtacagaaatcgcaagcggcaaaaaagatggccctcacggtagcgtgcttgaggagggcctggatgattatctgactagactgattgaagaacgcgatacactgatgcgcacaggtgtctacaatcacgaggataggatcatatccgagctcgatcggcagattcgggagatcttggcaaagagtaatgcaagcaactag

SEQ ID NO: 182451 - DNA, 2883 bp, Artificial Sequence
  Description of Artificial Sequence: Synthetic coding sequence
atgctggtggtggaggccaagttcgacggcgagcagctggccaccgacccggttgaccataccgatcagccggagtttgccaccgagctggcttgggagatcgacaggaaggcattgcatcagcacaggctgcagcggactcctatcaaactacagtgttttgctctggacccagtgacttccgctaaagagactatcgggtacatagtgctcgacttacggacggctcaggaaacaaagcaagctcctaagtggtatcagctgttaagcaacaaatataccaagtttaagagtgagatccagattagtatcgctttagaaacagacacaaagccaccggtggactctttcaaggccaaaggagcccctcctagggacggcaaagtgccagcaattctggctgggcttgaccctcgcgatattgttgccgtactcaacgaggaaggggggtaccatcagatcgggcccgctgagtactgtacagattcgttcatcatgtccgtcactatcgcatttgccacacaactggagcaacttatcccttgtaccatgaaactgcccgagcgccaaccagaatttttcttctactactccctgttaggaaacgacgtgaccaacgagcccttcaacgacttgattaacccaaacttcgaaccagaacgggcaagcgtgcggattcgatcctccgtagaaattctgcgtgtgtatttggcgctgcaaagtaaattgcaaattcacctttgctgcggtgaccaatccttggggtcaactgagatccccctgactggactgctgaagaaagggtctacggagatcaaccagcaccctgtcactgtcgaaggggccttcacactggaccctcccaatagagccaagcaaaagctggctcccatccccgtcgaactggctcccaccgtgggtgtctcggtcgctctacagagggaggggatagatagccaaagcctcatcgaactgaagactcagaatgagcatgagcctgagcactctaagaagaaggtgcttacgccaatcaaggaaaaaactctcacaggccctaagtcacctacagtcagcccggtgccaagtcataaccagtctccacctacaaaggacgatgccaccgagtcagaagtagaaagcctacagtacgataaggacacgaagcctaatccgaaggcaagtagcagtgtgccggcctcactggctcagctggtgactaccagtaatgcctccgaagtcgccagtggccaaaaaatcgccgtcccagccaccagccatcatttctgtttcagcattgatctccgctccatccatgccctggagattggtttcccgatcaattgcatcctgagatacagttatcctttcttcgggtctgccgctccaattatgacaaatccaccagtggaggtgcggaagaatatggaagtgtttctgccacagtcatattgtgcatttgactttgccactatgccacaccaactccaagataccttcctccgtattcccctgctggtcgagctgtggcacaaggacaaaatgtctaaagacctcctgctcggaatcgcaaggatccagctttctaacattctctcaagcgagaagacacgcttcctcgggtcaaatggtgagcagtgctggcgacagacatatagtgaaagcgtccccgtgatagcagcccagggttctaacaatagaatcgccgatctgagctatacagtgacactggaggattacggcctggttaagatgcgcgaaatttttatctctgactcatcgcaaggcgtcagtgctgtgcaacagaagccaagtagcctgccgcctgccccctgtcccagcgaaattcaaacagaacctagagagaccctcgagtacaaggccgccctggaactcgagatgtggaaggagatgcaagaagatatttttgagaatcagctcaagcagaaggaattggcccacatgcaagctctcgcagaggaatggaagaagcgggaccgggagagagagtccctggtcaagaagaaggtggcggaatataccatcttagaaggtaagcttcagaaaacattgatcgatctggaaaagcgagagcagcaactggcctccgtcgaaagcgaactgcagagagagaagaaggaattgcagagcgagcgccagcgcaacctgcaagagctgcaagattccatcaggagagccaaggaggactgtattcaccaggtcgaactcgagagattgaaaattaaacagctggaagaggacaaacacagacttcagcagcagctcaatgacgcagagaataagtacaagatcctcgaaaaggagtttcagcaattcaaggatcagcagaacaataagcccgagatcagacttcagagtgagatcaacttgctgacgttggagaaggttgagctagaacgaaagctcgagtcagcgacaaaatccaaactacattacaagcagcaatgggggagagctttgaaggaactggcccggctcaagcagcgggaacaagaaagtcagatggcaaggttgaaaaaacagcaggaagaactggagcagatgaggctcagatacctcgccgcagaagagaaggatacagtcaagactgagagacaggagttgctggatattcgaaacgagttgaatcggcttcgccagcaagaacagaagcagtatcaagatagcacggagattgccagtgggaagaaagatgggccgcacggatcagtcctggaggaagggctcgatgattatttgacccgcctgatcgaagagcgggatacccttatgaggaccggagtttacaatcacgaggacagaatcatctctgagctggataggcagatcagggaaatcctcgcaaaatctaacgcctctaattag

SEQ ID NO: 182452 - DNA, 2961 bp, Artificial Sequence
  Description of Artificial Sequence: Synthetic coding sequence
atggtgagcaagagcgaccagctgctgatcgtggtgagcatcctggaaggccgacattttcctaagcggcccaagcatatgctggtcgtggaagccaagtttgacggcgagcaacttgctacagatcctgtcgaccataccgaccagcctgagtttgcaactgagctcgcttgggagattgaccggaaagctctccaccagcatcgactgcagcgcacccccatcaagctgcagtgcttcgcattagatccagtgacctcggctaaggagactattggctatatcgtgctcgatttgcggaccgcacaggaaactaaacaggcccccaagtggtaccaactgctgtccaataagtatacaaagttcaaatcagagattcagatctcgatagcactggagaccgataccaaaccccccgtggactctttcaaagcgaaaggagctccaccacgggatggtaaagtgcctgccattctcgcagggctggatccacgggacatcgtagccgtgttaaacgaggagggaggataccaccagatcgggcctgccgaatactgtaccgactctttcatcatgagcgtgactattgccttcgctacccagttggagcagcttataccgtgcacgatgaaactcccagaaagacagcccgaattttttttctactatagcctcttaggcaacgacgttaccaacgagcctttcaatgatctgattaatccaaacttcgagccagaaagagcgagtgtgcggattcgctcttcagtagagattctgcgagtctacctagccctgcagtctaagctacagatccacttgtgttgtggtgaccaatctctggggtcaactgagatcccccttaccggactattgaagaagggcagcactgaaatcaaccagcacccagttactgtggaaggcgcctttacactcgatcctcccaaccgcgcaaagcagaaactcgctccaatccccgtcgagctggcacctactgtgggcgtttctgtggcactgcagcgtgagggaatagacagccagagcctgattgaactcaagacccaaaatgagcacgagccagaacattctaagaagaaggttctgacgcccattaaggaaaagactttgacgggaccaaagtctcccactgtttcacctgtacccagccacaaccagtctccccctacaaaagatgatgctacagagtcagaagtcgaatcccttcagtatgataaagacaccaagccaaaccctaaagcttctagttcagtgccagcgtctctcgcacagctggtgacgacctctaacgcctccgaggtagctagtggccagaagatagcggtccccgccacaagccaccacttttgcttctctattgatctccgttcaattcatgccctggagatcgggttccctatcaactgcattttgagatatagctatccattcttcgggagtgcagcccctatcatgactaatccacccgtcgaagtgaggaaaaatatggaagtgttcttaccccaatcttactgtgcattcgactttgccaccatgccacaccagctccaggacacttttttgcgtataccgctgctggtggagctgtggcataaggataaaatgtccaaagatctattgctgggaattgcccgaatccagctcagcaatattctgtcctccgaaaaaacccgatttctggggagcaatggagagcagtgttggagacaaacttattccgagtcagtcccagtaattgccgctcaaggctcaaacaaccgcattgccgatcttagctacactgttacactggaagactatgggctggtaaaaatgcgcgagatctttatctctgactcttctcagggcgtgagcgccgttcagcaaaagcccagctctctgccccccgccccgtgtccttccgaaattcagacagagccacgcgagacacttgagtataaagcagcactggaactggaaatgtggaaggagatgcaggaagacatctttgagaatcagctcaagcagaaagaattggcccacatgcaggcccttgccgaagagtggaagaagagagacagagagcgagagagtctagtgaagaagaaggtagccgaatacaccatactcgagggcaagctgcaaaagacgctgatcgatttggagaagagggagcaacagctcgccagcgttgaatccgagctccagagagagaaaaaagagctgcagagcgaaaggcagcgtaacctccaggagcttcaggactccatacggagggcaaaggaagactgcattcatcaagttgaactagaaagactgaaaattaagcaactggaggaagacaaacataggcttcagcagcaactgaacgacgctgagaataagtacaaaatactcgagaaggagtttcaacaattcaaagatcagcagaacaacaaacctgagatccgtctgcagtccgagatcaacctgttgaccctggaaaaagtcgagctcgagagaaaactggagtcagccacgaaatccaaactacactacaaacaacagtggggtagagctttaaaggagctggcaaggctgaaacagagggagcaagaatcacaaatggcgcgcctgaaaaaacagcaggaggagttagaacagatgcggttaaggtaccttgccgccgaagagaaagatactgtgaaaacagagaggcaggaattactcgacatccggaatgaactcaatcgcttgcgacagcaagaacagaagcagtatcaagatagcacagagatcgcctctggaaaaaaggacgggccacacggatcagtgctggaggaagggttggatgattatctgaccagacttatcgaagaaagagacactctcatgagaacaggtgtgtacaaccacgaggatagaatcattagcgagctagaccggcagatacgggagattttggcaaaaagtaacgcctctaactag

SEQ ID NO: 182453 - DNA, 1143 bp, Artificial Sequence
  Description of Artificial Sequence: Synthetic coding sequence
atggtgagcaagagcgaccagctgctgatcgtggtgagcatcctggaggggcggcactttccgaagagaccgaagcacatgctggtggtggaggccaagtttgacggggaacagttagcgactgaccccgtggatcataccgaccaacctgaatttgcgaccgaattagcttgggagattgatagaaaagcactgcaccaacacagactgcagcgcacgccaattaagttgcagtgctttgcactggaccccgtcacatcggctaaggaaactatagggtatatagtgttagacctaaggactgcgcaggaaaccaaacaagcacctaagtggtatcagctgctgagcaacaagtatactaaattcaaatctgagattcaaattagcatcgccctagagaccgacaccaagcctcccgtggacagtttcaaggccaagggggctcctcctcgggacgggaaagttcctgctatacttgctggcttggatcctcgcgatatagttgctgttttgaacgaggaaggggggtatcatcaaatcgggcctgcagaatattgcaccgacagctttattatgtcagtgaccatcgcgttcgctactcaactggaacagctgatcccctgcacaatgaagttgcctgagaggcagccggagttcttcttttactacagtcttctcggcaatgacgttacaaacgaaccttttaacgacttgatcaatcccaactttgaaccggagcgtgcttccgtgcggatccgttcctcagtggagatactacgggtctatctggccctgcaatccaagctgcagatccatctctgctgcggcgaccaatctctggggtccaccgaaatccccctgacagggctgctcaagaagggaagtaccgagataaaccagcaccctgttacggtggagggcgcatttaccctggatcccccaaatcgagctaaacaaaaattagctccaattcctgtagaattggctccgactgtgggggtgtcggtggcactacagcgggaggggatagattctcaggacgccttctggtattccgcgctggatatcatcttcccactttttatctttctttttttggtactggacgcaattcgaaaattcgcgaattacgaggagaaatag

SEQ ID NO: 182454 - DNA, 3828 bp, Artificial Sequence
  Description of Artificial Sequence: Synthetic coding sequence
atgagcctggacttcggcagcgtggccctgcccgtgcagaacgaggatgaagaatacgacgaggaggattatgagcgcgaaaaggagctacaacagctgctgacggacctcccccacgatatgctggatgatgacctgagtagccctgaactgcagtatagtgattgcagcgaggatgggaccgatgggcagccccatcatcccgaacagctggaaatgagctggaacgaacagatgctgccaaagagccagtcggtcaatggcccatcctgccagggtcttgaaccttacaataaagtcacctataagccataccagagcagtgcccaaaacaatgggagccccgcccaggaaataaccggcagcgacacctttgagggtctgcagcaacagtttctgggcgcaaatgagaacagtgcagagaatatgcaaataatccagcttcaggttctcaataaggccaaggaaaggcaactggaaaacttaatcgagaagctgaacgaatcagaacgccagatacggtacctgaatcatcagctggttattatcaaggatgagaaggatggactgaccctctctttgcgagagtcacagaaactatttcagaatggcaaagaaagagagattcagctggaggctcaaataaaagctctggagacacaaattcaggctctgaaagtcaatgaagagcagatgattaaaaaaagccgtaccactgagatggctcttgagtccttaaagcaacagttagtcgacctgcaccatagtgaaagtctgcagcgggcaagagagcagcacgagtctatcgtaatgggtctcaccaaaaagtacgaggaacaagtgttatcactccagaaaaacttagatgccaccgttacagccctgaaggagcaggaggacatttgcagtcggctgaaggaccacgtgaagcaactcgaacgaaaccaggaagcaattaaattagagaaaaccgaaatcattaataagcttacgagaagcctggaagaatctcagaaacagtgtgcacatctcctacagtccggcagcgtgcaggaggtcgcccagcttcagttccagctgcagcaggcgcagaaagcccacgccatgagtgctaacatgaacaaagccctacaggaagagctgacggagttaaaagatgagattagcctctatgaaagtgcagccaaactgggtatccacccctcagattctgagggcgagctgaatatcgagctcaccgaatcttacgtagacctcgggattaagaaggtgaattggaagaagtctaaagtgactagcatcgtgcaagaagaggacccaaacgaggagctgtcaaaagacgagtttatcctaaagctcaaggcggaagttcagcgcctgctgggtagcaatagtatgaagaggcacctggtgagccagttgcagaacgatctgaaagattgtcataagaaaatcgaggatcttcatcaagtcaaaaaggacgaaaagagcattgaagtggaaaccaaaactgacacttctgagaagcccaaaaatcagctctggcctgaatcatccacatcagacgtggttagggacgatatcctgctcctgaagaatgaaatacaggtactacaacagcagaatcaagagctgaaggaaacagagggcaagctccgaaacaccaaccaagatctgtgcaaccaaatgagacaaatggtccaggactttgatcacgacaaacaggaggcggttgataggtgtgagcggacatatcagcagcaccatgaggctatgaaaacacagataagagaaagcctgttggcaaaacacgctctagaaaaacagcaactgttcgaggcctacgagagaactcacctccagctgagatctgaattagacaagctgaacaaagaggtgactgctgtccaggaatgttatttagaagtgtgccgcgaaaaggacaacctggagttaacactgagaaaaaccacggagaaagaacagcagacacaggagaaaataaaggaaaagctgatacagcagctggagaaagagtggcagtccaagctggatcaaacgatcaaagcaatgaagaaaaagaccctggattgcggtagccaaaccgatcaagtgaccaccagcgacgtgatttcaaaaaaagaaatggccattatgatcgaagagcaaaagtgcactattcagcaaaacctagaacaggagaaggatatcgctatcaaaggcgcaatgaaaaagttggagatcgaactagagctgaaacactgcgaaaatataaccaagcaggtggaaatagccgtgcagaacgcccaccagaggtggctcggcgagctcccagagttggccgagtaccaagcgctggttaaagccgaacagaaaaaatgggaagagcagcacgaagttagcgtcaacaagagaatcagctttgcagtcagtgaggcaaaggaaaaatggaaatctgagcttgagaacatgagaaaaaacattctccccgggaaggagttggaagaaaagatccactcccttcagaaagagctagaattgaagaacgaagaagtaccagtggtgattagagctgaacttgccaaagcccgcagcgaatggaacaaagagaagcaagaagagatccacagaatacaggagcagaacgaacaagactaccgccagtttcttgacgaccaccgcaacaaaatcaatgaagtgcttgcggctgcaaaggaggatttcatgaagcagaagaccgagctgctcctccagaaggagaccgaactgcagacttgccttgatcaaagccgccgtgagtggacgatgcaggaggctaaacggattcaactggagatttatcagtatgaagaggacatactcaccgtgctgggcgtgctcctgtccgacactcaaaaggaacacatttctgacagcgaagataagcaactgctggagatcatgagcacatgctcatcgaaatggatgagcgtacaatatttcgaaaagctcaaaggatgtatccagaaagcttttcaagatacactccctctcctggtggagaacgcagatccggaatggaaaaagagaaacatggccgagctgtccaaggacagcgcatcgcagggaacaggccagggggatcctggccctgcagccggacatcacgcccagccactcgcattgcaagcgactgaagccgaagctgataagaagaaggtcctggagatcaaggacttgtgctgcggtcattgcttccaggagctggagaaagctaaacaggagtgtcaagatttgaagggcaagcttgagaaatgctgcagacacttacagcatcttgagagaaaacacaaggccgtcgtggaaaagataggggaagaaaacaacaaggtggtcgaggagctgattgaagagaacaacgatatgaagaacaagctcgaggagctgcagacactgtgcaagaccccaccccgcagtctttcagctggcgctatcgagaacgcttgcctgccttgttctggcggtgccctcgaagagctacgcgggcaatatattaaagccgtgaagaaaattaaatgtgacatgcttcgctatattcaggaaagcaaagaaagggctgccgagatggtcaaagccgaggtattgcgggagagacaggaaacggcgaggaaaatgcgaaagtactatctcatctgcttgcagcagattttacaggatgatggaaaggagggagccgaaaaaaagataatgaatgcagcctcgaaattggccactatggcgaaattactggaaacaccaataagtagcaagtcacagtcaaaaacaactcagtctggcatgtccaagtag

SEQ ID NO: 182455 - DNA, 5133 bp, Artificial Sequence
  Description of Artificial Sequence: Synthetic coding sequence
atgagcctggacttcggcagcgtggccctgcccgtgcagaacgaggatgaggaatacgacgaagaggactacgaaagagaaaaagaactacaacaattactgacagatctgcctcatgatatgctcgacgacgacttgtcctctccagagctgcagtactcagattgctccgaggatggtactgatggacagccacatcatccggagcagctggaaatgagttggaacgaacagatgttacccaagagccaatctgtcaacggttataatgagatccagagtctctatgccggagagaagtgcggaaatgtttgggaagaaaatcggagcaaaaccgaggatagacatcctgtgtatcacccagaggaagggggtgatgaaggcggaagtggctactcaccaccatcgaagtgcgaacagacggacctttaccaccttccagaaaacttccgcccatatacaaatgggcagaaacaagagttcaataaccaggctactaacgtgatcaaatttagcgacccacagtggaatcattttcagggaccttcttgccagggtcttgaaccgtacaacaaagtaacctacaagccgtaccagagcagcgctcagaacaacggctccccagcccaagaaatcacggggtctgatacgtttgagggtctacagcagcagtttctgggcgccaacgagaatagtgcagaaaatatgcagatcattcagttgcaggtgcttaataaggccaaagaacgtcaactggaaaacctcatcgagaagttaaatgagagcgagcggcaaattcggtacctcaatcatcagctggtcatcattaaagatgaaaaagacggcctcacactcagcctgcgtgagtctcaaaagctcttccagaatggcaaggagcgagagatacagctggaagcacagataaaggccctggagacccagatccaggcactgaaagttaatgaggaacaaatgatcaagaagtcacgcacaactgagatggccttggagagccttaagcagcagctggtggacctgcatcactccgaatccctgcagagagcccgcgaacaacacgagagcatcgtgatgggattaactaaaaagtacgaggagcaagttctgagccttcagaagaacctggacgccaccgttacagctttgaaggagcaggaggatatttgttctagactaaaagaccatgtcaagcagctggagagaaatcaggaggctatcaagttggagaaaacagagattataaataaactcacaagatcactggaggagtctcaaaaacagtgtgcccacttgcttcaaagtgggtcggtgcaagaagtggctcagctccaattccagctgcagcaggcccaaaaagctcatgctatgtccgccaatatgaataaggccttgcaggaggagctgactgaactgaaggatgagatttcactatatgaatcggccgcgaagctgggcattcacccctccgattctgagggagaactcaacatcgagctcactgaatcctatgtagatctgggtattaaaaaagtgaattggaagaagtccaaagtgacaagcatagtacaggaagaagaccctaatgaagagctgagtaaagatgagttcatcctgaaactaaaagcagaagtacagcgtctgctgggtagcaacagcatgaagcgtcacctcgtatcccagctccaaaatgacctcaaagactgccacaagaagatagaagacttgcaccaagttaagaaggacgagaaatccattgaagtggagactaaaacagatacaagcgagaagcctaagaaccagctctggcctgagagtagcacctctgatgtggttcgtgacgatatcctcttgctgaagaatgaaattcaggttctgcagcagcagaatcaagagttgaaggaaacagagggcaagctgagaaatacgaaccaggatctctgtaatcaaatgagacagatggtacaagatttcgatcacgacaagcaggaggccgtcgatagatgcgagcggacctatcagcaacatcatgaggccatgaaaacgcaaattcgagagtcccttttagcgaagcacgccctggagaagcaacaactcttcgaagcctatgagaggacacatcttcagctgcgatctgaattggacaagctgaataaagaggtcacggcagttcaggaatgctacctggaagtgtgccgggagaaggataacttggaacttaccctgcggaagactaccgagaaagaacagcagactcaggagaaaattaaggagaagctgatacagcagcttgagaaagaatggcaaagcaagcttgatcagaccattaaagctatgaagaagaaaaccctagactgcggatcacagacagaccaggtcacaacctcggacgttatctctaagaaggagatggcaatcatgattgaagagcaaaagtgcaccattcagcagaacctcgagcaggagaaagatattgctatcaaaggggcaatgaagaagctggagattgaacttgaactcaagcactgtgagaatataacaaagcaggtcgagatcgcagtgcagaacgcgcaccagcggtggctaggggagctcccagagctggctgagtaccaagccttagtcaaagccgaacagaaaaaatgggaggaacaacacgaggtgtccgtgaataaaagaatatcgttcgctgtttctgaggctaaagagaaatggaagtccgagcttgagaatatgcgaaagaacatcttgcccggcaaagagctcgaagaaaaaattcattcattacagaaagagctggagctgaaaaatgaagaggtccccgtggtgatcagagcagagctggccaaagccagaagtgagtggaacaaagagaaacaggaggaaatccatcggattcaggaacaaaacgaacaggactatcggcagtttttggatgaccatcggaataaaatcaatgaggtgttggccgctgccaaagaagactttatgaaacagaagacagagcttctcctccagaaagagacagaattgcagacttgcctcgaccagagccgccgagagtggaccatgcaggaagcgaaaagaatccagctggagatatatcagtatgaggaggacatcctgaccgtgctcggagtgcttttgagcgatacccaaaaggaacatatctcggatagcgaggataagcagttactggagattatgagcacttgttcttccaagtggatgtccgtccagtatttcgaaaagctgaaaggttgcatccagaaggccttccaagatactttgcctttgctcgtcgagaatgctgaccctgagtggaaaaaaaggaatatggcggaactgtcgaaggattctgcatcccaaggcaccggtcagggagatcccgggcccgctgcgggccaccacgctcagcctttggcgcttcaggccactgaagctgaagccgataaaaagaaagttctggagattaaggatctgtgttgcggccactgttttcaggaactcgaaaaagccaagcaggagtgtcaggacctcaaaggcaagctggagaagtgctgccggcacttgcaacacctggagcgcaagcataaggccgtagtggagaagattggagaggagaacaacaaagtcgtggaagaactcatagaagaaaacaacgatatgaaaaacaaactggaagaattgcagactttgtgcaagacacccccacgctccctgagcgccggggcaatcgagaacgcgtgtctgccctgctccggcggtgctctggaagaactgagaggccagtacattaaagctgtgaagaaaataaagtgtgacatgttacggtacattcaggaatcgaaagagagagcagctgagatggtgaaggctgaagtgctgcgcgagaggcaagagacggctagaaagatgcggaagtattacttaatctgtctgcaacagatcctgcaggacgatgggaaggaaggggcggagaaaaaaatcatgaacgcagcatctaaacttgcaaccatggccaagctgttagagacccctatttcttcaaagagccagagcaagacaacccagagtgccctcccccttacctcggagatgctgatcgctgtgaaaaagagtaaacggaatgatgtgaaccaaaagataccctgctgcatcgagagcaagagtaatagcgttaataccatcactaggacactttgtgagcaagctcccaagcggcgcgccgcatgcaatctgcagagactgttggagaactcggagcaccagtctatcaaacatgttgggagtaaggaaactcatctcgaatttcagttcggtgacggatcctgtaaacacttaaatagcctgcctagaaacgtatcacctgaattcgttccatgtgagggagagggagggttcgggctacacaaaaagaaggatttgttgagcgataatggatctgagagtctccctcactccgcagcctatccctttctggggactcttggcaacaagccctcaccacggtgtacccccgggcccagtgagagcggatgcatgcacatcacattcagggattcaaatgaacgcctgggactgaaagtgtacaagtgcaacccgctgatggagtccgaaaacgcggcttccgagaaatctcaggggctggacgtccaggagcctccggtgaaagacggtggagacctttcagattgcctgggctggccaagctcctctgccacgctatctttcgatagtagggaagcgtcgtttgttcatggtcgcccccaaggcacgcttgagattcctagcgagagcgtgaagtcaaagcagttctcaccatctggctacctcagcgacactgaggaaagtaatatgatctgccagacaatgaagtgccagaggtaccagaccccctatttgtctgaggagacaacatacttggaacccgggaagatcagcgtgaactgcggccacccaagccggcacaaggccgacagacttaaatctgacttcaaaaagctgtcgagcaccctcccatcgtcagtatgtcagcagccatcgcggaagctcatcgtacccctgagttctcaacaagacagcggcttcgactcaccctttgttaatctggactag

SEQ ID NO: 182456 - DNA, 4965 bp, Artificial Sequence
  Description of Artificial Sequence: Synthetic coding sequence
atgagcctggacttcggcagcgtggccctgcccgtgcagaacgaggacgaggagtacgacgaagaggattacgagagagagaaggaactccagcagttacttactgatttaccccatgatatgttggatgatgatctgtcaagccccgaactccagtactctgactgttccgaagacgggacggacggacagccacaccaccctgaacagctcgagatgtcctggaacgagcagatgctgcccaaaagccagtccgtgaatggctataacgagatccagtccctgtatgctggagaaaagtgtggaaacgtgtgggaagagaatcgctccaagaccgaggaccgccatccagtctatcacccggaggaggggggcgatgaggggggctccggttactctccgccaagtaagtgtgagcagactgatttataccatctccctgagaactttaggccatacacgaatggccaaaaacaggaattcaataaccaggcaacgaacgtgattaaattttccgatccacagtggaatcattttcagggcccaagctgccaggggctggagccttataacaaagtaacctataaaccgtaccaatcgtcagcccagaacaatggatcgcccgctcaggagatcactggttctgacaccttcgaaggtcttcaacagcagtttctcggggcgaacgagaattccgccgagaatatgcagatcatccagcttcaggtgctcaataaagcgaaagagcgacagcttgagaatctaatcgaaaaactcaatgagagcgagcgacagatccggtacctgaatcaccaactggtcatcataaaagacgaaaaagatggcttaaccctctcgctgcgcgaatctcagaagctcttccagaatggtaaagagagggagatccagttggaggcacagattaaagcgctagagacacagatccaagccttaaaggtgaatgaggagcagatgatcaaaaaaagtcgcaccactgagatggcgctggagtctctgaaacagcagttagtggacttgcaccatagtgagagccttcagcgggcaagagagcagcatgagtctattgtcatggggcttaccaagaagtacgaggagcaggttctgtcactgcaaaaaaacctggatgcaacagtgactgcactcaaggagcaggaagatatctgttctagacttaaggaccacgttaagcagcttgaaaggaatcaagaggccatcaaactggaaaagacagagattatcaataaactgaccagatccctggaggaatcacagaagcagtgcgcacacctcttacaaagcggttctgtccaggaggtagcccagctgcagttccaacttcaacaggctcagaaagcgcatgctatgtcggccaacatgaacaaagcactgcaggaggagttgactgagctgaaggacgaaattagcttatacgagtcagctgctaaactgggcatccatcctagcgactcagaaggagaacttaacatcgaactgacagaatcctatgtcgacttgggcatcaagaaggttaattggaagaagagcaaagtcacaagcatagtccaagaggaagacccaaacgaagaactgagcaaggacgaattcatattaaagctgaaagcagaagtgcaaagactcttggggtcaaatagtatgaaaagacatctcgtctctcagctccaaaatgatcttaaggactgccacaagaaaattgaagacctacatcaagtgaaaaaagatgagaagagtatcgaggttgaaacaaagaccgacacttcggagaaacctaagaatcagctgtggccagaaagtagtacttccgacgtcgttcgcgatgacatcctcctgctaaagaacgagatacaggtgctgcagcagcagaaccaggaactaaaggagaccgaaggcaagctcagaaacactaaccaggacctctgcaatcagatgaggcagatggtgcaagacttcgatcatgataagcaggaagctgtggataggtgtgagaggacgtatcagcagcatcatgaggccatgaagacacaaatccgggaatcattgttggctaagcacgctctggaaaagcaacagctgttcgaagcctacgagagaacccacctccagttgcgtagtgagctcgacaagctaaacaaagaggttacagctgtgcaggaatgctacctagaggtgtgcagggaaaaggataacttggagctcacgcttaggaagaccactgagaaggaacagcaaacccaggaaaaaatcaaggagaagctgattcagcagttggagaaggaatggcaatcaaagctcgatcaaacaattaaagcaatgaagaaaaaaacgctagactgtggaagccagactgatcaggtcactacctccgacgtcatcagcaagaaggagatggccattatgatcgaagaacagaaatgtaccatccagcaaaacttagagcaagaaaaagatatcgccattaaaggtgccatgaagaagctggaaatcgagttggagctgaaacattgcgagaacatcaccaaacaggtggagatcgctgttcagaacgctcaccagcgatggctgggagagttgcctgaactggctgagtatcaagccttggtgaaagcagagcagaaaaaatgggaggaacagcacgaagtgagtgtcaataaacgaatatccttcgcagtgtcagaagccaaggaaaagtggaaatccgagctagaaaatatgaggaagaatatcctgcccggtaaagagctggaggagaagatccactcacttcagaaagaattagagctgaaaaatgaggaagtgcccgtggtgatccgcgctgagctggctaaagcccgctccgagtggaataaggagaagcaagaagaaatccacagaatccaggagcagaatgaacaggactatcggcagttcttagacgatcaccgcaataaaatcaatgaagtcctcgccgccgcaaaagaagattttatgaaacagaagaccgagctgctactgcagaaagaaacggaactgcagacttgtctagaccagtctagacgggaatggaccatgcaggaagccaagagaattcagttagaaatttatcagtatgaggaggatatcctaaccgtcttaggagttcttctctccgacacccagaaggaacatattagcgactctgaagacaaacagttgctcgagatcatgagcacgtgtagttctaaatggatgagcgtgcagtacttcgaaaaacttaaagggtgtatccaaaaagcctttcaggatactcttcccctgttggttgagaatgctgaccctgaatggaagaagagaaatatggctgaactgtcaaaggattccgcctctcaggggacagggcaaggggatcctggccctgcggctggccatcacgcccagcctctggcgctccaggcaaccgaagccgaggccgaggaaaacaataaagtcgttgaggagttaattgaggagaataacgatatgaagaataaattggaggaactacaaaccttatgtaaaactcctccacgctccctttctgcgggcgccatcgaaaacgcctgtctcccgtgtagcgggggtgctctggaagaattgcggggtcaatacatcaaagccgtgaaaaaaatcaaatgcgacatgttgaggtatatccaggagagcaaggagagggctgctgaaatggtcaaagccgaggtccttagggaaaggcaggaaactgcacggaagatgaggaagtactaccttatctgccttcaacagattctgcaggatgacggtaaagagggggccgaaaagaaaattatgaacgccgcctcgaagctagccaccatggcaaagctgttagaaacgcccatctctagcaagtcgcagagcaaaacgacacagtcggcccttccactgacctcagagatgttgatcgcagtaaagaagtcaaagcgcaacgacgttaatcaaaagattccttgctgtatagagtcaaagtccaatagcgtcaatactatcacccgtaccctctgcgagcaggcgcccaagcggcgggctgcatgtaatctgcaacggctattagaaaactccgagcaccagtctattaagcacgttggtagcaaggagacccacctagagttccagttcggagacgggtcatgtaagcatctcaatagcttgcctagaaatgtgtcacccgaattcgttccttgcgaaggtgagggtggatttgggctgcataagaagaaggacctgctttctgataacggcagcgagagcctcccacatagcgcagcttacccattccttggtacactgggaaacaagccaagtccacgatgtaccccagggccgtccgaatccggttgcatgcacatcacgttcagggactccaatgagcgcctgggcctcaaagtttacaagtgcaaccctcttatggaatctgagaatgccgcaagcgaaaaatcccagggcctggacgtccaggagccaccggtaaaagatggaggcgacttgagtgattgcctaggatggccgtctagctccgctaccctttcgtttgactcaagagaagcctcatttgtgcacggacggcctcaagggacattggaaatcccttctgagagcgttaaaagtaaacagttctcaccgagcggttatctgtccgatacggaggagtcaaacatgatctgccaaaccatgaagtgtcagcgctatcagactccctacttgagcgaggaaaccacctatctcgagccaggcaagataagcgtaaactgtgggcacccttccagacacaaagctgatagacttaaatccgacttcaaaaaactgagctccacgttgccatcgagtgtctgccagcaacctagtcggaaactgattgtccccctgtcctcacaacaggactctggtttcgactccccattcgtgaacttggactag

SEQ ID NO: 182457 - DNA, 1779 bp, Artificial Sequence
  Description of Artificial Sequence: Synthetic coding sequence
atgagcctggacttcggcagcgtggccctgcccgtgcagaacgaggatgaggaatatgacgaggaggactacgagagagagaaggagctgcagcaattgcttactgatttgccgcacgacatgctcgatgacgacctgtccagtccagagctccaatactcagactgttcagaggatggaaccgacggccagcctcatcacccagagcagcttgaaatgtcttggaatgagcagatgcttccaaagagccaatctgttaacggttataacgaaattcagtccctgtacgccggcgaaaagtgtggtaacgtgtgggaggaaaacaggtccaagaccgaggatcgacaccctgtttaccaccctgaggaggggggtgacgagggtggctcaggctatagccctccctctaaatgtgagcagacggacttgtatcatctgccagagaactttagaccgtatactaacggccagaaacaggagtttaacaatcaggcaacaaatgtcattaagttttcggatcctcagtggaatcactttcaaggaccgagttgtcaaggcctcgagccatacaataaggtgacatataagccttaccagtccagtgctcagaacaatggtagcccagcccaggagatcactggctccgatacgttcgagggtcttcaacagcagttcttaggcgccaacgagaattctgctgagaacatgcagattattcagttgcaggttctgaacaaggccaaagagagacagttggaaaatctgatcgagaaactgaacgaaagcgagcgccagattaggtatctcaaccatcagcttgtgattataaaagatgaaaaggatggccttacccttagcctgcgggagagccaaaaactgttccagaatgggaaggaaagagagatccagctcgaagctcaaataaaggcgttagagacccagatccaggctctgaaagttaacgaagaacaaatgataaaaaagagtagaacgacagagatggcattggagtcactcaaacagcagttggtcgatttacatcattcggaaagccttcagcgggccagggagcagcatgagtctattgtgatgggcttgacaaagaagtatgaggaacaagttctgagcttgcagaagaacctggatgctaccgtgaccgctctgaaggaacaggaggatatctgctctcggcttaaggaccatgtgaaacaactggagcgaaatcaggaggccatcaaactggaaaaaacagagattataaataaactcactagaagtttggaagagagtcagaaacagtgcgcacatctccttcaaagtggctcggtgcaggaagtggcacagttgcaatttcagcttcagcaggcccagaaggctcacgctatgtccgccaacatgaataaggcgctgcaggaggagctcactgagttgaaagatgagataagtttgtacgaatcagcggctaaactgggtatccacccctctgatagcgaaggcgagctgaacatagaactaactgagagctatgttgacctgggtatcaaaaaggtcaactggaagaaaagtaaggttacatcaatagtgcaggaagaggatcccaacgaagagctgagtaaggacgaatttatactgaagttgaaggcagaggtgcagaggctcttgggatccaactctatgaagcgtcacctggtttctcagctgcagaatgatctcaaagactgccataaaaagatcgaggatctgcaccaagtcaagaagaagaagaagaagaaaaaatag

SEQ ID NO: 182458 - DNA, 207 bp, Artificial Sequence
  Description of Artificial Sequence: Synthetic coding sequence
atgagcctggacttcggcagcgtggccctgcccgtgcagaacgaggacgaggaatacgacgaggaggattatgagcgcgagaaggagcttcagcagcttctgaccgatctgccacacgacatgctggatgacgatctcagctcccctgaattacagtatagcgattgctccgaggacgggaccgacggacagccacaccatccatag

SEQ ID NO: 182459 - DNA, 4755 bp, Artificial Sequence
  Description of Artificial Sequence: Synthetic coding sequence
atgagcctgaccagctggttcctggtgagcagcggcggcacccggcatcgccttccaagagagatgatcttcgtcggacgtgatgactgtgagcttatgttgcagtcgagaagtgttgacaagcagcatgccgtgataaattacgatgcaagtactgatgaacacctcgtgaaagatctgggatctctgaacggcacatttgtgaatgatgtgagaattccggagcagacctatataaccctgaagctcgaagacaaactgcgtttcggctacgatacaaatttattcactgtcgtgcagggcgagatgagagttccagaagaggcactcaagcatgaaaaatttacaatacagttgcagctcagtcagaaatccagcgagtccgagctgtcaaagtcagcgtccgccaagtccattgacagcaaagtggccgatgctgccaccgaggtgcagcataaaacaaccgaagcgctgaaatctgaggagaaggctatggacatctctgcaatgcctcgtgggaccccattatacgggcaacccagttggtggggcgatgatgaagtggatgaaaagagagctttcaaaactaatggcaaaccagaggagaaaaaccatgaagccgggactagcgggtgcggaatagacgccaaacaagttgaggagcagtccgccgccgcaaacgaagaagtgttgtttcccttttgtcgcgaaccctcatactttgagattcctactaaggaattccagcagccgtcacaaattactgaatcaactatccacgaaattcccaccaaggatactcccagctcccacataacgggagccggacacgcctcttttaccatcgagtttgacgatagtaccccggggaaagtgacaatccgcgaccatgttacaaagtttacctcggatcagcgccataaatccaagaaaagttcccccggaactcaggacctccttggcatccaaactgggatgatggctcccgaaaataaggtggctgattggctcgcccagaataaccctccccagatgctgtgggaacgaacggaggaagactctaaatcaattaaaagtgatgtgcccgtgtacctgaaaaggctgaaggggaacaaacatgacgacgggacccagagtgactctgagaacgccggggcacaccgcaggtgctctaagcgcgcgaccctcgaggagcatctgaggcggcatcattccgaacacaaaaagttacagaaggtccaagcaaccgagaaacaccaggatcaagctgtaacaagctctgcccaccacaggggggggcatggcgtgccccatggcaagttgctaaaacagaagtccgaagagcctagtgtgagtataccctttttacagacggccctgctgagatcaagcggaagcttaggacaccgaccatctcaagaaatggacaagatgctaaaaaatcaggctacttcagccacttccgagaaagacaacgatgacgatcagtctgataaggggacttacaccatagagttagagaaccccaactccgaggaggtcgaagctcgcaagatgatcgacaaggtgttcggcgtcgatgataaccaggactacaacagacctgtgatcaacgagaagcacaaggacctgataaaggattgggccctgtcctcagctgctgccgtgatggaagaacggaagcccttaacaacatctgggtttcatcactctgaggaagggacttcttcttccgggagtaagagatgggtgtcccagtgggccagtttggccgctaatcacactcggcatgatcaggaggaaagaataatggagttcagcgccccgctccccctggagaatgagaccgagattagcgagagcggaatgaccgtacgtagtaccggatccgccacatcgcttgcctcccaaggggagagaaggaggagaaccttgcctcagctcccaaacgaggaaaaaagcctggaatctcatcgagcaaaggtcgtgacacaacgatctgaaataggcgagaagcaggacaccgaactgcaggaaaaggagacaccaacccaggtgtatcagaaagacaaacaggatgcagatcgtcccctcagtaagatgaatagggcggtgaatggtgaaactctgaaaacggggggcgataataaaacattgctccatctgggttcatcggctcccggaaaagaaaagtctgagactgataaagagacctctctagtgaaacaaactctggcaaagctacagcagcaggaacagcgagaagaggctcagtggacaccaactaagctatcttcaaaaaacgtgtctggccaaaccgacaagtgccgtgaggaaaccttcaagcaggaatcacaaccacctgaaaagaattccggccactctacttctaagggcgacagggttgcccagagcgagtccaaacgtcgcaaggccgaggaaatcctgaagtcccagacccccaagggcggagataagaaggagtcttcaaagtctctcgtgcgacaggggagttttaccatagaaaagcccagccctaacatcccaatagagttgattccccacatcaacaaacagacatctagcactccgagttcactggctctgaccagcgcaagtaggattcgggagcgctctgagtccttggaccctgattcatccatggatacaactctcatcctgaaggacacggaagctgtgatggcttttctcgaggcaaagctgagggaagataataaaaccgatgagggtccagacacacctagctacaatcgcgacaactcaattagtcccgagtcagacgtcgatactgcaagcacgatctcacttgtgacgggcgagactgagaggaaatccacgcagaaacgcaagtcctttacgtctctctataaagatcgctgcagcaccggatctccttccaaggacgtcactaaatcatcttcgagcggcgctcgagagaaaatggaaaaaaaaaccaagagtaggtctaccgacgtgggcagcagggcggacgggcgaaaatttgtgcagagttcggggcgtatccgccagccgtctgtcgatctcactgacgatgatcagacgtcgtccgtgccacattcagctatctccgatataatgtccagcgaccaggagacgtatagctgtaagccgcacggaagaaccccgctcaccagtgccgacgagcacgtgcactctaagctggagggttccaaggtgacaaagtcgaagacatctcctgtggtctctggcagctcctccaagagcacaacattgccaagacccaggcctacgcgaactagtctgttacgtcgggcccggctgggggaagcgagcgatagcgaactggcagatgcggacaaggccagtgtggctagtgaggtgtctaccacgagctctacttccaaacctcctaccgggcgtagaaacatctctcgaatcgatttgctcgcccagcctaggagaactagactgggatctttatctgcaagatcagactctgaggctacaattagtagaagctctgcctctagccgcacagccgaagctattattaggagcggtgcccggcttgtaccaagcgacaagttttccccacgcatccgagctaattccatttcccgcctcagtgatagcaaagtcaaatctatgacgtctgctcatggttctgcatccgtcaatagcagatggagacgatttccgacagactacgcctccacttccgaggacgagtttggcagtaaccgaaattcccccaagcacacacggcttcgcactagtccagcactgaaaacaacccgcctccagtcagctggatctgctatgccaacatcttccagcttcaaacatcggatcaaagagcaggaagattatattcgagactggactgcccatagggaggaaatcgccagaatctcccaggacctggcactcattgctagagagataaatgatgttgcaggagaaatcgacagcgtcacaagctcaggcaccgccccgagcaccacagtctctacagctgccactacccctggcagcgccattgatactcgggaggagctagtggacagagtgttcgacgaaagtttgaattttcgcaagatccctcctctggttcatagcaagacaccagagggcaacaatggcaggagtggagaccccagaccacaggctgctgagcccccagaccacttaaccatcacacgaaggcgcacctggagccgcgacgaagtgatgggggataacctgttgctgtcgagcgttttccaattctcaaaaaaaattaggcagtcaatagataagacagcgggtaagatacgcatcctattcaaagataaggatcggaactgggacgacattgaatcaaagctccgcgcagaaagcgaggtgcctattgtaaagacttcaagcatggagatctcatccatcctgcaggagctcaaacgcgtagagaaacagctgcaggccattaatgctatgattgaccccgatgggacattggaagcccttaataatatggggtttccctcggctatgctcccctctcctcccaaacagaagtcgtcgcccgtgaacaatcaccacagccctggccagacgccaaccctgggtcagccggaagctcgggccctacaccccgccgctgtcagcgctgccgccgaattcgaaaatgcggaatccgaggcggacttctctatccatttcaataggttcaatcccgacggtgaggaagaagacgttacagtccaggagtag

SEQ ID NO: 182460 - DNA, 4383 bp, Artificial Sequence
  Description of Artificial Sequence: Synthetic coding sequence
atgagcctgaccagctggttcctggtgagcagcggcggcacccggcaccggttaccacgagaaatgatcttcgtcggcagggacgattgtgaattaatgttacaatctcgcagtgtggacaagcaacatgccgtcattaactatgacgcctccacggatgagcacctggtgaaagaccttggcagcctgaacggcacctttgtcaatgatgtgcgtattcccgaacagacttacattaccctgaaactggaggataagcttagattcggttacgacacgaatctgttcacagttgtgcaaggagaaatgagggtgccggaggaagccttaaaacatgagaagtttacaattcagctgcagctttctcagaagagcagcgaatcagagctttccaaatctgcctcagccaagtcgattgactctaaggttgctgacgcggccactgaagttcagcacaagaccacagaggctttgaagagcgaggagaaagccatggacattagcgcaatgcctcgcggaacaccactttatggccagccctcttggtggggggacgatgaggtcgatgagaaaagagcttttaaaaccaacgggaaacctgaagaaaagaatcatgaagctggaaccagcgggtgcggcatcgacgcaaagcaggtcgaggagcagtccgccgccgcaaacgaggaggtacttttcccattctgccgagaaccttcgtatttcgagatccctacaaaggagttccagcaacccagtcagatcactgaatcaaccatccacgagatccctaccaaggacacaccatcatctcatatcacgggcgccggacacgccagttttacaatagagttcgatgactctacacccgggaaagttacaatacgcgatcatgtcaccaaattcaccagtgaccagaggcacaagagtaagaagagttccccaggcacccaggacctcctgggcattcaaaccggtatgatggccccggagaacaaggtcgccgactggttagcccagaataaccctccccagatgctttgggaaaggactgaagaggactctaaatccataaagagcgatgtccctgtctacctcaaacgcctgaagggaaacaagcacgacgacggaactcagagcgactctgagaacgctggggcgcacagacggtgcagtaagcgggccacactggaggagcatctccgcaggcatcacagtgaacacaaaaaacttcagaaagtccaggctacggagaagcaccaggatcaggctgtggtcttcggcgtggacgataatcaggactacaatagaccggtgatcaacgagaagcataaggatctcatcaaggattgggcattgagttctgcagcagccgttatggaagagcgcaagccactgacgactagtggctttcatcattcagaggagggcaccagtagttcaggttcgaaacgctgggtgagccagtgggcctccctcgccgctaaccacactcgccacgatcaggaggaaaggattatggagttcagtgccccactgccacttgaaaatgaaactgaaatatcagaaagtggtatgacagttcgctcgacgggatctgcaacatccctcgcttcgcaaggagagaggcgtaggcggacactgccacagttgcccaatgaagagaaatccttggaaagccatagagccaaggtggtcacccagcggtcagagatcggagagaagcaggataccgaattgcaggagaaggaaacacctactcaggtgtaccagaaagataagcaagacgctgaccggcctctgtccaagatgaatagagctgttaatggagaaactcttaaaactggtggtgacaataagacgctgctgcatttggggtcctccgctccaggaaaggaaaaaagcgagaccgataaggaaactagcctggtgaagcagactcttgctaagctgcagcagcaggagcagcgggaggaagcacagtggactcccaccaagctgagttcgaagaacgtgtccgggcagacagataagtgtcgggaggaaaccttcaagcaggagagccagccaccagagaaaaactcaggccacagcacatccaagggtgatcgagtggcccagagtgagagtaagaggcggaaggccgaggaaatcctgaagagccagactcccaaaggaggagacaaaaaagagtccagcaagagtcttgtccgacagggaagcttcactatcgagaagcccagcccaaacatccctattgaactcattccacacataaataagcagacttcatccacaccatcatctcttgctctgactagcgctagccgaattcgcgaacgctcagaatccttagaccctgacagtagtatggacactaccttaattctcaaagataccgaggcggtaatggccttcctagaagccaaattgcgtgaagataataagactgatgaagggcctgacaccccgtcttataaccgggataatagcataagccccgagtctgacgtggataccgccagtactataagtctggtgacaggcgaaacagagcgcaagtccacccagaagcgcaagtcttttacaagcttgtataaggatcgctgctcaaccggctcaccttccaaagatgtgacaaagtcctcatccagtggtgcacgagaaaaaatggaaaagaagacaaaatcccggtctacagatgtcggttcaagagccgatggacgcaaatttgttcagtccagcggacgtattcgccagccttccgtggatctgaccgacgacgatcaaacaagttctgtgccacattctgccattagcgatataatgtcctccgaccaggaaacttatagctgcaaacctcacggcagaactcctcttacttccgcggatgagcatgttcacagcaagctggaaggttccaaggtgaccaaaagtaagactagtccagtagtctcgggctcctcctctaaatccaccacactcccaagacccagacctactcggacatctcttttacgtagggcgcgtcttggggaagcaagcgactctgagcttgccgacgccgataaggctagcgttgccagcgaggtttccacaacctcaagcaccagcaagccgccaaccggccgacggaatatcagcaggatcgacctcttggctcagcccaggcgcactcggctgggctctctttccgctcggtccgattctgaggctaccataagccgctccagtgcttcctcaaggacggccgaggcaattatccgatccggcgccaggctggtgccgagcgataagttcagcccccgcatccgtgctaacagcattagcaggctgagtgattcaaaggttaagtccatgacgtctgcccacggctctgccagtgccttgaagacgacgcggttgcaatccgccgggtcagcgatgccaacaagctccagctttaagcaccggatcaaggagcaggaggactacattagagattggactgctcaccgtgaggaaattgcacgcatcagtcaggacctcgctctcattgcaagagaaatcaacgacgtagccggcgagatcgacagcgtcacatcaagcggcaccgctccctccactacagtgtcaaccgctgctactacaccggggagtgcgatcgatactagagaagaagtcggagacctccacggcgagatgcacaagctcgtggaccgtgtgtttgacgaaagcctgaacttccgcaaaatacctcctctggtgcatagtaagacaccagagggaaataatggacggtccggagaccccaggccccaggcagcagaacccccagatcaccttacaatcacacggaggcggacctggagtcgggatgaagtcatgggcgataacctgctcctctcctcggtttttcagttctctaagaaaatccgccagagcatcgataaaactgcaggaaaaattagaatccttttcaaggataaggaccggaactgggacgatattgaatcaaaactgcgggctgagagtgaagtgcccatcgtgaagaccagttccatggagatcagctccatccttcaggagctgaagagagtcgagaagcaactgcaggctatcaacgccatgatcgatcctgacggaaccctcgaggctttaaataatatgggtttcccttcagcaatgttgccaagtcctcccaagcagaagtctagtccggtcaacaatcaccacagtcccggacagacacctacactgggacagcctgaggccagggctctgcaccctgccgccgtctctgccgccgcagagttcgagaatgccgagtccgaagctgacttctccatacatttcaacaggttcaacccagacggtgaggaagaggacgtgaccgtccaggaatag

SEQ ID NO: 182461 - DNA, 4461 bp, Artificial Sequence
  Description of Artificial Sequence: Synthetic coding sequence
atgagcctgaccagctggttcctggtgagcagcggcggcacccggcacaggttacccagggagatgatttttgtcgggagagatgactgcgaactgatgctccaatctagatcagttgacaagcaacacgccgtgattaattatgacgcctctactgatgaacaccttgtgaaagacctgggctcccttaacggcactttcgtcaatgacgtaagaataccggagcagacctacatcactctgaaactcgaagataagttgcgatttggatatgacacaaaccttttcacagtggtgcagggggagatgagggtccccgaagaggcgttgaaacatgaaaaatttactatacagctgcagctttcacagaagtcaagtgagagcgaactgtccaagtcagcctcagccaagagcatcgatagcaaagttgctgacgctgctaccgaagtgcaacacaagactacagaggcactgaagtcggaggaaaaagccatggatatttccgcgatgccacgcggtaccccactgtacggccagcccagctggtggggagatgatgaagtggatgagaagagggctttcaagacaaatggtaaacccgaagaaaaaaatcacgaggccggcacatccggctgcgggatcgacgccaagcaggtggaggagcagtcagccgctgcaaacgaggaggtgttgtttcccttctgccgggaacctagctactttgagatacctacaaaggaatttcagcagccgagtcagattaccgagtctaccatccacgagatcccgactaaggacacccccagttctcatattacgggagctggccatgcatcctttaccattgagttcgatgatagtacaccgggtaaagtcactatccgggaccatgtgaccaaattcactagcgaccagcgccacaagtccaagaagtcatcacccggtacccaggatctgttgggcattcaaaccggtatgatggcccctgagaataaagtagccgattggctggcacaaaataatccacctcagatgctctgggagcgaacggaggaggactccaagtcaatcaagtcagatgtgcctgtatacctcaaaaggttaaaggggaacaagcacgatgacggtacgcagtccgattcggagaatgccggtgcccatcgccgctgctcaaagagagccacattggaggagcacctgcgtagacaccactctgagcacaagaagctgcagaaggtccaggcaacagaaaagcaccaggaccaggctgtcgtgttcggcgtggatgataaccaggactataatcgacccgtgataaatgagaagcataaagacttgattaaggactgggctttatcaagtgccgctgctgtgatggaagaaaggaagccactgacaactagcggattccatcacagcgaagagggcaccagctcctcgggatcaaagagatgggtctcccagtgggcaagcttggccgccaaccatactaggcacgaccaggaagagcggatcatggaattctccgcacctctgcccttggagaatgaaacggaaatcagtgagagcgggatgactgtccgctccacaggctccgctacttcgttggcaagccaaggggagagacggagacgaacattgcctcagctccccaacgaggagaagagtctggagtcccatcgggccaaggtagtgacacaacgtagtgagattggcgagaaacaggacaccgaactccaagaaaaagaaacacccacacaggtgtaccagaaggataagcaggacgcagaccgaccgctgagcaagatgaaccgcgcagttaatggtgagaccctcaagacggggggagacaacaagaccttactgcacctgggatcttctgctccaggtaaggagaagagcgagaccgataaggaaaccagcctggtcaagcagaccctggccaagctgcaacagcaggaacagcgtgaggaagctcagtggacccccaccaagctcagctccaaaaacgtgagtgggcaaacagacaagtgccgggaggagacctttaaacaggagagccaaccaccagaaaagaactcggggcattcaacttccaaaggtgatagggtggcccagtccgagagcaaaaggaggaaggcggaggaaatcctgaagtcccaaacccctaaagggggcgataaaaaagagtcatccaagagtttggttagacagggaagcttcactatcgagaaaccctcaccaaatatccctatcgaactcattccacatatcaacaaacagacgtccagtacaccaagcagcctcgccttgaccagtgcgagtcgcatccgtgagcgaagcgagtcactggatccggattcctctatggatacaaccctcattcttaaggacactgaggcagttatggccttcctggaggcaaaactccgagaggacaataagaccgatgaaggtcccgacactccctcatacaaccgtgataattccattagtccagagtctgatgtggataccgcctcaactatctccctggtcaccggagagaccgaaagaaagtccacccagaagcggaagtcttttacctccctctataaagataggtgtagtactggaagcccctcaaaggacgtaactaagtcaagcagttccggagccagggaaaagatggaaaagaagaccaaatccaggtccactgatgtgggctcccgcgccgacggtcgcaaattcgtgcagtcctctggtcggattcgccaaccatctgtggatttaacagacgacgaccaaacaagcagcgttcctcattcagctatcagcgatattatgtccagcgaccaagaaacgtacagttgtaagccccacgggagaacccctcttacaagtgccgatgaacatgtgcactccaagttagagggaagtaaagtgactaagagtaagacttccccagtggtgtcaggaagttcatccaagagcacaacgcttccaaggccgagaccaacacgaaccagcctgctgcggagagcacgactcggcgaagcttcagactctgaactggcagacgccgacaaggcaagcgtggcaagtgaagtctccaccacaagcagcactagcaaaccacccacaggcaggcgcaacatttctcgcattgatctgttggcacagccccgtagaacacggctgggttccctgagcgcccgatctgacagcgaggcgaccataagtcgctcaagtgcatcaagccgcaccgctgaggccattatacgttcgggcgcccgtctcgtgccaagtgataaattctcgcctagaattagagccaacagcatttcacggctgtctgattctaaagtgaaatccatgacgtctgcacacggcagcgccagcgtgaatagccgatggcgaagatttcccaccgactatgcaagcacgtccgaggatgaattcggtagcaaccggaactctccaaaacacacccgccttcgtaccagccccgctcttaaaacaacccggctgcagtctgccggctccgctatgcccacctcatcttccttcaagcaccggatcaaggagcaggaagactacattcgagattggactgcccacagggaagaaattgcaaggatatcgcaggatctggcccttatcgcgcgtgaaattaacgatgtcgcaggagagatcgactccgtcacttcaagtggcacggcgccttcaaccactgtgtccacagcagctacaacgccaggttcagcaatagatactagagaagagctggtggatcgtgtgttcgatgagtctttgaatttccgtaaaatcccccctctggtccactcaaagacccccgaagggaacaatggaagaagtggcgatcccagaccccaggctgcagagccccccgaccatctcacaataacgcggcgcaggacctggtcaagagatgaggtgatgggagacaacttgctgctgagttcagtattccaattctccaaaaagatacgccaatcaattgataaaacggcgggcaagattaggattctttttaaggataaagatagaaattgggatgacattgaatctaagctgagagcagagtccgaggtgcctattgtcaagaccagttccatggaaatcagcagtatcctgcaggagctgaaacgcgtcgaaaagcagctccaggctattaacgccatgatcgatccagacggaacccttgaagcacttaacaacatggggttcccaagtgccatgctcccgtctccgccgaagcaaaaatcctccccagtgaacaaccaccatagccccgggcagactccgactcttggacagccggaagcccgggccctccaccctgccgcggtgagtgccgccgctgagtttgagaacgcagagagcgaagctgacttctcaattcattttaataggtttaatcccgatggcgaggaagaggatgtaaccgtacaagagtag

SEQ ID NO: 182462 - DNA, 1239 bp, Artificial Sequence
  Description of Artificial Sequence: Synthetic coding sequence
atgcgggtgcccgaggaggccctgaagcacgagaagttcaccatccagctgcagcttagccagaaaagttcagaaagtgaattgtccaaaagtgcatccgcaaaatcgatcgactcaaaagtggcagacgctgctaccgaggtgcaacataaaacaacagaggccctcaaatctgaggagaaggccatggacatctccgccatgccccgagggactcctctctacggtcagccgagctggtggggagatgacgaagtcgacgaaaaaagagcattcaaaactaatggaaagcccgaagaaaaaaaccatgaggccggaactagcggctgcggcatcgatgctaaacaggttgaagagcagtccgccgcagctaacgaggaagtcttattccccttctgcagagaacccagctactttgagatcccaactaaagagtttcaacaaccgtctcagatcaccgagagtaccattcatgagatcccaaccaaagataccccctcatcccacataactggggctgggcacgcctcattcaccatcgaatttgacgattccactcccggcaaggtgactattagggatcacgtaaccaagtttacatcagaccagcgacacaagtctaagaaaagcagcccaggaacccaagacttactcggaatccagaccggcatgatggccccagagaataaggtggccgactggctggcccagaataatccaccccaaatgctgtgggaacgcactgaggaggactcaaagagtataaaaagcgacgtcccagtctacctcaaacgccttaagggtaataagcatgatgacgggacacagtctgactcggaaaatgctggtgctcatcgcaggtgcagtaaaagggctacactcgaggagcacctcagaagacatcacagtgaacataagaagctacagaaggtgcaggccaccgaaaagcaccaagaccaggcagtcacaagcagtgcccaccatcggggcggccatggggtcccccacgggaagctgcttaagcagaaaagcgaggaaccgagcgtgtcaataccattcctgcagacagctctcctccgctcatccggttctctgggacatcgaccctctcaagaaatggacaaaatgctgaaaaaccaagctgactgcgggagcgtggccttttgcggtttcatgatcttcaagcttaatctgatgatcacaccattcccattcatagacctgttcagcttcttttag

SEQ ID NO: 182463 - DNA, 402 bp, Artificial Sequence
  Description of Artificial Sequence: Synthetic coding sequence
atgagcctgaccagctggttcctggtgagcagcggcggcacccggcaccgacttccaagggaaatgatcttcgtgggacgtgacgattgcgagctgatgctgcagagccgctccgttgataagcagcacgccgtcatcaactatgacgccagtaccgatgaacacttggtcaaggacctgggttctcttaacggtacatttgtgaacgatgtacgaattccggagcagacatatatcaccctgaagctggaagataagctgaggttcggatatgacaccaatctgtttacagttgtgcagggtgagatgcgcgttcctgaggaggccttaaagcacgagaaattcaccattcagctccaattatctcaaaagtccagcgaaagcgagctgtcaaaatcctag

SEQ ID NO: 182464 - DNA, 267 bp, Artificial Sequence
  Description of Artificial Sequence: Synthetic coding sequence
atgagcctgaccagctggttcctggtgagcagcggcggcacccggcatcggctccctcgcgagatgattttcgtcggtcgcgatgactgtgagcttatgttgcagtcaaggtcagtggataagcagcatgcagtgatcaattacgatgcttccacagacgagcacctagtgaaggacctcggatctctgaatggtacattcgtgaatgacgttaggattcccgagcagacgtacatcacactgaagctggaggacaagctccgctag

SEQ ID NO: 182465 - DNA, 336 bp, Artificial Sequence
  Description of Artificial Sequence: Synthetic coding sequence
atgagcctgaccagctggttcctggtgagcagcggcggcacccggcatcgcctgccgagggagatgatcttcgtaggccgcgacgattgtgagctgatgctgcaatctaggagcgttgacaagcagcacgctgtaatcaattatgatgcgtccaccgatgagcatctggtaaaagatttggggagccttaatggtacattcgtgaatgatgtgaggatcccagagcagacatacataactttaaaactcgaggacaaactccgatttgggtacgatacgaacctgtttaccgtggtgcagggcgaaatgagagtgcccgaggaggccctgaagtag

SEQ ID NO: 182466 - DNA, 1407 bp, Artificial Sequence
  Description of Artificial Sequence: Synthetic coding sequence
atgagcagcgaccaggagacctacagctgcaagccccacggccggacaccactcacttcggcagatgaacatgttcacagcaaattagagggttccaaagttactaaatctaagacttcgccagtcgtgtccggtagtagtagcaagtcaacaaccttgccgaggccaagacccacaagaacctctttactccggagagctcgccttggcgaggcctctgactctgagttagcggatgcagacaaagcatccgtggcgtcagaggtgtctacaacctctagcacatctaagcccccaaccggacgacgcaacatcagtcggattgatctgttggctcagcctcgcaggacaaggctcggatccctgagcgccagatctgacagcgaggctactatctcccgaagcagtgcgagctctaggaccgctgaggccatcatccggagtggcgcccggttggtcccctctgataagttttcaccacgaattcgtgccaactcaatctccagacttagcgacagcaaggtgaaatcgatgaccagcgctcacggatccgcgagtgcactgaaaacaactaggctccagtctgccggatcagccatgcccacgtcaagttcattcaagcaccgcattaaggagcaggaagactacattcgcgattggacagcacaccgggaagaaatcgcaaggattagccaggatctcgccttgattgcacgggaaatcaacgacgtcgcaggcgaaatcgattccgtcacttcatccggtaccgccccttcaacgactgtgtccacagcagccacaactcctgggagcgcaattgatacacgcgaggaggtgggggatctccacggagaaatgcacaagctcgtcgatcgcgtgttcgatgagagtctgaacttccgcaagattccacctctggtgcatagcaagacgcctgaaggaaacaacgggagatctggcgaccctcgaccacaagcggccgagcctcctgatcacctgaccataactcggcgccgaacatggtcccgcgatgaggtgatgggggacaatctcctgttgagcagtgtctttcaatttagtaagaagatccgacagtccatcgacaagactgccggcaagatcagaatactttttaaggacaaagaccgcaactgggacgatattgagagcaagcttcgcgctgaaagcgaggtcccaattgttaagacatcatcaatggaaatcagctctatcctacaggagttgaagagagtggagaagcaactacaggccattaacgccatgatcgatcccgacggcacccttgaggccctcaataacatgggcttccccagcgctatgctgccaagtcctcctaaacagaagagctcccccgtcaataatcaccacagccctgccatgctttag

SEQ ID NO: 182467 - DNA, 7161 bp, Artificial Sequence
  Description of Artificial Sequence: Synthetic coding sequence
atggagacccggagccccggcctgaacaacatgaagccccagagcttacagttagtactagaagaacaggttctggctctgcaacaacaaatggctgaaaatcaggcagctagttggcgcaaattgaagaacagccaggaggcgcagcagcgtcaggctaccttggtgcggaaattgcaagctaaggtgctgcaatatcgttcctggtgtcaggaattagaaaagcggttggaggcaaccggaggcccaatcccgcagcgctgggaaaatgtggaagagcctaatctcgacgagctcttggtaaggctggaggaggagcaacagaggtgcgaatcactggccgaagtcaacacacagctgagactgcacatggaaaaagccgatgttgtgaataaagcccttagggaggacgttgagaaactcactgtggactggagccgggctcgcgacgaactgatgcggaaggaatctcagtggcagatggagcaagagttcttcaaaggatatcttaagggagagcacggaagactactgtccttgtggcgggaagtagtgacctttcggagacattttctcgagatgaaaagtgctaccgatagggatctgatggagctgaaagctgaacacgtgcggctcagtggatctctgctcacttgttgcttgcgcctgaccgtcggcgcacagtcgcgggagcccaacggatccggtcgtatggatgggagggagccagcccagctcctcctgttgctggctaagacccaagagctcgagaaggaagcccatgagcgctcccaagagctgatccaactcaaatctcagggggacctggagaaagccgagctccaggaccgcgtcactgaactgtccgccctgctcacacaatctcagaagcaaaatgaggactacgaaaaaatgatcaaggctctgcgggaaactgtggaaatcctcgagacaaatcacaccgaactgatggagcacgaagcctcgctgtcacgaaacgcgcaagaggaaaagctaagcctccagcaggtcatcaaagatattacacaggtgatggtggaggagggggataacatagctcaagggagcggccacgagaattctctggagctggactccagcatattctcccaatttgattaccaggacgccgataaggcccttaccctagtgagaagcgtgctgacccggagaaggcaagcagttcaggatctccgacagcagctggcgggttgtcaggaagcagttaatttgcttcaacaacagcacgatcagtgggaggaggagggcaaggctctcagacagcggctgcagaagctgacaggagaaagagacactctggcaggacagacagtcgacttacagggagaggtggactctctgtccaaagagcgagagctcctgcagaaggccagggaggagctgcgacagcagttggaggtgttagagcaggaagcctggaggctgagaagagtaaatgtggagctgcagctgcagggagattcagcgcagggccagaaagaggaacagcaagaagagctgcacctggccgtcagggagagagagagattgcaggagatgctcatgggtctggaggccaagcagtctgagagtctaagcgaacttattacactgagagaggctcttgaaagtagtcacctcgagggcgagctgctccgacaggagcagactgaagtaaccgccgcgttagcaagagccgaacaatccatagccgaactgtcctcttccgagaacactctgaaaaccgaggttgctgaccttcgcgctgccgcagtgaagctgagtgcgcttaacgaggctctggccctggataaagtaggactcaaccagcagctgctgcagctcgaggaggagaaccagagcgtttgcagccgtatggaggcagctgagcaggctagaaacgcgctccaggtcgacttggctgaggccgaaaagagaagagaggccctatgggagaaaaacacacacctggaagctcagcttcagaaagctgaagaggccggcgctgagcttcaggcagacttgcgcgacatccaggaggagaaagaggagatacaaaagaaattatctgagtcaaggcatcaacaggaggcggctaccactcagctggaacaactgcaccaggaagccaagcgacaggaagaggtgcttgcccgggcagttcaggagaaggaggccctggtacgcgagaaggccgctttggaagttcgtctccaagccgtagagagggatagacaagacctggcggaacagttgcaaggactctcctcagccaaggaacttctagagagcagcctgtttgaggcacaacaacaaaactccgttatcgaggtgaccaaggggcagttggaagtgcagatccagacagtgacccaggccaaggaagtgattcagggagaagtgcgatgcctaaaactggagctagatacagagaggtctcaagccgagcaggagagggacgccgccgcgcggcagttggcccaggctgagcaggaggggaaaacagcactggaacagcagaaagccgctcatgaaaaagaggtcaaccaattacgggaaaaatggatgcaactggagaccgaaaaggagagggtcagcctactcgagaccttactgcagacgcagaaggaactggcagatgccagccaacagcttgaacgactgagacaagacatgaaggttcagaaactgaaggaacaggaaaccactgggattcttcagacgcagcttcaagaggcccagagggaattgaaagaggcagctagacagcaccgcgacgatctcgctgcactgcaggaggagtcatcttccctattacaggataaaatggatctacagaaacaggttgaggacctaaagtcacaattagtggctcaggatgattctcagagactcgttgaacaagaagtgcaggaaaaattacgggagacacaggaatacaacaggatacagaaagaactggagcgcgagaaagcttccctcacactgtcattgatggagaaggaacaaaggttgctcgtgctgcaggaggccgactccatccggcaacaggagctaagcgcgctgaggcaagatatgcaggaagcacaaggcgagcaaaaagagctcagcgcacaaatggaacttctgagacaggaagtaaaagaaaaggaggctgacttcctagcgcaggaggcccaactgctcgaggagctggaagctagccatattactgaacaacaactgcgggcttcattatgggcacaggaggcaaaagcggctcagttgcagctccgactgcggagtacagaatcacagcttgaagccctggccgccgaacagcaacccggcaatcaggcccaggctcaggctcaactcgccagtctgtatagtgccctccaacaggccttaggttctgtttgtgaaagcagaccagagctatcagggggaggggattctgctccttccgtgtggggacttgaaccagatcagaatggggctcgatcactctttaaaaggggccccctgcttaccgccctctcagcagaagccgtggccagcgcgctgcacaaactgcaccaggatttgtggaagacccagcagacccgggacgttctgcgggaccaggtgcagaagctcgaagaaaggctgacagatacagaggccgagaagtcccaggtacacactgaacttcaagatctccaaagacagctcagccagaatcaggaggagaaaagtaagtgggagggcaagcagaattctcttgaatccgagttgatggagctgcacgaaactatggcctcacttcagtctagacttaggagagccgagctccagaggatggaggcccagggtgaaagggaacttttgcaggctgctaaggaaaacctgaccgcacaagtggagcacctgcaggccgccgtagtggaagcaagagctcaggcctcagccgccgggattctggaggaagacctgcgcaccgctcggagcgccctgaagctcaaaaatgaagaggtagaaagcgaacgcgagagggctcaggcactccaggagcagggcgagctgaaagttgcacaaggcaaggctctgcaggaaaacctggccctgttaactcagaccctggcagagagagaagaggaggtagagactctacgcggccagatacaggaactcgagaagcagcgagagatgcagaaagcagccctggaattgctatccttagatctgaaaaaacggaaccaggaggtggacctccagcaagaacagatacaggaacttgagaaatgcagaagcgtccttgagcacctgccaatggccgtccaggagcgggagcaaaagctcactgtacaaagagagcagatccgggaactggagaaggaccgggagactcagcgaaatgtcttggaacatcaactcctggaactcgaaaaaaaggaccagatgatagaatctcaacgaggtcaggtgcaggatcttaaaaagcagttggtgacactcgagtgcctggccctcgagctggaggagaaccatcacaaaatggagtgccagcagaagttaattaaggaactagagggacagcgcgagacacaacgagtcgctctcacccaccttacgctggacttggaggagcgcagccaagaactgcaagctcagagcagtcagatacacgatctcgaaagtcacagcactgtgctggcaagagaactccaggagcgcgatcaagaggtgaaaagccagcgggagcagattgaggagctgcagcggcagaaggagcaccttacgcaggatctcgaaagacgtgaccaggaactgatgctccaaaaggaaaggatccaagtgctggaggaccaacgcaccaggcagaccaagattctcgaggaggatcttgaacagattaaactgtctttgcgggaaagaggaagggagcttaccacccagaggcaactgatgcaagagcgggctgaagagggtaagggtccatcaaaagcacagcgaggctctctggagcatatgaagttgatccttagagacaaggagaaagaagtggagtgtcagcaagagcacattcatgagctccaggaactgaaggaccagctcgaacagcaacttcagggactccatcggaaggttggtgaaaccagtcttctgctctcccagcgggagcaagaaatcgtcgtgctgcagcagcagctgcaagaagctagggaacaaggagagctgaaggagcagtccctgcaatcacagcttgatgaggcccagagggctctggcccagcgcgaccaggaactggaagccctgcagcaggaacagcaacaggcacagggtcaggaagaacgtgtcaaggagaaagccgacgctttgcagggagccctcgaacaggcacacatgaccctgaaagaaaggcacggcgaactacaagaccacaaagagcaggcccgccgcttggaggaagaactcgcggtggaggggcggcgggtgcaggccctcgaggaggtattgggcgatcttcgtgcggaaagtcgggagcaagaaaaggccttgctggctttgcaacagcagtgcgcagagcaggcccaggaacatgaggtggaaacccgagccctccaggatagctggctccaggcccaggccgtgttaaaagagagggaccaggaattagaggccttacgtgctgaaagtcaaagcagtaggcatcaggaagaagctgcccgcgccagagcagaagctttgcaggaggctctaggaaaagctcatgcagcattgcagggaaaggagcagcatttacttgagcaagctgagttgagccggtcactcgaggcatcaactgccaccctccaggcctccttggatgcctgccaggcccacagccgtcagttagaagaggccttaaggatccaggagggagaaatccaagatcaggaccttaggtaccaggaggatgtgcagcagctgcagcaggccctcgctcagagagatgaggaactgaggcatcagcaagaacgcgaacagttgctcgagaagtctttagcgcagagagtgcaggagaacatgattcaggaaaagcagaacttggggcaggagcgcgaggaggaagagatccggggcctacaccagtccgtacgggaactgcagttgacgttggcacagaaggagcaggagatcttggaactcagagagacccaacagagaaacaacctggaagcattgccgcacagtcacaagacatcgcctatggaggaacaatccttgaagctggactctcttgaacctcgcttgcagcgtgagctggagcgtctacaggccgcactccgtcagactgaggcacgggaaatcgagtggagagagaaagcccaggacctggccctaagtcttgcacagactaaggcgtctgtctcatctctgcaggaagtagctatgttccttcaggctagcgtcctcgaaagggattccgaacagcagcggctgcaggacgagctggagttaacgaggcgggccttggagaaggagcggctgcattccccaggtgctacctccacggctgaactgggaagtcggggtgagcagggagtgcaactcggagaggtgtcgggtgtggaagctgaacctagcccagatggaatggagaagcagagttggcgccaacgtctggaacatctacagcaggctgtggctcgcctcgaaatcgatcgctctcggctgcagcggcacaatgtccagctgaggagtaccttagaacaggtcgagcgagagcgacgcaaattgaagcgagaagccatgagagccgctcaagctggctcactggaaataagcaaggccactgcttcttccccgactcagcaggacggccgtgggcaaaagaacagtgacgctaaatgcgtggctgagctgcagaaggaagtggtcctacttcaggcacaactgacattagagcggaagcaaaagcaggactatatcacgagaagcgcccagacaagtagagagcttgccgggttgcatcacagcctgagccactcactcttggccgtggcccaggcccctgaggctacggttctggaggctgaaactcggcgccttgatgagagtcttacccagtctcttacctcacccggtccagtcctgttacacccttctccctctacaactcaggccgcaagtcgctag

SEQ ID NO: 182468 - DNA, 1020 bp, Artificial Sequence
  Description of Artificial Sequence: Synthetic coding sequence
atggagacccggagccccggcctgaacaacatgaagccccagagcctccaactcgtactggaagagcaggttctagcactgcaacagcagatggcagaaaaccaggcggccagttggagaaagctgaagaacagccaggaggcccagcagagacaggccactctggtgcgcaagctccaagccaaagtactgcagtaccgctcatggtgtcaagagcttgagaagaggctggaagccaccgggggacctatccctcagcgctgggaaaatgttgaggagcctaatcttgacgagctgctcgttcgattggaggaggaacagcagcggtgtgaaagtctggcagaggtgaacacacagttacgtttacatatggaaaaagctgatgtcgtaaataaggcattaagggaagacgttgaaaagctcactgtggattggtctagagccagagacgagctcatgaggaaggagagtcagtggcagatggagcaagaattctttaagggctacctgaaaggggagcacggcagattgctgtccctgtggcgagaagtggtgacatttcggaggcatttccttgagatgaagtcagcaactgatagagatcttatggagctgaaagctgaacacgtccgcctatcaggttcactgttaacctgctgcctgcgtctgacggtgggagctcagagtcgggaacccaacggctctggcaggatggatggtagagagcccgcacagctgctcctgctgctggccaaaacccaggaactggaaaaagaggctcacgagaggtcacaagagcttattcaactcaagagccagggagacttagaaaaagccgagctgcaggaccgtgtcacagagctaagcgccctgttaacccaatctcaaaagcagaatgaagactacgagaaaatgattaaagccctacgtgagacggtggagatcctggtacatgaccctctgctttggaagggagtgggacgagggcttgtgggtagtttatgctttatggatagatag

SEQ ID NO: 182469 - DNA, 7329 bp, Artificial Sequence
  Description of Artificial Sequence: Synthetic coding sequence
atggagacccggagccccggcctgaacaacatgaagccccagagcttgcagctcgtcctggaagagcaagttttggctcttcagcaacagatggctgaaaaccaggcagccagttggcgcaagctgaaaaactctcaagaagcccagcagagacaagccacccttgtcaggaaactgcaagcaaaagtactgcagtaccgctcctggtgtcaagagctggaaaagcgcctggaggctaccggcggcccgattccccagcggtgggaaaacgttgaggaacccaatctcgacgagttgctcgtaaggctagaggaggagcagcagcgctgtgaatccctcgctgaagtgaatacacagcttcgactccatatggaaaaagcggacgtggtcaataaagctctgcgggaagacgtcgaaaaactgactgttgattggtcccgagctagggacgagctgatgcgcaaagaatcccaatggcagatggagcaggaattctttaaaggctaccttaagggagaacacggaaggcttcttagcctgtggagagaggtggttaccttccggagacattttctggagatgaaaagcgccacagaccgcgacttgatggagctgaaggccgaacacgtccgactgtcagggtcactgctgacgtgctgtcttcggcttactgtgggggcccagtctcgagagcccaacgggagtggaagaatggatggtagagagcccgctcagctactgttactgctagctaaaacccaggagctggagaaagaagcccacgagaggagtcaggaactcatccagctcaaatcacaaggggacctcgagaaggctgagcttcaagacagggtgaccgagctgtcagccctgctcacccagtcacaaaaacagaatgaagattacgagaaaatgattaaggcactgagagaaacagtggagatcctggaaacaaatcatacagagctgatggagcacgaggcttctctcagccgtaacgcgcaggaagaaaagctatccctgcagcaggtgatcaaggatatcacacaggtgatggttgaagagggggataacattgcacagggcagcgggcatgagaactcccttgagttggacagctctatcttcagccagttcgactaccaggatgcagacaaagcgctgaccctggtgcgttccgtgctgaccagaagacgccaagctgtgcaggatctcagacagcagctcgctggctgccaggaggccgtgaacctccttcagcagcaacacgaccagtgggaggaagaaggaaaggcacttcgacagcgtctccagaagctgaccggtgagcgggacacactagccggccaaaccgtggatttgcaaggtgaagtggacagcctgagcaaggaaagagaactgctccagaaggcacgagaagagctgcgccaacagctcgaagttttggagcaggaggcttggcgactccgcagagtgaatgtcgagttacagctccagggcgacagtgcacagggacaaaaggaggaacagcaggaggaactgcacttagccgtgagggagcgggaacggttgcaggagatgctgatgggactcgaggcaaagcagtcagaatcacttagcgagttgatcaccctgcgggaagctctggaatccagtcacctcgagggagaactcctccggcaggagcagaccgaagtcaccgcagcactggcacgggccgagcagtctattgccgaacttagcagctccgagaatactttgaagaccgaggttgcagacttgcgtgctgccgctgtgaagctctccgcactgaatgaagcgttagctctggataaggtaggtttaaatcagcagctcctgcagctggaagaagagaatcagtccgtgtgcagtagaatggaggcagcagagcaggcccgtaacgccctgcaggttgatctagcagaagcggaaaaacggcgcgaggcactgtgggaaaaaaatacacatttggaggcacagctgcagaaggccgaggaagcgggagctgaactgcaggcagacctgcgtgacatccaagaggaaaaagaagagatacagaagaagttgtcggagagtagacaccagcaggaagctgcgacgactcagcttgagcaactccatcaagaagccaagcgacaagaggaggttctggcaagggccgtgcaagagaaggaggctctcgtgagagagaaagccgctctggaagttcgtctccaggccgtagaaagggatcggcaggatcttgcagagcaactgcaaggactcagtagtgctaaggagctgctggaatctagcctgttcgaagcgcagcaacagaattcagtcatcgaggtaacaaaagggcagctggaggtgcaaatccaaactgtcacacaggctaaggaggtcattcagggggaggtgcggtgcctgaagctcgagctggacactgaaagatcacaggcggaacaagagagggacgccgccgcccgtcagcttgctcaagccgagcaggaagggaaaactgccctcgaacagcagaaagccgcacacgagaaggaagtgaaccagctcagagagaaatgggaaaaggagcgtagctggcatcagcaggagctggcgaaagcactagagagcctggaacgtgagaagatggaactggaaatgagactcaaagaacagcaaactgaaatggaagctatccaggctcaaagagaggaggagagaactcaggctgaatccgctctgtgccagatgcagttggaaactgaaaaggaaagagtttctctactagagacactgctgcagacacagaaagagctggcagatgcttcccagcagctcgagcggttaaggcaggatatgaaggttcagaaactgaaggagcaggagaccaccggaattctccagactcagttgcaggaggcccaaagggagctgaaagaagcagcccgccaacaccgagatgacctagcagctttgcaggaggagagcagcagcctcctgcaggacaagatggacctccagaaacaggttgaggatctgaagagtcaactcgtcgctcaggacgactcccagcgcctcgttgagcaggaagtgcaggaaaaattgcgggaaacacaagagtataacagaattcagaaagaactggaaagagagaaggccagcttgactctttcgttgatggaaaaggagcaaaggttgctggtactccaagaggccgactcaataagacagcaggagctgagcgcgctgaggcaggatatgcaggaggcacagggtgagcagaaagaacttagtgcccagatggaattactccgacaggaggtcaaggagaaggaggctgatttcttagcccaggaagcccagttgctggaggagctcgaagcttctcatattacggagcagcagcttagagctagtctctgggctcaagaggccaaggcggcgcagcttcagcttcgcctccggtcaaccgagtctcagttggaagcactggctgcagagcagcaacctggcaaccaggcccaggcccaggcacagctcgcatcgctatactcagctctgcaacaagcactgggttccgtatgcgaaagcagaccagagctgagcggcggcggggatagcgctccaagcgtgtggggattggagccggatcagaacggggctaggagcctatttaagcgcgggccactgctgacagccctgagtgcagaagcagtggcttctgcgctgcacaagcttcaccaagacctctggaagactcagcagactagggatgtcctgcgggaccaagtccaaaaactcgaggaacgacttactgacaccgaggctgagaaatctcaggtgcacaccgagctgcaggatctccaacgtcaactttcccagaatcaggaggagaagtccaaatgggagggaaaacagaactcattagagtcagaacttatggagctgcatgaaaccatggcctcacttcagagcaggctacgacgcgcagagcttcagaggatggaggctcagggggagagagagttgctgcaggcggccaaggagaacctcacagctcaggtggaacaccttcaagccgccgtggtggaggcccgcgcccaggcctccgccgccggcatcctggaggaggacctaagaaccgcccgcagcgccctgaagctgaaaaacgaggaggtggaaagcgagcgcgagagagctcaggccctccaggagcaaggcgagctaaaagtagcccagggtaaggccctgcaagagaatttggctctgctgactcaaactctggcggagcgggaggaggaagtcgaaacacttagagggcagatccaggaactagagaaacagagggaaatgcagaaagcagctttagaactcctgtcccttgatctgaaaaaaaggaaccaggaagtcgacttgcagcaagagcagatccaggaactggaaaaatgtcgatccgtactggagcacttaccaatggcggttcaagaacgggagcagaagctgaccgtgcagcgggaacagatacgcgaactggagaaagaccgggaaactcagcggaatgtgttagaacaccagctcctcgaactggaaaagaaagaccagatgatcgagtcccagagaggccaagtgcaagatctcaaaaaacagctggtgacacttgagtgtctggccctcgagttggaggagaatcatcacaagatggagtgtcagcagaaactcattaaggagttggagggccagcgagagactcagagagtggcgctgacccacctgacattagatcttgaggaacgctcacaggagctccaggcccagagctcacagatccacgaccttgaaagtcattccaccgttttggcccgcgaactccaggaaagggatcaggaagtgaagtctcaacgagaacagatcgaagagctgcaacgccagaaagagcacctcacacaggacctcgaacgacgggatcaggagctcatgctgcaaaaagagaggattcaagtgctggaagatcagcgcactcgacagacaaagatccttgaagaagatctggaacaaattaagctgagtctgcgtgagcgcgggagagagctgaccactcagcggcagttaatgcaggagcgagctgaagaggggaaaggcccaagcaaggcccagcgggggtcactcgagcatatgaagctcattctcagggacaaggagaaagaagtagagtgccagcaggagcatattcatgagctgcaggagctgaaagatcagctcgaacagcaactgcaaggtctccaccgaaaggtgggggagacaagtctgctgctctcacagagggagcaggagatcgtcgtcctccaacaacaacttcaagaggcacgagagcagggtgagctcaaggaacaatctctgcagagtcagctggacgaggctcaacgtgctctggcacagcgtgatcaggagctcgaggccctgcagcaggagcagcagcaggctcaaggacaggaggagagggtgaaggagaaagctgacgctcttcagggcgctcttgagcaggcacatatgaccctgaaggagcgtcatggagagcttcaggaccataaagaacaggcacgccgactggaggaggagttggctgtggagggccggcgtgtgcaagctcttgaagaggttctcggtgacctacgagcagaatcaagggagcaggagaaggccctgttggctctgcagcagcagtgcgctgaacaagctcaggaacacgaggtggaaacccgggcattgcaggactcatggctgcaagcccaggcggtccttaaggagcgcgatcaagaactggaggctctgcgggctgagagtcaatcctcaagacatcaggaggaagccgctagggcacgcgccgaagccctgcaagaggccctgggaaaggcacatgcagccctacagggaaaggagcaacatctcctggagcaggccgagctttcccgctccctggaggcatccaccgccaccctgcaggcttccttggacgcctgccaggctcactcacggcaactcgaggaggccctgaggattcaggaaggcgagatacaggaccaggatctgcggtaccaagaggacgtgcagcagcttcagcaagctctagcgcagagggacgaggagctcagacatcagcaggagcgcgagcagttgttggagaaatcccttgctcagcgcgttcaggaaaacatgattcaagagaagcaaaatctaggccaggagcgcgaggaggaggagatccgggggctacatcagagcgtgagggaactccaattgacgcttgcccaaaaagagcaggaaatcctggaactgcgggaaacccagcagagaaacaatcttgaggcactaccacactcacataaaacttctcccatggaggagcagtcactcaagctggattctctggaaccccgcctgcagcgggagctggagcgactgcaggctgctctcaggcaaacagaagcacgggagatcgaatggcgtgagaaggctcaggatctcgcattgtcactggcccagacaaaagcctcagtctcatccctgcaggaagtcgccatgttcctccaggcatcggtgctagagcgcgatagtgagcagcaacgactacaagacgaactcgagctcaccaggagagctttggaaaaggaaaggctccacagccccggcgctacatcaaccgccgagctgggctcccggggcgagcagggagttcaactaggagaagtatccggggtggaagctgagcccagcccagatggaatggagaaacaatcatggcggcagagattggagcacctgcagcaggccgtggctaggctcgagattgacagatcaagactgcagcgtcataatgtgcagctgcgttctaccctggagcaggtggaacgagaaagaaggaagctgaaacgcgaagcaatgcgtgccgcccaggccgggagccttgagatctcaaaagcgaccgcttcgagccccacgcagcaagacgggagaggacagaagaatagtgatgctaaatgcgtggctgagctacagaaggaagtcgtgctattgcaggcccagctgaccctggaacgaaagcagaagcaagattatatcacacgtagtgcccaaacttcaagggaacttgcaggcttacaccattccttatctcattcactgctggctgttgctcaggctcccgaagccacagtgttagaggcagagacacgcaggctggatgagagcttaactcaaagtctgaccagccccggccctgttttgcttcacccatcacctagcaccacccaggctgcctctaggtag

SEQ ID NO: 182470 - DNA, 345 bp, Artificial Sequence
  Description of Artificial Sequence: Synthetic coding sequence
atggagacccggagccccggcctgaacaacatgaagccccagagcctccaactggtgctagaagagcaagttctggcgctgcagcaacagatggcagaaaaccaggcagcatcttggaggaaactgaaaaactctcaagaagctcagcaaaggcaggcgactctggtgcgcaaactgcaggcaaaagtgctgcagtataggtcatggtgccaggaactggagaaaagactggaggccactgggggacctataccccagagatgggaaaacgtggaggaaccaaatctggatgaactgcttgttagactggaggaagagcagcagcgatgcgagtcacttgcgtag

SEQ ID NO: 182471 - DNA, 2055 bp, Artificial Sequence
  Description of Artificial Sequence: Synthetic coding sequence
atggagacccggagccccggcctgaacaacatgaagccccagagcctgcagctcgtgctggaggaacaggtgcttgcactgcagcaacagatggctgaaaatcaggccgcttcttggcggaagttgaaaaattcccaagaggcccagcagcggcaggcgactcttgtgagaaagctccaggctaaagtcctgcagtatcgaagctggtgtcaggaactagaaaaaaggcttgaagcgactggaggaccaattcctcagaggtgggagaacgttgaggaaccgaacctggatgaactactggtgaggctggaagaggaacagcagaggtgcgagtcacttgcagaagtaaacactcagctgcggctgcacatggagaaagctgacgtcgtgaacaaggcccttcgggaagacgtagaaaagctgaccgtggattggtccagggctagagatgagctcatgcgtaaggagagtcagtggcagatggagcaggaattcttcaaggggtacctgaaaggggaacacggcaggcttctgtctttgtggcgcgaggtggtcacattcagaagacatttcttagaaatgaaaagtgctactgaccgggacctgatggagctgaaggccgagcacgtgagactgagtggtagtctcctgacttgttgtcttagattgaccgtgggcgcccaatcgcgtgagcctaatgggtccggccgcatggacggaagggagcccgctcaactgttacttctgctggccaagacacaggagctagagaaagaggcccacgaaagaagccaggagctgatccagctgaaatcccagggagatctagaaaaggcggagttgcaggaccgtgtgaccgaactgtccgcccttttgacccaatcacagaagcaaaacgaggactatgaaaagatgataaaggccctgcgcgagactgttgaaattttgactaatcataccgaactcatggaacacgaagcatcgctgtcccgtaacgcgcaggaggagaaactatcgctgcaacaggtgattaaagacattacccaagtgatggtggaggaaggtgacaatatcgctcagggttcaggacacgagaattctctggagctagattcgtcgattttcagccagttcgactaccaagatgccgataaggcactgaccctcgtgcggtctgttcttacccggcggcgccaggctgtgcaagacctccgccaacagctcgcaggctgtcaggaagcggtgaatttgctgcagcagcagcatgaccagtgggaggaggaaggtaaggccttgaggcagcggctgcagaaactaactggggagcgggatactttggctggacagactgtcgatcttcagggcgaggtcgacagcctttcaaaagagagagaattgctgcagaaggcaagggaagagttgcgccagcagctggaggtgctggaacaggaagcatggagactgcggcgagtgaacgtggagctgcaactgcagggagacagtgcccaaggtcagaaggaagagcagcaggaggaacttcacctcgccgtcagggaaagggaacgactccaggagatgctcatgggccttgaggctaaacagagtgagagtctatctgagcttatcaccctcagagaggcattggagtcctcacatctggagggggaactgctgaggcaagaacagacagaagtgaccgctgcactggcccgcgccgagcagagtattgctgagttgagcagttccgaaaataccctgaagactgaagtggctgacttgcgcgccgccgccgttaaactctcggccttaaacgaggccctggctctcgataaggttgggctgaaccagcagctgctgcagctggaggaggaaaatcaaagcgtctgcagtcgcatggaggcagccgagcaggcacgcaacgcacttcaagtcgatttggccgaggcagagaaacgtcgggaagccctctgggagaagaacacccacctcgaggcccagctgcaaaaggccgaagaggccggggctgaacttcaggccgatctccgagatatttag

SEQ ID NO: 182472 - DNA, 495 bp, Artificial Sequence
  Description of Artificial Sequence: Synthetic coding sequence
atggagacccggagccccggcctgaacaacatgaagccccagagcctccaactcgtgttggaggagcaggtgctggcattacagcagcagatggcagagaaccaggccgctagctggcggaaactgaagaactctcaagaagcacagcagcggcaggccaccttagtgcgcaaattacaagcgaaagtgctgcaataccgatcttggtgccaggagctggagaagcgcctcgaagccactggcggccccatcccccaaaggtgggagaatgtggaagagccgaatctcgacgagttgctggtaaggctagaggaggagcaacagcgttgcgaatcactggccgaagtgaatacccaactccgactgcatatggagaaggctgatgtggtcaacaaagctctaagagaggacgtagagaaactaaccgtagattggtctcgggccagagacgagctcatgagaaaagaatcccaatggcagatggagcaggagtag

SEQ ID NO: 182473 - DNA, 1617 bp, Artificial Sequence
  Description of Artificial Sequence: Synthetic coding sequence
atggagacccggagccccggcctgaacaacatgaagccccagagccttcagctggtgctagaggagcaggtgctggccctgcagcagcagatggctgagaatcaggctgcctcatggagaaagctgaagaactcacaggaagcccagcaaaggcaggcgacgctggtacgcaagcttcaagccaaggttctacagtacagatcctggtgccaagagctggagaagcgtttagaggccacagggggacctattccccaacggtgggaaaacgtggaagagcctaatctggacgaactactggtcagactggaagaggagcaacagaggtgtgagagcctcgctgaggtgaacacccagcttagattgcacatggagaaagctgacgtggtcaacaaagctctgcgcgaggacgtagaaaagctcacagtggattggagccgcgctagggatgagctgatgcggaaggaatcccagtggcagatggagcaagagttctttaaaggatatctgaaaggggaacatggtcggctgttgagcctttggagggaggtagtgacatttcgccgacacttccttgaaatgaaatccgccaccgaccgcgaccttatggaactcaaagctgagcatgtcaggctgtccgggtcactcttaacttgctgcctgcgcctaaccgtcggagcccagtcacgcgaaccaaatggaagcggcagaatggatgggcgtgagccggcgcagttgcttctccttttggctaaaacgcaggagctggaaaaagaagctcatgagcgctcccaggaactgatacaacttaagtctcaaggcgatcttgagaaggccgagctacaggaccgtgtgacggagttgagcgcgctgctgacccagtctcagaagcagaatgaggactacgagaaaatgattaaggctcttcgcgagacggtggaaattctggaaacaaaccacaccgaattaatggagcacgaggctagcctcagccgtaacgcccaggaggagaaactgagcctgcagcaagtaattaaagatattacacaggttatggtcgaggagggggacaacatcgctcagggcagcggccatgagaattctctggaactggattcctcgattttttcacagtttgactaccaggatgccgataaagcgctcaccctggtcagatcagtcctcaccaggcggaggcaggccgtgcaagaccttcggcagcagcttgctggctgccaggaagcagttaacttgctccagcaacagcatgaccagtgggaagaggagggaaaggctctgaggcaaagactgcagaaactcaccggggagcgcgataccctcgcgggccagaccgtcgacctgcaaggtgaagtggactctctttctaaggagagggaactgctccagaaagccagagaggaactaaggcagcagcttgaggtgctggaacaggaggcctggcgcctgaggcgagttaacgtggagttacaactccagggagacagtgcccaggggcagaaggaggagcaacaggaagaactgcacctggcggtccgtgagcgggagcgcctccaaagttcacagctacagtcctgccgcgttttgaaaacgccttag

SEQ ID NO: 182474 - DNA, 7446 bp, Artificial Sequence
  Description of Artificial Sequence: Synthetic coding sequence
atgccccccaacatcaactggaaggagatcatgaaggtggaccccgacgatctgccgcgtcaggaggagctggccgataatttgttaattagcctttccaaggtggaggttaatgagctgaagagcgaaaagcaagagaatgtaatacatctatttcgcatcactcagagcctgatgaagatgaaggcccaggaagtggaactggctctggaagaagtggagaaggctggcgaggaacaagccaagtttgagaatcagctgaagaccaaggtgatgaaattagagaatgagctcgaaatggcccagcaatctgccggaggtcgtgacacccggtttttgcgcaatgagatttgccagctggaaaaacagctggaacaaaaggaccgcgagctggaagatatggagaaggaactcgagaaggagaaaaaagttaacgagcagttggcccttcgcaatgaagaggctgagaacgaaaactcaaaactacgccgggagaacaagcgtcttaagaaaaagaacgaacaactgtgccaggatataatcgattaccagaagcagatcgattcacagaaagaaaccctactctcccgcagaggcgaagactccgactaccgctctcagctgtcaaaaaaaaactacgaactcattcaatatcttgatgaaattcaaacactgacggaggcaaacgagaagatagaggtccaaaatcaagagatgagaaaaaatctggaagagtctgtgcaggaaatggaaaagatgacagatgagtacaatagaatgaaagccattgtgcaccagacagataacgtcatagaccagctgaagaaagagaacgaccattaccagctccaagtccaggaacttactgatcttctgaaatctaaaaacgaagaagatgaccctattatggtggccgttaacgccaaggtcgaagagtggaaactaatcttgagctccaaagacgatgagatcatagaataccagcagatgctccataacctccgagagaaactgaaaaacgctcagctcgatgccgacaagtctaacgttatggcattgcagcaaggcatccaagagcgcgacagccagattaagatgctgacggagcaggtggagcaatacaccaaggagatggaaaagaacacttgtataattgaagatctgaagaacgagctccaacgaaataagggggcttctacactaagccagcagacacatatgaagattcagtctacactggatatccttaaggagaaaaccaaggaggccgaacgaaccgcagagctggctgaggccgacgcacgcgaaaaagataaggaactagtggaagctttgaaaagattgaaggattatgagagtggggtgtacggactggaggacgccgtggtggagattaagaattgcaaaaaccagattaagatcagagaccgcgagatcgaaattcttaccaaggagatcaataagcttgagcttaagattagcgatttcctcgatgagaacgaggcactaagagaaagggtggggctcgaacctaaaaccatgatcgatctgaccgagttccgtaactcaaaacatttgaagcaacagcagtatcgggccgagaatcagatactactgaaggaggcctccatagaatccctggaggaggaacgattggacctcaagaaaaagattcggcagatggcacaggaacgcggcaagcgtagtgcaacgtcgggacttaccaccgaagatctcaacctaactgagaatataagtcagggggatcgaatcagcgagagaaagcttgatctgctgagtctcaagaacatgtcggaggctcagtcaaagaacgaattcttgagtagagagctcatcgagaaggagagggatcttgagcggagtaggactgtaattgctaaattccaaaacaagctgaaggagctagtcgaagaaaataagcaactcgaagagggaatgaaggagatcctgcaggctatcaaagaaatgcagaaggatccagatgtcaagggaggagaaacaagcttaatcatcccctccttggaacggctggttaacgcaatcgaaagtaaaaatgcagaaggaatttttgacgcatccctgcatctgaaagcgcaggttgaccagctgaccggacggaatgaggaacttagacaagaactgagggagtcaagaaaggaggccatcaactactctcaacagctggctaaggccaatctcaaaattgatcacctcgagaaggaaacctcactgttgagacagagtgagggaagtaatgtggtgtttaagggaatcgatctgcccgacggcattgcgccgagtagtgccagcataatcaattctcagaatgagtacctgatacacctgctccaagagctggagaacaaggagaagaagctgaaaaacctggaagactctctggaggactacaatcgcaaatttgcagttatcaggcaccagcagagtttactgtacaaggaatacctctcggagaaggagacgtggaagacagagtccaagactattaaggaagagaaaaggaagctggaggaccaggtccagcaggacgctattaaggtaaaagagtacaataacctcctcaatgccttacagatggatagcgatgaaatgaagaaaatattggcagaaaattcgagaaaaatcaccgttcttcaggtaaatgagaagtcgctgattcgccagtacaccaccctggtcgaactcgagcggcagctgagaaaagaaaacgagaagcaaaagaacgagctgctgtcaatggaagccgaggtgtgcgagaagatcggatgcctccagcgattcaaagagatggcgatatttaagatagctgcattgcaaaaggtggtcgataactctgtgtctttgagcgagctggagctcgccaacaagcagtacaatgagttaaccgctaagtacagagatatactgcagaaggataatatgcttgtgcagcgtacatccaatcttgaacacttggagtgtgagaacatttcgcttaaggagcaggtggaaagcatcaacaaggagctggagatcaccaaggaaaaactgcatacaattgagcaggcctgggagcaggaaacgaagctgggtaacgagtcttcaatggacaaagccaagaagagcattactaacagcgacatcgtgtcaatatcaaaaaaaatcactatgctcgaaatgaaagagctgaacgaacgtcagcgagccgagcattgtcagaaaatgtatgaacatctgcgaacatccctcaagcaaatggaagagcggaacttcgaactggaaacaaagttcgccgaactgaccaagatcaacttggatgcacagaaggtggaacagatgctgcgcgacgaacttgctgactccgtgtctaaagcagtgtcggacgctgaccggcagaggatcctcgagctggagaagaacgaaatggagctcaaagtcgaagtgtccaaactgagggagattagcgatatcgcacgacgacaggtggaaattctcaacgcacaacagcagagccgcgacaaggaagtggagtcactgaggatgcagctgctcgattaccaggcccagagtgacgaaaagtccctgatcgccaagctccaccagcataacgtgtccttacagctcagcgaggccaccgctctcggtaagctggaatctattacctccaagctgcagaaaatggaagcatataatctgagacttgagcagaagctggacgaaaaggagcaggccctgtactatgcaagattagagggtagaaaccgggccaaacacttaagacagacgatccagagcctcagaaggcaattttccggggccctgcccctggcacagcaggagaaattttcaaaaacaatgatccaactccagaatgataagcttaaaatcatgcaggagatgaagaacagccagcaggagcatcggaacatggagaataaaacactggagatggagctaaaattaaaaggactggaggagctcatcagtaccctgaaagatacaaaaggcgcacagaaagtcatcaattggcacatgaagatcgaagagttaaggctgcaggagctgaagctgaatcgggaactggtgaaagacaaagaggaaatcaaatatttaaacaacattataagcgagtacgaacggacgatcagttcgctcgaagaagagatcgtccagcagaataaatttcacgaagaaaggcaaatggcgtgggaccagcgtgaagtggatctcgagagacagctggacatattcgatagacagcaaaacgaaatcctcaacgcggcccagaaattcgaggaggctacaggctctatccccgacccatccctgccgctcccaaatcaactggagattgcactcagaaagattaaagagaacatcagaattatcctggagacacgtgccacatgtaaaagcctggaggaaaagcttaaggaaaaggaatccgccctgaggctggccgagcagaatatcctttctagggacaaggttatcaacgaattgagattacgcctacctgcgaccgcagaacgagagaagctgatcgcagagctggggaggaaagagatggagccgaaatcccatcacacattaaagatcgctcaccagacaatcgcaaatatgcaagccaggctgaaccaaaaagaggaggtcctgaagaaatatcagcgtcttctcgagaaggcaagagaggagcagagggaaatcgtaaagaaacacgaggaggacctgcatatcctccatcataggctcgagctgcaggcagattccagcttgaacaaattcaaacagacagcttgggatttgatgaaacagtcacccaccccggtcccaacaaataaacattttataaggctcgccgagatggagcagaccgtagcggagcaggatgattccctcagctccctgttggttaagctaaagaaagtgagccaggaccttgagaggcagcgcgagattacagaacttaaggtgaaggagtttgagaacataaaattgcaactgcaggagaaccatgaggatgaagtaaaaaaagtgaaggctgaagtcgaagatctgaagtacctgctcgaccagtcccagaaggagtcacagtgtctaaagagtgagcttcaggcccagaaagaagccaactcccgagctccgaccaccaccatgagaaatttggttgaacgcctgaagagccagttagccctaaaggagaaacaacagaaagctctgagtcgtgccctgctggaattgcgggccgagatgacagccgctgccgaagagcgcatcatcagtgcgacgtcacagaaggaagcccacctgaacgtgcagcaaatcgtggatcgccatacacgggagcttaagacacaggtcgaggacctgaatgagaacttgctgaagcttaaggaggccttgaagacctcgaaaaatcgagagaattctctaacagataatcttaacgatctgaataacgaactgcagaaaaaacagaaagcctataacaagatattgcgagagaaggaagaaatcgaccaggagaatgacgaactgaaaaggcaaattaaacgcttgacgtcgggccttcaggggaaacccctgaccgacaataagcagtcactcatcgaagaattgcagcgtaaggtgaagaagctcgagaaccagcttgaggggaaggtggaggaggtcgatcttaagccaatgaaggaaaagaatgccaaggaagaactgattcgctgggaagagggaaaaaaatggcaggcaaaaattgagggaattcggaataagctgaaagagaaggagggggaagtgtttacactcacgaagcagttgaataccctaaaagatttgttcgccaaggcagataaggagaagttgacactccagagaaagctgaagacaaccggaatgacagtggaccaggttctcggaattcgtgccttggaatctgagaaggagctcgaagaactcaagaagcgcaacctggacctagagaatgacatcttgtacatgcgcgcccatcaggccttgcctagagatagcgtagtggaagatctccacttacagaacagatatctgcaagagaaattgcacgccctcgaaaagcagttcagcaaggacacctacagcaaacctagcatctccgggatcgaaagcgacgaccattgccagcgagaacaggagctccagaaggaaaatctaaaactgtcctcggagaacattgagttgaagtttcaattagagcaggccaataaggacctgccacggctaaaaaaccaagtcagagacctgaaggaaatgtgcgaattccttaagaaggaaaaggctgaagttcagcgcaaattgggccacgtacggggttctggcagaagtggaaagacaatcccagaactggagaaaaccattggactgatgaagaaagtcgtggaaaaggtgcaacgtgagaatgagcagctaaagaaggcttccggaatcctgacatctgaaaagatggcgaatattgagcaggaaaacgagaagctaaaagccgaactggagaaactgaaggctcatctggggcaccagctaagcatgcattatgagagtaagactaaaggaactgaaaagatcatcgcagagaatgagcgccttagaaaagaacttaagaaggaaacagacgcggccgagaaattacgtatagccaaaaacaacctcgagattttgaacgagaaaatgaccgtacaactggaggaaacagggaaacgccttcagtttgccgagtccagaggccctcagctggagggagctgactctaaatcttggaagagtatcgtggtcacaagaatgtatgaaactaagctgaaggagttggaaactgacattgcgaagaagaaccagagcatcaccgacctaaaacagctggtgaaagaagctaccgagagggagcagaaggtaaataaatataacgaggaccttgagcaacagatcaaaattctgaagcacgtgcccgagggagcagagacggagcagggactcaaaagagagctgcaggtcctgagactagcaaatcaccagctggacaaggagaaggccgagttaatacaccaaatcgaagccaataaagaccaatccggagccgaatctactattcccgacgccgatcagttgaaggaaaagatcaaggacctggagacccagttaaaaatgtcagatctggagaagcagcatctgaaggaggagattaagaagttaaagaaggaacttgagaactttgacccttctttcttcgaggagattgaagatttgaagtataactataaagaagaggtgaaaaagaatattctgctggaggaaaaagtgaaaaagctctcagagcagctgggcgtggagctcacatccccagttgctgccagcgaggagtttgaagacgaagaagaatcccctgtaaattttcccatttattag

SEQ ID NO: 182475 - DNA, 4620 bp, Artificial Sequence
  Description of Artificial Sequence: Synthetic coding sequence
atggccatcttcaagatcgccgccctgcagaaggtggtggacaactccgtgtccctctctgaactggagctggccaataagcagtacaatgagctcaccgcgaagtaccgcgacattctgcagaaagacaacatgctggtgcaaaggacaagcaacctcgaacatcttgagtgtgaaaacatttccttaaaagaacaggtagagagcatcaacaaggaactggagatcaccaaggagaagcttcatacaatcgagcaggcctgggagcaggagactaaactgggtaacgagagttcgatggataaagcaaagaagtcaattaccaattcagatattgtgagcataagcaaaaaaattacaatgcttgagatgaaagagctcaatgaaagacagagagcagagcactgccaaaaaatgtatgagcatctgcgcacctctctaaagcagatggaagagcgaaatttcgaactcgaaacaaaattcgcggagttgaccaagatcaacctggacgctcagaaagtggaacagatgttacgcgacgaactggcagactcggtcagcaaagccgtctcagatgctgaccgtcaacgcattctcgaactggaaaagaatgagatggaactgaaagtagaagtgtcgaagcttcgcgagataagcgatatagcccgcagacaagtagagatattgaatgcacagcagcagtcaagggataaggaggtggaaagcctgaggatgcaactgctagactaccaggcacagtcagacgaaaagtccctgatcgccaaactccaccagcacaacgtttctctccagctgtctgaggcgactgcccttggaaagctggaaagcataacaagtaagcttcaaaagatggaggcctacaacttgcgactcgagcaaaagttggacgaaaaagaacaggcactatattacgctagactcgagggccgaaacagagcaaagcatctgagacaaaccattcagtctctgcgtaggcaatttagtggggccctgccactggctcagcaagaaaagttttctaaaaccatgattcagctgcagaatgacaaactgaagataatgcaggagatgaaaaacagccagcaggagcacaggaatatggaaaataaaaccctggagatggaactgaaactaaagggattagaggaactgatctccacactgaaggacaccaagggcgcacagaaggtgattaattggcacatgaaaatcgaggagctccgccttcaggagctaaaactcaacagagagcttgtgaaggacaaggaagagatcaaatatctgaataacatcatttcagaatacgagcggaccatttcctcccttgaagaagaaatcgtgcagcagaacaaatttcatgaagagcggcagatggcttgggaccaaagggaggttgacttggagcgccagctcgatatctttgacagacaacagaatgagattctcaacgccgctcagaagttcgaggaggcgacggggagtatacccgacccttccctcccattacccaaccagctggagatcgcgttaagaaaaatcaaggagaatatcagaatcattctggagacaagagccacctgtaagagccttgaagaaaagctgaaggagaaggagagcgcgctgcgtctggcagagcagaacatcctgtcccgcgacaaggtcatcaacgagctgcgtctccgactcccagctactgccgagcgtgagaaactaatagctgagctgggacgcaaggaaatggaacccaagagtcatcataccctgaagatagctcatcaaacgatcgctaacatgcaggctcgtctcaatcagaaggaagaggtgctgaaaaagtatcaacgccttctggaaaaggcacgagaagagcaacgggagatagtgaaaaaacacgaagaagacttgcatattctgcatcacaggttggaactgcaagcagattcttctctgaataagtttaagcagactgcctgggacctgatgaagcagtcacccactcccgttcctaccaacaaacattttatcaggctggccgagatggagcagacagtggcggagcaggacgactctctctctagtttgctagtcaagctcaaaaaggtttcgcaggatcttgaacgccagcgggagattactgagttaaaagtgaaggagttcgagaatatcaagctgcagctgcaggagaaccacgaagacgaagttaaaaaagtgaaagcagaggttgaagacctcaaatatcttctcgaccagagccagaaagagagccagtgcctcaaaagcgagttgcaggcacagaaggaagccaactcgagagcgccaaccacgacaatgaggaaccttgtggagcggcttaagtcacaactggctttaaaagagaaacagcagaaagccctgtcaagagcactgctggaactgagagctgagatgacggccgctgctgaggaacggatcatctccgccacaagccagaaggaagctcatctgaacgtgcagcagatagtggatagacatacacgggaactgaaaacccaagtggaggacctcaacgagaacctcctgaaactcaaagaggcattgaaaacgtccaagaaccgggaaaacagcctgactgataacttaaacgacctaaacaatgagcttcagaaaaagcagaaagcctacaataaaatcctgcgcgaaaaggaagaaatcgaccaggaaaatgacgaactgaagagacagataaagcggctgacaagcggtctccagggaaagcctcttacagacaataaacaatcactgattgaggagctgcaacgcaaggtgaagaaattggaaaaccaactggaggggaaagttgaagaagtcgatcttaagcccatgaaggaaaagaacgcaaaagaggaacttatccgatgggaagaaggaaagaaatggcaggcgaaaatagagggaatccggaataagttaaaggagaaggaaggagaagtgtttacactgaccaagcagctcaataccttgaaggacctgtttgcaaaagcagacaaggaaaagctgacactccaaaggaagctcaagactacagggatgaccgtcgaccaggtcttgggaatacgggccctggaaagcgagaaagagctcgaggagctcaagaagcggaatctcgacctggaaaatgacatcctgtatatgagggcccatcaggcattgcctagagacagcgttgtcgaagatctccacctccagaatcgatatcttcaggagaagctgcacgctctggagaagcagttctcgaaggacacttattctaagcccagcatttccggcatagagagcgatgaccattgtcagcgtgagcaggaactgcagaaagaaaatctgaagttaagcagtgagaacatagagctcaagtttcagctggaacaggccaataaggacttgcctcggctaaaaaatcaggtaagagaccttaaagagatgtgtgagtttctcaagaaggaaaaggctgaggtgcaacggaagttagggcatgtgagagggtctggtaggagcggaaaaaccattcctgagttggagaaaaccatcggtctgatgaaaaaggtggtggagaaagttcagcgggagaacgaacaactgaaaaaggctagtggcatactgacatctgagaaaatggcaaatattgagcaggaaaacgagaaactgaaagcggaactcgagaaactcaaagctcacctagggcaccagctgtcgatgcactacgagagcaagaccaaagggaccgagaaaataatagccgagaatgagagactacgtaaagagctgaaaaaagaaaccgatgctgccgaaaaattgcgcattgcgaagaacaatcttgagattcttaacgaaaaaatgacagtccagctcgaagagaccggcaagcggttgcagtttgcagagagccgtggaccccagctcgagggcgcggactccaaatcatggaagagcattgtggtcactcgcatgtatgagactaaacttaaagagctggaaacagatattgcaaaaaagaaccagagtatcactgatctgaagcagctggtcaaagaggctacagaacgcgagcagaaagtgaacaagtacaacgaagacctggagcagcagatcaagatcctgaagcacgtacctgaaggcgctgagaccgaacaaggcttaaagcgcgaactgcaagtgctgagactcgctaatcatcagctggacaaagagaaggcagagctgatacatcagatcgaggcgaataaagaccagtccggcgccgagtcaaccatacctgatgctgaccagctaaaggagaaaatcaaagacctcgagacacaacttaagatgagtgacctggaaaagcaacacctcaaggaggagattaagaaactgaagaaggagctcgagaatttcgatccttccttcttcgaggagatcgaagatctgaaatacaactacaaagaggaagtgaaaaaaaatatcctgcttgaagagaaggtgaagaagctctccgaacagttaggggtagagctcacaagtccagtggccgcttctgaggagttcgaagacgaggaagaaagccctgtgaattttcccatatattag

SEQ ID NO: 182476 - DNA, 2415 bp, Artificial Sequence
  Description of Artificial Sequence: Synthetic coding sequence
atgccccccaacatcaactggaaggagatcatgaaggtggaccccgacgacctcccgcgccaggaagagctggcagataatcttctcatctcgctttccaaagttgaggtgaacgagctcaaaagcgaaaagcaggaaaatgtgattcacctgtttcggataactcagagcctgatgaagatgaaagctcaggaggtggagctggccttggaggaagtggagaaagccggcgaggaacaggctaaatttgagaaccagttgaaaacgaaggtcatgaaactggagaatgaactagaaatggcccagcagagcgcgggtggtcgcgatacccgattcctccggaacgaaatttgtcaactggagaaacagcttgaacagaaagatcgggagctcgaggatatggaaaaagaactagagaaggaaaagaaagtgaatgaacaactggcacttcgcaatgaggaagctgagaatgagaactcaaaactgcgcagggaaaataaacgactgaaaaagaaaaacgagcagctctgtcaagacattattgactaccagaagcagatcgattctcagaaggagaccttgctgagccgccgaggagaggattctgactatcgtagtcagctgagcaagaaaaactacgaactgatccagtacctggacgaaattcagacactcacagaggccaacgaaaaaatcgaagttcagaaccaggagatgcggaagaacctggaagagtctgtgcaggagatggaaaaaatgaccgacgaatacaaccgcatgaaggctatagtgcatcagaccgacaacgtaatcgatcagctgaagaaggaaaatgaccattatcagctgcaggttcaggaactgacagacctactgaaatctaaaaacgaggaagatgatcctatcatggtggccgtgaatgctaaagtggaagaatggaaattgatactgtctagtaaagatgacgaaattattgaataccaacagatgctccataatctcagggagaagctcaaaaatgcacagctggacgcagataagagcaatgtgatggctttgcagcagggtatccaggaaagggactctcagatcaaaatgctgacggagcaagttgagcagtacaccaaggagatggagaagaatacatgcatcatagaagacctgaaaaacgagttgcagaggaacaaaggcgcctccacgctgtcccagcagactcatatgaaaatccagtccaccctagatatcctgaaggagaagacgaaagaggctgagcgcactgccgaactagctgaggctgatgcccgcgaaaaggacaaggaactggtggaagctctgaagaggctgaaggactacgagtccggagtgtacgggttagaagatgccgtcgtggagatcaagaactgtaagaaccagataaagattcgcgaccgagaaattgagatactgactaaggaaattaataagctggaactcaagatttcagactttctggacgagaatgaggccctgcgcgaaagagtaggccttgaaccaaagaccatgattgatctgaccgaatttcgcaatagtaagcaccttaaacagcagcaataccgggcggagaaccagatcctgttgaaagagattgaaagcctggaggaagaaaggctcgatctgaagaagaaaattcgacagatggcccaggagcgcggtaaaagatccgccacaagtgggttgaccacggaagatcttaacttgaccgagaacatcagccagggggaccgtatttcggagcggaaactggacctgctgtctctgaagaatatgagtgaagctcagtcaaagaacgagttcctttccagagagctcattgaaaaagaacgagacttggaaaggtccaggactgttattgcaaagtttcagaacaagctcaaggaattagtcgaggaaaataagcagctcgaagaggggatgaaagagattctgcaggccataaaagagatgcagaaggaccccgatgtcaagggtggcgagacttcgcttatcattccctccctcgaaagactggtgaacgccatcgaaagcaagaacgcagaggggatttttgatgcatccctgcacctgaaggctcaagtggaccagctcactggccgaaacgaggagttgcgtcaagaactaagggagagtcgcaaggaggccatcaattactcacagcagttagccaaggcaaacctcaaaatcgaccatctcgaaaaggagacttctttactcagacagagtgagggctccaatgtcgtattcaaagggatcgatttgcccgacggcatagctcccagctccgcgtctatcatcaatagccaaaatgagtacctgatccacctgctgcaggagctagaaaataaggaaaaagtgaaggagtttagaagatttagctag

SEQ ID NO: 182477 - DNA, 1650 bp, Artificial Sequence
  Description of Artificial Sequence: Synthetic coding sequence
aagatggcccagcagagcgccggcggccgggacacccggttcctgagaaatgagatctgtcagcttgagaagcagctggagcagaaggacagagagctagaagatatggagaaagagttagagaaggagaagaaggtgaacgagcagcttgccctgcgcaatgaggaagcagaaaatgagaacagtaagttaagacgcgagaacaaacgcctgaagaagaagaacgaacaactgtgccaagacattattgattatcagaaacagattgactcacagaaagagactctgttgagccggcgcggggaggacagcgactatcgtagtcagctgagtaagaagaattacgaactgatccagtacctcgacgaaattcagactcttactgaggccaacgagaagattgaggtccagaatcaggagatgcggaaaaatttagaagaatcagtacaagagatggagaaaatgacagacgaatataatcgcatgaaggccatcgtacatcagacagataatgtgatcgaccagctgaaaaaggagaatgatcactatcaacttcaagtgcaggagcttacggatttactgaagagcaaaaatgaggaggacgaccccatcatggtggcggtgaatgccaaagtggaggaatggaagttaatactgtcttccaaggatgacgagataattgaatatcaacagatgctccacaatttgcgggagaaactaaaaaacgcccagttggacgctgacaaaagcaacgtgatggctttgcagcagggcatccaggaacgcgactctcagattaaaatgctcactgagcaggtcgaacagtacacaaaggagatggagaagaatacctgtattatagaggatctgaaaaacgaactgcagcgaaataagggtgcaagtacgctctcccagcagacacatatgaagatacaatccactcttgacatccttaaggagaagacaaaggaagcagaaaggacagccgagctagccgaagccgatgcgagggaaaaagacaaggagctagtggaagcattaaagagactgaaggactacgagtccggtgtttacggtctagaagacgctgttgtggagattaagaattgtaagaaccagatcaagattagagatcgcgaaatcgagatcctgactaaggagatcaacaaactcgagctcaaaataagcgacttcctcgacgaaaacgaggctctgagagagagggtcggcctggaacccaagaccatgatcgatctgaccgagttcaggaactcgaagcacttaaaacaacagcaatacagggccgagaatcagatactactaaaggagattgagtcccttgaagaggagagacttgatctgaaaaagaagatacgccagatggctcaggagagggggaagcggtctgcaaccagcggcctcaccacagaggatctgaatctgacagaaaatattagtcaaggagaccgtatcagcgaacggaagttggacctgctgtctcttaaaaatatgtcagaagctcaatctaagaacgaatttctatcgcgagaactgattgagaaagaacgagacctggaaaggtcccgtaccgtcattgccaagttccaaaataagtgttaccggattaaagaatgccgtcgcaacctgtag

SEQ ID NO: 182478 - DNA, 4620 bp, Artificial Sequence
  Description of Artificial Sequence: Synthetic coding sequence
atggccatcttcaagatcgccgccctgcagaaggtggtggacaactcagtgagcctgagtgaactggagctggctaataagcagtacaacgagctgaccgccaagtatagggacatccttcaaaaggacaacatgctggtgcaaagaacaagcaatctcgaacacctggaatgtgagaacatttcgctgaaagaacaggttgaatcgattaataaagaattggagatcactaaggagaaactccacactatcgaacaggcctgggagcaggaaaccaagctgggcaatgagtcttctatggacaaggcaaaaaaatcaattactaatagtgacattgtttctatctccaagaaaatcaccatgctggagatgaaggagctgaatgagcggcagagggcagagcactgtcagaaaatgtacgagcacctgaggacctcactgaagcagatggaggaaaggaattttgaactcgagacgaagttcgccgagctgactaaaatcaatctagacgcgcagaaagttgagcaaatgctccgggacgagctggctgattcagtttcgaaagccgtgtctgacgccgatcgacagaggattcttgagttggaaaagaacgagatggaactcaaggtggaggtgtcgaaattgagagaaatttcggacattgcacggcgccaagttgaaatcctgaacgcgcaacagcagtctagggacaaagaagttgagagcctgcgcatgcaactactggattatcaggcccagtcagacgagaaatcccttattgctaagctccaccaacacaatgtgtctctgcagctcagcgaagccacagccttaggaaagctagagtctattacctcaaaactgcagaagatggaggcgtataatctgagactggaacaaaaacttgatgagaaagagcaggcgctttactacgcccgcctcgaaggcagaaatcgtgctaaacatttgagacaaacgatccagtccctcagacgccagttttcaggcgccttgccactggcacagcaagaaaagttcagcaaaactatgattcaactgcagaatgataaacttaagataatgcaagagatgaaaaattcacagcaggagcaccgaaacatggagaataagacactggagatggagctgaagcttaagggtctagaagaactcattagtacactgaaggacacaaaaggcgcccagaaagtgatcaactggcatatgaaaattgaggagctgagacttcaggagctaaagcttaacagagagctggtaaaagacaaagaggaaatcaaatatctgaataacatcatttccgaatacgagcgaacaatcagctctttggaggaagagatcgtgcaacaaaataagtttcacgaagagagacagatggcctgggaccagcgggaggtcgatctggagcggcaactggacatcttcgatcgacagcagaatgaaatcttgaatgccgcgcaaaagttcgaggaagcgactggcagcatcccggatccgagtctccctttaccaaatcagctggagatcgccctcagaaagatcaaagaaaacattagaattatactggaaacacgcgccacctgcaagagcttggaagaaaaactgaaggagaaagaatccgcactgcgactagctgaacagaatatcttgtctcgggacaaggtgattaacgagctccgattgagacttccagctacagccgaacgcgaaaagctgattgcggagctcggacgaaaggagatggagccaaaatcacaccataccttgaagattgcacaccaaacgatcgctaatatgcaggcgcgcttgaaccagaaggaagaggtccttaaaaagtaccagcggctgctggagaaggctagagaagaacaaagagagatcgtgaagaagcatgaggaggatctgcacatactgcaccaccggctggaactacaagccgactccagcctaaataaatttaagcagactgcatgggaccttatgaagcagagcccaacacctgtgccaactaacaagcatttcatccgactcgccgagatggagcagaccgtcgctgagcaagatgacagcctctcatcactgcttgtgaagctcaagaaggtttcacaggacctagagaggcagcgagagattacagagcttaaggtcaaggaattcgagaatataaaactgcaacttcaggagaatcatgaagatgaggtgaagaaagtcaaggccgaggtcgaagacctgaagtatcttcttgatcagagccagaaggagagtcagtgcctcaaatcagagctgcaagctcaaaaggaggcaaatagccgcgcacctacaacaacgatgcgtaacttagtcgagagacttaaaagtcagctggctctcaaggaaaagcagcaaaaggcattgagtagagcactgctcgagctgcgggctgagatgacggcagccgctgaagagaggatcatctccgccacctcccagaaggaggcacaccttaatgtccaacaaatagttgatcgtcacacccgcgaactcaagacacaagtggaagatctgaatgagaatttactgaagctgaaagaagcgctgaaaacaagtaaaaaccgggaaaattccctgacggacaacctgaatgatttgaacaatgagctgcagaaaaaacaaaaggcttacaacaagatccttcgagaaaaagaagaaatagatcaggagaatgacgagctgaaaaggcagatcaagcgcctcacctctggactgcaaggaaagcctctcactgataataaacagtcacttattgaagaactgcagaggaaggtgaaaaaactcgagaatcagcttgagggaaaagtggaggaggtcgacctaaagccaatgaaggaaaagaacgccaaagaagaacttattaggtgggaagagggcaagaagtggcaggcaaaaatagaaggcatcagaaacaaattaaaagaaaaggagggggaagtattcacactgacaaagcagctgaacaccctgaaggacctgttcgcgaaagctgataaggagaagcttacacttcagcggaagttaaagactaccggaatgacggttgatcaggtgctgggcatccgcgcactcgaatctgaaaaggaactagaagaacttaagaaacgaaacctcgatctggaaaacgacattctgtatatgcgagctcaccaggccttgccgcgcgactccgtcgtcgaggacctgcatctccaaaatcggtatctgcaggagaaattgcacgccctcgagaagcagttttccaaggacacttactctaagccttcgatctcaggcattgaatcagacgatcactgtcaaagagagcaagaactgcagaaggagaatcttaagctgtctagcgagaatattgagcttaaatttcagcttgaacaggcaaacaaagatctgccaaggttgaagaatcaggtgcgcgatttgaaagagatgtgtgagttccttaagaaggagaaagcggaggtgcagaggaagcttggacatgtcaggggaagtggtcgttcaggcaaaacaatccctgaactggagaagaccattggcctgatgaaaaaggtggtagagaaagtacaaagagagaatgaacagttgaagaaggcatccgggatcctcacatctgaaaaaatggccaatattgaacaggaaaatgagaagctcaaggcggaactcgaaaagctgaaggcgcaccttgggcatcagctctccatgcactacgagtcaaaaactaagggcacagaaaagattattgctgaaaacgagcgcctcagaaaagagctgaaaaaggagaccgatgctgccgaaaagttacgcatagcgaaaaacaacctggagatcttgaacgagaaaatgacggtgcaactagaggaaaccgggaagagactgcagttcgcagaatctaggggcccccagttagagggggctgacagcaagtcctggaaaagcattgtcgtcactagaatgtacgaaacaaagcttaaagaacttgaaaccgatatcgcaaaaaagaatcagtctattacagatttgaagcagctggtgaaggaggcgaccgaacgggagcagaaagtgaataagtacaacgaagacctcgagcagcagattaagattctcaagcacgtccccgagggcgcagaaacagagcagggcctgaagagagaactgcaggttctgaggttagccaaccaccagctcgacaaagagaaagctgagctgatccaccagattgaagcgaataaagatcagtccggcgcagaatctaccattccggacgctgaccagcttaaggaaaagatcaaggaccttgagacccaattgaagatgagcgacctggagaagcagcacctcaaagaggagataaagaagctcaaaaaagaactggaaaactttgaccctagtttttttgaagaaatcgaagacctcaagtacaactataaggaagaggttaaaaagaacatccttctggaggaaaaggtgaaaaagctgtcggaacagcttggtgtagaactgacatcacccgtggccgcttccgaggaattcgaggatgaggaagagagtccagtgaactttcctatatactag

SEQ ID NO: 182479 - DNA, 7440 bp, Artificial Sequence
  Description of Artificial Sequence: Synthetic coding sequence
atgccccccaacatcaactggaaggagatcatgaaggtggaccccgacgacttgccacgtcaggaagagttggccgacaatctgctgatttctctgtccaaggtcgaggtgaatgagcttaagagcgagaagcaggaaaacgtgattcatttgttcagaatcacacaatctctgatgaagatgaaagctcaggaggtagagttggccctggaggaagtcgagaaggccggcgaggagcaagcaaagtttgaaaaccaactaaagaccaaagtgatgaaacttgagaacgagcttgagatggctcaacagtctgccgggggccgagacacccgcttccttaggaatgaaatctgtcagcttgagaaacagctcgagcagaaagatagggaattggaggacatggagaaagagctggagaaagagaaaaaggtgaacgaacaactggctttaagaaatgaagaggcagagaatgagaattctaagctccggagggaaaacaaaagactcaaaaaaaagaatgagcagctctgtcaagacattatagactatcaaaagcagatcgattcccagaaagaaactcttcttagcaggagaggcgaggatagcgactaccgcagccagctcagcaagaagaattatgagttaattcagtatctggatgagatccaaactctaactgaagctaatgagaagatagaggtgcaaaaccaagagatgagaaaaaacctggaggaaagcgtgcaggagatggagaagatgacagacgagtacaataggatgaaggcgatcgtccatcagaccgacaacgttatcgatcagctcaagaaagaaaacgaccactatcaactgcaggtgcaggaactaacggaccttttgaagagcaagaacgaggaggatgatcccatcatggtggcggtgaacgcgaaagtcgaggagtggaaactcattctgagctcgaaagatgacgagataatagaatatcagcagatgctccataatcttcgcgagaagctgaaaaacgcccagctagacgccgacaagagcaatgtgatggcccttcagcaaggtattcaggagcgagattcacagatcaagatgttaaccgaacaggtggaacagtacaccaaagagatggagaaaaacacttgcattattgaagacttgaagaacgaactgcagcgcaataaaggagctagtaccctctcacagcaaactcacatgaagatccagtctactttggatattctaaaagagaaaactaaagaggccgaacggacagcggagcttgcggaggccgatgcgcgggagaaagataaggaactggtggaagctctaaagaggttgaaggattatgagagcggcgtgtatggtctggaggacgccgtggtcgagattaagaactgtaagaaccagatcaagatccgggaccgggaaatcgagattctgacgaaggaaataaataagttagagcttaagattagcgactttctggacgaaaatgaagccctcagggaacgcgtgggtctcgaacctaagacaatgatcgacctgaccgaattcagaaactcaaaacacctgaagcagcagcaatatcgtgctgaaaaccagatactcttgaaggagatagagtcgctggaagaggagcggctggatctgaaaaagaaaattcggcaaatggcccaggaacgggggaaaaggagcgcaacaagcggccttactaccgaggatctcaacctcaccgaaaatatcagccagggagatcgcatctccgagcgtaaacttgacctcctgtcacttaagaacatgtctgaagcccagtctaagaatgaattcctgtctcgagaactgattgaaaaagaacgggacctggaacggtctaggacggtgattgccaaattccagaacaagcttaaagaattggtcgaggaaaataagcagctggaagaggggatgaaagagatactgcaggctatcaaggaaatgcaaaaagaccccgacgtgaagggaggggaaacaagcctcattatcccttcactggaaagactggttaatgctatcgagtctaaaaacgccgagggcatctttgatgctagcctgcatcttaaggcccaagttgaccaactcacaggccgcaatgaagagctccgccaagagctccgggaaagccggaaagaggctatcaattactcacagcagcttgcgaaggcaaacctgaaaattgatcacctagagaaggagaccagcctcttgcggcagtcagagggaagcaacgtggtcttcaagggtattgatctacccgacgggatcgcaccgtccagtgccagcattataaactctcagaacgaatatctgatccacctgctacaggagttggaaaataaagagaaaaagctcaaaaatctggaagactccctcgaagattacaacagaaagttcgcagtcattcggcatcagcaaagcttactgtacaaggagtacttgagtgagaaagagacgtggaaaacagaatcaaagaccataaaggaggaaaaaagaaagctcgaagatcaggtgcaacaagatgccattaaggtgaaagaatacaataacctgctcaacgccctgcagatggactccgatgaaatgaagaagattctggcggaaaactcccgaaagataaccgtgctgcaagtgaatgaaaaatcgctgatccgccagtacaccacactggtggagttggaacgccagctgcggaaggaaaacgaaaagcagaagaatgagctgttaagtatggaggcggaagtgtgtgaaaaaattgggtgcctccagagattcaaagagatggccatctttaagatcgcagctctccagaaggtcgtggacaacagcgtcagtctgagcgagcttgagctagccaacaagcaatataacgaattaacagcaaaatatcgcgacatactccagaaggataatatgctcgtgcaaaggacttccaacttggagcacctggaatgtgaaaatatcagtttgaaagagcaggtggaaagcattaataaagaactggagatcaccaaggagaaactgcacacaatcgagcaggcatgggagcaagagactaaactaggcaacgagtcttccatggacaaggccaaaaaatccatcaccaactcagacatcgtgagtatcagcaagaaaatcaccatgttggaaatgaaggagcttaatgagcgccaaagagctgaacactgccaaaagatgtacgaacacttacgcaccagtttgaaacagatggaagagagaaattttgagttagagacaaaatttgctgaactaactaaaataaacctggacgctcagaaggtggaacaaatgctccgcgacgagttggcggatagcgtgtccaaagcagtgtccgacgccgaccggcagagaatcttggaattggagaagaacgaaatggagctcaaggttgaggtcagcaaattaagagagataagcgatattgcccgtagacaggtagaaatactgaacgcccagcagcagtctcgggacaaggaggtggagtccctgcggatgcagttgctggactaccaggcacagtccgatgaaaaatccctgatcgcgaagctccaccagcacaatgtctctctgcagttgagcgaggcgactgcccttggtaagctcgagagcatcaccagtaagctgcagaagatggaagcctataacctgcgactcgagcagaagctcgacgaaaaggagcaggccttatactacgcccgcttggaggggagaaaccgcgcaaaacacttaaggcagacaatccagtccctgcgtcgtcagtttagtggtgctctgcctctcgcccagcaggaaaagtttagcaaaaccatgatccaactacagaacgataagcttaagattatgcaggagatgaaaaattcacaacaggaacatagaaatatggagaataagactttagagatggagctaaagctgaagggcctagaagaactaattagcactctaaaagatactaaaggggctcagaaagtcatcaactggcacatgaaaatagaagagttacgtttgcaggaattgaaattgaaccgcgagctggtgaaagacaaggaggagatcaaatacttgaataacatcattagcgaatatgaacgcacaatcagcagcctggaggaagaaatagtgcagcagaataaatttcatgaggagaggcagatggcctgggaccagcgcgaagtggacttggagcgtcagttggacatttttgatcggcagcaaaacgagatactcaacgccgcacaaaagttcgaggaagcaaccgggagcatcccagacccaagcctcccgcttccaaaccaactggagattgctctccgcaagatcaaagagaatattagaattattcttgagacccgggccacatgtaagtctctggaggagaagttaaaggaaaaagagtcagcgttacgtcttgccgagcagaatattctatcgagagacaaggttataaacgaactgaggctccggctgcctgcgaccgctgaacgggagaagctgattgccgagttaggtaggaaggaaatggagccgaaaagccatcatacactgaagattgcccaccagaccatcgccaacatgcaggctcgactgaaccagaaagaagaggtgctaaagaagtatcaaaggctgctcgagaaggccagagaggagcagagggagatcgtgaagaaacacgaggaggacctacacattctgcaccacaggctggagttacaggcagattcctcactgaataaatttaagcagacagcctgggatctgatgaaacagagtcctacccctgtccccactaacaaacattttataaggctcgccgagatggagcagacagtcgccgaacaggatgattcattaagttctctgctcgtgaaattaaagaaggtctcccaggatctagaaagacagcgagagatcacagaactcaaggtgaaagagttcgagaacattaaactccagctgcaggaaaatcacgaggatgaagtgaagaaagttaaggccgaagttgaggatttgaagtatctgctggaccaatcacagaaggagtcccagtgtttgaaatctgagttgcaggcccagaaggaagcaaacagcagagctccaaccaccacaatgaggaatttggttgaaaggcttaaatcccagctggccttgaaagaaaaacaacaaaaggccctcagcagggccctgctggagctgagggcagagatgactgctgccgcagaggaacgcatcatatccgccaccagccagaaggaggctcacctcaatgtgcagcagattgttgataggcatacacgggaacttaagacacaggttgaggacttaaatgagaacctgctgaagcttaaagaagccctgaagacctccaaaaatagggaaaacagcctgactgataacctaaatgaccttaacaacgaactccaaaagaagcagaaagcatacaataagatccttagagagaaagaagagatcgatcaggagaatgacgagcttaaaaggcagatcaagcgtttgacttcaggactccagggaaagccactgaccgataataagcagagcctgatcgaagaattgcagagaaaagtgaaaaagttagagaatcagctggaaggtaaggtggaagaggtggatctgaaaccaatgaaagaaaagaatgccaaggaagaattgatcagatgggaagaggggaagaaatggcaggctaaaattgaggggattcgcaataagctcaaggaaaaggagggggaagtcttcacgttgaccaagcagctgaacacccttaaagatctatttgctaaagcagacaaggagaagttgactctccagcgcaaactcaagactactggcatgactgtggaccaggtcttggggattagagccctggagagcgaaaaagaattagaagaactgaaaaagcgcaatcttgatctggagaatgacatcctgtacatgagagctcaccaagcgctgccacgtgattctgtcgtggaagacctccatctccagaatcgttatctccaggaaaaattgcacgctcttgagaaacagttctccaaggacacatattctaaaccttctatatctgggatcgagtctgatgatcactgtcagagggagcaggaattacagaaggaaaatctgaaattatcttcagaaaatatcgagctgaagtttcagcttgagcaggcaaataaggatctcccccggctcaagaatcaggtgcgcgacctcaaagagatgtgcgaatttttgaaaaaggagaaagctgaagtgcagaggaaactgggccacgtgagagggtctggcaggagcggcaagaccattccagaattagagaaaactattgggttgatgaagaaagttgtcgaaaaagtacaacgagagaatgaacagcttaagaaagctagtgggatcctaacatccgagaagatggccaacattgagcaggaaaacgagaagttaaaggctgaactagagaagctaaaagcccatctaggacaccagctctccatgcactacgagtctaagaccaaaggaacggaaaagattatcgcagagaatgagaggctaaggaaggaactaaagaaagagactgatgcagcagagaaactgcgaatcgctaaaaacaatcttgaaatattgaacgagaagatgacagtgcagctggaggaaacaggtaaacgcttgcagttcgccgagtctcggggccctcagttagagggagccgactctaagtcatggaaaagtatcgtagtcacacgaatgtacgagaccaagctcaaggagttggagacagatatcgccaagaagaatcagagcataactgatctcaagcaactggtgaaggaagcaaccgaaagagagcaaaaagtgaataagtataacgaggatctggagcagcaaataaagatattaaaacatgtgccggaaggggcagagacagagcaggggttgaaacgggagttgcaagtgctcagactcgctaaccatcagttagacaaggagaaagccgaactcattcatcagattgaggccaataaggatcagtctggagctgagtctaccatcccagatgctgatcagctcaaagaaaagatcaaagatttggagacacagctaaaaatgtccgacctggaaaagcagcacttaaaagaggagatcaagaagctaaagaaggagctggagaatttcgacccttcatttttcgaagagatcgaggatctcaaatacaattacaaggaggaagtgaagaagaacatccttctggaagagaaggtgaaaaaactctctgagcaactgggcgtggagctgacgtcacccgtggccgcctccgaggaattcgaggacgaagaagagtctccagtcaacttccccatctattag

SEQ ID NO: 182480 - DNA, 1512 bp, Artificial Sequence
  Description of Artificial Sequence: Synthetic coding sequence
atggaggagcacggcgtgacccagaccgagcacatggccaccatcgaagcccacgcggttgcccagcaggtacaacaggtgcacgtggctacttacactgaacacagtatgcttagcgccgacgaggactcgccaagcagccctgaggacacgtcatatgacgacagcgatatcctaaattctacagccgccgacgaagtgacagcacatctggccgccgccggccccgttggcatggcagcggctgccgctgttgcaacaggcaagaagcgcaagcggccgcacgtgttcgagtctaatccatctatccggaagagacagcaaactagactgctgcgcaaacttagggctacgctcgacgagtacactacacgagtagggcagcaggcaatagtgctatgcatttcgccttctaagccaaaccctgtgtttaaggtcttcggggcagcccccttggagaacgttgttagaaaatataagagtatgatactcgaagacctagaaagcgccctggccgagcatgccccagcaccacaggaagtgaacagcgagctccccccacttaccatcgatggtatacccgtgtcagtggacaagatgactcaggcgcagctgagagcctttattccagagatgctcaagtactctacaggtaggggcaagcccggatggggtaaagagtcctgcaaacccatatggtggccggaggatattccatgggcaaatgtacgctctgacgttagaaccgaggagcagaaacagagggtgtcatggacccaggcgctgcgcaccatagtgaagaactgctacaaacagcatgggagagaggaccttttatatgcatttgaagaccagcagacgcaaactcaggccactgcaacacacagcattgctcacctcgtaccttctcaaactgtcgtgcagaccttttcgaaccctgacggtacagtatccttgatacaagtcgggaccggggccactgtggcaactctcgcagatgcttcagaattgcccaccacagtaaccgtggctcaggtgaattactccgccgtcgccgacggggaggtagagcagaactgggcgacactgcaggggggcgagatgacaattcagaccactcaggccagtgaagccacgcaggccgtggcctcgttggccgaggcagcggtggccgcatcccaggagatgcaacagggtgctactgtgacaatggccctgaactccgaggccgctgcgcatgccgtggcaacactcgcggaggccacactgcaaggaggcggtcaaatcgtgttgtctggggagaccgctgcagctgttggcgctcttacaggggtgcaggacgccaatgggctggtgcagattcctgtgtcaatgtaccagactgtagtaacatcacttgcccaggggaacgggcccgtgcaggtggctatggcaccagtaaccacaagaataagcgactcagctgtgacgatggatggacaagcagtcgaggtggtcacgctagagcagtag

SEQ ID NO: 182481 - DNA, 906 bp, Artificial Sequence
  Description of Artificial Sequence: Synthetic coding sequence
atgagcctgcggcggcacatcggcaaccccgagtacctgatgaagcgcatcccccagaaccctagataccagcacatcaaatccaggctggatacaggaaacagcatgacaaaatataccgaaaagctggaggaaataaaaaagaactataggtataaaaaagacgaactttttaaacgattgaaggtgaccacttttgcgcaattaataatccaggttgcatccctgtccgaccagacgcttgaagtgactgctgaagaaatccagcggttagaagacaacgactccgccgcgagtgatccggacgcagagaccaccgctcggacgaacggaaagggcaatcctggagagcagtccccctcgcctgagcagtttattaataatgcaggggccggtgatagctctcgctctacattacaaagcgttatctcaggtgtgggagaactagatctggacaaaggacctgtcaaaaaagcagaaccccacaccaaagataaaccttaccccgattgtccatttctgttgctggacgtgcgtgatcgagattcataccaacagtgtcatattgttggggcctactcgtatcctatagctaccctatccaggactatgaacccttatagcaacgacatcctggaatacaaaaacgctcatggcaagatcatcatcctgtacgacgacgatgagagactcgcctcacaggccgcaacaacgatgtgcgagaggggtttcgaaaatctcttcatgctcagcgggggaagacttaatcaagccaacagttctggacgtgagtcaaaggtgcccggcgctcgaagcgctcagaacctcccaggcggggggcccgcgagccatagcaacccaagatctctcagtagtggccatctccaaggcaagccctggaagtag

SEQ ID NO: 182482 - DNA, 165 bp, Artificial Sequence
  Description of Artificial Sequence: Synthetic coding sequence
atgagcctgcggcggcacatcggcaaccccgagtacctgatgaagagaataccgcaaaatccgcgataccaacacattaagtcccgcctggacacaggggcctgtgtgtatctgactagctcacccgccctgcccgactgcgcgatgaatggactgtgcttttag

SEQ ID NO: 182483 - DNA, 858 bp, Artificial Sequence
  Description of Artificial Sequence: Synthetic coding sequence
atgagcctgcggcggcacatcggcaaccccgagtacctgatgaagagaatccctcagaaccctaggtaccagcatattaagagcagactggacactgattaccgctacaagaaagatgaactgttcaagaggctcaaggtgacaacatttgcccagctaattatccaggtggcgagtctgtcagatcagaccctagaggtcaccgctgaagagatccagcgattagaagataacgattctgccgcatccgatccagacgccgagacaaccgctcgcacaaatggcaagggtaatcctggcgaacagtctccctcacctgagcagtttattaacaatgcaggagctggagattcctcacgttcgacattacagtctgtgatcagcggcgtgggagaactggatctcgacaaaggacctgtaaagaaagcagagccacatactaaggacaagccataccctgactgcccattcctcctcctggacgtcagagatagagacagctaccaacagtgtcacattgttggggcatattcctatcctatcgctaccctgtcgcgtaccatgaacccctattccaacgacatcttagaatacaaaaatgcccatggaaaaattatcatcctgtatgatgatgatgaacgcctggcgtcacaggccgctacaacaatgtgtgagcgcggattcgaaaaccttttcatgctaagtggcggtaggctgaaccaggcaaacagttccgggagggaaagcaaggtgcccggggcccgatctgcccagaacctgcctggcggcgggcccgcatcacattctaacccccgtagtctgagctcaggccacttgcagggaaagccctggaaatag

SEQ ID NO: 182484 - DNA, 1200 bp, Artificial Sequence
  Description of Artificial Sequence: Synthetic coding sequence
atgagcagccggagcaccaaggacctgatcaagagcaagtggggctcaaaaccctcaaactccaagagtgagacaaccctggaaaaattaaaaggtgaaattgctcaccttaaaactagtgtggacgagatcacctctggcaaaggcaaattaaccgataaggaaagacataggctgctagagaaaatccgggtgttggaagcagagaaggaaaagaatgcctatcagctgacagaaaaggataaagagatccagaggctgcgcgatcagttgaaggctcgctattcaactacgacgcttttggaacagctggaggaaacaactagagagggtgagcgacgcgaacaagttctgaaagccctgtctgaggagaaagacgtgctgaagcagcaactgagcgccgctacaagtcggatagctgagctggaaagcaaaactaatacattgagactttcccagacagtggccccaaactgcttcaactcttcaattaataatatacatgagatggaaatccagctcaaagatgcacttgagaaaaaccagcaatggctggtttatgatcagcagcgtgaggtttacgtcaagggactactggccaaaattttcgaattggagaaaaagactgaaactgctgcccattctctaccccagcagactaagaagcccgaaagcgagggctacctgcaggaggaaaagcagaagtgctataacgatctgttggcttccgcaaaaaaggatttagaagtcgagaggcagaccattacccagctgagcttcgaacttagcgagttcagacggaagtatgaagagacccagaaagaagtgcacaaccttaaccagctgctatattcccagagacgggcggatgtccaacacctcgaggatgacaggcacaagaccgagaagattcaaaaattaagggaggagaacgacatcgcccgcggtaagctcgaggaagaaaaaaagcgttccgaggagctgttgagtcaggtacagtttctctatacctcccttttgaagcagcaggaggagcaaacacgtgtggcgctccttgaacagcagatgcaagcttgcactttagattttgagaatgagaaactggacagacagcacgtgcagcaccagctccatgtcattttaaaggagctgcgcaaggcccggaacaatacagtaggcattttggacaccaaatcttag

SEQ ID NO: 182485 - DNA, 1395 bp, Artificial Sequence
  Description of Artificial Sequence: Synthetic coding sequence
atgagcagccggagcaccaaggacctgatcaagagcaagtggggctctaagcccagcaactccaaatccgaaaccactctggagaagctaaagggagagatagcacatttgaaaactagtgtggacgaaatcacgagtggaaaggggaagttaaccgataaggagcgccacagattgctggagaagatcagggtccttgaggctgagaaagagaaaaacgcctatcagctgacagaaaaggacaaggagattcagcggctgagagaccagctgaaagccagatattcaacgactacactgctggagcagttggaggaaaccaccagagagggcgaaaggagagaacaggtcctcaaagccctgtctgaggagaaggatgtactcaagcagcagctcagcgcggccacctcacgaatcgccgagcttgagagcaagacaaatacactgcgcctgagtcaaacagtggcacctaattgcttcaattcatccataaacaatatacatgagatggagattcagttaaaggacgcactggagaagaaccagcaatggcttgtgtatgatcaacagcgcgaagtctacgttaagggactgctcgccaagatattcgagctagaaaaaaaaaccgagaccgctgcccattccctccctcaacagactaagaagccggagagtgagggctacctgcaggaagagaagcagaaatgttataatgatctccttgcgtctgccaaaaaggatcttgaagtggaaaggcagaccataacccagctctctttcgaattgtctgaatttcgaagaaaatacgaggagacccagaaagaagtccacaacctgaaccagctcttatattcccaaaggagagcagatgtgcagcatctcgaggatgatcggcataagacagaaaagattcagaagctgcgcgaggagaacgacatagcgagaggcaaactggaggaagagaagaagcggagcgaggagctgcttagccaggtgcagtttctgtacacatcactcctaaagcaacaagaggaacagacaagggtcgcgctcctagagcagcagatgcaagcatgcacactggacttcgagaacgaaaaacttgatcgccaacatgttcagcatcagctgcacgtcattctgaaagagttgcgaaaagcccggaaccagatcacacagctcgagagtctgaaacaattacacgagttcgctattactgaaccgttggtgacctttcagggagagacagagaacagggagaaagtcgctgcctcccctaagtcccccaccgccgcactgaacgaatcactggtggagtgccccaagtgcaacattcagtatcccgcaacagaacatagagatctactggtccacgtcgaatattgcagtaagtag

SEQ ID NO: 182486 - DNA, 627 bp, Artificial Sequence
  Description of Artificial Sequence: Synthetic coding sequence
tgaagcagcatcaacaacatccacgagatggagatccagctgaaggacgcccttgaaaagaatcagcagtggctggtgtatgatcagcagcgggaggtctatgtgaaggggctcttagccaaaatatttgaattggaaaagaaaactgaaacagccgcccattcactaccacaacagactaagaaacccgaaagcgaaggttatttgcaggaggagaagcagaagtgctataatgacctcctggcctctgccaagaaagatttggaggtggagcgccagactatcacgcagctgtcatttgaactgtctgaatttaggagaaaatacgaggagacacaaaaggaagttcacaatctgaaccagttattgtactcacagcgtagggctgacgtacagcacctcgaggatgatcgtcacaaaacagagaagattcaaaaattgagagaggagaatgatatcgctcgcggaaaactggaggaagaaaagaagaggagtgaggagttactgtcccaggtccagttcctctacacaagtctcctgaaacagcaggaagagcagacacgtgtagccctgctggagcagcaggtattaatccgagtagcctctaagttcaatagcgcctgttag

SEQ ID NO: 182487 - DNA, 1425 bp, Artificial Sequence
  Description of Artificial Sequence: Synthetic coding sequence
atggccgccgccagcgtgagcgccgccagcggcagccacctgagcaactcatttgccgaaccatccagaagcaatggctccatggtgaggcattcttcctcaccttacgtggtgtacccatctgataaaccttttctaaacagcgacttgcgccggagtccgtccaagcccaccctggcttaccctgagagcaatagcagggccatattttcggccctgaagaaccttcaagataaaataagaagactggaactggaaagaatccaagctgaggaatctgtgaaaactctgagcagagagacaatagaatacaagaaagtgcttgacgagcagatccaggagagagagaactcaaagaatgaagagagcaagcataaccaggaacttacatcccagctactggccgcagaaaacaaatgcaaccttctagagaaacaactggagtacatgagaaacatgatcaagcacgccgagatggagcgcacctcagtccttgagaaacaggtgagcctggagagagaacgacagcacgaccagacgcatgtacagtcacagcttgagaaactggaccttttagagcaggagtataataaactcaccactatgcaggcccttgccgaaaaaaagatgcaggaactggaggccaagctccacgaagaggaacaagagaggaagagaatgcaggcgaaggccgccgaactgcaaaccggcctcgaaaccaacaggctcatttttgaggataaagcgacaccttgtgtgcctaatgcccgacgcatcaaaaaaaagaagtcaaagcctccagaaaagtccacatcaccgtctcatgctgtggtggcgaacgtgcaacttgtcttacacctgatgaaacagcattctaaggccttatgcaatgatcgcgtgattaactcaatccccttagcaaagcaggtcagctctaggggtgggaagtcaaaaaagctgagtgtgactcccccttcttccaatggaattaacgaggagcttagtgaggtcttacagacgcttcaggacgagttcgggcaaatgtcatttgatcaccagcagctggccaagctgattcaagagagtcctaccgtcgagctcaaagacaagctggagtgcgagttggaagcccttgtaggacggatggaagccaaagccaaccagatcactaaagtcagaaaatatcaggcccagttagaaaagcagaagttagagaagcagaaaaaagagctgaaggccactaagaagacattggacgaggagaggaactcgtcctctcggagcggaatcacgggcaccactaataagaaggattttatgaaactacgtccaggggaaaaacgccgcaagaacctgcagctcctgaaggatatgcagtctatccagaattccctccaatcttcaagtctctgctgggactattag

SEQ ID NO: 182488 - DNA, 1503 bp, Artificial Sequence
  Description of Artificial Sequence: Synthetic coding sequence
atggccgccgccagcgtgagcgccgccagcggcagccacctgagcaacagcttcgctgagccatcaagatctaatggatccatggtcaggcacagtagttccccgtacgtagtgtacccttcagacaagccgttcctgaattcagacctaaggcgttctccctctaagcccactctggcttaccccgagtctaattccagagccattttcagcgccctaaagaacttacaggacaaaatacggcggctggagctagagaggatccaagcagaggagtcagtgaaaactcttagtagagaaaccatagaatataagaaagtgctagacgagcagatccaggaacgggagaattcaaagaatgaggaaagtaagcacaaccaggaactgacgtcgcagctgttggccgccgaaaacaagtgcaatctgctggaaaaacagctcgagtatatgcgaaacatgataaagcatgcagagatggaacgcacctccgtccttgagaagcaggtgagcctggaacgagaacggcaacacgaccaaacacacgtgcagtcccagcttgaaaagttggatctcctggaacaggagtacaacaaactcacaaccatgcaggccttagccgaaaagaagatgcaggagttggaggcaaaactgcatgaggaagaacaggagcggaagcgaatgcaggcaaaagctgccgagttgcagactggtctggagactaacagactgatcttcgaggacaaagccactccttgcgttcccaatgcccggaggatcaaaaagaaaaaaagcaaaccacccgagaagaagtcttctcgtaactatttcggagcccagccacattaccgactatgcctaggagacatgccctttgttgctggaaaatctacaagcccgagccatgccgtggtcgcaaacgtccagcttgttctccatctgatgaaacagcactctaaggcgctgtgcaacgacagggttatcaactctataccactagcaaagcaagtgtcatccaggggcggtaaatctaaaaagctatccgtgactccccctagctctaacgggattaacgaagaactaagcgaggttttacagacactgcaggacgagttcggccaaatgagcttcgaccaccagcaactggcgaagctcatacaggagagtcctacagtggaactcaaggacaagctcgagtgtgaactagaagccctggttgggcggatggaggccaaggccaatcaaattacgaaagtcagaaaatatcaagcccagttggaaaagcagaagctggaaaaacaaaaaaaagaacttaaggccactaagaagaccttagatgaggagcgcaatagcagctcaagatcaggaatcacagggactacaaacaagaaggactttatgaagctgcgtccaggggaaaaacgcaggaagaatttacagcttctgaaagacatgcagtccatccaaaacagtctccaaagttcctcactgtgttgggactattag

SEQ ID NO: 182489 - DNA, 813 bp, Artificial Sequence
  Description of Artificial Sequence: Synthetic coding sequence
atggccgccgccagcgtgagcgccgccagcggcagccacctgagcaattcgttcgctgagccaagtcggtctaacggctcgatggtcaggcacagctccagcccttacgtggtctatccaagcgacaaaccctttcttaatagcgatctgcggcggtccccaagcaaaccaacactggcataccccgagtcaaactctcgggcaatatttagcgctcttaaaaatctccaggataaaattagacggctcgagcttgaaaggattcaggctgaggaaagtgtcaaaactctttccagagaaaccatcgaatacaagaaggtcttggatgagcaaattcaggaacgtgagaattccaaaaatgaagagagcaagcacaatcaggaactcacatcccagctgctggccgctgaaaataagtgcaatctgctggagaagcaactggaatacatgcgcaacatgattaagcacgcggagatggagaggacgagcgttttagagaagcaggtctctttggaaagggaacgccagcacgatcaaacccacgtgcaatcgcagctcgaaaagctagacctacttgagcaggagtacaataagctgacaactatgcaggcgctcgctgaaaaaaagatgcaggaactcgaggctaagcttcatgaagaggaacaggagaggaaaagaatgcaggccaaggcagcagaattacagaccgggcttgagaccaatagactgattttcgaagacaaagcaactccttgcgtacctaatgcacgcagaatcaaaaagaaaaagtccaaaccccctgaaaaagtatag

SEQ ID NO: 182490 - DNA, 1476 bp, Artificial Sequence
  Description of Artificial Sequence: Synthetic coding sequence
atgctgacccggatcgacaacagcttcgccgagcccagccggagcaacggatctatggtgaggcactccagctccccgtacgtcgtatacccatccgataaaccatttttgaacagcgacctcaggaggagtccatctaaaccaactctggcatatccggaaagtaattcccgtgccatcttctcagcactgaaaaacctgcaggacaagatcaggagactggagctcgaaaggatccaggctgaagagagcgtgaagacactgtctagagagactatcgaatataagaaggtgctggatgagcagatccaggagcgggaaaacagcaaaaatgaggaatcaaaacataatcaggagctgacgagtcagctgctcgcggcagagaacaagtgtaatttactggaaaagcaactggaatacatgcggaacatgatcaagcacgctgaaatggagaggaccagcgttctggagaagcaagtttccctcgagcgcgagcgccagcatgaccagacacatgttcaatctcagctcgagaagcttgacttgcttgagcaggaatataataaactgactactatgcaggcacttgctgagaaaaagatgcaggaactggaggcaaagttgcacgaggaggaacaggaacgcaaacgaatgcaggccaaagcagccgagctccaaaccggactggaaactaacagactcatctttgaggacaaagccacaccgtgtgttcccaatgcccgtagaatcaagaaaaaaaaatcaaagcccccagagaaaaaaagctcccgcaactacttcggggcccagccacattatcggctttgcctcggcgacatgcccttcgtggctggaaagtccacttctccatctcacgccgtcgtagccaatgtgcagttggtgctgcacctgatgaagcaacattctaaggccctctgtaacgatcgggtaataaactctatccccttagctaaacaggtgtccagcaggggtggcaaatctaagaaactgagcgttacgcccccatcatccaacggaatcaatgaggagctttcagaagtcctccagacattgcaggacgagtttgggcaaatgtcgttcgatcaccagcagctcgctaagctcattcaggagtctccaacagtggagctgaaggataaactggagtgcgagctggaggcccttgtgggaaggatggaggccaaagcaaaccagatcactaaagtcagaaagtaccaggcgcagttggagaagcagaaactggagaaacaaaagaaagagctgaaggccaccaaaaagaccttggacgaggaacgaaattcaagctcacgcagtgggattaccggaacgacgaacaagaaagactttatgaaacttaggcctggcgaaaaacgtcggaaaaacctacaactattaaaagatatgcaaagtatccaaaactccttgcagtccagctctctgtgctgggattactag

SEQ ID NO: 182491 - DNA, 1794 bp, Artificial Sequence
  Description of Artificial Sequence: Synthetic coding sequence
atgttccccgtggcccccaagccccaggacagcagccagcccagcgatcggcttatgacggaaaagcagcaagaggaagcggaatgggagtccatcaatgtgctgctgatgatgcacggactaaaaccactgtctctggttaaaaggacagatcttaaggaccttattatctttgataagcagtcttcacagcggatgagacagaatctgaaactgctagttgaagagacctcgtgccaacagaatatgattcaggaactgattgaaactaaccagcagctgcggaacgaactgcaactcgagcagagtcgtgccgccaaccaggaacagagggctaacgatctcgaacagatcatggaaagcgtgaaatcaaagattggggagctggaggacgaaagcttgagtcgggcctgccatcagcaaaataagattaaagacctacaaaaggagcagaaaaccctacaggttaagtgccagcactacaaaaagaagcgaaccgaacaggaagagacaatcgcatctttacagatggaggtgtgcaggctcaaaaaggaagaggaggatcggattgtgactcagaatagagtgttcgcatatctgtgtaagcgggtgccccacaccgttctcgaccggcagctgttatgccttatcgattactacgaatcaaagatacgtaagatacacacccaaaggcaatataaggaggatgaatcccagagcgaggaggagaatgattacagaaatctggatgcaagccccacatacaaaggtctgctgatgtctttgcaaaatcagctgaaagagtccaaatccaagatcgacgccctgagcagtgaaaagttgaacctccaaaaagatctggaaacaagacctacccagcacgaactccgactgtataagcagcaggttaaaaagctggaaaaagctctcaagaagaacgtgaaactccaagaactgattaatcacaaaaaagctgaggacaccgaaaaaaaagacgaaccatcaaagtacaatcagcagcaagcattaatcgatcagcgctactttcaggtgctgtgttctattaactctataatccataatccgagggcgcctgtgattatatacaaacagacaaaaggcggggtgcagaatttcaataaagacttagttcaggactgcggcttcgaacatttggtacctgtgatcgagatgtgggcagaccaactcacaagtctcaaagacttgtacaagtctctgaagacacttagcgcggagctggtaccctggctgaacctgaaaaagcaagatgagaacgaagggataaaggtggaagacctactgttcatcgtcgacaccatgctggaggaagtcgaaaacaaggagaaggattctaacatgccccactttcagactctgcaggcaatagtttctcacttccagaagctgttcgacgtgccctcccttaacggggtatatcctaggatgaacgaggtgtacactcggttaggtgagatgaataatgccgtgagaaatctgcaggaactgctggaactagacagctcttctagcttatgcgtacttgtttcaacagtgggcaagctgtgccgactcatcaacgaggacgttaatgagcaggtgatgcaggtactgggtcctgaggacctacagagcatcatctacaagctggaagaacacgaggagtttttccccgctttccaggctttcactaacgacctgctggagatcctggaaattgatgatctcgacgcgatcgtgccagcagtcaagaaactaaaagtactgtcttactag

SEQ ID NO: 182492 - DNA, 639 bp, Artificial Sequence
  Description of Artificial Sequence: Synthetic coding sequence
atgttccccgtggcccccaagccccaggacagcagccagcccagcgatcgactgatgaccgagaagcaacaggaagaggccgagtgggagtctataaacgtactcctgatgatgcacggacttaaacccctatctctcgttaaaaggaccgacttaaaggatctgatcatttttgacaagcagagtagtcaaaggatgaggcagaatttgaaactgttagtggaggagacatcatgccagcagaacatgattcaggaacttatcgaaactaatcaacagttgaggaacgagttgcagctggagcagtcacgcgccgctaaccaggagcagcgggctaatgacctggaacagatcatggagtcagtcaagtccaaaatcggcgaactggaggatgagtctctttcacgggcctgccaccagcagaacaagattaaggacctgcagaaggagcagaagactctgcaggtcaagtgtcagcattacaagaaaaagaggaccgagcaggaagagacaatcgcttctctgcagatggaggtctgcagactaaagaaggaggaagaggatagaatcgtgacccagaaccgagtattcgcatatttgtgtaagcgtgtgccccacaccgtgcttgaccgccagtag

SEQ ID NO: 182493 - DNA, 351 bp, Artificial Sequence
  Description of Artificial Sequence: Synthetic coding sequence
atgttccccgtggcccccaagccccaggacagcagccagcccagcgaccgactgatgaccgaaaagcaacaggaggaggctgaatgggaatcaatcaacgtgttgctcatgatgcacggcttgaagcctttgagtctggtaaagcgcaccgaccttaaggatctgattatatttgacaaacagtcttcccagaggatgagacaaaacctgaaactgctggtcgaggaaacttcttgtcagcagaacatgatccaggaactcatcgagactaatcagcaattgcgaaacgagcttcagctggaacagagccgcgcggcgaatcaagagcaaagagcaaacgatctcgaatag

SEQ ID NO: 182494 - DNA, 1665 bp, Artificial Sequence
  Description of Artificial Sequence: Synthetic coding sequence
atgttccccgtggcccccaagccccaggacagcagccagcccagcgacagactaatgacagaaaaacagcaggaggaggcggaatgggagtctattaatgttttgctgatgatgcacggacttaaacccctttcattggtcaaacgaacggacttaaaggatcttatcatcttcgataagcagtccagtcaacgcatgcggcaaaatctaaagttactggtcgaggaaacatcatgccagcagaatatgatccaggaattaatagagacaaaccaacaattgcggaacgagctgcagctggaacagtcccgggctgccaaccaggaacagcgcgccaatgatctggagcagatcatggagtccgtaaagagtaagattggtgaactcgaggacgagagtttaagccgggcctgtcatcagcagaacaagattaaagacttacagaaggagcaaaagacactgcaggtcaaatgccagcactacaagaaaaaaaggacagagcaggaggagacaatagcctcactacagatggaggtttgccgactgaaaaaagaggaagaagatagaatcgtaacccagaatagagtgttcgcctacctgtgcaaaagggtgcctcacacagtgctggacaggcagcttctttgtctgattgattactatgagtcaaagatccgcaagattcacacccagcgtcagtacaaggaagacgagtctcagtctgaggaggaaaatgactaccggaacctggacgccagccccacctacaaaggccttctgatgagcctccagaatcaattgaaagagagtaagtctaagatcgatgcactgtctagcgagaaacttaatctccagaaagatctggaaacgcgcccaacgcagcacgagttgagactgtacaaacagcaggtgaaaaaactggaaaaagctctcaagaaaaacgtgaagctgcaagagcttatcaaccacaaaaaggccgaggacaccgaaaagaaggatgaaccaagtaaatataatcagcagcaggctctcatcgatcaaaggtatttccaggtcttgtgtagcatcaacagcatcatacataacccgcgcgcccctgtgataatatacaaacagacaaagggaggggtgcaaaacttcaataaggacctcgtccaggattgcgggtttgaacacttggttccagtcattgagatgtgggctgaccagttgacttcactcaaggacctgtacaagtctctgaaaactctgtcagccgagctcgttccctggctcaatctgaagaaacaggacgagaatgagggcatcaaggtcgaggatctgctgtttattgttgatacaatgctggaggaagttgagaacaaggagaaggactccaatatgcctcactttcaaacgctgcaggcgattgtatcccactttcaaaagctctttgacgtaccaagtctgaatggagtctacccccgaatgaatgaggtgtacactagactaggagagatgaacaacgcagtcagaaacctgcaggaactgttagagctggactcaagttcaagcctctgtgtacttgtgagcaccgtcggcaagttgtgtagactgattaacgaggatgtgaacgaacaagtcatgcaagtcttaggaccagaggacctccagcgttatctgttctag

SEQ ID NO: 182495 - DNA, 1794 bp, Artificial Sequence
  Description of Artificial Sequence: Synthetic coding sequence
atgttccccgtggcccccaagccccaggacagcagccagcccagcgataggttgatgaccgagaagcaacaagaagaagctgaatgggaaagtatcaatgtgctcctcatgatgcatggtttgaagcctctttcccttgtcaagcgaaccgatttaaaagacctcatcatcttcgacaagcagtcatcccagagaatgcgccagaatcttaaactcctggtggaagaaactagctgccagcaaaatatgatccaggaactgatagaaactaaccagcaactgcgcaatgaacttcagttagaacagtccagagccgcaaaccaggagcagcgcgcaaacgacctggaacagatcatggagtccgtcaagtctaagatcggcgaactagaggacgagtccctgagccgcgcctgtcaccagcagaacaagatcaaagacctacagaaggagcagaaaactctccaggtgaaatgccagcactacaagaagaagcgcacggagcaggaggaaacaatcgccagcttgcagatggaagtatgccggctaaagaaagaggaggaagacagaattgtgacccagaacagagtgttcgcttatctgtgtaaaagggtgccccacacggtactagacaggcaactcttatgtcttattgactattatgaaagtaagatccgcaaaatacatactcaacggcaatataaggaagacgagagccagtctgaggaggagaatgattatcgcaatctggacgcctctcccacctacaagggacttctgatgtctctgcagaatcagcttaaggagtctaagagtaagatcgatgccctttcgagtgagaagttgaacctgcagaaagacttggagactagacctacccagcacgagcttaggctatacaaacagcaggtgaagaagttagaaaaagccctgaaaaagaacgtcaagctccaggagctaataaatcacaagaaagcagaagatacggaaaagaaggatgagcctagtaagtataaccagcagcaggcactcattgatcaaaggtattttcaggttctgtgttcaattaatagcatcatccataatcctcgcgctcctgtcattatttacaagcagaccaaagggggagtgcagaattttaacaaagatctggttcaagactgcgggtttgagcatctcgtgcccgtgatcgaaatgtgggcggatcagcttaccagcctgaaggatctctacaaaagtttgaaaacactctcagccgagctggttccatggctgaatctaaagaaacaggacgagaatgaggggattaaggtcgaagatctactgtttattgtcgatactatgttggaggaagtggagaacaaggagaaagattccaatatgccccatttccagaccctgcaagctattgtgagccattttcagaagctttttgatgtaccatcattaaatggagtatatcctcggatgaatgaggtgtacacaagactcggtgaaatgaataacgcagtccgcaatttgcaggagcttctggagctggattccagctcctccctctgtgttttagtttctaccgtgggtaagctgtgcagactcattaacgaggacgtaaatgagcaagtgatgcaggtcctcggccccgaagacctccaaagcattatctataaactcgaagaacatgaagaatttttcccggcctttcaggctttcaccaatgatttgttggaaatcttagagatcgacgacctggacgctattgtgcctgccgtaaagaaactaaaggttctaagctactag

SEQ ID NO: 182496 - DNA, 72 bp, Artificial Sequence
  Description of Artificial Sequence: Synthetic coding sequence
atgttccccgtggcccccaagccccaggacagcagccagcccagcgaccgtctgatgacagaaaagcaatag

SEQ ID NO: 182497 - DNA, 1734 bp, Artificial Sequence
  Description of Artificial Sequence: Synthetic coding sequence
atgaccgagcaggaggaggccgagtgggagagcatcaacgtgctgctgatgatgcatggcttaaagcccctgagcttagttaagcggaccgacctaaaagacctcataattttcgataaacagagcagtcagagaatgcgacagaatctaaagctgttggttgaggaaacttcatgtcagcaaaacatgatccaagaactcatcgagacaaaccagcagcttcgaaacgaactgcagctggagcagtccagggcagctaaccaggaacagcgcgccaatgatttagagcagattatggagagcgttaagtccaaaatcggggagctcgaagatgagagcttgtcgcgggcttgccatcagcagaataagatcaaagacctgcagaaggaacagaagaccttacaggtgaaatgccaacattacaagaagaaacgtactgagcaggaggagacgatcgcctccttacagatggaggtgtgcagactgaaaaaggaggaagaagaccggatagtgacacagaaccgcgtgttcgcatacctgtgtaagcgcgtgcctcacacagtgctggaccgacagctcttatgtctgattgattactatgaatctaaaatcaggaaaattcatactcaacgccagtataaagaagatgagagccaatcggaggaggaaaatgactaccgcaatcttgatgcttcgccgacctacaaaggccttttgatgtcgctacagaatcagctgaaggaatcaaaaagtaagatagacgctctgtcttcagaaaagctgaacctccagaaagacctcgaaactaggccaactcaacacgagttgaggctgtacaagcaacaggtaaagaaactggaaaaggctctgaagaaaaacgtcaaattgcaggaactgatcaaccacaaaaaagcagaagataccgaaaaaaaggacgagccatccaagtataaccaacagcaggcactgatcgaccaacgatacttccaggtgctctgtagcattaacagcattatccataatcctagggcccctgttataatatataagcagacgaaaggcggtgttcaaaacttcaacaaggacctggtacaggactgcggtttcgagcatctggtgcccgttattgagatgtgggccgatcagcttacctctttgaaagatctctacaaaagcctcaaaacactgtcagccgagctggtgccctggcttaatctcaagaagcaggacgagaacgaaggaatcaaagtcgaggatctgctctttattgtcgatacgatgcttgaggaagtggagaataaagaaaaggactcaaatatgcctcattttcagaccctgcaggcaatcgtttctcactttcagaaactgtttgacgtcccctcacttaacggggtctaccccagaatgaacgaagtgtacacccggttgggggagatgaataatgcagtgcgtaatctgcaggaactgcttgaactggactcttccagcagtctgtgtgtcttggtcagtacggtcggaaaactttgcagactcatcaacgaggacgtgaacgaacaagtgatgcaggtgctgggcccagaagatttacaatccattatatataaattggaagagcacgaagagtttttcccagcttttcaggcgtttactaatgatctgctggaaatcttagagattgatgatctggatgctattgtcccggccgtcaaaaaacttaaggtcctgagctactag

SEQ ID NO: 182498 - DNA, 3666 bp, Artificial Sequence
  Description of Artificial Sequence: Synthetic coding sequence
atgctgttccccctgcaggtggccgccgtgaccagcagcgtgcgggatgatccccttgaacattgcgtgagtccaaggacacgggcccgctctccagagatatgtaagatggctgacaacctcgatgagtttattgaggagcagaaagcccgcctggctgaggataaagctgaactcgaaagcgacccaccgtacatggagatgaagggcaaactctctgcaaagctgagtgaaaactctaagattcttattagtatggctaaggagaatatcccaccgaatagtcagcagacgcgagggtctcttggcattgactacggactatccctacccctcggagaagattatgaacgaaagaagcacaagctcaaggaagaactaaggcaggattatcgacgctatttgacacaggaaagactcaagttagagagaaataaagagtacaatcaattcttgcgggggaaggaggagagcagtgagaagttccggcaagtagaaaagtccacagagccaaaatcccagagaaataagaagccaatcggtcaagttaagcctgatctcacctcgcagattcagacctcctgtgagaactctgagggaccgcgcaaggatgtgttgaccccgtctgaggcctatgaagagcttctcaatcagagacgccttgaggaagatcggtatcggcagctagacgatgaaatagagctgcgtaaccgcagaattatcaaaaaagctaatgaggaggtcgggatatcaaaccttaagcaccagaggttcgcatctaaagctggcatcccagaccgaaggttccataggttcaatgaggacagggttttcgacagacgttatcaccgccctgaccaggatcccgaggtctcagaggagatggacgagcgtttcagatatgagagtgatttcgacagaaggctttcccgggtatacacgaatgaccggatgcaccgcaataagcgaggtaatatgcctccgatggagcacgacggagacgtaatagagcagtctaatattaggatcagttctgccgaaaacaaaagtgcccccgacaacgagactagcaaatcagccaatcaggacacatgttcacccttcgcggggatgctcttcggaggcgaagatcgggaactgattcagagacgcaaggaaaagtatcggctcgagctgctcgaacagatggctgagcagcagcgcaataaacgtagggaaaaagatctggagctgagggtggccgcatctggtgcgcaggaccccgaaaagagtcccgataggctaaagcaattctctgtcgctccccggcattttgaagagatgattccaccagaacgacccagaatagccttccagacaccgcttccccccctgtctgctccaagcgttccccccatcccgtctgtccacccggtgccctcccagaacgaagatctgcgctcgggcctatcttctgctcttggagaaatggtaagccctaggatcgcccctctccccccaccccctttactgcctccccttgcgaccaattacagaaccccgtacgacgacgcgtactacttttacggctcccgcaataccttcgatccgagcctagcttactatggctcaggcatgatgggtgtccaaccagccgcatacgtgtctgctcccgtcacacaccagctggctcagcctgtagtgaacaccgtagggcagaacgagctgaaaatcacaagtgaccaggtgattaacagcggcctgatcttcgaggataagccgaagcccagtaagcaatctctccagagctatcaggaggccctgcaacaacagatacgggagcgagaggagaggaggaagaaggagagagaagagaaagaggagtatgaggccaagttggaggctgagatgcggacctataacccgtggggcaaagggggaggtggcgcgcctcttagagacgcgaaaggaaaccttataacagatctgaatcgaatgcacaggcagaacatcgacgcctatcacaacccagacgccaggacatacgaagacaagcgggcagtcgttagtctggaccctaacctcgcaaccagcaatgctgagaacctcgaagacgctgctaataaatcatctgggcatatgcaaacacaaagtagcccattcgcacgcgggaatgtgttcggggaaccgccaactgaactccagatcaaacagcaagagctgtataaaaattttctgcgttttcagattgaagagaaaaaacaacgtgaggaggcggagagggagagactacgaatcgcagaagagaaggaggaacggcggctggcagagcagagggctagaatccagcaggagtacgaggaagaacaggaaaaaaagcgtgagaaggaagaagaacagcgcctgaagaatgaggagcacataaggttggctgaagaacgtcagaaggaggccgagaggaaaaagaaggaagaggaggagaagtacaacctccaactgcaacactactgtgaaagggataatttgatcggggaggagacaaagcacatgcggcagccaagccctattgtccccgcactgcagaataagatcgctagcaagttgcagcgtcctccgtccgtggatagcatcattaggagcttcatccatgaatcttccatgagccgggcacagagtccccctgtgcccgctcgtaaaaaccaactgcgggccgaagaggaaaaaaagaacgtaatcatggaattgtccgagatgcgcaagcagctgagatctgaagaaaggaggctccaagagaggctgctgcacatggattcggacgatgagatccctattcgcaagaaagaacgcaacccaatggacattttcgacatggcaaggcacaggcttcaggcgccagtcagacgacaatccccaaaggggctggacgctgcaacctttcaaaacgtccacgatttcaatgagctcaaagacagagacagcgaaacacgggtggatctgaaatttatgtatctggacccacctagggatcatcacacgttggagatacagcagcaagccctgcttcgcgaacagcaaaagaggctgaaccgtatcaaaatgcaggaaggggccaaggtggacctcgacgccatcccatccgctaaagtgcgcgagcagcgcatgccccgcgacgacacgagcgattttcttaagaacagcctgctggagagcgatagcgcctttatcggtgcctatggagaaacttaccccgccatcgaagatgacgtgctgcccccccctagtcaacttccctccgccagagaacgccgacgtaacaaatggaagggcttggacattgatagctctcgtccgaatgtggcgccagacgggctgtccctgaagtctatatccagcgttaacgtagatgagctgcgcgtgcggaacgaagaaagaatgcggcggttaaatgagtttcacaacaaacccataaacactgatgacgaaagttccctcgtcgatcctgacgatatcatgaaacacatcggcgatgacggaagcaactctgttgccaccgaaccctggttgaggcccggaacgtcagagacactcaaaagatttatggccgagcagctgaatcaggagcagcaacaaattcctggcaagcctgggacatttacatggcagggcctctcgaccgcgcacggttag

SEQ ID NO: 182499 - DNA, 3771 bp, Artificial Sequence
  Description of Artificial Sequence: Synthetic coding sequence
atgctgttccccctgcaggtggccgccgtgaccagcagcgtgcgggatgaccctctcgagcattgcgtgagtcccaggacaagggcccgtagtcctgaaatttgcaagatggcagacaatcttgatgagttcattgaggagcagaaggctcgactggccgaggacaaagcagagctcgagtcagaccccccttacatggagatgaaggggaagttatccgctaagctcagcgagaattcaaaaatcttaatttcaatggcaaaagagaatatcccacccaatagtcagcagacgcgcggatctcttgggatcgattatggcctatctttgccactgggcgaagattatgagagaaagaaacacaagctgaaagaagagctgaggcaggactatcggcggtacctaactcagaaagttttctccggtacatccaagaagaactttcttagcacatcagaaacggaccctagcaccttgggtgtcagtttaccaattggcgagcggctgtccgcaaaggagcgccttaagcttgagcgcaacaaggaatataatcaatttctccgaggtaaggaagaaagcagcgagaagttccgccaggtggagaagagcactgaacctaaatcacaacggaacaagaagccaatcggccaggtcaagccagacctgacctctcaaattcagacatcctgtgagaatagcgaaggccccaggaaggatgtactgaccccaagtgaggcatacgaagaacttctaaaccagaggagattggaggaagaccggtatcgccagctagatgacgagatcgaactacgcaatagacgcataatcaagaaggccaacgaggaggtcgggatttccaacctgaaacaccaacgatttgcatcgaaagctggcatacctgataggcgattccaccggttcaatgaagatagagtctttgatcgaaggtaccatcggccggatcaggacccagaggtgtccgaagagatggatgagcgcttccggtatgagtcggactttgaccggcggctgagccgagtgtacacaaacgatcgcatgcatcggaacaaacgaggaaatatgccaccaatggaacacgatggtgacgtgatagaacagagtaacattcggatctctagtgctgaaaacaagtctgcgccggacaatgagacctctaagtccgccaaccaggatacatgctctccatttgcaggcatgcttttcggaggcgaggatcgcgagctaattcagcgccgcaaggagaagtacaggttggagctgctcgagcagatggccgagcagcagagaaacaaaaggcgcgagaaagacctggagctgagggtggccgccagtggagcccaggacccagaaaaaagtcccgaccgtctgaaacagttcagcgttgctccacggcatttcgaagaaatgattccaccggagaggccgcggatcgctttccagaccccgctgccccctctctcagcgccatccgtgccaccaataccttctgtgcatcccgtgcctagtcagaacgaggacctccggtccggtctgtctagtgctctgggggagatggtctctccacggatcgcacccttacccccccccccacttctacccccactcgcaactaattacagaacaccttacgatgacgcttattatttctatggtagccgcaacacattcgatccctccctggcttactacggaagcggaatgatgggagtccaaccggcagcttacgtatcagctcctgtgacacatcagcttgcccagcctgtggtcaacaccgtcggccagaatgagttaaagataacatccgaccaggtgatcaattctggcctgatattcgaagataagccaaagccgtctaagcaaagcctgcagtcctatcaagaggcactccaacagcaaattagagaacgcgaggaacggcggaaaaaagaaagggaggaaaaagaggagtacgaggccaagctcgaggcagagatgaggacatacaacccttggggcaaagggggggggggtgccccgctgcgtgacgcaaaggggaatttgattaccgacctgaaccgcatgcaccggcagaacatagacgcatatcataacccggatgcacggacgtatgaggacaagcgtgcagtggtcagcctcgatcccaaccttgccacctctaatgcggaaaaccttgaggacgccgctaacaagtcatcgggtcacatgcagacacagtctagcccttttgcacgaggcaatgttttcggcgagccgcctacagagctacaaatcaaacagcaggaactgtacaagaacttcttgcggttccagatagaggaaaagaagcagcgcgaggaggcagagagggagagattgcggattgcggaggagaaggaggaacggcgcttggcagaacagagggcccgtatccagcaggagtacgaagaggaacaagaaaaaaaacgcgagaaagaagaggaacagcggctcaaaaacgaagagcacatcagactggctgaggagaggcaaaaagaagctgagcgtaagaagaaagaagaagaggagaagtacaatcttcaactgcaacactattgtgaaagagacaatctcattggcgaagagacaaaacacatgaggcaacccagcccaatcgtgcccgccctgcagaacaagattgctagtaaactacagaggccaccatctgttgattctataatcaggtcctttatccacgagagcagcatgtcacgagcccagagcccccctgtccctgcgagaaagaatcagctcagagctgaggaggagaagaagaacgttattatggaattaagcgaaatgcgaaaacagctgaggtcggaggagagaaggttgcaagaacggctgctccatatggactcagatgatgagatcccaatacggaaaaaggagcggaatcctatggacatctttgacatggcccggcaccgattgcaggcccccgtgagaagacaaagtcctaaaggtcttgatgccgcaaccttccagaacgtccatgatttcaatgaactgaaagaccgggactctgaaactcgcgtcgatcttaagtttatgtacctcgacccccccagagatcaccacaccctggagatacaacagcaggccctcctgcgcgagcaacagaaaaggctgaacagaatcaaaatgcaggagggcgctaaggtagacctcgatgctattccatccgccaaagtgagagaacaacgcatgcctcgtgatgacacctccgactttcttaagaacagcctccttgagtctgattccgcattcataggcgcttatggagaaacgtaccctgcaatagaggatgacgtgctcccacctccgagccagcttccaagcgccagagaaaggcgccgtaacaaatggaaaggcctggatattgattcttcacgcccgaatgtggcccccgatggactctccttgaaaagcatctcgtccgtcaacgtggatgaactaagagtgagaaacgaagaaaggatgcgtaggctgaacgaattccataataagcccattaataccgacgatgagtcttcactagtcgatcctgacgacatcatgaaacacatcggggacgacggttccaattctgtcgccaccgagccgtggctgcgtcccgggacgagcgagacacttaaacgatttatggcagaacagttgaaccaagagcagcaacagatccccgggaagcctgggacttttacctggcagggactctcaaccgctcacggctag

SEQ ID NO: 182500 - DNA, 2631 bp, Artificial Sequence
  Description of Artificial Sequence: Synthetic coding sequence
atggacgagcggttccggtacgagagcgacttcgaccggcggctgtccagggtctacaccaacgatagaatgcataggaataaaaggggtaatatgccgcccatggagcatgatggtgatgtgattgaacaatcaaatatacgaatttccagcgcagaaaataaatcggcccccgataacgagacaagcaagtccgctaatcaggatacctgtagccccttcgctgggatgctctttggtggcgaggatagggagttgatccagcgcaggaaggagaaatatagattagaactgctcgaacagatggctgagcagcagagaaataaacggagagaaaaagatctggagttacgcgtcgcggcaagtggcgcccaggacccagagaagtcaccggatagactcaaacagttttccgtcgccccacggcatttcgaggagatgataccccccgaacgaccccggatcgcttttcaaacacccctgcccccactcagtgcacctagcgtcccacccattccctccgtccaccccgttccttcccagaacgaggacttaaggagcggtctgtcgagcgcgctgggggaaatggtgtccccccgtattgcccccctccctcctcctccactgttgcctcccctggccaccaattacaggaccccctacgacgacgcttactacttttacgggtccagaaacacattcgacccgagcctggcgtattacgggtccggaatgatgggcgtgcaacctgctgcatacgtgtcagctccagttacccatcagctggcacaacctgtggtcaacactgtaggacagaacgagcttaagattacctctgatcaggttataaactcggggttaatcttcgaggacaaacccaagccaagcaaacagagtctccagtcttatcaagaagccctgcagcagcaaattcgggagcgcgaagaacggagaaagaaagaacgggaggagaaggaagaatacgaagcgaagttagaggcagagatgaggacttacaatccctggggcaagggcggaggcggggccccgctccgggatgccaaagggaatctcatttctcatatgcagacccagagcagcccattcgcccgtgggaatgttttcggcgagcctccaacggaacttcaaatcaagcagcaggaactgtataagaactttctgcgcttccagatcgaagaaaagaagcagcgcgaggaagcagagcgcgagcgcctaagaatcgctgaggaaaaagaggagaggcgcctcgccgaacagcgggcccggattcaacaagagtatgaggaggagcaggaaaagaagagagagaaagaagaggagcagaggctcaaaaacgaggagcacatccgtctcgcagaggagagacagaaggaagctgaacggaagaagaaggaggaggaagagaaatacaacttacagctccagcactactgcgaaagagataatcttattggcgaggaaaccaagcacatgagacagccaagccctatcgttccagctctccagaacaaaatagcttccaaattacaacgcccaccctccgtggacagcattattcgttcctttatccacgaatcctctatgtcgcgcgcccaatcccctcctgtgcctgctcgcaaaaatcagctcagagccgaagaagaaaagaagaacgtgatcatggagctctctgaaatgcggaaacagctacgctccgaggagaggcgactgcaggagaggctgctgcatatggatagcgacgatgagattcccatacgaaaaaaggagcgcaacccaatggacatctttgatatggcgcgccataggctccaggcccctgtgaggcgccagagccctaaaggtcttgacgcggccacatttcagaacgtgcacgatttcaacgaactgaaagaccgtgacagcgagacacgggtagacttgaagttcatgtacctcgatcctccaagggatcatcatacccttgagattcagcagcaagccctcctccgcgagcagcagaagcgactcaacaggatcaagatgcaagagggcgcgaaagttgacctggacgccattccctcagcaaaggtcagagaacagagaatgccgcgggacgatactagcgacttcctgaagaatagcctgctcgagtccgacagtgctttcattggagcctatggagagacctaccctgccatagaggacgacgttttgccaccaccctcacagctcccatcggctagagaaaggcgtcgaaacaagtggaaggggctcgatattgatagcagtaggccaaacgtggccccggatggactctctcttaagtccattagctcggtaaacgtggatgagctgcgcgtgagaaatgaggagagaatgcggcgcctgaacgaattccacaacaaacccatcaacaccgacgacgagagctccctggtggatcccgatgatatcatgaagcatatcggagatgatgggtcaaatagtgtggctacagagccatggttacgtcccggcacctccgagaccctgaagcgctttatggccgaacaactcaaccaggaacagcagcaaatccccggcaaacccggaacatttacttggcaaggcctcagcacagcacacggatag

SEQ ID NO: 182501 - DNA, 2631 bp, Artificial Sequence
  Description of Artificial Sequence: Synthetic coding sequence
atggacgagcggttccggtacgagagcgacttcgaccggcggctgtctagagtgtataccaacgaccgcatgcataggaacaagaggggcaatatgcctccgatggagcacgatggggacgtgatcgagcagagcaacataaggatctcctctgctgagaacaaatccgcccctgacaacgagacaagtaaaagcgccaaccaggacacctgttcccccttcgctggtatgctctttggaggcgaggatcgtgagcttattcagcgccgaaaggagaagtataggctcgagctgttagagcagatggccgaacagcagagaaataagcggcgggagaaagacctcgagctgcgagtggcggccagcggtgctcaagaccccgagaagagtcccgataggcttaaacagttctcagtggccccacggcacttcgaagagatgatcccccctgaaagacctcggatagcctttcagacacccttacctcccctgtccgcaccctccgtgccacctattccctccgtgcatcctgtgccatcccagaatgaggatctgcggtcgggtttgagtagtgcgcttggcgaaatggtgagcccccgaatcgccccactgccgccaccaccattactgccccccctggccactaactatcgaactccctacgatgatgcctactacttttatggatcacgaaacacgttcgatcctagtcttgcctactacggctccggaatgatgggagtgcagcccgccgcctacgtatcagccccggtgacccaccaacttgcacaacctgttgtgaacacggtgggtcaaaacgagcttaagatcactagcgatcaagttataaattcgggcttaatctttgaagataagccgaaaccctccaaacagtccctccaatcttatcaagaagctctccagcaacagatccgggagcgggaggagaggcggaaaaaggagagagaggagaaggaagaatacgaggccaaactggaggccgaaatgcggacctacaatccttggggaaagggcggtggcggcgcacctttgcgcgacgcaaaaggaaacctaatttcccacatgcagacccagtcatctcccttcgcacggggaaatgtgttcggtgagccaccaaccgaactgcagattaagcagcaggaactgtataagaacttcttaagattccagatcgaggaaaaaaaacaacgggaggaggccgaaagagagcggttgcggatcgccgaggagaaagaagagagaaggttagctgagcagcgggcccggatccaacaagagtatgaggaggaacaggaaaaaaagcgggagaaggaagaagaacagaggctgaaaaatgaggagcacatcagactggcagaagagcggcagaaggaagcggaaagaaagaaaaaggaagaggaggagaaatataatttgcagttgcagcattactgcgagcgcgacaatctgatcggcgaggaaaccaaacatatgaggcagcccagtccgatcgtaccagccctgcagaataaaatagcctccaagttgcagcgacctccttcagtggatagcatcattcgctcctttattcacgagagctccatgagccgtgcacaatcaccaccggttcccgcccggaaaaaccagctgagggctgaagaggagaagaagaacgtgatcatggaactgagcgaaatgcggaagcagctgagaagcgaggagaggagactgcaggaaaggctactgcacatggactccgatgacgagatcccaatacggaagaaggagcgcaatcctatggatatttttgacatggctagacaccgcttacaggccccggtaagacggcagagccctaagggcctcgacgctgctacgtttcagaatgttcacgacttcaacgagctgaaggatcgagattccgaaacgagggtggatctgaagtttatgtacctggaccccccaagggatcatcacacactggagattcagcagcaagctttgctacgggagcaacaaaagcgtctgaatagaataaagatgcaggagggtgcgaaggtggatctggacgctatcccctcagccaaggttcgcgagcaaagaatgccaagagacgatactagcgatttcctcaaaaactccttactggaatccgactcagccttcatcggggcctacggcgagacctaccccgccatcgaagatgatgtgctacctcccccctcccagctaccgagcgccagagagaggcgtagaaacaaatggaaggggcttgatatcgacagtagcaggcccaacgtggcccccgacggcctgagcctcaagagcatcagtagcgtgaacgtggacgagctgcgagtcaggaacgaggaacgaatgcgcaggctgaatgagtttcacaataaaccaatcaacacggacgacgaaagcagtctggtggatcctgacgatataatgaaacatatcggagacgatgggtcgaatagcgtggcaaccgaaccctggttgaggcctgggacttcggagacgctgaaaagattcatggccgagcagctgaaccaggagcagcagcagattccaggaaaacctggcacctttacatggcagggattgtcaaccgcacatgggtag

SEQ ID NO: 182502 - DNA, 1677 bp, Artificial Sequence
  Description of Artificial Sequence: Synthetic coding sequence
atgccctggcggcggcggcggaaccgggtgagcgccctggagggcgggagagaagaggaggccccaccagaggcagccgctgttccccccgcactgttgacatcccctcagcagacagaagccgctgccgaaaggatcctgctacgtggtatatttgaaatcggtcgggactcctgtgacgtggtcctgagcgagagagcgctgagatggaggcctatacagcctgagcggcctgctggggatagtaagtacgatcttctctgcaaggaggagtttatcgaactgaaagacattttctccgtcaaactcaagagaagatgcagcgtcaaacagcagcgatcaggaaccttactgggtattacactcttcatttgcctgaagaaggagcagaacaaactcaaaaacagcaccctcgatctgattaatctttcggaagatcattgcgacatttggttccggcaatttaagaagatcctcgctggcttcccgaacagacccaagtctctaaagattcttctcaaccctcaatcacacaaaaaagaggctacccaggtgtactatgaaaaagtcgagccgctcctaaaactggccggaattaaaacagatgtgacgattatggagtatgagggacatgcactttccctcctcaaagagtgtgagctgcaggggtttgacggcggccacaggaagccactcttcgctatccattggtctgtgcagcgtttgtttacaggaatgcaaaccctcgagccatctgttgtctgcgtgggcggtgatggatccgcaagcgaggtggcccacgccctgctactgcgcgcccaaaagaatgccggcatggagacagatcggatcttgactcctgtcagggctcaattgccgctgggcctcattcctgccggctccacgaacgtacttgcccattccctccatggtgtgccacacgtaattaccgccacgctccacataattatgggccacgtgcagctggttgacgtgtgtaccttttctaccgcgggaaagcttctgaggttcggtttttcagctatgttcggatttgggggtaggacactcgcactggcagagaaataccgctggatgtcgccaaatcaacgccgagatttcgcagttgttaaggccttagcaaaattgaaggcagaagactgtgagatctccttcctccctttcaatagcagtgacgacgtccaggagagaagggcgcagggttctcccaaatccgattgcaacgaccagtggcaaatgattcagggacagttcctgaacgtaagtatcatggcaatcccctgcctatgttcagttgctccacgagggctggctcctaacactcggcttaataacggttctatggcgctgattatagctcggaatacgtctcgccccgaattcatcaagcacttaaagcgctatgcgtccgtgaaaaaccagtttaatttcccctttgtggagacttacactgtggaagaggtgaaagtgcatccacgcaacaacacggggggatacaaccccgaagaagaggaagatgagaccgcttccgaaaattgctttccttggaatgtggacggggacctaatggaagtcgcgtcagaggtccatataaggctgcatccgaggttgatctctttgtatggaggatcaatggaggaaatgatcccaaagtag

SEQ ID NO: 182503 - DNA, 1260 bp, Artificial Sequence
  Description of Artificial Sequence: Synthetic coding sequence
atgccctggcggcggcggcggaaccgggtgagcgccctggagggcgggagggaggaggaggcaccgcccgaagcggccgcagtcccaccagcccttctgacatctccccagcagacagaggcagctgccgagcgtattctgttacgcggcatcttcgagattggacgagacagctgtgacgtggtgctgtccgagagggctttgaggtggcggcctatacaacctgagaggccagcaggggacagtaagtacgatctcttatgcaaggaagagttcattgaactcaaggacatctttagtgtgaaattgaaacgcaggtgctcagtgaaacagcaacgatccggcactttgctaggaataactctctttatctgtctgaagaaagaacaaaataaactaaagaactcaacgctggacttaatcaacctgagtgaggatcactgcgacatttggttcagacagttcaaaaagatactggccggttctacgaatgtgttggcgcacagtctgcatggggtgcctcatgtgatcactgcgaccctccacatcattatgggacacgtgcagttggtggacgtgtgtactttttctaccgcaggtaaacttctgaggtttggcttctctgctatgttcgggtttggaggccgaacccttgctctggctgaaaaatataggtggatgtcgccaaaccaaagacgggattttgctgtcgtgaaggccctcgcaaagctgaaggcagaggactgcgaaataagcttcttgccgttcaacagtagtgacgacgttcaagaacggcgagctcagggctctccgaagagcgattgtaacgatcaatggcagatgatacagggtcaattcttgaatgtcagtatcatggctatcccttgcctttgcagtgtcgcccccagagggctggcaccaaacacacggttgaacaatggatctatggccctcatcatcgcaaggaatacaagtcgacccgagtttataaagcacctgaaacgttacgcctcagtgaaaaaccaattcaatttccctttcgtggagacttatacggtcgaagaagtgaaagtgcacccaagaaacaacaccggagggtataaccccgaagaagaagaagacgagaccgcctcagagaattgctttccttggaatgtggatggggacttaatggaggtagcgagtgaggttcacatacgtctgcaccctagactgatttccttgtacggaggctcgatggaggaaatgatcccaaagtag

SEQ ID NO: 182504 - DNA, 1392 bp, Artificial Sequence
  Description of Artificial Sequence: Synthetic coding sequence
atgccctggcggcggcggcggaaccgggtgagcgccctggagggcgggcgggaggaagaagccccacccgaggctgcggcagttccacccgcccttctgacctctcctcagcagacggaggcggctgcagagcgtatcctgctgcgtggcattttcgaaatcggaagagattcttgcgacgtcgtgttatcggaacgcgcgttacgatggaggcctatccagccagagagaccggccggcgactccaagtacgatctcctgtgcaaggaggagttcatcgagctcaaggatatcttttctgtaaagttgaaaaggagatgctcggtcaaacagcagcgctctggcactctgctgggtattacactctttatctgcctcaaaaaagagcagaataagctaaaaaactctactctggatctgattaacttgtccgaagaccactgcgacatctggttccgccagttcaagaagatcctggccgggtttcccaatcggcccaagagcctgaagatactgctcaatcctcaaagtcataagaaggaagcaacccaagtttattatgagaaggtggagcccctgcttaagttagctggaataaagaccgatgtcacccgatcaacaaatgtcttagctcattccttgcacggagtgccgcatgtcatcacggccacgctgcacataataatgggccacgttcagctggtggatgtctgcaccttcagcacagccggcaaactgcttaggttcggcttcagcgctatgtttggctttgggggtcgaacactggcactcgctgagaagtacaggtggatgtctccaaaccaaagacgcgacttcgcagtggtgaaagccctggcgaagctcaaggccgaggattgtgagatatccttcctcccgttcaattcatccgacgacgtgcaggaacgacgcgcccagggatctcctaaaagcgactgtaatgaccagtggcagatgatacaaggccagttcctcaatgtgtcaattatggccataccatgcctctgttcggtggctcccagaggactcgcccctaacaccaggttgaataatggatccatggcactgattattgcgcggaatactagtcgcccagaatttatcaaacaccttaaacgatatgcttctgtgaaaaaccagtttaacttcccattcgtggaaacctatacagttgaggaggtgaaagtgcaccccaggaacaacaccggggggtataatcccgaggaggaggaagacgagacagcttccgagaactgcttcccctggaatgtcgacggcgatctgatggaggtggctagcgaggtgcatatcagactgcaccctagacttatctcactgtatggcggttcgatggaagagatgatccccaagtag

SEQ ID NO: 182505 - DNA, 1599 bp, Artificial Sequence
  Description of Artificial Sequence: Synthetic coding sequence
atgccctggcggcggcggcggaaccgggtgagcgccctggagggcggccgagaggaagaggctcctcccgaggcagcggcagttcctcccgccttgttgacatctcctcagcagaccgaggccgccgctgaacggatcctactgaggggaatcttcgaaatcggccgcgactcctgcgacgtcgtgctgtctgagcgtgcactgcggtggcgtccaatacagccagaacgcccagcgggtgatagcaagtatgacctgctgtgtaaagaggaatttatcgaattaaaggatatattctcagttaagcttaaacgtagatgttctgttaagcagcaaagatcaggcacattgctgggaatcactctctttatctgcctaaaaaaggaacagaacaagctgaaaaattcaactctggacctgataaatctaagcgaagaccactgtgatatctggtttcgacagttcaaaaaaatcctggcagggttcccgaatagacccaaatccctcaaaatcttattgaatccacagagccataagaaggaggccacccaggtgtattacgagaaggtggagccattactgaagctcgcaggaattaagacagatgtgacaattatggagtatgaagggcacgctcttagcctgctgaaggagtgtgagctccaaggattcgatggcgtggtgtgtgtgggtggagacggaagtgcaagcgaggtcgcgcatgctctgttgttgcgcgcacaaaagaacgctggcatggaaaccgacagaatcctcacacctgttcgtgcccagttaccactggggctgatccctgccgggagcacaaacgttcttgcccattctctgcatggtgtcccacatgtgatcaccgctaccctgcacattatcatggggcatgtgcagctcgttgacgtctgcacattctcaactgcgggaaaactcctaaggttcggattctccgcaatgtttggcttcggggggcgcactttagcactggcagagaagtatcggtggatgtcgcctaatcagcgacgggactttgccgtagtaaaagctctcgccaaattgaaagcagaagactgcgagatttcatttctcccctttaattcatccgatgatgtgcaggaacggagggcccagggcagccctaaaagtgattgtaatgaccagtggcagatgattcaaggccagtttcttaacgtgtccattatggcgatcccctgcctttgctccgttgctcccagaggcctcgcgcccaatacccggttaaacaacgggtcgatggcactaattattgcacgaaacacttctcgccccgaattcataaaacaccttaagcggtatgcatccgtgaaaaatcagtttaatttcccattcgtagagacatacacggtggaggaggttaaagtccatccgcgaaacaacaccggaggatacaatcctgaagaagaagaagatgaaactgccagcgagaattgtttcccatggaacgtcgacggggatctgatggaggtggctagtgaggttcatatccggctccacccaagactgatttctctctatgggggaagtatggaagagatgatccctaagtag

SEQ ID NO: 182506 - DNA, 1545 bp, Artificial Sequence
  Description of Artificial Sequence: Synthetic coding sequence
atgccctggcggcggcggcggaaccgggtgagcgccctggagggcggacgagaggaagaggcccccccagaagccgccgccgtcccaccggccttgctcacctctccgcagcagaccgaggcggctgccgagaggatcttacttcgagggattttcgagattggtcgcgacagctgtgatgtggtccttagtgaacgagcactgagatggcgcccaatccagcccgaacgcccagcaggcgacagtaaatatgatctcctgtgcaaagaagagtttattgaactgaaggacattttttccgtgaaattgaagcggaggtgttctgtaaagcagcagagatctggcaccctgctcggtattacattatttatctgtctcaagaaggagcaaaacaaattaaagaactccaccctggatctgattaatctcagtgaggatcattgcgacatttggtttaggcagttcaaaaaaatactcgccgtcatggaatacgaaggccacgctctgtctctgctgaaggagtgcgagcttcaaggtttcgacggcggacatcgcaagcctttgtttgcaatccattggagcgtgcagaggctgtttacgggtatgcaaaccctggagccatctgtggtctgcgtcggcggagacgggtccgccagtgaggtagctcacgccctcctgctgcgagctcagaagaatgcaggtatggaaacggaccggattctcaccccagtcagggcacaactccccctaggcctcattccagctggcagcaccaacgtcctggctcactcactccacggggttcctcacgtgataactgcaactctgcacatcattatggggcatgtgcagctggttgatgtttgtacgtttagtactgccgggaagctcctgcgtttcggtttttctgccatgttcggctttggaggacgaactctggccctggccgagaagtatcggtggatgtcccctaatcagaggagagattttgccgtcgtgaaagccctggctaagttgaaagccgaagattgtgaaatttctttcctcccattcaatagctctgatgatgtacaggagcgccgagcccaaggcagtcccaaatccgattgcaacgaccagtggcaaatgatccaggggcagttcttgaatgtgagtattatggcaatcccatgtctgtgttcggtggcccctcgcggcctggctcccaacacaagattgaacaatggcagcatggccctcatcatcgcccgcaacacctcacggcccgaatttatcaagcacctaaaacggtacgcctccgtcaagaaccagtttaatttcccatttgtcgagacatatacggttgaggaagtgaaggtgcatcctagaaataatacaggcggatacaatcctgaggaggaggaagatgagacagcgtccgagaactgttttccttggaacgtagacggcgacctaatggaagtcgcatctgaagtccatattagacttcaccccaggctgatctccctgtatggaggctccatggaggagatgatccccaaatag

SEQ ID NO: 182507 - DNA, 804 bp, Artificial Sequence
  Description of Artificial Sequence: Synthetic coding sequence
atgcacctgctgctgttccagctgctggtgctgctgcccctgggcaaaaccacacgccaccaggacgggaggcagaatcagtccagcctatcccctgtcttgctccctcgcaaccagagagaattgcctaccggcaaccacgaggaggcagaggagaagccagatctgttcgtcgctgttcctcatctggtggcgacaagtccggctggcgagggtcagcgccagagggagaagatgctgtcccggtttggtaggttctggaagaagcctgagcgcgagatgcacccaagcagagactccgatagcgagcccttcccccctggtacacagtctctgatccagccaatcgacggcatgaaaatggagaaaagtccgcttcgggaggaggcaaaaaagttctggcatcattttatgttccggaagaccccagcctctcagggcgttatcttgcctatcaagtcacacgaggtacactgggaaacctgccgaactgtgccattttcccagactataacacacgaaggctgtgaaaaggtcgtggtccagaacaacctgtgcttcgggaagtgcgggtctgttcacttcccaggcgctgctcagcattctcacacaagctgctctcactgcctgcctgcgaagtttacaaccatgcatctgcctttgaactgcacagagctgtcttcagtgatcaaagtagtgatgttggttgaggaatgtcagtgcaaagtcaagacagaacacgaagacggacacatcctgcatgcgggctctcaggattcatttattccgggcgtcagcgcctag

SEQ ID NO: 182508 - DNA, 789 bp, Artificial Sequence
  Description of Artificial Sequence: Synthetic coding sequence
atggcctggctggaggacgtggacttcctggaggacgtgcccctgcttgaggatataccattactagaggacgtcccacttcttgaggacgttcctttgctagaggatacctctagattagaagatattaatttgatggaagacatggcgctacttgaggatgtcgatctcttggaggacacggacttcctcgaagatctggacttttcagaagcgatggacttgcgtgaagacaaagactttcttgaagacatggacagcctcgaagatatggcccttctggaagatgtagacttattagaagataccgatttcctggaggatccagattttttggaagccatcgaccttagggaggacaaagattttctcgaggatatggattctctggaagacttggaggccattggtcgatgtggattttcgggcaggcatggctttttcgggcgtcgccggtttagcggccgacccaaactgtcaggccggctcggactccttggcagaaggggattttctggacgcctcggcggatattggaagacctggatattctggaaaacatggatcttctggaaaacgtggatcttccgcaagacttacataggatggaagacgtggatcttttccggtcgttgtggacttaccgggagaccaggctttggcggacggagacgcttcttctggaagaccttgaccgattggaagacatggatctctttctggaaaaccctgattgattggaagacctggataagcttttggaagactctcattgattggaagatctag

SEQ ID NO: 182509 - DNA, 1365 bp, Artificial Sequence
  Description of Artificial Sequence: Synthetic coding sequence
atgctggccgagaacctggtggaggagttcgagatgaaggaggacgaaccttggtatgatcatcaggatttacagcaagacctccagcttgcagccgaattgggtaaaaccctgttagaccggaacaccgaactcgaagattctgtgcaacagatgtatactacaaatcaggagcagttacaggagattgaataccttactaaacaagtggaattgttgcgtcagatgaacgagcagcatgccaaagtgtacgaacagctcgacgtgactgcgcgagagctcgaagaaacaaatcagaagctggtcgctgatagcaaggccagccagcagaaaatactgtcactgaccgagacgattgagtgcttgcagaccaatatagaccatctgcagagccaggtggaggagctaaagagtagcggtcagggacggcgttctccaggaaaatgcgatcaagagaaaccagctccttcattcgcctgcctgaaagagctttacgatcttcgacaacattttgtgtatgaccacgtttttgctgagaaaattacgagcctgcagggacagcccagtcccgacgaggaggaaaacgaacatttaaaaaagacggtaactatgcttcaggctcagctgtcacttgaaagacaaaaacgggttaccatggaagaagaatatggtcttgtcctcaaagagaactctgaactggaacagcaactgggcgcaacaggcgcctatcgggcaagggccctggagttggaggccgaggtggcggaaatgagacaaatgcttcagtcagagcatcccttcgtaaatggcgttgaaaaactcgtgcctgattctctgtatgtcccattcaaggagcccagccaatcccttttagaagaaatgttcctgactgtgcccgagtctcacaggaagccactcaagcgcagttcctctgagacgattctgagtagccttgccgggtcagatattgtcaagggacatgaggagacctgtatcaggagagccaaggccgtaaaacagagggggatctccctgctgcacgaggtggatacacaatacagtgccttgaaggtgaagtacgaggaactgctgaagaaatgccaggaagagcaggactcactgtctcacaaggcggtgcaaacctctcgggccgctgccaaagacctcaccggtgtgaacgctcagagcgagcctgtagccagcggttgggaactggcatcggtgaatcctgaacctgtgagcagccccaccacacctcctgagtataaagccctcttcaaagaaatcttctcctgcatcaagaagaccaagcaggagattgatgagcagagaaccaagtaccgaagcctgtcctcccacagctag

SEQ ID NO: 182510 - DNA, 618 bp, Artificial Sequence
  Description of Artificial Sequence: Synthetic coding sequence
atgctgggcgccaagccccactggctgcccggccccctgcacagccccggactgccgctggttttagtgctgctggccctcggggccggatgggctcaggaaggctccgagcccgtcctcttggagggcgaatgcttggtagtctgtgagcctggtcgggctgctgccggagggccggggggcgccgccctgggagaggccccccccggtagagttgctttcgcagcggttcggagccaccaccacgaacccgctggcgagactggcaatgggacctcgggcgcgatctactttgaccaggtattggtaaatgaaggcgggggattcgatcgagcaagtggttctttcgtggcacctgtgcggggtgtgtacagctttagatttcatgttgtcaaagtgtacaaccgtcagactgtgcaggtgagcctcatgttaaatacgtggcccgttatttcagcattcgccaacgacccggatgtgacccgggaggccgccaccagctccgtgttgcttcctctcgaccccggggaccgcgtatccctgcggttgagaagagggaaccttctggggggttggaaatactcgtcgttttcagggtttttaatcttcccactctag

SEQ ID NO: 182511 - DNA, 990 bp, Artificial Sequence
  Description of Artificial Sequence: Synthetic coding sequence
atgatcctgatgaagatgggcttcagcggcatcgtggtgcaccaggagtctgtatgtgccacttacggaagtgggctgagcagcacttgcatcgtcgatgtaggcgatcaaaagacatctgtgtgctgcgttgaagacggggtctctcatagaaataccaggatcttttcgtggaatcaagacatcagcggcctgcaggatcatgagttccagattcggcatcccgactctccggcacttctttatcagttccggctcggcgatgagaaactccaggcccccatggctctgttttaccccgcgaccttcgggatcgtggggcagaagatgacgacactgcaacaccgatctcagggtgatccggaagacccacacgacgaacattacctcctggccactcagtctaagcaggagcaatccgccaaagcaacagccgatcgtaaaagtgcaagtaagcccataggctttgagggagaccttcgagggcagtcgtctgatctgcctgagcggcttcattcccaggaggttgacctcgggagtgcccagggagatgggcttatggccggaaatgattcagaagaggccctgacagctctgatgtctcgaaagacagctatcagtctctttgagggaaaggcattaggactggataaagcaatcctgcactccatagactgttgctcaagtgatgacaccaaaaaaaagatgtactccagcatactggtggttggcggagggctgatgtttcataaagcacaggagttcctgcagcaccgtatactgaacaagatgcccccctccttccggaggatcatcgaaaacgttgatgtgattactcgccccaaagatatggatcccaggctgatcgcttggaagggaggggccgtgcttgcctgtttagacaccacgcaggaactctggatttaccaacgcgaatggcagcgcttcggagtccggatgctcagggaaagagctgctttcgtgtggtag

SEQ ID NO: 182512 - DNA, 1131 bp, Artificial Sequence
  Description of Artificial Sequence: Synthetic coding sequence
atggaggagttccacggccggaccctgcacgacgacgacagctgccaggtgatccccgtgttgcctcaggttatgatgatcctgattcccgggcagactctgccattgcaactatttcacccacaggaagtgagcatggtgcggaatctgattcagaaagacaggacatttgccgtccttgcgtattcgaatgtgcaagagagggaggcccagtttggaacaaccgccgaaatctacgcctaccgcgaagagcaggattttggaatagagatcgttaaggtcaaagctattggccgccagaggttcaaggtgctggagctgagaacacaaagcgatggtatccaacaggcaaaggtccaaatactcccggaatgcgttctgccatctaccatgagtgcagtacaattagagtcgctaaataagtgtcagatcttccctagtaagcctgtttcaagagaggatcagtgcagttacaagtggtggcagaagtaccaaaaacgaaaattccattgcgccaacctgacaagttggccaagatggctgtactcactttacgacgccgagactttgatggacagaatcaaaaagcagctgagagagtgggacgagaacctgaaggacgattcccttccttccaattttagctacagagtcgctgcctgcctccccattgacgatgtgttgaggatccaactcctcaaaattgggtcagccattcagcgccttcgttgtgaattggatattatgaataagtgcacctccctctgctgtaaacagtgccaggagactgagatcactaccaagaacgagattttctcactcagcctgtgcggcccaatggcagcctatgtcaacccccacgggtacgtccacgaaacgctgaccgtttacaaagcttgcaatttaaacctcattggcagaccgtctaccgaacattcttggtttcctggatatgcctggactgtcgctcagtgcaaaatctgtgcgtcccatatcgggtggaagtttactgcaactaaaaaagacatgtctccacaaaagttttggggactgaccagatcggcccttctccccactatccctgataccgaagacgagatttcaccggataaggtcatcctgtgtctctag

SEQ ID NO: 182513 - DNA, 1326 bp, Artificial Sequence
  Description of Artificial Sequence: Synthetic coding sequence
atggccggcgagggcgaccagcaggacgccgcccacaacatgggcaaccatctgcccctcttgcccgagtcggaggaagaggacgagatggaggttgaggaccaagactccaaggaggctaagaaacccaatatcattaatttcgatacctccctccctacctctcatacctatctgggggccgacatggaagagttccatggcaggaccttacatgacgacgactcatgtcaggtcattcctgtgcttccacaagttatgatgatattgattcctggccagacactcccactacaactgttccatccccaagaggttagcatggtccgtaatctgatccagaaagaccgtacctttgctgtcctggcatactcaaatgtacaagaaagagaagcgcaatttggtacgacagcagaaatatatgcctaccgggaagagcaggatttcggcatcgagatcgtgaaagtgaaagccatcggacgccaacggttcaaggtactcgagctcaggacacaaagtgatggaattcagcaggccaaagtgcagattttgcctgaatgtgtcctcccatcaaccatgtctgccgtacagctcgagtccttaaacaagtgccaaatcttcccctctaaacctgtatcacgggaagaccagtgtagctataagtggtggcagaagtaccagaagcgtaaatttcactgtgcgaacttgactagctggccacgttggctttactctctctacgatgctgagactcttatggaccgcataaaaaaacaactaagggagtgggatgagaacctgaaagatgattctctgccaagcaatccgatcgatttcagttacagagtggctgcgtgcctgccaattgatgacgtattgagaatacagttacttaagattgggagtgccattcagcgcctgcgatgcgagctggacattatgaataagtgcacctcactgtgctgtaagcaatgccaggagacagagatcacaaccaagaacgagatattttccctgtctctgtgtggccccatggccgcctacgtgaacccgcatgggtatgtgcacgagactctgactgtttacaaagcttgtaacttaaacctcattggacggccttcaaccgagcacagctggtttccagggtacgcctggactgtagcccagtgcaaaatatgcgcttcccatatcggctggaagttcacagctaccaaaaaagatatgagtccgcaaaagttttggggccttacccggtccgcccttttgccaactatcccagatactgaagacgagatttcccccgacaaggtgatactgtgtctctag

SEQ ID NO: 182514 - DNA, 1335 bp, Artificial Sequence
  Description of Artificial Sequence: Synthetic coding sequence
atggaggaggagggcaagaagggcaagaagcccggcatcgtgagcccattcaaacgcgtgttcctgaaaggtgagaagtctagggataaaaaagcccatgaaaaggtcaccgaaaggaggcccctgcacactgtcgttttgagtctgcccgaacgcgttgagccagataggctgttatcagactatatcgagaaggaggttaaatatcttggacagttgaccagtatacccgggtacctgaaccctagcagtcgcacagaaatattgcattttatagataatgctaaaagagcccaccagctccctgggcacttgacccaggaacacgacgccgttctttccctatccgcgtataacgttaagctagcctggcgcgacggggaggacatcatcctgagagtgcccatccacgatattgccgctgtcagctacgttcgagacgacgccgcccacctagtggtacttaaaactgcacaggatccaggaatcagcccttcccagtcgctttgtgctgaatccagtcgcgggctctctgctggatccctgagcgagtccgctgtcggacctgttgaggcttgttgcctggtcatccttgccgctgaatccaaagtggccgcggaagagttatgctgcctgcttggacaggtctttcaggtggtctacacagaatccactattgattttctggatagagctattttcgacggcgcttccacaccaacccatcatcttagccttcatagcgacgactccagtactaaggtggacatcaaggagacctacgaggtggaagcttctactttttgctttcctgagagcgtcgacgtgggtggcgccagccctcacagcaaaactataagtgagtctgagcttagtgcgtccgcaactgaactcttgcaagactacatgttgaccctgcgcacaaagctatcatcgcaggagatacagcagttcgccgctctgttacacgagtacaggaatggcgctagcatccacgaattttgcatcaatctcagacagctttacggggatagccggaagttcttactacttggtcttcgcccattcatccccgagaaagatagccaacactttgaaaacttcctggagacaattggtgtgaaggacggcagaggaatcattaccgattcctttggtaggcacaggcgcgcactctcaactacatcgtcgtctacaaccaacggcaaccgagccacaggcagttctgacgatagatcagccccatccgagggagacgaatgggacagaatgatatccgatattagttctgacattgaggctttaggttgctcgatggatcaggactctgcctag

SEQ ID NO: 182515 - DNA, 1398 bp, Artificial Sequence
  Description of Artificial Sequence: Synthetic coding sequence
atgcacagcagctgccggcagcggcggaaccagaacctgagcaaggagattccacagaccgaattccacacagggtattcaatggaaaacgagcctggcatagtaagccctttcaagagggtttttctcaagggagaaaaatcacgggacaagaaggctcatgagaaagtgacggagaggcgacctctgcacacagtggtgctgagcctgcccgagcgggttgaacccgacagactgctgagcgactacattgagaaagaggtgaagtaccttggtcaactgacttccatccccggctatttgaatccctcctcacgcacggagattctgcactttattgacaacgctaaacgtgcccaccagcttcccggacatctgacacaggagcatgacgctgtgttgtccctctcagcctacaatgtgaagcttgcctggcgggatggcgaggatatcatactgcgcgtacctattcatgatattgccgctgtgagctatgtgcgtgacgatgctgctcatttggtcgtgcttaagactgcgcaggacccaggaatctcacccagccagtccttatgcgccgaaagctcacgggggctctctgccggctccctcagtgaatctgcagtggggccagtcgaagcatgctgcctggtcattttagccgcagagtccaaagtggctgccgaagagctatgctgtctgttaggccaagtgtttcaggtggtgtacactgagagtaccatcgatttcctcgaccgcgccatatttgacggtgcatcaacccctacgcatcatctttctctccattccgatgacagctcaacgaaagtagacattaaggagacctacgaagtcgaagcgtctaccttctgtttcccagaaagtgtggacgtcggtggggcttccccacactcaaagacgatctctgagtctgaactgagtgcatcagctaccgagctcctgcaggactatatgctcacacttagaactaagctgagtagccaggaaatccaacagtttgcggcgctgctgcacgagtatcgtaacggcgcttccatccatgaattctgcattaatctccgtcagctgtacggagacagtaggaaattcctcctgctagggctgcgcccatttattccggagaaggactcccaacatttcgagaacttcctggaaaccatcggcgtgaaggacggccgaggaattatcaccgactccttcgggcggcacagaagggctctgtcaacgacatcgtcctccaccactaatggaaaccgcgctacgggatcttccgacgatcggtcggctcctagcgagggcgacgaatgggatcgaatgatatctgacattagctcggacatcgaggctttgggctgctcgatggaccaggattctgcctag

SEQ ID NO: 182516 - DNA, 1317 bp, Artificial Sequence
  Description of Artificial Sequence: Synthetic coding sequence
atggagaacgagcccggcatcgtgagccccttcaagcgggtgttcctaaaaggagagaaatcaagagataaaaaagcgcacgaaaaggtgactgagagacggcctctgcataccgtggtgctgagcctgccggagagggtcgaacccgatagactgttgagtgactacatcgagaaggaggttaaatatctggggcagctgaccagcattcccggatacctgaacccatcaagtaggaccgagatactccacttcattgataatgccaagagagctcaccagcttccggggcacctcacacaggagcacgatgccgtcctgagcctgtctgcctataatgtgaaactggcctggagagacggagaggatatcattctcagggttcctatccatgacattgcggcagttagttatgtcagggatgatgccgcacatctggtggtgctgaagacggcccaggatcccggaatatcccctagccagtcactctgcgcagaaagttcgcggggcttgtccgccggcagcctgtccgaaagcgctgtggggccggttgaggcctgctgtctagtcatcctggcagccgaatcgaaggtcgctgcggaggagctgtgctgcctgttagggcaggtgtttcaggttgtttatactgaaagcaccatcgattttctggacagagcgatctttgatggtgcttctacaccgacgcatcacctgagccttcactcggacgatagttctactaaggtggacatcaaggagacatatgaggtggaggcttcaactttttgcttcccagagtccgtcgatgtggggggggcctccccccactctaagacaattagcgagagtgaactgtcggccagcgcaacagagctcctacaggattacatgcttacactgaggacaaagctaagctcccaggaaatacagcagtttgcagccctactccacgagtatcggaatggggccagtatccatgagttctgcatcaacctgagacagctgtacggagattcccgcaagttcctgctgctgggactgagaccctttataccagagaaggatagtcaacatttcgaaaattttctggagaccatcggggtaaaagatggtagggggattattaccgactcttttggcaggcatcgaagagctcttagcacgacatcatcctcgaccacaaacggaaaccgcgccactgggtctagtgacgatagatccgcccccagtgagggggatgaatgggatcgtatgatctctgatatttcttccgatatcgaggcactcggttgttcaatggatcaggatagtgcctag

SEQ ID NO: 182517 - DNA, 1161 bp, Artificial Sequence
  Description of Artificial Sequence: Synthetic coding sequence
atggaggaggagggcaagaagggcaagaagtacctgggccagctgacctctattcctggctaccttaacccatctagccgcactgaaattctgcacttcatcgacaacgccaaacgggcccaccaactgccgggccacctcacacaggagcacgatgctgtgctgtctctgtctgcatacaacgtcaaattggcctggcgggatggcgaggatattatcctgcgcgtgcctatccatgatatcgctgcggtatcgtacgtgagggacgatgctgctcatttagttgtcctcaaaactgcccaggaccctggcattagcccaagccagtccctctgtgccgagagctcaaggggcctgtctgcaggtagcctgagcgagagtgccgtggggcctgtagaggcctgctgtctggtgatcctggccgctgagtcaaaagtggccgccgaagaactgtgttgcctgctcggacaggtcttccaggttgtctacactgagagtacaatcgacttcctcgaccgcgcgatatttgacggcgccagcactcccacgcaccacctttcactgcactccgatgacagctccaccaaagttgatatcaaagaaacgtacgaggtggaggcaagcactttttgcttccctgagtccgttgacgtcggtggcgcgtcgcctcactcaaagacaatcagcgagtcagagctttcagctagcgccactgaacttctgcaagattatatgctgacgctcaggacaaagttaagtagtcaggaaatccaacagtttgctgctttacttcacgagtaccgtaacggcgcgtctatccacgaattttgtatcaatctgagacagctgtatggagactcccgaaaatttctgctgctgggccttagacccttcataccagaaaaggacagtcagcacttcgagaatttccttgagactatcggcgtgaaagatgggcgcggcatcatcactgacagcttcggcagacatcgtagagccctgtccactacatcttccagcactactaacggcaaccgagccacagggagctcagacgataggtccgcgccatcggaaggtgacgaatgggaccgaatgatctcggacatcagcagcgacatcgaagctctggggtgcagcatggatcaggattccgcgtag

SEQ ID NO: 182518 - DNA, 216 bp, Artificial Sequence
  Description of Artificial Sequence: Synthetic coding sequence
atggaggaggagggcaagaagggcaagaagcccggcatcgtgagccccttcaaaagagtgtttctaaaaggtgagaaatcacgcgacaagaaagctcacgaaaaggtcactgagaggaggccacttcacacagtagtgttgtctctgcctgagagagtagagcctgatcgtctgttgtcggactacatagagaaagaggtgaaggggtctcattag

SEQ ID NO: 182519 - DNA, 1062 bp, Artificial Sequence
  Description of Artificial Sequence: Synthetic coding sequence
atggaggaggagggcaagaagggcaagaagcccggcatcgtgagcccatttaagcgcgtttttctgaaaggggaaaaatctagagacaaaaaggcgcatgaaaaggttaccgaaagaagaccactgcacactgtggtgctgtctctcccagagcgggtggagccagacaggctgctcagtgactatatagagaaagaagtgaagtacctgggccagcttacttcgattccgggctacctaaatccgagctcaaggactgagatactgcactttattgacaacgcaaagcgcgcacaccagctgcccgggcatctgacgcaggagcatgatgccgtcctgagccttagtgcttacaacgtcaagttggcatggcgtgatggcgaagatataatcctgagggtgccaattcatgacatcgctgctgtaagctacgtccgcgatgatgcagcccacttagtggtactaaaaaccgacgactcatccactaaggttgatataaaagagacatatgaggtcgaggcctccacattttgtttccctgagagtgtggatgtgggcggcgcgagtccgcatagtaagaccatctccgaaagcgaattgagtgcaagcgccacggagctgctgcaggactacatgctcacgcttaggactaagctcagctcacaggaaattcagcaatttgccgctttactacacgagtataggaatggtgcgtcgatccatgaattctgcattaacctccgacagctatacggggattctaggaaatttctcttactcggactcagaccattcattccagaaaaggacagccagcatttcgaaaactttctcgagaccattggggttaaagacgggagaggtattataaccgattcatttgggcgacatcgccgggccctgagcactacttcgagtagcactacgaacggcaacagggccactggcagcagtgacgaccggtccgcaccctccgaaggggatgagtgggacagaatgatctcggatatctcctcagacatcgaggcgcttgggtgctcaatggaccaagacagtgcctag

SEQ ID NO: 182520 - DNA, 1224 bp, Artificial Sequence
  Description of Artificial Sequence: Synthetic coding sequence
atgcggcggaacctgcggctgggccccagcagcggcgccgacgcccagggccaaggggcgccaagaccagggctggcagcccctcggatgttactgccgccagcttcgcaggctagccggggatcaggcagtacgggctgctccttgatggcccaggaggtggatacagcccagggcgccgagatgcgccgtggcgcaggggctgctagaggaagggcctcctggtgttgggcactggctctgctatggctggctgtcgtccccggatggtctcgggtgtcggggattccctcacgtcgtcactggccggtaccctataaacgtttcgattttagacctaagccagatccatactgccaagctaagtataccttttgtccaacgggatctcctatccccgtgatggagggggacgatgatattgaggtgtttagactgcaggcccccgtatgggaattcaagtacggggacctcctgggtcatcttaaaattatgcacgatgccattgggtttcgctcgaccttaacaggcaaaaattacaccatggagtggtacgagctgtttcagctggggaattgcacgtttccccacctgcggcccgaaatggatgcacctttttggtgtaaccagggtgctgcctgctttttcgaaggcattgatgatgtgcactggaaggagaacggcactctggttcaagttgcaacgatctctggtaacatgtttaatcagatggctaaatgggtaaagcaggataatgagacaggcatttactacgagacctggaacgtgaaggccagccctgagaaaggggccgaaacttggtttgattcttacgactgttctaagttcgtgctcaggacctttaacaagttggcggaattcggcgccgaatttaagaacatcgaaacaaattacacccggatattcctgtactctggggagcccacttacctgggcaacgagaccagcgtgttcgggcctacagggaataagactctgggtctggctatcaaaaggttctactatccatttaaaccacacctgcctacaaaggagttcttactgtctttgctgcagatattcgatgcagtgatcgtgcacaaacagttctacctattttacaatttcgaatattggtttctgcctatgaaatttcccttcattaagattacctacgaagaaattcctttgcccatccggaacaagaccctgtcagggctctag

SEQ ID NO: 182521 - DNA, 822 bp, Artificial Sequence
  Description of Artificial Sequence: Synthetic coding sequence
atggagggcgacgacgacatcgaggtgttccggctgcaggcccccgtgtgggagtttaaatacggtgacctcttgggccaccttaagatcatgcacgatgccattggatttagatctactctgaccgggaagaattatactatggagtggtacgagttgtttcagctcggcaactgcacgttcccccacctgaggcccgaaatggatgccccgttttggtgcaatcaaggcgctgcatgcttttttgaggggatcgacgatgtgcactggaaagagaacggaactcttgttcaggttgccacaatatctggcaacatgttcaatcaaatggctaaatgggtgaagcaagacaatgagaccggaatatactatgagacctggaacgtgaaggccagtccggagaagggtgcggagacttggttcgactcctacgactgttctaagttcgtcctgaggaccttcaataagctggccgaatttggggccgagttcaagaatattgaaaccaattacacccgaatttttctctactctggcgaacccacctacttggggaatgagacttctgttttcggccctactgggaataagaccctaggcctggccatcaagcgtttctactacccatttaagccacaccttcccacgaaggagttcttgctgagcctgttacaaattttcgatgccgtgatcgtacacaagcaattttacttgttctacaactttgagtactggttccttccaatgaagttccccttcatcaaaatcacatacgaagaaatcccactcccaattcgaaataaaaccctgtccggcctgtag

SEQ ID NO: 182522 - DNA, 1077 bp, Artificial Sequence
  Description of Artificial Sequence: Synthetic coding sequence
atggcccaggaggtggacaccgcccagggcgccgagatgcggcggggagctggagccgcgcgcggacgcgctagttggtgctgggcattggcactgttgtggctcgccgtggttcccgggtggtcacgcgtgtcaggaatccccagtcgaagacactggcccgtgccctataagcggttcgactttagacccaagcccgatccgtactgccaggccaagtatacattctgccctactgggtctcccatcccagtgatggagggggatgatgatattgaagtgttccgccttcaggcacctgtgtgggagtttaagtacggcgacctcctgggacatctcaaaatcatgcatgacgccatcggattcaggagtaccctgacaggtaaaaattacacaatggagtggtacgagctgttccagcttgggaactgcacattccctcatctgcgcccggagatggacgcccccttttggtgtaatcagggcgccgcttgtttctttgaaggtatcgatgatgtacactggaaagaaaacggaacgctcgttcaggtcgccaccatctcaggcaatatgttcaatcagatggctaaatgggtcaagcaggataacgaaactggcatctattacgaaacatggaatgtgaaggcttcacccgagaagggggcggagacctggttcgacagctatgattgttcgaaatttgtgctcaggacctttaacaaactggccgagttcggcgcggaatttaaaaacattgaaaccaattacactcgcatattcctctactccggcgaaccgacctatctgggaaacgagacgagcgtgttcgggcccacaggtaataaaactttaggcctagccatcaagcgtttctactaccctttcaagccccatctccccaccaaggaattcctgctatccctcctccaaattttcgacgctgtaattgtccacaagcagttctatcttttttacaattttgaatattggtttctgcctatgaagttcccatttatcaagatcacttatgaagaaattcctctcccaattcgcaacaagacactttccggcctatag

SEQ ID NO: 182523 - DNA, 936 bp, Artificial Sequence
  Description of Artificial Sequence: Synthetic coding sequence
atggaggccacccggcggcggcagcacctgggcgccaccggcggcccgggggctcagctgggtgcttcttttttacaggcccggcatggatccgtgtctgctgacgaagctgcgcggacagctccctttcacttggacctgtggttctacttcaccctgcagaactgggttctcgattttggcaggcccattgccatgctggtgtttccactggagtggttcccactgaataaaccaagcgtgggtgactacttccacatggcttacaacgtcatcacaccctttctgctgctgaaactgatcgagcgttctccccgtaccctgccaaggagtatcacatatgtgtccatcataatttttatcatgggggctagtatacatcttgtgggcgactcggtgaatcacaggctgctctttagtggttaccagcatcacctctcagtcagagaaaacccaatcatcaaaaaccttaaacccgaaactctcatagacagcttcgaactgctttattattatgatgagtacttggggcattgcatgtggtacatcccattctttctgattctctttatgtacttcagcgggtgctttaccgcctctaaggccgagagtcttatcccagggcccgcactgctcctcgtggcgccatccggcctgtactattggtatctcgtcacagagggccagatctttatcctgtttatcttcacgttttttgcgatgttagcgctagtcctgcatcagaaacggaagcggttgtttctcgattccaacggactgttcttgttcagctccttcgcccttaccttgctcctcgtggctctctgggtggcttggctgtggaatgatcccgttctacggaagaagtatcccggagtcatttacgttcctgagccttgggcattctacaccttacatgtgagttctcggcactag

SEQ ID NO: 182524 - DNA, 549 bp, Artificial Sequence
  Description of Artificial Sequence: Synthetic coding sequence
atgcggctgcccgcccggctgcccagcaccagcaccagcggcagcacttctcattgtcgaacgggcttctggacattaggtgtgccactaccatgttggtatagcctttccagcgggtttcactccacaagtccggtgttaggcactacttcgacctggcccacaaccagctcaaggccatttagctgtagttcagggtgctttaccgctagcaaagctgagtctctgatccctggacccgcactgctgctggtggcaccttcgggactttattactggtatcttgtcacagaggggcagatttttattctcttcatctttacattttttgccatgctggcacttgtgcttcaccagaaaaggaagcgcttgtttctggattcaaacgggctattcttattcagcagttttgcactcacgctgctgctggtagccttgtgggtagcatggctatggaatgaccctgtactgcgtaaaaaataccccggtgtaatctatgtcccagagccatgggcgttctatactctgcatgtatccagccggcactag

SEQ ID NO: 182525 - DNA, 1032 bp, Artificial Sequence
  Description of Artificial Sequence: Synthetic coding sequence
atggccgccgtggccggcaaggagcggcgggcccggggccggccccggcccgagacgcttggagcgattccgaggcgggagggtggcgaggccgggctttcgagagcttttaaacccctcgcccaggcacccctcagctgcgagacctccctgcgcaagttaaagttcaaagggaagaagcacggcagcgtgagcgccgatgaggctgcgcgcactgctccattccacctggacttgtggttttattttactctgcaaaactgggtgctggactttggacgaccaatcgcaatgctggtatttcctttggaatggttcccactcaataaaccttctgtgggagactacttccacatggcctacaacgtcatcacacctttcctgctgctgaaactgatcgaacgaagccccaggaccctcccccggagcatcacctacgtgagcataataatcttcatcatgggagccagtatccacttggtaggggacagcgtgaatcatagactgctgttctcaggatatcagcatcacctcagtgttcgtgagaaccctatcatcaagaatctgaaaccagagactctgattgattcgtttgaactgttatactactatgatgaatatctagggcattgcatgtggtacatccctttctttctgatcctgttcatgtatttcagcggatgctttactgcctccaaagccgagtccttaattcctggccccgcccttctcttggtggcaccatcaggcctgtactattggtacctggtgaccgagggccaaatctttatactgttcatcttcaccttctttgccatgctggcactcgtgctccatcagaagagaaaaaggctatttctcgatagcaatggactttttctgttcagctcctttgcactgaccctcctactggtggccctgtgggtagcctggttgtggaatgacccagtgttgagaaaaaagtatccgggtgtgatctacgttccagagccctgggcgttctatacgctccacgtttcaagtcgccattag

SEQ ID NO: 182526 - DNA, 861 bp, Artificial Sequence
  Description of Artificial Sequence: Synthetic coding sequence
atgaaccccgccagcgacggcggcaccagcgagagcatcttcgacctggactatgcatcctggggaattcggtctacactaatggtggcaggatttgtgttctatctgggagtgtttgttgtgtgtcaccaactctcatccagtctcaatgccacatacaggagcctggtcgcccgtgagaaagtcttctgggacctggcagctacaagggcagtcttcggcgtccaatctactgcggccgggctgtgggccctgcttggagatcccgtgttgcacgcggacaaggctcggggacagcagaattggtgctggttccatatcacaaccgcaaccggcttcttttgcttcgaaaacgtggcggtgcacctctcaaaccttattttccggacctttgacctcttcctcgtgatccatcaccttttcgctttcttggggttcttaggatgcctggtgaatctacaggccggtcactatctggccatgaccacgctattactcgagatgagcacgcccttcacttgtgtatcctggatgctgctgaaagccggatggtccgagtccctgttctggaagttgaaccagtggttaatgatacacatgttccactgtcggatggtgctcacctaccacatgtggtgggtgtgcttctggcactgggatgggcttgtaagcagcctctacctgccccacctgactctctttctggtcggcttagccctgttaaccctcattataaacccatattggacgcataaaaagacacagcagctactaaatcctgtggattggaattttgcccagccggaggcaaaaagcagacccgagggcaacggacagctgctgcgtaaaaagaggccatag

SEQ ID NO: 182527 - DNA, 1065 bp, Artificial Sequence
  Description of Artificial Sequence: Synthetic coding sequence
atgtaccgggagtgggtggtggtgaacgtgttcatgatgctgtacgtccagcttgtgcaggggtcatctaacgagcacgggccagtgaaacgctctagtcagtccaccctcgagagatctgaacagcagatccgcgccgctagcagcctggaagagctattacgcatcacccattccgaagattggaagctctggcgctgccggttgcgactgaaaagcttcaccagcatggacagccgatctgccagtcataggtcaactaggtttgccgccacgttctatgatatcgaaaccctgaaagtgattgatgaggaatggcaaaggactcagtgcagccctcgagaaacatgcgtggaggtggcctccgagctaggcaagtctacgaacaccttcttcaagccaccctgcgtcaacgtttttcgatgcggaggatgttgcaacgaggagtcactaatatgcatgaacacgtcaacatcctatataagcaaacagctattcgaaatcagcgtacccctcacgtctgtgccagaactcgttcccgtcaaagtggccaatcacaccgggtgtaaatgtctgccaacagcacctcggcacccttactccatcatccggaggtccatccagatccccgaagaggacaggtgttcccattctaagaagttatgtcccatcgacatgctgtgggactccaacaagtgcaagtgcgtgcttcaggaggaaaatcctctagccggcacagaagaccattcccatctccaggaacctgctctctgcgggccacacatgatgtttgacgaggacaggtgcgagtgtgtgtgtaagacaccctgtcctaaagatttaatccaacatccaaaaaattgttcctgctttgagtgtaaagagagcctggagacctgttgccagaagcacaagcttttccaccccgacacctgtagctgcgaggatcgttgtccttttcacaccaggccttgtgcctctggcaagacagcctgcgccaagcattgccgctttccgaaagaaaagagggccgcgcaggggccacacagtcggaagaacccttag

SEQ ID NO: 182528 - DNA, 504 bp, Artificial Sequence
  Description of Artificial Sequence: Synthetic coding sequence
atggagcggttcgtggtgaccgccccccccgcccggaaccggagcaagactgccttgtatgtaactccactggatcgggttaccgaattcggcggcgagctgcatgaagatggcggaaaattgttctgcacatcttgcaacgtggtgttgaatcatgtcagaaagtccgcaattagcgatcacctcaagtctaagactcacacaaaaagaaaggccgaattcgaagaacaaaacgtacgaaagaagcaacgacccctcactgcctccttgcagtgcaatagtaccgcccagaccgaaaaagtttcagtgatccaggattttgtgaagatgtgtctggaggctaatattccgttggagaaggctgaccatcctgctgtacgggccttcctaagccggcacgtgaaaaacggaggaagtattcccaagtcagatcagttacggagagcctacctgcccgatggctacgagaatgaaaaccagctccttaactcccaggattgttag

SEQ ID NO: 182529 - DNA, 504 bp, Artificial Sequence
  Description of Artificial Sequence: Synthetic coding sequence
atggagcggttcgtggtgaccgccccccccgcccggaaccggagcaagactgccctgtacgttacacctctcgatcgcgtcacagagtttggcggcgaattgcacgaagacggtggcaagctcttctgtacctcgtgcaacgtcgtactgaaccacgtgaggaagtctgcaatttcggaccatttgaaaagcaagacccatactaagcggaaagctgagtttgaggagcagaacgtgagaaaaaagcagcggcccctcaccgccagcctgcagtgtaactcaaccgcacagacagaaaaagtttctgtaattcaggattttgtcaaaatgtgccttgaggccaacattcctctcgaaaaggcagatcatccggctgttagggcctttctgagccgacacgtgaaaaatgggggtagcatcccaaagtccgaccaactaaggcgagcttatctgcctgacgggtacgaaaacgagaatcagctgctcaattctcaggattgttag

SEQ ID NO: 182530 - DNA, 504 bp, Artificial Sequence
  Description of Artificial Sequence: Synthetic coding sequence
atggagcggttcgtggtgaccgccccccccgcccggaaccggagcaagactgctctctacgtgacccctttggaccgcgtgaccgaattcggcggtgagctgcatgaggatggtgggaagctgttctgtacgtcctgcaatgtcgtgttaaaccacgtaaggaaatctgcaattagtgaccatctcaagagcaaaacccacacaaaacgcaaggcagaatttgaggagcagaatgtaaggaagaaacagcgacccctgactgccagtctgcagtgcaattccaccgcacagactgaaaaggtaagtgtgattcaggatttcgtgaaaatgtgcttggaagcaaacattccattggagaaagccgatcacccggcagtacgagctttcctttcccgacacgtcaagaacggcggatccatccccaaaagcgatcagctgcgacgcgcctatctgcccgacggctacgaaaacgagaatcagctcctcaacagtcaagactgttag

SEQ ID NO: 182531 - DNA, 321 bp, Artificial Sequence
  Description of Artificial Sequence: Synthetic coding sequence
atggagcggttcgtggtgaccgccccccccgcccggaaccggagcaagactgcgctgtacgtgacaccccttgatagagttacggaattcgggggcgagctgcacgaagacggcgggaaattgttctgtacctcatgcaatgtcgtacttaaccacgtccgtaagtctgcaatctccgaccatttgaagtccaaaacccacaccaaacggaaagcagagtttgaggagcaaaatgtcaggaagaagcaacgacctttaaccgccagtctgcagtgtaactccacagcacagacagagaaggtgagtgtgatccaagactag

SEQ ID NO: 182532 - DNA, 504 bp, Artificial Sequence
  Description of Artificial Sequence: Synthetic coding sequence
atggagcggttcgtggtgaccgccccccccgcccggaaccggagcaaaacggctctttatgtgacccccctagaccgtgtgacagaatttggaggagaactacatgaggacgggggaaaattgttctgtacatcatgtaatgtggtgctcaaccacgtaagaaaatccgcaatttctgaccatctgaaatctaaaacccacaccaagcggaaggccgagttcgaagaacagaatgtgaggaagaagcaaaggcccctgaccgcatcattgcaatgtaacagcactgctcagaccgaaaaagtttccgtgatccaggattttgtaaagatgtgtctggaagcgaatatccccttggagaaggcagaccatccagcagtgcgagcatttctctctcgccacgtgaagaatggcggaagcatcccgaagtctgaccagctgcgacgtgcctacctgcccgacggctacgaaaacgaaaaccagctgttaaactcccaagattgttag

SEQ ID NO: 182533 - DNA, 1608 bp, Artificial Sequence
  Description of Artificial Sequence: Synthetic coding sequence
atggccagcctgagcctggcccccgtgaacatcttcaaggccggcgctgatgaggagagagccgagactgcccgtttaacctccttcatcggtgctatcgcaatcggggacctcgtgaagagtactctggggccgaaggggatggacaaaatcttactttcatctggccgagatgcatcgctgatggtaactaacgatggcgctactattctcaaaaacatcggtgtcgacaatccagccgccaaggtcctcgtggatatgagcagagtccaggatgacgaggtaggtgatggcaccactagcgttaccgttcttgctgctgagctgcttcgcgaggcggaaagcctgattgctaaaaaaattcatccccaaacgataatagccgggtggagagaagcaactaaggccgctcgggaagccctacttagcagcgccgtggaccacggctcggatgaagtgaagtttcgtcaggaccttatgaacatagctggcacaaccctttcttccaaactactcacccatcacaaagatcactttacgaaactggccgtggaggccgtgctgcgcttaaaaggcagtgggaacctggaagctattcatattattaaaaaactaggcggctctctggctgatagctaccttgatgagggctttctgctggacaagaaaataggcgtcaaccagccaaaaaggatcgaaaatgcaaagatactgattgccaatacgggcatggacacagacaaaataaagatatttggctctcgtgttagagtcgattccaccgccaaggtggccgagattgagcatgccgaaaaagagaaaatgaaagaaaaggtggagcgtattctcaagcatggcatcaattgtttcattaatcggcagctcatttacaactatcccgagcagttgttcggggcggctggtgtcatggcaattgaacacgccgatttcgcaggagtggagcgactggctctagtcactggaggggagatcgcttctacgtttgatcacccagagttggtgaagctcggcagctgtaagcttattgaggaagttatgattggtgaagataaactgattcatttctcaggagtcgctctgggcgaggcctgcacgatcgtgttgcgaggagccacccagcagatcctggatgaagcggagagatccctccatgacgccctttgcgtgctcgcgcagaccgtcaaagactcccggacagtatatggcggaggatgcagtgaaatgctcatggcccatgccgtgactcaactcgcaaatcgcacaccaggtaaagaggccgtggctatggagtcttacgccaaggccctgagaatgctcccaacaataatcgccgacaacgccggttacgatagcgcggatctggtagctcagctgcgggctgcccacagcgaaggcaacacaaccgcgggactggatatgcgagaggggactatcggggacatggccattctgggaatcactgaaagctttcaagtgaaacgacaggtgttgctgagcgctgcggaggccgccgaagtcattcttcgggtggataatataatcaaggccgcccctcggaaacgggtacctgaccaccatccctgttag

SEQ ID NO: 182534 - DNA, 1467 bp, Artificial Sequence
  Description of Artificial Sequence: Synthetic coding sequence
atggacaagatcctgctgagcagcggccgggacgccagcctgatggtgacgaacgacggcgccacgatcctgaagaatattggcgtggacaacccagcagccaaagtgttggttgacatgtcaagagtgcaggacgatgaggtgggcgacggcacaacatccgttacggtattggcagcagagctgttgcgtgaggcagaaagcctaatcgctaagaaaatccatcctcagaccattatagctggctggagggaggctacgaaggcagcccgggaggccctcctctcatccgccgtggaccacggatccgacgaggtgaaatttagacaagatttgatgaatatagctggcactaccctctcgtccaagttgctgacacaccacaaggatcattttacaaaactcgccgtggaggccgtcctcaggttgaaaggctctggcaatctagaggctatccatattatcaagaagctcggaggctcccttgctgattcctatttggacgaaggattcctgttggacaaaaagataggggtcaatcagcccaaacgcattgaaaatgctaagattctgattgcaaacacgggcatggatacagataaaataaaaatcttcgggtctcgcgttcgcgtggactctaccgccaaggttgcagaaatcgagcacgccgagaaagaaaagatgaaggagaaggttgaaaggattctcaagcacggaatcaactgctttattaaccgccaactcatatacaattaccccgagcagctcttcggggcagccggggtgatggccatagagcatgccgatttcgccggggttgagaggttggcactggtgacgggcggtgagattgcctccacttttgatcacccggaattggtaaaactggggtcgtgcaaactcatcgaggaggtgatgatcggggaggataaattgatccatttctcaggcgtcgccctgggagaagcatgtactatcgtgttgagaggggccacgcaacagatcctcgatgaagccgaaaggtctctgcacgatgcactatgtgtcctagcacaaacagtcaaggattccaggaccgtttatggtggcggatgcagcgaaatgctgatggcccatgccgtcacgcaactcgccaacagaacccctgggaaagaagcagtcgccatggagtcctatgcaaaagccctgaggatgctgccgactattatcgcagataatgccggttacgacagtgccgatctcgtggctcaattgagagctgcccactccgaaggcaacacaaccgctggactggacatgagggagggcacgatcggcgatatggccatcttgggtataaccgagagttttcaggtgaagcggcaggttctcctgtcagccgcagaggccgctgaagtgattcttcgagtagacaatatcattaaagccgcgcctcggaaaagggtcccagaccatcacccatgctag

SEQ ID NO: 182535 - DNA, 1638 bp, Artificial Sequence
  Description of Artificial Sequence: Synthetic coding sequence
atgatgggccaccggcccgtgctggtgctgagccagaacaccaagcgtgagtccgggagaaaggtgcagagcgggaatataaacgctgccaaaaccattgccgacataatacggacctgcctaggacccaagtctatgatgaagatgctgctggaccctatgggaggtatcgtgatgacaaacgatgggaacgccatactccgagaaattcaggttcagcatcctgccgcgaaaagcatgatcgagatatctcggacacaggatgaggaagtaggcgacgggactaccagcgtaattatcctcgctggcgagatgttgagcgtggcagagcacttcttggagcagcagatgcaccctacagttgtcatctctgcctacagaaaagctctcgacgatatgatttcaacacttaagaagatttctatccccgtcgatatcagcgacagcgatatgatgttaaacatcatcaatagttccattaccactaaagcaatcagcagatggtcttctctcgcatgtaacatagccctcgacgccgtgaagatggtgcaattcgaagaaaatggaagaaaggagatcgacattaaaaaatatgctcgggttgagaagatccccggcgggatcatcgaggacagctgcgtgttgcggggtgttatgattaataaggacgtgactcatcccagaatgcggaggtatattaaaaacccacgaatagtcctgttagactcatcccttgaatataagaagggtgagtctcagacagacatcgaaatcacacgggaggaggatttcactagaattctgcagatggaagaagaatatatacaacaattgtgcgaggacatcatccagttaaaaccagacgtagtgatcactgaaaaaggtatctcggatctcgcacagcactacctgatgagagctaacatcacagctatccgccgtgttcgcaagacggataacaaccggatcgcccgtgcttgcggcgccagaatcgtgagtagacccgaagaactacgggaggacgacgtggggaccggggccggactcctggagattaaaaagattggcgatgaatattttacattcataacagattgcaaggatccaaaggcctgcactatccttctgcgtggagcaagcaaggaaattttgtccgaggttgagaggaatctgcaggatgctatgcaggtctgtcgtaatgtcctcttagatcctcagcttgtccctggtgggggtgccagtgagatggccgtggcacacgctctcactgagaaatcaaaggcaatgactggcgtggagcaatggccctaccgagctgttgcacaagctctggaagtaattcccaggaccctcattcagaattgtggcgcatcaactattcggctgctgacgagcctgcgggcaaagcacacacaggaaaactgtgaaacttggggggtaaacggggagacaggtacactggtagacatgaaggaactaggtatttgggagcccttagctgtgaagctgcaaacgtacaagactgccgtggagactgccgtgctgctcctaagaattgatgatattgtgtccggccataaaaaaaagggagacgaccaaagccgacaggggggagcccctgacgcaggccaggagtag

SEQ ID NO: 182536 - DNA, 1524 bp, Artificial Sequence
  Description of Artificial Sequence: Synthetic coding sequence
atgatgggccaccggcccgtgctggtgctgagccagaacaccaagagagagtccggcagaaaagtccagtccggcaacattaacgcggccaaaatccaagtgcaacacccggccgctaagtccatgattgaaatatctcgcacccaggacgaagaagtgggagacggcactaccagcgtgatcattctggccggagagatgctgtccgtggcggaacactttttagagcagcagatgcatcctaccgtagtgatcagtgcctatcgtaaagctttggacgacatgatctccaccctcaagaagatctccattcccgtcgatatcagtgattcggatatgatgcttaatatcatcaactcctctatcaccaccaaggcaatcagccgatggagcagcttagcatgtaacatcgctttagatgccgtcaagatggtccagttcgaggagaacggcaggaaggagatcgacattaaaaagtatgcccgtgtcgaaaagattccaggcggcataatagaagacagttgtgtcctgaggggcgtgatgatcaataaggatgttacacatccccgcatgcggcggtacataaaaaatccacggattgtcctactcgacagttcattggaatacaaaaaaggagaatcccagaccgatattgaaatcacgagggaagaggacttcaccagaattcttcagatggaggaggaatacattcaacagttatgcgaagacattatccagctgaagcccgacgtggtgattacagagaagggaatcagcgacctggcgcaacactacttgatgagagctaacatcaccgccatcaggcgggtgagaaaaacagacaacaatcgtattgccagggcttgtggggctcgcatcgttagccgccccgaagagctgcgggaggacgatgttggcactggtgctggcctgctggagatcaaaaagatcggagacgaatacttcacgttcattacagactgtaaggatcccaaggcctgcaccattttgcttcggggagcctctaaggaaatcttgtccgaggtagaacgtaaccttcaggatgctatgcaggtgtgtagaaatgtgttgcttgatccacagttggtgccaggcggaggggcaagcgaaatggctgtagctcacgctctcactgaaaagagcaaggcaatgaccggggtcgagcagtggccatatcgggccgttgcacaggcccttgaggtgatccctcgcaccctaatccaaaattgcggcgccagcaccataagactgctcacatctttgcgggcaaaacatacacaggaaaactgcgaaacatggggggtgaatggcgaaactggaactttggtagatatgaaggaactcggaatctgggaacctcttgctgttaaacttcagacgtataaaactgcggtcgaaaccgcggtgcttctgctgagaattgacgatattgtttctgggcataaaaagaaaggagacgatcagtcaagacaggggggcgctcccgatgctggccaggagtag

SEQ ID NO: 182537 - DNA, 1503 bp, Artificial Sequence
  Description of Artificial Sequence: Synthetic coding sequence
atgatgaagatgctgctggaccccatgggcggcatcgtgatgaccaacgacggtaacgctatcctgcgcgagatccaagtgcagcaccctgcagccaaatcaatgatagaaatcagcaggacccaggatgaagaagtcggcgatggtactacttctgtcatcatcttggctggagagatgctaagtgttgccgagcattttctagagcagcagatgcacccgaccgtggtaattagcgcgtaccgcaaggctctggatgacatgattagtactctcaaaaagatttcaattcccgttgacataagtgatagcgatatgatgcttaatatcataaatagtagtatcaccacaaaggccatctcaaggtggagctccttggcctgtaacattgcactggatgccgtgaagatggtccagttcgaagaaaatggacggaaggaaattgacattaagaaatatgcccgggtggaaaagatccccgggggaattatcgaggactcctgtgtgcttcgcggcgtcatgattaataaagacgtcacacatccccgtatgaggcggtacattaagaaccccagaatagtccttctcgactcgtcgttggaatataaaaagggagagtcacagacagatattgaaatcacacgggaagaggactttaccagaattctccaaatggaagaagagtacatccagcaactctgtgaggatataattcaactcaagcctgacgttgtcatcactgaaaaaggaattagcgacctggctcagcattatctcatgcgggccaacattactgccattcggcgggtcaggaaaaccgataataatcggatcgcgagagcctgtggggcccgcattgttagccgccctgaggaactgcgggaagacgacgtggggaccggtgctgggctgctggagatcaaaaagattggggacgaatattttacgtttataactgattgtaaagatcctaaagcatgtacaatcctgttacgtggggcttctaaagaaatcctcagcgaggtcgaacggaacctgcaggacgccatgcaagtttgtcgaaacgtgctgctagatccacagctggtgcccggaggtggcgcttcagaaatggctgtagcgcacgctctgaccgaaaagtctaaagctatgacaggagtagaacagtggccctaccgagccgttgcacaggctttggaggtgatccccaggaccctgattcaaaattgcggtgcctctacaatccgtctgctcacttcattgagggcgaaacatacacaagagaactgcgaaacctggggggtaaatggggaaacagggaccctggtggatatgaaagaactcggcatctgggagcctttggcagtgaagctgcagacatataagactgcagtcgaaaccgccgttttgctcctgagaattgacgatatcgtctctggccataagaagaaaggggacgatcagagtcggcagggaggcgcccctgacgccggccaggagtag

SEQ ID NO: 182538 - DNA, 831 bp, Artificial Sequence
  Description of Artificial Sequence: Synthetic coding sequence
atgtacgagggcgacctggagggccagagcatgaactggaccagcgaggaggggagaggcgacatcatccgttcgggaaccaacatcgatagagcttggcagtgccagaacacaaaaagagagagcgggagaaaggtgcagtccgggaacatcaacgcggcgaaaaccattgcagacatcatccggacatgtttgggtcccaaatcaatgatgaagatgcttcttgatccgatgggaggaattgtaatgacgaacgatggcaacgcgatcttaagggaaatccaggtacagcaccccgccgctaaaagtatgattgagatcagccgcacacaggacgaggaggtgggggatgggacaacttcggtcataattctggccggcgagatgctttcagtggctgagcacttcctggagcagcagatgcatcctaccgtagttatctccgcctacaggaaagccctcgacgacatgatttccacactgaagaaaatcagcatcccagtggatatcagtgactctgatatgatgctgaatattatcaattcttctattacaaccaaagcgatttctaggtggtcctccctggcctgtaatattgcgctcgatgctgtaaagatggtacagtttgaagaaaacgggcgcaaagagattgacattaagaaatacgctcgagttgaaaaaatcccgggcggcatcatagaagatagctgtgttttacggggcgtgatgatcaataaggacgttactcaccccagaatgcggagatacattaagaaccctcgtatcgtgttactggattcatccttagagtacaaaaagggtgaatcatag

SEQ ID NO: 182539 - DNA, 486 bp, Artificial Sequence
  Description of Artificial Sequence: Synthetic coding sequence
atgatgggccaccggcccgtgctggtgctgagccagaacaccaagagggaatcaggtcggaaagtacaatctgggaacatcaatgcggcaaagacgatcgcagatattatcaggacctgtctggggccgaaaagcatgatgaagatgctcctggatcctatgggagggatagtcatgacaaatgacggtaatgccatcctgagggaaatccaggtgcagcaccctgccgccaagagtatgattgaaatctcccggacgcaggacgaggaggtgggtgatggcactacttccgtcattatcctggagtcccacagcgttacgatgttggagtgcggcggtgctatactcgctcattgcaacttgtgtttaccagccggcgaaatgttatctgttgcagaacattttctcgagcagcagatgcacccgactgtagtaatcagcgcataccggaaggctttagatgacatgatctccacactgaagtag

SEQ ID NO: 182540 - DNA, 567 bp, Artificial Sequence
  Description of Artificial Sequence: Synthetic coding sequence
atgtacgagggcgacctggagggccagagcatgaactggaccagcgaggaaggtcgcggggatatcattcgctccggcaccaacattgacagagcctggcaatgccagaatacaaagagagagagcggaaggaaggtccagagtggcaatattaatgcagccaagatccaggtgcaacatccggctgcaaaatccatgatcgaaatatccagaacccaggacgaagaggttggagatggcaccacatcagtgatcatccttgctggagagatgttatccgtggcagagcattttctcgagcaacaaatgcaccccacggtagtaatctcagcctacagaaaggccctagatgatatgattagcacattaaagaagatctctattcctgtcgacatcagtgattccgatatgatgctgaacatcattaatagttccatcacaaccaaagccatttcacgatggagctctctagcttgtaacatcgccctggatgcagtgaagatggtccagttcgaggaaaatggaagaaaggaaatcgatattaaaaaatatgcgcgggtggaatag

SEQ ID NO: 182541 - DNA, 1503 bp, Artificial Sequence
  Description of Artificial Sequence: Synthetic coding sequence
atgatgaagatgctgctggaccccatgggcggcatcgtgatgaccaatgacgggaacgccattcttagggaaatccaagtgcagcaccctgctgcaaagagcatgatcgaaatttctagaactcaggatgaagaggttggggatggcaccacctccgttatcatactggccggggaaatgctgtctgtcgctgagcattttctggaacagcaaatgcatcccaccgtggtcatcagcgcttaccgaaaggcactggatgatatgatctctaccctcaagaagatttctattcctgtggacatttctgactcagatatgatgctgaatattattaactcttcgattacaactaaagccatcagccggtggagcagtctggcatgtaatatcgccttggacgccgtgaaaatggtgcagttcgaagaaaatggcaggaaggaaattgacattaaaaagtatgcacgcgttgaaaagatccccggaggaattatcgaggatagttgtgtactcagaggggtcatgattaacaaagatgtgacccatccaaggatgagacgctatatcaagaatcctcgtattgtgcttctcgatagctcccttgagtataaaaaaggagagtcacagacagacattgagataacgagagaggaggactttacaaggatcctacagatggaagaggaatacatccaacagctatgtgaggacattatccagttgaaacccgacgtcgtgatcactgagaaagggatcagcgacctcgcacagcactacttaatgcgggccaatataacagcgattcgccgagtgcgcaaaaccgataataaccgaattgcccgggcctgtggtgcccgcatcgtgtccagacctgaggagctgagagaggatgacgtgggaactggcgctggtcttctggaaataaaaaagattggcgatgagtactttacattcatcaccgactgcaaggaccccaaagcctgtactatcctacttagaggagctagcaaggaaattctgagcgaggtcgaacgaaatctgcaggacgctatgcaagtgtgcagaaacgtgctgctggacccgcagctggtgccaggcggcggtgcaagcgaaatggcagtcgcccacgctttgacagagaaaagtaaggcaatgactggcgttgagcagtggccttatcgcgcagtggcccaagccctggaggtgattccccggaccctcatccaaaattgtggcgcctcaaccatcaggcttttgacgtctctcagagccaaacatacacaggaaaattgtgaaacatggggagtcaacggagaaactgggactttagtcgatatgaaggaactgggcatctgggagcctctcgctgtaaagctccagacctataaaaccgcggtggaaaccgcagttttgctgttacgaattgacgatatagtgtcagggcataaaaaaaaaggagacgatcaatcgcgccagggcggcgctccagacgcgggccaggagtag

SEQ ID NO: 182542 - DNA, 1620 bp, Artificial Sequence
  Description of Artificial Sequence: Synthetic coding sequence
atgcccgagaacgtggccccccggagcggcgccaccgccggcgccgccggcggcaggggcaagggcgcgtatcaggaccgagacaaacccgcacagattcgattctccaacatttcagccgccaaggccgtggctgacgctatccgaacttccttggggcccaagggaatggataaaatgattcaggatggcaagggcgacgtgacaattaccaatgacggcgcgaccatcctgaagcaaatgcaggtattgcaccctgccgcacgaatgctcgtggaactatcaaaggcacaagacattgaggcgggagatggcactacctctgtggtgattatcgcagggtccttgctggactcttgtaccaagctgttgcagaagggcatccatcccactatcatctcggagtcctttcaaaaagcactcgagaaaggtatcgagatactcaccgacatgtcccgtcctgtggaactcagcgatagagagaccctgctaaatagtgcaacaacgagcctcaattccaaggtggtgtctcagtacagctccttgctgagcccaatgagcgtaaatgcagtgatgaaggtgatcgaccccgccactgcgacttcagtagacctgcgggacatcaaaattgtaaagaaactcggcggcaccatagacgattgcgagttggtggaaggcctcgttctgacacagaaggtttccaactccggcattaccagggtcgagaaagcgaagatcgggctcatccagttttgcctgtccgcgcccaagaccgacatggacaatcaaatagttgtgagcgattatgcacaaatggatcgtgtacttagggaagagagagcatacatacttaatctggtgaagcagattaaaaaaacaggatgtaacgttctgcttatccaaaagtcaatactccgagacgcgctttctgacctggccctccacttcttgaataagatgaagatcatggtcatcaaggatattgagcgcgaggacatcgaattcatctgtaagaccatcggcacaaagccggtcgctcatatagaccagttcaccgcggatatgctggggagcgccgagctggccgaagaggtcaatcttaacggtagtggcaagctgctgaagataactggttgcgctagcccaggaaaaacggtgactatcgtggtgaggggcagcaataagctggtgattgaggaggcggagaggtccattcatgatgcactctgtgtgattcgatgtctggttaagaagagggccttaatcgcgggggggggcgcgcctgaaatcgagctcgcccttcgcctgactgagtactctagaacattgtccgggatggagagctactgcgtccgcgcctttgccgatgcaatggaagttattccttcgaccttggcagagaacgcggggctgaacccgatttctaccgtcactgaattacgcaatcgccatgcccaaggagaaaagactgcagggatcaacgttcgcaaggggggcattagtaatattctggaagagctggtggttcagccactgctggtgagcgtaagcgccctgacactcgccactgagacagtgaggagcatcctgaagattgatgatgtggtgaacactaggtag

SEQ ID NO: 182543 - DNA, 1452 bp, Artificial Sequence
  Description of Artificial Sequence: Synthetic coding sequence
atggacaagatgatccaggacggcaagggcgacgtgaccatcaccaatgatggcgcaacaattctgaaacagatgcaggttctccacccagcagcacgcatgctagtagaactgtccaaggctcaggatattgaggctggggacggcaccacctctgttgtgattatcgctggatctttgcttgacagctgcaccaaactgttgcaaaagggaattcaccctactatcatcagcgaaagctttcagaaggcattggaaaaagggattgagatcctcacggacatgagcaggcctgtcgaactgagtgatagagaaaccctcctgaactccgcgacgacatccctcaattctaaggtcgtgagccaatacagcagcctcctgtcccctatgtcggttaacgcagtgatgaaagtcatcgaccccgctaccgcgacatcggtagaccttagggatatcaagatcgttaagaaactgggggggacaatcgatgactgcgagctcgtggaggggcttgtcctgacccagaaagtgagcaattctggcatcacacgggtggagaaggcaaagataggattgattcagttctgcctatccgccccaaagacggacatggacaaccagattgtggtaagtgactatgcccagatggaccgggtactgcgggaagagagagcctatatcttgaacctggtcaagcagatcaagaaaaccgggtgtaacgtgctcctgatccagaagtctattcttagggatgccttgtcagatttagctctccatttcttgaataaaatgaaaattatggtgataaaggatattgagagagaagacatcgaatttatctgcaagacaattgggactaagcccgtagcccacatcgaccaatttactgccgatatgcttggctcggctgaacttgcagaagaggtcaacctgaatggctccgggaaactgcttaagataaccgggtgtgcatccccagggaagacggtgaccattgtggtgcgcggatctaataagctcgtaattgaagaggccgaacggagtatccacgacgcactctgtgtgatcagatgcctggtgaagaagagagctctcatcgccgggggcggagcacctgaaatcgaactggctctgcgtctcacagagtacagtcgtaccttgtccgggatggaatcctattgcgtccgggcttttgcggatgccatggaagtgatccccagcacattggcggagaacgcagggctgaatcctatttccacagtcaccgaactgagaaatcgccacgcccaaggcgagaaaaccgccggcataaacgtgagaaagggaggcatctcaaacatcctggaagaattggtggtgcagcccttacttgttagtgtgtcagccctcaccctcgcgacagagaccgtgcggtctattcttaagattgacgacgttgtgaacaccagatag

SEQ ID NO: 182544 - DNA, 1530 bp, Artificial Sequence
  Description of Artificial Sequence: Synthetic coding sequence
atgcccgagaacgtggccccccggagcggcgccaccgccggcgccgctggcgggaggggtaagggcgcctatcaggatagggacaaaccagcccagattcgatttagcaatatctccgccgcaaaggcagtcgcggatgccattcggacctctctcggcccgaagggcatggacaaaatgttagtcgagctgagcaaggcccaggatattgaagctggggacgggacaacttccgtagtaataatagccgggtctctcttggacagttgtacaaagttattgcagaagggtatccacccaacaattatctctgagagctttcaaaaagctctggagaaaggtatcgagatactgacggatatgtcgaggcctgtggagttgtccgatcgtgaaaccctcctcaattctgctaccacctcactgaatagcaaggtggtcagccaatactcgtctctgctcagtccaatgagcgttaacgccgtgatgaaggtgatcgaccccgccaccgccacaagcgtagatttgagggatatcaagattgtcaagaagctgggcggaacaatcgacgactgcgaactggttgaaggcttggtgctgacacagaaggttagtaattcaggaatcacccgagtggaaaaagctaagattgggctgatccagttctgcttaagcgcacccaaaaccgacatggacaaccagattgtggtgtctgattatgcacagatggatcgggtgctcagggaggagcgtgcgtacattctgaatctggtcaagcaaataaagaagaccgggtgtaatgtgctactcatccaaaaatccattctgcgggatgccctatctgacctggccctgcattttttgaacaagatgaaaattatggtgataaaggatatcgaaagagaggacatagagtttatatgtaaaaccatcgggactaagcctgttgctcacatagatcagtttactgccgatatgctcggctcagctgaactggccgaggaagtgaacttaaacgggagcggaaaattgctcaagataacagggtgcgcttcacctggaaagacggtgaccatcgtagtgaggggatctaataaactagtaatcgaagaggccgagcggagtatacacgacgcactgtgcgtgattcggtgcttggtgaagaaacgggcgttgattgccgggggaggcgcacccgaaatcgagctggctctgagactgaccgagtattctcgcactctttctggcatggaatcttattgcgtgcgggcttttgcagatgccatggaggtcatcccttcaacattggcagagaacgccggcttgaaccctatctccactgtgactgaattacgtaatcgccatgcacagggcgagaaaactgccggcataaatgttcgtaaaggtggaatcagtaatatactggaggagcttgtggtccagccgctgctggtgtcagtatccgcgctgacactcgctaccgaaaccgttcgttccatcctgaagatcgacgacgtcgtgaacacgagatag

SEQ ID NO: 182545 - DNA, 1170 bp, Artificial Sequence
  Description of Artificial Sequence: Synthetic coding sequence
atgagccggcccgtggagctgagcgaccgggagaccctgctgaacagtgctaccacaagtcttaatagcaaagtggtgagccagtattcaagcctgctctcccccatgtctgtcaatgccgtaatgaaagtgatagaccccgccacggcaacgtcggtggatcttcgggatatcaagatcgtaaagaagctaggaggaacaatcgatgactgcgagctggtcgagggtcttgtgttgacccaaaaagtgtctaactcaggtataacacgcgtggaaaaagcaaagataggactgatccagttctgtctttcagcacccaagactgatatggacaaccagatcgtggtctctgattatgcacagatggaccgggtgcttagagaggaaagagcatatatactgaatttggtgaaacagataaaaaagactggatgcaacgtcctgctcatccaaaagtccattttacgagacgcattatctgacttggccctgcattttctcaataagatgaaaataatggtgatcaaggatatcgagagggaggacattgagttcatctgtaagacaatagggacaaagcctgttgcccatatcgatcagtttaccgcagatatgttgggctctgcagagctggctgaagaagttaacttgaatggctcagggaagcttctgaagattaccgggtgcgcctccccagggaaaaccgtgacgatcgttgtgaggggatcaaacaaactggtgatcgaggaagccgagcggtcaattcatgatgctttgtgtgttattcgatgcttagtcaaaaaacgcgcacttatagccggaggcggggcgccagaaatagaacttgctttgcgactgacagaatacagccgaactcttagtggcatggagtcgtattgcgtgcgagcattcgcagatgcaatggaggtgatacctagcactctcgccgagaatgccggcctgaacccaatcagtacggtgaccgaactgcgcaaccgccacgcccagggcgagaagacagctgggatcaatgtcaggaaaggcggcatatctaacattttggaagagttggtggtccagcccctgctcgtgtcagtctcagcacttactctggcgactgaaaccgtcaggtcaatccttaagattgatgacgtagtgaacactcgttag

SEQ ID NO: 182546 - DNA, 1626 bp, Artificial Sequence
  Description of Artificial Sequence: Synthetic coding sequence
atggccagcatgggcaccctggccttcgacgagtacggccggccctttctcattattaaggatcaggacagaaagtccaggctaatgggactagaggcccttaagtctcacatcatggccgcgaaagctgtggctaacacaatgcgaactagcctcggaccaaatggtcttgacaaaatgatggtcgacaaggatggagacgtcactgtgactaatgatggggcgaccatattgagcatgatggacgttgatcaccagatcgctaaacttatggtcgaactgtccaaaagccaggacgacgaaatcggggacgggaccacaggagtagtggttttggctggcgctctgctggaagaggcagaacagttactcgaccgggggattcatccgatacgcatcgcggacgggtacgaacaggccgctagggtcgccattgagcacctcgacaaaatcagcgattctgttctggtggatattaaggacaccgagcctctcatccagaccgcaaaaactacactgggctccaaggttgtgaactcttgccaccgtcagatggcagagattgccgttaacgctgtgttaaccgtggctgacatggaaaggcgagacgttgattttgaactgatcaaggttgaagggaaggtgggcggtagactggaggacaccaagctcattaagggagtgatcgtggataaagatttcagtcatccccagatgccaaagaaagtagaggacgcaaagatcgccattctaacttgccccttcgaaccccctaagccgaagacaaaacataagttagatgtcacgtccgtcgaagactacaaagctttgcagaaatatgagaaggaaaagttcgaagaaatgatccagcaaataaaggaaactggcgctaatttggcaatttgccagtggggttttgatgacgaagcaaaccatctgctcctacaaaacaatctaccagccgtcagatgggtaggcggtccagagatcgaacttattgccatcgccacaggagggaggatcgtgcccagatttagcgagctgaccgccgaaaaattgggctttgccggcctggtgcaagaaatcagctttggaaccacaaaggacaaaatgctcgttattgagcagtgtaagaactcacgcgcagtcaccatctttattcgaggaggcaacaagatgattattgaagaggccaaacggtcgctccatgacgctttatgcgtgataagaaatctcatacgtgataatcgcgtggtttatggcggaggagcagcagaaattagctgcgccctggcggtcagccaggaggcggacaaatgtcccactttagagcagtatgcgatgcgtgctttcgctgatgccctcgaggtgatccctatggccctcagcgagaatagtgggatgaatcccattcagactatgaccgaggtgcgggcccgtcaggtgaaggagatgaacccagctctgggcattgattgtctccacaagggaaccaacgatatgaagcagcagcatgtcattgagactttaatcggtaagaagcaacagatctcccttgccacacagatggtccggatgatcttgaagatagatgacatccggaagccaggtgagagcgaagagtag

SEQ ID NO: 182547 - DNA, 1545 bp, Artificial Sequence
  Description of Artificial Sequence: Synthetic coding sequence
atggccagcatgggcaccctggccttcgacgagtacggccggccctttcttataattaaggaccaggaccgtaaatctcgcctgatggggctcgaggctttaaaaagccacattatggcggcaaaagctgtagctaacactatgagaacctccctgggaccaaatggcctggataagatgatggtagataaagacggcgacgtaaccgttaccaatgacgagatcggtgacggaacgactggtgtggtggtgttagcaggggccctacttgaagaggccgaacagttgctggatcgcggtatccacccaattcgaatcgcagatggctatgagcaggcagcaagagtggctatagaacacttagataagattagtgatagtgtcctcgtggatatcaaggatactgagccgctgatacagacagccaaaacaacgctcggctccaaagtagtcaattcatgccacagacagatggccgaaatcgccgtcaatgcagttttgacagtcgcagatatggaaagacgagacgtcgacttcgaactgattaaggtagagggtaaggtcggaggccgcctggaggatactaagttaataaagggggttatcgttgataaagatttctctcaccctcaaatgcctaaaaaggttgaggacgctaaaattgcgatattgacttgccccttcgaaccccccaaaccgaagaccaaacacaagctggatgttacaagcgtggaggactacaaagccctgcagaagtacgaaaaagagaaattcgaggagatgattcagcagattaaggagacaggggcaaacttagccatttgtcagtggggcttcgacgacgaggcaaaccatctgctcttacagaacaatcttccagccgtgcgttgggttggtggacccgagattgagctgatcgccatcgccaccggtggcaggattgtgcctagatttagcgagctcaccgccgagaaactggggttcgccgggctcgttcaggaaattagctttggtactacaaaagacaagatgctggttatagaacagtgcaagaattcccgcgccgtcaccatttttatccgggggggaaacaagatgattatcgaggaggcaaagagatcccttcatgatgccctctgcgtaatacgtaacttgatacgagataatagagtggtttatggggggggggccgcagaaatcagttgtgcgctcgctgtgagccaggaagctgacaaatgcccaacccttgaacagtatgccatgagagctttcgctgatgcactcgaggtaatcccaatggctctgtcagagaattccggcatgaatcccatacagacaatgacggaggttagagctcggcaagtgaaagagatgaatccggccctgggaatagattgcctgcataaaggcaccaacgatatgaaacagcagcacgtcatagagactctgattggcaagaagcagcagatctctctggctacacagatggtgcgcatgatacttaagatcgatgacatccggaagcctggagagtctgaggaatag

SEQ ID NO: 182548 - DNA, 1563 bp, Artificial Sequence
  Description of Artificial Sequence: Synthetic coding sequence
atgaacagcagcctgggccccaccatcgagaagctgagcgtgagccacatcatggcagccaaagccgtggcaaataccatgcgtacaagcctgggcccaaacggcctggacaagatgatggtggacaaagatggggacgtgacagtaaccaatgacggcgccacaattctgtcgatgatggatgtcgatcaccaaatcgcaaagcttatggtggagctttcaaagtcccaagatgatgagattggagacggtacaacaggggtggttgtactggccggcgccctgctagaggaggccgagcagctcttggacagaggtatccaccctatcaggatagctgacgggtacgaacaggccgcccgagtggcaatcgagcatttagacaagatctctgactctgtgttagtcgatatcaaggacaccgaacccctaattcagactgccaaaactacgctaggcagcaaggtcgtaaacagttgccacaggcaaatggccgagattgccgtgaatgctgtcctgacggtggctgacatggagagaagggacgttgactttgaactcatcaaagttgaaggcaaggtcggcggccgcctggaggacactaagcttattaaaggcgtaattgtcgataaagatttcagccacccacagatgccgaagaaggtggaggacgccaagatcgcaatcctaacgtgcccctttgagccaccaaaaccaaaaactaagcacaaactggacgtgacctcagtggaagactacaaagcattacagaaatacgagaaggagaaattcgaggagatgatacagcaaattaaagaaaccggcgctaatttagcaatctgtcagtggggttttgacgacgaagctaaccacctacttctccagaataatctgccagctgtcaggtgggttggcggccccgagatcgaacttattgccatcgccacaggaggccggatcgttcccagattcagtgagcttactgctgaaaaactgggatttgcgggtctggttcaagagatttcctttggtacgactaaggataaaatgcttgtcatcgaacagtgcaaaaactcccgggccgtaacgatctttattcgaggagggaacaagatgatcatcgaggaagcaaagcgatccctccatgatgccctctgcgtgatccggaacctcatcagggacaatagggtggtgtacggtggaggcgcagccgagatttcgtgcgccctagctgtgagtcaggaggctgacaagtgccccaccctcgagcagtatgcaatgcgcgcctttgccgatgcactcgaagtcatccccatggccctcagcgagaactccggcatgaatccaatccaaacaatgactgaagtgcgggccagacaagtgaaggagatgaatcctgccctcggaatcgactgcctccacaaaggtactaatgacatgaaacagcagcacgtcatcgaaactctgatcggaaaaaagcagcagattagtttggctacacagatggttaggatgattctaaaaatcgatgacattcgcaagcctggagaaagcgaggagtag

SEQ ID NO: 182549 - DNA, 1347 bp, Artificial Sequence
  Description of Artificial Sequence: Synthetic coding sequence
atggccgccaaggccgtggccaacaccatgcggaccagcctgggccccaatgtgcttgccggagccctccttgaagaggccgaacagcttctagaccgggggattcaccccattcgcatcgccgacggatacgagcaggcggcccgagtggctattgagcacctcgacaagatttccgacagcgtcctggttgatatcaaggacacggagcctctgatccagacggccaaaacgaccctaggaagtaaagtcgttaactcttgccaccgccaaatggcagagattgccgtgaatgctgtcctgactgttgctgacatggagcgtagggacgtcgattttgagctgattaaggtcgagggcaaggtgggcggccgcctggaggacactaaacttatcaaaggagtcattgtggacaaagatttctcacaccctcaaatgccaaaaaaggtggaggacgccaagatcgccattctcacgtgtccgttcgaacccccaaaaccgaaaacaaagcacaaactggatgtgaccagcgtggaagactataaggccctccagaagtatgagaaagagaagttcgaggagatgatacagcaaattaaagaaacaggcgcgaacctggccatttgtcaatggggcttcgacgatgaagccaatcacctgctcctgcagaataatctccctgcagtgcgctgggtgggaggcccagagatcgaactaatcgcgattgccactggcggccgaattgtcccaagattttccgagcttacagctgagaaactgggctttgccgggttggtccaggagatctccttcggtacgacgaaggataagatgctggtgatcgaacagtgtaagaacagcagggccgtgacgatctttatcagaggaggtaacaagatgatcatcgaagaagcgaaaagatcactgcacgacgctctgtgcgtgattcggaatttaattcgagacaatcgggttgtctacggcggcggggctgcggagattagctgtgccctggcagtttcacaagaggcggacaagtgtcctaccctggaacagtacgcgatgagggcttttgctgatgcgctggaggttattcccatggccctttcagaaaacagcgggatgaacccaatacagacaatgacagaggttcgagcaagacaggtgaaggagatgaatccggccctgggcatcgattgcttgcacaagggaacaaatgacatgaagcagcaacacgtgatcgaaaccttgatcgggaagaagcagcagatcagcttagcaactcagatggttcggatgatactgaaaatagacgacattcgaaagccaggggagtcggaggaatag

SEQ ID NO: 182550 - DNA, 1461 bp, Artificial Sequence
  Description of Artificial Sequence: Synthetic coding sequence
atggccagcatgggcaccctggccttcgacgagtacggccggcccttccttattataaaggatcaggaccgtaaaagtcgcctgatgggcctagaggctcttaagtcccacataatggcagctaaggcagtagctaacacgatgagaacgtcactcgggcctaacgttcttgccggggcactcctcgaggaggcagagcagctgctcgacagggggatacaccctatcaggatagccgacggctatgagcaggcagccagagtggccattgaacaccttgacaagatctccgactcagtgctggtggacataaaagacacagagccattgatccagacggcgaaaacaaccttgggaagcaaggtagttaactcttgtcaccggcagatggccgaaattgcagtgaacgccgtactgacagtggccgatatggagcgtagagatgtcgacttcgagctcattaaagtggaaggcaaggtgggcggcaggctcgaagacaccaaactgatcaagggggtgattgttgataaggatttttcccatccacagatgccaaagaaggtcgaagacgctaagatagcaattctgacctgtccttttgagcctccgaagccaaaaaccaagcataagcttgatgtgaccagtgtggaagattacaaggcactgcagaagtatgaaaaggaaaaattcgaggaaatgatccagcaaattaaggagactggagctaatctggcgatatgtcagtgggggttcgatgacgaggccaaccacttgctgttacagaataatctccctgccgtcaggtgggtgggcgggcctgagatcgaattgatcgccatcgccaccgggggcaggattgtgccaaggttctcagaattgactgccgagaagcttggtttcgcaggcctcgtgcaggagatcagtttcggcacaacgaaggataagatgctcgtaattgagcagtgcaaaaactcaagggctgtaacgatttttatccgcggaggaaataagatgatcatcgaggaggctaaaagatctctgcacgatgcactctgtgttatccgcaatctcattcgcgacaacagggtggtttacgggggcggcgcagccgagatttcctgcgcattagccgtatcacaggaggccgacaaatgcccaacgctggagcagtatgccatgcgggcatttgccgatgcactcgaggttattcccatggccctgagcgagaactctggcatgaatccaattcagacgatgaccgaggtccgggccaggcaagtgaaagaaatgaatcccgcacttggaattgattgcctgcacaagggcacgaacgacatgaagcaacagcatgttattgagacgctcatagggaaaaagcagcagatttcgttggccacccagatggttcgcatgatcctgaagatcgatgatattagaaagcccggagagtcggaggaatag

SEQ ID NO: 182551 - DNA, 1512 bp, Artificial Sequence
  Description of Artificial Sequence: Synthetic coding sequence
atggccgccaaggccgtggccaacaccatgcggaccagcctgggcccgaatggtttggataaaatgatggtagataaggacggcgatgtcaccgtgactaatgacggcgcgacgatactgagcatgatggacgttgatcaccagatagccaagcttatggtggaacttagtaaaagtcaggatgacgagattggagacggcaccactggcgttgtggtattggctggtgcactgttggaagaagccgaacagctcctagatcgggggatccatccgatcaggatcgcggacggatacgagcaggccgcgcgagtcgccattgaacaccttgataaaatatccgactccgtactcgtggatataaaggataccgaacccctgattcagaccgccaaaaccaccctaggcagcaaggtcgtcaattcctgccaccgtcagatggcagagatcgccgtgaacgccgtgctcacagtggctgatatggagaggcgggacgtcgattttgaactcattaaagtcgagggtaaggtgggtggcagactagaggacactaaactcataaaaggagtaatcgtagataaagattttagccacccccagatgcccaaaaaagtcgaggatgccaaaattgccatactcacttgtccattcgagccccctaagcccaagacaaagcataaactggacgtgactagcgtggaagattataaagcattgcagaaatacgagaaagaaaagttcgaagaaatgattcaacagatcaaggagacaggggctaatctggccatctgccagtggggtttcgacgatgaggccaaccatctgctcctccaaaacaacctgcccgccgttagatgggtcggaggcccagaaatcgaattaatcgcaatagctaccggaggaaggattgtgccccggtttagtgagctgacagccgagaaactaggattcgcaggcctcgtgcaagagatcagcttcgggaccacaaaggataagatgttggtgatagaacagtgcaaaaatagtcgcgcagtaacaattttcatacgcggaggaaacaaaatgatcattgaagaagccaaaaggtctcttcacgatgctctgtgcgtgattcgcaatctgatccgcgataacagggtcgtatacggcggaggtgctgcagaaatcagctgtgctttagctgtgtcacaggaggcagataaatgccctacactcgaacagtacgccatgagggcctttgctgatgccttggaggtaatccccatggccctctctgagaactctggcatgaatccaatccagacgatgaccgaggttcgtgccaggcaagttaaggagatgaatcctgcactggggatcgactgcttacacaaagggacaaatgacatgaagcagcagcacgtaatagaaaccttaataggaaaaaaacagcagatctcgctcgcgacgcagatggtccgaatgatattgaaaatagatgatatcagaaagccaggggagagcgaagaatag

SEQ ID NO: 182552 - DNA, 1593 bp, Artificial Sequence
  Description of Artificial Sequence: Synthetic coding sequence
atggccgccatcaaggccgtgaacagcaaggccgaggtggcccgggcacgggctgctctggcggtgaacatctgcgccgcgcggggactgcaggatgttctgagaaccaatctaggtccaaaaggaaccatgaagatgctggtcagcggcgctggagacatcaagctcacaaaagacggcaacgttctgctggatgagatgcagattcaacatccgacggcatcccttattgccaaagtggcaactgcccaagatgacgtcaccggcgacgggacgaccagtaatgtgctgattataggagaattactgaagcaggccgacctgtatatttcagaaggcctacaccctagaattatcgcagagggcttcgaggccgccaagataaaggcccttgaggtccttgaggaagttaaagtgacaaaggagatgaaaagaaagatccttctcgacgtagcaaggacctccctgcagaccaaagtgcatgctgagttggctgatgtcctgaccgaggtcgtggtggatagcgttctcgccgtgagacgccctgggtaccctattgacttattcatggttgaaattatggaaatgaaacacaagctcggtaccgataccaagctgatccaagggcttgtactggatcatggcgcccggcacccagacatgaagaaaagggtggaagacgcatttatactgatttgtaacgtctctctggaatacgagaagaccgaggtgaattcaggcttcttctacaagactgccgaagaaaaggaaaaacttgtgaaggccgaacggaagtttatcgaggacagagtccagaaaattatcgatctgaaggacaaggtatgcgcgcagagtaataagggtttcgttgtgatcaatcagaaaggcatcgacccctttagcctggactctcttgcaaaacacggcatcgtcgcactcagacgagccaagcgacgtaacatggagcggttatccctggcatgcggcgggatggccgtaaacagctttgaagatcttaccgtcgactgcctgggccacgctgggctggtctacgaatacaccctcggcgaggagaagttcaccttcatcgaagagtgcgtgaacccttgctccgtgactctgcttgtgaagggacccaacaagcacacgctcacgcaggtgaaagacgccatccgggacggtctgcgagcaataaaaaatgcaatcgaggacggctgcatggtacccggcgccggtgctattgaagtggcaatggccgaggcactggtcacatataagaattcaataaagggacgcgcacggctcggcgtgcaggccttcgctgacgccctgctgataattcccaaggttctggcccaaaacgcagggtatgacccacaggaaaccttggtgaaggtacaagcagagcacgtcgaatcaaagcagctagtgggagtggacctgaatacaggagagcctatggtggcggctgacgctggcgtgtgggacaactattgcgtgaaaaaacagttactccactcctgtacagtgatagcgaccaatattctgctggtggacgaaatcatgagggctggaatgtcctccctgaagtag

SEQ ID NO: 182553 - DNA, 1482 bp, Artificial Sequence
  Description of Artificial Sequence: Synthetic coding sequence
atggccgccatcaaggccgtgaacagcaaggccgaggtggcccgggcacgagccgctctggccgtgaacatttgcgcggctcggggtttgcaagacgtgttacgaacaaatctcggaccaaaaggcaccatgaagatgctcgtctccggcgcaggcgatatcaagctgaccaaggacggtaacgtgcttctcgatgaaatgcagattcagcatcccacggcctcactgattgcgaaggtggctacggcacaggacgacgttaccggcgatggcaccactagcaacgttcttataattggagagctccttaagcaggccgatctgtacatttccgagggactgcatcctagaatcatagccgagggcttcgaggcagccaaaatcaaggcattagaggttttggaggaagtgaaggtcaccaaagagatgaagcgcaaaatcctgctggatgtggcccgaacaagcctccagactaaagtgcacgccgagctggccgacgtcttgaccgaggtggtggtggattctgtactagcagtccgtaggcccggatacccaatagatctcttcatggtagagatcatggagatgaaacacaagctggggacagatactaaagaggtgaatagcggctttttctacaagaccgccgaggaaaaggagaagctggtcaaggcagagagaaaattcatcgaggatcgagtgcagaagattatcgatctgaaagacaaggtgtgtgcccagtcaaacaaaggctttgtggtaattaatcagaagggtatcgatccctttagtctcgactccctggcaaagcacggaatcgtcgccctgcggcgggcaaagcgccgcaacatggagcggctcagccttgcctgtggaggaatggccgttaactcatttgaagacctgacagtggactgcctggggcatgctggtcttgtgtatgagtataccctgggggaagagaaatttaccttcatcgaggaatgtgtgaacccctgtagcgtgactctgttagtcaaaggtccaaataagcacacactaactcaagtaaaggacgctattcgagacggactccgagccataaaaaatgccattgaggatggttgcatggtgcccggcgccggtgctattgaggtggctatggctgaggcccttgtgacctataagaactcaattaagggcagagcacgcctgggtgtgcaagcattcgctgatgctctccttatcattcccaaagtactggcgcagaacgccggatatgatccacaggaaacactcgtaaaagtccaggctgaacacgtcgagtccaagcaattggtaggcgtcgacctgaacaccggggagccgatggtggctgccgatgccggagtatgggataactattgtgtgaaaaaacaactactccactcttgtaccgtgatcgccacaaacatcctcctggtggatgagataatgcgggccggaatgagctctctgaagtag

SEQ ID NO: 182554 - DNA, 1458 bp, Artificial Sequence
  Description of Artificial Sequence: Synthetic coding sequence
atggccgccatcaaggccgtgaacagcaaggccgaggtggcccgggcaagggcggcactggccgtgaacatttgcgcggctcggggcctccaggatgttctgcgcacaaatctgggaccgaagggcactatgaaaatgctggtctctggtgcaggcgatattaaactaacaaaggacggaaatgtgctgctggacgagatgggcttacacccaagaatcatcgctgagggatttgaggctgctaaaatcaaagcgctggaggtcctagaagaggtgaaagtgacaaaagagatgaaacgcaaaattctactggacgtcgcccgcacatctcttcagaccaaggtacacgccgagttggccgatgtgctgaccgaggtggtggtggatagtgtcctggcagtgagacgccctggatatcccatcgaccttttcatggttgagattatggagatgaagcacaagctcggaactgacaccaaacttattcaaggactggttctggaccacggcgctcgccacccagatatgaaaaagcgcgttgaagatgcctttatactgatctgcaatgtgagcttggagtacgagaaaaccgaagtcaacagcggatttttctataagacggcagaagagaaggaaaaactcgtcaaggccgagagaaaatttatcgaagatagagtgcagaagatcatcgatctgaaggataaagtctgcgcccagtccaacaagggattcgtagtaataaaccagaagggcatcgatcctttcagcctagattcacttgcaaaacatggcattgtggcactgcggagggcaaagcgacgcaatatggagcgtctcagtctggcatgtggcgggatggccgtcaattcctttgaggacttaaccgtggattgcctgggccacgccggattagtgtatgaatatacacttggggaggaaaaattcacctttattgaggagtgtgtaaacccctgttccgtgacccttctggtgaaaggtccgaacaaacatacactgacacaggtgaaagatgccattcgcgatggcctaagggctataaaaaacgcgatcgaggatgggtgtatggtgcccggtgcaggtgccatcgaagtagccatggccgaggccctcgtgacgtacaagaactccatcaaaggccgcgctaggctcggcgtccaggcatttgccgatgctcttctcatcataccaaaggtactggcccagaatgccgggtacgacccccaagagacactagtcaaagtccaggctgagcatgttgaatctaagcaactcgtcggcgtcgatcttaacacaggtgaacccatggtggcagccgacgctggagtatgggataactactgcgtcaagaaacagctgctgcactcatgtaccgtgatagccacaaatatcctgcttgtagacgagatcatgcgagcaggaatgagctcgttgaagtag

SEQ ID NO: 182555 - DNA, 966 bp, Artificial Sequence
  Description of Artificial Sequence: Synthetic coding sequence
atgaagcccggcttcagcccccggggcggcggcttcggcggccggggaggctttggcgaccggggagggagagggggccggggggggtttggaggggggcgcggcagaggcggcggtttccgtgggcggggcagaggtggcggaggaggcgggggcggcggtggaggcggaggccgaggcggcggtgggttccacagcggcgggaatcgcggccgcggccgtggcgggaaaagggggaatcagagcggcaagaacgtaatggtggaaccccaccggcacgagggagtgtttatctgtcgcggaaaggaggatgccctggtgaccaagaatcttgtcccaggcgagagcgtgtatggagaaaaaagggtgtccatctcggagggcgacgacaaaatcgaatatagagcatggaacccctttcgcagtaaacttgccgcagcaatcctcggtggggttgatcagatccacatcaaacctggcgccaaggtgttgtatctgggtgcagcatctgggacaacagtgtcgcacgtgtctgatatcgtagggcccgacggactggtgtacgccgtggagttttctcaccgatcaggccgggacctgattaacctggccaaaaagcggacaaatatcattcccgtcatcgaggatgcccgccatcctcacaagtacagaatgctcatcgccatggtggacgtgatattcgccgatgtcgcccagccagatcagaccaggattgtagctctgaatgcgcacacatttctgagaaatggcgggcacttcgtgatcagtatcaaggccaactgcattgactcgactgcctccgccgaagcggtgtttgccagcgaggtcaagaaaatgcagcaagaaaatatgaaaccacaagaacaattaacccttgagccttacgaacgggaccacgctgttgtggtgggcgtgtataggcccccacccaaggtcaagaattag

SEQ ID NO: 182556 - DNA, 723 bp, Artificial Sequence
  Description of Artificial Sequence: Synthetic coding sequence
atggacgtgcacggcgaggccgccggcgaggccggccaggagggcggtgaaggactgcagggcggcgcggggcagtcggaggagggtccgagtgcggagaagtgcagagtctgcccctgcgtgtgccgggagaggcacccgcaggaggagcgccgatgtgagcttgcttcagacggggtgccgcgcagaagatccggcctgcaaggggcagactcctgtgattacgagggaggtgaccaagaatatggacccggcgatcagtccccgggacaggggcctgaacatcacggccccgcagaaggattactgagcgacggccaagtaagggcagccggagccgagccgggacgaccgtatatcggcgatgggggccttcatgagctcgggcatcaccctgaccatgccgccggcgccggggggcagcctcatcacgccgacaggcgcggcgagtggccaggtggtgccggccccgctcagcccgccgcgagggggcggctgtgcagaggacgcgagctctgtgcacagcctggaggccccgctgtgactgaagtggggcggttggaggagctggccgtccctaggcgatgtgccccgccactaccgcgggatgttctggaggggagctgccccctccctactgcatcctgcttgtgcgctgatccagccgggttacggccagcggccaccctgagattaagccctgcgcgcccagcctggccctag

SEQ ID NO: 182557 - DNA, 591 bp, Artificial Sequence
  Description of Artificial Sequence: Synthetic coding sequence
atggacgacaccctgttccagctgaagttcaccgccaagcagctggagaaactggccaagaaagctgagaaggatagtaaagccgaacaggctaaggtgaaaaaagcacttctccagaagaatgttgagtgcgctcgcgtctacgcagagaatgcaataagaaagaagaatgaaggagtgaattggcttcgcatggcctctcgggtagatgccgtggccagcaaggtgcagacagctgtcaccatgaagggagtgacgaaaaacatggctcaggtgaccaaggctctggataaagctctgagcactatggatttgcagaaggtgtcctcagttatggatcggttcgaacagcaggttcagaatctcgacgtgcacacatctgttatggaggactccatgagcagcgcaacaacactcacaacaccacaggaacaggtcgattcactgataatgcaaattgccgaggagaacgggctggaggtgctcgatcaactcagtcaattacctgaaggcgcatctgccgtgggagagtctagtgtgcggtctcaggaagaccagctctctcggaggctggcagccctaagaaactag

SEQ ID NO: 182558 - DNA, 600 bp, Artificial Sequence
  Description of Artificial Sequence: Synthetic coding sequence
atgagcaacatggagaagcacctgttcaacctgaagttcgccgccaaggagttgtctcgttctgcaaagaagtgcgacaaagaagagaaggctgagaaagcaaaaatcaaaaaagccatccagaaggggaacatggaggtggctcgcatccacgcagagaacgcgatcaggcaaaagaaccaagcggtgaactttcttcgtatgtctgcccgggtggacgccgtggcggccagagtccagactgctgtaacaatgggcaaagtgacaaaatccatggctggggtcgtaaaatcaatggatgctaccctgaagaccatgaacctagagaagatctctgccctgatggataagttcgaacaccagtttgaaactctcgacgtgcagactcagcagatggaggacaccatgtcatccactacaacactgactaccccacagaaccaggtcgatatgctgctccaggagatggccgatgaagccggcttagaccttaacatggaactcccgcagggccagacgggctccgtggggacctcagtggcaagcgctgaacaggatgagctgagtcaaaggctcgctcggctgcgggatcaggtttag

SEQ ID NO: 182559 - DNA, 669 bp, Artificial Sequence
  Description of Artificial Sequence: Synthetic coding sequence
atggacctgctgttcggccggcggaagacccccgaggagctgctgcgtcagaatcaaagggccttgaatagggccatgagagaactagaccgagagagacaaaaactggagacccaagaaaaaaagattattgctgacatcaaaaagatggccaagcagggccagatggatgccgttcgaatcatggcgaaagatttggtcagaaccaggagatacgtcagaaagttcgtgctgatgcgcgcgaatatacaggctgtgtctctgaagatccaaacgctgaaatcaaataattccatggctcaggccatgaagggggtgaccaaggccatggggacaatgaatcgacagctcaaattgcctcagatccagaaaattatgatggaattcgagagacaggctgagatcatggacatgaaggaggaaatgatgaatgatgcgattgacgatgctatgggtgacgaagaagatgaagaggagtcagatgccgtggtttctcaggtactggatgagcttggtctgtcgttgaccgacgagttgtctaacctgcctagcaccggaggctcactctccgtcgctgctgggggcaagaaggccgaagctgcagctagtgctctggctgatgctgacgccgatctggaagaacggctgaaaaatctgaggagggactag

SEQ ID NO: 182560 - DNA, 669 bp, Artificial Sequence
  Description of Artificial Sequence: Synthetic coding sequence
atggacctgctgttcggccggcggaagacccccgaggagctgctgagacaaaaccaacgcgcactgaatagggcaatgcgcgaactcgatagagaaagacagaaattggaaacccaggaaaagaagataattgcagatatcaagaaaatggctaagcagggacagatggatgccgtacgtattatggctaaggacctcgtgaggacaaggagatatgtgaggaagttcgtgctgatgcgcgccaacatccaggccgtgtccctgaagatccagacacttaagtcaaacaatagtatggcgcaggccatgaagggggtcaccaaagccatgggtaccatgaataggcaactcaagcttcctcagatccagaagatcatgatggagttcgagcgtcaggccgagataatggatatgaaggaggagatgatgaatgatgcaatcgacgatgctatgggtgacgaggaagacgaagaggagtcagacgctgtagtgtctcaggtattggatgaacttggactgtccctaaccgacgagctgtcaaatttgcccagtacaggggggagcctctcagtggctgcgggtgggaaaaaggcagaggctgctgcgagtgcattggccgatgctgatgccgacttggaagagcggcttaagaatctaaggagggactag

SEQ ID NO: 182561 - DNA, 642 bp, Artificial Sequence
  Description of Artificial Sequence: Synthetic coding sequence
atggccagcctgttcaagaagaagaccgtggacgacgtgatcaaggagcaaaaccgcgaactacgcggcacacagcgcgccatcattcgagatagggctgctctcgagaagcaggagaaacagctagaactcgagataaaaaaaatggccaagatcgggaataaagaagcatgtaaagtgcttgccaaacaacttgtccacttgagaaagcagaaaactagaaccttcgccgtttctagtaaggtgacctccatgagcacacagactaaagtgatgaattcccaaatgaagatggccggcgcaatgtccactaccgccaaaactatgcaggctgtaaacaagaaaatggacccgcaaaagaccctgcagactatgcagaattttcagaaggagaatatgaaaatggagatgacagaggaaatgataaacgacacattggacgacatctttgacggctccgatgacgaggaggaaagtcaggacatagttaaccaggtgctcgacgagataggcatcgagatctctggaaagatggccaaggcaccaagcgcagctaggagcctgccctcagcatcgacctccaaagctaccatcagcgacgaggagattgagagacaactgaaggctctgggtgtggattag

SEQ ID NO: 182562 - DNA, 519 bp, Artificial Sequence
  Description of Artificial Sequence: Synthetic coding sequence
atggagctggagatcaagaagatggccaagatcggcaacaaggaggcttgcaaagttctggctaaacagctcgtgcaccttaggaagcagaaaacaaggacttttgccgtctctagcaaagtcacgagcatgtctacacagactaaggtgatgaactctcaaatgaagatggccggcgcaatgtctaccaccgctaaaaccatgcaggccgtgaacaaaaagatggatcctcagaagacgcttcagaccatgcaaaactttcagaaagaaaatatgaagatggagatgaccgaggagatgatcaacgacaccctggacgacatttttgacggctccgacgacgaggaagagtctcaggatattgtgaatcaggtgctggacgagattggcatcgagatctctggtaaaatggctaaggcgcctagcgcagcccgcagcctgccttctgcaagcacatcaaaagctactatatcagacgaggagattgaaagacagctcaaggctttaggcgtggactag

SEQ ID NO: 182563 - DNA, 669 bp, Artificial Sequence
  Description of Artificial Sequence: Synthetic coding sequence
atgggcctgttcggcaagacccaggagaagccccccaaggagctggtgaacgaatggagcttaaaaattcgcaaagagatgcgcgtcgtcgatcggcagataagggatatccagagagaagaggaaaaggtaaagcgcagcgtgaaagatgccgcaaaaaaggggcaaaaggacgtttgtattgtgttggcaaaagagatgatccgcagtcgaaaggcagtctccaagctgtatgcttctaaagcccatatgaactccgttctgatggggatgaaaaaccaactggccgtgttaagagtggccggttctctgcagaaatcaaccgaagtcatgaaggcgatgcaaagcctggtgaagattccggaaattcaggcaaccatgcgggaactctctaaagagatgatgaaggccgggatcattgaggaaatgctggaggatacctttgagagcatggatgatcaggaggaaatggaagaagaggccgagatggagatcgaccgcatcctgtttgaaatcacagccggcgcactgggaaaggccccgtccaaggtaaccgacgctttgccagagccagagcctccaggggctatggctgcctctgaagatgaggaggaggaagaggaagccctggaggcaatgcagtccaggctggcgactctacgatcttag

SEQ ID NO: 182564 - DNA, 471 bp, Artificial Sequence
  Description of Artificial Sequence: Synthetic coding sequence
atgatccggagccggaaggccgtgagcaagctgtacgccagcaaggctcacatgaattctgtactgatgggcatgaagaaccagctggcggtgctgagggtggcaggctccctgcagaaaagtaccgaagtgatgaaggcaatgcagtcacttgtgaaaattccagaaatccaagccaccatgagggagctttccaaagagatgatgaaagcaggcatcattgaggagatgctggaggatacattcgaatctatggacgatcaggaagagatggaggaggaggccgaaatggagattgaccgtatcctcttcgaaattacagccggcgcattaggtaaggcaccatcgaaggtgacggacgccctgccagaacctgagcctcctggagccatggccgccagcgaggacgaggaagaggaggaagaggcccttgaagctatgcagtctcggttagccactctgaggagctag

SEQ ID NO: 182565 - DNA, 756 bp, Artificial Sequence
  Description of Artificial Sequence: Synthetic coding sequence
atggagggcgagctgtacagcgccctgaaggaggaggaggccagcgaaagcgtgagctccactaacttctccggggagatgcacttctacgagctggttgaggacaccaaagacggtatctggctcgtacaggtgaacgagtggagtctaaaaattcgaaaagagatgcgtgtagttgaccgacagattagggatatacagcgagaagaggaaaaagtcaaaaggagcgtgaaggatgcggccaaaaagggacagaaggacgtgtgtattgtccttgccaaggagatgattaggtccaggaaagccgtaagcaaattatatgcctcaaaagctcatatgaactcggtgctgatgggcatgaaaaaccaattagccgttctgcgggtggctggttctctacagaaatcaactgaagtaatgaaggcgatgcagtcgctcgtaaaaattcctgagattcaggctactatgcgggagctgtcaaaggagatgatgaaggctggaataatcgaggagatgttggaggatactttcgagtctatggatgaccaggaggagatggaggaggaggccgaaatggagatcgatcggatccttttcgaaatcacagctggggcactgggcaaagcgcctagcaaagttacggatgcattgcctgagcccgaacctccaggagctatggccgcttcggaagatgaggaggaagaggaagaagcactggaagccatgcagtctcggctggcgactctgcgcagttag

SEQ ID NO: 182566 - DNA, 549 bp, Artificial Sequence
  Description of Artificial Sequence: Synthetic coding sequence
atgggcctgttcggcaagacccaggagaagccccccaaggagctggttaacgaatggagtctgaagatccgaaaggagatgcgcgttgtggaccgacagattagagatattcaaagagaggaggaaaaagtcaagagatctgtgaaagatgccgcaaagaaaggccaaaaggatgtttgcatcgtgctggccaaagagatgatccggagcagaaaggcaatgcagtcactggtgaagattcccgagatccaggctactatgcgggagcttagcaaagagatgatgaaggcagggattatcgaagagatgctggaggacaccttcgagtctatggatgaccaggaggagatggaagaggaagccgagatggaaatcgataggatccttttcgagattacagctggtgctttagggaaggcgccctctaaagtcactgacgccctgcccgaaccagagcctccgggggccatggctgcgtcggaagacgaggaagaggaagaagaggctttggaagcgatgcaatcacggttggcaacccttcggtcttag

SEQ ID NO: 182567 - DNA, 798 bp, Artificial Sequence
  Description of Artificial Sequence: Synthetic coding sequence
atgagccggcggcggcccgaggacggcctgggcaaggccggcccctgtgtcatgcgtcaccatcccccaaggagcaaggcagaggtctggcgtaccctgagagggggaggtgggagaggtgagttagctatgagcggacttggtcggcttttcggaaagggaaagaaggaaaagggaccgacccccgaggaagccatccagaaactgaaggagaccgaaaagattctaataaagaagcaggaatttctcgagcagaagatccagcaagagcttcagacagcgaaaaaatatgggactaagaacaagcgggcagccctgcaagccttgagacgcaagaaacggtttgagcagcagctcgcacagacggatgggactctgagcactctcgaattccaacgagaagctattgagaatgcgaccactaacgctgaagtgctccgcactatggaacttgccgcccaatccatgaagaaagcctaccaggatatggacattgataaggtggatgagctgatgacagacatcaccgagcagcaagaggtagcccagcagattagcgatgcgatctcccgacccatgggattcggggatgacgtggacgaggatgaactccttgaggagctggaagagctcgaacaggaagaactggcccaggagctgctgaacgtcggcgacaaggaagaggagccctccgtgaagctgccatctgtgccatccacccatctcccagccggcccagcccccaaagtcgacgaagacgaagaggctctgaagcagcttgccgagtgggtgtcgtag

SEQ ID NO: 182568 - DNA, 378 bp, Artificial Sequence
  Description of Artificial Sequence: Synthetic coding sequence
atggccggccccagcctggcctgctgcctgctgggcctgctggccctcacttccgcttgctacatccaaaattgccctttaggtggcaaaagggccgcccctgacctggatgtcaggaaatgtttaccatgtgggccaggcggcaagggccggtgctttggtccaaatatctgctgcgccgaagagctgggatgcttcgtggggaccgcagaagcacttcggtgccaagaggagaactatctgccgtcaccttgccaaagcggacagaaagcctgtggaagcggtggtcgatgtgctgttctaggtctctgttgctccccagatggatgccatgccgaccctgcgtgcgatgcggaggccactttctctcagcggtag

SEQ ID NO: 182569 - DNA, 831 bp, Artificial Sequence
  Description of Artificial Sequence: Synthetic coding sequence
atggcccccccccccgcccccctgctggccccccggcccggcgagacaaggccagggtgtcggaagcctggtaccgttagttttgcagacgtagctgtatacttcagcccagaagaatggggctgcttgcggcccgctcagcgggccctgtaccgcgatgtgatgcaggagacttacggacatcttggtgctttggggtttcccggccctaaacccgcactgatttcatggatggagcaggagagcgaagcatggtctcccgctgcacaggaccccgagaaaggcgaaagacttggtggcgccagaaggggggacgttcccaataggaaggaggaggaaccggaggaagttcctagagctaagggtccccgcaaggcaccggtgaaagaatcacccgaagtccttgtggagagaaatcccgacccagccatttctgtggcccctgcccgcgcccagcctccaaagaatgctgcctgggatccgaccactggtgctcagccacccgccccaatcccttcgatggacgcacaagctgggcagcggaggcacgtctgtactgattgcggtcggagattcacctacccaagcctgcttgtgagccatcggcgaatgcattcaggagaacggccttttccatgcccggagtgcgggatgagattcaagagaaagtttgccgtggaagcacaccaatggatacaccgctcatgcagcggcggccgaagagggcggcggccagggatccgcgcggtgcctcgggccccagtccgaggagaccgggaccctccagtgctattccgacactatcccgacattttcgaagagtgtggatag

SEQ ID NO: 182570 - DNA, 516 bp, Artificial Sequence
  Description of Artificial Sequence: Synthetic coding sequence
atgaaccggctgttcggcaaggccaagcccaaggccccccccccctctttgacagactgtatcggaactgtggattctcgcgctgaaagcattgataagaaaatctctaggttagacgcagagcttgtcaaatacaaagaccagataaagaagatgagagagggcccagccaaaaatatggttaagcagaaggccctcagggtgctaaagcagaagcggatgtatgaacaacagcgcgataatcttgcgcaacaatccttcaacatggagcaggctaactacaccatccagagcctgaaagatacaaagactaccgtggacgccatgaaactcggtgtaaaagagatgaaaaaggcctataaacaagtgaagatagatcagattgaggatttgcaagatcagttggaagatatgatggaggacgctaacgaaatacaggaagcactctctagatcttacgggacccccgagcttgacgaagacgacctcgaagcaggatggtcctcgggaggctag

SEQ ID NO: 182571 - DNA, 606 bp, Artificial Sequence
  Description of Artificial Sequence: Synthetic coding sequence
atgggcaacctgttcggccggaagaagcagagccgggtgaccgagcaggataaggccattctgcaattaaagcaacaacgcgataagctgagacagtaccagaaaagaatagctcaacagctggagcgggaacgggcactggctagacaacttctccgggacggaagaaaggagcgggctaaactattgttaaagaaaaagcgctaccaagagcagctcctggaccgtaccgaaaatcagatttcgagtttagaagctatggttcagtccatagagttcacccagatcgagatgaaggtcatggagggactccaatttgggaatgaatgcctgaataagatgcatcaggttatgagcatcgaggaggtcgagcgtatcttagacgagacccaggaggccgtagagtaccagagacagatagacgagcttttggccgggtctttcactcaggaggatgaggacgctatcctcgaggagctgtcagctattacccaggaacaaattgaacttccggaggtccccagcgagccactcccagagaagattcctgagaacgtacctgtcaaggcccgcccacgccaggctgagctggtggcggcttcctag

SEQ ID NO: 182572 - DNA, 1362 bp, Artificial Sequence
  Description of Artificial Sequence: Synthetic coding sequence
atgtggagccccgagcgggaggccgaggcccccgccggcggcgacccggccggtttgttgccccccgagtgggaagaggacgaggagcgtatgtccttcctgttctcagctttcaaacggtcaagggaggtcaattctacggactgggactccaaaatggggttttgggcacctctcgtcttgtcgcactccagacgccaaggcgtggtgaggctgcgcctgagggacttacaggaagcattccagaggaagggttcagtgcctctgggacttgccaccgtgctgcaggaccttctccgacgcggggaactgcaaagagaatcagacttcatggccagcgtggactccagttggatttcctggggagtgggcgtgtttctgctgaagcccctgaaatggacactgagtaacatgctcggcgataacaaagtgccggccgaggaagtgctggtcgccgtggaactgctcaaggaaaaggctgaggaggtgtacaggctgtaccaaaacagcccgcttagctcccatccagtggttgctcttagtgaactgagtaccctgtgtgccaattcctgccctgacgagcggacgttctacctggtcttattgcaactgcagaaggaaaagcgggtgaccgtcttagaacaaaatggggagaagatcgttaaatttgccagagggcctagagccaaggtgagtccggtcaacgatgtggacgtgggcgtgtaccagctgatgcaaagtgagcaacttttgtcaaggaaagtggagtccctctctcaggaggccgaacgctgcaaagaggaagccagacgagcctgtcgggccggtaagaaacagctggccctgagaagtttgaaagccaagcagagaacagaaaagagaatcgaagctctccacgccaaattggataccgtacagggcattctggacaggatatacgcaagtcagactgatcagatggtctttaacgcatatcaagcaggtgttggcgctctgaaactgtctatgaaagatgtgacagttgaaaaagctgaaagtctggtagaccagattcaggagctgtgtgatactcaggacgaagtcagtcagaccctggccgggggagtgacaaatggcttagacttcgacagcgaggaactcgagaaggaactcgacatcctactccaggacaccacaaaggagccccttgatttaccggacaatccgcgtaaccgtcatttcactaactcggtgcccaacccccggatatctgacgccgagctggaggccgagctagaaaaattgtccttgagcgagggaggcttggtcccatccagcaaaagccccaagcggcagctcgaacctactctcaagcccttgtag

SEQ ID NO: 182573 - DNA, 1362 bp, Artificial Sequence
  Description of Artificial Sequence: Synthetic coding sequence
atgtggagccccgagcgggaggccgaggcccccgccggcggcgaccctgctggacttctaccgcccgaatgggaggaggacgaggagcggatgagctttttattttcagcgttcaagcgatccagagaagttaattctacagattgggattctaagatggggttctgggccccgctggtgctaagtcactccaggcggcagggcgtagtgagactgaggctaagagatctgcaggaagccttccagcgtaaaggaagcgtgcctctcggcctcgctacagtgctccaggatctactgaggcggggcgagttgcagagggagtcggacttcatggcctccgtggactcctcatggatctcttggggagtgggagtattcctcctgaagcctctgaagtggaccctgtctaatatgttgggcgacaataaggtgcccgcagaggaagtactggtcgctgtagagcttttgaaggaaaaggccgaagaagtctatcgcctgtatcaaaactcacctcttagctctcaccccgtcgtggccctctctgagttatctactctgtgtgccaatagctgcccagatgagcgcacattctacctggttctgctgcagctgcagaaggagaaacgcgtgactgtcctggaacagaacggcgagaaaattgtcaagttcgctagaggccctagagctaaggtgagcccagtgaacgatgtggatgtgggcgtgtaccagctgatgcagtccgagcaactactctctagaaaggtggagtctctgtcccaggaggcagaaagatgtaaagaggaggcaaggagagcgtgtcgcgctggtaagaagcaattagccttgcggtctttgaaagcaaagcagagaacagagaagcgcatcgaggcactacacgcaaaactggacactgtgcagggtatcctcgaccggatatacgcctcacaaacagatcagatggttttcaatgcataccaggcaggagtcggggccctaaaactgtcaatgaaggatgtgaccgtggagaaagccgagtccctggtagatcagattcaggagctgtgtgacacacaagacgaagtcagccagacattggccggtggcgttactaacggccttgactttgacagcgaggagctggagaaggagctcgacattttgctacaggatacgacaaaagaacctctggacttgccggacaatccgaggaacagacactttaccaactcggtccctaacccacgcatcagtgacgccgagcttgaggccgagctcgaaaaattgtcactttcagaaggcgggctggttccgtcgtccaagagtccaaagcgccagttggaacccactctcaagcccctgtag

SEQ ID NO: 182574 - DNA, 1992 bp, Artificial Sequence
  Description of Artificial Sequence: Synthetic coding sequence
atggagcggcccgaggagggcaagcagagcccccccccccagccctgggggaggctactgcgcctgggagcggaggagggcgaaccacacgtgctgttgcgaaaacgagaatggactattggtcgtcggagaggctgtgacctgagctttccatccaataaactcgtctccggcgatcattgtcgcatcgttgttgatgagaagagcggccaggtgactctggaagataccagcacatccggaaccgtcattaataaactgaaagtggtgaaaaaacagacatgcccacttcagaccggcgacgtgatctatttagtgtacaggaagaacgagccagagcacaatgtggcttatctgtacgaatccctttccgagaaacagggcatgactcaggagtcatttgaggcaaacaaggaaaatgtgttccatgggaccaaggatacgagcggcgctggggctggaaggggggccgacccccgcgtgcctccctcaagtcccgccacccaggtgtgcttcgaagaaccccagccctctacctcgacctccgacctgttcccgactgcgtccgcaagttccactgagccctcacccgccgggcgcgagcggtcctctagctgcgggtctggaggggggggaatatcccctaaaggctctggcccaagcgtggcctccgacgaagtgtccagctttgcatctgccttaccagaccggaagaccgcctctttctccagtttagagccccaggatcaggaggatctcgagccagtcaagaagaaaatgaggggagatggcgatctggatctgaacgggcagcttctggtagcgcaaccacgacgcaacgctcaaactgtgcacgaggacgtgcgagctgcggcgggcaagcctgacaagatggaagaaacattgacgtgcataatttgccaggacttgttgcatgactgtgtgtctctacaaccctgcatgcacaccttttgcgcagcctgctacagcggttggatggagcgctcatctctgtgccctacatgtaggtgcccagtcgagcgaatttgcaaaaaccatatcctgaacaaccttgttgaggcatacctgattcagcatcccggaaacagccggtccgaggaggacgtgcagtctatggatgcccgtaataaaatcacacaggatatgcttcagcctaaggtaagaaggtccttttctgacgaagagggaagcagtgaggacctcttggaactgtccgacgtggatagcgaaagctccgatatctctcagccatacgttgtctgcagacagtgtcccgaataccgtaggcaggccgcccagccaccccactgccccgcgccagagggcgaacctggcgcgcctcaggcactgggagatgctccctctacaagtgtgagtttgacaacggtacaggactatgtgtgccctctgcagggtagccacgcactgtgtacatgttgttttcagcctatgcctgaccggcgggccgaacgggagcaagacccccgagtggctccgcagcagtgcgcggtatgtcttcagccattctgtcatctctactggggctgtactaggactgggtgttatgggtgcctagccccattctgtgaattaaacctgggtgacaagtgcctggatggtgtgctgaacaacaacagctacgagtctgatattttgaagaattatcttgctaccaggggtctgacctggaaaaacatgctcacagagtctctcgtggcacttcagcggggagtcttccttctctcagattaccgagtaactggcgacactgttttatgttattgctgtggcctgcgcagtttcagggagctgacgtatcagtacagacaaaacattcctgccagtgaacttcccgtcgccgtgacaagtcggcctgattgctactgggggaggaattgccggacacaggtgaaggcccatcacgcaatgaagttcaaccacatctgcgagcaaaccaggtttaagaactag

SEQ ID NO: 182575 - DNA, 1872 bp, Artificial Sequence
  Description of Artificial Sequence: Synthetic coding sequence
atggagcggcccgaggagggcaagcagagcccccccccccagccctgggggcgcttgttgcggttaggggctgaagagggagaaccgcacgtcctcctcaggaagagggagtggaccattggccgtaggagaggctgcgatttatcctttccttccaataaactcgtgtctggcgaccattgcaggatcgttgtcgacgagaaatctggtcaggttacactggaagacaccagcacgtcaggtaccgttattaataaactgaaagtggtgaagaagcagacctgccctttgcagactggtgatgtcatctacctcgtgtatcgcaaaaacgagcccgagcacaatgtggcttatttatacgaatcactgtccgagaagcagggtatgacacaggaatcctttgaaatggtcccttgttgtgtcgcccaggcaggcctcaaactgctcggaagtagcgacccacctaccttagcatcacagagtatcgttatcactggctccgggggcggtggaatatccccaaaggggagtgggccctccgtcgcctctgatgaagtctccagcttcgcatcggctcttccggatcgcaaaaccgcatcattttcgagcctggagcctcaggatcaagaggacctagagccagtaaagaaaaaaatgagaggggacggagatcttgatctgaacggccagctgctggtggctcagcctcgacggaacgcacaaaccgttcacgaggacgtaagggctgctgctggcaaaccggacaagatggaggaaacccttacatgcataatttgccaagatctgctgcatgactgtgttagccttcagccctgcatgcacaccttttgcgccgcctgttatagcgggtggatggaacgtagtagtctgtgcccaacatgtcgctgccctgtggagcgtatttgcaagaatcacatcttaaacaaccttgttgaagcctatctcatacagcatccagacaaatcacgctctgaggaagatgttcagagtatggacgctcggaataagatcacacaggatatgctgcagcctaaggtgaggcgaagcttttccgatgaagagggctcttctgaagatctgctggagctgtccgacgtcgactccgaatcatctgatatttcacagccctatgtggtgtgccggcagtgtccagaatatagacgtcaggctgcccaacctccccattgcccagctcccgagggagaaccaggcgccccgcaggctttaggggacgccccaagtactagtgtctccttaaccactgctgttcaagattatgtttgtccactgcaaggaagtcacgccttatgtacttgttgtttccaacctatgccagacaggcgtgcagaaagggaacaggatcctcgcgttgcacctcagcagtgtgccgtgtgcctccagcccttctgtcatctgtactggggctgcaccagaaccggttgctacggctgcctcgcaccgttctgtgaattgaacctgggtgacaagtgcttagatggagtgctgaataataactcttacgagtctgatatcctcaagaactatcttgcaaccagaggtctgacatggaaaaacatgctaactgagtcactggttgccctgcagcgcggcgtctttcttctgagcgattatagggtcacgggcgataccgttttgtgctactgttgtggattaagaagtttccgcgaactgacttaccagtaccgccagaacattcctgcttctgagctccccgtggccgtgacaagtagacccgattgttattggggccggaattgccggacccaggtgaaagcacatcacgctatgaaattcaatcacatctgtgagcagacgcgcttcaaaaactag

SEQ ID NO: 182576 - DNA, 1995 bp, Artificial Sequence
  Description of Artificial Sequence: Synthetic coding sequence
atggagcggcccgaggagggcaagcagagcccccccccccagccctggggaagattgctccggctcggagcagaagaaggagagccgcacgtgcttctcagaaagagggagtggacgattggccggcgtcgcggctgcgacttaagttttccgtcaaataagctggtgtcaggcgaccactgccgcatcgtcgtcgacgagaaatccggccaggtgaccttagaagatacgagcacatcgggcacggtgattaacaaattaaaggtggtgaaaaagcagacctgccctctccagacaggagatgtgatctatctggtctatagaaagaacgagccagagcacaacgtagcctacctgtatgaatctctttcggagaagcagggcatgacgcaggagtcgtttgaggctaacaaggaaaacgtgttccacggcactaaggacacctctggagctggcgccggaaggggggcggatccccgagtgcccccttcgagcccagcaacacaagtgtgcttcgaggagccccagccaagtacatccacatctgatttgtttcccaccgcctccgcatcaagcacagaacccagtccggctggtagagaaaggagcagcagctgcggatctggcggcgggggtataagcccgaaaggaagcggccctagtgtggcctcagatgaagtctcatcctttgcctctgccctgccagatagaaagaccgcgtctttctccagtctggagccgcaggatcaggaggacctggagcctgttaaaaaaaagatgcgtggcgacggagatctagacctgaatggccaactcctggtggcccagcctcggcgaaacgctcagacggtccacgaggacgtgcgcgcggccgcgggaaaacctgataagatggaggagactttaacatgcatcatatgccaagacctcctgcacgattgtgtgtccctacaaccctgcatgcataccttttgcgctgcatgttactcaggctggatggagcgttcctcgctttgccccacctgccgctgcccagtggaaaggatctgcaagaaccacatcctaaataacttagtggaggcctatctgattcagcatcccgataaatcgcgctccgaggaggacgtccagagcatggatgccagaaacaaaatcacacaggacatgttgcagcctaaggtcagaaggagcttctctgacgaagagggatcaagtgaagacctgttggagttatccgacgtggattccgaaagctccgacatctctcagccatatgttgtgtgccgtcagtgtcctgaatacaggcgacaggcggctcagccgccccactgtcctgcaccagaaggggagcctggggctccccaggccttgggcgacgcaccctcgacctccgtgagcctgaccaccgcagtgcaggattatgtctgcccccttcaaggtagccacgccctatgtacgtgctgctttcagcccatgcctgacagacgagcagaaagggaacaggacccacgtgtcgcacctcaacagtgtgccgtgtgcctgcagcccttttgtcatctttactggggttgcacgcgtacgggctgctatggctgtctcgcacccttctgtgagctgaacctaggtgacaagtgcttggacggggtcctgaataacaattcttacgaaagtgacatcctgaaaaactacctcgccacccgtggactcacttggaaaaatatgctgactgagagcctggtggccctgcaacgtggggtgtttctactttctgattacagggtgaccggtgacactgtgctctgttattgttgcggcctccggagctttagggagctgacataccagtaccggcagaacattcctgcttctgagcttcccgtggccgtgactagccgtccagactgctactggggtagaaattgcagaactcaagtcaaggcccatcatgcaatgaaattcaaccacatttgcgagcaaacgagattcaaaaactag

SEQ ID NO: 182577 - DNA, 1959 bp, Artificial Sequence
  Description of Artificial Sequence: Synthetic coding sequence
atggagcggcccgaggagggcaagcagagcccccccccccagccctggggacgcctgttgcgcctgggtgctgaagagggagaaccacacgtattactgcgcaagcgagagtggactattggcagacgaaggggctgcgatctgagcttcccatcaaacaagctggtctctggggatcactgtcgcatcgtggttgacgaaaagtccggtcaggtcacgttggaggatacgtctacgtcagggaccgttatcaataagttgaaggtcgtgaagaaacagacatgccccctgcagaccggcgacgtgatttatctcgtttataggaagaatgagcccgaacacaatgtggcttacctgtacgaaagcttatctgaaaagcaaggaatgactcaggaaagtttcgacaccagcggggccggagccggcaggggtgctgaccctcgagtacctcccagcagtcccgcaacccaggtttgtttcgaggagccacagccatccacctcaaccagtgacctcttccctaccgccagcgcctcctctaccgagccttcccctgccgggcgcgagcggtcgtcgagctgtggctccggcggcggtggaatatcacccaagggttccggtccttcggtcgcaagcgacgaggtcagcagtttcgccagcgcgctgccagacagaaagacagccagtttctcctcactcgaacctcaggaccaagaggatctcgagccggttaaaaaaaagatgcggggagacggagatctcgacctgaacggacaactactcgtagcccaaccacgccggaatgcccagaccgtgcatgaggatgtacgcgctgcagcaggaaaacccgataagatggaggaaactttgacgtgtattatctgccaggatcttctgcacgactgtgtgtccctccagccctgcatgcatactttctgcgccgcctgttacagcgggtggatggaacggagctcactctgtccgacctgtaggtgcccggtggaacgaatatgtaaaaaccatatcctgaacaacttagtcgaagcttatctgatccagcaccccgacaagtcacgctctgaggaggacgtgcaatctatggacgcacgcaataaaattacccaagacatgttacagcctaaagtacggcgatctttttctgatgaggagggttcttccgaagaccttctcgagctcagtgatgtcgattccgagtcttccgacatttcccagccctatgtggtttgtaggcagtgtcccgagtatagacgtcaggctgcacaacccccccactgcccagccccagaaggagaacctggagccccacaggccctgggggacgctccatcaacctcagtttcgctcactaccgccgtccaggattatgtctgtccccttcagggctcccatgcgctgtgcacctgttgctttcaaccaatgccggacaggagggccgagagagagcaagacccacgggtcgctccacagcagtgtgccgtgtgtctccaacctttctgccatttgtactgggggtgtacgcggacgggatgttacggatgcctcgcccccttctgcgaactcaatcttggggacaaatgcctcgacggagtcctcaataataacagctacgagagtgacatcctgaaaaactacctggcaactagaggcctcacctggaagaatatgcttaccgagtccctagtggccctgcagaggggcgtcttcctactctctgactaccgggttaccggcgatactgtgctctgctactgctgtggactgaggagcttcagagagcttacataccagtaccggcagaacatccccgcctccgaactgccagtcgctgtgacttccagaccagactgctattgggggcgaaattgtaggacccaggtgaaggcccaccacgccatgaagtttaatcacatatgcgagcagactaggtttaagaactag

SEQ ID NO: 182578 - DNA, 672 bp, Artificial Sequence
  Description of Artificial Sequence: Synthetic coding sequence
atggagcggcccgaggagggcaagcagagcccccccccccagccctggggccgcctgcttcggctgggtgctgaggaaggagaaccgcatgtcctgctgcggaaacgtgagtggactatcggccgccggagaggttgcgacctgagttttcccagcaataagcttgtaagcggagatcattgcaggattgtggtggatgagaagtccggccaggtgaccctggaggacacctctacctccggtacagtgataaacaaactcaaagtcgtcaaaaagcaaacttgtccgctgcagaccggagatgtgatttacctggtttaccggaaaaatgaacccgagcataatgtagcctatctctacgagagcctgtcagagaagcaaggcatgacacaagaatccttcgatacaagtggagccggcgccggtcgtggcgctgatccccgggtgccaccgtccagtcccgcaacccaagtgtgcttcgaggagccacagcccagcacaagcacatctgatctgttccctaccgcaagcgcatcctccacagaacccagccccgcaggccgcgaacgcagctcctcatgcggatccgggggcggaggaatcagtccaaagggatcaggaccaagcgtggcttcagacgaggtgtcgtcctttgcctcagccttaccatag

SEQ ID NO: 182579 - DNA, 1050 bp, Artificial Sequence
  Description of Artificial Sequence: Synthetic coding sequence
atgacccaggagagcttcggcagcggcggcggcggcatcagccccaaagggtcagggccttcagtcgccagtgacgaggtctccagtttcgcgtctgctctgccagaccggaaaacggcttctttctcttccctcgagcctcaggaccaggaagaccttgagcccgtaaagaagaagatgagaggtgatggagacctggaccttaacggccagctgctggtggcacagccacgcaggaatgctcagacagtacatgaggatgtgcgagcagccgccggtaagcctgataagatggaggaaacactgacgtgtatcatctgccaggacttgcttcatgattgtgtgtcgctgcagccctgcatgcacaccttctgtgcagcatgttatagcggctggatggagagaagcagcttgtgtccaacctgtagatgtccagttgagcgcatatgcaagaaccacatcctgaataacctagtggaagcctatctgatacaacatcctgacaaatcccgcagcgaagaagacgtgcagagcatggatgctcgcaacaagattactcaggatatgctccagcccaaggtgcgtaggtccttcagcgacgaagaaggctcctctgaggacctgctggaattatctgacgtcgatagtgagtccagtgatatttcacaaccttatgtggtctgtcggcagtgtcccgagtacagaaggcaggccgcccagccaccccactgtcccgcaccagagggagaacccggagccccgcaggcgctgggagacgctcccagcacatccgtgagtttaacaacagctgtccaggattatgtgtgccccctccagggctctcacgcactttgcacatgctgcttccaaccaatgccggaccgacgggcagagcgggaacaggacccaagagtggctcctcagcagtgtgcagtgtgcctgcaaccgttctgccatctgtactggggttgtaccaggactggatgctatgggtgtcttgcccctttctgtgtgtccgggcgacagtgcttcccggcaacatccctgtag

SEQ ID NO: 182580 - DNA, 1719 bp, Artificial Sequence
  Description of Artificial Sequence: Synthetic coding sequence
atggagcggcccgaggagggcaagcagagcccccccccccagccctggggtcggctactgagactgggggccgaagagggggaaccacatgtactgctaaggaagagggaatggactattggacgacgccggggatgcgatctgagctttccatctaacaaactcgtgtcaggcgaccattgccggatcgtggttgatgagaagagtgggcaggtcacactggaagatacctcgacatctggaaccgttataaataagctcaaagtcgtcaaaaaacagacatgccccctgcagaccggtgatgtcatctatctggtttataggaagaacgagcctgagcacagatccggcgggggagggattagccccaagggtagcgggccttcggtggccagcgatgaagtctcatcatttgcttcggcgctacccgaccggaaaacagctagcttctccagccttgagcctcaggaccaagaagatctggagccagtcaagaagaagatgcgcggagacggagacctcgacctgaatggccaactgctggtggcccaaccgagaagaaacgctcagaccgtgcatgaagacgtaagagccgcagcagggaaacctgataaaatggaggaaacattgacatgcattatctgccaggacctacttcacgactgtgtctccctgcagccctgcatgcacactttctgtgctgcctgctacagtgggtggatggagcggagtagtctttgtcctacctgtcgatgcccagttgagcggatttgtaaaaaccacatcctgaacaatcttgttgaggcctacttgattcagcacccagacaagagccgttcagaggaggacgtgcagtccatggacgcccgcaacaagatcactcaggatatgctgcagcctaaggtgcggagaagtttttctgacgaagaaggatcatccgaagatcttttggaactttcggacgttgactcagagtcatcagatatcagccaaccatacgtggtgtgtaggcagtgtcccgagtacagacgacaggcagcccaacctccccactgtccagctcctgagggcgagcccggcgcccctcaggctctgggagacgctccaagtactagtgtgtccctaacgactgccgttcaggattatgtctgtcctcttcagggctctcatgcactttgcacctgttgtttccagccaatgccagatagacgcgctgagcgagagcaggaccctcgcgtggccccacagcagtgcgccgtgtgcttacagcccttctgccacctgtactggggatgtacccggacagggtgctacggttgcctggcccctttttgcgaactcaacctgggtgacaaatgtctggatggggtactgaataataatagctacgagagtgacatcctcaaaaactacctggctactcgaggcttgacctggaagaatatgctgactgagtcattggtagctctgcagcgcggagtgttcctgctgtccgattaccgcgtaacgggagatacggtgctttgttattgctgcggcctgcgtagctttagagaactgacttatcagtaccgtcagaacataccagcctccgagctgcccgttgcagtgacaagtcggccagactgttactgggggaggaattgccgcacacaggttaaggcacaccacgccatgaagtttaaccacatatgtgagcagacgcgctttaaaaactag

SEQ ID NO: 182581 - DNA, 345 bp, Artificial Sequence
  Description of Artificial Sequence: Synthetic coding sequence
atgcggctgctgatcctggccctgctgggcatctgcagcctgaccgcttatattgtcgaaggagtcgggagcgaggtttcagacaaaagaacttgcgtgagcctgacgacacagaggttaccggtgtcccggatcaaaacctataccatcacggaagggagtctgagagccgtgattttcatcactaagagaggcctcaaagtttgcgcagatccgcaggcaacttgggtccgcgacgtagtgcgctcaatggatcgtaagagcaacactcggaataacatgattcagaccaagcccacggggactcaacagtctactaacaccgctgtcacactcactggatag

SEQ ID NO: 182582 - DNA, 345 bp, Artificial Sequence
  Description of Artificial Sequence: Synthetic coding sequence
atgcggctgctgatcctggccctgctgggcatctgcagcctgaccgcctacattgtggagggtgtcggatccgaagtgtcccaccgacgtacgtgcgtgagcctgactacgcagagactgcctgtgagccgaatcaagacgtacaccatcacagagggatctctgcgagcagtgatattcatcactaaacgtggattgaaagtgtgtgcagatccgcaggccacgtgggtgcgggacgtggtgagatcaatggaccgcaaatccaatactaggaataatatgattcagacgaaaccaacgggcacccagcagagcacgaacacagccgtgacactcacaggttag

SEQ ID NO: 182583 - DNA, 1002 bp, Artificial Sequence
  Description of Artificial Sequence: Synthetic coding sequence
atggagagcagcggcaaccccgagagcaccaccttcttctactacgacttacagagtcagccttgcgagaaccaggcctgggtgttcgctacactggctacgaccgtgctatactgtctcgtttttctactgtcattagtcggtaattctctagtcctgtgggttcttgtaaaatacgagtccctggagtctctcactaatatctttattctgaacctttgtctttcggaccttgtgttcgcctgcttactgccagtctggataagcccctatcattggggatgggtactgggggatttcctgtgcaagctgcttaatatgatctttagcattagcctttactccagcattttcttcctgacgattatgacaattcaccgatacctgagtgtggtcagcccgctgtctactctgagagtaccaacactcagatgccgagttcttgtgactatggcagtatgggtggcctctattttgtcttcaatcctggatacaatctttcacaaggtcttgagctccgggtgcgattactctgaactcacctggtacctcacttcagtatatcagcacaatctcttctttctgctgagtttaggaattattctgttctgctacgttgaaatcctgagaacccttttccggtcccgcagcaagcgaaggcataggacggtcaaacttatttttgccattgttgtcgcctatttcctgtcctggggaccgtacaattttacactgtttctgcagactctcttccggacacaaatcattcgaagttgtgaggcgaaacagcagctggaatatgccctactcatctgtcggaacctcgcattttctcactgttgttttaatccagtgctgtatgtgtttgttggggtgaaatttcgtacccacctgaagcatgtattgagacaattctggttctgcagactgcaggctccgtcccccgcgagtattcctcattctcccggtgcctttgcatacgaaggagccagcttctactag

SEQ ID NO: 182584 - DNA, 111 bp, Artificial Sequence
  Description of Artificial Sequence: Synthetic coding sequence
atggagagcagcggcaaccccgagagcaccaccttcttctactacgacctgcaatcgcagccctgcgaaaaccaagcctgggttttcgccacactcgccacgacagtgtag

SEQ ID NO: 182585 - DNA, 1002 bp, Artificial Sequence
  Description of Artificial Sequence: Synthetic coding sequence
atggagagcagcggcaaccccgagagcaccaccttcttctactacgatttacagagtcagccttgcgagaaccaagcttgggtgttcgccaccctggctaccaccgtgctttattgtctcgtgtttttgctgtcactcgttggtaatagcttagtcctatgggttctcgtaaaatacgaaagcctagagtctctgacaaacatttttatcttaaacctgtgtctgtctgacctggttttcgcctgcctgctgcctgtgtggataagtccgtaccattggggatgggtactcggcgactttctctgcaagttgctcaacatgatttttagcattagcttatactcaagcatcttttttctgacaataatgaccatacaccgatacctgtctgtcgtgagtccactcagcaccctaagagtgcctactttgcgctgcagggtgctggtcactatggcagtgtgggtggcgagcattctcagctccattctagataccatcttccataaagtgctgtccagcggctgtgactacagcgagctaacatggtatttgactagtgtctaccagcacaacctgttctttctgctgtccttaggtatcatcctcttttgctatgtggagattcttagaactctctttcggagcagatcaaagaggcggcaccgaactgtaaaacttatctttgccatcgtggtcgcctacttcttatcatggggaccctacaacttcacgttgttcttgcagactctcttcagaacacagataattagaagttgtgaagcaaagcaacagttggagtacgcactgctaatctgccggaatctagcattcagtcattgttgctttaatccagtgctctatgtgtttgtgggggtcaaattcagaacgcaccttaaacacgtcttgagacagttttggttttgcaggctgcaagctccttccccagctagtataccccattcaccaggagctttcgcctatgaaggggctagtttttactag

SEQ ID NO: 182586 - DNA, 300 bp, Artificial Sequence
  Description of Artificial Sequence: Synthetic coding sequence
atgaaggtgagcgccgccctgctgtgcctgctgctgatggccgccacgttctcgccacaaggccttgcacagcccgattccgtgtcaatcccaattacttgttgtttcaacgttataaatcgcaagatacctattcaacgattagagtcttatactaggattactaacatccagtgcccaaaagaggctgttatcttcaaaactaaacgcgggaaagaagtttgcgccgaccccaaggaacggtgggttcgagacagcatgaagcacctggatcagatcttccaaaacctgaaaccttag

SEQ ID NO: 182587 - DNA, 291 bp, Artificial Sequence
  Description of Artificial Sequence: Synthetic coding sequence
atgcagatcatcaccaccgccctggtgtgcctgctgctggccggcatgtggcccgaagacgtagactctaaaagtatgcaggtcccctttagccgctgctgtttctcttttgccgaacaggaaatccctctgagggccatcctgtgctaccggaacactagtagcatatgtagcaacgagggactgatattcaagctgaagcgaggtaaggaggcgtgcgccctagataccgtaggctgggtgcagcgccatcgcaaaatgctcaggcactgcccttccaaacggaaatag

SEQ ID NO: 182588 - DNA, 282 bp, Artificial Sequence
  Description of Artificial Sequence: Synthetic coding sequence
atgaagatcagcgtggccgccatccccttcttcctgctgatcaccatcgctctcgggaccaaaaccgagtccagcagtcgcgggccctaccacccttcggagtgctgcttcacatatactacctataagatcccgagacagagaataatggattactacgaaactaactctcaatgctcgaagccgggtatcgttttcatcacgaagcgtgggcacagcgtgtgtactaacccatccgacaagtgggtacaggactacatcaaagacatgaaggaaaactag

SEQ ID NO: 182589 - DNA, 330 bp, Artificial Sequence
  Description of Artificial Sequence: Synthetic coding sequence
atgaagatcagcgtggccgccatccccttcttcctgctgatcaccatcgctttgggaacaaaaaccgaatcttcctcacagacaggcggtaagcccaaagtggtgaaaattcagctcaagctggtgggcggaccctatcatccctccgagtgctgtttcacatatacgacatacaagattcctcgacagcgcatcatggactactacgagacaaactctcagtgctcaaagcccggcatcgtatttataaccaagaggggccactcagtgtgcactaaccctagtgataagtgggttcaagactacatcaaggatatgaaagagaactag

SEQ ID NO: 182590 - DNA, 330 bp, Artificial Sequence
  Description of Artificial Sequence: Synthetic coding sequence
atgaagatcagcgtggccgccatccccttcttcctgctgatcaccattgctctgggtaccaaaaccgagtcgtcgagtcaaacagggggaaaaccaaaggtcgtcaaaatacaactgaagcttgttggaggcccatatcatccaagtgaatgttgtttcacctacacgacatacaagattccacgacaacgcataatggattactacgagaccaactcccagtgctctaagcctggcattgtgttcatcaccaagcgggggcactcggtctgcaccaatccttccgacaagtgggttcaggactatatcaaggatatgaaggaaaattag

SEQ ID NO: 182591 - DNA, 342 bp, Artificial Sequence
  Description of Artificial Sequence: Synthetic coding sequence
atgaaggtgagcgtggccgccctgagctgcctgatgctggtggccgtgctcgggtcccaggcccagtttatcaacgatgctgaaactgagctgatgatgtccaagctaccccttgagaatcctgtagtactgaactcatttcatttcgcggccgactgctgcacgtcctatatctctcagagcattccctgctccctgatgaagtcatacttcgaaactagtagcgagtgttccaagccaggagtcatcttcctgactaaaaagggaagacaagtctgcgctaaacctagtggacctggggtgcaggattgtatgaagaaactgaaaccctacagtatctag

SEQ ID NO: 182592 - DNA, 186 bp, Artificial Sequence
  Description of Artificial Sequence: Synthetic coding sequence
tgatgcaccagctacatcagccagagcatcccctgcagcctgatgaagtcctattttgaaacttcaagcgaatgcagtaagcctggagtcatcttcctcacaaagaagggccgtcaagtctgcgcgaagccttccggtcctggcgtgcaggattgtatgaaaaagttgaaaccctacagcatttag

SEQ ID NO: 182593 - DNA, 342 bp, Artificial Sequence
  Description of Artificial Sequence: Synthetic coding sequence
atgaaggtgagcgtggccgccctgagctgcctgatgctggtggccgtgcttggaagccaggcacagtttattaatgacgctgaaaccgaactgatgatgtcaaagctgcctctggagaacccagtggtgcttaactcattccactttgcggctgactgctgtacatcatatatcagtcagagtattccttgcagcctgatgaagtcttacttcgagacttccagcgaatgttccaaaccaggagtaattttcttaaccaaaaagggtcgacaggtttgtgccaaaccaagcggacccggcgtccaggattgcatgaagaagctaaagccatatagcatttag

SEQ ID NO: 182594 - DNA, 342 bp, Artificial Sequence
  Description of Artificial Sequence: Synthetic coding sequence
atgaaggtgagcgtggccgccctgagctgcctgatgctggtggccgtgctgggctcccaggcccagtttatcaacgacgctgagacagagctcatgatgagcaaacttcctctcgaaaatcccgtggttctgaattcatttcattttgcagccgactgctgcacgtcttatatcagtcagtcaatcccgtgctcacttatgaagtcttattttgagactagctcagaatgctcaaagcccggagtgatttttctaactaaaaaaggaagacaagtgtgcgcgaagccaagtggccctggcgttcaagattgtatgaagaagttaaagccctattcaatctag

SEQ ID NO: 182595 - DNA, 363 bp, Artificial Sequence
  Description of Artificial Sequence: Synthetic coding sequence
atgaaggtgagcgaggccgccctgagcctgctggtgctgatcctgataatcaccagtgcttccagaagccagcccaaagtgccagagtgggttaatacaccttctacttgctgccttaagtactatgaaaaagtgctgccacgcagacttgtcgtgggatataggaaggccctgaactgccatctccctgccatcatctttgtcactaaacggaacagagaggtctgcacgaatcctaacgatgactgggtccaggagtatatcaaagaccccaatctgcctttgctaccaaccagaaatctctctaccgtgaagatcattactgcaaaaaacggtcagcctcaacttctgaattcccagtag

SEQ ID NO: 182596 - DNA, 1188 bp, Artificial Sequence
  Description of Artificial Sequence: Synthetic coding sequence
atggcctggcggcacctgaagaagcgggcccaggacgccgtgatcatccttgggggtggtggactgctattcgcatcatacctgatggcaactggcgatgagcgcttctacgctgagcacttgatgccgacgctacagggtctcttggatcctgaatccgcacaccggctcgcagtacgttttacgagtcttggactactgccccgggccaggttccaagactcggatatgctggaggtgagagtgctaggccacaagtttaggaatccagtgggtatcgctgctgggttcgacaaacatggagaggcagtggacggactgtataagatgggctttggatttgtggaaatcgggtctgtgacgccgaagccacaagaaggcaacccgcgacctagagtgtttcggcttcctgaggaccaggctgtcataaatagatatgggtttaatagccacggactgagtgtggtggaacatagacttcgagcccggcagcagaaacaggctaaattgacagaggatggactgcctctgggagtcaacttgggtaaaaacaagaccagcgtggatgcagccgaggattacgcagaaggggtgcgtgtcctgggccctcttgctgactatctggtggtcaatgtatctagtcctaacactgccggtctgcggtcactgcaggggaaggcggagcttcgccgtctcctgactaaagtacttcaggaaagggatggccttaggcgcgtgcataggcctgccgttctggtgaagattgcaccagacctgacaagtcaggacaaagaggacatcgcttccgtggtgaaggagctgggcatcgacggactaatcgtgacgaacactactgtctcacgccctgcgggtttgcagggggctctgagaagcgaaactggcggattaagcggaaagccattgagagatctttcaacccagacaatccgggagatgtatgctctaacccaggggagagtcccaattatcggcgtgggcggtgtatcatcagggcaagatgctctggagaagatccgcgccggcgctagcctcgtgcagctgtataccgcactaacattttggggtccccctgtggtcggcaaggtcaagagagaacttgaggccttactgaaggaacagggctttggaggtgtgacagacgccatcggcgcggatcaccgcaggtag

SEQ ID NO: 182597 - DNA, 270 bp, Artificial Sequence
  Description of Artificial Sequence: Synthetic coding sequence
atgaagggcctggccgccgccctgctggtgctggtgtgcaccatggccttatgttcctgcgcccaggttgggacgaataaagagctgtgttgcctggtttacacttcctggcagatacctcagaaattcattgtggattactccgaaacctctccacaatgccccaaacctggggttatactcctcactaagcggggacgacagatctgcgcagacccaaacaagaaatgggttcagaagtacatcagcgatctcaagttaaacgcctag

SEQ ID NO: 182598 - DNA, 297 bp, Artificial Sequence
  Description of Artificial Sequence: Synthetic coding sequence
atggccctgctgctggccctgagcctgctggtgctgtggaccagcccggcccctacactgtctgggaccaatgacgcagaggattgttgtctgagcgtgacccagaagcccatcccaggatacatcgtaagaaattttcactatctactgataaaggacgggtgtagggtacccgccgtcgtcttcactacgctgcgagggagacagctgtgtgcacctccggatcagccatgggtggagcggatcattcaacgcttacagagaacatccgcaaaaatgaaaaggcgctccagctag

SEQ ID NO: 182599 - DNA, 315 bp, Artificial Sequence
  Description of Artificial Sequence: Synthetic coding sequence
atggccctgctgctggccctgagcctgctggtgctgtggaccagcccagctcctacacttagcggaactaacgatgcagaggactgttgcctctctgtcacacaaaagcccatcccaggatacattgttcggaatttccactatctgctgatcaaagacggctgccgggtgccagcggtcgttttcacaactctccgaggccggcagttatgcgcccctcctgatcagccgtgggtcgagcggattatccagaggctgcaacgaacctctgcaaaagcctcccttgccctgcctggtcccgtatcttccctgtag

SEQ ID NO: 182600 - DNA, 291 bp, Artificial Sequence
  Description of Artificial Sequence: Synthetic coding sequence
atgtgctgcaccaagagcctgctgctggccgccctgatgagcgtgctccttctgcacctgtgtggcgagtctgaggccgccagcaacttcgactgttgccttggctataccgacagaatcctgcaccccaagttcatagtgggattcacgcggcagctcgctaacgaagggtgcgacatcaatgcaatcatatttcacacaaaaaaaaagttaagtgtttgtgcaaacccaaagcagacgtgggtgaagtatattgtgcgactactctcaaagaaggtgaagaacatgtag

SEQ ID NO: 182601 - DNA, 288 bp, Artificial Sequence
  Description of Artificial Sequence: Synthetic coding sequence
atgtgctgcaccaagagcctgctgctggccgccctgatgagcgtgctgctgctgcacctgtgtggagaatcagaggcatccaattttgattgctgcctaggatacacagacagaatcctgcacccaaaatttattgtgggttttacacgacagctggcaaacgaaggctgtgacatcaatgccatcatattccatactaaaaagaaactgagtgtctgcgctaacccaaagcagacctgggtcaaatatatcgtgaggctgctgtctaaaaaagttaaaaatatgtag

SEQ ID NO: 182602 - DNA, 405 bp, Artificial Sequence
  Description of Artificial Sequence: Synthetic coding sequence
atggcccagagcctggccctgagcctgctgatcctggtgctggcctttgggatcccacgcacccaggggagtgacgggggagcacaggattgctgcctcaagtattcccagcggaagatccccgcaaaagtagtgcgttcttataggaaacaggagccctctttgggttgttccatccccgccatcctgttcctaccaagaaagagatcccaagcagagctgtgtgcagatcctaaagaactgtgggttcagcagttgatgcagcatctggacaagacccccagtcctcaaaaaccagcccaggggtgccggaaggatcgcggagccagcaagactggcaagaaaggaaagggaagtaaggggtgcaaacgtaccgagcgaagtcagactcctaaaggaccttag

SEQ ID NO: 182603 - DNA, 375 bp, Artificial Sequence
  Description of Artificial Sequence: Synthetic coding sequence
atggcccagagcctggccctgagcctgctgatcctggtgctggccttcggcattccaagaactcagggcagcgatggcggagctcaggattgctgtctgaagtattcacagagaaaaattccagcaaaggtggtcagatcctatcgcaaacaggagccgtcactcggctgtagtattcccgccattttattcctgcccaggaagagatcccaagcagagctgtgtgccgaccccaaggaactatgggttcagcagctgatgcagcacctggataaaacaccctccccacagaagccggcacaaggttgtaggaaggatagaggagcttcaaaaacaggcaaaaaaggaaaaggatccaagggttgtaaaagatag

SEQ ID NO: 182604 - DNA, 549 bp, Artificial Sequence
  Description of Artificial Sequence: Synthetic coding sequence
atggccgagttccccagcaaggtgagcacccggaccagcagccccgctcaaggagccgaggccagcgtcagcgccctcaggcccgacctcggattcgtgcggtcaagactcggcgctctgatgctgctccagctggtcctgggcctcctggtgtgggcgctgatcgccgacacaccgtaccacctgtaccctgcctacggatgggttatgttcgtggccgtcttcctgtggctggtgaccattgtactttttaacctctacttgttccagctgcacatgaaactgtacatggtgccctggcccttggtgcttatgatttttaacatatctgccaccgttctgtacattacagcctttattgcatgcagcgcggcggtcgaccttaccagtcttcgcgggacgcgaccttataaccagcgtgctgctgcctccttctttgcatgtctggtgatgatcgcgtatggggtgtctgctttcttcagctatcaagcgtggagaggagtaggaagcaatgctgctaccagtcaaatggccggcggatatgcctag

SEQ ID NO: 182605 - DNA, 414 bp, Artificial Sequence
  Description of Artificial Sequence: Synthetic coding sequence
atgaaggtgagcgtggccgccctgagctgcctgatgctggtgaccgctctaggcagccaggctcgggtgactaaagacgccgaaaccgagttcatgatgagcaagctccctctggagaatcccgtgctgttggatatgctttggaggcgcaagatcggaccacagatgacgctgtcgcacgccgcaggttttcatgcaaccagtgctgattgttgtatcagttatacaccacgatctattccgtgcagcctactcgaatcctatttcgaaaccaactctgagtgcagtaagcccggcgttatcttcttgacaaagaagggtcggcgcttctgcgctaacccaagcgataaacaagtccaggtgtgtgtccgtatgctgaaactggacactaggataaaaacccgaaagaactag

SEQ ID NO: 182606 - DNA, 363 bp, Artificial Sequence
  Description of Artificial Sequence: Synthetic coding sequence
atgaaggtgagcgtggccgccctgagctgcctgatgctggtgaccgcactgggcagccaagctcgggtcaccaaggacgcagagacagaattcatgatgtcgaaactgcccctcgaaaatccggtgctgttagacagattccatgccacatccgctgattgctgcatcagttatacaccacggtccattccttgttctcttctggagtcttacttcgaaacgaattccgagtgcagtaagccgggcgtgattttcctgacgaagaaggggagacggttttgcgctaatcctagcgataaacaggttcaggtatgcgttcgtatgctgaaattggacacccgtatcaagacaaggaaaaactag

SEQ ID NO: 182607 - DNA, 2862 bp, Artificial Sequence
  Description of Artificial Sequence: Synthetic coding sequence
atggaggagcagggccacagcgagatggagatcatccccagcgagtcgcatccccacatacaactccttaagagtaacagggagttgctggtcacacatataagaaacacacagtgtttggtggacaatctgcttaagaacgattacttctcagccgaagatgcagaaattgtgtgtgcatgccctacccagccagacaaagtcaggaaaatcctggatctcgttcagtccaaaggcgaggaagtttctgaattctttctttacttgttgcaacagctggccgatgcctatgtggatctccgcccgtggctgctagagattgggtttagtcctagtttactgacgcagtccaaagtggtggttaacacagaccctgtctcccgctacactcagcagctgcgtcaccatctcgggcgagacagtaagtttgtgctctgctacgctcaaaaggaggagctactcttggaagagatttatatggataccatcatggagcttgtcgggttttctaacgaaagcctggggtctctgaacagtctcgcctgtctgctggatcataccaccggcattctgaacgagcagggcgagacaatctttatcttgggggatgccggcgttggcaagtccatgctgctgcagagacttcagtcactttgggccacgggtagacttgatgctggagtgaagttcttcttccatttcaggtgccgaatgttttcttgcttcaaggagtccgatcggctgtgtctccaggacctgctgtttaaacactactgttatcccgagcgggatcccgaagaagtatttgcgttcctgctgcgattcccacacgtagccttgtttacctttgatgggctggacgagcttcactcagatctcgatctgtcccgagtgcccgacagcagctgtccttgggagcccgcccacccgttggtcttgctggctaatctcctgagcggcaagcttctgaagggcgccagtaaactgctaacagcccgaacggggatcgaggtcccgcgccagtttctgaggaaaaaggtgctcctgaggggcttctccccttcccacttgcgagcatatgctcgacgcatgttcccagaacgagcacttcaagaccgcttgttatcccagctggaggccaacccaaatctgtgttccttgtgtagcgtgccactcttttgctggataatttttcgttgttttcaacattttcgcgccgctttcgaaggttccccccaactgcccgactgcacaatgactctcacggatgtctttcttcttgtgacagaggtccacctgaaccgtatgcagccctctagcctggtgcagaggaacacacgatcaccagttgaaaccttgcacgccggaagggacaccctctgcagcctggggcaggtggcccatagaggcatggagaaatctctgttcgtcttcacccaggaagaagttcaggccagcggcttgcaggagagagacatgcagcttggatttctgcgtgctctgccagagctgggcccaggaggggaccagcagtcttatgaatttttccatctgacgttgcaggcttttttcactgcgttcttcttagttctcgacgatagggtgggcacacaggagttactccgctttttccaagagtggatgcccccagctggggccgcaacaactagttgctatccaccgttcctcccgtttcaatgtttgcaaggttcagggccggctagggaggacctcttcaagaataaggaccatttccaattcacaaatttgtttctttgcggcttacttagcaaggccaaacaaaagctgctgcgccacctggtccccgccgccgctctgcgccgcaagcgcaaagccctgtgggctcaccttttttcctctctgcggggttatcttaagagcctgcctcgggtgcaagtcgagtcattcaatcaggttcaggcaatgcccacctttatatggatgctgcgatgtatctacgagacgcagtctcaaaaggtaggtcaattggctgcacgtggaatttgcgcgaattatcttaaacttacctactgtaatgcatgttccgctgattgttcagcattgtcctttgtgttgcatcatttcccaaaacgcctagcgctggaccttgataacaacaatctgaatgattacggggttcgggaactccagccttgcttttcacgactgaccgtgcttcgtctctctgtcaaccagataaccgacggaggggtgaaggtgttgagcgaggagctcaccaagtacaagatagtgacctacctgggcctatacaacaatcaaatcactgacgtgggcgctcgatatgtgacaaaaatcttagatgaatgcaaagggctcacacatctgaagctgggaaagaacaagattaccagtgaaggaggcaaatacctggctctcgcagtgaagaatagtaagagtatcagcgaggtcggcatgtggggaaatcaggttggagacgagggggccaaggcattcgctgaggccttgaggaaccatccatcattaaccacactgagcctggcaagtaacggcatctccaccgaggggggcaaatctctcgccagagcactccagcagaacacctccctggaaatcctgtggttaacccaaaacgaactgaatgacgaggtggccgagagcttggccgagatgctcaaggtgaaccagaccctgaagcacctgtggttaatccagaaccagattacagcaaagggcaccgcccagctggccgatgcattgcagtccaacacaggcatcaccgaaatatgcttgaacggaaacctgattaagcctgaagaagcgaaggtgtatgaagatgagaaacggattatttgtttctag

SEQ ID NO: 182608 - DNA, 360 bp, Artificial Sequence
  Description of Artificial Sequence: Synthetic coding sequence
atggccggcctgatgaccatcgtgaccagcctgctgttcctgggcgtctgtgctcatcatattattcccactggctccgtagtgataccgagcccttgttgtatgttttttgtctccaagcgtatcccggaaaatcgagtggtctcttatcagctgagcagtaggagcacatgcttgaaagctggtgtgattttcaccactaagaaggggcagcagttctgtggcgatccaaagcaggaatgggtacagcgttacatgaagaacctggatgcaaaacagaagaaggccagccctagggcgcgcgcagtcgccgtcaaagggcccgtgcaaaggtaccccggcaatcagacgacatgttag

SEQ ID NO: 182609 - DNA, 450 bp, Artificial Sequence
  Description of Artificial Sequence: Synthetic coding sequence
atgaacctgtggctgctggcctgcctggtggccggcttcctgggcgcatgggcgcctgcagtccacacgcagggggtgtttgaggattgttgcttagcgtaccattatcccataggttgggcggtcctgcggcgtgcctggacatacagaatacaggaggtctctgggagctgtaacctgccagcggcgatcttttacctacctaagaggcatcggaaagtatgtggtaacccaaagagcagagaagtgcaaagggctatgaaacttctcgatgcccggaataaagtgtttgcaaagttacatcacaacactcagacgttccaaggcccgcacgccgtgaaaaaattgtcttcaggaaacagtaaactttcttcatccaaattttccaaccccatatcctcaagtaagcgtaatgtttctctgcttatctcagccaacagcggtctgtag

SEQ ID NO: 182610 - DNA, 255 bp, Artificial Sequence
  Description of Artificial Sequence: Synthetic coding sequence
atgaacctgtggctgctggcctgcctggtggccggcttcctgggcgcctgggccccagccgtccatactcagggtgtttttgaagattgttgtttagcataccattaccctatcggatgggctgtgctgcgtagagcgtggacataccggatccaggaggtgtccggatcatgtaatctgcctgccgccatccgtccatcatgttgtaaggaggtggagttctggaagttgcaggttatcatcgtccaggtatag

SEQ ID NO: 182611 - DNA, 453 bp, Artificial Sequence
  Description of Artificial Sequence: Synthetic coding sequence
atgaacctgtggctgctggcctgcctggtggccggcttcctgggcgcctgggcacccgctgttcatacacagggagttttcgaggactgctgtctcgcctatcactatcctatcggatgggcagttctacgcagggcttggacatacaggatccaagaggtgtcagggtcttgcaatttgcctgccgctatcttctatctccctaaaaggcatcggaaggtgtgcggtaacccgaagtcccgcgaagtgcagagagccatgaagctactggacgcgcgcaacaaggtgtttgctaaacttcaccacaacactcagacttttcaagcgggcccccacgccgtgaagaagttgtcaagtggaaacagcaaactctcatcctcaaagttcagtaatccgatcagctcttccaagcgaaatgtatcgctgcttatttcagcaaattcagggctatag

SEQ ID NO: 182612 - DNA, 285 bp, Artificial Sequence
  Description of Artificial Sequence: Synthetic coding sequence
atgatgggcctgagcctggccagcgccgtgctgctggccagcctgctgagcctgcacctaggcaccgcaactcgaggctccgatatctcaaagacctgttgtttccagtacagtcacaagcctctgccctggacctgggttcgttcatatgagtttacctccaatagctgctcccaacgagccgtgattttcactaccaaaagggggaagaaggtgtgtacacaccctagaaagaaatgggtgcagaaatacatctctttgctgaagacccccaagcagctgtag

SEQ ID NO: 182613 - DNA, 285 bp, Artificial Sequence
  Description of Artificial Sequence: Synthetic coding sequence
atgatgggcctgagcctggccagcgccgtgctgctggccagcctgctgtcccttcacctggggacagcaactagaggcagtgacatttctaaaacctgttgtttccagtattcgcataaaccgttgccttggacgtgggtccgctcgtatgaatttacctccaattcctgctcacagagggccgttattttcaccaccaaacgaggcaagaaagtgtgcacacaccccagaaaaaaatgggtccagaaatatatctctctattaaagactcccaagcaactgtag

SEQ ID NO: 182614 - DNA, 339 bp, Artificial Sequence
  Description of Artificial Sequence: Synthetic coding sequence
atgaagggcccccccaccttctgcagcctgctgctgctgagcctgctgttaagcccagatccgacagccgcgtttctcctccccccatctaccgcttgttgcacacagctgtatcggaagccacttagcgacaagcttctgagaaaagtgatccaggtagagctgcaggaggccgacggagactgtcacctgcaagcattcgtgctgcatttggcccaacgttctatctgcattcatcctcagaaccccagcctcagccaatggttcgaacaccaggagcgaaagcttcacggtacacttcctaagctcaattttggaatgttgaggaaaatgggctag

SEQ ID NO: 182615 - DNA, 384 bp, Artificial Sequence
  Description of Artificial Sequence: Synthetic coding sequence
atgcagcagcggggcctggccatcgtggccctggccgtgtgcgccgcgttacatgctagcgaagctatcctgcccatcgcttcctcatgttgtacagaagtaagtcatcacatcagcaggcgactgttggagcgggtaaatatgtgtagaatccaaagggcagacggggactgcgaccttgctgccgttatcctgcacgtgaaacgtcggcgaatctgtgtctctccccataatcacacagtcaaacaatggatgaaggtacaggccgccaagaagaacgggaaaggaaacgtctgtcaccgaaagaaacatcacggcaagaggaacagcaatcgggcacaccagggaaaacacgagacgtacgggcacaagacgccatattag

SEQ ID NO: 182616 - DNA, 384 bp, Artificial Sequence
  Description of Artificial Sequence: Synthetic coding sequence
atgcagcagcggggcctggccatcgtggccctggccgtgtgcgccgcactccacgcttcggaggcgattctgccaatcgcgtcgtcctgctgtacagaagtttcccatcacatcagccgccgactactggagcgcgtgaacatgtgccgcatccaaagggctgacggcgactgcgatcttgccgccgtaattctgcacgttaaacggaggagaatttgtgtctcaccccataatcacaccgtaaaacagtggatgaaagtgcaggccgctaaaaaaaatggtaaaggtaatgtgtgccatcgaaagaagcaccatggaaagagaaattctaacagagcccaccagggtaaacatgaaacctatggccacaaaactccgtattag

SEQ ID NO: 182617 - DNA, 243 bp, Artificial Sequence
  Description of Artificial Sequence: Synthetic coding sequence
atgtgccggatccagcgggccgacggcgactgcgacctggccgccgttatcctgcacgtcaagcggcgaaggatctgcgtttcacctcacaaccataccgtcaagcaatggatgaaagtccaagccgccaaaaaaaacggtaaaggcaatgtgtgtcatcgcaaaaagcatcacgggaaacggaacagtaacagagcccaccaaggcaagcacgagacatacggacataagactccttattag

SEQ ID NO: 182618 - DNA, 354 bp, Artificial Sequence
  Description of Artificial Sequence: Synthetic coding sequence
atgcagcagcggggcctggccatcgtggccctggccgtgtgcgccgcgctgcacgcttctgaggccatcttacctattgccagctcatgctgcacagaggtgtcccaccacatttcccgccgcttgctcgagcgtgttaacatgtgccggattcagcgggctgacggggactgcgatctcgccgcggttatgttggaatgcagtgacatgataagcgctcactacaaccttcatcttcccggctccaatgattccccgacctcagccttccaggtggcgggtatcactgcttttatgagtagcgcagaggagtccgtgtctgctcggaccaccatccttctcagctcaggatag

SEQ ID NO: 182619 - DNA, 282 bp, Artificial Sequence
  Description of Artificial Sequence: Synthetic coding sequence
atgcaggtgagcaccgccgccctggccgtgctgctgtgcaccatggctctgtgtaatcaggtactgagcgcacctctggctgcggacacacctaccgcttgctgtttttcgtacaccagtagacaaatcccgcaaaacttcattgccgactacttcgagaccagctcccagtgtagtaagccctctgtgattttcctcactaagcgggggaggcaggtctgtgccgatccctccgaggaatgggtgcagaaatatgtatcagacctcgagctgtctgcatag

SEQ ID NO: 182620 - DNA, 159 bp, Artificial Sequence
  Description of Artificial Sequence: Synthetic coding sequence
atgcaggtgagcaccgccgccctggccgtgctgctgtgcaccatggctctttgcaaccaagtgctgtctgcaccattgtccaggcctagggaagccggcagatccgtgctcacccccgtccgcagcgggtctaggaacacaagtgtgacctggagctag

SEQ ID NO: 182621 - DNA, 144 bp, Artificial Sequence
  Description of Artificial Sequence: Synthetic coding sequence
atgcaggtgagcaccgccgccctggccgtgctgctgtgcaccatggcactgtgtaaccaggtgttgtccgccccacaggctggcaggagcgtgctgacccccgtaaggtccggaagcaggaatacgtcagtgacatggagctag

SEQ ID NO: 182622 - DNA, 279 bp, Artificial Sequence
  Description of Artificial Sequence: Synthetic coding sequence
atgaagctgtgcgtgaccgtgctgagcctgctgatgctggtggccgccttttgttcacccgctttgagcgctcctatgggcagtgacccgcccaccgcttgttgtttttcatatacagctaggaagttacccaggaactttgtggtggactactacgagacctcttctttgtgcagccaaccagctgtcgtgtttcagactaagaggagcaaacaggtctgcgcagatccgagtgagtcttgggtgcaggaatatgtctatgaccttgagctgaattag

SEQ ID NO: 182623 - DNA, 159 bp, Artificial Sequence
  Description of Artificial Sequence: Synthetic coding sequence
atgaagctgtgcgtgaccgtgctgagcctgctgatgctggtggccgctttctgcagccccgccctctccgcacctaatagtaaacccaaagaagcaagcaagagcgtgctgattcctgtgaatcctggatcccgatcaacctgcatgacctggaactag

SEQ ID NO: 182624 - DNA, 159 bp, Artificial Sequence
  Description of Artificial Sequence: Synthetic coding sequence
atgaagctgtgcgtgaccgtgctgagcctgctggtgctggtggccgcgttctgcagtttagctctctctgcacccaactctaaacccaaggaagcttccaaatccgctctcacccccgtctcccctggctcacgctcaacatgcatgacctggaactag

SEQ ID NO: 182625 - DNA, 207 bp, Artificial Sequence
  Description of Artificial Sequence: Synthetic coding sequence
atgaagctgtgcgtgaccgtgctgagcctgctggtgctggtggccgccttttgctctcttgctttatcagcccccactaagtcttcagagtggaaattgcagggggtttgctttcagtgctgctcccgcaaggatccgattcaccagtcctgtcccacatggactatggttcgacagcgcaagatgccaaccactgggaagggttag

SEQ ID NO: 182626 - DNA, 261 bp, Artificial Sequence
  Description of Artificial Sequence: Synthetic coding sequence
atgaagctgtgcgtgaccgtgctgagcctgctggtgctggtggccgccttttgcagcctcgccctatctgcgcctatgggcagcgatccgccaaccgcctgctgcttttcttacacagcccgcaagttaccacgaaatttcgtcgttgattactacgaaacctccagtttatgttcccagcccgccgtcgtcgcggctccacacgggccatggagcggacgtggtagatgcttgcctcaagctagggataaagctaggtag

SEQ ID NO: 182627 - DNA, 279 bp, Artificial Sequence
  Description of Artificial Sequence: Synthetic coding sequence
atgaagctgtgcgtgaccgtgctgagcctgctggtgctggtggccgccttttgctctttagccctgagcgcccccatgggaagcgaccctcctacagcctgttgcttctcgtatacagcccggaagcttccccgcaacttcgttgttgactattatgaaacttcctcactctgcagtcaaccggccgttgtttttcaaaccaagcgcggtaaacaggtttgtgccgatccatccgagagttgggtgcaggagtacgtttatgacttagagctgaactag

SEQ ID NO: 182628 - DNA, 300 bp, Artificial Sequence
  Description of Artificial Sequence: Synthetic coding sequence
atgaaggtgagcgccgccctgctgtgcctgctgctgatcgccgccaccttcatcccgcagggacttgcccagccggacgccataaatgcaccagtcacctgttgctacaacttcaccaaccgtaagatcagcgtgcagagattggctagctaccgcagaatcacttcaagtaaatgcccaaaggaagctgtgatttttaaaactatcgttgcgaaagagatctgcgctgacccaaaacaaaagtgggttcaggacagtatggaccatctagataagcagacccagactcccaagacctag

SEQ ID NO: 182629 - DNA, 330 bp, Artificial Sequence
  Description of Artificial Sequence: Synthetic coding sequence
atgctgaagctgacccccctgcccagcaagatgaaggtgagcgccgcacttctttgcctgctcttgatggccgccaccttcagcccgcaaggccttgctcagcctgactccgtatcgatcccaatcacgtgttgtttcaatgtaatcaatcgtaagatccccatacaacggctggagtcctacacgaggataaccaacatccagtgcccaaaagaggccgtgatcttcaagaccaaacgggggaaggaggtgtgcgcagatccaaaagagcggtgggtgagggactctatgaaacatctggatcagatctttcagaatcttaagccctag

SEQ ID NO: 182630 - DNA, 1068 bp, Artificial Sequence
  Description of Artificial Sequence: Synthetic coding sequence
atggagacccccaacaccaccgaggactacgacaccaccaccgagttcgattatggtgacgccaccccttgtcagaaggtgaacgaacgtgcctttggtgcccagcttctccctccgctgtattcactagtgttcgtaattgggttagtcgggaatatccttgttgtacttgttcttgtccagtacaagcgcctgaagaacatgacgagcatctaccttctgaaccttgcaatcagcgacttattgtttctgttcacactccccttttggattgactacaaactcaaagatgactgggttttcggcgatgcaatgtgcaaaattctgagcggattctattacacgggactgtactcagaaatcttctttattatactgctcacaattgatcgttacttagctatcgtccacgccgtctttgcactgcgggcccggacagttacctttggagtgattacatctattattatttgggctctggccatcttagcatcaatgcctggattgtatttttccaagactcagtgggagttcacacaccacacttgcagcctccacttccctcacgaatccctacgggaatggaagctgttccaagccttgaaactcaacttgtttgggttggtactgcctcttctcgtcatgattatctgttacacgggaataattaagatcctgcttagaagacctaacgagaagaagtccaaggctgtgcgactgatcttcgtgattatgatcatcttcttccttttctggaccccttataatctaactattcttatttcagtctttcaagacttcctgtttacgcatgagtgtgaacagtcacggcatcttgatctggcagtgcaagttacagaagtcatcgcctacactcattgttgtgtaaatcccgtcatttacgccttcgtgggagagaggttccgaaaatacctgcggcaattattccacaggcgagtcgctgtgcatctggtaaagtggctccctttcttgagcgtggacagactggaacgcgtctcctctaccagcccgagcaccggcgaacatgagctcagcgctggattctag

SEQ ID NO: 182631 - DNA, 1089 bp, Artificial Sequence
  Description of Artificial Sequence: Synthetic coding sequence
atgggcaccgaggccaccgagcaggtgagctggggccactacagcggggatgaggaggacgcttattcagctgaacccctgcctgagctctgttacaaggctgatgtccaggctttttcccgcgcttttcagcccagcgtctccctcactgtcgccgccttgggtttagccggcaatggtcttgtgctcgcgacgcatttagccgcgaggcgggctgccagatcgcccacttcagcccatctgctgcagttagcccttgctgatctgttgctcgcactgacgctccccttcgctgccgccggcgccctgcaggggtggagcttggggtctgcgacctgccgaaccatcagtggactatactccgcctccttccacgctggcttcctgtttctggcatgcatttcggccgaccggtatgtggcaatcgcccgggctctgcccgccgggcccagacccagcactcctggaagagcccatctggtgtcggtaattgtgtggctgctgagcctgctcctggccctgccagctctgttgttcagtcaggacggacagcgggagggacagagacgatgtcgcctgatcttcccagaggggttaacgcagacagttaaaggcgcgagcgcggtggctcaggtagccctcggttttgcacttccgctgggcgttatggtagcctgttacgcactcctcggacgcacacttctagcggcccggggtcccgaaagacggagggctctgagagttgtggtagcattagtggccgcattcgtcgtgctgcaactgccctactctttggccctattgctggataccgctgacctgttggctgctcgagagagaagctgtccagcctcaaagcgcaaggacgttgcgctcctggtgactagtggccttgctctggctaggtgtggcctcaatcctgtcttatatgcattcctaggcctgcgcttccgtcaggaccttagacgcttactgagagggggcagctgtccgtctgggcctcaacctaggcgcggctgtccccggcgaccaaggctgagcagttgctctgctcccactgagacccacagcttatcttgggacaactag

SEQ ID NO: 182632 - DNA, 1125 bp, Artificial Sequence
  Description of Artificial Sequence: Synthetic coding sequence
atgctgagcaccagccggagccggttcatccggaacaccaacgagagtggagaggaagtaactacattttttgactacgactacggagccccatgccataaatttgacgtgaagcagatcggcgctcagctgctgcctcccctctacagtcttgtctttatcttcggattcgtggggaatatgttggtggttcttatcttgattaactgtaagaagctgaaatgcctgacagatatctatctgctaaacttagcaatcagtgacctgttgttcctaataacgctcccactttgggcccatagtgccgccaatgagtgggtgtttgggaacgccatgtgcaaattattcacaggactgtaccacattgggtatttcggcggaattttctttattatccttctcaccatcgaccgctatctggccattgtgcacgcggtgttcgcccttaaggctcgaacggtgacctttggggtcgtgaccagtgtgatcacttggctggtcgccgttttcgccagcgtgcccggtatcattttcacaaagtgccagaaggaggattctgtgtacgtgtgcggaccttacttcccacgaggttggaacaattttcatacaatcatgcggaatatcttaggtctggtgctgcctctgttaatcatggttatttgttattccggaatccttaagaccctcctccgttgccgcaacgagaagaagaggcatcgggcagtccgagttatatttaccattatgattgtctacttcctgttctggacaccgtataacatcgtgatactgctcaataccttccaggaattttttgggctgtccaattgtgaatccacatctcagctcgaccaggccacacaagtgaccgagaccctgggcatgacccattgctgcattaaccccattatatacgctttcgtcggggaaaaatttaggtccttgttccacattgcattgggctgtaggattgcgcccctacagaagcctgtgtgcgggggtcccggcgttaggccagggaagaacgtgaaggtcacaacacaggggctgttggacggccgcggaaaagggaaatccattggcagagcgcccgaagcgtctttgcaggataaagagggtgcatag

SEQ ID NO: 182633 - DNA, 1125 bp, Artificial Sequence
  Description of Artificial Sequence: Synthetic coding sequence
atgctgagcaccagccggagccggttcatccggaacaccaacgagtcaggggaagaagtgaccaccttcttcgactacgactacggagctccttgccataagtttgacgtgaagcagataggcgcccagctgctgccccccctgtattctctggtgtttatcttcgggttcgttgggaacatgctggtggtcctgattctgattaactgcaagaagctgaagtgtttaactgacatatatttactcaacttagccatctcagatctcctttttctgataactctgcccttgtgggcacattccgctgccaatgagtgggttttcggcaatgccatgtgtaaattgttcactggcctgtatcacattggctacttcggtggtatcttcttcataatcctgctcaccattgaccgctaccttgccatagtccacgcggtgttcgccttgaaagcgcggaccgttacattcggcgtggtaacctccgtgatcacatggcttgtggccgtgttcgccagcgtgccaggaattattttcaccaaatgtcagaaggaagactctgtgtatgtttgcggcccatacttccccagggggtggaacaacttccataccatcatgcgtaacatactgggattggtattgccactgcttattatggtaatttgttactctggaatcctgaaaactcttcttagatgccggaacgagaagaagaggcatagagccgttcgagttattttcacaattatgatagtctatttccttttctggaccccctataacattgttatactcctgaataccttccaagagttttttggcttatctaattgcgaatctacctctcagcttgaccaggcgacacaggttacagagaccctcggcatgacacactgctgtatcaaccccatcatctatgctttcgtgggggagaaattccgaagcctctttcacatcgcactgggctgtagaatagcacccctgcagaaaccagtgtgtggtggcccgggtgtgcgtccaggaaagaatgtcaaagttactactcaagggttgctggatggaaggggcaagggaaagtccataggcagagctcctgaagccagccttcaggataaggagggcgcatag

SEQ ID NO: 182634 - DNA, 366 bp, Artificial Sequence
  Description of Artificial Sequence: Synthetic coding sequence
atgctgagcaccagccggagccggttcatccggaacaccaacgagagcggcgaggaagtgacgactttttttgactatgattacggagccccttgtcacaagtttgacgtgaaacagattggagcccagttgctgccgccactgtatagcctggtgttcatatttggattcgtgggaaacatgctcgtggtgcttatactgattaactgtaagaagctgaaatgcctaacagatatatatctcctcaacctggccatttccgatcttttgttcttgatcaccctccctctatgggcacactctgcagctaacgaatgggtttttggtaatgcgatgtgtaagctgttcacaggtctgtatcactag

SEQ ID NO: 182635 - DNA, 1083 bp, Artificial Sequence
  Description of Artificial Sequence: Synthetic coding sequence
atgctgagcaccagccggagccggttcatccggaacaccaacgagagtggcgaggaagtgacgaccttcttcgactacgactatggtgccccttgtcataagtttgatgtgaaacagattggggcacagttactgccgccgttatacagtcttgtgtttatctttggattcgttgggaacatgctggtagtgctcatcctgataaattgcaagaaacttaagtgtctgactgatatctacctgctgaatcttgccatcagcgatctgctctttttgatcaccctaccactgtgggcacactcagccgcaaatgaatgggtgttcggtaatgccatgtgcaaactgtttactggcctctaccacatcgggtacttcggcggcattttttttatcatactgttgacaatagacaggtatctcgccattgttcacgccgtgttcgcgctcaaggcgcgtacagtgacattcggcgtcgtgacaagtgtaattacttggctagttgctgtgtttgcctctgtgcctggcataattttcactaaatgtcaaaaggaggatagcgtgtacgtatgcggaccgtacttcccaagagggtggaacaactttcacacgatcatgaggaacatactgggcctggtgcttcccctactgatcatggtgatttgctactcggggatattgaaaaccctccttcgttgcagaaacgagaaaaagaggcacagagctgtgcgggtgatttttactatcatgattgtgtattttcttttctggacaccctataatattgttatcttattaaatacttttcaggagttcttcggactatcaaattgcgagtccacctcgcaactcgaccaggccacacaggtgacagagacactcggcatgacgcattgttgcatcaacccaattatttacgcctttgtgggcgagaagtttcggcggtatctgagcgtcttttttaggaaacacattaccaaacgcttttgcaaacagtgtccagttttctacagggaaactgtagatggtgtgacctccactaatacacctagcaccggggaacaggaagtctccgcaggtctttag

SEQ ID NO: 182636 - DNA, 1068 bp, Artificial Sequence
  Description of Artificial Sequence: Synthetic coding sequence
atgaccaccagcctggacaccgtggagaccttcggcaccaccagctattacgatgatgtcggcctcctttgcgagaaagcagacacacgcgcactcatggcccagttcgtaccgccactctacagcctggtgttcaccgtaggactactcggcaatgtcgtcgtcgtgatgattttaatcaaatacaggagactaaggattatgacaaacatatatctgttgaaccttgcaatctctgatttacttttcctggtaacgctcccattctggattcactatgtgcgtggccacaattgggtgttcggtcacggtatgtgtaaacttctgagcggtttttatcacaccggcctatattcggagatctttttcatcatccttctgaccatcgatagataccttgctatcgtccacgccgtttttgcgctgagggcacgtacagtgactttcggagtgattacatcaattgtgacctggggtctcgctgtgcttgcagccctgcctgaattcatattttacgaaacagaggagctttttgaagagaccttatgcagtgccctgtacccagaagatactgtgtatagttggcgccacttccatactctccgcatgacaatcttctgtctagtgttgcccctgctggtgatggcaatatgttacacaggtattatcaagactctcctgagatgcccaagcaaaaagaaatacaaagctattcgcctgatcttcgtgattatggcagtgttctttattttttggaccccttacaacgtggctattttgctgtcttcataccagtccattctcttcggcaatgactgcgagcggagtaaacaccttgacttggtgatgctcgtgacagaagtgattgcttatagtcattgttgtatgaacccagtcatctatgcctttgttggggagcgctttcgaaaatatctccgccatttcttccaccgtcatctattgatgcatctggggaggtacatcccattccttccttcagagaaactggagaggaccagctcggtgtcaccatctaccgctgaaccagagctctcaatagttttctag

SEQ ID NO: 182637 - DNA, 1068 bp, Artificial Sequence
  Description of Artificial Sequence: Synthetic coding sequence
atgaccaccagcctggacaccgtggagaccttcggcaccaccagctattatgacgacgtcggcctcctatgcgagaaagctgacacacgtgccctcatggcccagttcgtcccacctctgtacagccttgtattcacagtcggtctgttagggaacgtggtggtggttatgatcctcatcaagtatcggcggcttcgaattatgaccaatatctacttgctgaacttggcgattagtgaccttctgtttctggtgacgctccctttttggattcactatgtgaggggccacaattgggtgttcggtcacgggatgtgtaagttgctttcagggttttatcacactgggctgtattcagaaatattctttatcatccttcttaccatagaccggtacctggctatcgtgcacgccgtcttcgccctgcgggctagaacagtgacttttggcgtaatcaccagcatcgtcacatggggcttagccgtactggccgctctgcctgaattcattttctatgagaccgaagagctgtttgaggaaaccctctgttcagcgctgtatcccgaggacaccgtgtacagttggaggcattttcacactcttcgcatgacaatcttttgtctggttctacccctgctggtgatggcgatctgttatacggggatcatcaaaacactccttcgatgtccctctaagaaaaaatataaagctatccgcttaatttttgtcataatggctgtgttcttcatcttttggactccttataatgtggccatcctcctgtcttcttatcagagtatactgtttgggaacgactgcgagcggtccaagcacttggacctggtcatgctcgtaaccgaggttatcgcttatagccactgctgcatgaaccctgtgatttatgcttttgtaggcgaacgcttccggaagtacctgcggcattttttccaccgacacctcttaatgcacctcggccggtatattccctttctgccgtctgagaagctcgagaggacctcgtcagtgtccccaagtacggcggaacccgagttatccattgtgttctag

SEQ ID NO: 182638 - DNA, 1068 bp, Artificial Sequence
  Description of Artificial Sequence: Synthetic coding sequence
atgaccaccagcctggacaccgtggagaccttcggcaccaccagctattacgacgacgtgggactgctgtgcgagaaagcggataccagagcactcatggcccaattcgtcccccctctctactccctggtgttcacagtcggactcctgggaaatgtcgttgttgtgatgatcctcatcaagtaccggaggttaaggatcatgaccaacatctatctgttgaacttggccatatctgacctccttttcctggttaccttaccgttttggatacactacgtccgcggccacaattgggtgttcgggcatggcatgtgcaagctgctatccgggttctatcacaccggactgtatagcgagatattctttatcattctcctaacgattgatcggtacttggccatcgtccatgctgtcttcgcactgcgggcccggaccgtgacattcggcgtgatcaccagcattgtgacttggggactagcagttctggcggccctgccggagtttattttctacgaaactgaggagctatttgaggagacactgtgcagcgccctgtaccctgaagacacagtatactcatggaggcactttcacactctgcggatgacgatattttgccttgtgttaccactccttgtaatggccatctgctataccggcatcatcaagactttgcttagatgtcctagtaagaagaagtataaggccattcggctgatttttgtgatcatggctgtcttctttattttttggaccccttataacgttgcaatcttgctgtccagctatcagtctatcctgttcggtaatgattgtgaacggtctaagcatctcgatcttgttatgctagtcaccgaggtcatagcctactcccactgctgtatgaatcccgtgatctatgccttcgtaggagagcgctttagaaagtacctcagacacttcttccacaggcatctgttgatgcacctcggccggtatattccctttctgccaagtgagaaactagagcggacctcctcagtgtccccgtctaccgccgaacctgagctgagtattgtattttag

SEQ ID NO: 182639 - DNA, 243 bp, Artificial Sequence
  Description of Artificial Sequence: Synthetic coding sequence
atgaccaccagcctggacaccgtggagaccttcggcaccaccagctattacgacgacgttgggctactttgcgagaaggccgacaccagagccctaatggcccagtttgtaccacccctgtacagcctggtattcacagtaggcctcctgggcaatgttgtggtagtcatgatactgatcaaatatcgccgccttaggattatgactaacatttacctgctcaatttggcaatctcagactag

SEQ ID NO: 182640 - DNA, 66 bp, Artificial Sequence
  Description of Artificial Sequence: Synthetic coding sequence
atgaccaccagcctggacaccgtggagaccttcggcaccaccagctactatgacgacgttggatag

SEQ ID NO: 182641 - DNA, 1068 bp, Artificial Sequence
  Description of Artificial Sequence: Synthetic coding sequence
atgaccaccagcctggacaccgtggagaccttcggcaccaccagctactatgatgacgtggggctgctttgtgagaaggcagacacccgggctctgatggctcagttcgtcccccctctgtacagcttggtttttacagtcggtttactcggcaacgtggttgtagtaatgatcctgatcaagtaccggcgactcaggataatgaccaacatttacctgctcaacctggccatctctgatctgctattcctggtgaccctgcccttctggatccactacgtcagaggccataactgggtctttgggcacggaatgtgtaaacttctgtcgggcttttatcataccgggctgtacagcgagatcttctttatcattcttttgacaatagacagatacctggcaattgtccacgctgtgttcgccctgcgggctcgtaccgtgaccttcggagttatcacatcaatagttacttgggggctcgcagtgctggcagccctccctgaattcatcttttatgagacagaggaactctttgaagaaactctgtgctcggcactgtacccagaggatacagtatatagctggaggcactttcacacccttaggatgactattttttgcctggtgcttcctctgctggtcatggccatttgttacactggaatcataaagacgctcctgcggtgtcccagtaagaaaaagtataaagccataagactgatctttgtgataatggccgtgttttttatcttctggacaccttataatgtggccatcctgttgagctcttatcagtccatcctgtttggtaatgattgtgaaaggagcaaacacctcgacttagtgatgctggtgaccgaagtgatagcctactcgcattgttgtatgaaccctgtgatctacgcatttgttggagagcgctttcgtaaatatctccggcactttttccatagacacctcttaatgcacctaggcagatacatcccatttttaccctccgaaaaactggaaagaacctccagcgtctccccgtctaccgctgagccagagctaagtatcgtcttttag

SEQ ID NO: 182642 - DNA, 1131 bp, Artificial Sequence
  Description of Artificial Sequence: Synthetic coding sequence
atgcccttcggcatccggatgctgctgcgggcccacaagcccggcagtagccgcaggtccgagatgactacaagtctggataccgtcgagacgtttgggacaacctcctactacgacgatgtaggtctgctgtgtgagaaggctgatacccgggccctaatggctcagtttgtgccacccttgtatagcttagtgtttacagtgggtctcttgggcaacgtggtggtggtaatgattctgattaagtaccggagacttcgcattatgaccaatatttacctgctcaatctggccattagtgacctccttttcctggttacgctgcccttctggatccattatgtgaggggccacaactgggtttttggacacggcatgtgcaagctgttgtctgggttttaccataccgggctctatagtgagatttttttcattattctcctgaccattgaccggtatctggcaattgtacatgcggtattcgccttgcgtgctagaacggttacttttggagtaatcacctccattgtgacatggggattggctgttctggctgcacttccggaattcatcttttatgagactgaagaactcttcgaggagactctgtgcagcgcgctgtaccctgaagatacagtctatagttggcggcacttccataccctgcggatgaccatattttgtctcgtgcttcctctattggtgatggccatttgttacactggcatcatcaaaactctactccgttgtccatccaagaaaaagtataaggcaatccggctgattttcgttattatggcggtgttctttatcttttggacaccatataatgttgctatactgctgtcatcctaccaatctatactgttcggcaacgactgcgagaggagtaaacacctggacttagtgatgttagttaccgaagtgatcgcttattctcattgttgtatgaaccctgtgatctacgcttttgtcggagaaagattccgcaagtatctccggcatttttttcacaggcacctgcttatgcacctgggccggtacattccatttttgccaagtgagaagctggagaggacttcttctgtgtcaccttcaactgccgaaccagagttgtccattgtgttttag

SEQ ID NO: 182643 - DNA, 1083 bp, Artificial Sequence
  Description of Artificial Sequence: Synthetic coding sequence
atgaaccccaccgacatcgccgacaccaccctggacgagagcatctatagtaactattacctttatgagtctattcctaagccatgtaccaaggaaggcattaaagcttttggcgagctgtttctccctcccctgtattccttggtcttcgtgttcgggctgctggggaattccgtggtggtactggtccttttcaagtataagagactacgctctatgactgatgtgtatctgcttaacctggcgatttctgacctcctgtttgtcttttcactgccattctggggctattatgcagctgaccagtgggtgtttgggttgggcctatgtaagatgataagttggatgtatttagtcggattttattcggggatcttctttgtcatgctcatgtctatagatcggtacttagctatagtgcatgccgtgtttagtctgcgcgccaggactctgacttacggagtcattacgagtctggctacgtggtccgtggccgtcttcgcctctctgccaggatttctgttttcaacatgctatacggaaaggaaccacacctattgtaagacaaaatacagtctgaattctacaacctggaaagttctgtcttcactggaaatcaatattctggggctggtgattccattgggaatcatgctcttctgctacagcatgattatccggacgctccagcattgtaaaaatgaaaagaagaacaaagccgtcaaaatgatttttgcagtcgtcgtgctgtttcttggtttctggaccccttataacatagttttgtttctggaaactttagttgaactcgaggttctgcaggattgcacattcgagcggtatttggattacgccattcaggctaccgaaaccttggcgtttgtgcactgttgcttaaatccaataatttacttttttctgggtgaaaagttcaggaaatatatcctccagctgttcaagacatgtagaggactatttgtgttgtgccaatattgcgggctgctgcaaatctattccgccgacacaccctcgagctcttacacacaaagcaccatggatcacgacctgcacgatgccctatag

SEQ ID NO: 182644 - DNA, 1059 bp, Artificial Sequence
  Description of Artificial Sequence: Synthetic coding sequence
atggactaccaggtgagcagccccatctacgacatcaactactacacatcagagccctgtcaaaagatcaatgtcaagcaaatcgccgcccggctgctgccacccttatatagtctggtatttatctttggctttgtgggtaacatgctcgtcattcttattctcattaattgcaaaagactgaagtccatgacagacatttatctgctgaacttggcaatcagcgatctgttttttctgctgacagtccctttttgggcgcattatgctgcagctcaatgggatttcggtaacactatgtgccagctgctcaccggactgtactttatcgggttcttttccggaatattttttatcatcctgttaactattgacagatatttggcagttgtgcacgccgtttttgccctgaaagcgcggacggtgacatttggcgtagtgaccagcgtgataacatgggtggtcgccgtctttgccagcctccctggcatcatatttactcggtctcagaaagaaggcctccactatacttgcagcagccattttccatactcacagtaccagttttggaagaactttcagaccctgaaaatcgtcatccttggacttgtcctccccctgcttgtcatggttatttgttactctggcatcctgaaaactttactccgatgcaggaatgaaaagaaacggcaccgcgccgtgagactgatcttcaccatcatgatcgtgtacttcctgttttgggccccctacaacatagtgctgctgttgaatacgttccaggagttctttggcctgaacaactgcagttcatccaaccggctggatcaggctatgcaggtgacagagacactaggtatgacacattgctgcatcaacccaattatctatgccttcgttggagagaaatttaggaactatctcctggtgttctttcagaagcacatcgccaagaggttttgtaagtgttgctcaatcttccagcaagaagcgcccgagcgagcatcttctgtgtatactaggtctaccggcgagcaagaaattagtgtcggcctttag

SEQ ID NO: 182645 - DNA, 1059 bp, Artificial Sequence
  Description of Artificial Sequence: Synthetic coding sequence
atggactaccaggtgagcagccccatctacgacatcaactactacactagcgaaccctgtcagaaaattaacgtgaaacagatcgctgcacgacttctgcctccattatattccttagtttttatatttggcttcgtggggaacatgttggtgatactgattctcattaactgcaagcggctcaagtctatgactgatatttatttgctaaacctcgcgatttccgaccttttcttcctgctcactgtccccttctgggcccactatgcagcggcgcagtgggattttgggaatactatgtgtcagctcctgacaggattgtacttcatcgggttcttctcaggcatctttttcattatcctactgacaatcgaccggtatctggctgtggttcatgccgtgttcgccctcaaggccagaaccgttaccttcggtgtagtgacctcagtgattacgtgggtggtagcagtttttgcctcccttcccgggattatttttaccagatcacagaaagagggtctccattacacgtgttcgagtcatttcccctatagccagtaccaattctggaaaaacttccagacattgaagatcgtgattttggggctggttctgcccctacttgtgatggtcatttgttatagcggaatccttaagacacttctgaggtgtaggaacgaaaagaaacggcatcgtgccgtacgattgatcttcaccatcatgatcgtatacttcttattctgggcaccttataacatagtgctccttctgaatacctttcaagagttcttcggattaaataactgttcttcgagtaaccgcctcgatcaagctatgcaggtgaccgagacgctcggaatgacacactgttgtataaacccaatcatctacgcctttgttggggaaaaatttcggaattatctgctagtgttttttcagaagcatattgccaaaaggttttgcaagtgctgttcaatctttcagcaagaagcccccgaaagagcatcctctgtgtatacccggtctaccggcgagcaggaaataagtgtagggctctag

SEQ ID NO: 182646 - DNA, 999 bp, Artificial Sequence
  Description of Artificial Sequence: Synthetic coding sequence
ctgcccaagaaccagtgcgaggccaaccggagccccccccccgcctccgcccttcttacaggggtgcacttgtggttctgcaacatgctagtcatactaattctgatcaactgcaagaggctgaagagtatgacggatatttacttgctgaatttggctatctcagatctctttttcctcctcactgtgcctttttgggcccactatgctgcggcccaatgggattttggaaataccatgtgtcagcttttaactggcctgtatttcatcggctttttctcaggcatcttttttatcatcctgctcaccatagaccggtatctggccgtagttcacgccgtttttgccctgaaagctagaaccgttaccttcggcgtcgtgactagcgtcatcacctgggtagtggccgtgttcgctagtcttccaggtattatcttcacacgatcccaaaaggagggcctgcactacacgtgttcatcccactttccatatagccaatatcagttctggaaaaatttccagactttaaaaatcgtgatactcggcctggttctgcctttactggtgatggttatctgctacagcggtatcctcaaaactcttctgagatgcaggaacgagaagaagagacaccgggctgtacgcctgattttcacaattatgattgtttactttctgttttgggccccatacaatattgtcctgttgcttaatactttccaggagttctttgggctgaacaattgcagttcaagcaaccggcttgaccaggccatgcaggttactgagactctcgggatgacgcactgttgtattaatcccatcatttatgccttcgtgggcgaaaagttccgtaattatctactggttttctttcagaagcacattgctaaaagattttgtaaatgttgcagcattttccagcaggaggcccctgagcgtgcgtcttcagtttacacccgcagcacgggagagcaagagatctccgtcggactgtag

SEQ ID NO: 182647 - DNA, 1059 bp, Artificial Sequence
  Description of Artificial Sequence: Synthetic coding sequence
atggactaccaggtgagcagccccatctacgacatcaactactacaccagcgaaccgtgtcaaaaaattaacgtcaaacagatcgctgcaaggttgcttccccccttgtactcactggtgtttatctttgggtttgtgggtaacatgctggtgattcttatacttattaattgtaaacggctgaaaagtatgacagatatttatttgctgaatttggcaatatcagacctttttttccttttaaccgtgccgttctgggcacactacgccgctgcccaatgggattttggtaacaccatgtgccagctcctcacaggactgtactttatcggcttctttagtggcattttctttattatattactgactattgataggtaccttgccgtggttcacgctgtgtttgccctgaaggcgcgcactgtcacctttggagtggttacatcagtgatcacgtgggttgtggctgtattcgcctccctgcctggcattatattcactaggagccaaaaggaaggcctgcactatacctgcagctcccactttccatattcccagtaccagttctggaagaattttcagaccctgaagatcgtgattcttggcctagttctgccgctcttagtgatggtgatttgttactcaggtatcttaaagacactccttcgatgtagaaacgaaaaaaaaaggcaccgagctgttcgacttatattcacaatcatgattgtctacttcctattctgggcgccctacaatatcgtactgctgctaaacacttttcaggaatttttcggcctgaacaactgtagcagttctaatcgacttgaccaggccatgcaggtgacagagactctggggatgacacactgttgcataaacccaataatttacgcctttgtgggagaaaagttcagaaattatctcctagtgttctttcagaagcacattgccaagagattttgcaagtgttgctccatctttcagcaggaggccccagagcgggcctcatcggtgtacacccgttcaacaggcgagcaggagatttccgtcggcctgtag

SEQ ID NO: 182648 - DNA, 1125 bp, Artificial Sequence
  Description of Artificial Sequence: Synthetic coding sequence
atgagcggcgagagcatgaacttcagcgacgtgttcgacagcagcgaagattattttgtttctgttaacactagctattactccgtagatagtgagatgctgttgtgtagcttgcaggaagtcagacagttctcacggctgtttgttcccattgcatatagcttgatttgcgtctttggtctcctgggcaatattctcgtcgttatcaccttcgccttctacaaaaaggcacgttcaatgaccgacgtctatcttctaaatatggcaattgccgatatcttatttgttctgacacttccattctgggctgtgtctcacgccaccggagcatgggtgttttccaacgcaacttgcaaactacttaagggcatctacgctataaatttcaactgcgggatgctgctgctaacctgtatatcgatggaccgatacatagccattgtgcaagcaacaaaaagcttcaggctgcgcagcagaactctccctaggagtaagattatctgcctcgtggtatggggtttatctgtgattatatcaagtagtacttttgtgtttaaccagaagtataatacacaggggagcgacgtatgtgaacctaagtaccagaccgtctcagaaccaattcggtggaaacttctgatgctgggcctggagctgctgttcggcttctttattccccttatgtttatgattttctgctatacattcatagtcaaaacactcgtacaggcgcagaattccaagagacataaagccatcagagtgattatcgccgtggtgttggtgttcctcgcctgccagatcccacataatatggtgctgcttgtgacagctgccaatctcggaaaaatgaacaggtcctgccaatccgagaaattaatcgggtataccaagacagttacagaggttttggcgtttctacattgctgtttgaatcctgttctctatgccttcatcgggcagaaatttcgtaactatttcctgaagattctgaaagatttatggtgtgtgcgacggaagtacaaaagctccggatttagttgcgctggaaggtatagcgagaatattagccgccagacctcagagacagcagacaacgataatgctagctcctttactatgtag

SEQ ID NO: 182649 - DNA, 1125 bp, Artificial Sequence
  Description of Artificial Sequence: Synthetic coding sequence
atgagcggcgagagcatgaacttcagcgacgtgttcgacagcagcgaggattacttcgtttctgtgaacacgagttactacagcgtggactccgaaatgctcttgtgctccctgcaggaagttagacagttctcaaggctctttgtaccaatcgcatacagcctaatttgtgtctttgggctgctggggaacatcctcgtcgtgatcaccttcgctttttataaaaaagctcgatccatgactgacgtgtatctgctgaacatggccattgcggacatcctattcgtgctcaccttacctttctgggccgttagccatgccactggcgcttgggtgttctccaatgcaacatgcaagctacttaagggaatctacgcaattaatttcaattgcggaatgctgctcctgacttgtatttcaatggaccggtacatcgctatagtacaggccactaagtcgttccgcttgaggtctcgtaccctgcccagaagcaaaattatctgtctggtcgtctggggcctgtcagtgatcatcagctccagcacattcgtattcaaccagaagtacaatacacaagggagcgacgtctgcgaacccaagtatcagactgtttcagagccaattagatggaagctgttgatgttagggttagaactgctcttcgggttttttatacctctgatgttcatgatcttctgttatacctttatcgtgaaaaccctggtgcaggcccaaaattccaagaggcataaggcgatcagggtgatcattgcggtggttctggtttttttggcgtgtcagatccctcacaatatggtactacttgttaccgccgcaaaccttggtaaaatgaaccgaagctgtcaaagtgaaaagctcatcggatacaccaagactgtaaccgaggtgctggccttcctgcactgctgcctgaatccagttctgtatgccttcattggccagaagttccggaattactttctcaagatcctcaaagacctttggtgcgtgagaaggaaatacaaatctagtggcttcagctgtgctgggcggtacagcgagaacataagcagacagacctccgaaaccgccgataatgataacgcatcaagtttcacgatgtag

SEQ ID NO: 182650 - DNA, 1125 bp, Artificial Sequence
  Description of Artificial Sequence: Synthetic coding sequence
atgagcggcgagagcatgaacttcagcgacgtgttcgacagcagcgaagactatttcgtttcagttaatacctcttactactccgtcgattctgaaatgttgctctgctctctccaggaggtcagacagttctcgagactgtttgtgcctattgcatactccctgatttgcgtgttcggccttctggggaatatactggtggtgataacctttgctttctataaaaaggctcggtctatgacagacgtctacctcctcaacatggctatcgccgacatcctgtttgtgctcacactgccgttctgggctgttagccatgctactggagcctgggttttctccaacgccacgtgcaagcttctgaaggggatttacgccatcaatttcaattgtgggatgcttctgcttacatgcatctccatggatcgctacatcgcaatcgtccaggccacgaagtctttcaggctgcgctcccgaacgttgccgcgctctaagatcatctgtctggtggtctggggactttcagtaataatatcttcttcgactttcgtattcaaccaaaagtacaacacacagggctctgacgtgtgtgaaccgaaatatcagactgtttctgagcctatacgctggaagcttctcatgctcggcctcgaactgttgtttgggttttttattcctcttatgttcatgattttctgctacacttttattgttaagacgctggtacaagcacagaattcgaaacggcacaaagctatccgtgtgattattgctgtggtgcttgtgtttctggcttgtcaaatcccacacaatatggtccttttagtcacagctgctaatctagggaaaatgaataggagttgccagagtgagaaattaattgggtatacaaaaacagtgacagaggtgctggccttcttacattgctgtctgaatcccgtactgtacgcattcatcggtcagaaatttaggaactactttctcaaaatattgaaggatttgtggtgcgtaagaaggaaatataaaagttctggcttctcgtgcgccgggcggtactccgaaaacattagcagacagacctcagagaccgcggacaatgacaacgctagtagtttcacaatgtag

SEQ ID NO: 182651 - DNA, 1137 bp, Artificial Sequence
  Description of Artificial Sequence: Synthetic coding sequence
atggacctgggcaagcccatgaagagcgtgctggtggtggccctgttagtgatcttccaggtgtgtctatgccaggacgaggtcaccgacgactatattggcgacaacaccaccgtcgattataccctttttgaatccctatgttccaagaaagacgtgcgaaattttaaggcctggtttctgccaattatgtatagcatcatctgtttcgtcggcctgctggggaatgggctggttgttctgacatacatttactttaaaagactgaagacaatgacagatacctatctcctcaatctggcggtagcggacattctgtttctgctcaccttacctttttgggcgtatagtgccgccaaatcctgggtatttggagtacacttctgtaagcttatatttgcgatatataaaatgtccttcttctcaggcatgctcctgctcctgtgtattagtatagatcggtatgtggctatcgttcaagccgtcagcgcccaccggcatagagcccgagtactgctgatctccaagctatcctgcgtgggaatctggatcttggcaactgtgctgtctatacccgagctcctgtacagtgatttacagagaagttccagcgagcaggccatgaggtgctcccttattaccgaacatgtggaggcatttatcaccatccaggtggcacagatggttataggctttctagtcccattgcttgcaatgagcttctgctacctggtgatcattagaaccttgctgcaggctcgaaacttcgagcggaataaggcaattaaggttattattgcggtcgttgttgtgtttatcgtgttccagctcccttacaatggtgttgtgcttgctcagaccgtggccaactttaacatcacatcatctacatgcgaacttagcaagcagctcaacattgcctatgatgtcacatactcactggcatgtgtgagatgctgcgtaaacccattcctttacgctttcatcggcgttaaatttaggaacgatctgttcaagctcttcaaagatttagggtgcctgtcccaagagcagctgcggcagtggtcttcctgccggcatatcaggcggagtagtatgagtgtggaggctgaaacaactaccaccttctcaccttag

SEQ ID NO: 182652 - DNA, 1068 bp, Artificial Sequence
  Description of Artificial Sequence: Synthetic coding sequence
atggactacaccctggacctgagcgtgaccaccgtgaccgactactactatcccgatatcttcagttcaccttgtgatgctgaactgatccagacaaatggtaaactgttgctcgccgtgttttactgtctgctgtttgtctttagcttgctgggcaactccttagtaatactggtgctggtggtctgcaagaagctccgcagcattacagatgtttaccttctgaatctagcactatcagatctcttgttcgttttttcatttccttttcaaacgtattacctgctggaccagtgggttttcggcacagttatgtgcaaagtggtatccggtttttactatatcggcttctatagttcaatgttcttcataactcttatgagcgttgatagatacctggccgtggtgcatgctgtgtacgctctgaaggtgcggacgattcggatgggcaccacattgtgtctggccgtctggctgacagcaattatggctacaatcccactgcttgtattttaccaggtggcatctgaggacggggtgctacagtgttacagtttttataatcagcagaccctgaaatggaagatctttacaaactttaagatgaacatcctgggactgctcataccgtttacaatattcatgttttgctatattaagatactccatcagcttaaacgatgtcagaaccacaacaagactaaagcaatccgtcttgttctgattgtcgtgatcgcaagtttactgttttgggtgccgttcaatgttgttttattccttacttctctgcactctatgcacatcttggacggctgctcaatatcccagcaactcacatatgccacccacgtgactgagattataagttttacgcactgttgtgtgaaccctgttatttacgcatttgttggcgaaaagttcaaaaagcacttgtctgagattttccagaaaagctgtagccaaatattcaactatctgggacggcagatgccccgggagtcctgtgaaaagagttctagctgccagcaacactcttccagatcgtctagcgtggactatatcctatag

SEQ ID NO: 182653 - DNA, 819 bp, Artificial Sequence
  Description of Artificial Sequence: Synthetic coding sequence
atgcggaacctgttccggcagatgacctactacctgctggaccagtgggtgttcgggactgtgatgtgcaaagtagtgtcgggcttctactacatcggtttctactcatcgatgttttttattaccctgatgagcgtagatcgatacctcgcggtcgtccatgctgtgtatgctctcaaggttcgtaccataagaatgggaacgaccctctgtctcgctgtgtggttgactgccattatggctaccattcccctgcttgtcttttatcaggttgcctcagaggacggcgtgctccagtgttatagtttctacaaccagcagaccctcaaatggaagattttcactaacttcaagatgaacatattgggcctgcttatccctttcacaatattcatgttttgctatatcaagattttacatcagctcaaacgctgtcagaatcataataagactaaggcaatacgcctggttctgatcgtagtcattgcatctttgcttttctgggtgccgttcaatgtggtattatttctcacgtccctccacagcatgcacatacttgacggatgttctattagccagcagttgacgtatgctactcacgtaacggagatcatttcattcactcattgctgcgttaatcctgttatctacgcattcgtaggcgaaaaatttaaaaaacatctaagtgagatcttccagaaatcatgtagccagatcttcaattatctaggccggcagatgccgcgggagagttgcgaaaaaagctcctcttgccagcagcatagctctaggtccagctccgttgattacatcttgtag

SEQ ID NO: 182654 - DNA, 1074 bp, Artificial Sequence
  Description of Artificial Sequence: Synthetic coding sequence
atggccgacgactacggcagcgagagcaccagcagcatggaggactatgtgaattttaattttactgacttttactgcgaaaagaacaacgtcaggcaattcgcatctcacttcctgccaccactatactggctcgtgtttattgttggtgctctagggaattctttggtcatcttggtgtattggtattgtacccgggtgaagaccatgacagacatgttcctgctgaacctggcgattgccgacctgttatttttggtgacactccccttctgggccattgctgccgctgatcagtggaaattccagacattcatgtgcaaagtcgttaatagtatgtataagatgaatttttactcttgtgtgctgcttataatgtgtattagcgtcgacagatacatcgcaatcgctcaggcaatgcgagcccatacctggcgagagaaacggctgctatattctaagatggtatgttttaccatttgggttctggctgctgcattgtgtataccggaaatcctgtatagccaaataaaagaggagtctggaattgccatttgcactatggtttacccctccgacgagagcacaaaactgaagagcgccgtcctcaccctgaaggtaatcttgggattttttctccccttcgtggttatggcttgttgctataccattatcatccatactcttatacaggctaaaaagagctcaaaacacaaagccttgaaagtgaccatcactgtgctgactgtgtttgtgctcagccagttcccatataattgtattctcctggtccaaaccatagacgcatacgctatgtttatctccaactgcgctgtgagcaccaacatcgatatttgtttccaggtgacgcaaacaattgccttctttcattcatgcctgaatccagttctttacgtctttgttggcgagcggttcagaagggatttagtaaagaccctcaaaaacctggggtgtatcagccaggcccaatgggtctctttcacccgaagagaaggttccctcaagttgtctagtatgctgctagaaacaacgtctggcgcgctgtctttgtag

SEQ ID NO: 182655 - DNA, 1110 bp, Artificial Sequence
  Description of Artificial Sequence: Synthetic coding sequence
atgacccccaccgacttcaccagccccatccccaacatggccgacgactatggcagtgaatccaccagttctatggaggactacgtaaacttcaacttcactgatttctactgtgagaagaacaacgtgcggcagttcgcgtcacattttctgccaccactgtattggctcgtatttatcgtcggagccctggggaacagtctggtgatattagtgtattggtactgtactcgagtcaagacaatgaccgacatgttcctgctgaacctcgcaatagcagatctgctattcctggtaaccctacctttctgggccatcgctgctgccgaccaatggaagttccaaacctttatgtgcaaagtggttaactctatgtacaagatgaatttttacagttgcgtcttgctgattatgtgtattagcgttgacagatatatcgctatcgcgcaggctatgcgcgcgcacacttggagagagaagaggctcctttacagcaaaatggtttgctttaccatatgggttttggcagcagctttgtgtattccggaaatcctttactcacagattaaagaggaatccggtattgcaatatgcaccatggtctacccctctgatgaaagcacaaaactgaagtctgccgttctgactctgaaagtgattctcggatttttcttgcctttcgtcgtgatggcctgctgctatactatcattattcatacattgatacaggcaaagaagagctccaagcataaagcattgaaggtcactattactgtgttgaccgttttcgtgctgtcacagttcccctacaattgcattttgttagtccagacgatagacgcttatgccatgtttatctctaattgtgccgtctcaacaaatattgatatttgtttccaagtgacacaaactatcgcgtttttccactcctgcctaaatcccgtcttatacgtgtttgtgggagagagattccgtcgtgatctagttaaaaccctgaagaaccttggttgtatctcccaggcacagtgggtgagttttacacgtcgcgaggggagtctgaagctttcctctatgcttctcgagacaactagcggtgccctgagcctgtag

SEQ ID NO: 182656 - DNA, 1074 bp, Artificial Sequence
  Description of Artificial Sequence: Synthetic coding sequence
atggccgacgactacggcagcgagagcaccagcagcatggaggactacgtgaacttcaattttaccgacttttactgtgaaaaaaacaatgtgaggcaattcgccagccatttcttacccccactgtattggctcgtcttcatcgtcggtgcgctggggaactccctggtgatcctcgtctactggtattgtacgcgggtgaaaacaatgactgacatgttcctgctgaaccttgccattgcggacctgctgtttctagttaccctgcccttctgggcgatagcagccgctgatcagtggaagttccagaccttcatgtgtaaagtcgtgaattccatgtataaaatgaatttttactcctgtgtgctgttgattatgtgcatttcagtcgaccgctacatcgccatcgcccaggctatgcgggcacatacatggcgagaaaagcgtctcctgtattctaagatggtatgttttaccatttgggtcctcgcggccgcactgtgcatcccagaaattctttactctcaaattaaggaggaatccggtatcgccatctgtacaatggtctacccatcagacgaatctaccaagctgaaatccgctgtgctgacactcaaagttattctgggtttctttctaccatttgttgtgatggcgtgctgttacactatcatcatacacactctcattcaggccaagaagagtagcaaacacaaagcactgaaggtcactataacggtgttgactgtattcgtgctctcgcaattcccatataactgtatcttgttggtccaaaccatcgatgcctatgcgatgttcatcagtaactgtgctgtctccactaatatagatatttgttttcaggttacccagacaatagcttttttccattcttgcctcaatccggtgctctatgtgttcgtgggagagcgtttccggagggatctggttaagactttaaagaatctgggttgtatctctcaagcccaatgggtgtcctttaccagacgggaggggtccttgaaactctcttccatgctcctagagactacaagcggcgctttatccctgtag

SEQ ID NO: 182657 - DNA, 1053 bp, Artificial Sequence
  Description of Artificial Sequence: Synthetic coding sequence
atggccctggagcagaaccagagcaccgactactactacgaggagaatgaaatgaatggaacatacgattactcccagtacgagcttatatgtatcaaagaggacgtcagagaattcgccaaagtatttcttcccgtcttcctgaccatcgtgttcgtcataggactggctggcaacagcatggtggtagccatctacgcctattacaaaaaacagaggactaagactgatgtgtacattctgaatctggctgttgcggatctgctcctgctcttcactctgccattttgggccgtaaatgccgtgcacgggtgggtgcttggtaaaattatgtgtaagattacctctgccctttacacgttaaactttgtttcaggcatgcagtttttggcatgtatttctatcgataggtatgtcgctgtgacaaaagtcccaagccagtccggcgtgggaaagccttgttggattatctgcttctgtgtttggatggccgccatcctgctatccattccccagcttgtgttctataccgtgaacgacaacgcccgttgtattcccatctttccccggtacttgggtactagtatgaaggccctgatacaaatgctcgaaatctgcattggctttgtggttccgtttctgatcatgggggtgtgttattttatcaccgcaaggacacttatgaagatgcctaacatcaagattagtcggccgctgaaggtgcttttgacggttgtgatcgtctttatcgtgacccagctgccatataacatcgtgaagttctgcagagcaatcgatattatttattctttgattacttcatgtaatatgtcgaagagaatggatattgcgatccaagtgaccgaatcgatcgccttgttccactcgtgcctgaacccaatcctctatgtatttatgggcgcaagctttaagaactacgttatgaaggttgcaaagaagtacggttcctggaggaggcagcgccagtctgtcgaggagtttcccttcgatagtgagggcccgacagaacccacgtctaccttctccatctag

SEQ ID NO: 182658 - DNA, 825 bp, Artificial Sequence
  Description of Artificial Sequence: Synthetic coding sequence
atggccctggagcagaaccagagcaccgactactactacgaggagaacgagatgaatggcacttatgattacagccagtatgagctcatttgcatcaaggaagatgtcagggaatttgcgaaggtcttcttacccgttttcctgacgattgtgtttgtgatcggcctggccgggaacagcatggtcgtcgccatatatgcgtattacaagaaacagagaacgaagaccgatgtatacatcctgaatctcgccgtcgcggatttgctcctgctttttaccctgccattctgggcggttaatgctgtgcacggctgggtgcttggcaagattatgtgcaaaattacatctgcactctacaccctaaacttcgtatccggaatgcagttcctggcctgcatcagcattgacaggtatgtggcagtcaccaaagtaccttcacagagcggggtgggcaagccttgctggattatctgtttctgcgtgtggatggccgctatattgctctctatcccccagctggttttctataccgtgaatgataatgcaagatgtattcccatctttcctagatatctgggaactagcatgaaggctcttatccagatgttggagatctgtattgggttcgtcgttccattcctgataatgggcgtttgctattttatcaccgcccgcacactcatgaagatgccaaatattaagatttcacgtcctctgaaggtgctgctcacagtggtcatagtgtttatcgtcacccagctacctttcgcctggatccatatgaatgacgccttcccctccaataaaacctccgccttattctag

SEQ ID NO: 182659 - DNA, 1071 bp, Artificial Sequence
  Description of Artificial Sequence: Synthetic coding sequence
atgatctacacccggttcctgaagggcagcctgaagatggccaactacacgttagctcccgaagatgagtacgatgtgctcatcgagggggaattagaatcggatgaggcagagcagtgcgataaatacgacgcccaggcactgtcagcccagctggtaccaagcctgtgcagcgccgtgtttgtgattggcgttctggataatctcctggtcgtgttgatcctcgtgaagtacaaagggctgaagagagtggagaacatatacctgctgaacttggctgtgtcaaatctctgctttctgctcacactacccttctgggctcatgccggcggcgacccgatgtgcaagatcttgattggtctgtacttcgtcggcctgtatagcgagaccttcttcaactgtctgctgaccgtgcagaggtatctcgtgttcctgcacaagggtaatttctttagcgctcggagacgcgtgccttgcgggatcataacatcggtcctggcatgggtgaccgcaattttagccacgctccccgagttcgtggtctataagccccagatggaggaccaaaaatataagtgcgcgttcagtcgcaccccgttcctgccggcggatgagactttctggaagcacttcctcacactgaagatgaacataagtgtgctggtgttgcccttatttatatttacgtttctgtatgtgcagatgcgcaaaaccctcaggttccgagaacagagatactccctgtttaagctggtgttcgcaattatggtggtctttctcttgatgtgggccccatacaatattgctttttttcttagcacattcaaggaacatttctccctgtctgattgcaagtcatcctacaacctggacaaaagcgtacacattacgaagctcatcgcgacgactcactgctgcattaatcccctgttgtatgcgtttctagacggtaccttctcaaaatatctgtgcaggtgctttcacctccgttccaacactcctctccaacctcgcggtcagtctgcgcagggcactagtcgcgaagagcccgaccacagtactgaagtgtag

SEQ ID NO: 182660 - DNA, 1035 bp, Artificial Sequence
  Description of Artificial Sequence: Synthetic coding sequence
atggccaactacaccctggcccccgaggacgagtacgacgtgctgatcgagggcgagttggagagcgacgaagccgaacagtgtgacaaatatgatgcccaggccctgtccgctcagctggtgcccagcttgtgcagcgccgtcttcgtcatcggcgtcctagataatctacttgtggtgctgatcctggtcaaatacaaaggactgaagagggtagagaacatctatcttctgaatctcgctgtgtccaatttatgttttctactcacgctgcctttttgggctcacgctggtggagatcccatgtgcaagatacttatcggcctctatttcgtgggcttatactcagaaactttctttaactgtctactgaccgtgcagcgctacctggtattcctccacaaaggtaatttcttctccgcccggcgccgagtgccgtgtggtatcattacgagtgtgctggcatgggtgaccgccatacttgcaaccttacctgaatttgtcgtgtacaagccacaaatggaagaccagaaatataaatgcgctttctctagaacgccttttctacctgccgatgagacgttctggaaacattttctcactctgaaaatgaatatctccgtcctggtgctcccactgtttattttcaccttcctgtatgtgcagatgcggaagaccttgcgcttccgcgaacagaggtatagcctgttcaagctggtgttcgccataatggttgtgttcctgttgatgtgggccccttacaatattgcctttttcctaagtaccttcaaggagcacttctctctgagcgattgtaaaagctcctataaccttgataagtcggttcacatcactaaactcatagccacaacccattgctgtatcaatccactgttgtacgctttcctcgacggcaccttttcaaagtatctctgccgctgcttccatcttcgcagcaacactcctcttcaaccacgagggcaatccgcccagggaacctctagagaggagcccgatcactcaacagaagtgtag

SEQ ID NO: 182661 - DNA, 1035 bp, Artificial Sequence
  Description of Artificial Sequence: Synthetic coding sequence
atggccaactacaccctggcccccgaggacgagtacgacgtgctgattgagggggaactcgaatcagacgaggcagagcaatgcgacaaatatgatgcccaggcgctcagtgcccagctggtgccctcgctttgttccgcggtcttcgtgatcggagtgctggacaatctgctggtcgtcttaatcctggtcaagtacaagggactgaagcgggtagaaaatatttacctgctcaacctggctgtgagcaatctgtgcttcctcctgactctgcccttctgggctcacgctgggggcgacccaatgtgtaagattctgatcgggttatacttcgtgggcctctattccgagacgttttttaactgtttactcacagtgcaaaggtatcttgtgtttttacacaagggcaatttctttagcgctcgcaggagggtgccctgcggcatcatcacgagcgtacttgcctgggtgactgcaattctagccacccttcctgagttcgtagtctacaagccccagatggaagaccagaagtataagtgcgccttcagtagaacccccttcctcccggcggatgagaccttctggaagcatttcctgaccctgaaaatgaatatctccgtccttgtgttgcccctattcatctttacctttctctacgtgcagatgcgcaaaaccctcagattcagggaacagcgctattctctctttaagctcgtcttcgctattatggttgtttttctgctgatgtgggcaccgtacaatatcgcattcttcctctcaacctttaaggaacattttagtctctcagactgcaaaagctcctacaacctagataagtcggtacacattacaaagctcatcgccacgacacattgctgtattaacccgctgctttatgcctttttggatggcactttttcaaagtatctgtgtagatgctttcacctcagatccaatacccccctccaacctcgggggcagagcgcccaaggcacctctagggaggagcctgaccattccactgaagtctag

SEQ ID NO: 182662 - DNA, 1035 bp, Artificial Sequence
  Description of Artificial Sequence: Synthetic coding sequence
atggccaactacaccctggcccccgaggacgagtacgacgtgctgattgagggggagttagagtcagacgaagctgagcagtgtgacaaatatgacgcacaagccctttcagcgcaacttgtaccgtcactctgtagcgctgtattcgtgattggggtgctggacaatctcctagtcgtgttaatccttgtgaaatacaaggggctgaagcgagtagagaatatttatcttctaaacctagcagtatccaatctgtgctttctccttaccctgcctttttgggcgcacgcggggggcgatcccatgtgcaagatactgataggactgtacttcgtgggtctgtacagcgaaacattttttaattgcctcctgactgtgcagcggtatcttgtgttcctgcacaagggtaacttcttctctgcccggcgtagggtgccatgtggtatcatcacttcggtgctagcctgggttactgcaattctggcgactctgcccgaatttgtcgtttacaaaccacagatggaggaccagaaatacaaatgtgcatttagtagaaccccatttctgcctgcggacgagacattctggaaacatttcctgacactcaaaatgaacatttcagtgctggtattgccgctgtttatttttacctttctgtacgttcaaatgaggaagacccttaggttcagggagcagcggtactcattgttcaaattggtttttgctattatggtggtctttcttctgatgtgggccccttataacatcgctttttttctgtccacgtttaaggagcatttttctctctccgactgcaagtcatcgtataacctggataagagtgtccatataaccaagctaattgccactacacattgctgtataaacccactcctgtatgcatttctggacgggacattctcaaagtacttgtgcagatgcttccatctgaggtcgaatacccctttacagccacgagggcagagcgcacagggcacgtccagagaagagccagatcactccacagaagtttag

SEQ ID NO: 182663 - DNA, 654 bp, Artificial Sequence
  Description of Artificial Sequence: Synthetic coding sequence
atggccaactacaccctggcccccgaggacgagtacgacgtgctgattgagggtgaactggagtccgacgaggctgagcagtgtgacaagtacgacgcgcaggcactgtcagctcagctagttccaagtctctgctcagctgtgttcgtcataggcgtgctggataacctcctggtggtgctgatactagtgaaatacaagggccttaagcgcgtcgaaaacatttatttgctgaaccttgctgtgtccaacctctgcttcctgctgaccttgcccttttgggctcacgcaggaggcgaccccatgtgtaagatattaattggtctgtacttcgtgggcctctattccgagacattcttcaattgcctcctgactgtccaaaggtacttagtgttcttgcacaagggcaactttttctcagccaggcgaagagtgccctgcgggatcatcacatccgtactggcctgggtgaccgcaatacttgcgaccctgcctgagttcgtggtctacaagccacaaatggaagatcagaagtacaaatgcgcctttagccggactccatttctccctgccgatgaaaccttctggaagcactttctaacattaaaaatgaacattagcgtgctcgtgctgccactttttatctttacctag

SEQ ID NO: 182664 - DNA, 1194 bp, Artificial Sequence
  Description of Artificial Sequence: Synthetic coding sequence
atggcccccatcagcctgagctggctgctgcggctggccaccttctgccatcttacagtccttctggcgggacagcatcacggcgtaactaaatgtaacattacctgctcaaaaatgaccagcaaaattcccgtcgcgcttctgatccattaccaacagaatcaggccagctgtggcaaacgcgctattatactcgagaccagacagcacagactcttttgcgccgatcctaaggagcagtgggtcaaagatgccatgcagcatttggaccggcaggccgcagctctaactcgtaacggcggcactttcgagaaacaaattggagaagtgaaacctaggaccacccccgcagccggaggcatggatgagagcgtggtcttggagccagaggcaactggggaaagctctagcctggagcccacgccatccagtcaagaagctcagcgtgctctgggcacaagccctgagctgcccactggagtgacaggatcttccggaacccgcctgcctcccacccccaaggcacaagacgggggccctgttggcacagagttgtttcgggtgcctcccgtgtctacagccgcgacatggcaaagttccgccccccaccagccgggaccctctttgtgggcggaagccaagacaagtgaagccccaagcacacaggatccttcaacgcaagcctctacggcatcatctcccgctcccgaagagaatgcaccttcagagggtcaacgggtgtggggacagggccagtccccacggcccgaaaactctctggagagagaagagatggggcccgtgcccgcacacactgatgctttccaggactgggggcctggttctatggcccacgtatctgtcgtccctgtatcaagcgagggtacaccgtcccgagaaccagttgcctcaggctcctggactccaaaggcagaagaacccatccacgctacaatggatccccagcgcctcggagtcctgatcacaccggtcccggacgctcaggcggctaccagacgccaagctgttgggctattggcttttctcggtctgctgttctgcctgggagtcgccatgtttacttaccaatctctgcaaggctgtccacgcaaaatggctggcgagatggcagagggccttcgatatatcccccgatcttgtggttcaaactcctatgtccttgtgcctgtgtag

SEQ ID NO: 182665 - DNA, 1164 bp, Artificial Sequence
  Description of Artificial Sequence: Synthetic coding sequence
atgcgggagcccctggaggccttcaagctggccgacctggacttccggaagtccagtctggcgtccggctggcgaatggccagcggtgccttcactatggaccagttccctgagtccgttactgaaaattttgagtacgacgacctcgcagaagcttgctacatcggagacattgtcgtcttcggaacagtcttcttatctattttctatagtgtcatttttgcaatcgggctggtgggcaatttactcgtggtcttcgcgctcaccaattctaagaagcctaagtctgtgacggacatttacttgctcaacttggccctgtctgaccttttgttcgtggcaactttaccattttggacacactacctgattaacgagaagggacttcacaacgctatgtgtaagtttaccacagcctttttctttattggcttcttcggcagtatatttttcattacagtgatttctatcgatcggtacctcgcaattgttttagcagcaaattctatgaacaaccgaactgtccaacacggagtcacgatttcattgggtgtgtgggccgctgccatccttgtggcagctccccagttcatgttcaccaaacaaaaggagaatgaatgtctcggcgattatcccgaagttttacaggagatttggcctgtattgagaaatgtcgagacaaactttttggggtttctgctgcccttgttgattatgtcctattgttatttcaggattatccagaccctcttttcttgtaaaaatcataagaaggctaaggcgattaagctcattctgcttgtggtgattgtcttcttcctcttctggaccccttataatgtcatgatctttctcgaaaccctcaagctctacgacttctttcctagctgcgatatgcgtaaagacctgcgcctggctctgtctgtgaccgagaccgtggcttttagccattgctgtctgaatccgcttatttacgcgttcgccggcgagaagtttagacgctatctgtatcacctatacggcaaatgccttgccgtcctgtgcgggcggtctgtacacgttgatttcagtagctcagaatcacagcgttctagacacggatcagttttgagctccaattttacatatcatacatcggacggggatgccttactgctcctgtag

SEQ ID NO: 182666 - DNA, 1068 bp, Artificial Sequence
  Description of Artificial Sequence: Synthetic coding sequence
atggaccagttccccgagagcgtgaccgagaacttcgagtacgacgacctcgcagaagcttgctacattggcgatatcgtagtgtttgggactgtcttcctgtctattttctactctgttattttcgccattggacttgtgggtaatctgctggtagtgttcgcattgaccaactctaagaaacctaagtcagtgaccgatatctatctgctgaacctggcgctttcagacctgctcttcgttgctacactgcccttctggactcattacctcattaacgaaaagggtctgcacaacgccatgtgcaaattcaccactgcatttttttttatcggatttttcggatccattttttttatcacggtgatttccatcgaccgctatctggccatcgtgttagccgccaattccatgaacaaccgaactgtgcagcacggagtgactattagcttaggggtatgggcagctgctatcctcgtcgcagccccacagtttatgtttaccaagcaaaaagaaaacgagtgcctgggggattaccctgaagtgctgcaggagatttggccagtgctgcgcaatgtggagaccaatttcttggggttcttactgccactgctcatcatgagctactgttacttcaggattatccagactttgttttcttgtaagaatcacaagaaggccaaggctattaagcttatcttgctggtcgtgattgtcttctttctcttttggactccttataacgtgatgatcttcttagagacacttaagctgtacgactttttcccatcttgcgacatgcgcaaggacctgcgcctggcactgtccgtaactgagacggttgcttttagtcactgttgcctaaaccctctgatctacgccttcgccggagagaaatttagaagatatctgtaccatctgtatggcaaatgcctcgctgtgctgtgcggtcggtcggtccacgtggatttttccagttctgagagccagaggtccaggcatggttcagtactgagcagcaacttcacttaccacacctctgatggcgatgctctcttactcctgtag

SEQ ID NO: 182667 - DNA, 321 bp, Artificial Sequence
  Description of Artificial Sequence: Synthetic coding sequence
atggaccagttccccgagagcgtgaccgagaacttcgagtacgacgacttagctgaggcgtgctatattggcgacattgtggtattcggaacagtgtttttgtcaatattttattccgtaatattcgctataggactggtgggaaatctgttggtcgtattcgccctgactaacagcaaaaaacctaaatctgtgactgacatctatctgctcaatctggcactgagcgacctgctgttcgtggccacccttcccttctggacgcactacctaattaacgagaagggtttgcacaatgcgatgtgtaaattcactacatag

SEQ ID NO: 182668 - DNA, 501 bp, Artificial Sequence
  Description of Artificial Sequence: Synthetic coding sequence
atggaccagttccccgagagcgtgaccgagaacttcgagtacgacgatctggcagaagcttgctatattggggatatcgtggtgttcgggactgtgtttttaagcattttctatagcgtgatatttgctataggcctggtgggcaatctcctcgtggtatttgcgctcacgaatagtaaaaagccaaaaagtgtcaccgatatctacctactcaacttggcactgagtgacttgctttttgtagcaacgttacccttttggacccactacctgattaacgagaagggcctccataatgcgatgtgtaagttcaccactgccttcttctttatcggcttcttcggctcgatctttttcattactgtgatcagcatagacaggtacctggccatcgtgcttgccgcaaatagcatgaacaaccggacggttcagcacggtgtgacaatcagtctgggagtgtgggcggccgccatcctggtggcagcgccccagttcatgtag

SEQ ID NO: 182669 - DNA, 1092 bp, Artificial Sequence
  Description of Artificial Sequence: Synthetic coding sequence
atggccagcggcaaggccttcaccatggaccagttccccgagagcgttaccgaaaattttgagtatgacgatcttgctgaggcttgttacattggagacatagtcgtctttgggaccgttttcctgagtatattttactcagtcatcttcgccatcggactcgtgggtaatctgctcgtggtcttcgctttgacgaactcaaagaaacctaagtccgttacagacatatacctgctgaatctggcgctctccgacctgctattcgtggcgacattaccattctggactcattacctgatcaacgagaagggcctgcataatgctatgtgtaaatttacaaccgccttcttttttatcggcttctttggctccatcttcttcatcactgttatttccattgacagatacttagcaatcgtgctggctgccaactcgatgaacaaccgtaccgtgcagcatggcgttaccatttctctgggagtgtgggccgctgcaattttggtggccgcccctcagttcatgttcacaaagcagaaagaaaatgaatgtcttggagattaccctgaggtattgcaagagatatggcctgttctgcgcaatgtggaaacaaacttcctgggctttcttttacctctcctgataatgtcttattgttacttcagaattattcagaccctgttctcctgtaaaaatcataagaaggctaaggccataaagctcatccttttagtggtgatcgtgtttttcttattttggaccccctataacgtcatgatcttcctggagaccctcaagttgtatgactttttcccctcctgcgacatgcgcaaagacctgagactcgctttatctgtgaccgagactgtggctttcagtcactgttgccttaatcccctaatttacgcgttcgccggggagaaattccgtcgatacctctaccacttatacggaaagtgcctggccgtgctctgtggccggagtgtgcacgtcgactttagctcaagtgagagtcagcgaagtagacatggtagcgtgttaagcagcaacttcacctatcataccagcgatggtgatgccctcttactgttgtag

SEQ ID NO: 182670 - DNA, 1068 bp, Artificial Sequence
  Description of Artificial Sequence: Synthetic coding sequence
atggaccagttccccgagagcgtgaccgagaacttcgagtacgacgacctggccgaggcctgttatatcggtgatatcgtcgtgttcggtaccgtgtttttaagtatcttctactccgtaatcttcgccatcgggctggtgggtaatctgcttgtagttttcgccctcacaaattcaaagaaaccgaaaagcgtgaccgacatttacctgctgaacctggcattatcagatctgctgttcgtcgccaccttgcccttctggacacattatctgatcaatgaaaaaggactccacaacgcaatgtgtaagttcacgaccgcctttttcttcattggtttctttggttccatttttttcatcacagtcatcagcatcgatcgttacctggcgattgtgttagcagccaattccatgaataatagaactgtccagcacggagtgacgatttcgctgggcgtgtgggccgctgctattcttgtcgctgcgccgcagtttatgttcacgaaacagaaggaaaatgaatgtttaggcgattatcccgaggtgctccaagaaatttggccggtgctccgcaacgttgagactaatttcctagggtttctgctgcccctcctgataatgtcatactgctatttccgaattatccaaactctgttcagctgcaaaaatcataagaaggcaaaggcaattaagctgatcctacttgttgtgatcgtgttctttctcttctggactccctataatgtaatgatcttcctagagacactcaagctgtatgacttttttcccagttgcgacatgcgcaaggacttgagacttgcactcagcgtcaccgagacagtcgctttcagccactgctgcttgaacccactgatatatgcctttgccggagaaaaattcagacgctacctttatcacttgtacggcaaatgtctggcagttctgtgtggtagaagtgtccacgtggacttttccagttccgaatcccaacgatcacggcacgggtccgtcctgtcttctaatttcacatatcatacctcggacggcgacgccttactgctgttgtag

SEQ ID NO: 182671 - DNA, 1068 bp, Artificial Sequence
  Description of Artificial Sequence: Synthetic coding sequence
atggaccagttccccgagagcgtgaccgagaacttcgagtacgacgatcttgctgaggcttgttacatcggcgacattgtagtgtttgggactgtttttctatcaatcttctactcagttatctttgctatcggactggtggggaacctcctcgtcgtcttcgccttgactaacagtaagaaacccaaatccgttaccgatatatacctgttgaacctggcactttccgatctgctatttgtcgcaaccctgcctttctggacccattacttgattaatgagaagggcctacacaatgccatgtgcaaatttactaccgctttcttcttcattggattcttcggcagcattttttttatcacagtcatttcaattgatcgttatctggccatcgtgctagctgcaaactctatgaacaacagaaccgtgcaacatggagttacaatttccctcggcgtgtgggcagccgccattctggtcgcggcccctcaatttatgtttacaaaacagaaagagaacgagtgtctgggtgactaccctgaggtgttacaagagatttggcccgtgctgcggaacgttgagacaaattttctcggttttttattgcccctcctaatcatgtcctattgctactttaggatcatccagaccctcttttcgtgtaaaaatcacaaaaaggccaaggctattaagcttatcctccttgtggtgatcgtatttttccttttctggaccccatataacgttatgatatttttggagacactgaaactatacgacttcttcccgtcctgcgacatgcggaaggatctgcgactggctctttccgtcactgagacagtcgcttttagtcattgctgcttgaacccgttaatctacgccttcgctggggagaagtttcgcagatatctttaccacttgtatggcaaatgcctggctgtgctttgcggacggtccgttcatgttgattttagttctagtgagtctcagaggtccaggcatggttcagtgttaagtagtaacttcacctaccacacctcagacggcgacgctctccttctcttatag

SEQ ID NO: 182672 - DNA, 324 bp, Artificial Sequence
  Description of Artificial Sequence: Synthetic coding sequence
atggcccgggccgccctgagcgccgcccccagcaacccccggctgctcagagtggccttactgcttctgctgctcgtagccgcggggagaagggcggctggcgcctctgttgccacagaactccgttgtcagtgtctccagactctgcagggcattcacccaaagaacatccagagtgtgaatgtgaaaagcccgggacctcattgtgcccagaccgaggtgattgccaccctgaagaatgggaggaaagcttgtttaaaccccgcgtcgccaatcgtcaagaagattatcgaaaagatgcttaactcagacaaatccaattag

SEQ ID NO: 182673 - DNA, 285 bp, Artificial Sequence
  Description of Artificial Sequence: Synthetic coding sequence
atgagcgtgaagggcatggccatcgccctggccgtgatcctgtgcgcaaccgtcgtgcagggttttcccatgttcaagaggggacgatgcttgtgtatcggccctggcgtgaaggccgtaaaagtggctgatatcgaaaaggctagtataatgtatcctagtaataattgtgacaagattgaagtcattattacccttaaggagaacaaaggccagcgctgtctcaatcctaagagcaaacaggccagactgataattaagaaagtcgaaagaaaaaacttctag

SEQ ID NO: 182674 - DNA, 285 bp, Artificial Sequence
  Description of Artificial Sequence: Synthetic coding sequence
atgagcgtgaagggcatggccatcgccctggccgtgatcctgtgcgctaccgtggtccaggggttccccatgttcaagcggggaaggtgcctgtgcatcggtcccggcgttaaggccgttaaggtggccgacatcgaaaaagccagcattatgtatcctagcaacaattgtgataagatagaagtgattatcaccctgaaggagaacaagggtcagagatgcctgaatcctaagtccaagcaggcaaggctgattatcaagaaagtggaaagaaaaaacttttag

SEQ ID NO: 182675 - DNA, 336 bp, Artificial Sequence
  Description of Artificial Sequence: Synthetic coding sequence
atgagcctgctgccccggcgggccccccccgtgagcatgcggctgctggccgccgccctgctgctgttacttcttgccctgtataccgcgcgagttgacggctccaaatgcaaatgttcgcggaagggcccaaagatccgatactccgatgtcaagaaactggagatgaaaccaaagtatccacattgtgaagagaagatggtgattatcacaactaagtccgtaagccgatataggggccaggaacattgccttcacccaaaactccagtccacgaagagattcataaagtggtacaacgcttggaatgagaagagacgcgtgtatgaagaatag

SEQ ID NO: 182676 - DNA, 300 bp, Artificial Sequence
  Description of Artificial Sequence: Synthetic coding sequence
atgcggctgctggccgccgccctgctgctgctgctgctggccctgtacacagcacgtgtggatgggtcaaaatgcaaatgctcgcgcaaaggacccaagataagatactctgatgtcaagaagttggagatgaagcctaaataccctcactgtgaagaaaagatggtgatcattaccaccaagtctgttagcagataccgggggcaagagcattgtctccatcctaagttgcagtccacaaagcggtttatcaaatggtataatgcatggaatgaaaagaggcgcgtgtatgaggaatag

SEQ ID NO: 182677 - DNA, 822 bp, Artificial Sequence
  Description of Artificial Sequence: Synthetic coding sequence
atgagcggcagccagagcgaggtggcccccagcccccagagccccagaagtcccgagatgggcagggacctccgccccgggagcagagtgctgctgctcttgctgctcctcctgcttgtgtacctcacacagcccggaaacggcaacgagggctctgttactggctcctgctactgcggcaaacgaattagcagtgattctcctccctcggtccagtttatgaaccgcttacgtaaacatctccgagcatatcatcgatgcctatactatacacggttccaactcctctcctggagcgtatgcggcggaaataaggacccctgggtccaggagctcatgtcgtgtctggaccttaaggaatgcggacatgcttacagcggtatcgtagcccaccagaaacacttattaccaaccagtcctcccatttctcaggcctccgagggagcgagcagcgatatccacacacctgcccaaatgctgctttctaccctgcaatcgacacagcgaccgacacttcccgtgggatcactgagctctgacaaagagctcacgcggccaaatgaaactaccattcatactgcaggtcactcactcgccgccggtccagaggcaggggaaaatcagaagcaacccgaaaaaaatgccgggcctaccgcccgtacctccgcgacagtgccagttctctgtctgctagctatcatattcattctgactgccgccttatcctacgtgttatgtaagcggcgcagggggcagagtccacagtcttcaccagaccttccagtccactatatccctgtggcccccgacagtaacacctag

SEQ ID NO: 182678 - DNA, 822 bp, Artificial Sequence
  Description of Artificial Sequence: Synthetic coding sequence
atgagcggcagccagagcgaggtggcccccagcccccagagccccagatccccagagatgggcagggacctgcgccccggctcacgagttttattgcttctcctactcctgttacttgtgtatcttacacagccaggtaacggaaatgaaggctctgtgactggttcttgctactgtggcaaacgaattagcagcgattcacccccatcagtgcagtttatgaatcgtctcaggaagcacttgcgggcatatcaccgatgtctgtactacacacggttccagctgctcagctggagcgtgtgcgggggtaataaggacccctgggttcaggaactcatgagttgtctagacctgaaggagtgcggtcatgcttactctgggatcgtagcccaccagaagcaccttctcccaactagtccccctatctcgcaagcctccgagggtgcatccagtgacatccatactccagcccagatgctgttgtctacgctgcagtcgacccagagaccaacattgcctgtgggctcccttagctcagacaaagagcttactaggcctaatgaaaccaccatacacacagctgggcactcactcgctgctggccctgaagccggggagaatcagaaacagcctgagaaaaacgccggacccactgccagaacaagcgcaacagtgcccgttctgtgcctcctagcgatcatcttcatcctcactgcagccctctcatacgtgctgtgtaaaaggcgaagaggccagtctccccaaagctcccccgatctacccgtccactacattccggtggctcctgacagtaacacatag

SEQ ID NO: 182679 - DNA, 360 bp, Artificial Sequence
  Description of Artificial Sequence: Synthetic coding sequence
atgaaggtgctgatcagcagcctgctgctgctgctgcccctgatgctgatgagcatggtgtctagcagcctgaaccctggcgtagccagaggtcaccgagaccgaggccaggcgtcaagacgctggctccaggaaggcggtcaagagtgtgaatgcaaggattggttcctgcgcgcacctagaagaaagtttatgacagtctccggcctgccaaaaaaacaatgtccctgcgatcatttcaagggtaacgtgaagaagacccggcatcaacggcaccataggaaacccaacaaacatagcagggcctgtcagcagtttcttaagcagtgtcagttgcggtcgtttgccctccctctatag

SEQ ID NO: 182680 - DNA, 360 bp, Artificial Sequence
  Description of Artificial Sequence: Synthetic coding sequence
atgaaggtgctgatcagcagcctgctgctgctgctgcccctgatgctgatgagcatggtatcgagtagccttaaccccggcgttgctcgcggccaccgcgaccgcggccaggcctcccgtaggtggcttcaggaggggggtcaggagtgcgagtgtaaagactggtttctcagagccccccgacggaagttcatgacagtatcaggactgccaaagaagcagtgcccctgcgatcactttaaaggcaacgtgaaaaagacacgtcatcaacgccaccaccggaaacctaacaaacatagcagagcttgccagcagtttttaaagcagtgtcagctcagatcttttgcccttccactgtag

SEQ ID NO: 182681 - DNA, 324 bp, Artificial Sequence
  Description of Artificial Sequence: Synthetic coding sequence
atggcccgggccaccctgagcgccgcccccagcaacccccggctgttacgggttgcactgctgctactgttattggtagcagcttcacggagggcggcaggggctccactcgctaccgaactgcggtgccagtgtttacagacactgcaggggatccatctcaagaatatccagtctgtgaaagtcaagagcccagggccacactgcgcacagaccgaggtcatcgccacactcaaaaatggccaaaaggcctgtttgaaccctgcttcgccaatggtaaaaaagatcatcgagaagatgttaaaaaatgggaaatccaattag

SEQ ID NO: 182682 - DNA, 324 bp, Artificial Sequence
  Description of Artificial Sequence: Synthetic coding sequence
atggcccacgccaccctgagcgccgcccccagcaacccccggctgctacgcgttgctctcctgctgctccttctcgttgccgcctcacgcagagccgctggtgcatccgtagtgacagaacttcgatgtcaatgcttacagactctccagggaatacacctgaaaaatattcagtctgtgaatgtaaggtctccaggtccccactgtgctcagacagaagttattgcaactttgaaaaacggcaaaaaggcatgtctgaatcccgcctcaccaatggttcagaaaatcatagagaagatcctgaacaagggaagcacgaactag

SEQ ID NO: 182683 - DNA, 345 bp, Artificial Sequence
  Description of Artificial Sequence: Synthetic coding sequence
atgagcctgctgagcagccgggccgcccgggtgcccggccccagctcaagcttgtgcgctttgctggtgcttctactcttgcttactcagccaggccccattgcctccgccggccctgccgccgccgtgcttagagaactgcggtgtgtctgcctacaaaccacacagggtgttcaccctaagatgatttctaatttgcaggtgttcgcaatcggcccccaatgcagcaaggtggaggtcgttgcgtcgctgaaaaacggcaaagaaatttgtttagatcccgaagctcctttcctcaaaaaagtgattcagaagatcctggatggcggaaacaaggaaaattag

SEQ ID NO: 182684 - DNA, 1053 bp, Artificial Sequence
  Description of Artificial Sequence: Synthetic coding sequence
atgagcaacatcaccgacccccagatgtgggacttcgacgacctgaattttactggtatgcccccagccgacgaagactactcaccctgcatgctagaaactgaaaccctcaataaatacgtggtgataatcgcgtacgctctggtgttcctgctgagcttattgggcaattctctggttatgctggtcatcctttactcgagggtggggcggtctgtgactgacgtttacctgttaaacctggcactggccgatctcctgttcgctctaaccctcccaatctgggccgccagcaaggtgaacggatggatctttggaacttttctctgtaaagtggtgagcctgctgaaagaggttaacttttatagcggcattctcttactggcctgtataagcgtcgaccgttacctggccatcgtccacgcgactcgcacacttacccaaaagaggcacctcgtcaaatttgtttgcttggggtgttggggactgagtatgaatctttcgctgccctttttcttgttccgccaggcttaccatccaaacaactcgtctccggtctgctatgaagtcctcggaaacgacacagccaagtggcgtatggtcttacggatcctcccacacacttttggcttcattgtccctctattcgtcatgctgttttgctatggattcactctgaggactctatttaaggcccacatgggccagaagcaccgcgccatgcgcgtcatcttcgccgtagtgctcatttttcttctctgttggctgccatacaatcttgtgcttcttgccgacactctaatgcgcacccaggtgattcaagaatcctgcgaaaggagaaacaacatcggacgtgcactggacgcaacggagatcttaggattcctccacagttgtttgaaccccatcatctatgcttttatcgggcagaactttagacatggatttttaaaaatcttggccatgcatggcctcgtgtcaaaagaattcctggcccggcaccgcgtgacttcttatacttcctctagcgtgaacgtgtcttccaacttatag

SEQ ID NO: 182685 - DNA, 885 bp, Artificial Sequence
  Description of Artificial Sequence: Synthetic coding sequence
atgagcaacatcaccgacccccagatgtgggacttcgacgacctgaatttcaccgggatgccaccagcagacgaagactatagcccttgtatgctcgagaccgagactctaaataagtacgtggtgattattgcctacgccctggtattcctcttatctttgttgggcaactcactggtgatgctggtcattctctattctcgggttgggcggagtgtcaccgacgtgtatttgctaaatctagccattgtccacgcgactcgcactctcacgcagaagcgccacttggtaaagttcgtgtgccttggatgctggggactgagcatgaatttgtctctgccctttttcctcttcagacaggcataccaccccaacaactcttcacccgtttgctatgaggttctggggaatgacaccgccaaatggaggatggtactgaggattttgccccatactttcggcttcattgttcccttatttgtgatgctcttctgttacggattcacactcagaaccctgttcaaggcacatatggggcaaaaacaccgcgcaatgagggtcatcttcgccgtagtcttgatctttttattgtgttggctaccctataatctcgtcctgctggcagatacgcttatgaggacgcaggtcatccaagagtcctgtgagagaaggaacaatattggcagggcgcttgatgctaccgagatcctcggattcctgcactcatgtctaaatccgattatctacgcttttattggccagaacttccgccacggttttttaaaaattctggcgatgcacggactggtatcaaaggaattccttgcccgccaccgcgtaacatcctatactagcagctctgtgaacgtgtcatccaacctctag

SEQ ID NO: 182686 - DNA, 804 bp, Artificial Sequence
  Description of Artificial Sequence: Synthetic coding sequence
atggtgctggaggtgagcgaccaccaggtgctgaacgacgccgaggtcgcagcgctcctggagaatttttcgtcctcttacgactacggtgagaatgagtccgactcttgctgtactagccccccatgtccccaagatttttccctaaacttcgatagggcctttcttcccgcgctttactctttgctgttcctgctgggactgctcggtaatggagccgttgctgctgtgctcctttctcgacgaaccgcccttagtagcaccgacacatttctgctccatctggccgtcgcagatactctgctagtgctgactctgcctttgtgggccgtcgacgctgctgtgcagtgggtatttgggtctggtctgtgcaaagtcgcaggtgccctctttaacatcaacttctatgccggggcactccttctcgcctgtatttcctttgacaggtaccttaacatcgtgcacgccacacagctgtaccggagagggcctcctgcccgcgttaccttgacctgtctggcggtgtgggggctctgcctgttatttgccctgcctgacttcatcttcctgtcagcacaccacgacgagaggctcaacgcgactcattgccagtacaactttccccaaggctccagctctggatctggctgcggatgctgctcctgcgcttgggcagccccgacccgggagggatccaggggaagtcaccgcctgcccgccggaattcatcctggcctgcgcccccagaggcctcccaccagagcttgcgaagccggcatccgagcccccctctcacccacgtag

SEQ ID NO: 182687 - DNA, 1248 bp, Artificial Sequence
  Description of Artificial Sequence: Synthetic coding sequence
atggagctgcggaagtacggccccggccggctggccggcaccgtgattgggggcgcagcccaatccaaaagccaaacaaagagcgactctataacaaaggaattcctcccgggactctacaccgctccatcatccccctttcccccctcccaagtgagtgaccaccaggtcctaaacgacgctgaggtggccgcgctgttggagaatttctcctccagctacgactatggcgaaaacgaatcggactcttgctgtacttcacctccatgcccccaggacttcagcctgaacttcgatagagcctttctcccggccctgtatagtcttctattcctcctcggcttgctcggcaatggcgcggttgcggctgtcctgctgtccagaaggacagctctgagtagcaccgataccttcctgttgcatctggccgtggctgataccttactcgtgctgacactccccctgtgggctgtggacgcggccgtacagtgggtattcggttcaggtctctgtaaggtcgcaggcgcgctttttaacattaacttttatgcaggggctcttctccttgcatgtattagctttgacagatatttgaacatagttcatgccacccagttataccgacgcggcccccctgcaagagtcacacttacttgccttgcagtctggggactgtgcctgctgtttgctctccccgacttcatctttttgtcagcccatcatgacgagaggctgaacgcaacccactgtcaatataactttccacaagtcggaagaaccgcactacgagttctacagctggtggccgggtttctgctacccctgctggtgatggcctattgttacgctcacatccttgcagtgctgctggtatcccgtgggcaaagaaggctaagagctatgagactggtggtggtagttgtagttgcattcgcgttgtgttggacaccttaccatttggttgtgctggtggacattctcatggacttgggggcccttgctagaaactgcggtcgcgaatccagggtcgacgtcgctaagagcgtgaccagcggcctgggctacatgcactgctgcctgaaccctttgctttatgcctttgtgggggtaaagtttagggagcgcatgtggatgctgctactgcgcttgggttgccctaaccaacggggcctccagcgccaaccaagctccagtcggcgagactctagttggagtgagacatctgaggcctcttatagcggattatag

SEQ ID NO: 182688 - DNA, 1107 bp, Artificial Sequence
  Description of Artificial Sequence: Synthetic coding sequence
atggtgctggaggtgagcgaccaccaggtgctgaacgacgccgaggtggccgcattactggagaatttttcaagctcatacgattacggcgaaaatgagtccgactcctgttgcacatcaccaccctgtcctcaggacttttccctcaattttgacagggctttcctgccagccctgtactccctgctgtttctcttggggctgcttggtaatggtgccgttgcagccgtgttactgagtaggaggactgccctctcctccaccgataccttcctgctgcacctcgccgtcgccgataccctactggtgttgaccctccctctgtgggccgtggatgcagctgtgcaatgggtcttcgggtctggactgtgtaaggtcgcgggtgccttattcaatattaacttctacgctggcgctctgctgctggcctgcatctcctttgatcgatatctaaatatcgtacacgccacacagctgtaccgtagaggaccacccgctcgagtaactctcacatgtcttgccgtttggggcctgtgtttgctcttcgcgttgccagactttattttcctgtcagcccaccacgatgaacgcttgaacgctactcactgccaatacaatttccctcaagtgggaagaaccgctctccgggtcctccagctggttgctggatttctgctacctcttctcgtgatggcttactgctacgcccacatcctggccgtcttgctagtgtctagaggtcagaggcggctcagggcgatgaggcttgtggtcgtggtggttgtggcttttgccctatgttggacaccttaccacttggtggttttggtcgatatcttgatggatctgggcgctctagcccggaactgtggtagggagagtcgtgtagatgtggccaagtccgtaacttcaggtctgggctatatgcactgttgcctcaacccccttctgtacgccttcgtcggagtcaaattccgggagcgcatgtggatgctgctgcttcggctgggctgccctaaccagcggggcttacagcgccagcctagttcttctcgtcgcgacagcagctggtctgagacctctgaggcgtcgtactcaggactatag

SEQ ID NO: 182689 - DNA, 1119 bp, Artificial Sequence
  Description of Artificial Sequence: Synthetic coding sequence
atgaactaccccctgaccctggagatggacctggagaacctggaggatctgttctgggagttagacaggctggataactataatgacaccagtctggtcgagaaccacctctgtcccgccactgagggccccttgatggctagctttaaggcggtcttcgttcctgtcgcctattctcttatcttcctgctgggggtgattggaaacgtgctggtgctggttatcctggagaggcatcggcaaaccaggtcctccacggagaccttcttgtttcatctggccgtggctgacctactcttggtgttcatcctccctttcgccgtcgctgaaggaagcgtcggatgggtgctaggtacctttctatgtaaaaccgtgatcgctttgcacaaagtaaatttctattgttccagcttactcttagcttgcattgctgtcgataggtacctagcgattgttcatgctgtgcatgcctatagacacaggcgcctccttagtatccatatcacatgtggtacaatatggctcgtcggttttttactggccctgccggagatcctgtttgccaaagtgtcgcagggtcatcacaataattccctgccaagatgtacctttagtcaggaaaaccaggcagagacgcacgcgtggttcaccagccgctttttgtaccatgtggccggatttcttctccccatgttggtgatggggtggtgctacgtcggcgtggttcaccgcctcaggcaagcccagcggcgaccgcagagacagaaggccgtgcgggttgccattcttgtcactagtatcttttttctctgttggtccccttaccatatcgtgatcttccttgacacactcgctcgtctgaaagccgtcgacaacacgtgtaaacttaatgggtctctgcctgtagcaattacaatgtgtgagttcctgggtctggcccactgctgtttgaaccccatgctgtacacttttgctggggtgaaattccgctcggatttaagtaggctgctcactaaactcggctgcactggccccgcctctctatgccagttgttccctagctggcgaaggtcgagcctgagtgagtccgaaaacgcaacttccctcactacgttttag

SEQ ID NO: 182690 - DNA, 1029 bp, Artificial Sequence
  Description of Artificial Sequence: Synthetic coding sequence
atggccgagcacgactaccacgaggactacggcttcagcagcttcaacgactccagccaggaggagcaccaagattttctgcagttttccaaagtcttcctcccttgcatgtatctcgtggtgtttgtttgcggcctggtgggaaactccctggtacttgtcattagcattttttaccataaacttcagtcactcacagacgtgttcctggtgaacctgcccctcgccgatctggtatttgtgtgtactctgcccttttgggcctacgcgggtatccacgagtgggtgtttggacaggtaatgtgtaagtccctgctgggcatttatactatcaatttttacaccagtatgctaatcctcacttgtatcacggtggaccgcttcattgtggttgtgaaagccacgaaagcttacaaccagcaggccaaacggatgacatgggggaaagtcaccagtctgctgatttgggtgatttctctcctggtgagtctgccccagattatttatggcaacgtgtttaacttagataaactgatatgcggataccatgacgaggccataagtactgtggtattagctactcagatgacactgggatttttcctcccactgctcacaatgattgtgtgttactctgtgattataaagacactgctccatgcaggcggctttcagaaacacagatctttgaagattatcttcctggtcatggccgtctttctgctgacgcagatgccctttaacctgatgaaattcatcagaagcactcactgggagtactatgccatgacctcgtttcactatacaattatggtaactgaggccatcgcctatctgagagcgtgcctgaacccagtgctgtatgccttcgtgtcactgaagtttcgaaaaaatttctggaaacttgtcaaagacataggatgcctgccctacctgggggtgagccatcagtggaaaagttcggaagataattcaaagacattctccgcctcacataacgtggaggctacgagtatgtttcagctttag

SEQ ID NO: 182691 - DNA, 1029 bp, Artificial Sequence
  Description of Artificial Sequence: Synthetic coding sequence
atggccgagcacgactaccacgaggactacggcttcagcagcttcaacgattcctcacaggaagaacaccaggacttccttcaattttctaaagttttcttgccatgcatgtatctggtggttttcgtgtgcgggctggtgggcaactctttagtgctagtgatttcaattttctatcacaagcttcagtccctgactgacgttttcctcgtgaacttgcctcttgccgacctggttttcgtctgcacgctccccttctgggcctatgcaggcatacacgagtgggtattcggacaagtaatgtgcaagtccctccttggcatctataccatcaatttctatacaagcatgctgatcctgacgtgcatcaccgtcgataggttcatcgtggtggttaaggccacaaaggcatataaccagcaagccaaacgcatgacatggggcaaagtgacaagcctactgatctgggtgatttcacttcttgtctctctaccacaaatcatttatggtaatgtttttaacctggacaaactgatttgcggatatcacgatgaagccatctcaacggttgtcttggcaacacaaatgactctgggattcttcctgcccttactgactatgattgtctgctattctgttattattaagaccctgctgcacgctggtgggtttcagaagcacagatctctcaaaatcatcttcttggtgatggcagtatttctcctgacacaaatgccatttaacctgatgaagttcataagatctactcattgggagtattacgcaatgacctccttccattatacgattatggtcacggaggcaatcgcctacttgagggcatgtcttaaccctgtgttatatgcatttgtttctcttaaattcaggaaaaacttttggaagctggtgaaagacattggatgccttccatatttgggggtgtctcatcagtggaagagtagcgaagacaatagtaagactttctctgcgagccacaatgtggaagctacatccatgttccagctgtag

SEQ ID NO: 182692 - DNA, 1029 bp, Artificial Sequence
  Description of Artificial Sequence: Synthetic coding sequence
atggccgagcacgactaccacgaggactacggcttcagcagcttcaatgatagtagtcaggaggaacatcaggacttcctgcagtttagcaaggtgttcctgccgtgtatgtatttagtggtgttcgtgtgcggactggttggtaactctctagttttggttatctctatattttaccacaagttgcagtctctaactgacgtgtttttggtgaatctgcccttggctgacctagtgttcgtctgtacgttacccttttgggcatatgctggtattcatgaatgggtcttcggccaggtaatgtgtaaatcacttctcgggatctacacaatcaatttctatacatctatgcttatcctcacctgtataacggtggatcgcttcattgttgtcgtgaaggccactaaagcgtataatcagcaggccaaaaggatgacttggggtaaggtgactagtctcctcatctgggtgatcagcctgcttgttagcctccctcagatcatctacggaaatgtgttcaaccttgacaagctcatatgcggctatcatgatgaagctatctccaccgttgtcctggcaactcaaatgacattaggattctttctgccactgctgacgatgattgtctgctattccgtgattatcaaaactcttctgcatgctggcggctttcaaaaacaccgcagcctgaagatcatcttcctcgtgatggccgtgttcctgctaacacagatgccatttaatcttatgaaattcattagaagcactcattgggaatattatgccatgacaagtttccattatacgatcatggtgactgaagctatcgcttacctcagggcatgtctaaatccagtcctgtatgcttttgtatctttgaaattcaggaagaacttttggaagctggtaaaggatatcgggtgcttgccctatctcggggtgagccatcagtggaaatcctccgaggacaattcaaagacgttctctgcctcccacaacgtagaagctacttctatgtttcagctgtag

SEQ ID NO: 182693 - DNA, 1029 bp, Artificial Sequence
  Description of Artificial Sequence: Synthetic coding sequence
atggccgagcacgactaccacgaggactacggcttcagcagcttcaacgattcctctcaggaggagcaccaggactttctacagttttccaaagtctttcttccgtgtatgtacttggtcgtgttcgtgtgcgggcttgttggcaatagtctggtgttagttatctcaattttctatcacaagctccagtccctgacggacgtgtttctagtaaatctgccgctggctgatctcgtgtttgtgtgcaccctgcccttctgggcttatgctgggatccacgagtgggtgttcggtcaggtcatgtgcaagagtttgctgggcatttacacaatcaatttttacacttcaatgctgattctcacctgcatcaccgtggaccgatttatcgtggtggtgaaggcaacaaaagcctacaatcagcaggctaaacgcatgacatggggcaaagttacgagtctgcttatatgggtgatttccttactggtgagtttgccccaaattatttacggcaatgtgtttaatttagataagttgatctgtggctaccacgacgaggccatttcaactgtggtgcttgcaacgcaaatgacacttggattttttctaccgctgctcactatgattgtctgttactctgtcattataaaaactctgcttcacgcaggtggattccagaagcaccggagtctgaaaattatattcctcgtgatggcggttttccttttgactcagatgcctttcaatctgatgaagttcatccgatccacacactgggagtactatgcaatgacatcatttcactataccatcatggtgactgaagcaatcgcatacttgagagcctgtctgaaccccgttttgtacgccttcgtgtcattgaagtttcggaagaatttttggaagctggtgaaagatattggctgtctgccgtatctgggagtatcgcatcagtggaaaagctccgaagataacagcaagactttttcggccagtcacaacgtcgaagcaacatccatgtttcagctctag

SEQ ID NO: 182694 - DNA, 1089 bp, Artificial Sequence
  Description of Artificial Sequence: Synthetic coding sequence
atggacctgcacctgttcgactacagcgagcccggcaacttcagcgatatatcctggccttgcaactccagtgactgtatcgtagtggacactgtaatgtgtcctaacatgcccaataaatcagtgctgctgtacacactctccttcatttatatttttatcttcgtgattggcatgatagctaattctgtggtcgtgtgggtgaatatacaggccaagaccacaggctacgacacgcactgctacatactcaacctggccattgctgacctctgggtcgtcctgacaataccggtctgggtggtatcattagtgcagcacaaccagtggccaatgggcgagctcacatgcaaggtgacccaccttatcttcagtattaacctgttcggctccattttttttctgacatgcatgagcgttgatcgatacctgagcattacttattttactaacacaccctccagccgtaaaaagatggtgcggagagtagtatgtatactcgtctggttgctcgccttctgcgttagtctgccagatacatattacctaaagaccgtgacaagcgcgagcaataatgagacctattgtaggagtttctaccccgagcattcaatcaaggagtggctaataggaatggaactcgtttccgttgtcctcgggttcgccgttcccttttccatcatcgctgtgttctattttctgttggcacgcgcaatttcggcttcttctgaccaggagaaacactcatctagaaaaattatctttagctatgtggttgtgttcctcgtttgctggcttccttatcatgtagccgttctcctggacattttcagtattctgcactacataccattcacctgcagactggaacatgcacttttcacggccctacatgtgacacagtgcctcagcctcgtgcattgctgtgtgaatccggtgctgtattcctttataaacaggaattaccggtacgagctgatgaaagctttcatcttcaaatactctgcaaaaaccggacttactaagctgatcgacgcgtctcgcgtgtctgagacagaatactcagcacttgagcagagcactaagtag

SEQ ID NO: 182695 - DNA, 636 bp, Artificial Sequence
  Description of Artificial Sequence: Synthetic coding sequence
atggacctgcacctgttcgactacagcgagcccggcaacttcagcgatattagttggccatgcaactctagcgattgtatcgttgtggacaccgtgatgtgtccaaatatgcctaataagagcgtgctgctttataccctgtctttcatctatattttcatcttcgtaattggcatgatcgccaacagcgtcgtagtatgggttaacatccaggctaagaccacgggatacgacactcactgttacattttgaaccttgcaatcgcagatttgtgggtcgtactgactattccagtttgggttgtgtccctggtccagcataaccagtggccgatgggcgagctgacctgtaaagtgactcaccttattttttccataaatctctttggttccatcttttttctgacttgcatgtcagttgaccgctacttatccatcacttacttcacgaatacacccagcagccggaaaaaaatggtgcgacgagtggtatgtatcctagtgtggctgttggccttctgtgtcagtttgcccgacacctattacctgaagacagtcacgagcgcctctaacaatgaaacgtattgccgctcattctaccccgagcacagtattaaagagtggctgatcggatag

SEQ ID NO: 182696 - DNA, 1155 bp, Artificial Sequence
  Description of Artificial Sequence: Synthetic coding sequence
atggccgccaccgccagcccccagcccctggccaccgaggacgccgactctgaaaattccagcttctattactatgattatctcgacgaagtcgcttttatgctttgccgtaaggacgctgtagtgtcttttggcaaagtgttcctgccagtgttctactcccttatctttgtgctggggctgtcagggaatttgctgctcctgatggtccttcttcggtacgtccccagacgaaggatggtcgaaatttacctcctcaatctcgcaatcagcaatctcctgtttcttgttaccctgccattttggggcatttccgtcgcctggcactgggtcttcggttcttttctgtgcaagatggtttccacattgtatacaatcaacttttactctgggatattcttcatctcctgcatgtcgctggacaagtatttggaaatcgtacacgctcagccttaccatcgacttcgcacccgagccaagtccctgctgctggctaccatcgtatgggctgtgtcgttggcggtgtcaatccccgatatggtatttgtacagactcacgaaaatcccaagggcgtctggaactgccacgctgatttcggtgggcatggcacaatttggaaactgtttctacgcttccaacaaaatctgctcggttttttgttgcctctccttgccatgatcttcttctacagcaggatcgggtgtgtacttgtcaggttgagacctgcgggtcaggggagagctctgaagatcgcagctgcactcgtcgtggcttttttcgtgctgtggttcccttacaacctgaccttgtttcttcatactttgttagacctgcaggttttcggtaactgtgaggtgtcccagcacctcgattacgctctacaggtcaccgaatctattgcctttttgcactgttgcttcagccctattctgtacgctttttcttctcaccgtttcagacagtacttgaaagctttcttagcagctgtgttgggatggcacctagcccctggaactgcccaggcttcactgtcttcatgctcggagtctagtatcctgacagctcaggaagagatgactgggatgaatgatctgggcgaacgccaaagcgaaaactaccccaataaggaagacgtaggcaacaagtctgcctag

SEQ ID NO: 182697 - DNA, 1155 bp, Artificial Sequence
  Description of Artificial Sequence: Synthetic coding sequence
atggccgccaccgccagcccccagcccctggccaccgaggacgccgacagtgagaacagtagcttttactactatgattacctcgacgaggtcgcctttatgctgtgccgcaaggacgccgtagtctcttttggcaaggtgttcctgccagtgttttactcactcatatttgtcctgggcctttcagggaatctacttctgctgatggtgctcctgcgttatgtccccaggagacgtatggtcgagatctacttgctcaacctagctatctcaaacctcttatttctggtgacactacccttctggggaatctctgtcgcatggcactgggtctttggatcgttcctgtgtaagatggtatcaactctctacaccataaacttctacagtgggatcttcttcatctcctgtatgtcactcgacaaatacctcgaaattgtacacgcccagccctatcacaggttgagaacacgggccaaatccttactgctggccacaatcgtgtgggctgtttctctcgccgtgtctattcccgatatggtgtttgttcaaacacacgaaaatccgaagggcgtgtggaactgtcatgctgactttggtggtcacggaaccatatggaaactgttccttcgattccagcaaaatctgctgggcttcttgctccctctcctcgctatgatatttttttacagtcgtatcggctgcgtgctagtccggctaaggccagctggccaaggacgcgcattgaaaatcgcagctgcactagtggttgcctttttcgtgctctggtttccatacaacctgaccctcttcttacacacactgctggacctccaagtgttcgggaattgtgaggtatcccagcaccttgactacgctctacaggtgactgaaagcatagcctttctgcattgttgcttctccccaattttatatgctttttccagtcaccgtttcaggcagtatttgaaggccttcctcgcagcggtgctgggctggcacctggcacctgggactgctcaggcaagcctgagcagttgttcagagagttccatcctgacagctcaggaggagatgaccgggatgaacgacctgggagagaggcagagtgagaactatccgaataaggaggatgttggaaataaatctgcctag

SEQ ID NO: 182698 - DNA, 1155 bp, Artificial Sequence
  Description of Artificial Sequence: Synthetic coding sequence
atggccgccaccgccagcccccagcccctggccaccgaggacgccgactccgaaaactcctccttctactactatgactacttggacgaagttgcatttatgctctgtcgaaaagacgcggtagtctccttcggtaaagtattcctgccagtcttttactccctgatttttgtgcttgggctgtctgggaacctgctcctgctaatggtgctcttgcgttatgtgccacgcagacgaatggtggagatttatctgttgaatctggctatcagcaacctcctgtttctggtaacactgcccttttggggcatctctgtagcgtggcattgggtgttcggtagcttcttgtgtaagatggttagcacgctgtacaccatcaatttctactctggtatcttctttatctcctgtatgtctctggataagtatctggagatagtccacgcccagccataccatcggctcagaaccagggcgaagagtctcctgctcgccaccattgtatgggctgtcagtctggccgtatctattcctgacatggtctttgtgcagacccatgaaaacccgaagggggtctggaattgtcatgctgatttcggcggccatggaaccatttggaaacttttccttaggtttcagcagaacctcctggggttcctgctgccacttttggcaatgatctttttttatagccgaatcggatgtgtcctggtgaggcttaggcctgccggccagggacgggccctgaaaatcgcagccgctctcgttgtggcattttttgtgctgtggtttccttataatctgactctcttcttacacactttgctggacctccaagtgtttggcaattgcgaagtctcccagcatttagactacgccttgcaggtgacggaatccatcgccttcttgcattgttgcttttctcctatactctatgctttttcttcccacagattcaggcagtatttaaaagctttcctggctgccgtgctaggttggcacctagctcccgggacggctcaggcgtccctctccagctgttcagaatcttcaattctgaccgcacaggaggagatgacgggaatgaatgacctgggggaaaggcaatctgagaactatccgaataaggaggatgttgggaataagagtgcgtag

SEQ ID NO: 182699 - DNA, 1122 bp, Artificial Sequence
  Description of Artificial Sequence: Synthetic coding sequence
atgcggatggaggacgaggactacaacaccagcatcagctacggcgatgagtaccccgattatctggactctatcgtcgttctggaggacttgagcccccttgaggctagagtcacacgcatttttctggtggtggtctactccatcgtgtgttttctcggtatcctaggcaacgggttggtgataatcatcgctacatttaaaatgaaaaagactgtgaacatggtgtggttcctgaacctcgctgtcgccgatttcctgttcaacgtctttctgcccattcatataacctacgcagcaatggactatcactgggtctttgggacagccatgtgtaaaataagcaatttcttgctaatccataacatgtttacctcagttttcctactgactattatcagctctgataggtgcatttcagttttgctgccagtttggtctcaaaaccaccggagcgttagattagcttatatggcctgcatggtgatctgggtgctggcattttttctgagctccccaagtctagtatttcgggacactgccaatctccatggaaaaatatcatgctttaataacttcagtctgagcacacccggatcttcttcgtggcctacacactcccagatggacccagtcggatattctagacacatggtcgttactgtaacccggttcctgtgcggttttctggtgccggtgctcattataaccgcgtgttacctcacaattgtctgtaagttgcaaaggaacaggctcgctaagacgaaaaaacccttcaaaatcattgtgactattatcatcacattctttctgtgctggtgtccttaccacactctcaatctcctcgaactgcaccacacggcaatgccgggttctgtctttagtcttggtcttccattggcaaccgcattggccatcgccaatagttgcatgaatcctatcctgtacgtgtttatggggcaggatttcaaaaaatttaaggtcgccctgttcagccggctcgttaatgctttatctgaagacacagggcatagctcatacccatcccataggtcattcaccaaaatgtcttctatgaatgagagaacatccatgaatgagcgcgagaccgggatgctgtag

SEQ ID NO: 182700 - DNA, 1116 bp, Artificial Sequence
  Description of Artificial Sequence: Synthetic coding sequence
atggaggacgaggactacaacaccagcatcagctacggcgacgagtatcctgactacctagactctatcgtagtgctcgaggacctgtcccccctcgaggctcgtgtcacacgaatcttcctggtagtagtttatagtatcgtctgcttcttgggcatactgggcaacggactcgttataataattgcgaccttcaagatgaagaaaacagttaatatggtttggtttctgaatctggccgtggccgatttcctctttaacgtattcctgccaatccatattacatacgctgcaatggactaccattgggtgtttgggaccgctatgtgcaaaataagcaatttcttgctaatccataatatgtttacttcggtgttcctcctcactattattagttccgatcgttgtatttctgtcctgctgcccgtgtggtcccagaatcacaggtctgtcagactggcgtacatggcgtgcatggtaatctgggttcttgcattttttctgtcctctccctctctcgtgttccgagacactgccaatctccacggaaagatctcctgctttaacaattttagtctgtctacacctgggagcagctcctggccaacccactctcagatggacccagtcgggtatagcaggcacatggtcgtgactgtgacacgatttttatgcggctttttggtgcccgtactgataatcacagcctgttacctcacaatcgtttgtaaattacagcgaaataggctggcgaagaccaaaaagcccttcaaaattatcgtgacaatcatcattacttttttcctttgctggtgtccttaccatacattaaacttgctggaattgcatcacactgccatgccggggagtgtattttccctgggtttgcccctcgcaaccgcacttgccattgcgaatagttgcatgaaccctatcctctatgttttcatgggtcaggatttcaagaaattcaaagtggctctgttctcgcgacttgttaacgccctttcagaggacactggccactcctcatacccctcacatcgctcatttactaaaatgagctcgatgaacgagagaacctccatgaacgagcgcgaaacaggaatgctatag

SEQ ID NO: 182701 - DNA, 1122 bp, Artificial Sequence
  Description of Artificial Sequence: Synthetic coding sequence
atgcggatggaggacgaggactacaacaccagcatcagctacggcgacgaatacccagactacttggattcaatcgtggtattggaggatctgagccccctggaggcgagagtgactaggatcttcctggtggtggtatactccattgtgtgttttctggggatcttaggtaatggccttgtgattattatcgccacctttaagatgaaaaagaccgtaaacatggtctggtttcttaacctcgctgtcgcagatttcctcttcaatgtgtttctccccatacatattacatatgccgccatggattaccattgggtgttcggcaccgccatgtgtaagatctcgaattttttgctgatccataatatgttcacttctgtgtttctgctgactataattagtagtgacagatgtatctctgtgcttctgcctgtgtggtcgcagaaccacaggtcagttcgactggcttatatggcctgcatggtgatatgggtgctcgcgttttttctctcaagcccatccctcgttttccgcgatactgctaacctgcatggcaagatctcatgtttcaacaactttagtctgtccacccccggcagcagctcctggccaactcactcacagatggatcctgttgggtacagcaggcatatggtagttactgtgaccaggtttctgtgtggcttcttggtacccgttttgattatcacagcctgttacctgaccatagtatgtaagcttcagcggaatagactggccaagacaaaaaaaccctttaagatcattgtaacaatcatcattactttcttcctctgttggtgcccttatcacactcttaacctgttggagctgcatcacaccgcaatgcccgggtccgtctttagtctggggctgcctttagctactgccctcgcgatcgcgaatagttgcatgaatcccattctgtatgtgtttatgggtcaggattttaaaaaatttaaggtcgccctcttttctaggctggtcaacgccttgagcgaagatacgggccacagctcttacccctcacacaggagctttaccaagatgtctagcatgaacgaaagaacttccatgaatgagcgtgaaacaggtatgctgtag

SEQ ID NO: 182702 - DNA, 432 bp, Artificial Sequence
  Description of Artificial Sequence: Synthetic coding sequence
atgcggatggaggacgaggactacaacaccagcatcagctacggcgacgaatacccagactatctagacagtatagtcgtgctggaagacctcagccccctggaagctcgtgtaactagaatttttcttgtagttgtttactccatcgtatgctttctggggatcctggggaacggtcttgttattatcatcgccacatttaagatgaaaaagacagtcaatatggtgtggttcctaaaccttgcagtggctgattttctctttaatgtatttctgcccattcacatcacttacgcggcgatggattaccactgggtcttcgggactgccatgtgtaagatttccaactttctactcatccacaatatgtttacaagcgtgttcctgctcaccattatctcctcagataggtgcatctccgtgttgctgtag

SEQ ID NO: 182703 - DNA, 1122 bp, Artificial Sequence
  Description of Artificial Sequence: Synthetic coding sequence
atgcggatggaggacgaggactacaacaccagcatcagctacggcgatgagtacccagactacctcgacagtatcgtcgtcctcgaagatctgtcaccgctggaagccagggttacaagaatatttctggtggttgtgtactcaatcgtatgctttctgggaatcttaggcaacgggctcgtcattatcattgctacgttcaagatgaaaaaaacagtcaatatggtatggttcctcaacttggccgtagccgatttcctgtttaacgtattcctaccaatacatattacttatgctgccatggactaccattgggtcttcggcaccgccatgtgcaagatttcaaatttcctgctgatccacaatatgttcacgagcgtgttcctcctcactattatctctagcgataggtgcatttctgttctcctgcccgtctggagccaaaatcacaggtctgtacgtctcgcttatatggcctgtatggtcatttgggtactggccttcttcttatcttccccttcccttgtcttccgagacactgccaacctgcatgggaagatctcctgctttaacaacttctcactgagcacacccggtagttccagttggcctacacactcccagatggaccctgtcggctacagcaggcacatggtggtgactgtgaccaggtttttatgcgggttcctggtcccagtgcttatcattactgcctgctacctaaccatagtgtgcaaattacagaggaaccgcctcgctaagaccaagaaaccgttcaagattatcgtcacaattatcattacctttttcttatgttggtgcccctatcacactcttaacttgctggaattgcaccacacagccatgcccgggtccgtgtttagtctgggcttgcctctggccacagctcttgctatcgctaattcctgcatgaatcccattctctacgtctttatgggccaagactttaaaaaattcaaagtggctttgttctccagactcgttaatgccctgagtgaggacactggacactcctcttatccgagtcacagaagtttcacgaaaatgtcatctatgaacgaacgaacctccatgaacgagagagagaccggcatgctttag

SEQ ID NO: 182704 - DNA, 444 bp, Artificial Sequence
  Description of Artificial Sequence: Synthetic coding sequence
atgcggatggaggacgaggactacaacaccagcatcagctacggcgatgaataccctgattacctagatagcatagtcgtactggaggacctgtcacccttagaagctcgggttacacgcatctttctggtggtggtttattccattgtgtgcttcctgggcatactgggaaatggattagtcatcattatcgcaacatttaaaatgaagaaaacagtcaacatggtttggtttttaaacctcgcagttgccgactttctgttcaacgtcttccttccaattcacatcacctacgcagctatggattaccactgggtttttggtaccgccatgtgcaagatctcgaattttctgctgatccataatatgtttaccagtgtgtttctgctgacaataattagtagcgatagatgcatctctgtgcttctccccgtgtggagttag

SEQ ID NO: 182705 - DNA, 1116 bp, Artificial Sequence
  Description of Artificial Sequence: Synthetic coding sequence
atggaggacgaggactacaacaccagcatcagctacggcgacgagtaccccgactaccttgactcgatcgtggtcctcgaagatttaagccccctggaggcccgggttacccgcatctttctcgtggtcgtgtactctatagtgtgtttcctcggaatccttggcaatggtctcgttatcataatagcaacatttaagatgaagaaaactgtcaatatggtgtggttccttaatctcgccgtagctgacttcctgttcaatgttttcctccccatacacatcacttacgcagctatggactaccactgggttttcgggaccgccatgtgcaaaatttcaaattttctgctgattcataacatgtttacttccgtcttcctgcttacgatcatttcctctgaccgctgcatctcagtgctccttcccgtttggtcccagaatcataggtccgtcaggctggcttatatggcctgcatggtaatctgggtgctcgctttcttcctgagcagtccttcccttgtcttccgcgatacagccaatctgcatggaaagattagctgttttaataatttctccctgagcaccccgggcagttctagctggcccacccacagtcaaatggatcctgtcggatattcgcgacatatggtcgtgacagtgaccagattcctatgcggatttcttgttccagttctaattatcacagcctgctatctgaccatagtctgtaagcttcagcgtaatcgattggcgaaaaccaaaaaaccctttaagatcatagttaccatcattatcacatttttcctctgttggtgcccctatcacaccctgaacctgctggagttacaccacaccgctatgcctggatccgtgttcagccttggcctgcccctcgctaccgccctggcaattgcgaactcgtgcatgaaccctatactctatgtctttatggggcaggacttcaagaaatttaaggtggccctctttagccgactcgttaacgcgctctccgaggatacgggccactccagttatccttcgcatcgatcttttacaaaaatgtcgagtatgaacgagcgaacgtcaatgaatgaaagggaaacgggcatgctgtag

SEQ ID NO: 182706 - DNA, 1005 bp, Artificial Sequence
  Description of Artificial Sequence: Synthetic coding sequence
atgcccagcaaggagagctggagcggccggaagaccaaccgggccgcagttcacaagtctaagcaggaaggtcgccagcaggacttattgatagctgccctcgggatgaaactggggagtccgaaatcttcagtcactatttggcagccattgaaactttttgcatatagccagcttacgtcgttggtgagaagggctacactcaaagaaaacgagcaaatcccaaagtatgagaagatacataatttcaaagtgcatacctttaggggtccccattggtgcgagtactgcgcaaatttcatgtggggactcatagctcagggcgtgaagtgtgctgactgtgggctgaatgtccataaacagtgttctaagatggtgcccaatgattgcaaacctgacttgaagcacgtcaaaaaggtatacagctgcgatctcaccaccctggttaaggcccataccaccaaacgtcctatggtggtggacatgtgcatccgtgagatcgaatccaggggcttgaattccgaaggactctatagagtgagcggcttctcagatctgatagaagacgtcaagatggcgttcgatcgggacggcgaaaaggcggacatttcggtgaacatgtacgaggacataaatattattaccggagctctcaaactctatttccgtgatctccccattcccctgattacctacgatgcatacccaaagtttatagagtctgccaagattatggatcccgacgagcaactcgaaacactgcacgaagccctaaagctgctgccgcccgctcactgcgaaaccttgcgctatctgatggcgcatctgaagagggtgacactgcatgagaaggagaacttaatgaacgcagaaaacctgggcatcgtgttcggcccaacactgatgcgatcccccgagctcgatgccatggcagcgctcaacgatatcagataccagagactggtcgttgaactgcttattaagaatgaggacatcttattttag

SEQ ID NO: 182707 - DNA, 1302 bp, Artificial Sequence
  Description of Artificial Sequence: Synthetic coding sequence
atggccctgaccctgttcgacaccgacgagtaccggccccccgtgtggaaaagctatctttatcagcttcagcaggaggctccccacccccggcgcataacctgtacatgcgaagttgagaatcgaccaaagtattacggacgcgagttccacggaatgatctctagggaagctgctgaccagctgctgatagttgcagaagggtcttatctaatccgtgagagtcagagacaacccggcacttatactctggctctcaggttcgggtcccaaacccggaactttcggctctactatgatgggaagcatttcgttggggaaaagaggtttgaatcgattcatgacctggtgaccgatgggctgatcaccctgtacattgaaaccaaagctgcggagtacatcgccaagatgacgatcaatccaatatacgaacacgttgggtatacaacattgaatcgcgagcctgcttacaaaaagcatatgcccgtcctaaaggagacgcatgatgagagggactctacgggtcaggacggggtgtctgagaagagggtccacacctttcgcgggcctcattggtgtgagtattgtgccaactttatgtggggactgatcgcccagggtgtaaaatgtgccgactgcggattaaatgtccacaaacagtgttctaagatggttccgaacgattgcaagcctgacttgaagcacgtaaagaaagtgtactcttgtgatctgaccacattggttaaggctcatacaactaagcgccccatggtcgtagacatgtgtatcagagagatcgagtcaagggggctaaattccgaaggcttgtaccgagttagtgggttctctgacctaatcgaagatgtgaagatggccttcgacagggatggtgaaaaggccgatatctctgtcaacatgtatgaggatatcaatatcattaccggcgccctcaagttgtacttcagggatttgccaatacctctgatcacctacgacgcttacccaaagtttatagagtctgcaaaaataatggatcccgacgagcagcttgagactttgcacgaggcgcttaaacttctcccccccgctcactgtgaaaccctgagatatctgatggcccacctcaagagagtcactttacacgaaaaagaaaacctgatgaacgcagaaaatttgggaatcgtattcgggccgactctcatgcggtctccagagctggatgccatggcagcactgaacgatatacgttaccagaggttggtagtggaactgctcatcaagaatgaggatatcctgttctag

SEQ ID NO: 182708 - DNA, 1380 bp, Artificial Sequence
  Description of Artificial Sequence: Synthetic coding sequence
atggccctgaccctgttcgacaccgacgagtaccggccccccgtgtggaaatcttacctttaccagcttcagcaggaagccccacacccacgcaggatcacttgcacatgtgaggtagagaacagaccgaagtactacggaagagagtttcacggaatgatatctcgggaggcggctgatcagctgttaattgtcgccgagggctcctacctgatccgtgaatcccaacggcaacccggaacctacaccctggccctgcgcttcggatcacagacaaggaactttcggctgtactacgatgggaagcactttgtcggcgagaagcgctttgaaagtattcacgatctagtcactgacggtcttataacactgtacattgaaacaaaggccgctgagtacatcgctaagatgaccataaaccccatctacgaacatgtcggttatactactctcaatagggaacccgcctacaaaaaacatatgcctgtcctgaaagagacccacgacgagagagattcgactggacaggacggtgttagcgagaagcgtcttacaagtctggtgaggcgggccactttaaaagaaaacgaacagatcccaaaatatgaaaaaatacataactttaaagtgcatacttttaggggtccccactggtgtgaatactgtgccaatttcatgtgggggctcatagcccagggagtaaagtgcgccgactgtggcttgaatgtgcataagcagtgttctaagatggtgcctaacgactgtaagcctgacttgaagcacgtgaagaaagtgtattcttgtgacctgacaaccctggtgaaggcccacaccaccaaaagacccatggtagtggatatgtgcattagggaaatagaatcaagagggctgaactcagaaggactgtaccgcgtgtctggatttagtgacctaatcgaagatgtgaaaatggcttttgacagggacggtgagaaggccgacatcagcgtgaatatgtacgaagatatcaacataatcaccggagctttgaagctgtatttcagggatcttccaatacctctcattacctatgacgcctatcccaagttcatagagtccgcgaaaattatggaccccgatgagcaattggaaacgctccatgaagctttgaagctcctcccacccgcccattgtgagaccttacgctacttgatggctcatttaaagcgcgtcacactgcacgagaaggagaatctaatgaatgcggaaaaccttggaattgtgtttggtcccactctcatgcgatccccggaattggatgccatggcagccctgaatgatattagatatcaaagacttgtggtagagcttctcatcaagaatgaggacattctgttttag

SEQ ID NO: 182709 - DNA, 1167 bp, Artificial Sequence
  Description of Artificial Sequence: Synthetic coding sequence
atgaccgccagcgtgctgctgcacccccggtggatcgagcccaccgttatgttcttatatgataacgggggtggcctggtggctgacgagctcaacaagaatatggagggtgcagctgccgcggcagccgcagcagctgcagctgctgcagcgggggctggcggagggggtttccctcaccccgccgccgccgccgccggcggcaatttctctgtggccgcagccgctgctgcggctgctgccgctgctgccaaccagtgtaggaacctgatggcccaccccgctccattggctcctggggctgcctcagcttattcatcagcccctggagaagcaccgccgagtgcagctgccgctgctgctgcagccgctgcagccgcagcagctgccgcagccgctagctcctctggaggacccggtcctgcaggtccggcaggcgctgaagccgccaaacaatgcagtccatgcagcgcagccgcccaaagttcatctgggcctgcagcactcccttatggctattttggaagtggctactatccttgtgcgcggatgggacctcaccctaatgccatcaaatcgtgcgcccagcccgcctctgccgccgctgccgccgcttttgcagacaagtacatggatacggctggcccagctgcagaggagttcagcagccgtgctaaggaattcgccttttatcatcagggttatgccgctgggccttaccaccaccaccagcctatgcccggttacttggatatgcccgtcgtacctggactggggggacctggcgaatcgcgccacgagccactggggctgccgatggaatcataccagccctgggcgctgcctaatggttggaatggacagatgtattgcccaaaggagcaggctcaaccaccccatctgtggaagtccaccttgccagatgtggtgtcccacccctcggatgcctctagctaccgcaggggccggaagaagcgcgtaccgtacacgaaggttcagctcaaggagctggaacgggagtatgcgaccaataaatttattacaaaggacaaaaggagacgtatctccgcgactactaacctttccgaaagacaagtgaccatttggttccaaaacaggcgggtaaaggaaaagaaggtgattaataagttgaaaaccacatcctag

SEQ ID NO: 182710 - DNA, 999 bp, Artificial Sequence
  Description of Artificial Sequence: Synthetic coding sequence
atgttcagcgaggagctgtggctggagaacgagaagaagtgcgccgtggtgaggaagtctaaacaaggtcgcaagcggcaggagcttctggctgtagccttcggtgttaaagtgggagtcaaggggggcttcttgtggccaccactgaagctgttcgcctgctcccagatttccagtctagtacgccgggctgccctcactcataacgataaccatttcaattacgagaagactcacaatttcaaagtgcatacattccgggggccccattggtgcgagtactgcgctaactttatgtggggactcatagctcagggagttagatgcagtgactgtggactcaacgttcataagcagtgctcaaaacacgttcccaacgactgtcagccggatctcaagcgcatcaaaaaagtttattgctgcgatcttaccaccctagttaaggcccacaacacccaacgcccgatggtggtggacatttgcataagggagattgaggctagaggattgaagtccgagggcttgtatcgagtgtctgggttcacggaacacatcgaagatgttaaaatggcctttgatcgcgatggtgaaaaagctgacattagcgccaacgtgtaccccgacatcaatattattactggagccctgaagctgtacttccgggatctgcccattcctgtgataacctacgacacctattccaagttcattgatgccgccaagatctcaaatgcggatgagagattagaggctgtccacgaggtgctgatgctgctgccgcctgctcactatgagaccttacgctacttgatgatccacttaaagaaggttactatgaatgagaaagataattttatgaatgcagaaaatctagggattgtatttggtccaaccctcatgcgaccccctgaagacagcaccctaacaactttgcacgatatgagataccagaagttgatcgtgcagatactaatcgaaaacgaggacgtccttttctag

SEQ ID NO: 182711 - DNA, 525 bp, Artificial Sequence
  Description of Artificial Sequence: Synthetic coding sequence
atggccgccagcagcaacagcagcctgagcggcagcagcgtgagcagcgtctatagcgagccgaggagtccaagagaacttccaaagtatgcagaagaataccaaccccccatatggaagtcatacctttaccagctccaacaggaagctcctcggcctaaacgcatcatctgtcccagagaggtggagaaccgccccaagtactacggccgggagttccatggaatcatcagccgagaacaggcagacgagctactgggcggcgtagaaggcgcttatatattgcgcgagtcccagcggcaaccgggatgttacacactggcgctgagattcggaaaccagactttaaattataggctcttccacgatgggaagcattttgtgggagagaagcggttcgaatctatccatgaccttgtaacagatgggctaatcaccctgtacattgagacaaaggcagccgagtacataagtaaaatgacgaccaatccaatctatgagcacattggctacgctaccctgtag

SEQ ID NO: 182712 - DNA, 825 bp, Artificial Sequence
  Description of Artificial Sequence: Synthetic coding sequence
atgttcagcgaggagctgtggctggagaacgagaagaagtgcgccgttgttagaaagtctaagcagggacggaagaggcaagagctgcttgctgttgccttcggcgtgaaagtcggcgtcaaaggcggttttctctggccccccctgaaattgtttgcatgctcccaaattagctctctggttagacgggctgcgctgacacataatgacaatcattttaactacgagaaaacacacaatttcaaagtgcacactttccgcggaccgcactggtgcgagtattgtgccaatttcatgtggggtctgattgcacagggggttcgatgctccggcttaaagtccgagggcctttatagggtttcaggattcacagagcacatagaggatgtcaaaatggccttcgacagggatggagagaaggccgatatcagcgccaacgtctaccctgatataaatatcatcaccggcgcgctgaaactgtattttcgggacctgccgattcctgttatcacttacgacacatatagtaaattcattgatgcagctaaaataagcaatgccgacgagaggctggaggcggttcatgaagttcttatgctgttgccacccgctcattatgaaaccctccggtatctcatgattcacttaaagaaagtcacaatgaacgaaaaggacaatttcatgaacgcggaaaatttggggatcgtattcgggccaaccttgatgcggccacctgaagacagtacactcaccactttacacgatatgagatatcagaagctcatagtgcaaatcctgattgaaaatgaagacgttctcttctag

SEQ ID NO: 182713 - DNA, 864 bp, Artificial Sequence
  Description of Artificial Sequence: Synthetic coding sequence
atgttcagcgaggagctgtggctggagaacgagaagaagtgcgccgttgtccgcaaatcgaagcagggacggaagagacaggaactgctcgctgttgccttcggcgtcaaggttcatacttttcgcggaccacattggtgcgagtactgcgctaatttcatgtggggcctgattgcccagggagtgcggtgctcagattgtgggctgaatgtacacaaacaatgtagcaagcacgttcccaacgattgccagccagacctaaaacgcataaaaaaggtgtactgctgtgaccttaccactttggttaaagcccacaatacccaaagacccatggtggtagacatttgtatccgggaaatcgaggcaagaggtttaaagagtgagggcctttatcgtgttagtggattcaccgagcatatagaggatgtaaagatggcttttgatcgagatggcgaaaaggccgatatcagtgcaaacgtctatcctgacattaacataattactggcgcacttaagctatacttccgggatctgccaatccccgtgattacgtacgatacatattctaagtttattgatgccgcaaagatctccaacgccgacgaacgacttgaggccgttcatgaagtgcttatgctgctccctcccgcacactatgagaccttaaggtatttgatgatccacctcaagaaagttacaatgaacgaaaaggataactttatgaacgcggagaacctgggaatcgtcttcggacctactctaatgaggccgcctgaagattctacactgactaccctgcacgatatgagatatcaaaagttaatcgtgcagatactgatcgagaacgaagacgtgctcttttag

SEQ ID NO: 182714 - DNA, 579 bp, Artificial Sequence
  Description of Artificial Sequence: Synthetic coding sequence
atggccgccagcagcaacagcagcctgagcggcagcagcgtgagctctgacgccgaggagtatcagcctcccatatggaagagctacttgtaccaactacaacaggaagctcctaggcctaaaagaatcatatgccccagagaagtcgaaaataggccgaagtactacggaagggagttccatgggatcatttctagggagcaggcagacgaactgctcggaggagtggaaggagcatacattctccgtgaaagccagcggcaacccgggtgctacaccctggctctccgaaatcccacaaagatttcaaatgctgatgagaggctggaggccgtccacgaggttcttatgctgctcccaccggctcattatgagacattgagatacctgatgattcaccttaaaaaagtgactatgaacgagaaggacaacttcatgaacgcggagaaccttggaattgtgttcggacccactttaatgaggcccccagaagactctactttgacaaccctgcacgacatgaggtaccagaagctcattgtgcaaatcttgattgagaacgaggatgtccttttttag

SEQ ID NO: 182715 - DNA, 861 bp, Artificial Sequence
  Description of Artificial Sequence: Synthetic coding sequence
atgttcagcgaggagctgtggctggagaacgagaagaagtgcgccgtcgtgaggaagagcaagcagggtcgcaaaagacaggaactcctggccgttgcgtttggcgtgaaggtgggtgtcaaagggggcttcttgtggccccctctgaagctcttcgcatgctcccagatttccagcctcgtgcgccgtgcagcactgacgcataacgacaaccacttcaattacgaaaagacccacaacttcaaggtgcacacatttaggggcccgcattggtgcgaatactgtgctaatttcatgtggggcctgattgcacagggcgtgcgatgcagtgactgtggcctgaatgtacataaacagtgcagcaaacatgttcctaatgactgccaacccgacctaaaacgaataaagaaagtctactgttgcgatctcaccaccctggtcaaagcccacaatacacaacgacctatggtggttgacatttgcatcagggagatcgaggccagaggattgaagagtgagggactgtacagggtgagcggcttcaccgagcacattgaagatgtgaaaatggctttcgacagagaaatctctaatgcggatgaaaggctggaagctgttcacgaagtgctgatgctgctacctccagctcactacgagaccttgcggtatctgatgatccatttaaaaaaggtgactatgaatgagaaagacaactttatgaacgccgaaaatctggggattgtctttggacccaccctgatgcggccgcctgaggactccacactcaccacgttgcatgacatgaggtatcagaagttgattgtccagattctgattgaaaacgaagatgttctcttctag

SEQ ID NO: 182716 - DNA, 1446 bp, Artificial Sequence
  Description of Artificial Sequence: Synthetic coding sequence
atggccgccagcagcaacagcagcctgagcggcagcagcgtgagctctgtctactccgagccgcgtagtccgcgagagctgcctaaatacgctgaggagtatcagccgcccatatggaaaagctacctgtatcagctacagcaggaggcaccgagaccgaagagaattatttgcccccgggaggtggagaacaggccaaaatattatgggcgggagtttcacggaataataagcagagagcaggctgatgagcttttaggaggggtcgagggagcatacatcttacgcgagtcacagagacagcccgggtgctacacactggccctgagatttggaaatcagaccttgaattatagactgtttcacgacggcaagcatttcgttggggagaagcgctttgagtccatacacgatctggtaactgacggcctgatcacactgtacattgagacaaaggcggctgagtatatctctaagatgacaaccaaccccatttatgagcatattggatacgccaccctgctaagagagaaggtgtcccgcagactctcacgcagcaaaaacgaacctagaaagaccaacgtgacccacgaggaacacacagctgttgagaagattagctctcttgtgcgccgagctgccctgacccacaacgataatcacttcaactacgagaagactcacaactttaaagtccacacatttcgcggaccacattggtgtgagtactgtgccaactttatgtggggactgattgcccagggtgtgaggtgctctgactgtggcctcaacgtgcacaagcaatgcagcaaacatgtacctaacgactgccagcccgatctcaagagaattaagaaggtgtactgttgcgacctgaccactctcgtgaaggctcacaacacacagcgcccaatggttgtggacatatgcataagggagatcgaggcgaggggcctcaaatcagaaggcctgtaccgcgtcagcggatttacagagcatattgaggacgtcaagatggcttttgatcgagatggcgaaaaggccgacatatctgcgaatgtttatcctgacatcaatataatcactggggcccttaagctatactttagagacctcccgattccagtgattacttatgacacctattctaagttcattgacgcagccaaaatttccaatgccgatgagagattagaggctgtccatgaagttctgatgttactgccacccgcccactacgagacgctgcgctacctgatgattcatctgaaaaaggtcacaatgaacgagaaagataattttatgaacgcagaaaatctcggcatcgtattcgggcctaccctgatgcgacctcccgaggacagcaccttgaccactctgcacgatatgcgataccagaagctgatcgtgcagatcctgatcgagaacgaagacgtccttttttag

SEQ ID NO: 182717 - DNA, 975 bp, Artificial Sequence
  Description of Artificial Sequence: Synthetic coding sequence
atggccgccagcagcaacagcagcctgagcggcagcagcgtgagcagcgatgcagaggaataccaaccaccaatttggaagtcgtacctgtaccaacttcagcaggaagcccccagacccaaacgaatcatatgcccaagggagatctcttctctagtgcggagggcggccctcactcacaacgacaaccacttcaactatgaaaagacgcacaattttaaagttcacacttttaggggacctcactggtgcgagtactgtgcgaacttcatgtgggggctgatcgcccagggagtgcgttgcagcgactgtggactgaacgtacacaagcagtgcagcaagcatgtgcctaacgactgtcagcccgacctcaagcgcatcaaaaaggtgtactgctgtgaccttaccaccctcgttaaagctcacaacacccagcggccaatggtggtggacatttgcatccgggagatcgaggcccggggacttaagtctgagggcctctacagggtttctggatttacagagcatatagaggacgtcaaaatggcttttgacagggatggagaaaaagccgatatcagtgctaatgtctaccccgacatcaacattattactggcgccctcaagttgtacttccgggatctacccattccggtgattacttacgacacgtactccaaattcatagacgctgcaaaaatcagtaatgccgatgagaggctcgaggccgtgcacgaagtgctcatgttgctgccccctgcccattatgagacccttagatacttgatgatccatctgaaaaaggtgacaatgaacgaaaaggacaattttatgaatgcagagaacttgggaattgtatttggtccaaccctcatgcggcctcctgaggattccacacttactacccttcatgacatgcgttatcagaaacttatcgtgcagattctcattgagaatgaggacgtccttttctag

SEQ ID NO: 182718 - DNA, 1632 bp, Artificial Sequence
  Description of Artificial Sequence: Synthetic coding sequence
atgacccagacccaccgggccaagagcgccagcagctgccccaaccttttggttccagagacctggccccatcaggtctccgcctcacacgctgggagatctaaacagccgcagggtggcattctaaagatcaatgaggagcatcgtcggggtgccattcaggatctgttagccagtcccgggtttacttttggtaaaagggttgtgttcgattcccactgtctgaaacgccaacacacatttgctgacgggttacattcctcttgtacttctaacgccgaagagtaccagccccccatttggaagagttacctgtaccagctgcagcaagaggctccgaggccgaagaggatcatatgccctagagaggtcgagaaccggccgaagtactatggcagggagtttcacggcattattagccgggagcaagccgatgagctcctcggcggagtagaaggtgcttacatcctccgcgagtcgcagcggcagcctggctgttacactttggctctgcgattcgggaaccagacactaaattaccgcttattccatgacggaaaacatttcgtgggagaaaagcgatttgaatccatccatgatctggtgaccgacggcctcatcacactctacattgagacaaaagccgctgagtatattagcaaaatgaccactaatcctatctatgagcatatcggctacgccacgctgttacgggagaaggtctctcgcagactgtcacgtagcaagaacgagcctcgcaaaactaatgtcacacacgaagaacacacagcagtcgaaaagatatcctcgctggttagaagggcagctctgactcataacgacaaccactttaattacgaaaagacacacaactttaaagtccatacattccggggcccacattggtgtgagtattgtgctaatttcatgtggggattgatcgcccagggcgttcgttgctcagactgcggcttgaatgtgcacaagcagtgtagcaagcacgttccgaatgattgtcagcctgacctgaagcgcataaaaaaggtgtattgttgtgatctgaccactctggtgaaagcccataacacccaacgccctatggtggtcgatatttgcattagggaaatcgaagcaaggggtctaaaatccgagggcttataccgggtgagtggtttcacagagcatatcgaggacgtcaagatggcattcgaccgcgacggtgaaaaggcggacattagtgctaacgtgtacccagacatcaacattattacgggggccctaaaactctatttccgggacctgccgatacctgtgatcacttacgacacctacagcaagtttatcgacgccgccaaaatcagcaatgcggacgagcgcctggaagccgtgcacgaagtcctcatgctactaccaccagcccattatgagacactcaggtacttgatgattcacttgaaaaaggtgactatgaacgagaaagataattttatgaatgcagagaatcttggtatcgtttttggaccaacactgatgaggccccctgaagattccacgctcaccactttgcacgatatgcggtatcagaaactaatagtgcagattctgattgaaaatgaggatgtgctgttttag

SEQ ID NO: 182719 - DNA, 1362 bp, Artificial Sequence
  Description of Artificial Sequence: Synthetic coding sequence
atggacgccgaggagtaccagccccccatctggaagagctacctgtaccagctgcagcaagaggccccccggcccaaacgcatcatctgcccgagggaggtcgaaaacaggcctaaatactatggccgagaattccatggcataataagcagggaacaggccgacgagctgctagggggagtcgaaggagcatacatcctgagggaatcacagaggcaacctgggtgctacacactggccctccgctttggaaaccagacccttaattaccggctctttcacgacggcaaacacttcgtcggggagaagcgattcgagtctatccacgatctggttactgatggtttaatcaccctgtacatcgaaactaaggccgcagaatatatttccaagatgacgaccaacccgatctacgaacacatcggctacgcaacattacttcgcgagaaagtttccaggcgcctctcccgatccaagaacgaaccacgaaagacgaatgtgactcatgaggaacataccgcagtggagaaaatcagtagtctggtgcgccgcgctgccctcactcacaacgataatcactttaactacgagaagacccacaactttaaagtgcacacgtttcgaggtccgcactggtgcgagtactgtgccaacttcatgtgggggctgatcgctcagggcgtacggtgctcagactgtggacttaacgtgcacaagcagtgctccaagcatgtccccaatgattgtcaacccgatctcaagaggataaagaaggtctattgctgtgatttaaccaccctagtgaaagcccacaatacccagcggcctatggtcgtggacatctgtattcgtgaaattgaggcccggggcctcaagagcgagggcctctaccgtgtctcaggatttaccgaacatattgaggatgtgaaaatggccttcgacagggatggcgaaaaagcggatatctcagctaacgtctatcctgacattaacatcatcaccggtgccctcaaactgtattttcgggacctgcccatcccggttattacatacgatacctattctaaattcattgatgccgcaaagatctcaaatgctgatgaaagactcgaggccgtgcacgaagtcctcatgctgctccccccggcccactacgagacactaagatacctgatgattcaccttaagaaggtgactatgaatgaaaaagacaactttatgaatgccgaaaacttggggatcgtgttcgggcccacactgatgcgaccccccgaagacagtacgctcacaactcttcacgacatgcgttaccagaagctgattgtgcagattctgatcgagaacgaagatgttttgttctag

SEQ ID NO: 182720 - DNA, 1152 bp, Artificial Sequence
  Description of Artificial Sequence: Synthetic coding sequence
atgggcgtgaaggccagccagaccggcttcgtggtgctggtgctgctgcaatgctgtagcgcctacaagctggtatgttactacacatcttggagtcagtaccgggagggtgatggtagctgcttcccagacgctctggatcgctttctatgcacccacatcatatacagttttgccaacatctcaaacgaccacattgacacatgggagtggaatgatgtgactctctatgggatgcttaacacgctgaagaacagaaatcccaatttaaaaactttactgtctgtcggcggctggaacttcggatcccagaggttttccaaaattgcctccaatacccagagtagaagaactttcattaagtccgtccctcctttcctgcgtactcacggtttcgatggcctggatcttgcgtggctctatcccgggaggcgggacaagcaacactttaccacactcattaaggaaatgaaggcggaattcatcaaggaggctcaacccggcaaaaagcagctgctgctctcagccgcgctgtcagctgggaaagttactattgattcctcttatgacatcgctaaaatctctcagcacctcgactttattagcattatgacctacgactttcatggggcgtggagaggtactactgggcatcacagccccctttttagaggacaggaagacgcctcacccgacaggtttagtaacactgattatgcggtgggttatatgttgcgcctgggagcacccgccagcaagctcgtcatgggcatcccgacattcggccggtctttcactcttgccagctccgagactggagtcggagcaccgatctccggacccggaatccctggacgctttacgaaggaggctgggactctggcatactatgagatctgcgacttcctgaggggagctacagtgcatcgcatactagggcaacaagtcccgtatgctaccaaaggaaatcagtgggtggggtacgatgatcaggagagcgtgaagtccaaggtacagtacttaaaagatcggcagcttgcaggagccatggtgtgggccttggatctggatgattttcagggaagtttttgtggccaggacttaagattccctctgactaacgcaattaaagacgcattagcggctacctag

SEQ ID NO: 182721 - DNA, 459 bp, Artificial Sequence
  Description of Artificial Sequence: Synthetic coding sequence
tgactgctgctgagcgccgccctgagcgccggcaaggtgaccatcgactcgagctatgacatcgcaaagatctcacagcacctggatttcatcagcattatgacctacgatttccacggtgcatggcgtgggaccacgggccaccacagcccccttttccggggacaagaggacgcatctccggatcggttctcaaatacaatatgcgattttctccggggcgccacagtgcatcgcattctcgggcaacaggttccctatgctacaaaaggcaaccagtgggtggggtacgatgaccaggaatcagttaagagtaaggtacagtatctcaaagacaggcagctggcaggggccatggtttgggctctagacttagatgactttcaagggtccttttgtgggcaagatttaaggtttcccttaacaaatgcaattaaagacgccttagcggcaacctag

SEQ ID NO: 182722 - DNA, 306 bp, Artificial Sequence
  Description of Artificial Sequence: Synthetic coding sequence
atggtgagcacccccgagaaccggcagaccttcatcaccagcgtgataaaattcctgcgacagtatgaatttgatgggctggatttcgactgggaatatcccggatcacggggctctcccccccaggacaaacacctgttcacagtgctggtccagatgcgcaaactaaaatacagggaggatttgagtaacctgccaaagatcacccagctcgtcggcatcatcacatcaagcgctgtctggcctcagtctcccctcctcctcagcatcacgctggggtgtcctctgctccttcgtaacgcctag

SEQ ID NO: 182723 - DNA, 1431 bp, Artificial Sequence
  Description of Artificial Sequence: Synthetic coding sequence
atgaccaagctgatcctgctgaccggcctggtgctgatcctgaacttgcagctgggctccgcctaccaactcacttgttactttacgaactgggcccagtatagaccagggctgggcaggttcatgcccgataatatcgatccatgtctctgcactcatttgatctatgcctttgcaggtcgacagaataatgaaatcaccacaatcgagtggaatgacgtaactctgtatcaggccttcaatggcctgaaaaataagaactcacagctgaagaccttgctggcaatcggaggctggaatttcggaaccgcacccttcacggcaatggtgtcaacccctgagaacaggcagaccttcatcacgtctgttatcaaattcctcaggcagtatgaattcgacggactggatttcgattgggaataccctgggtccaggggctctcctccacaagataagcacctgtttaccgtcctcgtacaggagatgcgcgaagcctttgagcaggaagccaagcagatcaataagccccgactgatggtcacagccgctgtggcagcaggcatctccaatatacaatccggttacgaaatcccccagctgtcgcagtatctagactatatacacgtaatgacgtatgacttgcacggtagctgggagggatatacaggggagaatagtcccctgtacaaataccccaccgacaccgggagtaatgcctacctgaatgtcgactatgttatgaactattggaaggataatggggcccctgccgagaaactgattgtcggcttccccacctatggacataactttatcctcagtaatccctccaacaccggcattggtgcacccacttccggcgccggtccagcaggcccctacgctaaagagagcggtatatgggcatactatgagatctgcacgttcttgaaaaacggagcgacccagggatgggacgctcctcaagaagtgccttacgcgtaccagggcaacgtgtgggtcggctatgacaacatcaaaagctttgatatcaaagcccagtggctgaagcacaataagttcggcggagccatggtctgggccatcgacctagacgatttcacagggacattttgcaaccagggaaagttcccgctcatatctaccctgaaaaaagcgttgggcttacaatccgccagttgcactgcacccgcacaaccgatcgagccaatcaccgccgcacccagcgggagcggcaatggttcagggtcatccagttcagggggcagctctggaggtagcggcttttgcgctgtgcgggcaaatggcctctatcccgtcgctaataaccggaatgctttttggcactgtgtgaacggggtgacttatcagcagaactgccaggccgggctcgtcttcgatacctcttgcgactgctgtaactgggcctag

SEQ ID NO: 182724 - DNA, 948 bp, Artificial Sequence
  Description of Artificial Sequence: Synthetic coding sequence
atgcgggaggccttcgagcaggaggccaagcagatcaacaagcccagactgatggtgaccgctgcagttgctgccggcatttctaacattcaatccgggtatgagataccccagttgtcccagtacctggattacattcacgtgatgacttatgatcttcacgggagctgggaaggatatactggggagaactcaccactgtacaaatatcctacagacaccggcagcaacgcctacctgaacgtggactacgttatgaattattggaaagataacggcgcccccgctgagaaactaattgtcggcttccccacttatggtcacaacttcatactctcgaacccctcaaatactgggatcggtgctccaacatctggggcagggcctgctggtccctacgccaaagagagcggcatttgggcttactatgagatctgcacgtttctaaagaatggtgcaacccaggggtgggacgctccccaagaggtgccttacgcctatcagggcaacgtttgggtcggctacgacaatatcaaaagtttcgacatcaaggcccagtggcttaaacacaacaagtttggtggggccatggtgtgggcaatagacctggacgacttcaccggtacattctgtaaccagggtaagttccctcttatctcaaccttgaaaaaggcactaggattacaaagtgcctcctgcacagctccggcacagcctatcgagccaatcaccgcggcaccctccggcagtggaaatgggagcggttcttcctctagcggaggctcaagcggtgggtccggcttctgtgctgtgagagctaacggcttatatccggtggctaacaaccgcaacgcgttttggcactgcgtcaacggggttacatatcaacagaactgccaagctgggctagtatttgacacctcctgtgattgctgtaattgggcgtag

SEQ ID NO: 182725 - DNA, 1431 bp, Artificial Sequence
  Description of Artificial Sequence: Synthetic coding sequence
atgaccaagctgatcctgctgaccggcctggtgctgatcctgaacctgcagctcggttccgcctatcagctgacgtgctactttaccaattgggctcagtaccgcccaggactgggacgctttatgcccgataacatcgacccatgtctgtgtacacatttgatttacgcttttgctggccggcagaacaatgaaatcactacaattgagtggaatgacgtgacattataccaagctttcaatgggctcaaaaacaagaatagccagctgaagactttgctggccattggaggctggaattttggcaccgcccctttcaccgccatggtttcaacgcccgagaataggcagacttttattacttctgtgattaagttcctacgccagtacgaattcgacggtctggatttcgattgggaataccccggaagccggggcagcccacctcaggacaaacacttgttcactgtgctggtccaagaaatgcgcgaagcctttgaacaggaagcgaaacaaatcaacaagccacgactcatggtgaccgctgccgtggccgccggcataagtaacatccagtcagggtatgagattcctcagctgagtcagtatttggactatatacacgtgatgacctacgaccttcatggaagttgggagggttatacaggcgaaaattcccccttatacaaataccctacggatacgggctctaacgcatacctcaacgtcgactacgtgatgaactactggaaggacaacggagcccctgctgagaagctaatagttggctttcccacttacggacataacttcatattgtctaaccccagcaatacaggaatcggcgcgcctacttctggcgcgggccctgcagggccatacgccaaagagtcgggcatttgggcatattatgaaatttgcacgttcctgaaaaacggggccacgcagggttgggatgcccctcaggaggtcccatatgcttaccaaggaaacgtctgggttgggtacgacaacatcaagagctttgatattaaagcccagtggctaaagcataataaatttggtggggcgatggtatgggctattgacctggacgatttcacaggcaccttctgcaaccagggaaaatttccccttatcagcacattgaagaaggcgcttggcctacagtctgcatcttgcactgcccccgcacaaccaattgagccgatcaccgccgcaccttccggaagcggtaacgggagtggctcctcctccagcggtggttctagcggggggtctggattctgcgcggtcagggccaatggattataccctgtggccaataacaggaacgcattctggcactgtgttaacggcgtcacttaccagcagaattgccaggctggtctggtctttgacacaagttgcgattgctgcaattgggcatag

SEQ ID NO: 182726 - DNA, 1263 bp, Artificial Sequence
  Description of Artificial Sequence: Synthetic coding sequence
gagaccagcagcagcgtgcacgagcaggtggccgacagcggcgcccaagccgttgccttccaaagcggaggtgaatccagtatagtgtggaacagccagctgaaaacactgctagccataggcggctggaatttcggcactgctccctttacagcgatggtatctacaccggagaacaggcagacattcattacttcagtaattaagttcctgcgccagtacgaattcgacggattggacttcgattgggagtaccccgggtcacgcgggagccccccccaggacaagcatctgtttaccgtcctggtccaggagatgagggaggcctttgaacaggaagctaaacaaatcaataagcccagactaatggtgacagccgccgttgctgcaggaatatccaacattcaaagtgggtacgagattccacaactgtcacaatacctggactatattcacgttatgacgtatgatcttcatgggtcctgggagggctacaccggcgagaattcccctttgtataaataccctaccgacacagggtctaacgcgtatctgaacgtcgactatgtcatgaactactggaaagataacggagcgcccgccgaaaagttaattgtgggctttccaacctatggacacaatttcatactgtccaatccgagcaataccggcattggggctcccacctccggcgccggccccgccggcccttatgcaaaagaatcgggcatctgggcgtattacgaaatttgcacattcctgaaaaatggcgcaacacaagggtgggatgccccccaagaagtgccatatgcataccaggggaacgtctgggttggatatgacaacatcaagagctttgacattaaggctcaatggttaaaacataataagttcgggggggcaatggtgtgggccatcgacttagatgatttcactggcacgttttgtaaccagggcaagttccctctcatctctactctcaagaaggccctcggtctgcagtcagctagctgtacagcccccgcacagccaatagaacccattacagctgctccttctggcagcgggaatggatctggctcctcctcttccggtggatccagcggaggatctggcttctgcgccgttcgagctaatggcctgtaccccgtggctaataatcgcaacgcgttttggcactgtgtgaatggggtgacatatcagcagaactgccaagcaggactggtctttgataccagttgcgattgctgtaattgggcctag

SEQ ID NO: 182727 - DNA, 1107 bp, Artificial Sequence
  Description of Artificial Sequence: Synthetic coding sequence
atggtgagcacccccgagaaccggcagaccttcatcaccagcgtgattaagttcttaaggcaatacgaattcgacggtctcgatttcgactgggagtaccccggttctcgcggatctccacctcaggataaacatctgttcacagtacttgttcaggaaatgagagaagccttcgagcaggaagccaagcagatcaacaaaccgcgactcatggtgacggcagccgtggccgctggtatctccaatatccagagcggctacgaaatcccccagctgtcacagtatctggactatatccatgttatgacgtacgacttgcatggaagctgggagggctacactggtgaaaacagccccctttataagtatccgactgacacagggtcaaacgcttatctgaatgtggattatgtgatgaattattggaaagacaatggcgcgcctgccgaaaaactgattgtcggcttccccacctacgggcataattttatcctttctaatccgtctaacaccggtataggggctccaacctccggagccggtccagcaggaccttacgcaaaagagagcggcatttgggcatattacgagatttgtacttttctgaaaaatggagccacacagggctgggacgctccacaggaagtgccttatgcttaccaggggaacgtctgggtgggatacgataatattaaaagctttgacatcaaagcgcagtggctgaaacataacaaattcgggggtgccatggtgtgggccatcgacctggatgacttcaccggcacattctgcaaccagggcaaatttcctctgatctctacactgaagaaggcactggggcttcaaagcgcttcctgtacagcaccagcccagccgattgagccaataactgccgcaccgtctggcagcgggaacggatctgggtcctcgtcctccggaggctcttcaggcggcagcggcttctgtgcagttcgagcaaatgggctttacccagtggcaaataataggaacgcgttctggcactgcgtgaatggagtgacataccagcaaaactgtcaagcaggcctggtcttcgatacatcatgtgactgctgcaactgggcttag

SEQ ID NO: 182728 - DNA, 948 bp, Artificial Sequence
  Description of Artificial Sequence: Synthetic coding sequence
atgcgggaggccttcgagcaggaggccaagcagatcaacaagccccgcctaatggttactgcagccgtcgccgcagggatcagtaacattcaaagcggatatgagatccctcagctgagccaatatctggactacattcacgtgatgacttatgatctgcacggctcttgggaaggctacaccggcgagaatagcccactgtacaagtacccaaccgataccggatcaaatgcctatctgaacgttgattacgtcatgaattattggaaggataacggcgcacctgccgagaagttgatcgtcggatttcccacttatggccacaacttcatcctgagcaacccctccaatactgggataggtgcccccactagcggagccggacctgcggggccatacgcgaaggaaagtggaatctgggcatattatgagatttgcacctttttgaaaaacggagcaacccagggatgggacgcgccccaggaggttccctacgcctaccaggggaacgtgtgggtgggttacgacaacatcaagtcattcgatatcaaggcacagtggctgaagcacaacaagtttggaggcgctatggtatgggcaatcgatctggacgatttcacaggaaccttttgcaaccagggaaagtttccgttgatatccaccctgaagaaagctttggggctacagtctgcttcctgcaccgctcccgcccagccaattgaacccatcaccgccgctccgagcggatccggtaacggcagcggcagctccagcagcggtggcagttccggcggttctgggttctgcgcagtgcgcgctaacgggttgtaccccgtcgctaataatcgcaatgcattctggcattgtgtaaatggggttacctatcagcagaattgtcaggcaggacttgtcttcgataccagctgtgactgttgtaactgggcttag

SEQ ID NO: 182729 - DNA, 948 bp, Artificial Sequence
  Description of Artificial Sequence: Synthetic coding sequence
atgcgggaggccttcgagcaggaggccaagcagatcaacaagcccaggcttatggtcaccgccgccgtggccgccggcataagtaacatccagtcaggctacgagatcccccaactttcccagtatctggactacattcacgtgatgacatacgacctacatggtagttgggagggctacacaggggagaattcgcctctctataagtatccgaccgatacaggatctaatgcctacctgaacgtggactacgttatgaactattggaaggacaacggggctcctgccgaaaaactgattgttgggttcccaacctacgggcataatttcatactaagcaacccctctaatacggggatcggcgcgcctacgtcaggcgccgggcccgctggaccctacgcaaaggagtctggaatttgggcttattacgaaatttgtacgtttctaaagaatggtgcaacacagggatgggatgccccccaggaggtcccgtacgcctaccaggggaacgtgtgggtgggctatgataatattaagtcttttgatatcaaagcccagtggctcaagcataacaagttcggaggggcaatggtctgggcaatcgatttggatgatttcacggggactttttgtaaccagggaaaattcccgctcatcagtacccttaaaaaagctctggggctgcagagtgcgagttgtacagctcctgcgcagccaatcgagcctatcaccgccgccccaagcggctctggcaacggctctggaagcagttcttccgggggatcatccggagggtcaggattctgcgccgtgcgggccaacggactgtatccagtggctaataaccggaatgcattctggcattgtgtaaacggcgttacctaccaacaaaactgtcaagccggtctcgtattcgatacgtcctgtgattgctgcaattgggcctag

SEQ ID NO: 182730 - DNA, 864 bp, Artificial Sequence
  Description of Artificial Sequence: Synthetic coding sequence
atgcgggaggccttcgagcaggaggccaagcagatcaacaagccccggctgatggtcactgctgcagtggctgccgggatctccaacatccaatctgggtatgaaataccacagctgagccagtacttggattacatacatgtcatgacatatgatcttcatggatcttgggagggctacaccggcgaaaatagccccctatataagtaccctacggacactggcagcaacgcctaccttaacgtagattatgtcatgaactactggaaggataatggagccccagctgaaaagttgatcgtgggcttcccaacctatggtcacaacttcattctctctaatccaagtaataccgggatcggcgctcccacatccggtgcgggacctgccggcccttatgcaaaagaaagcggcatctgggcatactacgagatatgtactttcctcaaaaatggtgctacccagggctgggatgccccccaggaggtgccttatgcttaccagggaaacgtgtgggtgggctacgataacatcaagagcttcgacattaaggctcaatggctaaagcacaacaagtttgggggggctatggtctgggctattgatttggacgattttacgggcaccttctgcaaccaaggcaagtttcctcttatctccacgctgaaaaaggcattggggctgcagagtgcttcctgcactgccccagcgcagccgatcgagccaatcacggctgctccatctggaagtggcaacggctccggctccagttcttctggagggagcagcggcggatcagggttctgcgctgttcgtgccaacggattgtaccccgtagccaataatcgcaacgctttttggtag

SEQ ID NO: 182731 - DNA, 1158 bp, Artificial Sequence
  Description of Artificial Sequence: Synthetic coding sequence
atgagccggccccagctgcggcggtggcggctggtgagcagccccccatcaggcgtgcctgggttagccctcctcgctctgctggcactgctcgctctcagactggctgccggcaccgattgtccttgtcccgaacccgaactctgtcggcccatccgtcaccatcctgacttcgaggtcttcgtgttcgatgtgggtcagaagacctggaaatcctatgactggtcgcaaatcactaccgtggctacctttggaaagtatgacagcgaacttatgtgctacgctcacagcaagggagctcgggtggtgttaaagggtgatgtctccctgaaagatataatcgatccggctttcagagcaagctggattgctcagaaactgaaccttgcaaagacccaatacatggacggaatcaacatcgacatcgaacaggaagtaaattgtctctcacctgagtacgatgcgctaaccgccctagttaaggagacgaccgatagctttcaccgggaaatcgaaggcagccaggtgacttttgacgtggcctggtcgccaaaaaatattgaccgtaggtgttacaattatacggggatcgccgatgcatgcgacttcctatttgtgatgagctacgacgagcagagccagatctggagcgaatgtatcgcagctgcgaacgccccttacaatcagactctgaccggctacaacgactatatcaagatgtccatcaatccaaaaaagttagtcatgggtgtgccctggtacggatatgattacacttgcctgaacctctctgaagaccacgtgtgcaccattgctaaggttcccttccgcggtgctccttgctctgacgctgcggggcgtcaagtgccttacaaaacgattatgaaacaaattaactcatcaatctccggcaacctgtgggataaggatcagcgcgcgccttattacaattacaaagatccagctggacactttcaccaggtgtggtacgataatcctcagtctatatctcttaaagctacttacatccagaattatcggctccgtgggatcggaatgtggaatgccaattgcctggattattctggcgacgccgtggcaaagcaacagacggaagaaatgtgggaggtcctgaagcccaaactgctgcagcgatag

SEQ ID NO: 182732 - DNA, 2967 bp, Artificial Sequence
  Description of Artificial Sequence: Synthetic coding sequence
atggagcagagccggagccagcagcggggcggcgagcagagctggtggggctccgatccccaatatcagtatatgcctttcgaacactgcactagttatggtttaccgtccgagaatggagggctacagcataggcttcgcaaggatgccggtccccggcataacgttcacccaacacagatctatggtcaccacaaagagcaattcagtgaccgcgaacaggatatcggcatgcccaagaagacgggttccagtagtacagttgacagcaaagatgaggatcattattcaaagtgtcaggattgcatccatcgcttgggtcaagtggtgcggcgcaaattgggagaggacggcatattcctagttctcctcggcctgctaatggctctggtttcctggagcatggactacgttagcgcaaagtctctccaggcctacaaatggtcatatgcacagatgcagccaagcctgcctctgcagttccttgtttgggtgacgtttccgctagttcttatactgttttcagctctgttttgtcacctgattagtccacaggctgtgggctccggcatccctgaaatgaagactatcctgaggggggtggttctcaaggagtacctgaccatgaaagcgtttgtcgccaaggtggtggccttaaccgcaggactaggaagcggaatccccgtgggcaaggaaggcccatttgtgcatatcgcatctatctgtgccgctgtccttagtaaattcatgtcagttttttgcggcgtgtacgaacagccgtattactattccgatatcttaacggtgggatgtgctgtcggcgtgggatgctgctttgggacgcctctcggaggggtgctgtttagtatcgaggtgaccagtacgtacttcgcagtgaggaactattggcgcgggttcttcgcagcaacattttccgccttcgtatttagagtgttggcggtctggaacaaggatgccgtgactataactgcattgtttagaactaattttcgcatggacttcccgttcgacttgaaggaactgcctgcattcgccgcaatcggaatttgctgcgggcttctgggagccgtctttgtatatcttcatagacaggtgatgctcggcgtcagaaaacataaggccctgagccaattcctagccaaacaccgattgctctaccccggaatcgtcacctttgtcatcgcctcatttacgtttccccccggcatgggccagttcatggccggcgagttgatgccaagggaagctatctcaaccctttttgacaataatacatgggtcaagcacgccggtgaccccgaatccctgggtcagagcgccgtgtggatccacccccgggtgaacgtcgttatcatcatcttcctgttcttcgtgatgaaattctggatgtctatcgtcgcaacaactatgcccattccatgtggcgggtttatgccagtgtttgtcctgggggcggcttttgggcggctggtgggggaaatcatggccatgctgttcccagatggaattctgtttgatgacatcatttacaagatcctgccaggaggttacgcagtcattggcgccgctgctcttacaggagctgtgagccataccgtctcaactgcagtaatatgctttgaactgaccggtcagattgcccatattttgccaatgatggtggcggtgatcctggccaatatggtagcccaatctctgcagccctcgctctacgatagcatcatccaggtgaaaaaactgccgtatctgcctgacctggggtggaatcagctgagcaaatataccattttcgttgaggacatcatggtgcgagatgtcaaatttgtaagtgcttcatacacctacggggagttgaggacgttgctgcaaacgaccacagttaagaccctgcccttggtagatagcaaggattcaatgatcctactgggcagtgtggagagatccgaactgcaggctcttctccagaggcatctgtgccccgagcgtaggctgcgggccgcacaggagatggcaagaaagctgtccgagctaccctacgatggcaaggcccggctggctggggagggtctgccaggcgctccacccgggcggcctgagagctttgcatttgtcgacgaagacgaagatgaggacctgagcggcaagtccgaactcccaccgagtctggccttgcaccccagtacaacagcccccctgtcccctgaggagcccaatggtcccctgcctggacacaaacagcagccagaagccccagagccagctgggcagagacctagtatttttcagtcactcttgcactgtctgctgggaagggctcggcctaccaagaagaagacaactcaggactccacggatcttgtcgacaacatgtccccagaggagatagaagcatgggaacaggagcagctttcccaacctgtgtgctttgattcttgctgcatcgatcagagcccatttcaattggtggagcagaccacactgcacaagactcatactcttttctcactgctgggtttacacctagcctacgtaacctctatgggaaagctgcgcggtgtcctggcactggaggagctgcagaaggctatcgagggtcacacgaaatctggcgttcaactgcggccacccttagcctcgttccgtaacacaaccagcacacgtaagagtaccggcgcacctcccagttccgccgagaattggaatttaccagaggataggcccggggcgacaggtactggcgacgtgatcgctgcaagccccgagacgccagtgccatcaccaagtcctgaaccacctctgtctcttgctccaggaaaagttgagggggagctggaagaacttgaactggtggagtctcccggcctcgaggaagagctagccgacattttgcagggaccgtcccttcgatctactgacgaagaagacgaagatgagctgatcctgtag

SEQ ID NO: 182733 - DNA, 2697 bp, Artificial Sequence
  Description of Artificial Sequence: Synthetic coding sequence
atggccgccgccgccgccgaggagggcatggagccccgggccctgcagtacgaacagacactgatgtacgggcgctacacccaggacttgggcgcttttgcaaaagaagaggcagcacgtattaggctgggcggccctgaaccctggaaaggaccaccctcaagccgtgctgcccctgagctgctagaatatggacggtcaagatgcgcccgttgtcgcgtgtgctcggtcagatgccacaagtttttggtgagccgtgtgggggaagattggatcttcttggtgctgctgggcttgctaatggctcttgtgtcttgggtcatggactacgcgatagctgcctgccttcaggcccaacagtggatgagcagggggcttaacacttccatcctcctgcagtacctggcgtgggttacttacccggtggtactgatcacattctcagccggattcacccaaatcctcgccccccaggctgtcgggtccggcatcccagaaatgaaaaccattctccgcggtgtggtacttaaggaatatttaacccttaagactttcatcgccaaggtgattgggttgacctgcgcactgggatccggtatgcctttagggaaggagggcccttttgtgcatattgcatctatgtgtgccgcacttctctctaaattcctgtccctgtttggtggcatttacgaaaatgaaagcagaaacaccgagatgttggcagctgcctgtgcggtgggagtcggctgctgtttcgcggccccaatcggcggtgttctgttctccatcgaggtcaccagcacattttttgctgtcagaaactattggcgaggctttttcgctgccacatttagtgcctttatttttagggtgctcgcagtatggaacagggatgaggagacaattactgcccttttcaagaccagatttcgactcgattttccgttcgacctccaggagctgccagcattcgccgttatcggcattgcttccggttttggcggtgctcttttcgtctacctgaatcggaagatcgtgcaagtgatgcgaaagcagaaaacaatcaacagattcctgatgagaaagcggctgttgttccccgccctggttaccctgctgattagcactctcacgttcccacccggtttcggacagttcatggcagggcaactgtcccagaaggagacgcttgtgaccctgttcgataatcgaacttgggttaggcagggcctggtagaagagcttgaaccaccatcaacctcacaggcctggaatccgccaagggccaacgtgttcctgacactggtaatatttattttgatgaaattttggatgtccgctctcgctactacaatcccggtgccctgtggtgcatttatgcctgttttcgtgatcggagccgccttcggccgcctcgtgggtgagtcgatggccgcctggttcccagacggcatccacacagatagttccacttataggatagtaccaggagggtatgccgttgtgggggctgcagctctagctggagcagtcacccacaccgtctctaccgcggtcatcgtgttcgagctaacaggccagatagcccatattctgccagtgatgatcgccgtgatcctggccaacgctgtcgctcaaagcctccagccttccctatatgatagcattataagaattaagaaactgccttacctgccagaactcggctggggacgccaccaacagtacagggttcgcgtagaggacattatggtcagagatgtgccccacgtcgctctgtcctgcacgtttcgggacctcaggttagcactccaccgaaccaagggacggatgctagcccttgtcgagagccccgaatctatgatcctgctcggcagcatcgagaggtctcaggtggttgctctgctgggagctcagctgtcccccgctcggcgacgtcagcatatgcaagaacgaagggccacccagaccagccctctgtctgaccaggagggcccgcccactcccgaggctagcgtgtgtttccaagtgaacactgaagatagtgcctttcccgccgcccgcggcgaaacgcataagccactgaaacctgctctgaaacggggtccatcagttacgaggaatctaggcgaaagccctactgggagcgctgagagcgctgggatcgctttgaggagtctgttctgcgggtcaccccctcccgaagctgctagtgagaaacttgagagctgtgaaaagaggaagcttaagcgagtgcggatttccctggcctctgacgcagatcttgaaggggaaatgtcacccgaggaaattcttgagtgggaggaacaacaactcgacgagccagtgaacttctccgattgtaagatcgatcctgcgccgtttcagttagtggagcgcacgtcccttcataagactcatactatttttagtttgttgggagtcgaccacgcatacgtgacctccatcggtcgcctgataggaatcgtgacgctaaaggagctgcgcaaggctatcgagggctctgtaaccgcccaaggggtgaaggttcgcccacctctagcaagttttagggactcggctacatcatcgagcgacacagaaaccacagaggtgcatgccctgtgggggcctcatagccgtcacggacttccacgggaagggagccctagcgattcagacgacaagtgccagtag

SEQ ID NO: 182734 - DNA, 381 bp, Artificial Sequence
  Description of Artificial Sequence: Synthetic coding sequence
atgcggaagcggctgctgttccccgccctggtgaccctgctgatcagtactctgaccttcccccccggcttcgggcagttcatggctgggcagcttagtcagaaggagacattagttaccctgttcgacaacaggacgtgggtccggcagggccttgtcgaagagctcgagccaccctccacatctcaagcgtggaatccacccagggccaatgttttccttaccttggtgatcttcattctcatgaaacatttgggagtttggtgggtgaaggcatggttgcccggatcgcagatggagttcatccgaacggcggcgcctacaggtttatgtctgggagcaacactgtggtctggccagctgcggtggcaggagaggtag

SEQ ID NO: 182735 - DNA, 2601 bp, Artificial Sequence
  Description of Artificial Sequence: Synthetic coding sequence
atggagagcgagcagctgttccaccggggctactaccggaacagctacaatagtatcacatcagcctctagcgatgaagagctgctggatggcgccggggttatcatggattttcagacttctgaggatgacaacctgcttgacggcgataccgctgtgggcacccactatacgatgacaaatggaggcagcatcaattcctcaacccatctgctggatctgcttgacgagccaatacccggcgtagggacctacgacgacttccatacaatcgattgggtgagggagaaatgcaaggatcgcgaaagacaccgaagaatcaacagcaaaaagaaggagtccgcgtgggagatgaccaaatctctgtatgacgcttggtctggatggttagtggtcaccctgacggggttggctagtggggcacttgctgggttgatagacattgcggcagactggatgacggacctgaaagagggtatctgcctttctgctttatggtataaccatgagcagtgttgctggggctccaacgaaacaacttttgaggaaagggataagtgtccgcagtggaagacctgggcagaactgatcattggtcaagccgagggcccggggagctatatcatgaattacattatgtatatattttgggctctgtcctttgccttcctggctgtgagtcttgtcaaggttttcgccccatacgcatgcggatctgggatccccgaaattaagactatcttgagtgggtttatcatccgcggctatctgggtaaatggactctcatgatcaaaaccataactctggtcctggctgtggcctcaggcttgtctcttggcaaggaggggcccttagtgcacgttgcttgttgctgcggtaatattttcagctacttattccccaaatacagtaccaatgaagcaaagaaacgcgaggtcctttcagccgcttccgccgcaggagtgagcgtcgcttttggcgcacctatcggaggagtgctgttttctctagaggaagtaagctactactttccactgaagactctttggcggagtttctttgccgcactggtcgccgcttttgtgctacggtcaatcaatccattcggaaatagccgccttgtgctgttttacgtggaataccacactccgtggtatctgtttgaactattcccattcatcctcctgggcgtattcggagggttgtggggagcttttttcattcgggctaatatcgcatggtgtaggagaagaaagtccacgaaattcggcaaataccccgtgcttgaagtgattatcgtggccgccataactgcagtgatcgcattccctaacccgtatacacgcctcaacacctcggagttaataaaagagctattcactgattgcggacctctggaaagctcatcattatgcgattatcgaaatgacatgaatgcctcaaaaatcgtggatgacatccccgatcggcccgcaggaataggcgtgtacagcgctatttggcaactgtgtctcgcccttatcttcaagatcattatgacggtatttacatttgggataaaagtaccttctggcctgtttataccctcgatggctatcggcgctatagcgggccggattgttgggattgccgttgagcagcttgcatattatcaccatgattggtttatttttaaggagtggtgtgaggtgggcgctgactgcattacacccgggctctacgctatggtgggagcagcggcctgtctgggaggcgtaaccagaatgactgtttcactcgtggtaatagtgttcgagctgaccggaggactggaatatattgtgccactgatggcagccgtgatgaccagcaaatgggtgggggacgcctttgggagagagggaatctacgaagctcacatccgcctgaatggatacccctttctcgatgctaaagaggagtttacgcacaccacgctggccgctgatgtgatgcggcctaggcgcaacgacccacctctggcagtgctcacacaggataacatgacagtagatgacattgaaaatatgatcaatgagacaagctataatggatttccggtgatcatgagcaaagagtcccagagactggttggctttgccttacgcagggatttgactattgccattgagtctgccaggaagaagcaagaggggatcgtgggctccagccgcgtgtgtttcgcacagcataccccatctttaccggccgaatcccctaggcctctaaagcttaggtcgatacttgatatgtcaccttttacagtgactgatcatacaccgatggaaattgtagtcgacattttccgcaaactcggactacgccagtgtcttgtgacccacaacggcatcgttttgggcatcattacaaaaaaaaatattcttgaacatctcgaacagctgaaacaacatgtcgagccattagctcctccctggcactacaacaagaagcgttatccccctgcctatggcccggatggtaagcccagaccccggtttaataacgtccagttaaacctcaccgatgaggagagggaagagacggaagaagaagtgtatctgttaaatagcactactctctag

SEQ ID NO: 182736 - DNA, 2376 bp, Artificial Sequence
  Description of Artificial Sequence: Synthetic coding sequence
atggagagcgagcagctgttccaccggggctactaccggaacagctataattccattacttcagcgtcatctgatgaggaactgttagacggcgccggggtgattatggattttcaaacgtcagaagacgataacctacttgatggcgacacagccgtgggtacacattacacaatgactaatgggggcagcattaattccagtacccacctgctggacctgctggatgagcctattccaggagtgggaacatatgacgattttcataccattgactgggtgcgggagaagtgcaaggatagggagagacaccgcagaatcaattcaaaaaaaaaagagtccgcttgggaaatgactaagagcttgtacgacgcctggagtggatggctggtagtaaccctgactggactggcttcaggagcactcgccggactcattgacatagccgctgattggatgacggacctgaaggaagggatctgtctgtcagctctatggtataaccatgaacagtgctgctggggctcaaacgaaacaaccttcgaggaaagagataaatgccctcagtggaaaacgtgggctgagctgatcattggccaagccgaaggacccggatcttacattatgaactacatcatgtatattttttgggccttaagctttgcatttctggccgtgtccctggtaaaggttttcgctccttatgcctgcggctctggcatccctgaaataaagaccattctgagcggctttattattcgtggatacctgggcaaatggaccctgatgataaaaaccataactctcgtcctcgctgtggctagcggactgtctctgggaaaggaggggccccttgttcacgtcgcgtgttgctgtggcaatatattcagctatttattccctaagtattccacaaatgaagcgaaaaagcgggaggtgtcatactatttccctctgaaaaccctctggcggtcgttcttcgccgcgctcgtggccgcatttgtgttgcgcagtattaatcctttcggaaattcccgcctcgtactgttctatgtggagtaccacacgccctggtacctatttgaactctttccctttattctgctcggtgtttttggagggctgtggggtgccttctttatccgggccaacatcgcgtggtgccgcagacggaagagtacaaaatttggtaagtacccggttctggaggtcatcatcgtggcagctatcacggctgtaatcgccttccctaatccgtacactcggcttaacacaagtgagctgattaaggaactctttaccgactgtgggcctcttgaatccagctcgctgtgcgactatcgaaatgacatgaatgcaagcaaaattgtcgatgatatcccggaccggccagccgggatcggcgtgtactctgccatctggcagctgtgcctggccctgatcttcaagattatcatgacggtattcacatttggcattaaagtacctagcggattgtttatccccagcatggccattggtgccatcgccggaaggattgtggggattgcagtggaacagcttgcttattatcaccacgactggtttatattcaaagaatggtgtgaggttggagccgactgcattacccccggattgtacgccatggtgggagcggccgcctgcttaggcggcgtgacccgaatgaccgtgtccctagttgtgattgtgtttgaacttacggggggcctggagtatattgtacccctgatggccgccgtcatgacttcaaaatgggtgggtgatgcctttggccgggagggcatatatgaggctcatatcagactgaatggttaccccttcttagacgccaaggaagagttcacccacaccactcttgccgccgacgtgatgagacctaggcgaaatgacccacccctggccgtactgacgcaggacaatatgaccgtggatgatatcgagaacatgatcaatgagactagctacaacggcttcccagtcatcatgtcaaaggagagtcaaagactggtgggtttcgcactgcgaagggacctgacaatcgctattgagtcggcaaggaaaaaacaggaggggatcgtcggatcgagccgagtctgtttcgctcagcacaccccatcactgccagcggaatcaccccgcccccttaagttgcgatctattctcgacatgtcccctttcacagtcactgatcacacacctatggagatagtggtggatatctttcgcaagctggggcttcggcaatgtctggtgactcataatggacgccttctcgggataatcaccaagaaagacatcctgagacatatggcccagaccgctaatcaggatccagcatccataatgttcaattag

SEQ ID NO: 182737 - DNA, 2406 bp, Artificial Sequence
  Description of Artificial Sequence: Synthetic coding sequence
atggtgaccctgcagctgggcgagagccactacgtggtgcaggccggtctgcagctgttaggctcaagcaacccaccagcactcgcttcacaggtcgcagagataacaggcacccattacactatgactaatggcggtagtatcaatagctctacccacctgctggatttactcgacgaacccatacccggggtgggcacttacgatgactttcacaccattgactgggtgagagagaagtgcaaagatcgcgaaagacacagacggatcaatagcaaaaagaaggaatcagcatgggaaatgaccaagagcctgtatgatgcttggtccggctggttagtagtgacactgaccgggctggccagtggagcattggccggcttaatcgacattgccgctgattggatgacagatcttaaggaaggcatttgtctgagcgctctgtggtacaaccatgaacaatgttgctgggggtcaaacgaaactacatttgaggaaagagacaaatgcccccaatggaaaacttgggccgaactgatcatcggacaggctgagggccccggctcttacattatgaattacatcatgtatattttctgggccctctcatttgcattcctcgcagtcagcctcgtaaaagtgtttgccccgtatgcctgcggcagtgggatcccagaaatcaaaacaatcctgtccggtttcataattaggggatatttgggcaagtggaccctgatgatcaaaaccatcaccctggtacttgctgtagcctcggggttgtccctcggcaaagaggggccgctcgtccacgtggcctgctgttgcgggaatattttcagctacctgttccccaagtattccacaaacgaggctaagaaaagggaggttctgtctgccgccagtgctgccggagtatccgtggccttcggtgcccccatcgggggcgtcctgtttagtctcgaagaggtgagttattacttcccactgaaaaccctgtggaggagttttttcgccgccctggtggcagcttttgtcctccgctccattaacccttttgggaactcgcggctggtgcttttctacgtcgaatatcatacaccttggtatctgtttgaactctttcccttcatcctcctgggagtgtttggtggattatggggcgccttcttcatcagggcaaatatcgcatggtgcaggcggagaaagtcaacgaagtttggtaagtatccggttctggaggtgataattgttgctgccatcacggccgtaatcgcattcccgaacccctacaccaggctgaatactagcgagctgattaaggaactcttcaccgactgcgggccactggaatccagtagtctgtgtgattatcgcaacgacatgaacgcctccaagattgtggatgacattcccgatcgtcccgcaggaattggcgtttactcagctatctggcaactgtgtctggcgctgatctttaaaattatcatgacggtttttacatttggcataaaagtgcctagtggactgtttattcccagtatggccattggcgccattgcagggcggatcgtcggaatcgccgtggaacaactcgcttactaccaccacgattggtttatctttaaggaatggtgtgaggtgggggctgactgcatcacccctggtctgtatgccatggttggagcagccgcttgtttgggaggagttactcggatgactgtcagtcttgtggtgatcgttttcgaactaactggaggcctcgagtacattgtgccgctcatggcggccgtgatgacttcaaaatgggtcggggacgcattcggacgggaaggtatttacgaagctcacatcaggcttaatggataccccttccttgacgctaaagaagagttcactcacaccacacttgcagctgacgtcatgaggcccagacgaaatgacccaccccttgcagtcttgacccaggataatatgaccgtggatgatattgagaacatgatcaatgagacatcatataatggtttccctgttataatgtccaaagagtcacagagactggtgggctttgccctaaggcgggatctgactatagccatcgaaagtgcccgcaagaagcaggagggaattgttgggtccagcagggtctgcttcgcgcagcatacgccatctttgccagcagaatctcccaggccacttaaactccgatcaatactagacatgagcccctttactgtgacagatcacaccccaatggaaatagtggtggatatttttagaaagctgggcttgcgacagtgtctcgtaactcacaacggcaggctgctcggcatcattactaagaaagatattctgagacacatggctcagacggcaaaccaggatcccgcatctatcatgtttaactag

SEQ ID NO: 182738 - DNA, 522 bp, Artificial Sequence
  Description of Artificial Sequence: Synthetic coding sequence
atggagagcgagcagctgttccaccggggctactaccggaacagctacaacagcataacaagcgcgtcctctgatgaagagttgttggatggcgctggcgttataatggattttcagaccagtgaggacgataacttactggatggtgatacagccgtgggtacacactacactatgaccaacggcgggagtatcaactcttccacacacctgctggatctgctcgatgaaccaataccaggagtgggcacgtatgatgatttccatactattgattgggtgcgcgagaaatgcaaggacagggagcggcacaggcgaatcaattcaaagaaaaaagaatcagcttgggagatgaccaagtccttatatgacgcctggagtggatggcttgtcgtcacgctgacgggtctggcgtcaggagcactggccgggctcatcgatattgcagccgactggatgacggacctgaaagaagggatctgcctgagcgccctttggtacaaccatgaacaatgttgctag

SEQ ID NO: 182739 - DNA, 420 bp, Artificial Sequence
  Description of Artificial Sequence: Synthetic coding sequence
atggagagcgagcagctgttccaccggggctactaccggaacagctacaattctatcacgagcgcttccagcgacgaggagttgcttgacggcgccggcgtaatcatggactttcagactagcgaagatgacaatctcctggacggggataccgctgtgggaacgcactacacaatgaccaacggaggtagcataaactcttccacccatctccttgatttgcttgatgaaccaataccaggagtgggcacctatgatgatttccatactattgattgggttagggagaaatgcaaggatcgcgaaagacacaggcgaattaattccaagaagaaagaaagtgcatgggaaatgacaaaaagcttgtacgatgcctggtctggctggctggtggttaccctcactgggttggccagttag

SEQ ID NO: 182740 - DNA, 2457 bp, Artificial Sequence
  Description of Artificial Sequence: Synthetic coding sequence
atggagagcgagcagctgttccaccggggctactaccggaacagctataactcaataacatctgccagctccgatgaggagctcctcgacggggcaggagtgataatggattttcagacctccgaagacgataatctgctcgacggagacacggctgtgggaacacattatactatgaccaatgggggaagtattaacagttcaacacacttactcgatctgctcgacgaacccattccaggtgttggcacctatgacgacttccacaccattgactgggtgcgcgagaaatgtaaagatagggaaaggcacagaaggatcaactctaagaagaaagagtcggcatgggagatgacgaagtcactgtatgatgcctggtctggatggttagtggttacccttaccggtctggcatcaggagctttggcggggctgattgacatcgccgcagactggatgacggatctgaaagagggcatctgcttgtccgcattgtggtataaccacgagcagtgctgctggggatccaacgaaaccaccttcgaagaaagggacaagtgcccgcagtggaagacgtgggcagagttgatcattggccaggccgaaggaccgggctcttacatcatgaactacattatgtatattttctgggcactgtcctttgctttcctggctgtgtcattagtcaaggtattcgcaccgtacgcctgtggctccgggatcccagagatcaaaaccatcttaagcggattcatcatacgtggctacctcggaaagtggacgcttatgatcaagacaataacgctagttttagctgtggccagtggactaagtctgggaaaggaaggacctctcgtccacgtggcgtgctgctgcggaaatatattctcctacctctttccaaaatactcaaccaacgaagccaaaaagagggaggtactgtctgcggccagtgctgccggagtgtctgtggcgtttggcgcaccaatcggtggggtactgtttagtttggaggaggtttcctactattttcccttaaaaactctgtggcggtccttttttgcagctctggtggcagctttcgttctgagaagcatcaaccctttcggaaatagccgcctggtgctgttctacgtggagtatcataccccatggtacctgttcgaactctttccattcatccttcttggggtgttcggcggcctatggggagctttcttcatcagagcaaacatcgcttggtgccgacggcgaaagtccactaaattcggaaaataccctgtacttgaggtcattatcgtggctgccattactgccgtgatcgcgtttccaaacccctacacaaggttaaacaccagcgagctcattaaggaactgtttaccgactgcggtcccctggaatctagtagtctctgtgattaccgcaacgatatgaacgcttccaaaattgtcgacgatatccccgacagaccggccggcataggtgtatattcagcgatctggcaactctgtctcgccctgatcttcaaaatcatcatgactgtgtttacatttggcatcaaagtacctagcggcttgttcatcccttctatggcaatcggcgccatcgcaggccgcatcgtggggatcgccgttgagcagctggcctactaccatcacgactggtttatatttaaggaatggtgcgaagtgggtgcagattgtatcacccctggattgtatgctatggtcggagctgcagcctgcctgggcggtgtgactagaatgaccgtgtcgttagtggtgatagtatttgagctgactggaggattagaatacatcgttccattgatggcagctgttatgacctctaagtgggtaggtgatgcctttggacgggaagggatttacgaagcccacattcgacttaacggatatccctttcttgacgcaaaggaagagtttacacacacaactctggctgccgatgtgatgagacctcggcgaaatgatccaccactggccgttctgacccaggataacatgaccgttgatgatattgagaacatgattaatgagacatcctacaacggattccctgttattatgtctaaagagtctcaacgtctggtggggttcgccctgaggagagatctgactattgcaatcgaatctgccaggaagaaacaggaaggaattgtcggcagttcacgggtgtgcttcgcgcagcacactccaagcttgcccgccgaatcccccaggcctctgaaacttaggtctatattggacatgtctccattcaccgtcaccgatcacacacccatggagattgtggtggacatcttcagaaaactgggtctccggcaatgtctggtcacccataacggacgtttgctgggcatcatcacaaaaaaagacatactgagacatatggcacagacagccaaccaggaccctgccagtatcatgtttaattag

SEQ ID NO: 182741 - DNA, 576 bp, Artificial Sequence
  Description of Artificial Sequence: Synthetic coding sequence
atggagagcgagcagctgttccaccggggctactaccggaacagctataacagtattacgtcagcctcctccgatgaggagttgctggacggagccggggtaatcatggacttccagacatctgaggacgacaacctacttgacggtgatacagcagtcggaactcactatactatgaccaatggcggctccattaacagttcaacccacttactagacttactcgatgaacccatccctggggtcgggacctatgacgattttcacacaattgattgggttcgagaaaagtgcaaagacagggagcggcataggcggattaacagtaagaaaaaagaatccgcttgggagatgacaaagagtctgtacgacgcttggtccggatggctggtggttaccttgaccggcctcgcctcgggcgcactggctggtcttattgatattgcggccgattggatgacagacctgaaagagggaatttgcctgagcgccctgtggtataatcatgagcagtgttgttggggaagcaacgaaacgacttttgaaaagaagaaaaagaagaaaaagaaagcctag

SEQ ID NO: 182742 - DNA, 2190 bp, Artificial Sequence
  Description of Artificial Sequence: Synthetic coding sequence
atggtgaacgccggcgccatgagcggcagcggcaacctgatggactttctggacgagccattccccgacgttggcacttacgaagattttcatacgatagactggcttagagagaagtcacgggacacggaccggcacagaaagattaccagcaaaagcaaggaatctatttgggaattcatcaagtctctactcgatgcctggtcaggctgggtggtgatgttgctgatcggacttcttgctggaacccttgcgggagtaatcgatctcgccgtcgactggatgaccgatctgaaggagggggtatgtttgagcgccttctggtattcccatgagcagtgttgttggacttctaacgagacaacattcgaggaccgcgataaatgcccactgtggcagaagtggagtgagttattagtcaatcagtctgaaggagcaagtgcatacatcctaaactatctgatgtacattctttgggctctgctgttcgcctttctggcggtctccctagtgcgggtgttcgccccttacgcatgtggatcaggaattccagaaatcaagaccattttgagtggatttatcattagaggctacctcggcaagtggaccctgcttatcaaaacagtgactcttgtcctcgttgtgtcctccggtctgagtctcggtaaggagggtcccctggttcacgtcgcctgttgctgcgggaactttttcagctcactcttttctaagtatagcaagaacgaaggaaaacgccgggaggtcttgagcgcagccgcagctgcaggcgtgagcgtagcattcggggccccgattggcggggtgcttttctcgctggaagaggtcagctattacttcccgttaaagaccctgtggaggtccttctttgcagccttagtggccgcttttactttacggtctattaatccctttgggaatagcaggcttgtgctcttctatgttgagtaccacactccctggcgaaggaaaactacacggctgggaaaatatcctgtgcttgaggtcatcgtggtaactgccatcaccgccatcatcgcttaccccaatccgtatacaaggcaatccacatcagaactgattagcgaactgttcaatgactgtggcgccttggagtcctctcaactgtgtgattatattaacgaccctaacatgactcgcccagtagacgatatcccggatagaccagcaggggttggagtgtacactgccatgtggcagttagcactagccctgatctttaagattgtggtgacgatttttacattcggaatgaagataccatccggtttatttatcccaagcatggccgtgggtgctatagccggccgaatggtggggatcggcgttgagcagctagcttatcaccaccacgattggataatcttccgcaattggtgtcgccccggggccgattgtgttaccccaggcctctacgctatggtgggcgccgcagcctgcttaggaggcgtcacgaggatgaccgtgtcactggtggtaatcatgttcgaattgacaggtggtttagagtatattgtaccactgatggcggcagctgtaaccagtaaatgggttgctgacgccttcggcaaggagggcatttacgaggctcacattcacttgaacggatatccatttctggacgtgaaggacgaattcacccaccgtactttggccacagatgtgatgcgtccaaggagaggtgagcctccgctttctgtgctgactcaagactccatgaccgtagaggatgtggaaacgctgatcaaagaaacagactataacgggttcccagtcgtggtctcacgcgacagcgagcgactgatcggcttcgctcagaggagggagttaatcctcgcgattaaaaatgcaaggcagcgacaggaagggatagtaagtaattccattatgtacttcaccgaagagcctccagagttgccagccaattccccccacccgctcaagctgcgtagaatccttaatctgtcaccgttcaccgtcaccgatcatacccccatggagacggtggtggatattttcaggaagctcgggctgcgccagtgcttggtaacgaggtcagggcggctcctaggcatcatcaccaagaaagacgtgctgcgtcacatggcacagatggccaaccaagatccggagagcatcatgtttaactag

SEQ ID NO: 182743 - DNA, 2283 bp, Artificial Sequence
  Description of Artificial Sequence: Synthetic coding sequence
atggtgaacgccggcgccatgagcggcagcggcaacctgatggacttcctagatgagccttttcctgatgtgggcacctacgaagacttccataccatcgattggcttagggagaagagtcgggatactgaccggcataggaaaataacatccaagagcaaggagagtatctgggaattcatcaagtcgctgctggacgcttggtccggctgggtggtaatgcttcttattgggctgctggccgggacgcttgcaggagtaatcgacctggctgtggattggatgacagatttaaaagaaggagtttgtttgagcgctttttggtacagccatgagcagtgctgttggacctcgaatgagactacgtttgaagacagagacaaatgcccattgtggcaaaagtggagtgagcttctggttaatcagagtgagggcgccagcgcttacattctgaattatcttatgtatatactatgggcgctgctctttgcctttctggccgtgagcctggttcgggtgttcgcgccttacgcatgcggctccggcattccagagattaagaccatcttatctggcttcattatccggggttacctgggtaagtggaccctcctcattaagactgtaaccctggtgctcgttgtctctagtggtctgtcactgggaaaggaagggcctctagtccatgtggcgtgttgttgtggcaacttcttttcatcattatttagcaaatacagcaagaacgagggtaaaaggagagaggtgctgtcagctgccgctgccgccggggtcagtgtggctttcggggcccctatcggtggggtcctctttagcctcgaagaagtctcctactacttccccctcaagaccctgtggagatcttttttcgctgcgctggtggccgcctttacactgcgttccatcaacccctttggaaattcaagactggtccttttttacgtggagtatcacaccccatggtacatggcagagctcttccccttcattttactgggcgtcttcggcggtctttgggggactttgttcatcaggtgcaatatcgcttggtgtcggcgcaggaaaacaacacggctcggcaaatatcctgtgctcgaggtaatagtggtgacggctatcactgctatcatcgcttacccaaatccgtatacacggcaaagcacatccgagctcatttccgagctctttaacgactgtggcgcactcgaatcttcccagctgtgtgactacatcaatgatcccaacatgacacggcctgtggatgacataccggatcgaccagccggagttggggtctatactgccatgtggcagcttgccctggctttgattttcaaaatagtagttacaatcttcacatttggcatgaagatccctagtggcctttttataccaagtatggccgtgggggccattgccggtcggatggtagggatcggcgtggagcaactggcctatcaccaccatgactggatcatctttcggaattggtgcaggcctggcgcagactgcgttacgccaggtctttatgctatggtgggcgcagccgcgtgtttgggcggtgtgacaaggatgacagtttccctcgtcgtgattatgtttgaacttacaggcgggctcgagtatatcgtgccccttatggcagccgcagtgaccagcaagtgggtcgcggacgcttttggcaaggaggggatttacgaggcgcacattcacttaaatgggtatccttttctcgacgtgaaggacgaattcacccatcgtacactggcaaccgacgtgatgaggcccaggagaggggaaccccctctcagcgtcctcacacaggactccatgacggtggaggacgtcgagactttgatcaaagagacggactacaacggcttcccagtcgtggtgtcccgagattctgagcggctcatcgggttcgcccaaaggagggagctgatcctcgctatcaagaatgcgaggcaaaggcaggagggtatcgtgtcaaattctatcatgtactttaccgaggagcctcccgagctccccgcaaattctccgcacccgctgaaactgagacggatcctcaacctgtcccctttcaccgttaccgaccatacccctatggagacagtggtggacattttccgaaagcttgggctgagacagtgtcttgtgactcgaagtggccgcctcctgggcattattactaagaaagacgtgctccgccacatggctcaaatggccaaccaggaccccgagtcaattatgttcaactag

SEQ ID NO: 182744 - DNA, 2001 bp, Artificial Sequence
  Description of Artificial Sequence: Synthetic coding sequence
atgaccgacctgaaggagggcgtgtgcctgagcgccttctggtacagccacgagcaatgctgctggacgagcaacgaaactacatttgaggatcgcgacaaatgcccgctctggcagaagtggtccgagctattggttaatcaatccgaaggcgcatcggcatatatcctcaactatcttatgtacatcctctgggcgttgctttttgcctttctggccgtctccttggtgagggtgttcgctccatatgcttgcggctctggcatccccgagattaaaacgatcctctccggctttatcatcagggggtatctcggaaaatggacgctgctgatcaagactgtgactctagttcttgtcgtgtccagtggattgtccctcggcaaggagggcccattggttcatgtcgcttgttgctgcgggaattttttttcgagcctgttttcaaaatactccaagaatgagggcaagcgcagagaagtgcttagcgccgccgcagcagccggcgtttctgtagcattcggcgctcctattgggggtgtgcttttcagcctggaggaggtgagctactattttccgctcaagaccctgtggagatcctttttcgcggcacttgtagctgcattcacactcaggagcatcaatccgttcggcaattcaagattagttcttttttatgtcgagtatcacaccccctggtatatggcagagctgttccctttcatcttgctgggagtgttcggcggtctctggggtacactattcatccgatgtaatatagcatggtgccggaggcggaagaccactaggcttggcaaatatcccgtgttagaggtcatcgtggttacagccatcacagccatcatcgcataccctaacccttacacccgacaatcaacttccgagctgatctccgaattgttcaacgactgtggtgcactcgagagctcccaactctgtgactacatcaatgatcccaacatgacccggcctgtggacgacattccggaccgacctgctggtgtgggcgtctacactgccatgtggcagttggcactcgccttgatattcaaaattgttgttaccattttcacattcggaatgaaaataccgtctgggctgttcattccatcaatggccgtcggagcaattgcaggccggatggtggggatcggggtcgagcaactggcttaccatcatcatgattggattatctttaggaactggtgcagacccggagctgattgcgtgacccctggcctgtatgccatggtgggcgctgccgcttgtctgggcggagttacacggatgacagtctcactggttgtcatcatgttcgaattaacgggcggattggaatacatcgtaccgctgatggcagcagccgtgacgagcaagtgggtcgctgatgcatttggtaaggagggaatttatgaggcgcacatccacctcaatggctaccctttcctggatgtgaaagatgagtttacacacaggaccctcgccactgacgtcatgagacctagacgaggagaaccacctcttagcgtcctgacccaagatagcatgactgtggaggatgtggagacccttattaaagaaaccgactacaacgggttccccgtggtggtgtccagagactccgagcggctaatcggtttcgcccagcgacgcgagctcattctggcaatcaaaaacgccaggcaaaggcaagagggaattgtttctaatagcatcatgtacttcaccgaggaaccacctgagttgccagccaattccccccatccacttaaactgcgccgcatcttgaacctaagcccatttaccgtgacagatcacaccccaatggaaaccgtagtggatatattccgaaaactcggattgcggcagtgcctggtgacaagaagtggtcggcttctggggatcatcactaaaaaagatgtactcaggcacatggcgcagatggcaaaccaagaccccgaaagcatcatgttcaactag

SEQ ID NO: 182745 - DNA, 459 bp, Artificial Sequence
  Description of Artificial Sequence: Synthetic coding sequence
atggtgaacgccggcgccatgagcggcagcggcaacctgatggacttcctggacgagcccttccctgacgtgggcacttacgaggattttcataccatcgactggctcagagagaaaagcagagatacagatcggcatagaaaaatcacaagtaaatccaaagagtctatttgggaattcataaagagccttctggacgcctggtccgggtgggtagtgatgctgctgatcggcctgctggcagggaccctggccggagtcattgatctggctgttgattggatgaccgacctgaaagagggggtgtgtctcagcgccttttggtactcccatgaacagtgttgttggacgtccaacgaaaccacctttgaggaccgcgataaatgccctttatggcagaagtggtctgagttactggttaaccagagtgaagttctgtctgcagccgcagctgcttag

SEQ ID NO: 182746 - DNA, 2241 bp, Artificial Sequence
  Description of Artificial Sequence: Synthetic coding sequence
atggacttcctggaggagcccatccccggcgtgggcacctacgacgatttcaatacaattgattgggtgagggaaaagagtcgcgaccgggaccgccatagggagattaccaataaaagcaaagagtccacgtgggccctgatacacagtgtgtctgacgcttttagcggctggctcctgatgctgctgatcggcctgctgagcggctcgctcgccggcctaattgacatctctgcgcactggatgactgatctgaaggaaggcatctgcacgggagggttctggttcaatcacgaacattgttgttggaacagtgagcacgtgacattcgaggagcgcgacaagtgtcccgaatggaacagctggagtcaactcatcattagcactgatgaaggagcctttgcttacatcgtgaattatttcatgtacgttctgtgggccttactcttcgcattcctggctgtgagcctcgtcaaggtcttcgcaccctacgcctgcggcagtggaatcccggagataaaaacaatcctgtcaggctttataattagaggttatctcggtaagtggaccctggttatcaagacaatcacactagtgctcgccgtaagctccggactcagcttgggtaaggagggccccttagtacacgtggcttgctgctgtggcaatattttgtgccattgtttcaacaagtacaggaaaaacgaggccaagcgacgggaagtgctctccgccgcggcagcggctggagtgagcgttgcgttcggcgcgccaataggcggagtattgttctctctagaggaagtttcttattactttcccctgaaaactctatggcgctcttttttcgccgctctggtggctgcttttacactgcggtcaataaaccccttcgggaattcacggctggtgctcttttacgtagagtttcatacaccttggcacctttttgaactagtcccctttatcctgttggggatttttggagggctctggggtgccctgttcattcggactaacattgcgtggtgccggaaacgcaagaccactcagctcggcaagtatcccgtaatcgaagtgctcgtcgtgactgcgatcaccgcaatcctggccttccccaacgaatacacgcgaatgtcaacttctgagcttatttccgaactgtttaatgattgcggtctgctggactcatcaaagctctgcgactatgagaacaggttcaacacctcaaagggtggggaattgcctgaccggcccgctggtgtgggtgtctattcagccatgtggcagctagcgctgactctgatccttaagatcgtgattactattttcacttttgggatgaaaatcccttctggcttatttatcccatctatggctgtcggcgcaatcgccggccgactgctgggcgtgggcatggaacagctggcctactatcaccaagaatggactgtattcaatagctggtgctcccagggagcagattgcattacaccggggttgtatgccatggtcggcgctgccgcctgtcttggcggagtgactagaatgaccgtttcccttgtcgttataatgtttgagctaactggcggattagagtatatcgtgcctttaatggcagctgcaatgaccagcaaatgggtcgcggatgcattggggagagaaggtatttacgatgctcatattcggcttaatggataccccttcttggaggctaaagaagagtttgcgcacaagaccttggctatggacgtgatgaagcctcgcaggaatgacccgctgcttacagtgttgactcaggatagcatgactgtggaagatgtggagacgatcatctctgaaacgacctattccggattccctgtggtcgtgagtcgcgagagccaaaggctggtcggctttgttttgaggcgagacctgattatttcgatagagaacgccagaaagaaacaagacggtgtagtgagcaccagtattatctattttactgagcacagccctcccctgccgccttacactcccccaacactcaagctgcgcaacatcctggatctcagccccttcaccgtgaccgatctgacccccatggagattgtggtagatatttttcggaaattgggcctgagacagtgtctggtgacgcataacgggagattgctgggcattattaccaagaaggatgtgctgaaacatattgcacaaatggccaaccaggaccccgatagtatccttttcaattag

SEQ ID NO: 182747 - DNA, 2451 bp, Artificial Sequence
  Description of Artificial Sequence: Synthetic coding sequence
atggccatgtggcagggcgccatggacaaccggggcttccagcagggatctttttcaagcttccaaaactctagcagcgatgaagacttgatggacatacccgcgactgccatggatttcagcatgcgggacgatgtgcccccattagaccgggaggtgggggaagataaatcatataatgggggtggtattggaagttccaatcgaattatggatttcttggaggagccaatcccgggtgtgggcacatatgatgactttaacaccatcgattgggtccgggaaaagtcccgtgaccgtgatcgacatagagaaattactaataagtccaaagagtcaacgtgggcattgatccacagtgtgagtgacgctttctccggctggctgttaatgctgctcataggtctccttagtgggagcctcgctggcttgatcgacatttccgcccattggatgactgacttgaaagagggcatttgtacgggcggtttctggtttaaccacgaacactgctgttggaattccgagcacgtcacattcgaggagagggataagtgtcctgaatggaactcttggtcccaactgataatctctaccgacgagggagccttcgcatatattgtgaattattttatgtatgtcctgtgggctctgctgtttgctttcctggccgtctcgttggtcaaggtgttcgcgccatacgcatgcggatctggtataccagaaatcaaaacaatcctttctggttttatcattcgaggatacctgggcaagtggaccctggtgattaaaaccatcaccctcgtgctggccgtctcctccggtttgtcactgggaaaagagggcccattagtccacgttgcgtgctgctgcggaaacattctgtgtcattgcttcaacaagtacaggaagaacgaagcaaaaaggagagaggttctatctgcagctgccgccgccggtgtgagcgtggccttcggggcaccgatcggcggggtgctcttctcattggaagaagtgagctattattttcctctcaagacattgtggagatcttttttcgcggcattggtcgccgcttttaccttgagaagcatcaatccattcggaaatagcagactggtactgttttatgtggaattccacacaccctggcatctattcgaattggttccattcatcttgcttggaatttttggtggcctgtggggagcattgtttatcaggacaaacattgcttggtgccgcaaacgaaaaactacacagctcgggaagtaccctgtgattgaagtactggtggtcaccgcaataacagctattctagctttccctaatgaatatacgcggatgagcacatctgagctcatctcagagctgttcaacgactgcggactcctggatagctccaagctttgcgattacgaaaataggtttaacacaagtaaaggcggtgagttacctgacagacctgccggagttggcgtgtacagtgccatgtggcagctggccctgaccctgattttaaaaatcgtgatcacaatcttcaccttcggcatgaaaatcccgtctgggctcttcatcccatcaatggcggtcggagctatcgctgggcgcctgctcggcgtggggatggagcaactggcctattatcaccaggagtggacggtgtttaatagctggtgctcacaaggagccgactgtatcacaccagggctctacgcaatggttggggccgctgcctgccttgggggcgtgactaggatgaccgtatcactcgtagtgatcatgttcgagctaaccggcgggctggagtatatcgtgccactcatggccgccgcgatgacaagcaagtgggtcgcagacgctcttggccgagaaggaatatatgatgctcacattcgactaaacggttacccgttcctcgaggccaaggaggaatttgctcacaagaccctcgctatggatgtaatgaaacctagaagaaacgaccccctcctgacggtccttacccaagattccatgaccgtagaagacgtggagacgatcatttcagagactacatacagcgggttcccagtggtcgtctccagggaaagtcaacggctggtgggctttgtgttaaggcgcgacttgattatttcgattgagaacgctagaaagaagcaggacggggtggtgtccacatccattatctacttcaccgagcattctcctccactcccaccttatactcctccaacgctaaagcttcgtaacatcctggatctgtctccgtttaccgtgacagatttgaccccaatggagatagtggtcgacattttccggaagctgggtctgcgtcagtgtttggtcacccataacggcaggctactgggcatcatcaccaagaaagatgtccttaaacatatcgcgcagatggcaaatcaggacccagacagtatcctgttcaattag

SEQ ID NO: 182748 - DNA, 2451 bp, Artificial Sequence
  Description of Artificial Sequence: Synthetic coding sequence
atggccatgtggcagggcgccatggacaaccggggcttccagcagggatcattcagcagctttcaaaattcgtcttcagacgaggatcttatggacattccagctacagcaatggatttttctatgcgggatgacgtcccaccactcgatcgggaagtaggagaggacaaatcttacaatggcggaggcatcggtagctcaaaccgcattatggatttcctggaagaacccatcccaggagtcggaacatatgacgatttcaatacaatcgattgggtgcgggaaaaaagcagagaccgcgataggcatcgcgaaataactaataaatctaaggagtcaacttgggctcttatccactcagtttctgatgcttttagcggctggttactcatgctgttgataggactgctgagtggcagcctggccggcttgatcgatatcagcgcccactggatgaccgatctgaaagagggaatatgtacaggggggttctggtttaatcacgagcactgctgctggaactccgaacacgtgacttttgaagagcgagataaatgccctgagtggaactcatggtctcagttgattattagcacagatgagggcgcatttgcctacatcgttaactattttatgtacgtactgtgggctctgctcttcgccttcctcgccgtgtcgctggtcaaggtttttgccccctacgcctgcggctcagggatccccgagattaagaccatactttcaggttttattatcagaggttatttgggtaaatggactctcgtcatcaagacgataaccctggtgctggccgtttcatccggtctgtctctgggcaaggaaggacctctggtacacgttgcctgctgctgcggaaatattctttgccattgctttaataagtaccgtaagaatgaggctaaaagacgcgaagtgttatccgctgcagccgccgccggggtgtcggttgctttcggcgccccaattggcggtgtcctgtttagtttggaggaggtgagttattatttccctcttaaaacactttggcggtcatttttcgccgccctggttgcggctttcaccttgcgaagcattaaccccttcggcaacagcaggttggtcttattctacgtggagtttcatacaccctggcacttgtttgaactggtgcccttcatcctgctgggaattttcggtggcctctggggtgcactgttcatccgcacaaacatagcctggtgccgcaaaagaaaaactacacagcttggcaagtatcctgtgatcgaggtactggtggtgaccgctattaccgcaatcctggccttcccaaacgaatacacacgcatgagcacttctgagttgatatcagaactgtttaacgactgcggcctgctcgattccagcaaattgtgcgactacgagaaccggttcaacacttccaaaggaggtgaactgccagatcgcccagcgggagtcggggtctatagcgccatgtggcagctggccctgaccctgattttgaagatcgtaattaccatttttacttttggcatgaagatcccatccggcctgtttattcccagcatggcagtgggcgccatcgctggccgtctcctgggcgtgggcatggaacagttggcctactaccaccaggaatggactgtgttcaattcctggtgcagccagggcgcagactgtataaccccaggtctttacgcaatggttggcgcggctgcctgtctgggcggagtgacccgcatgaccgtaagccttgtcgtaattatgtttgagctcacaggtggcctggagtatatcgtaccattgatggccgctgcaatgacctcgaaatgggttgctgacgcacttgggcgggaggggatatatgacgctcatatcaggctcaacggatacccctttctggaggcaaaggaagaatttgctcacaaaaccctggcaatggacgtgatgaaaccgcgccggaatgatcccctgttgactgtgctgacccaggactctatgaccgtcgaagatgtcgagactattatcagtgagactacatatagtgggttccccgtagtcgttagcagggagtctcaaagactggtcggttttgttctgcggcgggacctcataatctccattgaaaatgctagaaaaaagcaagacggagtcgtgtccacgtctatcatttacttcacagagcactcacctcctctcccaccttacactccccccacactgaagctcaggaacattttagacctgtccccctttacagtgactgatctgacccccatggaaattgttgttgatatatttcgcaagcttgggttgcgacaatgcctggtgacacacaacgggcgattactgggcataattactaagaaagacgtgttgaagcacatagctcaaatggctaaccaggatcccgactctatcctatttaactag

SEQ ID NO: 182749 - DNA, 2241 bp, Artificial Sequence
  Description of Artificial Sequence: Synthetic coding sequence
atggacttcctggaggagcccatccccggcgtgggcacctacgacgattttaatacgatcgactgggttcgggaaaagtctcgggatagggatagacaccgggagatcaccaataagtcgaaagagtccacctgggctcttattcatagtgtatctgatgctttctctggatggttgcttatgcttttgatcggattactgagtggaagtctggccggattgattgacattagtgcccactggatgaccgaccttaaagaggggatatgtacgggcggcttttggtttaaccatgagcattgttgctggaattctgaacatgttaccttcgaggagcgagataaatgccctgagtggaattcttggtcacaactcatcatctccacggatgagggcgctttcgcttacatagttaactatttcatgtacgtgctgtgggcacttctgtttgctttcctggcagtctcattggttaaggtattcgcaccatacgcatgtggcagcggaatacccgaaattaagactatcctgtcgggattcatcatcaggggttatttagggaaatggactttagttattaaaacaattaccctagtccttgccgttagcagtggcctgtcccttggcaaggagggccctctcgtacacgtagcctgctgctgcggcaatatattgtgtcactgcttcaataagtatcgaaaaaatgaggcaaagagacgcgaggtgctgtcagccgcagccgcagcaggggtaagcgtggcattcggcgctcctatagggggcgtccttttcagtctcgaagaggtgtcctattactttccgctaaagactctttggagatctttttttgctgccttggtggcagccttcactcttagatccatcaatccattcgggaattctcggcttgtgctgttttacgtcgaattccatactccatggcacctctttgagctcgtgcccttcatcctgctgggaatcttcgggggcctgtggggcgccttattcatccgtactaatatcgcatggtgcagaaagaggaagaccacccagcttggaaagtatcctgtaattgaggtcttagtggtgactgctatcacggcgatccttgcgtttccaaatgaatacacaagaatgtctacaagcgaactgattagcgaactatttaatgattgcgggttgttagactcaagtaaactctgtgactatgagaataggttcaacacttcaaaagggggcgaactgccagatcggccagctggggttggtgtgtatagcgctatgtggcagttggcacttacgttgatcctcaagatagtgataaccatcttcacttttggaatgaagatcccatcaggactgtttatccccagtatggcggttggagcaatcgctggcaggctgctgggcgtcggcatggagcaactggcctattatcatcaggaatggacggtcttcaactcgtggtgctcccagggagctgactgtatcactcccgggctatacgcaatggtgggcgccgccgcatgtctcggtggggtgacaagaatgaccgtgtccctggtcgtaattatgtttgagcttacaggaggactcgagtacatagtcccccttatggcagcagccatgacttccaagtgggtggctgatgccctcggccgggaaggcatatacgatgcccacatccgcctgaatgggtatcctttcctcgaggcaaaggaggagttcgcacacaagacgctagccatggatgtcatgaagcccaggcgcaatgacccacttctcactgtcttaacacaagattccatgacagtggaggatgtcgagaccatcataagtgaaacaacatatagcggtttccctgtcgtcgtgtcaagagagagtcagagactcgtgggatttgtgctgaggcgcgatctgattatcagcatcgagaacgcccgtaagaagcaagacggagtggtgtcgacctctattatctacttcactgaacatagtcctcctctccccccctacacaccccctaccctcaaacttagaaacatcttggacctgtcaccattcactgtgaccgatctcactccaatggagatcgtggtggatattttccgcaaactgggactgaggcaatgccttgtgacccacaatgggcgcctgcttggcatcatcaccaaaaaagacgttttgaagcatatcgcacagatggccaaccaggaccccgacagcatcttgtttaactag

SEQ ID NO: 182750 - DNA, 1947 bp, Artificial Sequence
  Description of Artificial Sequence: Synthetic coding sequence
atgaacatcgtggccggcaccctgagcatgagccccctgaagcgggataaatgcccggagtggaacagctggtcacagctcattatctccacggacgagggagcatttgcgtatattgtgaactactttatgtacgtgctctgggcccttctttttgctttcctcgctgttagtctggtcaaggttttcgcaccttacgcgtgcggctccggcatccctgaaataaaaactattttatccgggttcattatccgtgggtatctcggtaaatggactttagttatcaagacaatcacgttggtcctcgctgtaagtagcggcctgagtctcggcaaggagggaccactcgtccacgtcgcctgctgttgcggtaatatactgtgccactgctttaacaagtataggaagaatgaggcaaaacgtagggaagtgctaagcgccgctgctgccgctggcgtctcagtggccttcggggcaccgatcgggggagtgctgttcagcctggaggaggtgtcctactatttccctttgaaaactttgtggcggagcttttttgctgccctggttgctgcctttacgctcagatcaataaacccgtttggaaatagtcgcctggttctgttttatgttgaattccacacaccttggcaccttttcgaactggtcccatttattctgttagggatatttggcggactgtggggtgcactctttattaggactaatattgcctggtgccggaaacgcaaaacaacacagcttggcaaatatcccgtgattgaggtgctggtggttactgccattactgcaattttagccttcccaaatgagtacacccggatgtcaacttcagagctgatctccgaactctttaatgactgtgggctcctggatagttcaaaactctgcgactatgaaaatagatttaacacgagtaagggcggagaactccctgatcgccctgcaggggtgggtgtttacagtgccatgtggcagctggctttaaccctaatcctgaagatcgtgatcacgatatttacatttggaatgaaaattcccagtgggctgtttatacccagcatggccgttggtgcaattgccggcaggctgctcggcgtgggaatggaacagcttgcctattaccaccaggaatggacagttttcaactcctggtgctctcagggcgccgactgcatcacccctggcctttatgccatggttggcgccgcagcatgtttgggaggggtaacaaggatgaccgtcagcctggttgtcattatgttcgaactgaccggaggccttgagtacatcgttccactcatggcagctgccatgacatccaaatgggtggcagacgctctgggccgggaggggatttacgatgcccatatacggcttaatggctaccctttcctggaggccaaagaggagttcgcacataaaaccttagccatggatgtaatgaagcctagaaggaatgaccctcttctgactgtcctgacgcaggactcaatgacggtagaagatgtagagactataataagtgaaacaacttacagcggatttccagtggtggtcagtcgggagtcacaaagacttgtgggatttgtgctgcggcgcgacctgataatcagcatcgaaaatgctcggaaaaaacaggatggagtggtttctacaagtatcatctactttacagagcactcccctccactgcccccttatactcctccgacattgaaactcaggaatatcctggatctgtccccctttacagtgactgatctgactcctatggagattgtggtggacattttccgcaagctgggtctgcggcagtgcctggtcacccacaacggccgcctactgggcataataacgaaaaaggatgtgctgaaacacatcgcacaaatggccaaccaagatccggactctatcctgttcaattag

SEQ ID NO: 182751 - DNA, 1062 bp, Artificial Sequence
  Description of Artificial Sequence: Synthetic coding sequence
atggccggctgccggggcagcctgtgctgctgctgccggtggtgctgctgttgcggggaacgcgaaacccgcacacccgaggaactgaccatccttggggaaacccaggaagaagaggatgagatactgccgcggaaggactatgagtccctcgattacgatcgatgcattaatgatccctatctcgaagtattggagactatggataacaagaagggaagacggtacgaggccgtaaaatggatggtcgtgtttgccattggagtgtgtactggcctagtgggcctcttcgtcgacttcttcgtgagactgtttactcagctgaaattcggagtggtgcaaacatctgtggaggagtgcagccagaagggatgccttgcgctcagcctgctagagttactcggtttcaacctgacatttgtttttctcgcctcgctgctggttcttatcgagcctgtggcagccgggagcggcatccctgaggtcaagtgctacctgaatggagtgaaagtaccgggcattgtgcggctcagaaccctcttgtgcaaggtcctgggggtgctcttcagcgttgcaggcggactcttcgtcgaaaaagaagggcctatgattcactctggttctgtcgttggcgccgggctacctcaattccagagtatatcactccgaaaaatccagttcaacttcccttactttagatccgacagagacaagcgtgattttgtatctgctggagcagctgccggggtcgccgccgccttcggtgctcccataggtggcactttattttcgctcgaagaggggtctagcttttggaatcaggggctcacatggaaagttttattctgctcaatgagcgccaccttcacacttaatttctttcggtccgggatccaattcggcagctggggttcttttcagctccccggactgctgaacttcggggaattcaaatcactgcgcgagccaccatgtgttagtggaaatcatcggggtggggtgtgcgggttagatggagtgcgccgaatgcctacagacgtgctttttgagagtaacagatag

SEQ ID NO: 182752 - DNA, 2610 bp, Artificial Sequence
  Description of Artificial Sequence: Synthetic coding sequence
atggccggctgccggggcagcctgtgctgctgctgccggtggtgctgttgttgtggcgaaagggaaacgcggactcccgaggagttgaccattctgggcgaaacacaagaggaggaagatgagattctcccacggaaggattacgagtcccttgattatgaccgctgtataaacgacccctatctcgaggttctggagacgatggataataaaaagggcagacgctacgaggcggtgaagtggatggtagtctttgcgattggggtttgtactggactggtgggattgttcgttgatttctttgtcagactgttcacacagttgaagtttggagtcgtccagactagtgtggaggagtgttctcagaaggggtgtctcgccctgagtctgcttgagctccttggcttcaatctgacatttgtctttctagcatctttgctggtcctgattgaacccgttgcagcagggtcaggaatccccgaggttaaatgctacttaaacggggtgaaggtgccaggaattgttaggttgagaacactgctgtgcaaagttttaggcgtgttattttctgtcgctgggggtctgtttgtggagaaggagggccctatgattcacagcggttctgtcgttggggccggcttgccacagttccaatctatatcactgaggaagatccagttcaattttccttacttccggagcgatcgggacaagcgcgacttcgtgagtgctggcgccgctgctggcgtggccgccgcgtttggtgccccaattggaggcacactcttctcattggaagagggcagttctttctggaatcagggtctgacatggaaagtgcttttctgctcaatgtccgcaacattcaccctgaactttttccgatcaggaatacagtttggaagctggggaagttttcagcttccaggtctgttgaactttggtgagtttaagtgttccgactccgacaaaaagtgtcatctgtggactgcaatggatctgggttttttcgttgtgatgggggtgatcgggggactgctcggggccaccttcaactgcctaaacaagagactcgccaaatacaggatgagaaacgtgcacccaaagccaaaactggtcagggttctcgagagcctcctggtatcactggtgacaactgttgtggtgtttgtcgcatcaatggtgttgggggagtgccgacagatgtctagctcctcgcaaatcggcaatgacagtttccaactgcaagtcacagaggatgtgaattcctcaataaagacattcttttgtcctaacgatacctataacgacatggcgaccctgtttttcaatccccaggagagcgccattctgcagctgttccatcaggatgggacatttagcccggtcacactggcccttttctttgttctatactttttactcgcttgttggacatacgggatctccgtgccttccggcctgttcgtgccctccctgctgtgtggcgcggcctttggcaggttagtcgcgaacgtgctcaagagctacatcggtctcgggcacatctactcaggcactttcgcgttaatcggcgccgcagcgtttctgggaggtgtggtgaggatgactatctcactcacagtcatcctaatcgaatccactaacgaaatcacatacggactgcctataatggtgacgcttatggtggccaaatggactggtgatttctttaataagggaatctacgatatccacgtgggcctacggggggtgcctttgctcgagtgggaaactgaagttgaaatggacaaactccgagcgagtgatataatggagcccaacctgacatatgtatatcctcacactaggattcagtcccttgtctcaatcttaaggactactgtgcaccacgcgttccctgtcgttactgagaataggggtaatgaaaaggaatttatgaagggaaaccagctgattagcaacaacattaaatttaagaaaagcagcattcttactcgagccggtgagcagcgcaagcgaagtcaatccatgaaatcttacccgtccagtgagctgaggaacatgtgcgatgagcatatcgccagtgaagaaccagccgaaaaagaagacttacttcagcaaatgctagagagacgctacaccccatatccaaacttgtacccggatcagagcccctcagaagactggactatggaggagaggtttcgcccattgaccttccacggcctgattctaagatcacagcttgtgaccctcctggtaaggggtgtctgttatagcgagtcccaatcttccgctagccagccccggttgtcttacgcggaaatggctgaggattaccccaggtaccccgatatacatgacctggacctgactttgcttaacccacggatgatcgtcgatgtgacaccttatatgaatcccagccctttcaccgtaagtcctaatacccatgtaagccaggtcttcaatctctttcggacgatgggtcttcggcacctccctgttgtgaacgccgttggcgaaattgtcggaattatcacacgacacaatttaacctatgagttcctacaggctaggctgcggcagcattatcagaccatttag

SEQ ID NO: 182753 - DNA, 2544 bp, Artificial Sequence
  Description of Artificial Sequence: Synthetic coding sequence
atggccggctgccggggcagcctgtgctgctgctgccggtggtgctgttgctgcggtgagcgagagactaggacccccgaggagttaacgatattaggggagacgcaagaagaggaggatgagatcctgcctagaaaggattacgaaaaaggccggaggtatgaggcggttaagtggatggtcgtcttcgccattggtgtctgtaccgggcttgtgggacttttcgtggacttcttcgtgcgcctgttcacccagctcaagtttggggtggtccaaacctcagtggaagagtgcagtcagaagggttgccttgccttgtccctgctggagcttcttgggtttaacctgacctttgtgtttttagcctctctgttggtccttatagagcccgttgccgcaggctcaggaattcccgaggttaaatgttatcttaatggcgttaaagtgcctggaatcgttcgtcttcgtaccctgttgtgcaaagtactgggagtgttatttagtgtcgctggcggtttgttcgtggagaaggagggtcccatgattcattcagggtccgtcgtgggggctggcctaccacagtttcagagtatttcactgaggaagattcagtttaatttcccgtattttcgcagcgatcgcgacaagagggactttgtctcagcaggtgccgctgctggagtggccgccgctttcggcgcaccaatcggcggcaccctgttcagcttggaggaggggagctccttttggaatcagggcctgacatggaaggtgttgttttgctcgatgtcagccacattcacactgaacttctttaggtccggtatccagttcgggtcatggggctcgttccagctgcctggtctcctaaactttggagagtttaaatgctctgactctgataaaaaatgccacctgtggactgcaatggatctgggctttttcgtggtgatgggggtcatcggcggactgctaggggcaacttttaattgtctcaacaagcgcctcgcaaaatacaggatgcgcaacgtgcatcctaagcccaagctcgtccgagtgttggagtccctactggtgtccctagtgacaacggtggtggtgttcgtggccagcatggttctgggagagtgccggcagatgtcttcaagttctcagattggaaacgattcttttcagttgcaggtcaccgaagatgttaattcttcaattaaaaccttcttttgccctaacgatacttacaatgatatggccacactctttttcaaccctcaggagagcgccatccttcaactatttcatcaggatggtaccttctcgcctgttaccctcgccctttttttcgtgctgtactttttactagcttgctggacgtatggcatatctgtgccttctgggctgttcgtcccaagcctgctttgtggcgctgcctttgggaggctagtcgccaacgtgctaaagtcatatatcggcctcggccatatttatagtggtacattcgcactcattggtgctgcagccttcttaggcggcgtggtccgaatgactattagtctgactgtgatcctgattgagtcaaccaatgagatcacatacggccttcccattatggtgaccctcatggtggccaaatggacgggtgatttctttaacaaaggcatttatgatattcacgtgggcctgaggggcgtccctctgctcgaatgggaaaccgaagtggagatggataagttgcgggcgagcgacattatggagccaaatctgacctacgtgtacccccatacccgaattcagtcgctcgtctctattctccggacgacagtgcaccacgcctttcccgtggttactgagaataggggtaacgaaaaagagtttatgaaaggcaaccagctgatttcaaacaatatcaagtttaagaagtcctcaatcttgacccgggccggcgaacaaagaaagaggagccagtcaatgaagagctacccatccagtgagttgcgcaacatgtgcgatgagcacattgcatcagaggagcctgccgaaaaggaggatctgctgcaacagatgctggaacggcggtacactccctatccaaacctgtatcccgatcagtctccgtcggaggactggaccatggaagagaggtttcgccctctcactttccatggattgatattgcgttcacagttggtcacattgcttgtccgtggtgtgtgctattctgagagtcagtcttccgcgtctcagccgcgtctttcatacgccgagatggcagaagactaccctagatatcccgacattcacgatcttgatctcacccttctcaatccaagaatgatagtcgatgtaacaccctatatgaatccaagcccctttaccgtatctccgaacacacatgtgtcacaggtgttcaacttgttccggacaatggggctgaggcatttgcctgttgtgaacgccgtcggcgagattgtaggcataatcacaagacataatctgacatatgagttcctccaggctcgcttacgccagcactaccagaccatttag

SEQ ID NO: 182754 - DNA, 963 bp, Artificial Sequence
  Description of Artificial Sequence: Synthetic coding sequence
atggccggctgccggggcagcctgtgctgctgctgccggtggtgctgctgctgtggcgaacgggagaccaggacacctgaggaactgacgatcttgggcgagacacaggaagaggaagatgagatcctcccaagaaaagactacgaatccttagattatgaccgatgtataaacgatccttacctagaagtcctcgagactatggacaacaaaaagggccgcagatatgaggcggtgaagtggatggtggtctttgcaatcggcgtctgcaccggattagttggcctcttcgtggatttcttcgtgcgtttgtttacccaattaaagttcggtgtggtgcaaacatctgtggaggaatgcagtcagaagggatgccttgccctgtctttgttagaactgctggggtttaacctcacctttgtcttcctggcgtccctgctggtcctgattgagccggtggccgccggatctgggatccctgaggtgaagtgctacctgaacggcgtgaaggtgccagggattgtgcggctgaggaccttactgtgcaaagtcctgggcgtgctgttcagcgtggctggtggactatttgttgagaaagagggtcctatgattcactccggatcagtggtgggcgccggactgccccaattccagtctattagccttcgaaaaatacagtttaacttcccttactttagatcagatcgctacgggaagcgacaggagaggttgtgcataagccgctccgggtgctggagttgctgctcatttcgaggtgccaatcggggctaccttgttcagtctcggggcgggtttgtgcttctggaacctagagcgcacgtagaaagcgcattactttttcatgtgtgccacctgcatcctcaactgctcccgttctgggactcggtatggaagctggggttcctacccgccccttggatcgccgagctttggcgagtttag

SEQ ID NO: 182755 - DNA, 927 bp, Artificial Sequence
  Description of Artificial Sequence: Synthetic coding sequence
atggccggctgccggggcagcctgtgctgctgctgccggtggtgctgctgctgcggcgagagagagacccggacacctgaagaactgacaattctcggcgaaacacaggaggaagaagacgagatcctgcctaggaaagattacgagagtctggactatgatcgttgcatcaacgacccctacctggaagtactggagaccatggataacaagaaaggccgccgctacgaggcagtgaaatggatggtcgtcttcgccatcggtgtgtgtactgggctggtgggtttgttcgtcgatttctttgtgcgtttgtttactcagctgaagtttggcgtggttcagacatctgtggaggaatgtagccaaaaaggatgcttagccctgtccctcttggagctgcttggattcaacctcacctttgtgtttctagctagccttctggtcctcatcgagcccgtcgccgcggggtccggcatcccagaggtgaaatgttatctgaacggcgtgaaagtacccggcatcgtccggctgagaaccctgctttgtaaggtcctgggggtgctcttttcagtggctgggggcctgtttgttgagaaagagggacctatgatacactctggaagcgtggtgggagctggtctgccgcagtttcagtctattagcctgagaaaaatccagttcaacttcccctacttcagatcagaccgcagcgggtgctggagttgctgctccttcagaggagccaacaggggatacttggtgcaatctagaggcggattcgtgttgttggagccccgagcccatgttgagagcgccctcctgtttcacgtttgtcacttgcatccccaactcttgcctttctgggattccgtgtggaagctaggatttctgccagctccctggatcgccgagctgtggagagtttag

SEQ ID NO: 182756 - DNA, 1062 bp, Artificial Sequence
  Description of Artificial Sequence: Synthetic coding sequence
atggccggctgccggggcagcctgtgctgctgctgccggtggtgctgttgctgcggggaacgcgagacccggactcctgaagaactcacaattttgggcgaaacgcaagaagaggaagacgagatccttcctaggaaagattatgagtcacttgattacgacagatgcataaacgacccatacctggaagtcctcgaaaccatggataacaaaaaaggacggaggtacgaagcggtaaagtggatggtggttttcgccataggggtctgcaccggcctggtcggcctgtttgtggacttctttgtgcgcctctttacgcagctaaagtttggagtggtgcaaacatcagtggaagaatgctcccagaaaggctgcctcgccttaagtctgttagagttgttggggtttaacctcaccttcgtatttctggcgagtctactggtgctcatcgagcctgtggctgcaggatcaggcattcctgaggttaagtgctaccttaatggcgtcaaagtgccaggaattgtcaggctgcggactttactctgcaaggtgcttggggttctgttctccgtggctgggggtttgttcgtcgaaaaggagggccccatgatccattcagggagcgtggtgggagctggtctccctcagtttcagagcatatccctgagaaagatccagtttaacttcccatacttccgcagcgacagagacaagagggacttcgtctcagctggagctgcagcaggcgtggccgccgcctttggtgctccgattggcggaacactattttcactcgaggagggctcgtctttttggaaccaaggactcacttggaaagtgttgttctgttctatgtctgccacttttaccctgaatttcttcagaagcggcattcagtttggttcttggggatctttccagctccccggtcttctcaacttcggggaatttaagtcgcttagggaacctccctgtgtgagtggtaatcatcgagggggagtctgtggcctcgatggcgtccgccggatgccaactgatgtgctattcgaaagcaaccgctag

SEQ ID NO: 182757 - DNA, 2862 bp, Artificial Sequence
  Description of Artificial Sequence: Synthetic coding sequence
atggccggctgccggggcagcctgtgctgctgctgccggtggtgctgctgctgtggcgagcgagaaacgcggaccccagaggaattaaccatcctcggggagacacaggaggaagaagacgaaatcctgccacgaaaggactatgagtccctggactatgatcgctgtattaacgacccttacctcgaggtgctagagacaatggataacaagaaagggcgcagatacgaggccgtcaagtggatggtcgtattcgcgatcggggtgtgcacggggctcgtgggtctctttgtagactttttcgtgaggctgttcacacagctgaagttcggggttgtgcaaaccagtgtcgaagagtgctcacagaagggctgtcttgctctgtctctgttagagctgttgggcttcaatctgacgttcgtgttcctggcttccttgctcgtattgatcgaaccagtcgcggcaggaagcgggatccctgaagtgaagtgttacctcaacggcgtgaaagtaccaggaatcgtgcggctgagaacactcttatgtaaggtcctcggtgttctgttttctgtggccggggggctctttgtggaaaaagagggacccatgatccatagcggctctgttgtgggcgcaggactgccacagttccagagtatttctctgaggaaaattcaatttaattttccatatttccggagtgaccgagacaaacgggattttgtgagcgctggggccgcagcaggcgttgccgccgccttcggtgccccaatagggggaactctgtttagcctcgaggagggcagcagtttctggaatcaagggctgacctggaaagtgctgttttgctcgatgtcagccacctttacactaaacttcttccgatcaggaatccaatttggaagttgggggtcatttcaattacctgggcttcttaattttggggagttcaagtgtagtgactctgataaaaagtgccacctctggacagccatggacctcggattcttcgttgtcatgggggttatcggcgggttgctcggcgcaaccttcaactgtctgaacaaacgtctcgctaaatacaggatgaggaacgtgcatcccaagcccaagctggtcagagttctggagagcctactggtttcactcgtcacaacagtggtggtttttgtggccagtatggtattgggcgagtgccggcagatgtctagttcctcgcagatcggcaatgactccttccagttacaagtgacagaagacgttaatagttccattaagacctttttttgccccaacgacacatataatgacatggccacactgtttttcaatcctcaggaatccgccatcttgcagctcttccatcaggatggtacgttttcacctgtaacactcgccctgttcttcgtactgtatttcctgctggcctgctggacctacggaattagcgttccatccgggctcttcgttccttctctgctatgcggggcagccttcggccgcctggtggcaaatgtgcttaaatcctacatcgggctgggacatatctattcaggcaccttcgcccttatcggtgcggctgcctttctcggaggagtggttagaatgacaatttcgctgacagttatattaatcgagtcaactaacgagatcacctacgggcttccaattatggtgacattgatggtggccaagtggacaggagacttttttaacaagggaatttatgacatacatgtgggcctccgaggcgtgccattgctggagtgggagacagaggtcgaaatggacaagctgcgggccagtgacatcatggagcccaatctgacttatgtttacccacacacccgcatccagtctctcgtgtccattttgaggactaccgtgcaccatgcctttccagtggttactgaaaaccggggtaacgaaaaggagttcatgaagggcaaccagctgatttccaacaatattaaatttaaaaagtctagcatcctcacgagagctggagagcagcgcaagaggagtcagagcatgaagtcatatccttcatccgaactgcggaatatgtgcgatgagcatattgccagcgaggagcctgccgagaaggaggatctcctccagcagatgttagagagacgctacaccccctacccgaacctgtaccccgatcagagcccttcagaggattggacaatggaggagcggttcagacccctcactttccacgggctaattctgcggagtcagctggtgacattgctggtccgcggtgtctgttacagtgaatcacagtcctctgcctctcagccaagactgagttacgccgagatggctgaggactaccccaggtatcctgacatccacgacctggacctaactctgctgaaccccaggatgattgttgatgtgaccccatacatgaacccctcaccttttactgtgagccccaatacacatgtgtcacaggtttttaatctgttcaggaccatgggactgcgccatctcccagtcgtgaatgccgtcggagaggtgtctgaggcaccggctctgccacctcccttgcgtgaagaccctttggcccgctgttgtttgtgtacccaagcgtcacatcagaagcgccgccacccgacgcgacggggggagtgcgggcctaccctggcactcaacccagcgcggttaccgtgcacacgtgacccattcccctgcctgccggctgacgggacgtcagttcccctggctgtcctgagctcccaatctagggcgagtacacgtttatgtctgcccccggagatgttgcttttcaccccttatcactggtgtagtctcgtgcttcatctccgacgagacctgcgcatacgttag

SEQ ID NO: 182758 - DNA, 369 bp, Artificial Sequence
  Description of Artificial Sequence: Synthetic coding sequence
atggccggctgccggggcagcctgtgctgctgctgccggtggtgctgttgctgcggtgaacgggagaccaggacacctgaggagctgaccatccttggggaaacccaagaagaggaagatgaaatcctgccgcgcaaggattatgaatcgctcgattacgaccgctgtataaacgacccctacctggaagtcctcgagaccatggataacaagaaagggagacgctatgaggcggtcaaatggatggtagtgtttgccattggcgtgtgcaccggacttgtggggctttttgttgatttttttgtgcggctcttcacgcaactaaaatttggagtggtacagacatataagttccagatgaagatgtag

SEQ ID NO: 182759 - DNA, 2277 bp, Artificial Sequence
  Description of Artificial Sequence: Synthetic coding sequence
agcccccggagcgccctgttccgggtgggccacatgagcagcgtggagcttgacgatgagctcctggatcctgacatggacccaccccacccattcccgaaggagatcccacataatgagaaactcctgtccctcaaatatgagagcctggactacgacaactccgaaaaccagctgttcctggaggaggaaaggaggatcaaccatacagccttccgcacagtggagatcaagcggtgggtgatttgtgccttgatcgggatcctcactggcctcgtggcctgctttattgacatcgtggtagagaacttggcaggactgaagtaccgggtgataaaggggaacattgataagttcactgagaagggagggctgtccttctcactgctgctttgggccactttgaatgctgcatttgttctagtgggctccgtcatcgtcgcattcatcgagcccgtggcagccggatctggcataccccagatcaagtgttttctaaatggcgtgaaaattccccacgtggtccgcttgaaaacattagtgatcaaggtttccggcgtcattctgtcagtcgtggggggactcgccgtgggaaaggaaggccctatgatccactcgggcagcgtgatcgctgccggtatctctcaggggcgttctacgtccctcaaaagggacttcaagatttttgaatacttccgccgagacacggaaaagagagacttcgtgagtgcgggcgctgcagccggcgtgtctgcagccttcggggccccggtggggggcgtgctgttttccctggaggaaggggctagtttttggaatcagtttttaacttggcggatcttcttcgcatccatgataagcacctttacactgaatttcgtgctgagtatctaccacggtaatatgtgggacctcagcagtccaggactgatcaatttcggtagattcgactctgagaagatggcttatactattcatgaaattccagtcttcatcgcaatgggtgtcgtgggcggggtactcggcgcagttttcaatgcactcaactattggctgaccatgttccgaattcgctatatacaccgaccctgtctacaagttatcgaagcagtgctggtggcggctgtgactgccactgttgcattcgtgttgatatattcaagccgggactgccaacccctgcaggggggatctatgtcctatcccctgcagctgttctgtgccgatggcgaatacaattctatggcagcggctttttttaacactcctgagaaaagcgtcgtgtcactcttccatgacccacctggctcctacaacccactgacacttggcctcttcaccctggtgtattttttccttgcatgttggacatacggcctaaccgtgtcagccggtgtgttcatccctagtctactgattggcgctgcctgggggcgcctgttcgggatttcgctgagttacctgaccggcgctgccatctgggcagatcccggcaagtacgcccttatgggggctgccgcacagctcggaggcatcgtaaggatgacgcttagtctaactgtgatcatgatggaagctacgtctaacgtgacgtacggttttcccatcatgctagtgctgatgacagccaagattgtgggcgatgtttttatcgaagggctgtacgacatgcatatccagttgcagtctgtaccctttctgcattgggaagctccggttacatcacattcattgactgccagagaggtgatgtcgacacccgtcacatgtctgagacgccgggagaaggtgggggtgattgtcgacgtgctgtctgacacagccagcaatcacaacggcttccccgtggtggagcacgccgacgatacccagccagcacgcctgcaggggcttatcctcaggtcacagctgattgtgctcctgaagcacaaggtgttcgtggaacgcagtaacctaggacttgtgcagcggcggctgcggctgaaggactttcgggatgcctatcctagatttcccccgatacagtccattcacgttagccaagatgaacgtgagtgcacaatggatctttccgagtttatgaaccccagcccatataccgtaccacaggaagcaagcctgccaagagtgttcaagctcttccgagccttaggccttcggcaccttgtcgttgtagataaccgaaaccaggtcgtgggccttgttacaaggaaggatcttgcccgctatagacttggcaaacgtggacttgaagaactgtctctggctcagacgtag

SEQ ID NO: 182760 - DNA, 2418 bp, Artificial Sequence
  Description of Artificial Sequence: Synthetic coding sequence
atggccaacgtgagcaagaaggtgagctggagcggccgggaccgggacgacgaggaggcagccccactactcaggaggactgccaggcccggaggtgggacaccactgctgaatggcgccgggccaggggccgcacgtcagtctcctaggtccgccctgttccgggtcggccacatgtcctccgtagagcttgatgacgagcttttagaccccgacatggatcccccgcacccttttcctaaggagattcctcataacgaaaaactgctatcacttaaatatgagtcgttggactatgacaactctgagaatcagctgtttctggaggaagagcgacgcattaaccacacggcttttcgaacagtcgaaatcaaacggtgggtgatctgtgctctgattggaatcctgaccgggctcgtggcatgcttcatcgacattgtcgtggagaatcttgcaggtcttaagtatagggtgataaaggggaatatcgataaatttacagagaaaggcgggttgtcgttctctctgctgctgtgggctaccctgaatgccgccttcgtgctggtgggttcagtaatcgtggcgtttattgaacccgtggccgccggatccggaatcccccagataaagtgtttcctgaacggcgtgaaaatcccacatgtggtaagattgaagactctggttattaaagtcagcggcgtgatcctatctgtggtaggggggttggctgtgggcaaggaagggccaatgatacattcagggtctgttattgccgcgggcataagccagggccgaagtacatccttaaaaagggacttcaaaatatttgaatattttaggcgggataccgagaagcgggactttgtgtccgccggagccgccgccggcgtatccgcagccttcggcgcaccggtcggtggcgtcttgttctctctggaggagggcgctagtttttggaatcaattcttgacatggcgcatttttttcgcatcgatgatctccacattcactctcaacttcgtcctctctatttaccacggtaatatgtgggatctcagctcacctggacttattaatttcggcagattcgactctgagaaaatggcatatacaatccacgagatccccgtctttatcgcaatgggggttgtgggcggagtgttgggcgctgttttcaacgccctcaactattggcttactatgttcaggatccgttatattcacagaccctgccttcaagtgatagaagctgtgctcgtggcagcagttaccgctactgtggcttttgtcctgatctattcaagccgcgattgccagcctttgcaaggtggtagtatgtcatacccactccagttgttttgtgccgatggggagtacaattccatggcggcggccttctttaacacaccagagaagagcgtggtgagcctgttccacgacccacccgggtcttacaatccattgactttagggctttttaccctggtgtatttttttttggcctgctggacatacggtttgactgtcagtgccggagttttcataccctctctgctgatcggtgcagcttgggggaggctctttggtatcagtctctcctacctgacaggcgccgctatctgggcggatccaggtaagtacgccctgatgggagctgcagctcagttgggcggcatcgtgcgtatgacactctctctgactgtcataatgatggaggcaacttcgaatgtgacctacgggtttccaattatgttagtactgatgacagcaaagattgttggcgacgtgtttatcgaaggcctgtatgacatgcatatacagctgcagagcgtcccttttctccattgggaggctccggtgacgagtcactctctgactgcgagagaagtgatgtcaacccctgttacttgtctccgcagaagggaaaaagttggtgtgatagtcgatgtcctttctgatacagcgtcaaaccataatggattccccgtagtagaacacgcagacgatacccagccagccagactgcagggcctgattctgaggtcgcagttgattgtgctcttaaagcataaggtgttcgtggagagaagtaacctcgggctggtccagcgcaggctaagactaaaggattttcgagacgcgtaccctcgattccctcctatacaatcaatacatgtgagtcaggacgaacgtgagtgtaccatggacctgtctgagtttatgaacccctccccgtatacagtgccccaggaagcctcccttccccgggtctttaagttattccgggccctgggcctgagacacctggttgtggtcgacaaccgaaaccaggtcgtaggcctagtgactcgtaaggacctcgccagatacagattgggaaagagaggcctcgaggagctttccctggctcagacatag

SEQ ID NO: 182761 - DNA, 2244 bp, Artificial Sequence
  Description of Artificial Sequence: Synthetic coding sequence
atgagcagcgtggagctggacgacgagctgctggaccccgacatggaccccccacacccttttcccaaggagattcctcacaatgagaagctccttagcctgaaatacgagagcctggattatgataattctgaaaatcagttgtttcttgaggaagagcgccgcattaatcacacagcattccgaacggtagaaatcaagcggtgggttatttgcgctttgatcggcatcttgaccggactggtggcgtgtttcatcgatatcgtagttgaaaacctggccggcctcaaatatcgggtaattaagggcaacattgataagttcaccgaaaaaggggggttgtcattttctctactgttatgggcgaccttgaatgcagcttttgtcctagttggaagtgttattgtcgcctttatcgaacccgtggcggccgggagcggtattccccagatcaaatgtttcctgaacggggttaaaatccctcacgtggtgcgcctcaaaactttggttatcaaagtcagtggagtcatcttaagtgtagtgggaggtttagcagtcggcaaggaggggcctatgattcactctgggagcgtgattgccgccggcatttcccagggcaggagcacatccttgaagcgggactttaaaattttcgagtacttcagacgcgacaccgagaagcgcgatttcgtgagcgctggggcagccgcaggagtctccgcagctttcggcgctcccgttggcggcgtgctattcagccttgaggaaggggcctctttttggaatcagtttctaacctggcgtatcttttttgcatctatgatcagtaccttcaccctcaactttgtgctatccatctatcatggtaatatgtgggacttgtcttctcccggactgatcaactttggaagattcgatagtgaaaagatggcttacacaatacatgaaattccagttttcatcgccatgggggtggtgggaggtgtgctgggggccgtgttcaatgctctgaactactggcttacaatgttccgtattagatatatacatagaccgtgtctgcaggtaatagaagcagtgctggttgcagcggttaccgccacagtagcgttcgtgctaatttactcgtcccgcgattgccaaccactgcagggcggctctatgtcttaccccctacaactgttttgcgccgacggagagtacaatagtatggcggcagcttttttcaatacacctgaaaagagcgtggttagtttatttcatgacccccccggttcttataatcctctaactctgggactgtttaccttggtgtacttctttctagcctgctggacctacggcttgactgtcagtgctggtgtgttcatcccgtccctgttaatcggggcagcttgggggcggctttttggtatatctctgtcctaccttactggcgcggccatctgggctgaccccggcaaatacgccctgatgggggcagccgctcaactcggtggaattgtccgcatgactctctccttgaccgtgattatgatggaggccacctctaatgtgacttacggttttccaattatgctggttctaatgactgctaaaatagtaggcgatgtgtttatagaagggctgtatgacatgcacatccagctgcagtccgttccctttctgcattgggaggctcctgtgacttcgcattcactgacagctcgcgaggtaatgtctaccccagtgacctgtctccgccgaagggaaaaggtgggcgtgatcgtcgatgtgctgagcgatactgcaagcaatcataacggcttccccgtagttgaacatgccgacgatacgcagcccgcccggctgcaggggctaatcctgagatcacaactgatagtactcctcaagcataaggtgtttgtggaaaggtcaaacttgggattagtccagcgtcgactgcgattaaaggacttccgcgatgcatacccgaggttcccccctatccaatcaatacatgtgagccaggacgagagagagtgcacaatggatctatctgaatttatgaacccaagcccttatacagtaccccaggaagccagtctaccccgggtgttcaaactgtttagagctctgggcctacgtcacctggtcgtagtagataatagaaaccaggtggtcggtctggttaccaggaaggacttggcgcgctataggttgggaaagaggggcttggaggagctctctcttgctcagacctag

SEQ ID NO: 182762 - DNA, 2346 bp, Artificial Sequence
  Description of Artificial Sequence: Synthetic coding sequence
atggccaacgtgagcaagaaggtgagctggagcggccgggaccgggacgacgaggaagcagccccattactccggaggaccgctcgcccaggcggagggacaccacttcttaatggcgctggacctggggctgcccggcaagacatggatccaccccatccttttcccaaggaaatccctcataatgaaaaactattgtctctgaaatatgagtccctggattacgacaatagcgaaaatcagctgttcctcgaggaggaaaggcgaattaatcacacggcctttcgaaccgtggagattaaaaggtgggtgatctgtgcgcttatcggcatcctgacagggttggtcgcctgcttcatcgatattgtagtggagaatttggctgggcttaaataccgggtgataaaggggaatatagataaatttacagagaaaggaggtctcagcttcagcctcctgctctgggcaaccctgaatgctgctttcgtgctggtgggcagtgtcattgtcgcatttattgagccggtggcagcagggtccgggataccccagataaaatgcttcctaaacggagtcaaaattcctcacgttgttaggctgaaaacgctggtcattaaggtttcgggggtgatcctcagcgtggtgggcggactggccgtaggcaaagaggggcccatgattcactccggaagtgtgatagcagcagggatcagtcaggggcgaagtacttctctgaaaagagattttaagattttcgagtactttaggagggataccgagaagagagacttcgtgagcgcgggggccgcagcgggggtttccgcagccttcggggctcccgtaggtggcgtgctgttttcattagaagaaggagcttccttttggaatcagtttctaacctggcggattttttttgcaagcatgattagcacttttaccttgaattttgttctgagcatctatcatgggaacatgtgggacctgtcctcccccggtctgatcaatttcggacgattcgactctgagaagatggcttatactattcacgagatcccggtctttattgctatgggggtggtcggcggggttcttggagccgtcttcaacgcactgaattattggctaactatgttccgcatccgctatatacatcggccatgtttgcaagtgatcgaggccgtgttagttgctgccgttaccgcaacagtggccttcgtcctgatctattcgagccgtgactgccaacccctgcagggggggtccatgtcttaccctttgcagctgttctgcgccgatggcgagtacaatagcatggcagccgccttctttaacacgccagaaaaatctgtagtgtcgctctttcatgacccacctggttcctacaatcctctgaccctgggcctgtttactctcgtctattttttcctagcctgttggacttatgggctaaccgtgagtgcgggagtcttcattccatctctgcttattggggccgcttggggccgcctcttcggcatttcactgagctacctgactggggccgccatatgggcagaccctggtaaatatgctctgatgggagcggcagcccaacttggcggtatagtgcgcatgactctctccctgacggtcattatgatggaggccacgtcgaatgtcacatacggctttcccataatgttggtgctcatgaccgccaaaatagttggcgacgtattcatcgaaggactttacgacatgcatattcagctgcagtcagtacctttccttcattgggaagctcccgtaacctcgcacagcttgacagcgagagaggtgatgtccacccctgtgacctgcctgagaaggagggaaaaggtcggtgttattgttgatgtgctctctgatacagcatcaaatcacaacgggttccccgtggtggagcatgccgacgacacacagccagcgagactccaggggctcatccttcgcagtcaactaattgtgctactgaaacataaggtcttcgtggagaggagcaatttgggtctggtccagaggcgactgcggctcaaggactttagagacgcatatccacgcttcccacctatacaatctatccacgtatcccaagatgaacgggagtgcaccatggacctctccgagttcatgaatccttcgccctatacggtgccccaagaagcttctctgccacgggtgtttaagctttttcgcgcactcgggttgcggcacctggttgtggtggacaaccgtaatcaagtagttggtttagtcacccggaaagacctggctcgataccgcttgggcaagaggggactggaggagctgtccctagctcagacttag

SEQ ID NO: 182763 - DNA, 1545 bp, Artificial Sequence
  Description of Artificial Sequence: Synthetic coding sequence
atggtgctggacctggacctgttccgggtggacaagggcggcgacccagcgttaatcagggaaacccaggaaaaacgattcaaggatcccggtctggtcgaccagcttgtgaaggcagattcagaatggaggaggtgccgatttcgagccgataatctcaataaactgaaaaacctctgctccaagacaataggggagaagatgaaaaaaaaagagcccgttggcgacgatgagtccgtccccgagaatgttctgagctttgatgacttgaccgcagacgcactcgcaaacctgaaggttagccagatcaagaaggtgcggctgttaatagatgaggccattctcaaatgcgatgccgaaagaatcaaacttgaagccgagagattcgaaaatctgagggagataggcaacctcttgcacccgagcgttcctatatccaacgatgaggacgtagacaacaaagtggaacgtatctggggagactgtacagtaagaaagaaatatagtcatgtggacttggtggtaatggtagacggcttcgaaggcgaaaaaggggccgtcgttgctggctctcggggttacttcctgaaaggtgttctggtcttcctggagcaagctcttatccaatacgcacttcgcactttgggttcccgaggatacattccaatctacactccattcttcatgcgtaaagaagtcatgcaagaggtagcccaattatcccagttcgacgaggagttatacaaggtaattggtaagggtagcgaaaagtccgatgataattcctatgatgagaagtacttgattgccacttctgaacagccaattgccgctctgcaccgtgacgagtggttacggccagaagatttgcccatcaaatacgccgggctgagcacatgtttcaggcaagaggtgggttcccacggtagggatacaaggggaatttttagagttcaccagttcgagaaaattgaacagttcgtgtattcctccccccatgataacaagtcctgggagatgttcgaagagatgattacaacggctgaagagttctaccagtcactggggataccatatcatatcgtgaatatcgtcagcggctccttgaaccacgccgcctcgaaaaaactggatctagaggcctggttcccaggaagtggcgcattccgcgaactggtgtcctgttcaaattgcaccgattaccaggcgcgaagactgagaattcgatatgggcagactaaaaagatgatggacaaggtggaattcgtacacatgctgaacgctacaatgtgtgccaccacccggaccatctgcgcaattctcgagaattatcagaccgaaaagggcattacggttccagaaaagctgaaagagtttatgccccctgggttgcaggagctcatccccttcgtcaagcccgcccccatagagcaggaaccttccaaaaagcagaagaaacaacatgagggctctaaaaagaaggcagcagcacgtgacgtgactctcgaaaatagactgcagaacatggaagtgaccgatgcctag

SEQ ID NO: 182764 - DNA, 2745 bp, Artificial Sequence
  Description of Artificial Sequence: Synthetic coding sequence
atgggccccttcaagagcagcgtgttcatcctgatcctgcacctgctggagggagccctgtcaaattccctgatccagctaaataacaacggatatgaggggatcgtcgtggccatcgaccccaatgtccccgaagatgagacactgatccagcagatcaaggacatggtgacccaggcctccctttacttacttgaggccaccgggaaaagattctacttcaaaaacgtcgccatcctcattcctgagacatggaagactaaggccgactacgtgaggccaaagttggaaacgtacaagaacgcagacgtgctggttgccgagagtaccccacccgggaacgatgaaccctataccgaacagatgggaaattgcggtgagaagggcgagcggatccatctgacccctgactttattgctggcaagaaactggccgaatatggtcctcaggggcgcgcgtttgtgcatgagtgggcacacctgcggtggggagtgtttgacgaatataataatgacgagaaattctacttgagcaacggaaggatccaggctgtcagatgcagcgccggtatcactgggaccaacgtcgtcaaaaaatgtcagggggggtcttgctacaccaagcgatgcacattcaataaagtgaccggcttatacgaaaaggggtgtgagtttgtgttacagagtagacagactgaaaaggcctctataatgtttgcgcagcacgtggactcgattgtggagttttgtacagagcagaaccacaacaaagaggctcctaacaaacaaaaccaaaagtgtaatctgcgctctacctgggaggtaattagagacagtgaggatttcaagaaaactacccctatgaccactcaacctcccaatcctacattttccctcctgcaaatcggacaacgcatcgtgtgcctggtcctcgacaaatctggcagtatggctaccggaaacaggctgaaccggctgaaccaggccggtcagcttttcttgctgcaaactgtggagttgggaagttgggtgggaatggtcacgtttgatagcgccgcgcatgtgcagaacgagctgatccagatcaactccggaagtgatcgggataccctagcaaaacgactgcccgccgctgcttcagggggcacatctatttgtagcggactgagatctgcttttacggtaattcgcaagaagtaccccacagatggctcagagattgtgcttctcaccgatggagaggataacacaatctctgggtgtttcaacgaggttaagcagagcggggctattattcacacagtggctcttggaccttcagcagctcaagagctggaggagctgagcaaaatgacagggggactgcagacctacgctagcgaccaggtgcagaataatggtttgatcgacgcttttggggccctgtcatccggtaacggtgccgtctcacagagatcaatccagttggagagcaagggcctcacactgcagaactcgcagtggatgaacggtactgtcattgtggattccactgtcgggaaagacactctgttcctcattacttggacaatgcagccccctcaaattctgctctgggacccgtctggacaaaagcagggaggctttgtagtcgataaaaacaccaaaatggcctacttacagatcccgggtatagcaaaggtggggacctggaagtactctttgcaggcatctagtcagaccttaacactcaccgttacttctagggcttccaacgccacccttccccccattaccgtaacctcgaaaaccaataaggacaccagtaagttcccctcacccctcgtcgtgtacgccaatatccggcagggcgcctccccaatcttgagagcatccgtcactgccctgattgagagcgttaacggcaagacggtcacgctggaactcctcgacaatggagctggagcagacgctactaaagacgatggcgtttatagcaggtacttcacaacctatgataccaatgggcggtattcagtgaaagtccgggccttaggtggagtgaacgcagcccggcgacgtgtgataccccagcagtcaggtgccctgtatatcccaggctggattgaaaatgacgagattcagtggaatcctcctcgccctgagatcaataaagatgatgttcagcacaaacaggtatgcttcagcagaactagtagcggcgggtccttcgtggcatctgatgtcccaaacgcccctattccagacctcttccctcctggccagatcactgatctaaaagctgagatacacggcggcagtttaataaatctcacctggaccgcccccggtgatgactacgaccatgggaccgcccacaaatatattattagaatttccacgagcatactcgatctgagagataaattcaacgaaagtcttcaagttaatacaaccgcgctgattcccaaagaagcaaattctgaagaagtgttccttttcaaacctgaaaatataactttcgagaacggcacggacctgttcatagccatccaagccgttgataaggtggacttaaagagtgagatctctaacatcgcgcgagtgagtttgtttattcccccacagacaccccctgagacgcccagcccagacgaaacaagcgcaccgtgtcccaacattcatattaattccactattcccgggattcatatcttaaagatcatgtggaaatggatcggcgagctgcagctgagcatcgcatag

SEQ ID NO: 182765 - DNA, 987 bp, Artificial Sequence
  Description of Artificial Sequence: Synthetic coding sequence
atgaccacccagccccccaaccccaccttcagcctgctgcagatcgggcagcggattgtttgtttggtgctcgacaaaagcggaagcatggcaaccgggaaccgactgaatcggctgaaccaagccggccaactatttctccttcagaccgtagaactgggtagctgggttgggatggtcactttcgactccgcagcacatgtgcagaatgagctcattcagattaactccggcagtgaccgcgacaccctggccaaacggctcccagccgccgcttccggtggaacctcgatctgctccggcctccgatcggctttcaccgtaattagaaaaaagtatcctacggacggatccgagatagtgctcctcaccgacggcgaagacaatacaatctcaggatgctttaacgaagttaaacagtctggcgcaataatccatacagtggctttgggtccgagcgccgctcaggagctggaggagctgtcaaaaatgacaggagggctgcaaacttatgccagcgaccaggtgcaaaacaacggcctgatcgacgctttcggcgctctgagcagtggtaatggcgcggtgagccagcgcagtatacagctggagtccaagggactcacgctacagaatagtcagtggatgaacggtacagttatcgttgacagcacagtcggaaaggacaccctctttctgatcacctggaccatgcagcctccgcagatcctgctctgggaccctagcggacagaagcagggtggatttgttgttgacaagaataccaagatggcctacctgcagatccccggaattgcaaaagtcggaacctggaagtattcgctccaagccagttcccagactttgacactgaccgttacgagtagagcttccaatgcaaccctgccacctataacagtgaccagcaaaaccaataaggacaccagcaacctgcccaattcgcagggacaatgccattctccagattag

SEQ ID NO: 182766 - DNA, 2064 bp, Artificial Sequence
  Description of Artificial Sequence: Synthetic coding sequence
atggaggagctggtgggcctgcgggagggcttcagcggcgaccccgtgacactccaggaattatggggcccttgcccccatatcagacgggctattcagggagggctggagtggttgaagcagaaagtgttccgactgggagaagattggtactttttaatgacccttggagtgctgatggcgctggtgagctacgccatgaattttgccattggttgcgtcgtgcgggcacaccagtggctctaccgagagattggcgattcgcacctgttacggtaccttagctggaccgtttaccctgtggcccttgtctcattcagctccggattttcccagagtattaccccatcatcaggcgggagcggaattcctgagctcaaaaccatgctggccggcgtaattctggaagattatttagatataaagaacttcggagcaaaagtagtgggactctcatgcaccctagcgaccggtagtaccctctttctggggaaggtcggcccttttgtgcatctgtcagtaatgatcgcagcctatcttggaagagtacgaacaaccactattggcgagccggaaaataaaagcaaacagaacgaaatgcttgtcgcagccgccgccgtcggggtcgccacagtgtttgccgcacctttttcgggtgtcttatttagcatcgaggtaatgtcttcgcacttctccgtacgggactactggcggggcttttttgcagcaacctgtggagcctttatttttagactcttggccgtgtttaactccgaacaggagaccataacttctttgtataagacttcattccgcgtagacgttccattcgatctccccgagattttttttttcgtcgccttagggggcatttgcggcgtacttagctgcgcctatctattctgccagcggactttcctgtcttttattaagacaaatagatattctagcaaactgctggcaacgtctaaaccggtgtactctgctcttgcaacccttttgctagcgtctatcacctaccctcccggcgtgggccatttcttggccagtcggctcagcatgaaacaacaccttgatagcctgttcgacaaccactcgtgggctctaatgacgcagaattcctcccctccctggcccgaagaattagacccccaacatctgtggtgggagtggtaccatccgagatttactatttttggcactctggcgtttttcctcgtcatgaagttttggatgctgatccttgcgacgacaatcccaatgcccgccggatacttcatgcccatcttcatcctgggcgcagccattggcagactcttaggagaagcactcgctgtcgcattccctgaaggaattgtgacagggggtgtgaccaacccaattatgccagggggctatgctctcgcaggcgccgccgcattttccggtgcggtgacccacaccatcagcacagctctgctagcattcgaactgacgggccaaatcgtgcatgccctgccagtacttatggccgttctcgccgcaaacgcgatcgcacagagctgccagccaagcttctacgacgggaccattatagttaagaaactgccatatctacctcggatccttggcagaaatataggctctcaccacgtgagggtggagcattttatgaatcattcaattaccaccctggccaaggacacaccgctggaagaggttgtgaaggtggtgactagtaccgatgtcacagagtatccactggtggagagcaccgagtcccagatcttggtcggaatcgtgcaaagggcgcagctagtgcaggccctgcaggcggagcctccctcgcgagcacctgggcaccagcagtgtcttcaggatatactcgcacgggggtgtccgacagagccagtgaccctgacactatttagtgagacaaccctacaccaagctcaaaatctttttaagctgctaaatctgcagagcctgtttgtcacatcccgcggaagggcagtcggctgcgtttcctgggtagagatgaaaaaagccatctccaacctaaccaatccccccgcccctaagtag

SEQ ID NO: 182767 - DNA, 2061 bp, Artificial Sequence
  Description of Artificial Sequence: Synthetic coding sequence
atggaggagctggtgggcctgcgggagggcttcagcggcgaccccgttaccctgcaagagctttggggcccatgtccccacatccgtcgcgccatccagggcggtctggagtggttgaagcagaaggtgtttaggctaggcgaggattggtattttctgatgactctgggcgtcctgatggctctcgtgtcttacgctatgaactttgccatcggatgcgtcgtaagagctcatcagtggctttaccgcgagattggggacagtcacctgctgcgatacctcagctggactgtatatcctgttgccctcgtcagctttagctctggcttcagccagagcataactcctagtagtggaggaagcggaattccggaactcaaaactatgctcgctggcgtgattctggaagactatctggatatcaagaatttcggggctaaggtggtgggcctctcatgtaccctggctactggaagcacactatttctcggcaaagttggcccattcgttcatctgagtgtcatgattgcagcctatctcggacgcgtcaggaccaccacaatcggggaaccagagaacaagtctaaacaaaatgaaatgcttgtggccgccgcagctgtgggcgtggccactgtgtttgcggcacccttcagcggcgtccttttctctatcgaggttatgagctctcatttcagcgtgcgagactactggcgtggcttcttcgccgctacctgcggcgccttcatcttcagattgttggctgtctttaatagtgagcaggaaaccattaccagcctgtataaaacgtcattccgggtggacgtcccctttgacctcccagagatcttttttttcgtggcactagggggaatctgcggggtgctcagctgcgcatacctgttctgtcaacggaccttcctctcattcattaagacaaatcgatactcgtcgaaacttctcgcaaccagtaagccagtgtatagtgctctcgctaccctgttactggcatccattacatacccaccaggggtcggacattttctcgcaagtcggctttccatgaaacagcacctagattctctgttcgacaaccattcatgggctttgatgactcagaatagcagtcctccctggccggaagagctggatccacagcacctgtggtgggagtggtaccatccacgtttcactatttttggcacattagcttttttcctcgttatgaaattttggatgcttatccttgccacgacgattcctatgccagcaggatattttatgcccatttttattctgggagctgcaattgggaggttgttgggcgaggcactggctgtagcttttcccgaaggcattgtaaccggaggggtgaccaacccaatcatgccaggagggtacgccctggccggcgccgcagcattctccggggctgtgacacacaccataagcacagccctactcgccttcgagttgaccgggcagatcgtccacgccctcccagtgctcatggcggttcttgcagcaaacgcaatcgcacagtcttgccagccctccttttacgatgggaccatcatcgtaaagaagttgccctatctccccaggatactgggacgaaacatcggatcgcaccacgtgagggtcgagcacttcatgaaccactctattactacattggccaaagacacccctttggaagaggtggtgaaagtggtgactagcacggatgtgactgaataccccctagttgaatccacagaatctcagattttagtgggtatcgtgcagcgggcccagctggtgcaggcgctccaggcggagccgcccagccgagccccgggccaccagtgtctgcaggacatcctcgcccggggctgtccaacagagccagtcacgctaaccctattttccgagacgactctgcatcaggctcaaaacttattcaagctgctgaacctgcaatcccttttcgtcacatcacgggggcgagctgtgggctgtgtaagctgggtggaaatgaaaaaagcgatttctaatctgaccaacccccccgctccaaaatag

SEQ ID NO: 182768 - DNA, 2061 bp, Artificial Sequence
  Description of Artificial Sequence: Synthetic coding sequence
atggaggagctggtgggcctgcgggagggcttcagcggcgaccccgtgacacttcaagagttatggggtccatgtcctcacatccgaagagctatccaaggcggtctggaatggttgaaacagaaggtgttccgactgggtgaggattggtactttttgatgaccctgggagtattgatggccttggtcagctacgcaatgaacttcgcgatcggttgtgtggtgagagcccaccagtggctgtatagagaaatcggcgacagccacctgctcaggtatctgtcatggaccgtctacccagtggcactcgtgagcttcagcagtgggtttagccagtccattaccccatcctcgggcggctccggaatccctgagctcaagacaatgctggccggtgtcattctggaggactacttagacataaaaaactttggtgccaaggttgttggactgagctgtacgcttgctactggaagcaccctttttctcgggaaggtgggcccattcgtacacttgtccgtgatgattgccgcatacctgggccgggtgcgaaccaccacaatcggggaaccagaaaataagagcaaacaaaacgaaatgctagtagccgcagccgccgtaggagtagcaacggtgttcgctgccccgttttctggtgtgctcttttccattgaggtgatgtccagccacttcagcgtccgggattactggcgtggattctttgcagccacgtgtggagccttcatttttaggctgctggccgtattcaatagtgagcaggagactatcacgtcactgtataagactagcttccgtgtggatgtgccgttcgaccttccagaaattttttttttcgttgcactcggcggcatctgcggggtgcttagctgcgcgtacctattctgccagcgtacctttctgtcattcattaagactaataggtatagcagcaagctcctcgctacttccaagccggtgtactcagctcttgcgacgttactgctggcaagtatcacctacccgccaggagtggggcactttcttgctagccggctctccatgaagcagcacctcgatagcctttttgacaaccattcatgggctttaatgacccagaactcctcaccaccctggcctgaggaactggacccacagcatttatggtgggagtggtatcatccccgattcacaatatttgggacattagcatttttccttgtgatgaaattctggatgctgatcctagcaactaccattcccatgcccgccgggtacttcatgcctattttcatactgggtgctgctattggcaggctgttaggcgaggcgctggccgtggcatttccagaaggaatcgtgacaggtggagtcaccaaccccattatgcctggcgggtatgccttggctggcgccgccgcctttagcggggctgtgacccacacaatctcgacggccttactggcttttgaactgactggccaaatagtccacgccttacctgtcctgatggcagtgctcgcggctaatgccattgctcagtcttgtcagccaagcttctacgacgggaccatcatcgtgaaaaaacttccttacctgccccgtatcctgggaaggaatatcggatcccaccatgtccgggtagagcacttcatgaatcattctattaccactctggcaaaggacacaccactcgaagaagtggtcaaggtggtgacctccacggacgtgactgaatacccactggtggagagtacagaatcacagatcctggttggcatcgtacagagagctcagctggtgcaagccctgcaggcagagcccccatcaagggccccaggacaccagtgcctgcaggacatcctggccagggggtgtcctactgagcctgtgaccctgaccctcttttcagagaccactctccaccaggcccaaaatcttttcaagctcctgaaccttcagtcccttttcgtgacatctcgagggcgggccgtgggatgtgtgtcttgggttgagatgaaaaaggcaatttccaatctgaccaatccgcccgcccctaagtag

SEQ ID NO: 182769 - DNA, 1935 bp, Artificial Sequence
  Description of Artificial Sequence: Synthetic coding sequence
atggaggagctggtgggcctgcgggagggcttcagcggcgaccccgtgacactccaggagctgtggggcccctgtccccatattaggcgggctatccagggcggtctcgaatggctgaaacaaaaggtgtttcgtcttggggaagactggtactttctcatgaccctgggcgtgctgatggccctggtgtcgtacgctatgaatttcgccatcggatgcgtcgtacgaggatccgggatcccagagcttaagactatgctggccggtgtgatactggaggactatctggacattaagaactttggggccaaggtagtgggtctctcgtgcactctggcaacgggctcgactctgttcttaggcaaggtgggcccgttcgtgcatctctctgtgatgatagccgcatatctcggccgcgtgagaacaactaccataggagaaccagagaataaatccaaacagaatgaaatgttagtagctgccgcagccgttggcgtggccaccgtgtttgcagcaccattcagtggggttttgtttagtatagaggtcatgtcctcgcacttttcagtaagagactattggcgcggttttttcgcggctacgtgcggtgcctttattttcagacttctggccgtttttaattccgaacaagaaaccatcacctctctatacaaaacaagtttcagagttgatgttccatttgacctgccggaaatttttttctttgtagcacttgggggcatctgcggcgtgctctcctgtgcttacttgttctgccagagaacattcctgtcattcatcaaaacaaaccggtactctagcaagctcctggctacctctaagcctgtgtacagtgccctcgcgacactcttactggctagtattacctatccaccaggcgtgggccacttcttagcgtcacgactgtccatgaagcagcacctcgattccctctttgataatcacagctgggccctcatgacacagaacagctcccctccgtggcccgaggagctcgatccgcagcacctgtggtgggagtggtatcacccccggttcacaatcttcggcacccttgctttttttctcgtgatgaaattctggatgttgatactggccactactattccaatgccggccggttacttcatgcccatcttcatcctaggggcagctataggcagactcctcggtgaagcactcgccgtggcttttcccgaaggcatcgtgactggcggagtcactaatcccatcatgcctgggggttatgccctcgccggggccgccgctttcagcggagccgtaacccacaccatctcaacagcactccttgccttcgagcttacaggccagattgtgcatgccttgcctgttctgatggctgtgctcgccgctaatgcgattgctcagtcctgccagccctcattctacgatggtacaataattgtgaagaaactaccctatctgccgaggattctaggcaggaatattggctcccaccatgtccgcgttgaacactttatgaatcactcaattaccaccctggcaaaggatactccactcgaagaggtggttaaggtcgtgacttctacagatgttaccgagtaccctcttgtggagagtaccgagtcccagattctggttggaatcgtccagcgcgcgcaactggtacaggcattgcaagcagagcctccctccagggctcctggacaccagcagtgcctccaagatatattggcccggggctgtcctactgagcctgttaccttgacactgttttctgaaactaccctccaccaggcccagaacctgttcaagctgctcaatctgcaatccttatttgttacttcaaggggccgggccgtgggatgcgtttcatgggtggaaatgaagaaagcaatctccaatcttacaaatccacccgcacctaagtag

SEQ ID NO: 182770 - DNA, 1389 bp, Artificial Sequence
  Description of Artificial Sequence: Synthetic coding sequence
atggaggagttcgtgggcctgcgggagggcagcagcggcaaccccgtcacgctgcaagaactctggggtccatgtccacgcatacgccgtggaatcagaggcgggcttgagtggctgaagcaaaaactgttcaggctgggggaggattggtatttcctaatgaccctgggcgtcctaatggctttagtctcttgcgcgatggacctcgccgtggaatccgtcgtgagggcgcatcagtggctctaccgcgagatcggggattctcacctgctcaggtatctttcgtggaccgtctatcccgtcgcactcgtcagtttttccagcggtttctctcaatcaattactccgtctagcgggggttctggcatccccgaggtcaagaccatgctcgccggagtggtgttggaagattacctggatatcaagaactttggcgccaaagtggttgggttatcctgtacattggcctgtggctcgaccctgttcttgggcaaggtcggcccttttgttcacttatcagttatgatggccgcctacttgggaagagtgagaactacaaccattggagaacctgagaacaaatccaagcccgtgtattccgcacttgctactctggtcttagcttctatcacttaccccccttcagccggccgtttcctcgcctcccgacttagcatgaagcagcatctggattccctattcgataatcacagctgggccttgatgacacagaatagtagccctccttggcctgaggaactagacccccagcacctgtggtgggagtggtaccaccccaggttcacaatatttggaactcttgccttctttcttgtgatgaagttctggatgcttatcttggccaccacaatcccaatgcctgcagggtacttcatgccgattttcgtttacggtgctgccattgggaggctgttcggagaaaccctttcttttattttccctgaggggatcgtggcaggtgggatcacaaatcccattatgcccgggggttatgcgttggcgggtgccgcagctttcagcggggctgtaactcacaccatctccactgctcttttagctttcgaggtcaccggtcaaatcgtacacgcactcccagtcttgatggccgtgttggctgccaacgccatagctcagtcatgccagccaagtttctacgatggtaccgtgatcgtaaagaaactgccgtatctccctaggatcctcggtcggaatattgggtcccatagggtaagggtggagcactttatgaaccactccataaccactttggcaataacactgatgaacgatgagatcggtgtgcactgccatcagggccaggcccaaatgccaagtggcgtggtttggtttccagttcgtgggtcttag

SEQ ID NO: 182771 - DNA, 1554 bp, Artificial Sequence
  Description of Artificial Sequence: Synthetic coding sequence
atgccctgcccccccctgctgagcgtgcccgtgcgggccgccggcgagcaagacaggtgggtgagagaggaggtgacctggggcggtggccctacagtgactgggggatggggatggagagcccacttgcgtagtgtatcccctcccggagtgctgttctctattgaagtgatgagctcacatttctcagtatgggactattggagagggttcttcgccgccacctgcggagcctttatgttcaggctgcttgcagtgttcaatagcgaacaagagaccatcacctcattgtacaagactagttttagagtagatgtccctttcgaccttcctgagatcttcttttttgtcgccctggggggcctgtgtgggatccttggatctgcctacctgttctgccagagaattttcttcggatttattcgaaacaatcgcttttctagcaaactgttggccacctctaagccggtatattccgccctggccaccctcgtgctggccagcatcacctaccccccctctgccggaaggttccttgcctccagattgagtatgaagcaacatttagattctctgtttgacaatcattcttgggccctgatgacacaaaatagcagtccaccctggcctgaggagctagacccccaacatctgtggtgggagtggtatcatcccaggttcactatcttcggtacactggcctttttcctggtcatgaagttctggatgctgatcctcgcaaccacaattccaatgcctgcaggctacttcatgcctatttttgtctacggcgcggctattgggagacttttcggggaaacactgagttttatttttcctgagggaatagtggccggaggcattacaaaccccataatgcccggaggctatgccctggctggcgcggccgccttttcaggcgcagtgactcacaccatctctacggccctactcgcattcgaggtcacagggcagatcgtgcacgccctccctgttctgatggcagttctcgcagcaaatgctatcgcacagagctgccagccatcattctacgatgggacagtgattgtcaagaagctgccctacttgcctaggattttgggaaggaacatcgggtcacatcgagtacgagtggaacattttatgaaccacagcattaccactctggcgaaggacatgcctttagaggaagtggtcaaggtggtgacctccacggacgtggccaagtaccccctggtcgagagcacggaatcccaaatccttgttgggattgtgaggcgggcccagctggtccaagctctgaaagccgaacctccatcgtgggctccaggccatcagtgccttcaggatattctggcggccggctgcccaacggaacctgtgacgcttaaactctcacctgagacatcgctgcacgaggcccataatctctttgaattgctgaacctgcattccctgtttgtgaccagtcgtgggcgggcagtggggtgcgttagctgggtagagatgaagaaggcaatctcaaacctcacgaaccctcctgctcctaagtag

SEQ ID NO: 182772 - DNA, 468 bp, Artificial Sequence
  Description of Artificial Sequence: Synthetic coding sequence
atggccgtgctggccgccaacgccatcgcccagagctgccagccctcattttacgacgggactgtgattgtgaagaaactcccctacctgccccgaattctgggccggaatataggctcgcaccgcgttagagtggagcatttcatgaaccactctatcaccaccctcgccaaagatatgccactagaagaagtagtcaaggtcgtgacatctaccgacgtggctaaataccctttagtagagtcgacagagagccagattctagtgggtatagtgcgccgtgcccaactggtgcaggctttgaaagccgagccgccgtcctgggcacctggtcatcagtgtctgcaggacatcttagccgcaggatgtcctacagaaccagtgactctaaagcttagtcccgaaacaagcctgcacgaagcacagatgccctctggtgtcgtgtggtttcctgttcgcggcagttag

SEQ ID NO: 182773 - DNA, 2064 bp, Artificial Sequence
  Description of Artificial Sequence: Synthetic coding sequence
atggaggagttcgtgggcctgcgggagggcagcagcggcaaccccgtcacattgcaagagctctgggggccttgtccgagaatcagacgggggatccgaggagggctagagtggttgaagcagaagctgtttaggctgggggaggactggtatttccttatgacactgggcgtgctcatggccttggtttcgtgtgctatggatctggcagtggagtctgtcgtccgagctcatcaatggctgtaccgggagatcggcgacagccatctcctccgttacctatcttggacggtgtaccccgtcgcccttgtgagtttttccagtggattttctcagtccattaccccgagtagtggcgggagtggtatacctgaggtgaaaacaatgctggccggcgtagttctggaggattacctggatattaagaactttggtgccaaagtagttggtctgagctgtaccctcgcctgtggaagtacactcttcttgggaaaagtaggaccgttcgtgcatctgtcagtgatgatggctgcttacctagggcgcgtgagaactaccaccattggggaacccgaaaataagtctaaacagaatgaaatgcttgttgcagccgcggcggtgggcgtagcgacagtgtttgctgcccccttctccggtgtcctcttctccattgaggtcatgagctctcatttcagtgtgtgggattactggcggggcttttttgccgcgacctgcggggcgtttatgtttagactgctggccgtctttaattccgagcaggaaaccatcacctcactttacaaaactagtttccgggttgatgttccatttgacctacctgagatatttttttttgttgcgctgggaggtctgtgcggtattctcgggagtgcctatcttttttgccaacgcatcttcttcggattcattagaaacaacagattctcaagtaagttactggcaacaagcaagcccgtgtacagtgcgcttgccaccctagtactggcatcaattacctatccgccttctgctggcaggtttctggcaagcaggctgagtatgaaacagcacctcgacagcttattcgacaaccacagctgggcactgatgactcagaactcctcacctccatggcccgaagagcttgaccctcagcacctgtggtgggaatggtatcatccccgctttaccatctttggaacactggccttcttcctcgtgatgaagttttggatgctgatactggccaccacaatcccaatgcctgccggttacttcatgcccatctttgtctatggcgccgccatcggacgcctgttcggtgagaccctctcatttatatttcccgaggggattgtagcggggggcatcacgaatcctattatgcctggcggctacgcgttagctggagccgccgcgttctctggcgccgtaacacacaccatttccacggccctgctggctttcgaagtgacaggccaaatcgtgcatgctctgccagtactaatggccgttctcgccgccaacgcgatagcccaatcctgccaaccatctttttacgacggaacagtgatagtgaagaagctgccctacctgccgagaattttaggccggaacatcggttctcaccgggttcgggtggaacactttatgaaccattcaataactaccctggcgaaggatatgcccctcgaagaggtcgttaaagtggtgacttccacggacgtggccaaatacccactggtggagtccacagagtcccagatactggtgggaattgtccgaagagcccagcttgtccaggcacttaaagctgagccccctagttgggcacctggccatcagcaatgccttcaagatatactggccgcaggctgcccaaccgagcctgtgactctgaagctcagtccagaaactagcctgcatgaagcccacaatctctttgaactgctaaacttacacagcctgtttgtgacatctaggggccgcgccgttgggtgcgtttcatgggtggagatgaagaaagcgatctcaaaccttacaaatcccccagcacccaaatag

SEQ ID NO: 182774 - DNA, 441 bp, Artificial Sequence
  Description of Artificial Sequence: Synthetic coding sequence
gcccagagctgccagcccagcttctacgacggcaccgtgatcgtgaagaaattaccctacctgccgcgaatccttggacgcaatattggttcccatcgggtgcgggtggagcattttatgaatcatagcattaccacactcgctaaggacatgcctctcgaggaggtggttaaagtagtaactagtacagacgttgcaaagtatcccctggtggagtccacggaaagtcagatcctcgtaggaattgtgagacgcgctcaacttgtgcaggcactgaaagctgaaccaccatcatgggctccaggacaccagtgcctacaggacattctcgccgccgggtgtcccactgagcctgtgacactgaagctgagtcctgaaacctcacttcatgaggcccagatgccgtccggagtcgtgtggtttccagtccgaggatcatag

SEQ ID NO: 182775 - DNA, 2646 bp, Artificial Sequence
  Description of Artificial Sequence: Synthetic coding sequence
atggccgccgccgccgccgaggagggcatggagccccgggccctgcagtacgagcagacattgatgtatggtagatatactcaggatttgggcgcttttgccaaagaagaggcagctcgaatccgactgggcgggcccgaaccttggaagggacctcccagcagccgtgctgcccccgaactgctggaatacggtcgttctcgttgtgctcggtgtagagtgtgttcggtgaggtgccataaatttctggtaagcagggttggagaggactggattttccttgtcctcctcggcttgctaatggctttggtgagctgggttatggattatgccatcgccgcctgcctccaggctcaacaatggatgagccggggcctgaacactagtatcctgctacaatatctcgcgtgggttacttacccagtggtgctgattactttcagcgctggtttcacccaaatcctggcgccacaggccgtgggcagcggcatcccagaaatgaagactatcctccgaggtgtggtcctcaaagagtacctcacccttaagacattcatcgccaaagtgatagggcttacctgtgcactcggaagcggaatgcctctagggaaagagggacccttcgttcacatcgccagtatgtgtgccgcactcctgtcaaagttcctttccctgtttggtggtatctacgaaaacgaaagtagaaatacagaaatgctggccgccgcttgcgccgtcggcgttggctgttgcttcgccgcaccaattggaggagtactgttcagcattgaagtaacttcaactttttttgccgtgcgcaactattggagaggattttttgctgcgacctttagtgccttcatcttccgagtgctcgcagtctggaacagagacgaggagaccatcactgccctatttaaaacacggttccgattggattttccctttgatctgcaggagttgccagcatttgcggtcatcggcatagcctcgggttttgggggggccctgtttgtctacctcaatcgaaaaattgtgcaagttatgagaaagcagaaaactataaatcgcttcctgatgagaaaacgcctgctgtttccggccctggtgactctgctgattagtacacttaccttccccccagggttcggacagttcatggctggacaattatcacagaaagagaccctcgtgaccctttttgataatagaacttgggttaggcagggactggtggaagagctggagcctcccagtacctcccaggcctggaatcccccacgcgctaacgtgttcctgactctcgtgatcttcatcctgatgaaattttggatgtccgcccttgccaccaccatacccgtcccatgcggagctttcatgcctgtgtttgtcatcgatggaatccacactgactccagcacctaccgcatagttcctggtggctacgccgtagtgggagcggccgcactggcgggtgctgttactcatactgtgagtaccgctgttatcgtgttcgagttaactggccagatcgcacatattctgccggttatgatcgcagtaatcttggccaacgccgtcgctcagagccttcagccatcactgtacgattcaataatcagaattaaaaagctgccctacctgcctgagctgggctggggccgacatcagcagtatagggtccgcgtggaagatatcatggtgagggacgttcctcatgtggcgttgagctgcacttttagggacctccggctggcactgcataggacaaaggggcggatgcttgctttggttgagtcacccgagagcatgatcctcctcggctccattgaaaggagccaggtggtggccctgctgggggcccaattgagccccgcaaggagacggcaacatatgcaggaaagacgtgctacacagacatccccattgagtgaccaggagggtccacccaccccagaggctagtgtgtgttttcaggtcaatactgaggactccgcctttccagctgcccggggggagacacacaagccactgaagcccgcattgaaaaggggacccagtgttactcgaaatttaggtgagagtccgacaggatctgcagagagcgctgggattgccttaaggtctctgttttgtggatcccccccacccgaggctgcctccgaaaaacttgaaagctgcgaaaaacgaaaactgaaaagggtacggatctctctggctagcgatgctgacttggagggcgaaatgtcacccgaagagatacttgaatgggaagaacaacagttagatgagccagttaacttcagcgactgtaagattgacccagctccgttccaacttgtggagcgcacctctctgcacaagacacacacaatattttccttgctgggcgttgatcatgcatacgttacatcaatcggccgcctgataggaatagtcaccctaaaagaactgcggaaagctatcgaaggctccgtgacagctcagggggttaaggttcggccacctctggcaagcttcagagattctgccacctcttcttcagatactgagaccaccgaggtccacgcgttatggggccctcattcgcggcatggcctcccacgcgaaggatcacctagcgattccgatgacaagtgccagtag

SEQ ID NO: 182776 - DNA, 2565 bp, Artificial Sequence
  Description of Artificial Sequence: Synthetic coding sequence
atggccgccgccgccgccgaggagggcatggagccccgggccctgcagtatgaacagacgctgatgtatgggagatatacgcaggatctgggagcattcgcaaaagaggaagccgccagaattaggctcgggggaccagagccttggaaaggcccaccatcttcaagagccgcacccgagctgctcgagtacgggcgatcccggtgcgcgcgatgtcgcgctcagcaatggatgtcgaggggcctgaatacctctatcctgctgcaatacctggcctgggttacttatccagtggtgctgataacattctctgccggcttcactcagattctagctccacaggctgtggggtcgggaatcccagagatgaaaaccatactgcggggagtcgttttgaaagaatatctcacccttaagacgttcattgccaaggtgatcggtctgacatgtgcgctgggttctggaatgccccttggaaaagagggaccgtttgtccacatcgccagcatgtgcgcagcccttctgagtaagttcctgagtttgttcggggggatttacgagaatgagagtaggaacaccgaaatgctggccgccgcctgcgcagtgggcgtgggctgttgcttcgcagcccctattggtggcgtgctgttttcaatcgaggtaacctcaacattttttgcagtacgaaactactggagaggcttttttgctgccacattctcagcgtttatatttcgcgtgcttgcagtgtggaacagggacgaggagacaatcactgctctcttcaagacccgctttcgtcttgattttcccttcgacctacaggagctccctgccttcgctgtgatcgggattgcaagtgggttcggaggcgcactatttgtctacctgaacagaaaaatcgttcaagtcatgaggaaacagaagaccatcaacagatttctcatgcgcaagcgcttattgtttcccgcgttagttacactgctgatcagcactctgaccttcccccccggcttcggacagtttatggcaggacaattgtcacagaaggagacgctcgtgacccttttcgacaataggacgtgggttagacaggggttagtggaagagctggagccgccttccacctcgcaggcatggaaccctccacgcgcgaatgtcttcctgaccctggttatattcatcctgatgaagttctggatgtcagctttggctaccaccatacctgtgccttgcggtgccttcatgcctgtctttgtgattggagctgcgttcgggcggcttgtaggagagagcatggccgcctggtttcctgatggtattcacaccgactcctcaacgtaccggatcgtgcccggaggctacgccgtggtgggggctgccgcactggcgggagcagttacgcatacggtgtcaacagccgttattgtgtttgagctaacaggtcagatagcccacatcctgcctgtgatgatagccgtcatcctggcaaatgctgtggcccagtctctgcaaccttcgctctatgattctataatccgaattaaaaagctgccctacctgcctgagctcgggtgggggcgtcaccaacagtaccgggtcagagtagaagatattatggtgagagacgtcccccatgtagctttgtcctgcacctttcgcgacctgcgtctcgctctacaccgaacaaaggggagaatgcttgcactggttgaaagccccgagagcatgattttacttggaagtatcgagcggtcccaggttgtggcactccttggtgcccagctatcaccagccaggcgccgccaacatatgcaagagaggcgggccacacagacgagcccgctgtccgaccaggagggccctcctacccccgaagcgtcagtgtgttttcaggtaaacaccgaggattccgccttcccagccgccagaggtgaaactcacaagcccttaaaaccagccctgaagcgcgggccaagtgtgacaaggaacctgggggagtctcccaccgggtctgcggagtctgctgggatcgccctgcggtctttgttttgcggctctccccctccggaagcggcatcagagaagttggaaagctgcgagaaaaggaagctcaagcgggtgagaattagtcttgcctctgatgcagatctggaaggcgaaatgagtcccgaggagattcttgaatgggaggagcaacagctggatgagccggtgaatttcagcgactgcaagatcgaccctgcccccttccagttggtcgagcgaacctccctgcacaagacacatacaattttttctttgctgggcgtcgatcatgcatacgtaacctccatcgggcggcttatagggatcgtaacactgaaggaattacgcaaggcaatcgagggatccgtgacagcccagggtgtcaaagtccgacctccgctcgcctcgttccgcgacagcgccacaagttcatccgacaccgagaccaccgaggttcatgccctgtgggggcctcacagccgtcacggactccccagggaggggtctccgtccgactctgacgacaaatgtcagtag

SEQ ID NO: 182777 - DNA, 2610 bp, Artificial Sequence
  Description of Artificial Sequence: Synthetic coding sequence
atggccgccgccgccgccgaggagggcatggagccccgggccctgcagtatgagcaaacactcatgtacggacgctatacacaggatcttggtgcctttgccaaggaagaggccgctcggatcaggctgggtggccccgaaccttggaagggacctccctcatccagagcggcacctgagcttctggagtatggtcggagcagatgtgcccgctgccgagtgtgctctgtgcgatgccacaaatttttggtgtcacgcgtaggcgaggattggatttttctggtgctgctgggattattaatggcgctggtgtcctgggtgatggattacgccatcgctgcttgcttgcaggctcaacagtggatgtctagaggcctcaacaccagtatcctgctgcaatatctcgcttgggtcacttatcctgtggtactgattactttctcagccggatttacacagatcctggctccccaagctgtcggctctgggatcccagagatgaaaactatactacggggggtggttctgaaggaatacctcaccctgaaaaccttcatcgccaaggtcattgggctgacctgtgccctgggatcgggaatgcccctgggcaaagaggggccattcgttcacattgcttccatgtgtgccgccctgttatcaaaatttctctccctctttggtggcatctacgagaatgaaagccgcaatacagagatgctggctgccgcgtgcgccgtgggcgtgggctgttgctttgccgcgcccataggtggagtgttgttctccatcgaggtgacaagcacattctttgcagtaagaaattactggcggggattcttcgctgccacgttcagcgctttcatcttcagagtgttggcagtatggaacagggacgaagagacaataacagctctcttcaagaccaggttccgactcgactttccatttgacctacaagagttgcccgccttcgccgtgattggtatcgcttccggctttggcggagctctgtttgtttacttgaataggaaaattgtccaggtgatgcggaagcagaagactattaatcgcttcctgatgagaaagcggcttttatttccagctttggtgaccctactgatcagtacactcacttttccacccggcttcgggcagttcatggccggtcaactgtcacagaaggaaacactggtgaccctgtttgacaatcgcacttgggtcagacagggtctggtcgaagaactcgagcctccctcaacatcccaagcgtggaatcctcctagggcaaacgtttttctgactctggtgatcttcattctgatgaagttctggatgtcagcactcgcgacgaccatccccgtcccatgcggggcgtttatgccggtatttgttatcggcgctgcttttggtcgtctagttggcgagagcatggcagcatggttccctgatggtatccacacggactccagtacgtatcgaattgtgcccggcgggtatgccgtggtcggtgcagccgcgcttgcgggtgctgtaacacacacagtttcgactgcagtcattgtgttcgagttgacaggccaaatagcccatattctacctgtgatgattgcggtgattctcgccaatgccgtcgcacagagtcttcagccctctctgtatgacagtattatacgcatcaagaaactgccatatctgcctgaactcgggtggggtagacaccagcaatatagggtgagggtcgaagacatcatggtgcgtgatgtgccacacgtggcgctcagctgcacgttccgggacctgagattggctctacaccggacaaagggcagaatgctagctcttgtggagagccctgagtccatgatattgctgggatcaattgagcgatcccaggtagtcgcgttattgggggcacagctctcaccagctaggcgcaggcaacacatgcaggagaggagagccactcagacctctccactgtctgatcaggaaggccccccgacacctgaggcctctgtgtgtttccaggtgaataccgaagatagcgcctttccagcagcgcggggggagacccacaagccccttaaacccgccctgaagagaggtcccagcgtgacgcgcaacctgggggagtcccctaccgggtccgccgagtcagccgggattgccctgagatctctgttttgtggatcgcctcctcccgaagccgcatcagagaaactagagagctgcgaaaaacggaaactgaagcgtgtaaggatttcacttgctagcgatgcagatttggaaggtgaaatgtcccccgaggagatcctcgagtgggaagagcagcagctcgatgagcccgtgaattttagcgactgcaaaatcgacccagcacccttccagctggtggaacggactagccttcataagcttcggaaggcgatagaaggcagcgtgacggcccagggcgtaaaggtaagaccacccctggcttctttccgcgactccgctacctctagctctgacactgagactactgaagtgcatgcattgtggggaccccattctaggcacggtctcccacgtgaaggtagcccctccgactcagatgacaagtgtcagtag

SEQ ID NO: 182778 - DNA, 714 bp, Artificial Sequence
  Description of Artificial Sequence: Synthetic coding sequence
atgagcttcctgaagagcttccccccccccggccccgccgagggcctgctgcgccagcagccagacaccgaagccgtgctaaatggcaaaggattgggcaccggaactctatatattgcagaatcccgcctgtcttggctggacggcagtggattgggattcagcttggagtatccgaccatcagcctacacgcattgagtcgggatcgttcagactgtctcggcgagcatctgtatgtcatggtgaacgccaaattcgaggaagagtccaaagagccggttgcagatgaggaagaggaggacagcgacgacgacgtggagccaatcactgagtttaggttcgttccttctgacaaatccgcgctggaggccatgttcaccgccatgtgtgagtgccaagctttgcaccctgatccagaagacgaggattcggatgactatgatggcgaggaatacgatgtggaggcccacgaacaaggacagggcgacatcccaaccttctacacctatgaggaggggctttcccacttaaccgcagaaggacaggcaaccctggagcgcttggagggcatgttgtcacaatccgtgtccagccaatacaatatggccggcgttaggaccgaagacagtatcagagattacgaggatggaatggaggtcgatactactcccaccgtggctggtcagtttgaagatgccgatgtggatcactag

SEQ ID NO: 182779 - DNA, 714 bp, Artificial Sequence
  Description of Artificial Sequence: Synthetic coding sequence
atgagcttcctgaagagcttccccccccccggccccgccgagggcctgcttaggcagcagcccgatacggaagccgtgctcaatggtaaaggcctgggaacagggacactgtacatcgcagagtccagactttcctggcttgatggatcaggactgggcttttcactcgaatacccgacaatttcattgcatgccctatcccgggacaggagtgactgtctaggggagcacctctatgtgatggtgaacgctaaatttgaagaggaatccaaggaaccagttgcggacgaggaggaggaggacagcgatgacgacgtggagccaattactgagtttcgatttgtcccaagcgacaaatccgcgcttgaggcaatgtttacagccatgtgtgaatgccaggcactgcatccagatcccgaagacgaagattccgatgactatgacggcgaggagtacgatgtggaggcccatgagcagggacagggggatattcctactttttacacatacgaagaaggcctcagtcatcttacggctgaaggacaggctacgcttgaacggcttgagggcatgcttagtcaatcagttagctcgcagtacaatatggccggtgtccggacggaggactccattcgggactacgaggatggaatggaggtggacaccacgccgacagttgccgggcaatttgaagacgctgatgtggaccattag

SEQ ID NO: 182780 - DNA, 504 bp, Artificial Sequence
  Description of Artificial Sequence: Synthetic coding sequence
atggtgctgctgctgaagggcgtgcccttcaccctgaccaccgtggatactcgcagatcacctgacgtgcttaaagactttgctcccggatcacaactgcccattctgctatatgacagtgacgctaagacagataccctccagatcgaagactttctggaggaaaccctagggcctccagacttcccgtccctcgccccaaggtatagggaatccaataccgcaggaaacgatgtcttccacaagttcagcgctttcattaaaaatcctgtgcctgcacaagatgaagcactgtatcaacagctccttagagctctggccaggcttgattcataccttagagcccctctggaacacgagctcgctggggaacctcaattgcgggagtcacgccggcgctttttagatggagacagactgacacttgctgactgctcgctactgcctaaattgcatattgtggataccgtgtgtgctcacttccgacaggcgccgatcccttag

SEQ ID NO: 182781 - DNA, 711 bp, Artificial Sequence
  Description of Artificial Sequence: Synthetic coding sequence
atggccgagaccaagctgcagctgttcgtgaaggccagcgaggacggcgagtcagtgggtcattgtccctcttgtcagaggttgttcatggtgttactgcttaaaggcgtcccgttcacgctcactactgtcgacactaggagatctcctgatgtgcttaaagattttgctccaggaagccagttgccgattctgctttacgacagcgatgccaaaacagatactctccagattgaagacttcctggaagagactctgggtccacccgactttcccagcctggcaccacgataccgcgaaagtaataccgctggcaacgacgtttttcataagttttccgccttcattaaaaatcccgtgccagcccaagacgaggctctttaccagcagctgctgagagctctggctcgtctcgactcttatttgcgcgctcccctggaacacgaactggcaggcgagcctcagctcagggagtcccgtcggcggtttctggatggcgaccgcctgactctggcagattgctcactccttccaaagctccatatcgtggacaccgtatgcgcccacttccgccaggctccaatccctgcagaattacgcggtgttcgacggtatctcgactctgctatgcaggagaaagaatttaagtacacatgtccccattcagctgaaatcttagctgcgtaccgtccagctgtgcacccccggtag

SEQ ID NO: 182782 - DNA, 348 bp, Artificial Sequence
  Description of Artificial Sequence: Synthetic coding sequence
atgaacagcggcgtgtgcctgtgcgtgctgatggccgtgctggccgcaggggcactcacgcagcccgtgcctccagccgacccggccggcagtgggcttcagagagcagaagaggctcccaggagacagctcagggtctctcagagaacggatggcgagagccgggcacatctgggggccctccttgcacgttatatccagcaggctaggaaggctccaagcggccggatgtcaatcgtgaaaaatttgcaaaacttggacccctcccatcgtatttccgatcgtgactatatgggctggatggacttcggcagaaggtcagccgaagagtatgaataccccagctag

SEQ ID NO: 182783 - DNA, 348 bp, Artificial Sequence
  Description of Artificial Sequence: Synthetic coding sequence
atgaacagcggcgtgtgcctgtgcgtgctgatggccgtgctggccgctggcgcactgacacagcctgtgcccccagccgatccggctggttcaggtttgcaacgggccgaagaggctccgaggaggcaattgagagtaagccaacggacagacggagaatccagggcgcacctaggcgccctgctcgccagatatatacagcaggcgcggaaggcaccaagcggcagaatgagcatcgtgaagaacctgcagaatcttgaccctagccacagaataagcgatcgtgattatatgggatggatggattttggccggaggagcgccgaagagtatgagtatcctagttag

SEQ ID NO: 182784 - DNA, 348 bp, Artificial Sequence
  Description of Artificial Sequence: Synthetic coding sequence
atgaacagcggcgtgtgcctgtgcgtgctgatggccgtgctggccgccggcgccctcacccagccggttcctccagcagatcccgcaggatccggactgcagcgcgcagaagaggctcctagacggcagctgagggtatctcagcgtacagatggtgaaagtcgtgcccatttgggagctctcttggccagatacatccagcaggccagaaaggcaccctctggcaggatgagcattgtcaagaacctgcagaaccttgatcctagtcacaggatctcggacagggattacatgggttggatggactttggccgacgtagtgcggaagagtacgaatacccgagctag

SEQ ID NO: 182785 - DNA, 1287 bp, Artificial Sequence
  Description of Artificial Sequence: Synthetic coding sequence
atggacgtggtggacagcctgctggtgaacggcagcaacatcaccccaccatgtgagctgggcctggaaaatgagacattgttctgcctagatcagcctcgcccctccaaagaatggcagcccgctgtccagatcttactgtattccctgattttcctcctgtctgtgctgggcaacaccctcgtgatcacagtgctgattcgcaataaaaggatgcgaactgtgactaatatcttcctgctctctctggccgtgtccgatttaatgctttgcttgttttgcatgcctttcaaccttattcctaacttgttgaaagacttcatctttggctccgccgtgtgcaagaccactacatacttcatgggcacgagtgtgtcagtgagtaccttcaacctagtagcaatctcattggagcggtacggagctatttgcaaacctcttcagtcgcgcgtgtggcagacaaagagccacgctctgaaggtgattgccgccacttggtgcctgagtttcacgattatgacgccttatcccatctatagtaatctagtcccattcacaaagaacaacaatcagacagctaacatgtgtcgatttcttctccccaatgatgtgatgcagcaatcatggcacacatttcttctgttgatcctgttcctgattccaggtatagtgatgatggtcgcctatggcctgatttcgttagagttgtaccaaggcataaaatttgaagcctcacaaaagaagagcgcaaaggaaaggaagccctcgacaacaagcagtggcaagtatgaggactcagatggctgctacctccaaaaaacccggccccccaggaagctggaactgagacagctgtccacaggaagcagctcccgcgccaacaggatcaggtccaattcttctgccgctaatcttatggctaagaagagagttataaggatgttgattgtgattgtggtcctcttcttcctgtgctggatgcctatcttcagtgcaaatgcgtggagagcatacgataccgcatcagccgaaaggcgcttgtcggggactccaatcagctttatcctgttgctgtcttacacttcctcctgcgtgaatcctattatttattgcttcatgaacaagcgcttccggctgggcttcatggcaacatttccatgctgtcctaatccagggcctccaggcgccagaggtgaggtcggggaggaggaagaaggtgggaccacaggcgcctctctgtcaagattcagttactcccacatgtcagcgtccgtgccacctcaatag

SEQ ID NO: 182786 - DNA, 1344 bp, Artificial Sequence
  Description of Artificial Sequence: Synthetic coding sequence
atggagctgctgaagctgaaccggagcgtgcagggcaccggccccggtcccggagccagtttgtgcaggcccggagcaccattgctgaactctagcagcgtaggcaacctgagctgtgagccaccgcggatccgaggggcagggacaagagaactggagcttgccatccgaattaccctgtatgccgtgatatttctcatgtcagtgggtggcaacatgctcatcattgtggtgctcgggctgagccggagattacgcaccgtaacgaatgcatttctcctctcactggctgtgtctgacctgctgctcgccgtggcatgcatgcctttcacacttctgcccaacttgatggggacattcattttcggcacggtgatctgcaaagccgttagctacctgatgggggtatcagtgtccgtgtccaccctgagcttggtggccatcgcactggagcgttattcagcgatctgtcggcctctgcaggcccgggtatggcaaacccgtagccacgcggccagggttatcgtggccacatggctgctgtcaggtttgctgatggtcccctacccggtgtacactgtggtgcagcctgtcgggcctcgagtactgcagtgcgtccacaggtggccaagcgccagagtgcgacaaacgtggagcgtcctgttattgctgcttttgttcttcattccaggtgtcgtcatggccgtggcatatgggttaatttctcgagaactgtacctcggcctgagatttgacggtgattcggattcggactcccagagcagagtgaggaaccaaggtggtctccctggcgctgttcatcagaatggacggtgtcggcccgaaacgggcgctgtaggtgaggattctgatgggtgctatgtgcagctacctcggtctagacccgctttggagctaactgctctgactgctcctgggcccggcagtgggtcgagaccgacgcaggcaaaactgctagctaagaagcgggtggttagaatgttgttagtcatagtggtgctcttttttctgtgctggttgccagtgtattcagccaatacttggcgcgcatttgacggaccaggggctcacagggccctaagtggagccccaatatcgtttatccacctcctgtcatatgcttcagcgtgtgtaaacccgctggtctattgtttcatgcaccgtcgttttcggcaggcctgcctggagacctgtgccagatgctgcccacgaccccctagagcccgtcccagggccctgccagacgaggacccccctacaccatctatagccagtctctcacggttgtcatacactactatttcaaccctggggccgggttag

SEQ ID NO: 182787 - DNA, 1551 bp, Artificial Sequence
  Description of Artificial Sequence: Synthetic coding sequence
atggagctgctgaagctgaaccggagcgtgcagggcaccggccccggacctggtgcaagtctgtgcaggccaggcgctcctcttttgaattccagtagcgtgggcaacctgagctgtgagccaccacggattcggggagccgggactcgtgaactcgagttagcaatcagaattacgctctacgccgtgatcttcctgatgtctgtgggtggcaacatgctgattatcgtagtgctcggcctctcccgacggctgcgcactgtcacaaatgctttcctgttgtctctggccgtgtccgacctcctcctggcagtggcttgcatgccattcacacttctacctaatttaatgggcacttttatcttcggaaccgtcatttgtaaggccgttagctatttgatgggggtgtccgtgagcgtctccacactatcactggtcgccatcgcccttgagcgctactcagcgatctgtcgtcctcttcaggccagagtttggcagacccgatcccacgcagctagggtgatcgtcgcaacctggttgctgagcggccttcttatggtgccctatccggtgtacacggtggtgcaaccagtggggccccgtgtacttcagtgcgtgcatcgatggccctccgcgagagtacgacagacatggagtgttctactcctactattattattttttattcccggagtggtgatggccgtggcatacgggttgatcagccgcgagctgtacctgggcctcagatttgacggcgactctgactctgactcccagtcccgtgtgcggaatcaaggcgggctccctggcggcgctggtcctagggaacagaacctgggagaggccgaattatggagagcaaccgggcccgccggtgtgggcgggactgaaatgaaggttcgcgtgagaaggaagcttgagatggagctcagctgggagaggaggagcggcggtgattgggccggagactggggagacagccctttttcgcttaccgcgcatcccctatgttccggagcagtccatcaaaacgggcgatgcagaccggagacgggtgccgtgggagaggacagcgatggatgctacgtacaacttcctcgatccaggcccgcccttgagctcaccgctctcaccgctcctggccccggttccggcagccgcccaacccaagctaaactgctggctaagaagcgggtggtacgcatgctcctggtgatcgtggtgctctttttcttgtgctggctgcccgtctatagcgcgaatacttggcgggcattcgatgggccaggagcccatcgggccctgtctggcgcccctatatcttttatccacctgctctcctatgccagcgcctgcgtgaaccccctcgtgtactgctttatgcacaggcgcttccgacaggcatgcctagagacttgtgcccgctgttgccccagacctccgagggccaggcccagggcactgcccgacgaagaccctcccacaccatccatagcgtctctcagtaggttgtcctatacgactataagcacactgggtcccggatag

SEQ ID NO: 182788 - DNA, 819 bp, Artificial Sequence
  Description of Artificial Sequence: Synthetic coding sequence
atgagctgccacaactgcagcgacccccaggtgctgtgcagcagcggccagctgtttctacagcccctgtgggaccacctgcggagctgggaggccctcctccagtcccctttcttcccggttatattcagtatcaccacatacgtgggattctgcctgccgtttgtggtgttggatattctttgcagttgggtgcccgctcttcggaggtacaagattcaccctgatttcagcccctccgcacagcagctcctgccctgcttgggccaaacattatatcagcacgtcatgtttgtgtttccggtcacacttctgcactgggcccgatctccagctctgcttccccacgaggctcccgaactcctgcttctcctccatcatatcttattctgtctcctcctctttgacatggaattttttgtgtggcacttgctacatcacaaggttccatggctctaccggacattccacaaggttcatcaccagaattcaagttccttcgccctggccacacagtatatgagtgtgtgggaactgttttctctggggttcttcgacatgatgaacgtgacactccttggatgccaccctctcacgaccttgacttttcacgttgtaaatatctggctttctgtggaagaccatagtgggtacaattttccttggtccacacaccgcctggtgccattcggatggtatggcggcgtggtccaccatgatctgcatcatagccacttcaactgtaacttcgcgccctatttcacccactgggacaagatattaggaaccctgaggaccgcctctgttccagctaggtag

SEQ ID NO: 182789 - DNA, 1482 bp, Artificial Sequence
  Description of Artificial Sequence: Synthetic coding sequence
atgctggccgccaccgtgctgaccctggccctgctgggcaacgcccatgcatgctccaagggcacctcgcatgaagccggtattgtgtgtcgaattaccaaaccggcactgctcgttctgaatcacgagaccgctaaggtcattcagaccgcttttcagagagcatcatatcccgacatcacgggcgagaaagctatgatgctcttaggtcaagtaaagtatggcctgcataacatccagattagccacctaagtattgcttcttctcaggtcgaactggtggaggctaaatcgatcgacgtgtcaattcaaaatgtgtctgtcgtttttaaagggactctgaagtatggctataccacggcctggtggttagggatcgaccaatcaatcgatttcgagatagactcagccatagaccttcaaataaacacacagttgacctgcgattctggccgggttagaactgacgccccagattgttacttgtcttttcacaagctcctgttacacttgcaaggtgaacgagagcctggatggataaaacagctctttactaactttatttcgtttaccctgaagttggtgctaaaggggcagatatgtaaagagattaacgtcatcagcaatattatggctgacttcgtgcagaccagggctgcatccatactctcagacggggacatcggggtcgatataagtctgacgggggatcccgtgatcaccgcgtcgtatctggagtcccaccataagggacacttcatctacaaaaatgtgtccgaagatctaccgctacccaccttttctcccacgctgttaggggactcgcgcatgctgtatttctggtttagtgagcgcgtattccacagccttgctaaagtggcatttcaggatggtaggcttatgttaagcctaatgggtgatgaatttaaagcggtactggaaacgtggggttttaacaccaaccaggagatctttcaagaagtggtgggagggtttcctagccaggcccaggttacagtccactgcctcaaaatgcctaaaatcagctgccagaacaaaggtgtggttgtaaatagttcagtgatggtgaagtttctcttccccaggccagatcagcaacacagcgtcgcttacactttcgaagaggacatagtcactactgtccaggcgagctacagcaagaaaaaattgttcctgagtctcttggacttccagatcacaccaaaaactgtttccaatttaaccgaatcctcttccgaatcagtgcagtcattcctccaatccatgataaccgccgtgggaatacctgaagtgatgtcacggcttgaagtggtgtttaccgctcttatgaacagcaagggagtcagtctctttgatatcattaaccccgagattatcacgagggatgggtttcttctgctccaaatggatttcggattccctgaacatctcttggttgatttcctccaatctttgagctag

SEQ ID NO: 182790 - DNA, 1302 bp, Artificial Sequence
  Description of Artificial Sequence: Synthetic coding sequence
atgctggccgccaccgtgctgaccctggccctgctgggcaacgcccacgcctgttctaaaggcaccagccacgaagcagggatcgtgtgcagaatcactaagcctgccctccttgtgctcaatcatgagaccgcaaaagtgattcagaccgcctttcaacgggcctcctaccctgatataacgggcgagaaggcgatgatgttgctgggccaggtgaaatacggcctgcataacatacagatctcccatctgagtatcgcttcctctcaggtggagcttgtggaagcaaaatcaatcgacgtgagtatccagaatgtatctgtagtcttcaagggcactcttaagtacggttacactactgcctggtggcttggcattgaccagtccatcgactttgagatagattctgccatcgatctccagatcaacacacagcttacctgcgacagcggtagagttcgcaccgacgcccctgactgctatctgtccttccacaagctgctcctgcaccttcagggtgagagagaacccggttggatcaagcaacttttcactaacttcatttcatttactctcaagctggtgctgaaaggacagatttgcaaggagatcaatgtgattagcaacattatggcagattttgtgcaaactcgggcagcaagcatactgtccgatggggacatcggagttgatatcagtctcaccggggatccagtcataacagccagttacttagagtcccaccacaaggccgttttagaaacctgggggttcaatactaatcaagaaattttccaggaggtcgttggaggctttccctcccaggcccaggtgacagtgcactgtctcaaaatgccaaaaatctcatgccagaataaaggcgtcgtcgtgaatagttctgtgatggtcaaatttctgtttccgcgacctgaccaacagcatagcgtggcctacacatttgaagaagacattgtcacgaccgtccaggcatcttattctaagaaaaaactttttctaagtctcttggacttccaaatcactccaaaaaccgtgagcaatctaacggaaagctccagcgaatcagttcaaagtttccttcagtccatgatcactgccgtgggaataccagaggtgatgagtagattggaagtggtattcacagctctaatgaactcaaagggggtatccctgtttgacatcatcaatccagaaattatcactagggacggattcctgcttttacagatggacttcggctttcccgagcacctgctcgttgacttcttgcagtctctatcctag

SEQ ID NO: 182791 - DNA, 1374 bp, Artificial Sequence
  Description of Artificial Sequence: Synthetic coding sequence
atgaagaccaagttctgcaccggcggcgaggccgagcccagccccctggggttactgttgagctgtggctccggcagcgctgcccccgcccccggcgtcggtcagcaacgcgatgccgccagtgatttggaatccaaacagctcgggggtcaacagcctccactggccctccctcctccacctcctctacctctgcctctccccctgccacagccaccgccccctcagcctccagccgacgagcagcctgagcctaggaccaggcgcagagcttacctatggtgcaaggagtttcttcccggagcatggcgggggctgagggaggacgagtttcacatctcagttattcggggaggcctgagtaatatgcttttccagtgctccctaccggataccacagcaacgctcggcgatgagcctcgaaaagtgctgctccgcctgtacggggccattctgcaaatgagatcctgtaataaagaaggcagtgagcaggctcaaaaggagaatgaattccagggagctgaggcgatggtactggagtctgtgatgttcgctatactcgcagagcgctcacttggaccgaagctgtatggaatttttccccagggccgcctggagcagttcattccatctcggcggctggacacagaggaactttcgctaccggatattagcgccgagatcgctgaaaagatggccactttccacggcatgaagatgcccttcaataaagagccaaaatggttgttcggaactatggagaagtatctaaaggaggtgctccgtatcaagttcacagaggagtccagaattaagaaattacacaagctcctcagctacaacctcccgcttgagctggagaacctcaggagccttttagaatccaccccctcccccgtagtattctgtcataatgattgccaggaaggcaacatccttttgctggagggtagggaaaattccgaaaaacagaaattaatgctgatagatttcgaatatagctcctataactatcgcgggtttgacatcggtaaccacttttgcgaatggatgtacgactactcttacgagaaatacccattttttcgggctaacatccgcaaatacccaaccaagaaacaacaattgcattttatttcctcctatttgccagcctttcagaacgactttgagaatctgagcacagaggagaagtccatcattaaggaggagatgctgctggaagtaaacagattcgcactagcatcacatttcctgtggggcctttggagcatcgtgcaagcaaagatatcctcaatagaattcgggtatatggattatgcgcaggccaggtttgacgcatattttcaccagaagagaaagctcggggtgtag

SEQ ID NO: 182792 - DNA, 1320 bp, Artificial Sequence
  Description of Artificial Sequence: Synthetic coding sequence
atgaagaccaagttctgcaccggcggcgaggccgagcccagccccttaggactgttactgtcctgcggcagtggatctgcagcccctgctcctggcgttggccaacaaagggacgctgccagcgacctcgagtcgaaacaattgggcggccaacaaccccctttggccctgccaccgccacctcctctcccactgcctctgcctttaccacaaccaccgcctccccaaccacctgcagatgagcagcccgagccacggactcgacgcagggcctatctgtggtgcaaggaattcttaccaggggcttggagaggacttagagaggacgaattccacattagcgtaatccgaggtggactgtcaaacatgctctttcagtgctctttgccggacacaacagcgacattaggtgatgaaccacggaaggtgctcctgcggctctacggagcgattttgcaaatgggcgcagaagcaatggtgctggaaagtgtaatgttcgccatcctggctgagaggagccttgggcccaaattgtacggaattttccctcaagggaggctggaacagtttattcccagcagacgactggatactgaagaactcagtttacctgatataagcgctgaaatcgcggagaagatggcaactttccacggaatgaaaatgccttttaataaagagcctaagtggctctttggaacaatggaaaaatatcttaaggaagtgctacgcataaagtttacggaggaaagcagaattaaaaaactacataagttactctcttacaatctaccgctggagctggaaaaccttcgcagcctccttgagtccacccctagtccagtggtgttctgtcacaacgattgtcaagagggtaacatattgcttctggaagggcgagagaatagcgaaaagcagaagctgatgctcatagattttgaatatagcagttataattatcgcggatttgatatcggaaatcacttttgtgagtggatgtacgattactcctacgaaaagtatccattcttcagagccaatatccgaaaataccccacaaagaagcagcagctgcatttcatctcttcgtacctccccgctttccagaacgacttcgagaatctcagcactgaggagaaatcaatcatcaaggaagagatgctgctcgaggttaaccggttcgccttggcaagccacttcctgtgggggttgtggagcattgtgcaggccaagatctctagtatcgaatttggttatatggactatgcgcaagccagatttgacgcgtatttccatcagaaacgcaaactcggagtctag

SEQ ID NO: 182793 - DNA, 1188 bp, Artificial Sequence
  Description of Artificial Sequence: Synthetic coding sequence
atggccgccgaggccaccgccgtggccggcagcggcgccgtgggcggctgtctggccaaggacggcctccaacagtccaagtgccccgacactacccctaaacgcaggcgggctagctcgttaagtcgggatgcggagcgcagggcataccaatggtgtcgggagtatctaggtggagcctggcgaagagttcagcccgaagagctgcgggtgtatcctgtctctggtgggctttcaaacctgctcttcaggtgtagcctcccagaccatctccctagtgtgggcgaggaaccgagagaagttctgctgaggctgtacggagctatcttgcagggtgtggacagtctggtactggaaagcgtgatgttcgccattctcgcggagcgttcactgggtccccagctgtacggagtcttccccgagggaaggctggagcaatacatcccaagccgccctcttaaaacgcaagagctgcgggaacccgttttaagtgccgccatcgccaccaaaatggcgcagtttcacggcatggaaatgccctttacaaaggagcctcattggctgttcgggacaatggagcgatacctgaagcagatccaggaccttccccctaccgggcttccagaaatgaatttactcgagatgtattccttgaaagacgagatgggtaatctacgcaagctgctggagagtaccccatcacccgtggttttttgccataacgacatccaggaaggtaacatactccttttgtccgagcccgagaacgccgactcacttatgcttgtggacttcgaatacagttcctacaactacagaggctttgatatagggaaccacttctgtgagtgggtatacgactacacccatgaggagtggcccttttataaggccaggccgacggactatcctacacaagaacagcaattgcactttatccgacattacctggccgaagccaaaaagggcgaaaccttgagtcaggaggagcagagaaagctcgaagaggatctactcgttgaggtctcaagatacgcactcgcctcccacttcttttggggactgtggagtattctgcaggcctctatgagcactattgaatttggttacctcgattacgctcagtctcgtttccaattctactttcagcagaagggccaacttactagtgtacatagcagctcttag

SEQ ID NO: 182794 - DNA, 2247 bp, Artificial Sequence
  Description of Artificial Sequence: Synthetic coding sequence
atgggcctgcggaccgccaagaagcggggcctgggcggcggcggcaagtggaagcgtgaggaaggaggcggaacacgagggcggagggaggttcggcctgcttgcttcttgcagagcggcggccggggggatcccggagacgtgggtggccctgccggcaacccgggctgctctccccatcccagggccgccacaagacctccccctctgcctgctcatacacctgcacacacccctgaatggtgtggagcagcttctgctgaggcagctgagccgcgaagagccggaccacatctatgcatccccgctcctgggttgacgaaaacccctatcctcgagaaggttccacgaaagatggccgcaaagacaccttcttccgaagagtcgggccttccgaaactcccggtccctcccctgcagcagaccttggccacttatctccaatgcatgaggcatctggtgtcagaggagcagttcaggaaaagccaggccattgtccagcagtttggcgctcctggtggactcggggagacgctgcagcagaagctcctcgagcgccaagagaagaccgccaactgggtgtcagagtactggctgaacgacatgtacctgaacaacaggttggcgctaccagttaactcttccccagccgtgatttttgcgcggcagcattttccagggaccgacgatcagttacgcttcgcagcatccctgatttctggtgtgctgagttacaaggccctgctggacagccatagtatccctaccgactgtgctaaagggcagctgagcggccagccgctgtgcatgaagcagtattacggcctcttctccagctatcgattgcctggccatacccaggacaccctcgtagcccagaactccagtataatgcctgaacccgaacacgtaatagtcgcatgttgcaaccagttctttgtgttggatgtcgtcatcaacttccgcaggctctctgaaggtgacctatttactcagctgcgcaaaatcgtgaaaatggctagcaatgaggatgagaggctcccacctataggattgctcacttctgacggcaggtcagagtgggcggaggcccgcactgtattggtgaaggattcgacaaatagggactccctggatatgatagagagatgcatttgcttggtttgcctggacgccccgggcggggtggaactgagcgacacgcaccgggccctccaactccttcacgggggagggtattctaaaaacggggccaacaggtggtatgacaagagcctccagtttgtcgttgggcgagacggcacctgtggggtcgtgtgcgaacattctccttttgacggaatcgtgctggtccagtgtactgagcatctgcttaaacacgttacccagtccagccggaaattgattagagccgactcagtttccgagctgcccgccccgaggcggctgagatggaaatgcagtcctgagattcaagggcacctcgcgtcttccgccgagaaactacaacggatcgtgaagaacttagatttcatcgtgtataagttcgacaattacgggaaaacatttatcaaaaagcaaaagtgtagcccagatgcttttattcaagtagcgctgcaacttgccttctataggctgcataggcgactcgtacccacctacgaatctgcctccattcgtagattccaggagggaagagtagataatatccggagcgcgacacctgaagccctggccttcgtacgcgccgttaccgaccacaaggccgctgtccccgcctccgaaaaactccttcttttgaaggacgccatcagagctcagactgcatataccgtgatggccatcactggcatggccattgataatcatctgctggccttgcgcgagcttgcccgtgcaatgtgcaaagaattgccagagatgttcatggacgagacgtatctaatgagcaatcgtttcgtactatctacttcacaggtacccactaccacagagatgttttgttgctacgggcctgttgtaccaaacggctatggagcctgttacaatccccagcctgagaccatacttttctgcatctcaagcttccactcttgtaaggagacaagctcctcaaaattcgctaaagcagttgaagagtctctgattgacatgcgcgacctgtgcagcctgctgcctcccaccgaatcaaaacctctcgcaactaaagaaaaagcgactagaccttcccagggacaccagccatag

SEQ ID NO: 182795 - DNA, 1893 bp, Artificial Sequence
  Description of Artificial Sequence: Synthetic coding sequence
atggccgccaagacccccagcagcgaggagagcggcctgcccaagctccccgtgcctccacttcagcaaacgcttgccacctatctccaatgcatgcgccatcttgtgagcgaagagcaattccgcaaaagccaggcaatagtccaacaatttggcgctcccggtggactcggtgaaacactgcaacagaagctgctggaaaggcaggagaagacagcaaattgggtgtctgaatactggcttaatgacatgtatctgaataatcggcttgcccttcctgttaattcgtctccggccgtaatttttgctaggcagcacttccccggcactgacgaccagttgcgattcgcagctagcctgatttccggcgtgctgtcctacaaggctctgcttgactcacactccatcccaaccgattgcgctaagggacagctgtcgggccaacccctgtgcatgaaacagtattatggcctgttctcttcttaccgattgccaggacacacgcaggacacactcgtcgcacaaaattcctcgatcatgcctgaaccagaacacgttattgtcgcatgctgcaatcagtttttcgtgctggacgtggtgatcaactttcgtcggttatccgagggtgatctctttactcagctgaggaaaatcgtgaaaatggccagcaacgaggatgagcggctgcctccaatcgggttgctgacaagcgacgggagaagcgaatgggctgaggcgcggacggttctcgtcaaggacagtaccaaccgtgactcgctcgacatgatagagcgatgcatctgtcttgtgtgtctcgatgctcctggtggagtggagctgagtgatacacatcgtgctcttcagctgctccatggtgggggatattctaagaacggcgcgaatcggtggtatgacaagtccctgcagttcgtggtgggccgagatggcacatgcggcgttgtctgtgagcatagccctttcgacgggatagtactagtgcagtgtactgagcacctactgaaacacgtgacacagtcttcacggaaactcatccgcgctgacagcgtgtctgagcttcccgccccgcgacggcttaggtggaagtgtagcccagagatccagggccaccttgcttctagtgctgagaagctccagcgaatcgtgaagaaccttgatttcatcgtctataaatttgataattatgggaaaacttttattaagaagcagaaatgctctcccgacgcctttatccaggtggcgctgcagctcgccttttatcgactgcacagacgactggttcctacatatgaaagtgcctcaatccgtagatttcaggagggccgggtggataacataaggtccgctactcccgaggcactggcatttgtgcgcgccgtgactgaccataaggcagcagtgcccgccagtgaaaagttgcttcttctgaaggatgccatccgggcgcagaccgcatatactgttatggcaatcacgggcatggccattgacaaccatctgctagccctccgcgaattagcaagagcaatgtgcaaggagctgccggaaatgttcatggatgaaacctatctgatgtccaatcgctttgtgctctccaccagccaggtccctaccaccacagaaatgttttgctgttatggaccagtcgtccctaatggctatggtgcctgctacaatccacagcctgaaaccatactcttttgtatatcctcgttccacagctgcaaagaaacctcgtctagcaaatttgccaaagcggttgaagaaagtttaattgatatgagagacctgtgcagcctgctcccccccaccgagtccaaaccgctggcaacaaaagagaaagcaacacggccttcccagggacaccagccttag

SEQ ID NO: 182796 - DNA, 1893 bp, Artificial Sequence
  Description of Artificial Sequence: Synthetic coding sequence
atggccgccaagacccccagcagcgaggagagcggcctgcccaagctgccagtgccacctctgcagcaaacccttgccacctacctacagtgcatgaggcatctggtgagcgaggaacagttcagaaagtcacaggccatagtacagcagtttggtgctcctgggggcttgggcgaaaccttgcaacagaagcttttagagcggcaggagaagaccgctaattgggtgtccgaatactggcttaatgacatgtatctgaacaatcgtttagctcttccggtgaatagtagtccagccgtgatcttcgctagacagcattttcccggcacagatgaccagcttcgcttcgcagcctcacttatcagcggagtccttagctataaagctttgctcgattctcactccatcccaactgactgtgcaaagggccagctttccggccaaccactgtgtatgaagcagtactacgggctctttagctcttatcgccttcctggacacacccaggatacactggtggctcagaatagtagcattatgcctgaacctgaacacgtgatcgtggcctgctgtaatcagttcttcgtgctggacgtagtgattaactttagacgattatccgaaggcgatttatttacccaactgcggaagatagtgaagatggctagcaacgaggacgaacggctccctccaattggccttctgactagcgacggtcgcagcgaatgggccgaagctaggactgtacttgttaaggattctactaatagggactcgctcgatatgattgagcgatgcatttgtctagtgtgcttggatgcccccggcggcgtcgagttatcggacacgcaccgcgccttacagctgttgcacggcggagggtatagcaaaaatggcgccaacaggtggtacgacaagtccttgcagttcgttgtaggtcgcgatggaacctgtggggttgtgtgtgagcacagtccgtttgatggcatcgtgcttgtacagtgcactgaacaccttctgaaacatgttactcagtcgtctcggaagctcattagagcggacagtgtcagcgagttacccgcccctagacggctgagatggaagtgctcccccgaaatccaggggcatttagcttcttccgcggagaaactacagcggattgtgaaaaatcttgatttcatcgtctacaaatttgacaattacggaaagaccttcataaagaagcagaaatgctcaccagatgcatttattcaggtggccctacagctagctttctataggctccacagaagactcgtgcccacatatgaatcggccagtatccggcggtttcaggagggccgtgtggacaacattcggagtgcaacccctgaggctcttgcatttgtgagggccgttaccgaccacaaagcagcagtgcctgcctcagagaagctgttgctgctcaaggacgctatacgggcccagacagcctacaccgtgatggcaataacaggtatggcaattgacaaccacttgctggctctacgcgagttagcccgcgccatgtgtaaagagcttcctgaaatgtttatggatgagacttacctgatgtctaatagattcgtgctatcaaccagccaggtgcctaccaccaccgagatgttctgttgttatggtccggttgtgcccaacggttatggcgcttgctacaacccacagcccgaaaccatccttttttgcatttctagtttccattcctgtaaagagacaagttcttctaagtttgccaaggctgttgaagagagcctcatcgatatgcgcgacttatgtagtctgttacccccaacggagtcaaagccactggccaccaaggaaaaagccaccagaccctctcaggggcatcagccctag

SEQ ID NO: 182797 - DNA, 1893 bp, Artificial Sequence
  Description of Artificial Sequence: Synthetic coding sequence
atggccgccaagacccccagcagcgaggagagcggcctgcccaagctccctgtcccaccacttcaacaaacgctggccacatacctgcagtgtatgcgtcacctggtgagcgaggaacaatttcggaagagtcaggcgattgtacagcagttcggcgctccaggtggcctgggagaaacccttcagcagaaactgttggagagacaggagaagaccgcaaactgggttagcgagtattggctaaatgacatgtatttaaataacaggctagctcttcctgtgaattctagcccggccgtgatctttgcccgccagcattttccaggcacagatgatcagcttagattcgctgcatccctgatttctggtgtgctttcctacaaagctttactggactcccacagtattcctactgattgtgctaagggccagctgtcaggacagcctctgtgcatgaaacaatactacggactcttctcttcatatagacttcccgggcatacacaagatacactggttgctcagaatagctcaattatgcctgagcccgagcatgtgatcgtcgcctgctgtaatcaatttttcgtcctggatgtcgtcatcaatttccgtcgattgtcggagggagatttgtttacacagctaagaaagatcgttaagatggcctccaatgaagatgagcgactccctccgattggcttgctgaccagcgatggccggagtgagtgggccgaagcccggacagtactggtcaaggatagtacgaacagagacagcctcgacatgattgaacgctgcatctgtctcgtttgtcttgatgcccctgggggtgtggaactctccgacactcatagggcactccagctgttacacggaggcggttattcaaaaaacggagcaaacaggtggtatgacaagtccctccagttcgtggttgggagggacgggacttgtggtgtggtgtgtgaacattccccatttgatgggatcgtgcttgtgcagtgcaccgaacacctcctcaaacacgtgacccagtcaagtaggaagctcatccgggctgattccgtttcagagcttcccgcaccgaggagactcaggtggaagtgttccccagaaatccagggccacctggccagcagtgcagagaagctccagaggatagtgaagaacttggatttcattgtgtacaagttcgacaattacggaaaaacctttataaaaaagcagaaatgctctcccgacgcttttatacaagtggcacttcagttggctttttaccggcttcaccgacgactggtccctacgtatgagtctgcttcaatccggcgctttcaggaaggaagagtcgataatatccgctccgcaacacccgaagcactggcattcgttcgcgctgtaacggatcacaaggccgctgtgcccgcctcagagaaacttctgctgctgaaggacgccatcagggcccaaacggcttataccgtcatggccatcaccggcatggccatcgacaatcacctcctggctttgcgagagctggcccgggcaatgtgcaaggagctgcccgaaatgtttatggacgagacgtatctcatgtctaatcggttcgttttgtccacaagccaggtcccaaccacgacggagatgttctgttgctatggacctgtggtacctaatggctacggcgcctgttataatccgcagccggaaaccatattgttttgtatcagcagtttccattcttgcaaggagacctccagcagcaagtttgccaaggctgtggaggaaagtctgattgatatgcgggatctgtgcagtctgctgcccccaaccgagtccaagcctttggccactaaagaaaaggctacaaggccttcccagggtcaccaaccgtag

SEQ ID NO: 182798 - DNA, 2001 bp, Artificial Sequence
  Description of Artificial Sequence: Synthetic coding sequence
atgtggcccgagtgccgggacgaggccctgagcaccgtgggcccccatctctgtatcccagccccaggcctcacaaagaccccaatcctggaaaaggttccacggaaaatggctgctaaaaccccatcctccgaagagtccggcctgcctaaactccccgtgcccccactacagcagaccctagcaacctatttgcagtgtatgagacatctggtctccgaggagcagttccgcaaatcacaggcgatcgttcagcaattcggagcccccggcgggttgggagagactttgcagcagaagcttctcgagcggcaggagaaaactgctaactgggtgtctgaatactggctgaacgatatgtatttaaataataggctggccctgccagtgaactcctccccagcagtaatatttgcgagacaacactttccaggtactgacgatcagctacggtttgccgccagccttatctctggagtccttagttacaaagcccttctcgactcacactctatacctactgattgtgcaaaaggccagctttccggccagcccctctgcatgaaacagtactatggcctcttttcgagctaccgacttccgggacatacgcaggataccttggtagcccagaattcctccattatgccagaacctgagcacgtcatcgtggcatgttgcaaccagttcttcgttctcgacgtcgtcatcaatttcaggaggctctccgaaggtgatctctttactcagctccggaaaattgttaaaatggcatctaacgaagacgagagacttccacctatcggacttctcacctcggacggacgaagcgagtgggctgaggctagaacggttttggtgaaagacagtactaaccgcgactccctcgacatgatcgaaaggtgtatatgtctggtgtgcttagacgctccaggaggcgttgaactgagcgacacacatagagccttacagcttctgcacgggggaggatactcaaaaaatggggccaatagatggtatgacaagtctctgcagtttgtcgtcggcagagatgggacatgtggagtcgtatgtgaacactccccatttgacggaatcgtcctggttcagtgcacagagcatttgctgaaacatgtgacgcagtctagccggaagctgatccgtgcagacagcgtaagtgaactccctgccccccgtcgcctgcggtggaagtgtagccctgaaatacagggccatttggctagctcagcggagaaactgcaacggatcgttaaaaatctggatttcatcgtgtataagtttgataattacgggaaaaccttcattaaaaagcagaaatgttcacccgatgcctttatccaggtggctttgcagctggccttttatcgtctacaccgaagacttgtgccaacctatgaatccgcttcaattcggcggttccaggagggacgagtcgataatatcaggagtgctacaccagaggctctggccttcgtgcgcgcagtcaccgaccacaaagcggctgtgcctgctagcgagaagctgttactactgaaagatgctattagggcccagaccgcatacacagtgatggccattaccgggatggctattgataaccatctgctggccttacgcgagttggcccgtgctatgtgcaaggagttaccagaaatgttcatggacgaaacctatttgatgagtaacagattcgttctcagtacttctcaggtacccacaaccacagaaatgttttgttgttacggtccagtcgttcctaatgggtatggcgcatgctacaaccctcagcctgagacaatacttttctgtatttctagcttccactcatgcaaggagacgtctagttcgaagtttgccaaagctgtggaagaaagcctgatcgatatgagggatttatgtagtctgctgcccccgaccgagtcgaagccgttagcaactaaagaaaaagccactcggccatcccaggggcaccaaccctag

SEQ ID NO: 182799 - DNA, 1638 bp, Artificial Sequence
  Description of Artificial Sequence: Synthetic coding sequence
atggccgccaagacccccagcagcgaggagagcggcctgcccaagctcccggtgccgccactccaacagacgttagcgacctaccttcaatgcatgcgccacctggtctctgaggagcaatttcgtaaatctcaggcaatcgttcaacagttcggagcccccggcgggctgggagaaaccttgcaacaaaagctgctggagaggcaggaaaaaaccgcgaactgggtgagtgagtattggctaaacgatatgtatttaaacaatagactagctttgccagtgaactcgtctcctgctgtcatatttgctaggcaacacttccctggcactgacgatcagttgagatttgccgcaagtttgatctctggcgtgcttagctataaggccctgttagactctcattcaataccaaccgattgcgccaagggccaactgagcggacagccactgtgcatgaagcagtactacggcctgtttagcagttatcgtctgccaggtcatacacaagacacgctggtggcccagaactccagcatcatgcccgagcccgagcatgtgatagtggcctgctgcaatcagttctttgtcctggatgttgttatcaactttcgtcgactgtctgagggtgacctgttcacgcagctccgcaaaattgtcaaaatggcctccaatgaagacgaacggctgcctcctatagggcttttaacatctgatggccgatctgaatgggcagaggctcgcacggtgttggtaaaagactcaaccaacagggacagtcttgacatgatcgagaggtgtatttgcctggtgtgccttgacgcacctggaggcgtggaactaagtgacacccacagagccctccagctcctgcacggtggtggctacagtaaaaatggcgccaatcgttggtacgacaagagtctgcagttcgtggtgggccgcgacggaacatgtggagtggtttgcgaacactcaccctttgatgggattgtccttgtgcagtgtacagagcacctgctgaagcacgtgactcagtccagcaggaagcttataagagccgacagtgtttcggaactgcccgcaccgagaagactccgatggaagtgtagtccagagatccagggtcacctcgcttcaagcgcggaaaaactacaaagaatcgttaaaaatctggatttcatcgtttataagttcgataactacgggaagacattcattaagaaacagaagtgctctcctgacgcctttattcaagttgccctgcagctcgcattctaccgccttcataggagactggtgccaacctatgagagtgcctcaattagacgattccaggagggccgcgtggataacatacgcagtgcgactccagaggctctcgcattcgttcgcgcagtcaccgatcataaagccgccgtgcctgcctctgagaagctcctactgttgaaggacgcaattcgcgctcagaccgcctataccgtgatggcaattacagggatggcaatcgacaatcatctcctcgccctccgcgagctggcaagggcaatgtgcaaagagctgccagagatgttcatggacgagacatacctcatgagcaatcggtttgtcctcagcactagccagttgtgctggccgtag

SEQ ID NO: 182800 - DNA, 1383 bp, Artificial Sequence
  Description of Artificial Sequence: Synthetic coding sequence
atgaacaccagcgccccccccgccgtgagccccaacatcaccgtgctggcgccaggaaagggaccctggcaggtcgcatttataggaataacaacgggccttttaagcctcgcaaccgttaccggaaacctgctcgtgctgatcagtttcaaggttaataccgagttgaagactgtgaacaactacttcttgcttagcctggcatgcgctgatctgattatcggtaccttttctatgaacctgtacacaacctacctcctgatggggcactgggcgctcggtaccctggcctgtgatctgtggcttgcgctcgattacgtggcgtcaaatgcttctgtgatgaatctccttctgatttcatttgaccggtacttcagtgtgacgaggccactcagttaccgcgctaagaggaccccccgccgagcagcactgatgattggcttagcttggctagtttcattcgtgttgtgggcaccagccattcttttttggcagtaccttgtgggtgaacgcacagtactagctggacagtgctacatccagtttttgtctcaacccattatcacctttgggaccgctatggctgcgttttatctgccagtaactgtgatgtgcaccctatattggagaatttaccgagagaccgagaaccgcgccagagagcttgctgcactccaaggcagcgaaacacctggaaaggggggcggcagcagcagtagtagcgaacgctcccaacccggggctgagggtagcccagagacaccaccagggaggtgctgccgttgttgcagagcccctcggctgctgcaggcttactcttggaaagaagaggaggaagaagatgaggggtcaatggagagcttgacaagctcagaaggggaggaacctggatctgaggtagtcatcaagatgccaatggtagatcccgaggctcaggcgcccacgaagcagccgccacgctcatcacctaataccgtgaaaaggccaactaagaagggccgggatcgcgccggtaagggtcaaaaaccgcgcggaaaggaacagctggctaaacgcaaaaccttctccctcgtgaaggagaaaaaagcagctaggacactctctgcaattctgttggcatttatcttaacttggacaccctacaacatcatggtcctggtgtcaaccttctgcaaggattgtgtaccggaaacattgtgggaactcggctactggttgtgttatgtgaattccactatcaaccctatgtgttatgccttgtgcaacaaagcatttcgggacacattccgactgctgttgctgtgccgatgggacaaacgccgatggagaaagatcccaaagaggcccgggtctgtgcaccgcactcccagcagacagtgttag

SEQ ID NO: 182801 - DNA, 405 bp, Artificial Sequence
  Description of Artificial Sequence: Synthetic coding sequence
atgaacaccagcgccccccccgccgtgagccccaacatcaccgtgctagcaccaggcaagggcccctggcaggtcgctttcataggcataaccaccgggttgctgagtcttgccacagtgacaggcaacctgttggttctaatctcttttaaagtgaacactgaactaaaaacagtgaacaattacttcctgctctccctcgcctgcgctgacctcattattggtactttctctatgaatctgtatacaacctaccttctgatggggcactgggcattggggacactggcatgcgacttatggcttgctctggattatgtggccagtaacgcatccgtcatgaacttactgctgatttctttcgatagatacttcagcgtgactaggccactgtcatatcgttag

SEQ ID NO: 182802 - DNA, 1365 bp, Artificial Sequence
  Description of Artificial Sequence: Synthetic coding sequence
atgaacaccagcgccccccccgccgtgagccccaacatcaccgtgttggcacccggcaagggtccatggcaggttgccttcatcggaataactactggtctgctgagcctcgccacggtcaccgggaatctgctggtccttatcagtttcaaagtgaacacagaacttaaaacagttaataactactttttactctccctggcctgtgcagatctaattatcgggacctttagtatgaatctgtatactacatatctgctcatggggcactgggccctgggaactctggcttgtgacctgtggctggccctggattacgtcgcatccaacgcctcggtaatgaatttactgctcatctctttcgataggtacttctcagtgactagacccctgtcttatcgcgctaagcgcacacccagaagagcggctctgatgattggcctcgcttggctggtttcgttcgtgctatgggcccccgccatactattctggcaatacctagtgggcgagcgcaccgtgctggctggacaatgctacatccagttcctctcccagccgatcataacattcgggaccgccatggccgctttctatctccccgtaacagtgatgtgcaccctgtactggcgcatctaccgggagactgaaaatcgagcccgcgaactggctgccctccagggaagtgaaactcctggaaagggaggcggctcttctagcagtagtgagagatctcagccaggggccgaaggaagtccagaaacccccccggggaggtgctgccgctgttgccgagcaccaagactcctccaggcatactcctggaaggaggaagaagaggaagacgaaggaagcatggagagtttgacatcttcggaaggcgaagaacctggctctgaggtcgtcatcaaaatgcccatggtggaccctgaagcacaggcccccactaaacaaccgcctcgttcttctcccaatactgtgaagcgccctactaagaaaggccgggacagagccggaaaaggccagaaaccaaggggaaaggagcagttagctaaaagaaagactttttctctggtcaaagaaaaaaaggcagccagaacgttgtcggcaatcctgcttgcttttatcctgacatggaccccttacaatatcatggtgctggtgtccacgttctgcaaagattgcgtgcccgagacgctgtgggagctgggttactggctatgttacgtgaactctaccataaatcccatgtgctatgcactctgcaacaaggccttcagagatacctttagactacttctcttatgtagatgggacaaacgacgctggcggaagatccccaaacgccccggatctgtgcataggtag

SEQ ID NO: 182803 - DNA, 1401 bp, Artificial Sequence
  Description of Artificial Sequence: Synthetic coding sequence
atgaacaacagcaccaacagcagcaacaacagcctggccctgacctccccttataaaaccttcgaggtcgtcttcatcgtgctggttgctgggtctctgtcgctcgtgacaatcatcggcaacattctggtaatggtttccatcaaagttaacagacacctccagacggtgaacaattacttcttgttctctctggcatgtgccgaccttattataggagtgttttcaatgaatctgtacacactgtacacagtaataggctactggccactgggccctgtggtgtgtgatttatggttggctcttgattacgtggtctcaaacgctagcgttatgaatctacttataattagcttcgaccgttacttctgcgtaacaaaacctttaacttatccagtgaaaaggactacgaagatggcagggatgatgattgcagccgcctgggttctttcctttatcctgtgggcccccgcgatcctattctggcagttcattgtgggagtgagaaccgtggaagatggtgagtgttacatccagttttttagcaacgccgccgtcactttcggtaccgcgattgccgctttttacctacccgtcatcattatgacggttctgtactggcacatcagtcgagcctccaaatctaggattaagaaagacaagaaggaacctgtagctaaccaggatcctgtgagcccctcactggttcagggcaggatagtgaagcccaacaacaataatatgcccagtagcgacgacggcctggaacacaacaagatccagaacgggaaggctccccgggaccccgtgacagagaactgtgtgcagggcgaagagaaggagtcaagcaatgatagtacatccgtctcagctgtggcttctaatatgcgcgacgatgagataactcaagacgaaaacactgtgtcaacaagtctcgggcactctaaagacgagaacagtaagcagacctgcatccggataggcacgaagacacccaaatccgatagttgtacacccacaaacaccactgtggaggtggtggggtccagtgggcagaacggtgatgagaagcagaatatcgtggcaaggaaaattgtaaagatgaccaagcagccagctaagaagaaacccccaccatcacgtgaaaagaaagtcaccagaactatcctggccatcctgcttgcttttataattacttgggctccctataacgtcatggtgctgataaataccttctgcgctccttgtattccaaataccgtgtggactatcggctattggctgtgctacatcaactccaccatcaatcccgcctgctacgcactttgcaatgcaacattcaaaaaaacgttcaaacatctgctgatgtgtcactacaagaacattggcgccacacggtag

SEQ ID NO: 182804 - DNA, 1401 bp, Artificial Sequence
  Description of Artificial Sequence: Synthetic coding sequence
atgaacaacagcaccaacagcagcaacaacagcctggccctgacctctccgtacaagacattcgaggtggtgttcatcgtgctggtggcgggatcactgtcgctcgttaccataataggaaacatcctggtcatggtctcaatcaaggtgaatcgacacctccagacggtcaataactacttccttttttccctcgcctgcgccgatcttatcattggagtcttttcaatgaacctatacacgctctacaccgtgatcggatactggccacttgggcctgtcgtctgcgacctatggctggctttagactatgtggtatcgaatgccagcgtgatgaatctgcttattataagtttcgacaggtacttctgtgttactaagccactgacctacccagttaagagaaccacaaaaatggcaggtatgatgatcgccgcggcatgggttctctcttttatactctgggcacccgctattttattttggcagttcattgtgggagtccggacagtggaagatggagagtgctacatccagttcttcagtaacgccgccgttacatttggtacagcaattgccgctttttaccttcccgtgatcatcatgacggtcctgtattggcatatctctcgagcttccaagagtcgcatcaagaaagacaagaaggagcctgtggcgaaccaggacccggtcagtccctccttagtccagggccgcatcgttaaacccaacaacaataatatgcccagttctgatgatgggctagagcataacaagatccaaaacgggaaggccccccgggacccagtgactgagaactgcgtgcaaggggaagagaaggagtcttccaacgactccacctccgtgtccgcggtggcatctaacatgcgggatgacgagatcactcaagatgaaaatactgtttccacatcactgggacacagcaaggacgaaaatagtaagcaaacttgtatcagaatcgggaccaaaacccctaagtctgattcctgcacaccaacgaatacaaccgtcgaagtggtaggctcttctgggcagaatggtgacgaaaagcagaacattgttgcgcggaagatagtaaagatgacaaagcagccagctaagaagaagccccctcccagccgtgagaagaaggtaacgaggactattctggctatccttctagccttcatcatcacatgggccccttacaacgttatggtccttattaatactttttgtgctccgtgcatccctaatacggtttggacaatcggttactggttgtgctacattaattcgacaattaacccagcctgttatgcgctgtgcaatgccacctttaaaaagacatttaagcacctgttgatgtgtcactacaaaaacataggtgccacaaggtag

SEQ ID NO: 182805 - DNA, 1401 bp, Artificial Sequence
  Description of Artificial Sequence: Synthetic coding sequence
atgaacaacagcaccaacagcagcaacaacagcctggccctgacctcaccctacaaaacctttgaggtggtgttcatcgttctggtggccggatcacttagcttggtcacgattattggcaatattctcgtgatggtttcgattaaggttaaccggcacctgcagactgtgaacaactacttccttttcagccttgcctgtgccgacttgatcattggtgtgttttctatgaacctctacacgctttacactgttatcggatactggcccctgggaccggtcgtttgcgatttgtggctggccctggactacgtggttagcaatgcttctgtcatgaacctcctgataatctccttcgaccgctatttttgtgtgactaagccgcttacatatccggttaaacgcactacaaagatggcagggatgatgatcgctgctgcctgggtgctttcctttatcctgtgggctcctgctatactgttctggcagttcattgtcggtgtgcggactgtggaggatggcgagtgctacatccaattttttagcaacgccgctgtaacctttggaaccgctattgccgctttctacttaccagtgatcataatgacagtgctgtactggcatattagccgggccagcaagagcaggatcaagaaggacaaaaaagagcccgttgctaaccaggatccggtgagcccatctctcgttcagggacgtatcgtgaagcccaataacaacaacatgcccagcagtgatgatggcctcgaacataacaaaattcaaaatggtaaagcgccccgtgaccctgtgactgagaactgcgtccagggggaagaaaaagaaagttctaacgatagtacgagtgtgagcgcagttgcgtccaacatgcgagatgacgaaatcactcaggatgaaaatacagtgtcaacttcgttaggccacagtaaggatgagaacagcaagcagacgtgtattcggatcgggacgaagacgcctaagtccgactcgtgtaccccaaccaacactacagttgaagtcgtcggctcgagcgggcaaaacggtgatgagaaacagaatatcgtcgccaggaaaatcgtgaaaatgaccaagcaaccggccaaaaagaagccacctccatctagagagaagaaagtgacccggaccatcctcgctattttgctggcctttattattacatgggccccctacaacgttatggtgctgattaatactttttgcgccccctgtataccaaataccgtttggactattggatactggctgtgttacataaactccaccatcaatcctgcctgctatgccctgtgtaacgcaacgtttaagaaaaccttcaagcatctcttaatgtgtcactacaaaaacattggtgcaacgaggtag

SEQ ID NO: 182806 - DNA, 1401 bp, Artificial Sequence
  Description of Artificial Sequence: Synthetic coding sequence
atgaacaacagcaccaacagcagcaacaacagcctggccctgacctcaccctataaaacatttgaggtcgtgtttattgtgttagtagccgggtccctctccctggtgactattatcggtaatatacttgtaatggtgtccattaaagtgaatagacacctgcaaactgttaacaattacttcctctttagcttagcttgtgccgaccttatcatcggcgtcttcagtatgaacctctacactctgtacactgtaattggctattggcccttgggaccagtcgtttgcgatctctggctcgccctcgactacgtcgtgagcaacgcaagcgttatgaacctgctgatcatttctttcgacagatacttttgtgtaactaagcccctaacgtatccagtaaagaggaccaccaaaatggctgggatgatgattgctgccgcctgggttctgagctttatcctttgggcacctgccatcctgttttggcagttcatcgttggggtccgaaccgtagaagacggcgagtgctacatccaatttttctcaaatgcggcggtgaccttcggcacagctatcgccgcattctacttgcccgtgataatcatgacagtgctctattggcacatctccagagcatccaagagccgcatcaaaaaggacaagaaggagcccgtggccaaccaggaccccgtcagcccctctttagttcagggcaggatcgtcaagcccaataacaacaacatgccctcttcagacgatggccttgagcataacaaaatacagaacggcaaggctccccgtgaccccgtgacggaaaactgtgtgcagggggaagagaaagaaagctcgaacgacagcacctcagtttctgccgtcgcatccaatatgcgagacgacgagatcacccaggacgaaaacacagtgagcactagccttggccattcaaaggacgagaatagtaagcagacatgcattcggattggcactaagaccccaaagtcggattcctgcacgcctactaatacaaccgtcgaagtggtgggaagttccggccaaaatggggacgaaaagcagaacatcgtggcccgcaaaatcgtgaagatgacaaaacaacctgcaaaaaagaagccgcctccctctcgggagaagaaggtgacaagaactatcctggcgatcctgctagccttcatcatcacttgggccccttacaacgtcatggtgttgatcaatactttttgcgcaccgtgcatccccaacactgtttggaccataggctactggctgtgttatatcaactccaccataaacccagcgtgttatgccctgtgcaacgccacttttaagaagacctttaagcacctcctgatgtgccactataaaaacatcggagcaacacgctag

SEQ ID NO: 182807 - DNA, 1401 bp, Artificial Sequence
  Description of Artificial Sequence: Synthetic coding sequence
atgaacaacagcaccaacagcagcaacaacagcctggccctgaccagtccttacaaaacctttgaggttgtgttcattgtgctggtcgccgggagcttgagtctagtaaccatcatcggaaacatattagtgatggtttctatcaaggttaaccggcacctccaaaccgttaataactattttctcttctctctggcatgcgcagacctgatcattggagtgttctctatgaacttatatactctatacactgtcatcggctactggccgctagggcctgtagtttgcgacctctggttggctctcgactatgtcgtcagtaatgcgagcgttatgaaccttctgatcataagtttcgaccgctatttctgtgttacaaaaccactgacttaccccgtgaagcgaaccacaaaaatggcagggatgatgatcgccgcagcttgggtcctgtctttcatactgtgggcccccgcgattctgttctggcaattcatcgttggtgttcgcacagtggaagacggcgaatgctatatacagttcttctccaacgcggcagtgacctttggaaccgccattgccgccttttacttgcccgttatcattatgactgtcctgtattggcacatctcccgggctagtaagagccgcataaagaaggacaagaaagaaccggtggctaatcaagaccccgtgagcccatctctggtgcaaggtagaattgttaaacctaataacaacaacatgcctagtagcgacgatggcctcgaacacaacaaaattcagaatgggaaggcccccagagatccagtgaccgaaaactgcgttcagggggaggagaaagaatcttcaaatgattcaaccagtgtttcagccgtcgctagcaatatgagggacgatgagatcacccaggatgaaaacaccgtctccacgtcactcgggcactccaaagatgagaacagcaaacaaacttgcatccggattggcactaaaacccctaaatctgactcttgcaccccgacaaataccaccgtggaggtcgtcggaagtagcggccagaacggggatgagaagcaaaatatcgtagctaggaagatcgtgaaaatgactaagcagcctgcgaagaagaaaccacctccatcaagggaaaagaaagtaacacgaaccatcctggcgatcctgctggcttttatcattacttgggccccatacaacgttatggtgctaatcaatactttctgcgcaccttgcatccccaacaccgtctggacgatcgggtattggttgtgctacattaattcaaccataaaccctgcgtgttacgcactgtgcaatgccacgtttaagaagacctttaagcaccttctgatgtgccattataagaatataggggccacacggtag

SEQ ID NO: 182808 - DNA, 1401 bp, Artificial Sequence
  Description of Artificial Sequence: Synthetic coding sequence
atgaacaacagcaccaacagcagcaacaacagcctggccctgaccagtccatacaagactttcgaggtcgtgtttatagtgctcgtggctggttcattgtctctcgttaccatcatcggaaatatactggttatggtcagcattaaagtcaaccgccacctccaaacagtcaataattacttcctattcagcctggcctgtgcggacctgatcatcggcgtcttctccatgaacctgtatacactctataccgtaatcggatactggcctctgggaccagtggtttgtgacctgtggttggcccttgattacgttgtcagtaatgcatctgttatgaatctacttattatcagcttcgaccgctacttctgcgtaaccaagcctctaacatatcctgtgaaacgtaccactaagatggccggcatgatgattgcggccgcttgggtattaagtttcatcctttgggcaccggccatcctgttttggcagttcatcgtcggcgttagaaccgtagaggacggtgaatgctacattcagttcttcagcaatgcagctgtaaccttcggcactgctattgccgccttttatctgccagtgatcattatgactgtgctgtattggcacatcagtcgggcaagcaaatccaggatcaagaaagataagaaggaaccggtggccaaccaggaccccgtcagccctagtctagtgcaaggcagaatcgttaagccaaataacaataatatgcccagttctgatgacggcctggagcacaataaaatacagaacggaaaagcaccaagagatcctgtgaccgagaattgtgtccagggcgaagagaaggagtcatccaacgatagcacttctgtgagcgctgttgcatccaatatgagagacgatgagattactcaggacgaaaatactgtctctaccagcctcggacattccaaagatgaaaattcaaagcagacgtgtatcagaattggcactaagacacccaagtcggacagttgcacccctactaatactacagtcgaggtagtgggctcctccggccaaaacggcgatgaaaagcaaaatattgtcgcccggaagatagtgaagatgactaaacagcccgcaaaaaagaagccccctccatctcgggagaagaaggttacacgaaccatactcgccatcctcttagcctttatcattacttgggctccatacaacgtaatggtgctgatcaacacattctgcgcgccatgcatccctaataccgtgtggaccataggatactggctatgctacatcaacagtaccatcaatcctgcctgttatgcgctgtgcaacgccactttcaaaaagactttcaagcacctgttgatgtgtcattataagaatattggcgcgactcggtag

SEQ ID NO: 182809 - DNA, 1773 bp, Artificial Sequence
  Description of Artificial Sequence: Synthetic coding sequence
atgaccctgcacaacaacagcaccaccagccccctgttccccaacataagctcatcctggatccactctccctcagatgccggcctcccaccagggactgtaacgcacttcggtagctacaacgtgtcaagggcagccggaaacttttctagtccggacgggacgacagatgatccactgggaggacacactgtgtggcaagtggtgtttatcgcattcttgacaggcatcctggcccttgtcacaattattggaaacatcttagttatcgtcagcttcaaagtgaacaaacagctgaagacagtgaataattactttctgttaagcctcgcttgtgccgatctcatcatcggagtgatttccatgaacctctttaccacctacatcattatgaaccgatgggctctgggtaaccttgcgtgcgacctctggcttgctatagattatgtggcctcgaacgccagcgtgatgaatctccttgtcatcagtttcgatagatactttagcatcactcgacccctaacttaccgggcgaagagaacaacaaagcgggctggggttatgatcggcctcgcttgggtaatcagcttcgttctgtgggcaccagccattttattctggcagtacttcgttggaaaacgcaccgtgccgcccggggagtgttttatccagttcttaagcgaaccaactatcacattcggtaccgcaattgcagcattctacatgcctgtaactatcatgaccattctctactggaggatttacaaggagacagagaagagaaccaaggaactcgcgggtctgcaggcctcagggactgaagctgagacagagaacttcgtgcaccccactggcagcagccgtagctgttcctcctatgagctgcagcagcagtccatgaagcggtccaatagacgcaaatatggacggtgccacttctggttcacgaccaaatcttggaagccatcttcagagcagatggaccaggaccattcttcttcagatagctggaacaacaatgacgctgctgccagcctcgagaattccgctagctctgacgaagaggatattggctcagagactcgcgccatctattctatcgtgctgaagctgcccggacactctactattttaaactcaaccaagctccctagcagtgataatctccaagtgccagaggaagaactaggaatggtggaccttgagcgcaaagccgataaattacaggcccagaagagcgtggacgacggaggcagcttccctaaatccttcagcaaactgcctatccagttggagtccgcggtggacactgccaaaaccagcgatgtgaacagcagcgtgggaaagtccacagccacccttcccctgtctttcaaggaggccacactagcaaagaggtttgcactgaaaacccgttcacaaatcacaaaacggaaacgaatgtctctggtgaaggaaaaaaaagccgcccagaccctttccgctatcctcttggcgttcattattacttggaccccttataacatcatggtgctcgtcaataccttttgcgatagctgtatacctaagacgttttggaacctggggtattggttatgttatatcaacagcactgtgaatcccgtgtgctatgcgctgtgtaacaagacatttagaaccacatttaaaatgttacttctctgccagtgtgacaagaagaagagaagaaagcaacagtatcagcagaggcaatcagtaatttttcacaagcgggcgcccgaacaggcactgtag

SEQ ID NO: 182810 - DNA, 333 bp, Artificial Sequence
  Description of Artificial Sequence: Synthetic coding sequence
atgaccctgcacaacaacagcaccaccagccccctgttccccaacatttcctcgtcttggatccacagtccatccgacgccggcctcccccctggcactgtgactcacttcgggtcttataatgttagccgagccgcaggaaacttttcttctcctgacggcacaactgacgacccccttggtggccacacggtctggcaggtcgtcttcatcgcatttctgacagggattctggctctggtgacaatcattggcaatatattagtgatcgttagctttaaggtcaataagcaactcaagaccgtgaacaattactttttgcttagcttgtag

SEQ ID NO: 182811 - DNA, 1440 bp, Artificial Sequence
  Description of Artificial Sequence: Synthetic coding sequence
atggccaacttcacccccgtgaacggcagcagcggcaaccagagcgtccgcctggttacttcatcctcccacaacagatacgaaaccgtcgagatggtctttatcgcaactgtgaccgggtcactgtccttagtcactgtagtgggcaacatcctggtgatgctgagcataaaggtcaatcgccagttgcagactgtgaacaattacttcctgttttcactggcatgcgctgacttaatcatcggcgcattttcaatgaacctttatacagtatatatcataaaaggctattggcctctgggagctgtcgtgtgtgacctgtggctggctcttgactatgtggtctctaacgcaagcgttatgaacctcctgattattagcttcgacaggtacttctgcgtgacaaaaccgctgacctaccctgcgaggcggacaaccaaaatggccggactcatgatcgcagccgcctgggtgctcagcttcgttctctgggctccagcgatactgttctggcagtttgtagttgggaaacgaacagtgcctgataaccaatgttttatccaatttctgagtaaccctgctgtcacttttggcactgctatcgccgcgttttatctgccagtcgtgatcatgacagtcctgtatatccacatatccctggcctcccgcagccgcgtgcacaaacatcgacccgaaggacccaaggaaaaaaaagccaaaaccctggcatttctgaagtcgccactgatgaagcaatccgtgaagaaaccaccccccggcgaagcagcccgagaggaactgaggaatggcaaacttgaggaggcccctccccctgcccttccacctcccccaagaccagtggcggacaaggacacctccaatgagtctagtagcggctcggcaacacaaaacacaaaggagaggcccgcaacagagttatccacaacggaagccacaacccccgccatgcctgcgccgcctctccagcctagagcgctgaatcctgcctctaggtggtccaagatccaaatcgtgactaagcagacagggaatgaatgcgtcactgccattgagattgtgcccgcgacacccgctggcatgagacctgccgctaatgtggcccggaagtttgcaagtatcgccagaaaccaggttcgaaaaaagcgtcagatggccgccagggaacgtaaagtgacccgcacaatatttgccattttactggcctttattctgacctggaccccttataacgtgatggtgctggtcaacacattctgccagagttgtattcccgatacagtttggagcatcggctactggctctgttacgtgaattctacaatcaatccagcatgctatgcactctgtaatgcgacctttaagaaaacattccgccatttgctcttgtgccagtataggaatattggcacagcacggtag

SEQ ID NO: 182812 - DNA, 1599 bp, Artificial Sequence
  Description of Artificial Sequence: Synthetic coding sequence
atggagggcgacagctaccacaacgccaccaccgtgaacggcacccctgtgaatcaccagcccctcgagcgccataggctgtgggaggtcatcaccatagcggccgttaccgctgtcgttagtcttattaccatcgtggggaacgtcttagtgatgatatctttcaaggttaactctcaactgaagactgttaataattattatctcctaagtttagcatgcgctgacctcatcattggaatcttttccatgaacttatataccacctatatccttatgggccggtgggctctcggctctctggcctgcgatctctggttagcgttggactatgtagcttcaaatgcgtccgtgatgaacctcctagtgattagtttcgaccggtatttctctatcacccgaccactgacataccgcgccaaaaggactcccaaaagggctgggatcatgataggacttgcctggctgatctcatttatactgtgggctccggccattctgtgttggcagtacttagtgggcaagaggaccgttcccctagatgaatgccagatacagtttctgtcagaacccacaattacttttggaaccgccatcgccgcgttctacatccctgtgtccgtcatgaccatactttattgcagaatctaccgggaaaccgaaaagagaactaaggacctcgcagacctccaggggtccgattcggtcaccaaagcagagaagagaaagcctgcacatcgagctctttttaggagctgtctccgctgtcctcgacccaccctggctcagcgagagcgcaaccaggcgagctggtctagctcccgaagaagcacttcaacaacaggaaagccttcacaggccactggcccgtccgcgaattgggccaaagccgagcaattaactacttgttctagctacccatccagcgaggacgaagataaacccgctaccgatcccgtgttgcaagttgtttataaaagtcaggggaaagaaagtccaggagaagaattctctgctgaagagacagaagagactttcgttaaggctgaaactgagaagtctgattacgacactccaaactacctgctctcacccgccgcagctcacaggcccaagagtcagaagtgcgtcgcgtacaagttccgacttgtggtgaaagccgatgggaaccaggaaaccaacaacggatgccacaaggttaagatcatgccttgcccatttcccgttgctaaggagccttctacaaagggactcaaccccaaccctagtcaccagatgacgaagcgtaagcgcgtggtccttgtgaaggagcggaaagcagcccaaactttaagcgcaattcttcttgcattcattattacctggaccccctacaacataatggtgttggtgtcaacattctgcgataagtgtgtgcccgtgaccctgtggcatttgggctattggctgtgctacgtaaattcgacagtgaaccccatctgctatgccctttgtaatcgcaccttccggaagactttcaagatgctgctgctttgtcggtggaagaagaagaaggtcgaggagaagttgtattggcaaggcaattcaaagctcccctag

SEQ ID NO: 182813 - DNA, 1599 bp, Artificial Sequence
  Description of Artificial Sequence: Synthetic coding sequence
atggagggcgacagctaccacaacgccaccaccgtgaacggcaccccagtgaaccatcagccactcgaaagacaccggctctgggaagttatcacaattgctgctgtgacggccgtagtctctttaattacaatagtcggaaatgtgcttgtcatgatcagctttaaggtgaacagccagctgaagactgttaacaactactacctgctcagcctcgcgtgtgcagacctgataatcggtatcttcagtatgaacctatacactacctatatcctgatgggcagatgggcactaggttcactcgcctgcgacctatggctggcacttgattacgtcgcatctaacgcgagcgtcatgaatctgctggtcatttcatttgataggtatttcagtatcacccgaccactgacctaccgggctaaacggacccccaagcgagccggtatcatgattggtctggcctggctgatcagcttcattttgtgggcgcctgcaatcctgtgctggcagtatttggtgggcaagcgtactgtgccgttggatgaatgccaaatccagttcttgtctgagcccactatcacatttggcacggccatagctgctttctacattcctgtgtcagttatgaccatcctgtactgcaggatttatcgcgaaaccgagaagcgtaccaaagatctggcagatctgcaaggttctgactcagtaaccaaggccgagaagagaaagccagctcatagggccctgttccggtcctgtctgcggtgtccacggcccaccctggcccagcgcgagaggaatcaagcatcctggagctcctcgcgacgttctacgtctaccaccggcaagccttcccaggcgacggggccctctgccaactgggccaaggccgagcagctcaccacttgctcatcttacccttcttcagaagatgaggacaaaccggcaacggacccggttcttcaggtcgtctacaaatctcaggggaaagaaagtcctggtgaggaattcagcgccgaagagaccgaggaaacattcgtaaaagcagaaacggaaaagagcgattatgacacccccaattatttgctttcccccgccgccgcccacagacctaagtcccagaagtgcgtcgcctacaaattccgtctcgtggtgaaggccgacgggaaccaggaaaccaacaacggttgccacaaggtaaagatcatgccgtgtccctttcccgtcgcgaaagagccaagtactaagggtctgaacccaaaccccagccatcagatgactaaacggaagagggtggtactagtgaaggaaaggaaggccgcccaaactctctctgccattctgctggctttcattatcacatggaccccatacaacattatggtcctggtgagcacattttgtgataaatgcgtgcccgtcaccctgtggcacctcggctattggttgtgttatgtcaacagcactgtgaaccctatctgctatgcactatgcaaccggaccttcagaaagacatttaaaatgcttctgctttgtagatggaaaaagaagaaggtggaggaaaagctgtattggcagggaaacagcaagctcccatag

SEQ ID NO: 182814 - DNA, 69 bp, Artificial Sequence
  Description of Artificial Sequence: Synthetic coding sequence
atggagggcgacagctaccacaacgccaccaccgtgaacggcacccccgtaaatcaccaacctctgtag

SEQ ID NO: 182815 - DNA, 1449 bp, Artificial Sequence
  Description of Artificial Sequence: Synthetic coding sequence
atggagccctggcccctgctgctgctgttcagcctgtgcagcgccgggttggtccttggctcggaacacgagacccggttagttgctaaacttttcaaagactactctagcgttgtgcgcccagttgaagaccaccgccaggtggtcgaggtgacagttggtctgcagcttattcagttaatcaatgtggatgaggttaatcagatcgtgaccaccaatgttcgattaaagcagggggacatggtcgacctgccccggccctcctgtgtaacccttggagtcccgctctttagccatctgcagaacgaacagtgggttgattataacctgaaatggaaccctgacgactacgggggtgtgaagaaaatccacattccttctgaaaagatttggaggccagacctggtactctataacaatgccgatggtgacttcgcaattgtcaagtttacgaaggtgttactgcagtatacaggccatattacgtggactccacccgccattttcaaatcttattgtgagatcatcgttacgcacttcccatttgacgaacagaactgcagcatgaaacttgggacatggacttatgatggctccgtcgtcgcgattaaccccgagtctgaccaaccggatttgagtaattttatggaaagtggggagtgggtgataaaagaatccaggggctggaaacactcagtgacatactcttgctgtccagataccccgtacctggatatcacctatcattttgttatgcaaaggctgcctctgtactttatcgtaaacgttatcatcccctgtctgcttttttcgtttctgactggtctggtgttctatctgccgacggactcaggagaaaaaatgacactcagcatttccgtcctcctgtctttgacagtcttcctgctcgttattgtcgaactcattccgtccacctcttcggctgtcccactgatcggtaagtatatgcttttcacgatggtttttgtgatcgcttcaatcataatcacggtcatcgtgatcaatactcatcatagaagtccatctacccatgtgatgcccaattgggtgcgcaaggtttttatcgacactatacctaacattatgtttttcagcacaatgaagcgaccaagccgagaaaagcaggacaagaaaattttcacagaggatatcgacatctccgatatttcaggtaagcctggcccacctcctatgggtttccattcgccgttgatcaagcaccccgaagttaagtccgctatagaggggattaaatatattgcggagactatgaagagtgaccaggagagcaacaatgccgcggctgagtggaaatacgtggccatggtgatggaccacatcctgctgggggtctttatgctggtttgcatcattgggaccctagccgtctttgccgggagacttatagagctcaatcagcagggctag

SEQ ID NO: 182816 - DNA, 1374 bp, Artificial Sequence
  Description of Artificial Sequence: Synthetic coding sequence
atggagccctggcccctgctgctgctgttcagcctgtgcagcgccggcctcgttctagggagtgagcatgaaacacggctggtggccaagctgttcaaggactacagtagcgtggttcgacccgtggaggatcaccgacaagttgttgaggttaccgtagggcttcagctgatccagctgatcaacgtcgatgaagttaatcaaatcgtcactaccaacgtccgtcttaaacagcagtgggtggactataatctgaaatggaatcctgacgactatggtggggtgaagaagatacacattccatccgaaaaaatttggaggcccgacctggtgctgtataacaacgccgacggcgactttgcaatcgttaaattcacaaaggtccttctccagtacaccggacacatcacatggacccccccagctatctttaaatcctattgtgagatcatagtgacccactttccatttgacgagcagaattgctcaatgaagctcggaacttggacttacgacggtagcgtggtcgccattaatccagaatccgatcagcctgacctgagcaactttatggagtcaggcgagtgggttattaaagaaagccgggggtggaaacattctgtgacatattcatgctgtccagacaccccgtatctcgatatcacttatcactttgtaatgcagcgcctgcctctctatttcatagtgaacgtcattatcccatgtttgctttttagcttcctgactggtctggtcttctacctgcctactgattcaggtgaaaagatgaccctttcgatatccgtcttgcttagcttgaccgtattcctactggtgattgttgaactcattccatccactagcagcgcagtgcccctgatcggcaagtacatgttgtttacgatggtttttgtgatcgcctccatcatcatcacggttattgtgatcaatacacatcatcgcagcccgtcaactcacgtcatgcccaattgggtccgtaaggtatttatcgacaccattccgaatatcatgttcttcagcacgatgaaaagaccttcccgagaaaaacaggataagaagattttcaccgaagacatcgacatcagcgacatttcaggaaaaccaggacctccccccatgggttttcatagtcccctaattaaacaccccgaggtgaaaagtgccatagagggtatcaagtatatagctgagaccatgaaaagcgatcaggagtcaaataacgcagccgccgagtggaaatacgtggcaatggtcatggatcacattcttctgggcgtgtttatgctggtgtgtataatagggacattggccgtttttgcaggacggttgattgagctcaaccagcagggatag

SEQ ID NO: 182817 - DNA, 1353 bp, Artificial Sequence
  Description of Artificial Sequence: Synthetic coding sequence
atgggcctgcggagccaccacctgagcctgggcctgctgctgctgttcctcttgccagctgaatgtctgggagccgaagggcggctcgctctcaagctgtttagggacctctttgctaactacaccagtgccctcaggccagtagccgacacagaccagacactgaacgtgacactggaggtcaccttgagtcagattatcgatatggatgaacgcaaccaagtgctgaccctttacctttggatccgacaggagtggaccgacgcatatttgcggtgggaccctaatgcctacggcggtctcgacgctatccgaattccgagctcactagtatggcgaccggatatcgtgctgtataataaagcagacgcccagcccccagggtcagcttctactaatgtggtcctaagacatgatggtgcggtccgatgggatgccccggcgataacccgttctagttgtcgagtggacgttgctgccttcccattcgacgcccaacattgcggtctgactttcggatcctggacccacggtgggcaccaactcgatgtgaggcctagaggggccgccgcgtccttggccgattttgtcgaaaatgtagagtggagggtgctggggatgcctgccaggcgaagggtgctcacatatggctgttgctccgagccctacccagatgttacatttaccttgctcttgaggcgtagggctgccgcctacgtgtgtaacctgctattgccttgcgtcctgattagtctccttgctcccttggcgttccatctaccagctgactcaggcgagaaagtatccctaggtgttaccgtccttctcgcgctgacggtattccaactgctgcttgcagagagcatgccaccggcggaaagcgtccccctcatcggtaagtattacatggccacaatgactatggttacattcagcacagccctgacaattctgatcatgaacctgcactactgcgggccttcagtccgcccagtgcctgcctgggccagggccttgctgcttggccacctagcccgcggattgtgcgttcgggagcggggtgagccatgcggccagagccggcccccagagctgagtccatctccgcagtcccccgagggcggggctggtcctcccgctgggccctgccacgaaccacgatgcctttgtaggcaagaggccctactgcaccacgtggcaaccatcgctaacacattcagatctcaccgagcagctcagcgctgccacgaggactggaaacgattggctagagtgatggaccgattcttcctggccatattcttcagcatggcgcttgtcatgtctcttctcgtcttggttcaggcactgtag

SEQ ID NO: 182818 - DNA, 1590 bp, Artificial Sequence
  Description of Artificial Sequence: Synthetic coding sequence
atgggccccagctgccccgtgttcctgagcttcaccaagctgagcctgtggtggctgctgctgacaccggctggcggagaagaggcgaagaggcctcctcctcgtgccccgggcgatcctctctcctctccatcacctaccgctctgccacaggggggtagccatacagaaaccgaggataggttgttcaagcacctctttcgcggctacaatagatgggctcggcccgtgccaaatacttccgatgttgtgatcgtaaggtttggactgtcgatagcacagcttattgacgttgacgaaaagaatcaaatgatgaccactaacgtgtggttaaagcaggagtggtccgactacaaattgcgctggaacccaactgattttggaaacatcacaagccttcgggtaccaagcgagatgatatggatcccggacattgtcctctataacaatgccgacggggaatttgccgtgacccatatgactaaggcccacttattcagcaccggtaccgtgcactgggtccctcccgctatttataagtcgtcttgcagcatcgacgtcactttttttccattcgaccaacagaactgcaagatgaaatttggatcctggacatatgacaaggcaaaaatcgaccttgagcagatggaacagactgtggatctcaaagactattgggagtcaggggaatgggcaattgtgaatgcaacaggaacctacaactcaaaaaaatatgattgttgcgctgagatctaccccgacgttacatacgccttcgtgatcagacgcttgcctttgttctacactatcaacctgatcataccatgcctgttgatttcgtgtctgacagtcctggtcttttatctgccgtccgattgcggcgagaaaattacactgtgcataagcgtacttctttcactgacagtcttcctcctcctaatcactgaaatcattcccagcactagtctggtgattcctctgattggcgagtaccttctttttacaatgatttttgtcacgctatcgatcgtgattacggtgtttgtgctgaatgtccaccaccggtctccatccacacacacaatgccccactgggtccggggagctctgctgggatgtgtcccaaggtggctgttaatgaatagacctcctcctccagtggaactgtgccatccgctcaggctcaaattgagtcctagttatcactggctggagtcaaatgtagatgcagaagagagagaggtggttgtggaagaggaagaccggtgggcctgtgcggggcatgtcgccccgtctgtgggcacactctgttcacatggacacctccactctggagcctctgggcctaaggcagaggcattgctgcaggagggtgaactacttcttagcccccatatgcagaaagcgttggagggtgttcattacattgcagatcatcttcggtccgaggatgcggactcctcagtgaaggaggactggaaatacgtggccatggtgatcgatcggatctttttgtggctatttatcattgtgtgctttcttggtactatcggtctgttcctgccgccatttcttgctggcatgatttag

SEQ ID NO: 182819 - DNA, 1590 bp, Artificial Sequence
  Description of Artificial Sequence: Synthetic coding sequence
atgggccccagctgccccgtgttcctgagcttcaccaagctgagcctgtggtggctgctgctgacacctgccggcggcgaggaagctaaaagaccacctccccgagctccgggcgacccgctttcatcccccagccctacagctctcccacaaggcggaagccacactgaaaccgaggataggttatttaaacatctgtttcgcggctacaatcgatgggcccgaccagtgcccaacactagtgacgtggtgatcgttcgcttcgggctgagcatcgcccagctgattgacgtggacgagaagaatcaaatgatgacaacaaacgtatggttaaagcaagaatggtccgactataagctcaggtggaacccaaccgacttcggaaacataaccagccttcgggtcccaagcgaaatgatttggattccagatatcgtgctttataacaacgcagatggcgagttcgccgtgacacacatgaccaaggctcaccttttttccaccgggactgtacattgggtccccccagcaatctacaaatcaagttgtagtatcgacgtgacattcttcccttttgaccagcagaattgtaagatgaagttcggaagctggacctacgataaggccaaaattgacctggagcagatggagcagacagtggatctcaaagactattgggagtccggcgaatgggctattgtcaacgccacagggacgtataactccaagaagtacgattgttgtgccgagatctaccctgacgtgacttacgcctttgtgattaggcgcctgccactgttctatacgatcaacctaattattccctgtctgctgataagctgcctgaccgtgttagtgttttacttacctagcgactgcggagagaagatcactctttgtatttccgtgttactaagtttgacagtctttctgctactgataacggaaatcatcccctctacgagcctcgtgatccctctgatcggagaatatctcctgttcacaatgatctttgtgacattatcgatagtgatcacggtgttcgttttgaacgttcaccatcgtagcccatccactcacactatgccacattgggtgcggggcgcactgctgggctgtgtgccgagatggctcttgatgaaccgaccccccccccctgtcgagctctgtcatccattgcgcttaaaactatcaccatcttatcattggctcgagagcaacgtcgatgccgaggagcgcgaggttgttgtcgaagaagaagacaggtgggcttgcgccggacacgtggcgcccagtgtggggactctgtgtagccacggacacctgcactcaggcgcgtcaggcccaaaagcagaagctctgctgcaggaaggtgagctcctccttagcccgcatatgcagaaggcgttagagggcgtgcattacatcgctgaccacctcagaagtgaagacgccgattcttccgtcaaagaggactggaagtacgtggccatggtcatcgacaggatctttctgtggctgtttattatagtttgcttccttgggacaatcgggctgtttctccccccttttttggctggcatgatttag

SEQ ID NO: 182820 - DNA, 1518 bp, Artificial Sequence
  Description of Artificial Sequence: Synthetic coding sequence
atgggcagcggccccctgagcctgcccctggccctgagcccccccaggctgctactcctgcttttgctcagcttgctgcccgtagcgagggcatctgaggctgagcaccgcctctttgaacggctgtttgaggactacaatgagatcattcggcctgtcgccaatgtgtccgaccccgtgataatacacttcgaggtcagcatgtcccagctagtcaaggtggacgaggtcaaccagataatggaaactaatctgtggctgaagcaaatctggaatgattataagctgaaatggaacccgtctgactacggcggggccgagtttatgagggtgccggcgcagaagatatggaaaccggacatagtcctgtataacaacgccgttggagacttccaggtggatgacaaaaccaaggccctgcttaaatatacaggcgaggtgacttggatccctcctgcgattttcaagagtagctgtaagatcgatgtgacgtatttcccattcgattaccagaattgcacgatgaagtttgggtcttggtcttacgataaggccaagatcgatttagtcttaatcggctcatccatgaacttgaaggattattgggagtccggcgagtgggccattatcaaggctcctggatataagcacgatatcaaatacaactgttgcgaggagatctaccccgacataacttatagtctgtatattcggcggctgcccctattctatacaattaacctgattatcccatgcttgctgatctcgttccttaccgtactggttttttatttaccctctgactgtggcgagaaagtgaccttgtgtatcagcgtgcttctgtccttgacagtttttctgctggtgattaccgaaacaattcccagtacttccctcgtaatccccctgatcggcgagtatctcctgttcactatgatttttgtgaccttatcaatagtgatcaccgtattcgttttgaacgtccattatcgcacacctactacccacaccatgccatcctgggtgaaaacagtgttcctaaatctactgccaagagttatgttcatgacacgtcctacatcaaatgagggcaacgctcaaaagccacggcccctctatggtgctgagctctccaacctgaactgttttagccgagctgagagcaagggctgtaaagaggggtatccatgtcaggacggtatgtgtggttactgccaccacaggcgtattaagattagcaatttttccgccaatctgacgcggagtagctcttcggagtccgtggacgccgtgttgtcactttcagccctttcaccagaaattaaagaggccatccagagtgtgaagtatatcgccgaaaatatgaaggcccagaatgaagccaaagagattcaggacgactggaagtacgtggccatggtcatcgatagaatattcctgtgggtgtttactttggtttgcatcttgggcaccgcaggactatttctgcagccacttatggctcgggaggacgcttag

SEQ ID NO: 182821 - DNA, 939 bp, Artificial Sequence
  Description of Artificial Sequence: Synthetic coding sequence
accaaggccctgctgaagtacaccggcgaggtgacctggatcccccctgctatatttaagtccagctgcaaaattgacgtaacatatttccctttcgattaccagaactgtactatgaagtttggctcctggtcatatgacaaggcgaagatagatcttgtgttaatcggcagctctatgaaccttaaggattactgggagtcgggggaatgggccatcattaaagcacctgggtacaagcatgacatcaagtataactgctgcgaggagatttacccagatatcacttattctctgtacatccgccggctaccattattctatactataaaccttataataccatgcctgctgatctctttcctcactgtgctggtgttctatctcccatctgattgcggtgaaaaagtgacgctgtgcatctctgttttactcagtttgaccgtgtttctgttagtgatcactgaaacaatcccttcaacaagcctggtgattcccttaattggggagtatctcctgttcactatgatctttgtgacactgtctatagttatcaccgtgtttgtgttgaacgttcactaccgcacacccaccacccatacgatgcccagctgggtgaagacagtcttcctgaatctattgcccagagtgatgttcatgaccagacccactagtaacgagggtaacgcccaaaagccgcgtcctttgtacggcgcgtctccgaaagccgcgagaagggagattaaggaggccatacagagcgtcaaatacatagcagagaatatgaaggcccagaacgaggcgaaagagatccaggacgactggaaatacgttgctatggttattgaccgcatattcctatgggtcttcaccctcgtatgtatccttggcaccgccggattgtttttgcaacccctcatggcccgagaagacgcatag

SEQ ID NO: 182822 - DNA, 1470 bp, Artificial Sequence
  Description of Artificial Sequence: Synthetic coding sequence
atgggcagcggccccctgagcctgcccctggccctgagccccccccgtcttctgctgctgttgctgctctccctgctgccagtagcccgtgcaagtgaggccgagcatcggcttttcgagagattattcgaggattacaatgagataatccgcccggtggcaaatgtctctgatcccgtaatcatccactttgaggtctccatgagccaactagtgaaggtggatgaagttaatcagatcatggagaccaacctctggctgaagcagatttggaacgattataagttgaagtggaatccctccgactacgggggcgcggaatttatgcgcgttcctgctcagaagatttggaagcccgatattgtgctgtacaataacgctgtcggtgacttccaggtcgatgacaagactaaggctcttctcaaatacacgggggaagtgacctggataccaccggctatcttcaaatcttcgtgtaaaattgacgtgacatatttcccgttcgattaccagaattgtactatgaaattcggctcttggtcctacgataaggctaagattgatctcgtcctcatcgggagctccatgaatctgaaggattactgggagagtggtgagtgggcgatcatcaaggcccctggctataagcatgacattaagtacaattgttgcgaagagatttaccctgacatcacttacagcctttatatcaggcggttaccactgttctatacgatcaatttgatcattccctgtctactgatttcattcctcaccgtgctagtattctacctgcccagcgactgtggggaaaaagtcaccctgtgcattagcgtgcttcttagtttgaccgtatttctgcttgtgatcaccgagactatcccctccacttccttagtcatcccactgatcggcgaatacctgctgttcaccatgatcttcgtcaccctgtccattgtcatcaccgtattcgttctcaacgttcattacaggaccccaacaactcacaccatgccgtcctgggtcaaaactgtatttctcaatcttctcccccgcgtgatgttcatgactaggcccaccagtaatgaaggcaatgctcaaaagcctcgccctctgtatggggcggagctgtccaatctcaattgtttctcccgagctgagtctaaggggtgtaaagaggggtatccttgtcaggatggtatgtgcgggtactgtcaccacagacgaatcaagatcagcaatttttctgccaacctgaccaggtcctcttcttccgagagtgttgatgcagtcctgagcctgtctgcgctgtctccagagattaaagaggcaatacagtctgtgaagtatattgccgagaatatgaaggcgcaaaacgaggccaaggaagaacagaaggctcaagagattcaacaactgaaacggaaagagaaaagcaccgagacaagtgaccaggagccgggcctgtag

SEQ ID NO: 182823 - DNA, 1518 bp, Artificial Sequence
  Description of Artificial Sequence: Synthetic coding sequence
atgggcagcggccccctgagcctgcccctggccctgagcccccccagactgctcttactcctgctcctttccctcctccccgtcgctcgggcttccgaagccgagcatcggttgtttgagagactgttcgaggactataacgaaatcattaggcccgtcgctaacgtatccgatcctgtgattatccattttgaggtcagtatgtcccagttggttaaggtcgatgaggtgaaccaaatcatggaaacaaacctatggctaaaacagatctggaatgactacaaactcaagtggaacccatctgattacggtggagctgagtttatgagggtgcccgctcagaaaatttggaaacctgacatagtgctgtataataacgccgtgggcgatttccaagtcgacgacaaaaccaaggctttacttaaatacactggggaggtcacctggattcccccagcaatttttaagtcatcttgtaagatcgatgttacatactttccctttgattatcaaaattgtacgatgaagttcgggtcatggtcctacgacaaagcaaagattgacttggttctcataggcagcagtatgaacctgaaagattactgggaatcaggggagtgggctattatcaaagctcctgggtacaagcacgacattaagtacaactgttgcgaggaaatctatcccgacatcacctattcactgtatatccggagactgccgctgttctacacaatcaatctgatcataccatgcttgttaatttcttttcttactgtgttggtcttctacctgccttcggattgtggcgaaaaagtgaccctgtgtatctccgtcctgttgagtctcacggtgtttctcctggttattactgaaactattccttccacgtcactggtcattcctttaataggtgagtatcttctttttaccatgatctttgtgacacttagtattgtgatcacggtattcgtgttgaatgtccattatcgcactccaactactcacactatgccaagctgggtcaaaacggtgtttctgaacctgctgcctcgggttatgtttatgactaggcctacctctaacgaggggaacgcacaaaaacccagacccttgtacggcgccgagctctccaatctcaactgtttcagtagagccgagagcaagggttgtaaagaaggatatccctgccaggacggaatgtgcgggtattgtcaccaccgccgaatcaaaatcagcaatttttctgctaatctgacccggtcttcatcgtcagagtccgttgatgccgtactgtctctgtccgcgcttagcccggaaattaaagaggccatccagtccgtcaaatacatcgcagagaatatgaaggcccagaatgaagctaaagaaatacaggatgactggaagtacgtagcgatggtaattgacaggatttttctatgggtgttcactctggtgtgcatcctgggaactgccggcttgtttctgcaaccgctcatggccagagaggacgcctag

SEQ ID NO: 182824 - DNA, 1602 bp, Artificial Sequence
  Description of Artificial Sequence: Synthetic coding sequence
gcccccgagcccggcgaggccccccggctggaccgggcccaccccgggtgtgcctgtgcggagctctccctgctgtggctgtgttgctgcacatttacctcagccgatggcgacttcgcagtgacccacttgactaaggcccacctgttccatgacgggagagtccagtggactccccctgctatctacaagtcctcatgcagcatagatgtgacgtttttccccttcgaccagcagaattgtaccatgaagtttggatcctggacttacgataaggctaagattgacttggtcaatatgcacagtcgggttgatcagctcgatttttgggaaagcggagagtgggtgattgtggatgcagttggcacttataacacacggaaatatgagtgttgcgccgagatctatccagacatcacttatgcctttgtgatccgacggctgccacttttctacacaatcaacctgatcattccgtgtttgctcatttcctgccttacagtgctcgtgttctatcttccgtccgagtgcggcgagaagatcacgttgtgcatttctgtgttgctcagtctgaccgtattcctgctgttgattactgagatcatcccaagtacttctcttgtgatccctctgatcggcgagtaccttctgtttaccatgatcttcgtcaccctttctatagttataaccgtcttcgtcctcaacgtccaccacaggtcaccacggactcacaccatgccgacttgggtgagaagggtttttctggacatcgtgccgcgcttgttactaatgaagcgcccctctgtggtaaaagacaactgtagacggttaatcgagtccatgcacaaaatggccagcgcccctcggttttggcctgaacccgagggagagccacccgccacttccggaactcagtctcttcatcccccttctcccagtttctgtgtaccattggatgtacccgcggagcctggcccctcatgtaaatccccttctgatcagctcccaccccagcagcctctggaggctgagaaggcctcccctcacccatcacctggcccttgtagaccccctcacggcactcaggcacccggcctggctaaggcaaggtccctgagtgtgcagcacatgtcctcaccgggagaagcggtagagggtggcgtgcgctgccggtcccgatccatccagtactgtgtgcctcgcgatgatgccgcccccgaagctgatggacaggccgcaggtgcgctagcaagcaggaatacccattcagccgagttacctccccctgaccagcccagtccatgtaaatgcacttgcaaaaaggagcccagctctgtgtcaccctccgctaccgtgaagacaaggtctacgaaagcccctccccctcacctccccctgagccctgcactgacacgcgccgtggagggggtgcaatacattgccgaccaccttaaggccgaggacactgacttctctgtcaaggaggattggaaatacgtcgccatggtcatcgacagaatatttctatggatgtttattatcgtttgtctgttagggactgtcggcctcttcttgcccccgtggctcgcaggtatgatctag

SEQ ID NO: 182825 - DNA, 1884 bp, Artificial Sequence
  Description of Artificial Sequence: Synthetic coding sequence
atggagctgggcggccccggcgccccccggctgctgccccccctgctgctgctcctggggacagggcttctgcgcgcctcaagccatgttgagacacgcgcccatgctgaggaaaggctgctgaaaaagctgttttcaggttacaataagtggtccaggcccgtggcaaacataagcgacgtcgtactggtgcggttcggactgagcatagcacagctgattgacgtcgacgagaaaaaccaaatgatgaccactaacgtatgggtgaagcaggagtggcatgattataagctgaggtgggatccagctgattacgaaaacgtcacatccatccgcatcccatcggagctcatttggagaccagacatcgtgttgtacaacaacgctgatggggattttgccgtgacccatctgactaaggcacacctgttccatgatggacgggtgcagtggactccaccggccatctataaatcctcctgcagcatcgatgtgacatttttcccatttgatcaacagaattgtacaatgaaatttgggagctggacttatgacaaggcaaagatcgacctcgtgaacatgcacagccgggtggatcagctggacttttgggagtccggcgagtgggtgatagtcgatgccgtaggtacatacaatacccggaaatatgaatgctgcgctgaaatctaccctgacataacctacgccttcgtcattagaagactgcccctgttttacaccattaatttaatcataccctgcttactcatttcctgtctgacagtcctcgtcttctatctgcctagcgagtgcggtgagaagatcactctgtgtatttcagtcctcctctcactgaccgtcttcttactgctgattacggagattatcccgtccacttcactagttatcccacttatcggcgaatacctgctgtttaccatgatatttgttacactgagcatcgtgataacagtgtttgttctgaatgtccaccatagatctcccagaacccacacaatgcccacttgggtacggcgtgtgttcctggacatcgtgccccggcttctgctcatgaaacgcccaagcgttgtcaaagataattgtcgcaggctcatcgaatcaatgcacaagatggccagcgccccccgcttctggccggagcccgagggagaacccccggccacatccggcacccaatccctgcaccctccctccccctccttctgtgtgcctctagatgtgccggccgaacccgggcccagttgcaagtcccccagcgaccagctgccgccacagcagcctttggaagccgagaaggcatccccccatcctagcccaggaccatgcagaccccctcacggaacccaagcccctggactcgccaaagcacgctccctgtccgtgcaacacatgagttcgcctggagaagccgtggagggcggcgttcgttgcaggagccgctccatccagtactgtgtgcccagagacgacgcggcacccgaagccgatggacaggccgctggggctctggcatctcgcaatacacacagtgcagaactgccgcctcctgatcagccctctccttgtaaatgtacctgtaaaaaagagccctcatccgtctcgcctagcgccaccgttaagacgagatctaccaaggcacctcccccacacttacccttgtctcccgccttaacacgtgcggtggagggcgtccagtatatcgcggatcatttgaaagccgaggatacagacttcagcgtcaaggaagattggaaatacgtggccatggtcatcgatcgcattttcctgtggatgtttataatcgtatgccttttgggcactgtgggcctttttctcccaccctggctggccggaatgatctag

SEQ ID NO: 182826 - DNA, 1671 bp, Artificial Sequence
  Description of Artificial Sequence: Synthetic coding sequence
atgcggatgagcccccccagcgccagcccccccagcagcagcggcgggaggacatccagctccacaacaaccgccggcgaaccattttgggcaggagtcctattcgcaattcgacctcatccgggtctgtcaggtcggattgtttggacagccggctgccccggagagggtgccgatggggacttcgcagttacccatctcacaaaggcccatttatttcacgatggtcgggttcagtggactccacccgcgatctataagtcttcttgcagcatcgacgtgacattcttcccattcgaccaacaaaactgcacaatgaagttcggctcatggacctatgataaggctaaaattgacctggtaaatatgcatagtcgagttgatcaacttgacttctgggaatctggggagtgggtaattgtcgatgcggtcggaacatacaacacaagaaaatacgaatgttgcgccgagatttatcctgatatcacctatgcgtttgtaatcagacgtctgccgctcttttacaccattaacctgattatcccttgtctgctgatctcctgcctcactgtcttggtgttttatctgcctagcgaatgtggggagaaaattactctgtgcatttctgttctactcagtctgaccgtgtttctcctgctcattactgaaataattcccagcacctcgctggtcatacccctgatcggtgagtatctcctgttcaccatgatctttgtaaccctgtcaattgtgattaccgtgtttgttcttaacgtacaccatagaagtccacgcacccatacaatgcccacgtgggttagacgggtgttccttgatatagttccacgattactgctgatgaaaaggccatccgtggttaaagataactgtagaagactgatcgaatccatgcataagatggcctccgcacctcggttctggccagaacccgagggagaaccaccagctaccagtggcacgcagtccttgcacccaccatcccccagcttctgcgtgccactggacgtgcccgctgagccagggcccagttgtaaatccccttctgatcaactcccccctcagcaacctctggaggcagaaaaggcaagcccgcaccccagtccaggaccatgtcgtcctccgcatgggacacaagcgcctggattggccaaggcacggtcgctcagtgttcagcacatgtcttccccaggagaggcagtcgaaggcggggttagatgtcgtagcaggagcatccagtactgtgtgccgagagatgacgcggctcccgaagctgacggccaggcagctggagctctggcctctaggaacacacactccgccgagctccctccccccgaccagccgtccccctgcaaatgcacgtgcaagaaagaaccgtcctccgtcagcccaagcgccacagttaagacccggagcacaaaagcacccccgcctcacctacctctctcacccgctctgacccgggccgtggagggggtgcagtatatagcagaccatctgaaagcagaggacacagacttttccgtgaaagaagactggaagtatgttgctatggtaatcgaccgaatattcctgtggatgtttattatagtctgtctgctgggcaccgtgggactctttcttcctccatggttggctgggatgatctag

SEQ ID NO: 182827 - DNA, 1407 bp, Artificial Sequence
  Description of Artificial Sequence: Synthetic coding sequence
atggccgcccggggcagcggcccccgggccctgcggctgctgctgctggtccagctggtcgcaggtcgttgcgggctagcaggggccgccggcggtgcccagagggggctgtccgagccgagtagcatcgccaagcacgaggattcattgctcaaagatctttttcaggattatgagaggtgggtacggcctgtggaacatctcaacgacaagataaaaattaaatttggactcgccatctcccagctggttgacgtggacgaaaagaatcagcttatgactaccaacgtgtggctgaagcaggagtggatcgatgttaagttgcgctggaaccctgatgactatggcgggattaaggtgatacgcgtcccatcagatagtgtctggacacctgacatagtgctgttcgataacgccgatggacgctttgaagggacttccacaaagacagtcattcgttataatggtaccgtaacttggactcccccagctaactacaagtccagttgcacgatagacgtcacattcttcccgttcgacctgcagaactgtagcatgaagtttgggagttggacttacgatggttctcaggtagacatcattctggaagaccaggatgtggacaaacgggactttttcgataacggggaatgggagattgtctctgcaaccggaagcaaaggcaaccgcacggatagctgttgttggtacccatacgtcacctacagttttgtgattaaaaggttgcccctcttctatacgctgtttttgatcattccttgcatcggccttagctttctgacggtgctggtcttttacttgcccagcaatgagggggaaaaaatttgtctgtgtacatctgtcctcgtttccctgacagtttttctcctggtgatagaggagattattcctagtagctcaaaagtaatccctctgatcggggagtaccttgttttcacaatgatttttgtgactttgagcattatggttacggtgttcgccattaacattcatcaccgcagctcgtctacacacaatgcaatggcaccattagtgagaaagatcttcctgcacacactgcctaagctactgtgcatgcgcagccacgtggatcgctactttacacagaaggaggaaacagagagtggttcggggccgaagtcatcgcgaaacacactggaagccgcgctcgacagtataagatacattacccggcacataatgaaggagaatgatgtccgagaggtcgtggaggattggaagtttatcgctcaggtcctcgatcggatgttcttgtggacatttctgttcgtgagcattgtgggatccctgggtctctttgtcccagtgatttataagtgggccaatattctcattccagtgcatatagggaacgcgaataagtag

SEQ ID NO: 182828 - DNA, 1485 bp, Artificial Sequence
  Description of Artificial Sequence: Synthetic coding sequence
atgctgaccagcaagggccagggcttcctgcacggcggcctgtgcctgtggctctgtgtttttacccccttctttaaaggctgtgtcggctgcgccaccgaggagaggttattccacaagctcttttctcactataatcaatttattcgtcctgtggagaatgtgtccgaccccgtgaccgtgcacttcgaggttgcaatcacacaattggcgaatgttgacgaggtgaatcagatcatggagacaaacctgtggctccgtcacatctggaacgattataaactgaggtgggaccctatggagtatgacggcattgaaactctgcgggtgccggccgacaaaatctggaaaccggatattgtgctgtacaacaatgccgtgggggatttccaggtggagggtaagaccaaggcactcctgaagtataatggcatgattacatggacccctccagcaattttcaagagttcctgccctatggacataactttcttccctttcgatcatcagaattgctcactgaaatttggatcctggacgtacgataaggcagagatcgaccttctgatcataggtagcaaggtcgatatgaacgatttttgggagaactcagaatgggaaattattgacgctagcggatacaagcacgatatcaaatataactgttgcgaagagatttatactgacatcacctattctttttatatccgcaggctaccgatgttttatacgataaatttgatcattccatgcctttttatcagttttctgacggtcctggtattttacctgccgagtgactgtggcgaaaaagtgacattgtgcatctccgtcctcctcagcctgacagtttttttgttggttatcactgaaacaattccctccacttccctcgtggttccactcgtgggggaatacttgctgtttaccatgattttcgttacgctgagcattgtcgtgactgtctttgtgctcaatatacattacagaacacctaccactcataccatgcccagatgggttaagacggtgttccttaaattactccctcaagtcctgctcatgcgatggcctctcgacaagactagaggcaccggtagcgacgcagtgccgcgaggactggcccgaagaccagctaagggaaagttagcatcacacggagaacccaggcacctgaaggagtgcttccactgccataaaagtaacgaactcgccacatcaaagagaaggctctcccaccagccactccagtgggtggtggagaacagcgaacacagtccggaggttgaagacgttattaatagcgtgcagttcatagccgagaatatgaaatcccacaatgagacaaaagaagtagaagacgactggaaatatgtggcaatggtcgtcgatcgtgtgttcctgtgggtgttcataatcgtgtgcgtatttggaactgctggcctcttcctgcagccattgttgggcaatacaggcaaatcttag

SEQ ID NO: 182829 - DNA, 1440 bp, Artificial Sequence
  Description of Artificial Sequence: Synthetic coding sequence
atgctgaccagcaagggccagggcttcctgcacggcggcctgtgcctatggttgtgcgtattcaccccattttttaaaggttgcgtggggtgcgctaccgaggagcggctgttccacaagctgttcagccattataaccaattcatccgacccgttgagaacgtctccgatccggtgaccgttcatttcgaggtggccatcacccaactggctaatgtaatctggaatgactataagctccggtgggatccgatggagtatgacgggatcgagacccttcgcgttccagcagataagatctggaagcctgacattgtactctataataatgctgtcggcgacttccaggtcgagggtaaaacaaaagcccttctgaaatataacgggatgataacatggaccccccctgctatattcaaaagtagctgcccaatggatatcaccttctttccgtttgatcaccaaaattgtagcttaaagttcggctcctggacttacgacaaagcggagattgacttgttaattatcggatcaaaagtggacatgaacgatttttgggagaattcggagtgggagatcattgatgcctcgggatataaacatgatataaagtataattgctgtgaggagatttataccgacattacatattccttctatattagacgtctgccaatgttctacacgattaatctcatcatcccctgtctgtttatttcttttctaactgtgcttgttttctatttaccttcagattgtggcgagaaggtcaccctgtgcatctccgtgttgctgtccctgacagtctttttgttggtcatcacagagaccatacctagcacctccttagtggtgccactggtgggggaatacttgttatttacgatgattttcgtaaccctatccattgtggtgaccgttttcgttttgaatatccattacagaacgcctactactcacaccatgcctagatgggtgaagacagtgtttctgaaattactgccgcaagtgctgctcatgcgatggccactggacaagacccggggcaccggatccgacgccgtgccgagaggactcgcccgcagaccagccaaaggtaagctggcgtcacatggcgaacctagacacctcaaagaatgtttccactgtcacaagtctaatgaactcgccacatccaagaggcgactgtcccaccaaccactgcaatgggtagtcgaaaacagcgaacatagccccgaagtggaggacgtgatcaatagtgttcagtttatcgccgaaaacatgaagtcacataatgagacaaaggaagttgaagacgattggaaatatgtggcgatggttgtagaccgggtgttcctgtgggtattcattatcgtgtgcgtgttcggtaccgccgggctgtttctgcagcctctcctgggtaacacaggcaagagctag

SEQ ID NO: 182830 - DNA, 1509 bp, Artificial Sequence
  Description of Artificial Sequence: Synthetic coding sequence
atgcggtgcagccccggcggcgtgtggctggccctggccgccagcctgctgcatgttagcctgcagggtgaattccagaggaaactgtataaagaactggtcaagaactacaacccactggaacgaccggtggccaatgattcccagcccctcacggtgtacttttccctgtcgcttctgcaaattatggatgtggacgagaagaaccaggtcctaacaacaaatatttggctgcagatgtcatggacagatcactacctgcagtggaacgtaagcgaataccccggagtcaagaccgtgcgattccctgacggacaaatctggaagcctgatatcctgttgtataactctgccgatgaacggttcgatgcaacctttcacaccaacgtgttagtgaactcctccggacattgtcagtacctgccccccggtatcttcaagtcctcctgctacattgacgtccgttggtttccgtttgatgtccagcactgcaagcttaaatttggatcatggtcctacggcggctggtccttagacctgcaaatgcaggaagccgatatcagcgggtatattcccaacggtgaatgggatttggtgggaattccaggaaaacggagcgaaagattttacgaatgctgtaaggaaccatacccggacgtgacattcaccgtgacgatgagacggcgtactctgtattacggactgaacctccttatcccttgcgtccttattagcgcattggctctgctggtgttcctgctgcccgcggacagcggagagaagatttctttaggtatcaccgtattgctctccctaaccgtgtttatgttactggttgccgaaataatgcccgctaccagtgacagcgtccccctgattgctcagtatttcgccagcacaatgattattgtagggctctctgtcgtggtcaccgtgatagtgctacagtaccaccaccacgatcccgatggcggtaaaatgcctaagtggacccgggtcatactccttaattggtgcgcatggttcctgaggatgaaacgcccaggcgaggataaggtgaggccagcctgtcagcacaaacaaaggagatgtagtctggctagtgtggagatgtcagccgtggccccccccccggcaagcaacggaaatctgctctatatagggttcagggggttagacggggtccactgcgttccaaccccagattccggggttgtttgtgggcggatggcctgctctcccacccacgatgaacacctgctgcacggaggtcaacccccagaaggagacccagatttggctaaaattttggaagaagttcgttacattgcgaatcgatttcgttgtcaggatgagtccgaggccgtgtgttccgaatggaagtttgcggcgtgtgtcgttgaccgtctgtgcctgatggcctttagtgtgtttaccatcatttgcacaattggtattctcatgtccgcacctaactttgtggaggcagtatcaaaagactttgcctag

SEQ ID NO: 182831 - DNA, 210 bp, Artificial Sequence
  Description of Artificial Sequence: Synthetic coding sequence
atgcagaagtactgcatctaccagcacttccagttccagctgctgatccagcacctctggattgccgctaattgtgacatttgggccaaggttgcgcgggtcattggattgctcgccagccacaagaccgacctacaagaaaacacgccagtggtggaggctttcccaaactccccgcgtacgcccacactccccggtgtgcttacatag

SEQ ID NO: 182832 - DNA, 1239 bp, Artificial Sequence
  Description of Artificial Sequence: Synthetic coding sequence
atgcagaagtactgcatctaccagcacttccagttccagctgctgatccaacatttatggatcgcagccaactgtgacatcgctgatgagagatttgatgccacatttcacactaacgtactggtgaacagcagtggccattgccagtatctacctccgggcatctttaaaagtagttgttacattgacgttcggtggttcccttttgatgtgcagcattgtaaattgaaattcggatcctggagctacggcggatggtctctggacttgcagatgcaggaggctgacatatcaggatacattccgaacggcgagtgggaccttgtgggtatccctggaaagcggagcgaaagattctacgagtgctgtaaggagccttatccagacgtaacatttacagtgactatgcggaggagaacgctgtattatggtctgaacttattgatcccttgtgtactgatctcagccctggcattgcttgtttttttgcttcccgccgacagcggcgagaaaatcagtttggggatcaccgtgctgttgagtctgacagtttttatgctattggtcgcggagatcatgcctgccactagtgatagcgtgccgttaattgcacagtattttgcctcaacaatgattatcgttggcctgtctgtcgtagtgacagtgatagtcctacagtatcatcaccacgatcccgatggaggtaaaatgcccaagtggacgagggtcatactcctaaactggtgcgcctggtttctacgcatgaaacgacccggagaggacaaggtcaggcctgcctgtcagcataaacagagaagatgttcactggccagcgtagagatgagtgccgtggcgccacctcccgcatccaatggcaatctactctatatcggctttcgagggttagacggtgtccattgcgtccctactcccgactccggagtcgtgtgcgggcgcatggcatgttctcccacccacgacgaacatctgttacatggcggccagcctcccgaaggagatcccgatttggccaaaattctagaagaggtgcgctacatcgccaacagattccggtgtcaagatgagagtgaggcggtttgttctgagtggaagttcgccgcatgcgtggtggatcggttgtgtcttatggctttcagtgtcttcacaatcatttgtaccatcggaatcttaatgtcagcacctaatttcgtggaggccgttagtaaggatttcgcctag

SEQ ID NO: 182833 - DNA, 447 bp, Artificial Sequence
  Description of Artificial Sequence: Synthetic coding sequence
atgcggtgcagccccggcggcgtgtggctggccctggccgccagcctgctgcatgtgagcctgcaaggcgagttccagcgcaaactatataaggaactcgttaaaaattacaacccactggagcgccccgttgccaacgatagccagccattaacagtgtattttagcctgagccttctccagatcatggatgttgacgaaaagaaccaggtattgactacgaacatttggctgcaaatgtcatggacagatcattacctgcaatggaacgtgtccgagtatccgggcgtgaaaacagttaggttccccgatggtcaaatctggaaaccagatatactgttgtacaattctagttacgaccagcagcaggaagttttggcctatgggatgcactgctggagcccacagttcggcccaaccagtagttcgatgttccctgtcgtctag

SEQ ID NO: 182834 - DNA, 600 bp, Artificial Sequence
  Description of Artificial Sequence: Synthetic coding sequence
atgaccaacagccggaagtgctggcccatgggctgcaccgccggcgcccattccctggatccccacccccggctgtgctctctactgtgcattggggagttctgtggtagagacggttgtagtgcagacgaacggtttgatgctaccttccataccaatgttttggtgaactcttcaggacactgccagtacctacctcctggaatttttaaatcttcctgctatattgacgtgcgttggtttccatttgatgtgcagcactgtaagctgaaattcggttcttggtcttatggcgggtggtctttggacctccagatgcaagaggcagatattagtggctacatccccaatggcgagtgggacttggtgggaatacccggcaaaaggagcgagcgtttttatgagtgctgcaaggaaccctatccagatgtaaccttcacagtcacgatgcgccggcggaccctgtactatggcctgaacctgctcattccctgtgtgttgatctctgcgttagccctgctcgtgtttctgctgccagcggactctggcgagaaaatatcccttggaataaccgtgctgctatctttgaccgtattttag

SEQ ID NO: 182835 - DNA, 1596 bp, Artificial Sequence
  Description of Artificial Sequence: Synthetic coding sequence
atgcggtgcagccccggcggcgtgtggctggccctggccgccagcctgttgcacggaaaggccactgcaagtcctccatctacacctccatgggatcctggccatatacccggcgcctccgtgagaccagctccgggaccggtctcacttcagggggagttccagcgcaagctgtacaaggagctcgtgaagaattacaatcctctggaacggccagtcgcgaacgatagccagcctctgactgtctatttctctctcagcttattgcaaattatggatgtagacgaaaaaaaccaagttctcactacgaacatttggctgcagatgtcgtggactgatcattatctccagtggaatgtgtccgaatatcctggagtaaaaaccgtacgcttccctgatgggcagatctggaagccagatatacttctctacaacagtgccgacgagcgtttcgatgctacgttccatactaatgtgctggtcaattcttccggacattgccagtatctgcctccagggatatttaagtcctcatgttatattgatgttaggtggttccccttcgacgtgcagcactgtaaattaaaatttggatcatggtcctacggaggctggagcctcgacctgcagatgcaggaagccgacatctccgggtatatccccaatggcgaatgggatctggtggggattcctggtaagagatccgagcgattctacgaatgttgtaaggaaccctaccctgatgtcacattcaccgtgactatgaggagaagaacactgtattacggcttaaatctgttaataccttgtgtacttatcagcgcccttgccctgctggtattcctgctccccgcggacagtggggaaaaaatatcactcgggatcactgttctcctctcattgacagtttttatgctgctggtggccgagatcatgcctgctacctcagattccgtgccactaatcgcccagtattttgccagtactatgatcatcgtagggctcagcgtggtcgtgactgtgatcgttcttcagtatcaccaccacgatcccgacggtggcaaaatgcctaagtggactagagtgatactcctaaactggtgtgcctggttcttgagaatgaaaagaccaggggaggacaaggtccgccccgcttgtcagcacaaacagagacgctgttctctcgcttctgttgaaatgtccgccgttgctcctcctcccgcctccaacggtaatctgttgtatattggctttagaggcctcgacggagttcactgtgtgccaacccctgattcaggcgttgtgtgcggcagaatggcatgtagtccaacccacgatgaacatctgctacacggtggacagcccccagaaggtgacccagacttggctaagattttagaggaggttcgctatatcgccaatcggtttaggtgccaggacgaatcagaggccgtctgtagcgaatggaagtttgcagcctgtgtggtggaccgtttatgcctgatggcgttttcggtcttcaccatcatttgtactattggtatcctgatgagtgcacccaactttgttgaagctgtgtccaaagacttcgcctag

SEQ ID NO: 182836 - DNA, 966 bp, Artificial Sequence
  Description of Artificial Sequence: Synthetic coding sequence
atgcaggaggccgacatcagcggctacatccccaacggcgagtgggatcttgttggaatcccgggcaaacgctccgagcgcttttatgagtgctgcaaggagccatatccggacgtgacctttaccgtgaccatgcgcagaagaactctatactacgggctgaatttactgattccttgtgtattgattagtgctttggccctcctggtcttcctcctcccagctgactcaggcgagaagatcagcttggggatcacagtgctcctttcattaaccgtatttatgctgctggtggccgagattatgcccgccaccagtgactccgtaccgctgatagcccagtactttgccagcactatgatcatcgtgggcctgagtgttgtggtaactgtgatcgtgttacagtaccaccaccatgatccagatgggggaaagatgcctaaatggacacgcgtaattctgctcaactggtgtgcttggttcctgaggatgaagagaccaggcgaggacaaagtgcgtcctgcctgtcagcataaacagcgaaggtgctccctggcgtcagtggaaatgtccgcggttgccccaccccccgcatccaatggtaatctgctgtatatcggtttcagaggcctggacggggttcactgtgttcctactcctgactccggcgtagtatgtggacggatggcctgctcaccaacccatgatgagcacctcctgcatgggggccaaccaccagaaggtgatcccgacctagcaaagatcctggaagaagtgcggtacatagcaaacaggtttaggtgtcaggatgaaagcgaagctgtctgcagtgaatggaaattcgctgcgtgcgtggttgataggttatgcctgatggccttcagcgtgtttactattatctgtaccatcgggatccttatgagcgcgccaaatttcgttgaggccgtctctaaggactttgcatag

SEQ ID NO: 182837 - DNA, 1440 bp, Artificial Sequence
  Description of Artificial Sequence: Synthetic coding sequence
atgaactggagccacagctgcatcagcttctgctggatctacttcgcagctagcagactccgcgcagctgagactgccgacgggaagtatgcacagaagctctttaacgatctgttcgaggattactcgaacgctctgcggccagtggaagacacagacaaagtccttaatgtgaccctgcaaatcacgctctcacagattaaagatatggatgagcggaatcaaattctgactgcatacttatggatcagacagatatggcatgatgcatacttgacctgggaccgcgatcagtacgacggtctggacagtattagaatcccctctgacctcgtttggcgaccagacatagtgctctataataaagcggacgacgagtcatccgagcccgtgaacactaatgtggtgctgcggtatgatggactgatcacttgggacgcgcctgcaattacaaaatcatcctgcgtggtggacgtgacctacttcccttttgataaccagcagtgcaatttaacgtttgggtcatggacttacaacgggaatcaggttgatattttcaatgcattggattccggcgaccttagcgatttcattgaagatgtcgagtgggaagtgcacgggatgcccgccgtgaaaaatgtgatctcctatggatgctgttctgagccctaccctgacgttacattcactttacttctcaaacgccgatccagcttttacattgtaaatttgctgatcccctgcgtgctaatatcctttctagcaccgttgtcgttttatttgcccgctgccagtggagaaaaggtttcacttggagtgactattttactggccatgacagtgtttcagctgatggtggccgaaattatgcccgcatccgaaaacgtgcctcttataggaaaatactatatagccaccatggccctgataaccgcttccacagctttgaccatcatggttatgaacattcatttttgtggtgctgaggcacggcccgtgccgcattgggctcgcgttgttatcctaaaatacatgtccagggtgctgtttgtgtacgatgttggcgaaagctgtctgtccccacaccactcgcgagaacgcgatcacctgacaaaggtttactcaaagctcccagagtcaaacttaaaagccgcccggaacaaagacctgagccgaaagaaagatatgaacaaacgtcttaagaacgatctcggctgtcagggcaaaaacccacaagaagccgaaagttattgcgcccaatataaagtcttaacaagaaatatcgagtacatagccaaatgcttgaaagatcataaggccacaaattcaaaaggctctgagtggaagaaggtggcaaaagtgatagatagattttttatgtggatcttctttatcatggtgttcgttatgaccatcctgataattgctagagcggactag

SEQ ID NO: 182838 - DNA, 1506 bp, Artificial Sequence
  Description of Artificial Sequence: Synthetic coding sequence
atgacccccggcgccctgctgatgctgctgggcgccctgggcgccccactcgcgcccggggtgcgtggcagcgaggctgagggcagactgcgagaaaagttatttagtgggtatgactcatccgtacgcccggctcgggaggtcggggaccgcgtgagggtgagtgtgggcctcatccttgctcagttaatatctcttaacgagaaggacgaggaaatgagcacaaaagtgtacctggatttggagtggaccgattaccgcctgtcctgggaccccgccgagcacgacggaatagatagcctccgcattactgcggaaagtgtgtggctgccggacgtggtgctgttgaataataatgatgggaatttcgatgtcgccctggacataagcgtcgtagtcagcagcgacggctccgttcggtggcagccacccgggatctacagatcctcgtgttcaatccaagttacgtactttcccttcgactggcagaactgcaccatggtgttcagcagctacagttacgactcttccgaagtgagtctccagacagggctggggcctgacggtcagggtcaccaggaaattcacatccatgagggtaccttcatagagaatgggcagtgggagattattcataagccaagccgcctcattcagccaccaggcgaccccagaggaggcagagagggacagaggcaggaagtcattttttatctgattataaggaggaaacctctcttttacctggtgaatgttatcgcaccttgcattctgattacactgctggccatttttgtgttttacctgccacctgacgccggtgagaagatgggattaagtatcttcgcactgttgacccttaccgttttccttctgctgttggctgataaggtgccagaaactagtttaagtgtccccataattataaaatacttgatgtttaccatggtgctcgttacattttccgttatcctaagcgtggtggtgcttaacctccatcatcgatcccctcacactcaccaaatgccactgtgggtgcggcagatcttcatccataagctacccctctacctgcggctgaagcggccaaagcctgaaagggacttaatgcccgaaccgccacactgctctagccctggcagcggctggggaaggggcactgacgagtactttattcgcaaaccaccctctgacttcctctttccgaaacccaatcgattccaacccgagctgagcgctccagatctgcggcggttcatcgatggaccaaaccgtgctgtggctctcctccccgagctcagagaagtagtgtcctcaattagctacattgcaagacagttacaggaacaggaagatcacgacgctctgaaggaggactggcaattcgtggccatggtggtggacaggcttttcctctggacctttattattttcacaagtgttggaacactggtgatcttcttggatgcgacctatcacttaccacccccagacccgtttccatag

SEQ ID NO: 182839 - DNA, 1290 bp, Artificial Sequence
  Description of Artificial Sequence: Synthetic coding sequence
atgagcaccaaggtgtacctggacctggagtggaccgactaccggcttagctgggaccccgccgagcatgatggtatcgacagccttcgcatcacagccgaaagcgtgtggctgcctgatgtggtcctgctgaataataacgacgggaactttgatgtcgcactggacatatccgtggttgtctcttcagacgggagtgtaaggtggcagccacctggaatttaccggtcatcttgctcgatccaggtgacatacttcccctttgactggcagaattgtacaatggttttcagttcttattcctacgattcgtctgaggtttctctgcagacaggcttgggtcccgacggccaagggcatcaggaaattcacattcacgagggcactttcatcgaaaatggtcagtgggagatcatccacaaaccgtctagacttatccagccacccggcgatccaagaggtggccgcgagggccagcgacaggaggtgatcttctacctgatcatccgccgaaagcctctgttttacctggttaacgtgatcgctccatgcatcctcatcacattgctggccatatttgttttttacctgccgcccgacgccggagaaaagatgggactgtccatctttgctctgctgaccctgacagtcttcctgctgttgctcgcagacaaggtgccagagacctcactgagtgtccccataatcatcaaatatttaatgtttacaatggttctggtgaccttcagtgtcatcctgtcagtcgtagtactgaatctccatcatcggtctccccacacccaccagatgcccctttgggtacgccagatctttattcacaaactgcccctctatcttagactgaagaggcccaagcccgagcgcgacctgatgccggaaccgccccactgctcgagccctgggtccggctggggcaggggaacggacgaatatttcataaggaagccaccctctgacttcctatttcctaaacccaatcggttccaaccagagctgtccgcacctgacctccgacgctttatcgatgggcccaatagagctgtcgcgcttctgccagagcttagagaggttgtgtcctcaatttcctatattgctcggcagctccaggaacaagaagatcatgatgctcttaaagaggattggcagtttgtagccatggtcgtggaccggctgttcctgtggacatttatcatctttactagtgtgggcacacttgtgatattccttgacgccacataccacttaccccccccagacccttttccttag

SEQ ID NO: 182840 - DNA, 1509 bp, Artificial Sequence
  Description of Artificial Sequence: Synthetic coding sequence
atggcccggcggtgcggccccgtggccctgctgctgggcttcggccttctccggctgtgctctggcgtgtggggaactgatacagaggaaaggttggtggaacacttgctcgatcccagtaggtacaataaactgatccgcccggctacaaacggcagcgagctggtcactgtccagctaatggtgagtctggcccagctgatttcagtgcacgagagagaacagatcatgactacaaacgtgtggctgactcaggagtgggaggattatagactgacgtggaagcctgaagagttcgacaatatgaagaaggtcaggctgccatccaagcacatctggctaccagatgtggtcctttataacaacgcagatggcatgtatgaagtcagcttttattccaacgcggttgttagctacgatggctccatcttctggctcccgcctgcaatctacaagagcgcctgcaagatcgaggtgaaacatttcccgtttgaccagcagaactgcactatgaagttcagaagctggacctatgaccgtactgagattgacctggttttaaaatctgaggtagcgagtctggacgattttacgcccagtggcgagtgggacatagtggccctccccggccggagaaatgagaaccccgatgactctacgtatgtggacattacctacgatttcatcatccgtcgtaagcctctgttctacaccatcaacttgattattccctgcgtgttgatcacatcactagccatactcgtcttctacctgccctcagattgtggggaaaagatgactttatgtatctctgttctgctggctctcacagtgtttctgctgttgattagtaagatagtaccccccactagcctggacgtacctctcgtggggaagtacctgatgtttactatggttcttgtaacgttttctattgtcacatccgtttgcgtgctgaacgtacaccatcggagcccaaccactcacactatggcaccgtgggtgaaagtggttttcttggagaagctgccggccctcctctttatgcagcagccaagacaccattgtgctcgacaacgcctcaggcttcggcggcggcaaagggaacgggagggcgcaggggcacttttttttcgtgaggctccaggggcagatagctgcacgtgcttcgttaatagggcatccgttcaagggctcgcaggagccttcggggcggagcctgcccccgttgctggacctggccgctcgggtgaaccgtgtggatgcggcctcagagaggctgtcgacggggtgcgctttatcgctgatcatatgcgatcggaggatgacgatcaatccgtctcagaggattggaagtacgttgcgatggtgattgatcgtctcttcctctggattttcgtctttgtatgtgttttcgggaccatcggcatgttcctgcaaccccttttccagaattataccactactacattcctgcacagcgatcacagcgcaccgtcatccaagtag

SEQ ID NO: 182841 - DNA, 1377 bp, Artificial Sequence
  Description of Artificial Sequence: Synthetic coding sequence
atgctgcccgacttcatgctggtgctgatcgtgctgggcatcccctcttcagccactactggctttaatagtattgccgagaatgaggacgcgctcttgcgacacttgttccagggttaccagaaatgggtgcgccctgtgctccactctaacgatactatcaaagtctactttggattgaagataagccagctggtggacgtagatgagaagaaccaattgatgacgaccaacgtttggctgaaacaggagtggacggaccacaagctgcgttggaacccagacgattatggcggaatccactctatcaaagtcccatctgagagtctgtggcttcctgacatcgtgctatttgagaacgctgacggacgcttcgagggatccctgatgactaaagtgatagttaagagtaacggcactgtggtgtggactcccccggcttcttataaatcatcctgcactatggacgtgacattttttccatttgatagacagaattgcagcatgaaattcgggtcctggacatatgatggaactatggttgatctgatactcatcaacgaaaacgtagacaggaaggatttctttgacaacggagaatgggagatactgaatgcgaagggtatgaaagggaatagaagagacggtgtatacagctaccctttcattacatattcattcgtgcttaggagactgcccctgttctatacattgttcctgatcataccctgccttgggttaagcttcctgaccgtgcttgtgttctacctcccctcagacgagggggagaaactgtcactctctacatcagtgctggtcagccttaccgttttcctgctggtgatagaggagattattcccagttcctcaaaggtgattccgcttatcggcgaatatctgctcttcatcatgatcttcgtgaccctgagcattatcgtgacagtgttcgtaattaacgtccatcataggagctcctccacctaccaccccatggccccatgggtgaagcgcttgttcttgcagaagttacccaagttgttatgcatgaaagatcacgtggatagatatagctccccagagaaggaggagtcacaaccagtggtgaaaggcaaggtgttagaaaaaaagaagcagaaacagttgtcagacggcgagaaggtgctggttgccttcttggagaaggctgcggactctatcagatatatatcccgccatgtgaagaaggagcatttcatttcccaagttgttcaggattggaaattcgtggcacaggtgttggacagaatttttttatggctcttcctaatagtcagcgtgactgggtcagtcttaatttttacccctgctctgaaaatgtggctacacagctatcactag

SEQ ID NO: 182842 - DNA, 1497 bp, Artificial Sequence
  Description of Artificial Sequence: Synthetic coding sequence
atgcggcgggcccccagcctggtgctgttcttcctggtggccctgtgtggtaggggcaactgcagggtcgcaaatgcagaggagaagttaatggatgacttgcttaataaaacacgttacaacaatctgattcggccagccaccagcagcagccagcttatctcaatcaagctgcagctcagcctagcacaactcatctccgtgaatgaacgggagcaaatcatgacaaccaatgtgtggctcaagcaagaatggaccgattacaggctcacttggaattcgagcaggtacgagggagtaaacatactgaggatcccagcaaagagaatctggcttcctgatatcgttctttataataacgcagacggcacatatgaggtgagcgtctacaccaatctcattgtccggtctaacgggtcggtgttgtggctccctcctgccatctacaagagtgcgtgcaagatcgaggtaaaatacttccccttcgatcagcagaattgtactctgaagttccgaagctggacctacgaccacaccgagattgacatggttttgatgactccaaccgcatcaatggatgacttcactccaagtggtgaatgggatatcgtcgcgctgccagggcgccgcactgtgaatccccaggacccaagctatgtggacgtgacgtacgactttataataaagcggaagcccctcttctacactattaatctgatcataccgtgcgtgctgacaacgctgctcgcaattcttgtgttttacctgccctctgactgcggagaaaagatgacactctgtatctccgttctgctggcactaactttctttttgctcttaattagcaagatcgtgccacctacctccctcgatgtgccactgattggcaagtatttgatgttcactatggtgttggtgacgttttcaatcgtaacttccgtatgtgtgcttaacgttcaccaccggtcccctagcacccacactatggcgccttgggtgaagagatgcttccttcacaagctccctacctttctgtttatgaagcggcctggaccggattcaagccctgcgcgggccttccccccgagcaaaagctgcgttaccaagcccgaagctactgctacttccactagcccatcaaatttttatggcaactctatgtattttgttaatccagcttccgctgcgtccaagtcgccggccggatctacgccagtggctatacccagggatttttggctccgcagctccggtcggtttcgccaggatgtccaggaggccctcgaaggcgtttctttcatagcccagcatatgaagaatgatgacgaagatcagtccgtggttgaggactggaagtatgttgccatggtcgtggaccgtttgtttctgtgggtgttcatgttcgtttgtgtgctcggcaccgtcggcctcttcttgcccccactatttcagacacatgcagcttcagaaggaccctacgctgcgcaacgcgattag

SEQ ID NO: 182843 - DNA, 696 bp, Artificial Sequence
  Description of Artificial Sequence: Synthetic coding sequence
atgcggcgggcccccagcctggtgctgttcttcctggtggccctgtgcggaaggggcaactgtagagtagcgaatgctgaggagaaactcatggatgacctgctgaataagactcgctataataacctgatccggccggcgactagttctagccagctgatctctatcaaactgcagttgtcactagcgcagcttattagtgtgaatgaacgcgagcagatcatgaccacgaacgtgtggttgaaacaggagtggacagactatagactgacctggaattcctctaggtacgaaggagtgaacatcttgaggatccccgctaagaggatctggctcccagacatagtcctctacaataagagcctaagaacagggtctacctggctatggtggtggaccgggtgctcatgtggttgtagctgcctctgtgcttcttgggcactgtgggggtcttcctacagaccctcctctaggccgatgcaactgcttaggggccccacactgccatccgtgaccgaaggtccactgggctgtggagtgcggggctgtgaatggcccggcggccattttgcagcctctttttgggtggttgcagatgaggctctttcaaagtacgtttctattgggcatcagccacatcagactagtcactcgaggggcacagggaaggatggaggactaggctgccctttgtag

SEQ ID NO: 182844 - DNA, 1554 bp, Artificial Sequence
  Description of Artificial Sequence: Synthetic coding sequence
atggagggccccgtgctgaccctgggcctgctggccgccctggccgtatgtggtagttggggcctgaatgaggaggaaagattgatccgccatctttttcaggagaagggctacaataaagagctgagacccgtcgcgcacaaggaggaatcagtggatgtcgccctcgccctcacactgtctaatctgatctctctgaaggaagtcgaagagacactcaccaccaatgtttggattgaacacggctggacagacaatagactgaagtggaatgccgaagaatttggcaacatttcagtactcaggctgccccccgacatggtttggctaccagaaatcgttttagaaaacaacaatgacggctcattccagatttcctactcatgtaacgtgctggtttatcattacgggttcgtgtattggctccctcccgctatctttcgctcttcctgtcctatttcagtgacgtactttccctttgattggcagaattgttccctcaaattctcctctttgaaatataccgcaaaggagattactttgagcctaaagcaggatgccaaggagaatagaacctacccagtggaatggatcatcattgacccggagggattcaccgaaaatggtgagtgggagattgtacataggccagcccgggtgaatgtcgaccctagggctcccctggattccccttctcgccaggacatcacattctatcttatcatccggaggaagcccttgttctacatcattaacattctggtaccctgtgtcctgatcagttttatggtcaacctagtgttttatctgcccgcagactccggtgagaaaacatccgtagccatctctgtgctgttggcccaatcagtatttctgctgctaatttctaagcgtcttcctgctacgagcatggccattcctctcattggaaaatttctcctattcggtatggtgctcgtgaccatggtcgtcgtcatctgcgtaattgttctgaacatccacttcagaacccctagcacccacgtgctgagtgaaggagttaagaaactgtttcttgaaactctgccagaattactccacatgagtcgcccagctgaggacgggcccagtcccggtgcccttgttcgcagatctagtagcctgggctatatcagtaaggccgaggagtacttcctcctcaagagcagatcagacctgatgtttgagaagcagagcgagagacacggactggcccggcggctgaccacggctcgcaggcccccagcgtccagcgaacaagcccagcaagaactgtttaatgagctaaaacccgcggtcgacggggctaatttcatagttaatcacatgcgcgatcagaacaactataacgaggaaaaggacagttggaatagggttgctcgaactgtcgatagactctgcctttttgtggttaccccggtcatggttgtcggaacagcctggatatttctacagggggtttacaatcagccaccaccccagcccttccctggagatccctactcctacaacgttcaagataaaagatttatttag

SEQ ID NO: 182845 - DNA, 708 bp, Artificial Sequence
  Description of Artificial Sequence: Synthetic coding sequence
atggagggccccgtgctgaccctgggcctgctggccgccctggccgtgtgcgggagttggggactcaatgaggaggagcgtttaatccggcacctcttccaggaaaaagggtacaataaggagctgaggcctgtggcgcacaaggaggagtctgttgatgttgctctggcactcacattgtcgaatctcatatcgctaaaagaggtggaagaaaccttgacaacgaatgtctggatcgagcacgggtggacagataacaggctgaaatggaacgctgaagagtttgggaacatttccgtgcttagactgccccctgatatggtgtggttgcctgagatcgttctcgagaataacaatgacggcagcttccagattagttactcttgcaatgttctggtgtaccactatggattcgtgtactggctgccacccgccattttccgctctagttgtcctataagtgtgacctatttcccttttgactggcagaactgctctctcaaatttagggaaagaggtgtaggtgactccccacccgcagggcaaggccagcgagggccgcaaagccccagcggccaaccgcagcccccagggcaccacctgctgccacaccaccccccccaggcgcctctgcttcatcaccagcaccctggggcccttcgtgcacatcttctacacggtcagcctggcctcctccctactggatag

SEQ ID NO: 182846 - DNA, 972 bp, Artificial Sequence
  Description of Artificial Sequence: Synthetic coding sequence
atgctgaagaacctggagaccagcgtgagctgcgccagcccccggacctggtgcggctcgcagcgactctgttggcgaaccacaatgacggccccttctagaagtcctacccctgcaacctgcctgtccactaccacagctagctgcactggatgtcacctgccctcttccgcacctcccgctccttcattatcacctattagcccatctactggaaggactgcgccctcgtctagtggcggtgaaaaaacatcggtggctatctcggttctcttagcccagagcgtgttcctcctgctcattagcaagcgcctgcctgccaccagcatggccatcccacttatcgggaaattcctgctgttcggaatggtgctggtgacaatggttgttgtgatctgcgtcatcgtcttgaatatccactttaggacgccgtccacccacgtactgtccgaaggagtcaagaagctgtttctggaaactcttcctgaactcctccacatgtctaggcccgctgaggacgggccttcacctggcgctctcgttcggagatcttcgtccctaggatacataagcaaggcggaagagtactttcttttgaagagtaggtcggatttaatgttcgagaaacagtctgaacgacatggactcgctagaagattgactacagccagaaggccgcccgcgagttcagaacaggcccaacaggagttgtttaatgaactaaagccagccgttgatggagctaattttatcgtcaatcacatgcgagaccagaataactacaatgaggagaaagattcgtggaatcgagtggctaggacagtggatcggctgtgtctgttcgtggtcactccagtgatggttgtgggaacggcttggattttccttcagggagtgtacaaccagcctcccccccagccctttcccggcgacccctacagttacaacgtgcaggacaaacggttcatctag

SEQ ID NO: 182847 - DNA, 708 bp, Artificial Sequence
  Description of Artificial Sequence: Synthetic coding sequence
atggagggccccgtgctgaccctgggcctgctggccgccctggccgtctgtggcagctggggcctgaacgaagaagagagacttatcaggcacctatttcaggaaaagggttataataaggagcttcgccccgtggcacataaggaggaaagtgtggacgtcgctctcgctttgacactgtccaatctaatctctctcaaggaggtggaagagacattgaccaccaatgtttggattgaacacggatggaccgacaatcgacttaagtggaatgccgaggagtttggtaatatcagtgttctgcggttgccccccgatatggtgtggcttccagagattgttctggagaataacaatgacggatcattccagatctcctactcttgcaatgtgctggtttatcattatggattcgtgtactggctccctcctgcaatttttaggagctcttgccccatcagcgtcacgtatttcccctttgactggcagaattgttcattgaaattccgggaaagaggagtgggcgattccccacccgcaggccaagggcagcggggcccacaatccccctctggccagcctcagccacctggacatcacctgctgccccaccaccccccacaggccccgcttctacatcaccaacacccaggagcccttcgggcgcacttgctgcacggacagcccggtctgctgcccacaggttag

SEQ ID NO: 182848 - DNA, 1509 bp, Artificial Sequence
  Description of Artificial Sequence: Synthetic coding sequence
atggagggccccgtgctgaccctgggcctgctggccgccctggccgtgtgcggatcttggggccttaatgaggaggaacgactgatcaggcacttgtttcaggaaaaaggctacaataaggaactgcgcccagtcgcccacaaggaagaaagcgtggacgtcgccctcgctctcaccctgagtaacctcatttcccttgggtggaccgataacagacttaagtggaacgcagaggagtttgggaacatatcagtgcttagactacccccggacatggtgtggctgcccgaaatcgtcctggaaaacaataacgacggatccttccagatttcatactcatgtaacgttctggtctatcactatggatttgtctactggctgccgccagctatctttagatcatcttgccctatttctgtgacctatttcccctttgactggcagaactgctcacttaagtttagcagcttgaaatacactgccaaggaaattactcttagcctaaagcaggatgctaaggagaatcgcacttacccggttgagtggattattatcgacccggaaggcttcacagaaaatggcgaatgggagattgtccaccgacctgcgcgggtgaatgtggatccaagggcccctctcgactcacctagtcgccaggacattactttctatctgattatcaggcggaagccactgttctatatcattaatatccttgttccctgcgtactgatttcttttatggtaaacctcgtgttctacctgccggctgacagtggtgagaagacgtccgtggccatcagcgtgttactggctcagtccgtattcctgctgctgatttccaagaggttacccgccacgagcatggcaataccactcattggcaaattcctgctgttcgggatggtgttagtgacaatggtcgtggtgatctgcgtcatcgttctgaatattcactttcggactccatcgacacatgtcctgtccgagggggtgaagaagctgttcctggaaactctcccagaacttcttcacatgagcagaccagcggaggacgggccttcccctggcgctttggtgagaaggagcagtagcctcggctacatttccaaggcggaagagtacttccttctgaagtcccgatctgacctcatgttcgaaaagcagtctgaacgccatggccttgccagacgcctgactaccgcaagacgccctcccgcctcttctgaacaggctcagcaggagttgttcaatgagttaaaaccggccgtcgatggagctaacttcatcgtgaaccacatgcgcgaccagaacaattataatgaagagaaggattcttggaaccgggtggctcggactgtggatagactctgcttattcgttgttacacctgttatggtagtggggacggcttggatttttttacaaggcgtgtataaccagccaccacctcaacctttccctggtgatccttattcttataacgtgcaggacaaacgatttatctag

SEQ ID NO: 182849 - DNA, 1482 bp, Artificial Sequence
  Description of Artificial Sequence: Synthetic coding sequence
atggcccgggcccccctgggcgtgctgctgctgctgggcctgctgggccgcggcgttgggaaaaatgaggagctccgcctgtaccaccaccttttcaataattatgatccaggcagccggccagtccgggaacctgaggacacagtcaccatttcactgaaagtgactctgaccaatcttattagcctgaacgagaaagaggaaaccttaactacttcagtctggatcggcattgattggcaggattatcggctgaattattccaaggatgatttcgggggcattgaaacgctccgcgtgccttctgagcttgtctggctccctgaaatcgttcttgagaataatattgacggtcagttcggagtggcttacgatgcgaacgtactggtgtatgagggcggctctgtgacatggttaccgcccgcaatatatcgaagcgtttgcgcagtagaggtgacctatttccctttcgactggcagaattgcagcctgatttttagatcccagacctataatgccgaggaagtggagttcaccttcgcagtcgataatgatggtaagacaattaacaagatcgacatcgataccgaggcttacactgagaacggcgagtgggccatcgacttctgcccaggtgtcattagacgacaccatggaggggcaacagatggcccaggcgagaccgatgtcatttattccctcatcatcaggagaaagcctctcttttacgtgattaacatcattgttccttgtgtactgatctccggcctggtgttgctagcctactttctacccgcccaggccggaggacagaaatgcaccgtgagcatcaacgtccttctggcgcagacagtttttcttttcttgattgcccaaaagataccagaaacaagcttgtcggtgcctctcctggggcgcttcctgatctttgtcatggttgtggctactctgatcgttatgaactgtgtgattgttctcaacgtgtcccagcgcacaccaacaactcatgccatgtctccacgacttcgacacgtcctgctggagctactgccacggttgctgggatctcctcctcctcctgaggcccctcgagccgctagtccaccacgccgcgctagttcggtcgggttgctgctgcgcgcggaagagcttatcctcaagaagcctcggtctgaattagtctttgagggtcaacggcataggcaggggacatggaccgctgctttctgccagagcctgggcgctgctgcccctgaggttagatgttgcgtcgatgccgttaactttgtagcagaatcgacccgcgatcaagaggcaactggagaggaagtctcggactgggttcgcatgggcaacgccctggataacatttgtttctgggctgcactggtcctgttctccgtggggagctctctcattttcctgggcgcttacttcaacagagttcccgacttgccatacgcgccttgtatccaaccgtag

SEQ ID NO: 182850 - DNA, 1554 bp, Artificial Sequence
  Description of Artificial Sequence: Synthetic coding sequence
atgcacggcggccagggccccctgctgctgctgctgctgctggccgtgtgtctgggggctcagggacgaaatcaagaggagcggctgctagcagatctcatgcaaaattacgacccaaacctgcgtcctgccgaacgagattctgacgtagtaaacgtgagcctcaaactgacccttactaacctcataagcttgaacgaaagagaggaagcccttaccactaatgtgtggattgaaatgcagtggtgtgattaccgtttacggtgggatccccgtgattacgaggggctatgggtgctacgggtcccgtccacaatggtgtggcggcccgacattgtcctggagaacaacgtggatggggtttttgaagtcgcgctgtattgtaatgtgttggttagccctgacgggtgtatatattggctgcctccagccatctttaggtccgcttgttcaatttcagtgacatattttccgttcgattggcaaaactgcagtctcattttccaaagccaaacatattccacgaacgaaattgatctacagctgagccaggaagacggacagacaatcgaatggatttttatagatccagaagctttcactgagaacggggagtgggcaattcaacaccggcccgctaagatgctgctcgatcctgccgcccccgcacaggaggccgggcaccagaaggtggtgttttatctattaatccagagaaagcctctgttctatgttataaacattattgcaccctgtgtgctgatttcctcagttgctattcttatccacttcctccccgccaaagcaggagggcagaagtgtactgtggccattaacgtcttgcttgcccagactgtgttcctttttttggtcgccaagaaggttccagagacgtcccaggccgtgccgctaatctctaaatacctgacattcctattggtagttaccattctaatagtcgtgaacgcggtggtggttctaaatgtgagccttcgtagtccccatactcacagcatggccagaggggtgaggaaagtattccttaggctgttgccacagctgcttaggatgcatgttagaccacttgctcctgcagccgtgcaggatacacagagccgactacaaaacggttcaagtggatggagtatcaccacgggcgaagaggtcgctctctgtctcccccgttcggagctactattccaacagtggcagagacaaggactcgttgccgcagcgctggagaagctggaaaagggccccgaactggggctttcacaattctgcggctcccttaagcaggccgccccagctattcaggcctgcgtggaagcgtgcaacctgatcgcctgcgctcgtcatcagcagagtcactttgacaatggaaacgaggagtggtttctggtggggcgcgtgctggatcgcgtttgcttcctcgctatgctgtctctgtttatttgtgggactgccggcatattccttatggctcactataatcgtgttccagccttaccattcccaggggatccacgtccatatttgccctctcccgactag

SEQ ID NO: 182851 - DNA, 1554 bp, Artificial Sequence
  Description of Artificial Sequence: Synthetic coding sequence
atgcacggcggccagggccccctgctgctgctgctgctgctggccgtttgtctgggcgctcaggggcgcaaccaggaggagcgactgcttgccgatctcatgcagaattacgacccaaacctgcgtccagcagagcgggatagcgatgttgttaacgtcagtctgaaactgactctcactaacctgataagcctgaatgagagagaggaggcactgactaccaacgtgtggattgagatgcagtggtgtgactataggctgcgctgggatcccagagactatgagggcttgtgggtactaagggtgcccagtactatggtgtggcgtcctgacattgtgctcgagaacaatgtggatggtgtgttcgaggtcgctctgtactgtaatgttctcgtttctcccgacggctgtatctattggcttcctccagcaattttccgatcagcttgttccatttcggtgacctattttccctttgattggcagaactgtagcttaatcttccagagccaaacctattccacgaacgaaatcgacctgcagttgtcgcaggaagacggtcagaccattgaatggatctttatagaccctgaagccttcactgagaatggagaatgggcgatccagcaccgaccggccaaaatgctcctggaccccgcagcccctgcccaagaggccggccaccagaaagtcgtcttctatctgctgattcagagaaagccgctgttttatgtgatcaatattatagccccatgcgtgctcattagctccgttgctattcttatacatttcttgcccgccaaagctgggggacaaaaatgtactgtggccattaacgtcctgctcgcccaaaccgtatttctgttcttagttgccaagaaggtaccagagacaagccaggcggtgcctttgatttccaagtatctcacgttccttctcgtggtcacgattctgatagtggtcaatgcagtagttgttctgaatgtgagcttaaggtcaccacatacgcactctatggcacggggcgttcggaaggtattcctccgattactgccacagctgctgcgcatgcatgtcagaccacttgcgccagctgcggttcaggacacccagagcaggctccagaacggctcttctggctggtcgatcactactggggaggaggttgctctttgtctgccccgctcagaactgctgttccagcagtggcagcggcaagggctggtggccgccgccttagagaagcttgagaagggccccgagctcggtctgtcgcaattctgtgggtcgcttaagcaggctgcacctgcaatccaagcatgtgtcgaggcatgcaatctgatagcatgtgccaggcaccagcagtcacactttgataacggtaacgaagaatggttcctggtcggccgggtcctggatcgggtatgtttcctggctatgctcagtttatttatctgtggtaccgcgggcattttccttatggcccactacaatagggtgcctgcacttcctttccctggcgaccctcgcccttatcttccctcacccgattag

SEQ ID NO: 182852 - DNA, 1080 bp, Artificial Sequence
  Description of Artificial Sequence: Synthetic coding sequence
atggtgcggcccatgctgctgctgagcctgggcctgctggccggcctattaccagcactcgccgcttgccctcaaaattgtcattgccattccgacctccagcatgtgatttgcgataaggtcggcctgcagaagattcccaaggttagcgaaaagactaagctcctcaatttgcagcgtaataacttcccggttctggctgcaaattcatttagagccatgcccaacctcgtctctctgcacctgcagcattgtcagatacgcgaggtggccgccggcgctttcagaggcctcaagcaactgatctacctgtacctgagtcataacgacataagggtcttacgggccggcgcattcgacgatctgaccgaattgacctacctttacctggaccataataaggtgactgagctcccaagaggcctcctgagcccactagtaaacttgtttattctccagctcaataacaacaagataagggaactccgcgcaggagctttccagggggctaaggacctccggtggctttatctcagtgagaatgcactgtcgtcactgcaaccaggcgctctggacgacgtggagaatttggccaaattccatgtcgaccgtaaccagctgagcagctacccttccgcagctctctccaaattaagagtggtggaggagctgaagctgagtcacaatcctctgaaatccatccccgacaacgcctttcagagcttcgggaggtatctcgagactctgtggctcgacaacactaacctggaaaagtttagcgacggggctttcttgggagtgaccacattgaagcacgtgcacctcgagaacaacagactgaatcagttgccttccaattttcccttcgactccttggagaccctcgctctcactaataatccttggaagtgtacttgtcagctgcgcgggttgcgccgctggctggaggctaaagccagtcgcccagatgcgacctgcgcctccccggctaaattcaagggtcagcatattcgggataccgatgcctttagaagctgtaagtttcctacaaaaagaagcaaaaaagctggtcgccattag

SEQ ID NO: 182853 - DNA, 129 bp, Artificial Sequence
  Description of Artificial Sequence: Synthetic coding sequence
tgagccagccggcccgacgccacctgcgccagccccgccaagttcaaaggacagcacatccgcgataccgacgctttccgcagttgtaagttcccgaccaagcgcagcaaaaaggcaggaaggcactag

SEQ ID NO: 182854 - DNA, 1080 bp, Artificial Sequence
  Description of Artificial Sequence: Synthetic coding sequence
atggtgcggcccatgctgctgctgagcctgggcctgctggccggcctgctgcccgccttggccgcctgtcctcagaattgccactgccactccgatcttcagcacgtaatatgcgataaagtcggtctccagaaaattcccaaagtgagtgagaaaaccaaactcctgaatttgcagcgcaacaacttccccgtgctggcagctaatagtttccgtgctatgccgaatttagtgtccctgcatctccagcactgccagattcgagaggtggctgcgggggcctttaggggactgaagcagctgatatacttgtacctgagtcataacgatatcagagtcctgcgcgctggtgcctttgacgacttgactgaactgacgtatctttacctggatcataataaggtgacggagctcccaagagggctgctctcgccattggtgaatcttttcattcttcagttgaacaataataaaatacgcgaactcagggcaggcgcattccagggagcaaaggatctacgatggttgtacctctccgaaaatgcacttagctccctgcagccaggagccctcgatgacgtcgaaaacttggccaaatttcacgtagataggaaccagttgtccagctaccctagtgccgctcttagtaaactgagagttgtcgaagagctgaaactttctcacaacccactgaagtcaattcccgataacgcgttccagagttttggtcgatatctggagacactctggctcgataacacaaatctggagaaattcagtgacggcgcctttcttggtgttactactctgaaacatgtacacttggagaacaatcgcctgaatcaactcccctcaaatttccccttcgattcgcttgagactctcgcgctcaccaataacccctggaaatgtacctgtcagttgcgggggctacgacggtggttggaggcaaaggcatcaaggcccgatgcaacctgtgcatcacctgcgaaatttaagggacagcatattagggacacggatgcatttagatcttgtaaattccctactaaacgctccaagaaagcaggacgccattag

SEQ ID NO: 182855 - DNA, 2328 bp, Artificial Sequence
  Description of Artificial Sequence: Synthetic coding sequence
atgcgggccagcctgctgctgagcgtgctgcggcccgccggccccgtggcagtgggcatttccctgggattcaccctctcactcttgtctgtgacatgggtcgaagaaccatgtggtcccggacctccccagccgggggatagcgaattaccccccaggggaaacaccaacgcggcgcggcgccctaacagcgtgcagccaggcgccgaaagagaaaagcctggggctggggagggcgcaggcgagaattgggaaccaagggtgctcccctaccatccagcccagcctggccaggccgcaaagaaggcagtacgcacacgatacatttcaactgagcttggtattcggcagcgactgctcgtggccgtgctcaccagtcaaactacactgccaacacttggagtagcggtaaacaggacactggggcaccggctggagcgagtggtcttccttacgggggcccgcggaaggagggctccgcctggcatggccgtggtcacgctaggagaggagaggccaatcggacacttgcaccttgccttaaggcaccttcttgaacaacatggggatgactttgattggtttttcttggtcccagacacaacctatacagaggcccacggccttgctcggctcacaggacacctgtccttggcctccgctgcacatctgtatctgggacggcctcaagactttatcggcggggaaccgacacctggacgttactgtcacggagggttcggcgtgctactttctcggatgttactccagcagctgcgaccacatctggaaggttgccggaatgatatcgtaagcgcacgtccagacgagtggctgggaagatgtatacttgacgctactggagtgggttgcactggggaccatgagggtgtgcattatagccaccttgagctcagtcctggcgagccagtgcaggagggtgacccacacttccgatccgcccttacggcccaccctgtgagggacccagtgcatatgtaccaactgcataaagccttcgcaagagcagagctggaacgcacataccaggagatacaagaactgcagtgggaaattcagaatacatctcaccttgcagtagatggggaccaggcagctgcgtggcctgtagggattcctgcacctagtaggcccgctagcagatttgaagttcttcgctgggattactttactgaacagcatgctttttcctgcgctgacggctccccacgttgcccactaagaggagccgatcgggccgatgttgcggacgtgctgggaaccgctctggaagagttaaacagacgctatcatcctgccctacggttgcaaaaacagcagctggtcaatggttacagacggttcgatcccgcaaggggcatggagtacactctggatttgcagctggaggccttgacaccgcaggggggccgaaggccactgacaaggagggtccagctcctgagacccctatcgagggtagagattcttcccgtcccgtacgtgacagaggcctctcggctcacggtccttttgcctctggcagccgctgagagggacctggctcccggatttctcgaggcatttgctaccgctgcgttggagccgggagatgcagccgccgctctgaccctcttgctgttgtatgagccacgtcaggcacagcgcgtggctcacgccgacgtttttgctcccgtgaaagctcacgtggctgaactggagagacgattccccggcgccagagtgccttggctctctgttcagaccgctgcacctagtccgctcaggttgatggacctcctctctaaaaagcaccccctcgatacgctgtttctgttagccggtcctgataccgtcctcaccccggatttcttaaatcgttgtcgcatgcacgctatttcgggctggcaggccttttttcccatgcacttccaagcattccatccggctgtcgccccaccccagggcccaggacctccagaacttgggcgagacacaggcaggttcgacaggcaagcagcctccgaggcttgcttttacaatagcgattacgtggctgcacgaggcagactcgccgccgccagcgagcaggaggaggagctcttagaatctctggacgtatacgagttattccttcacttttcatctcttcacgtgctccgcgcagtcgagccagcactactgcagcgatatcgcgctcaaacgtgcagcgccagattgagcgaggacctctatcaccggtgcctgcaaagcgtgttggaaggcctgggaagtcgcacccaactcgcgatgctgctttttgagcaggagcagggcaactccacatag

SEQ ID NO: 182856 - DNA, 1842 bp, Artificial Sequence
  Description of Artificial Sequence: Synthetic coding sequence
atggccgtggtgaccctgggcgaggagcggcccatcggccacctgcacctcgcgctcaggcatctactggagcagcacggagatgatttcgattggttctttcttgtgccggacacaacttatacggaagcacatggactcgctcggctgaccgggcacttgagcctcgcatcagccgcccacctgtacctaggacgaccacaagattttattgggggcgagcccactccagggagatactgccacggcgggtttggcgtgcttctctctcgcatgttactccagcagctccgcccgcatcttgagggatgccggaatgacattgtctcagccagaccggacgagtggctcgggcgatgtatcctggacgccacaggcgttgggtgcactggcgatcatgagggagttcattactcccacttagaactgagccccggcgagccagttcaggagggggaccctcactttaggagcgcactcactgcgcaccctgttcgggaccccgtgcacatgtaccagctccacaaagcctttgcaagggccgagttagaaagaacttaccaggagattcaagagctgcagtgggagattcagaataccagccatctcgccgttgacggggatcaagccgctgcatggcctgtgggcatccctgccccctctcgccccgcttctagatttgaagtgctacgctgggactactttacagagcagcatgcgttcagctgtgctgatgggtcccctagatgtccgctgaggggagcagatcgagctgacgtggctgatgttctgggcacagccttggaagaactgaaccgtaggtaccaccccgctcttagactgcaaaagcagcaattagtgaacggttacagacggtttgatcccgccaggggaatggagtataccctcgatttgcagttagaggccctaactccccaggggggccgacggcctttgaccagacgcgtgcagctcctgcgacccctgtcaagggtcgagatcctccccgtgccctatgtgacggaggcgagcagactgaccgttctcctcccattggcagccgcggagcgagatctcgctccagggtttcttgaagcattcgccacagccgccctagaacctggcgacgctgctgctgcactgactcttctgctgttatacgaacctcgccaagcccagagggtggcccacgctgacgtgttcgctccagtcaaggcccacgtggccgagctcgagcgccggtttcccggtgcccgggtcccctggctgtctgttcagaccgccgctccctcccccttgcggttgatggaccttctgagcaaaaagcaccccttggacaccttgtttctgctggccggaccagatacagtccttacgcccgatttcttaaataggtgtcgaatgcacgcgattagtgggtggcaggcattcttcccgatgcactttcaggcctttcaccccgccgtggcccccccgcagggcccgggcccaccagagctgggtagggacacaggccggttcgaccgccaggcagcgtcggaggcatgcttctataactcggactacgtcgctgccaggggaaggctggcagccgccagcgaacaggaggaagagcttttagaatctctggacgtctatgagctgtttctgcatttctccagtctgcatgtcctgagagccgtggaaccggctctccttcagcgctatcgggctcagacctgttccgcccgtctgagcgaagacctttatcacaggtgtctacagtcagttctggaggggttgggcagtcggactcagctggccatgctcttgtttgagcaggaacagggcaacagcacctag

SEQ ID NO: 182857 - DNA, 2319 bp, Artificial Sequence
  Description of Artificial Sequence: Synthetic coding sequence
atgcggctgagcagcctgctggccctgctgcggcccgccctgcccttgatcctgggtctgtccctggggtgctccctgagccttcttcgtgtctcatggatacagggcgaaggcgaagacccatgcgtagaagcagtgggagagagaggtggtccgcagaatccggactctagggctcggcttgaccaatccgatgaggattttaaacctcggatcgtcccttactaccgggaccctaacaaaccctacaaaaaggttcttagaacccggtatattcagaccgaactgggaagccgagaacgccttttagtagcggtcttgacgtcaagggccacattgtccacactggccgtggctgtcaatcggacagtggctcaccatttcccacgcttgttgtattttacgggccaaaggggcgcacgcgcaccagccggtatgcaggtcgtgagccacggtgacgagcggcctgcctggctaatgtcagagactttgcgccacctccatactcacttcggcgcagattatgactggttcttcattatgcaagacgacacctacgtccaggctccacgtctcgctgcccttgccgggcacctgtccattaatcaggacctgtatctggggagggccgaggaattcataggcgccggcgagcaggcgcgatattgccatggcgggtttggttatcttctgagtagatcccttttgctccggttacggcctcatctggacggttgtagaggggatattttgagcgccaggccagacgagtggctcggacgctgtcttatcgactcccttggcgtcggttgcgtgagccaacaccaaggtcaacaatataggtcttttgaactggccaaaaatagggatccagagaaggaagggtcttcagccttcctcagtgcatttgcagtgcatccagtgagtgaggggactctgatgtaccgcctgcacaagagattcagtgccctggaactggaacgtgcttatagcgaaattgagcagctgcaggcacagatcagaaacctaactgttttgacaccagagggagaagccgggctgtcatggcccgtgggacttccagcccccttcacaccccattctcgcttcgaggtcctcggctgggattactttaccgaacagcacacattctcatgtgctgacggggccccaaaatgccccttgcaaggagcgtcccgggccgacgtgggcgatgcgctggaaaccgccctcgaacaactcaacagacggtaccagccgcggctccggttccagaaacagagacttctgaacggctaccgacggttcgatcctgccaggggaatggagtatacacttgaccttctcctggaatgtgtcacacaacgcggacataggagagctctcgccagacgagtgtctctcctcaggccgctgtccagagtggagatcttaccaatgccatatgtgaccgaagccacacgggttcagctcgttttacccctcctggttgccgaagccgccgcagccccagcattcttggaagctttcgcggctaatgtcctggaaccccgcgaacacgccctgctcacactgttgcttgtatacggaccaagagaggggggaaggggcgctccagatccttttctgggagtcaaggctgccgcagccgaactggaacggaggtaccccgggactcgactggcatggttagctgtgagagcggaggctccttctcaggtcaggctgatggatgtggtgtccaagaagcaccccgttgatactttgttcttcttgaccaccgtgtggacaaggccgggcccagaggtgttaaacaggtgccgaatgaacgctatctcgggttggcaggcttttttccccgtgcacttccaagaattcaatcccgcccttagcccccagagatcgcccccagggccgcccggcgccggtcccgacccaccgtcacctccaggggctgatccctcaagaggggcgccaatcggaggacgatttgataggcaggcttcagcagagggttgcttttataacgctgactatttggccgcgcgcgcgcgcctagcaggagaactagctggccaggaggaggaggaggctctggagggcctagaagtaatggatgtattcctcagatttagtgggcttcatctgttcagggctgtggagccaggtctggttcagaagttcagtctaagggactgctctcctcgactttcggaagagttgtaccaccgttgtcgactgtctaaccttgagggtttaggtggaagggctcagctcgcgatggcgctctttgagcaagaacaggcaaatagtacatag

SEQ ID NO: 182858 - DNA, 2004 bp, Artificial Sequence
  Description of Artificial Sequence: Synthetic coding sequence
atgcggctgagcagcctgctggccctgctgcggcccgccctgcccctgatcttgggcctgtctcttggctgctctctcagcctgttgcgggtcagttggatccagggagagggcgaggatccgtgcgtcgaagccgtcggggagcgaggaggtcctcagaatcccgactccagagcacgtctcgatcagtctgacgaagattttaagccccgcatagtaccttattaccgcgaccctaacaagccctataaaaaggttctgaggacaaggtacatccagacagaactcggatctcgagagcgcctgctcgtggcagtgctcacaagtcgcgcaacactgtctacgttggctgtggccgtcaatcgtacagtagcccatcactttcctcgtcttctgtattttacaggacagcgaggggcacgagccccggctgggatgcaggtggtgtctcatggggatgaacgtccagcctggctcatgtcggagaccctgcggcatctgcacactcatttcggagctgactacgactggttttttatcatgcaggatgatacctacgtacaggctccccggctggccgcactggctggtcacctcagcatcaaccaggacctgtatctggggcgggccgaggaatttattggcgcaggggaacaggctcgctattgtcatggaggttttggttatttactgagccgcagcctgctcttgcgcctgcggccgcatttggatggttgtaggggggacatactcagcgcacggcccgatgagtggctcgggcgctgcttgatagattccctgggagttggatgcgtcagccagcaccagggacagcagtatcggagttttgagctcgccaagaacagagatcctgaaaaagaaggctctagcgccttcctgtccgcgttcgctgtgcatccggtgtccgagggcacactcatgtaccgcttacacaagcgattcagtgcccttgagctcgaacgcgcctattctgaaatagaacaattgcaggcccagatcagaaatctgaccgtcctcacaccggagggagaagccggcttatcttggcccgtgggcctccctgccccctttaccccccactcaaggtttgaagtgctgggatgggactattttaccgaacagcacaccttttcatgcgctgatggagcgcctaagtgcccactgcagggcgcttcacgagctgatgtcggagacgctctcgagacagctctggagcaattaaacaggcggtaccagccaagactccgttttcagaaacaaagacttctcaacggctatcggagatttgacccagctagagggatggaatatacactggatttattgctcgaatgcgtcactcagagagggcatcgtagagcgctggcccgacgtgtgagtttgctgcgcccgctaagcagagtggagattttgccgatgccctacgtgacagaggccactcgggtccagctcgtgctcccactgttggtggcagaggctgccgccgccccagcattcttggaagccttcgccgcaaacgtcctcgaaccacgggagcatgccttgctgacgctgttacttgtatacgggcctagagagggcggccgaggggcccccgatccttttcttggagtgaaggcggctgccgccgaactggagcgcagataccccgggacaaggcttgcctggctggccgtgcgcgccgaggcccccagccaggttcggcttatggacgtggtctcgaagaaacacccagtggatacgctgttctttctgacgaccgtctggacaagaccaggacctgaggtgctcaatcgctgccgaatgaatgctatttccggctggcaggctttctttccagtgcacttccaggagttcaatcctgccctgtccccacagcgttcgcccccaccaaatctgattactttccctcttagcgcgtcagccccaggacgagcaagacaggatgggggccagatagagaattgttgttgcattttctag

SEQ ID NO: 182859 - DNA, 6969 bp, Artificial Sequence
  Description of Artificial Sequence: Synthetic coding sequence
atgcagagcggcccccggccccccctgcccgcccccggcctggccctcgctctgacgttaaccatgctcgcacgcttggcttctgctgccagctttttcggtgaaaaccaccttgaagtaccagtggcaactgccctgacagatatcgacctgcaactgcaattctccacgtcccagcccgaggctctcctcctgctggccgcaggacctgctgaccacctactccttcaactttattctggcaggctgcaagtcagactcgtgctcgggcaggaggagctccgattgcaaacaccggccgagaccctcctcagcgactctatcccgcacacagtggtgctgacagtggtcgaagggtgggcaacacttagcgtggatgggttcttgaatgcttcaagtgcggtgcccggggcccctctcgaggtcccttatggactcttcgtgggaggaaccggtacccttggcttgccatatctgcggggcaccagccgccctctccgcggctgcttgcacgctgcaacacttaacgggaggagtctactgaggcctcttacgccagacgtccacgaagggtgcgcggaggaattttccgcttccgacgacgtggcattaggattttccggcccccacagcctggccgcctttcccgcctggggaacacaagacgagggcactttagagttcaccttaaccacccagtcacgccaggcacctttagctttccaagctggaggcagacgaggggattttatatacgtggatatcttcgaaggacatttaagagccgtggttgaaaaaggtcagggcactgttctgctccacaacagcgtccccgtcgccgacggccaaccacacgaggtgagtgttcatattaacgcccatcgattggagatcagcgtggatcaataccctacacacacaagcaatagaggcgtcttgtcatatctcgagcctagaggctctctgttgcttggtggactcgacgcagaggcttcgcggcatctgcaagagcacaggctgggtctgacaccggaagcaacgaatgctagccttctgggatgtatggaagatctctcagtgaacgggcaaagaagaggcctgcgggaagccctgctcacgcgcaacatggcggccggctgccgcctggaggaggaggaatacgaggatgatgcgtacggtcattatgaagcgttcagcacactggctcccgaggcttggccagcaatggagctgccagagccttgtgttccagaacccgggctgccccctgtcttcgcaaattttacacagctgcttaccatctctccccttgtggtcgctgaggggggtactgcatggctggagtggagacatgtccagcctactctcgatctgatggaggcggagctgaggaaatcacaagtcctgttttccgttacccggggtgctagacacggagaactagagcttgacattcctggggcacaggctcgaaaaatgttcactttgctcgacgtggtgaataggaaggccaggtttattcatgacgggtctgaagacacgtccgaccagctggtgttggaggtctccgtgactgcgagggtgcccatgccgtcttgccttcgtagggggcagacctatctgctccctattcaggtcaatccggtgaatgaccccccacatattatttttccacacggctcactgatggtgattctcgagcatacacagaagcccctgggtcctgaagtgttccaggcctatgacccagattccgcgtgcgagggattgacatttcaggtcctgggaactagttctggtttgcctgttgaacgcagagaccagcctggcgaaccagcaacggagttttcttgtagggagctcgaagcgggctcactggtgtatgtccaccgaggggggccagctcaggacttgacctttagggtgtccgatggcctccaggcatctcctcctgctacactaaaagtcgtcgcgatcagaccggctatccaaattcataggagtactggactcagactcgcccagggctcagccatgccaatcttacctgcgaacctgagcgtggagacaaatgctgtcggccaggatgtctcagtgctcttccgcgtgacgggagccctccagtttggggagctgcagaaacagggagcggggggcgttgaaggcgccgagtggtgggcaacccaggctttccaccagagagatgtggagcaagggcgggtgcgctatctctcgacggacccccagcatcacgcatatgatactgtggagaacttagcactggaagtgcaggtgggtcaggagattttatctaatttatcctttccagtcactatccaacgggctacggtgtggatgttaaggcttgagccattgcacactcaaaacacgcagcaggaaacattgactacagctcatcttgaggcaacacttgaggaagccggaccatctccccccacatttcattatgaggttgtccaggccccacggaagggcaatctacaactccaaggtacaagactctcggatggacagggcttcacccaggatgatatccaggctgggagagtgacctacggcgcaacagcccgcgcgagcgaggccgtcgaggatacgttccgcttccgcgtcaccgccccaccttatttctcacctctctacaccttccctatccacattgggggcgatccggatgcacccgtccttactaacgtccttctggttgtgccagaaggtggtgagggtgtgctgagtgcagatcatttgtttgttaagtccctgaattcagcctcctacctctacgaggtgatggagaggcctaggcatggacgtctggcctggagggggacccaggataaaactaccatggttacctcatttacgaacgaggatctgctgaggggcagactggtgtaccaacatgatgactcagaaaccacagaagacgacataccatttgtcgcgacacgccagggcgaatcctccggcgacatggcctgggaagaggttaggggtgtgtttcgcgttgccattcagcctgtgaatgaccatgcgcctgtgcagacgatctctaggatcttccacgtagcacgcggcggacgccgtcttctgacaacagatgacgtagcattcagtgatgcggatagtggttttgcagatgctcagctagtactgactcggaaagacctgctgtttggcagcatcgtggcagttgacgagccaacacggcccatttaccgattcacccaggaggatctgcggaagagacgggtgctgtttgtccactctggagccgaccgtgggtggatccagctgcaggttagcgacggtcagcatcaggcaactgccctgctagaagtgcaagcctccgagccatatctgcgagtcgccaacgggtcatccctggtggtccctcagggtgggcaagggacaatcgatacagctgtgctgcacctcgatacaaacctggacatcagaagcggagatgaagttcactaccatgtgaccgccggtcctagatggggccaactcgtgagagccggccaaccagccacggctttttctcagcaggacctacttgatggcgcagtgctctactctcacaacggttctctgtcccctcgggacacaatggcgttttctgttgaagcaggtccagttcatactgatgccaccctccaagtgacgattgccctcgagggtccattggcccccctgaagctcgtgcgacacaaaaagatctacgtgttccagggcgaggccgctgaaataagaagagatcagctggaggcggcacaagaggccgttccccctgcggatattgtgttcagcgttaagtcacctccaagtgctggatatctggtgatggtgtctcgcggcgcactggcagatgagcctccatccctggatcctgtccagtcgttctcacaggaagccgtagatactggaagagtcctatacctgcacagccgcccagaagcttggagtgacgcattttcgttggacgtggccagtggactgggggctccgttggagggcgtacttgtcgagctggaagttctccctgctgccatccctctggaggctcagaatttctctgttcccgagggcggcagcttgactctggcccctccactgcttagggtcagcggaccctattttcccacattgctgggcttgtcactccaggtcttagagcccccccagcatggggcactccagaaagaagacggcccacaagcacgcacgctgtccgcattttcttggcgcatggtcgaggaacaacttatccgctacgtccacgacggctcagaaactctaaccgattcttttgtactcatggctaatgcttccgagatggatcgacagtcacatcctgtagccttcacagtgaccgtgctcccggtcaacgaccaaccgcccattctaactaccaacaccggccttcagatgtgggagggcgcaaccgcccctatcccggcagaggcattaaggagtacagatggcgattcaggttctgaggatctcgtgtataccatcgagcagccatcaaatggcagagtggtgcttcggggcgctccaggaacggaagtgcgtagcttcactcaggctcagctggacggtgggctggtcctgttcagccacagaggaaccctggatggcgggttcaggttcaggctcagcgacggagagcacacctctcctggacacttctttagggtgaccgctcagaaacaggtgttgcttagtctaaagggatcacagactctcacagtgtgtccaggctccgttcaacctttatcatcacagactcttagggcatccagctccgccgggacagacccacagctgctcctgtatagggttgttcggggtccgcagcttggacggctgttccatgcccaacaggatagtaccggcgaggcattagtgaactttactcaagctgaggtgtatgccggaaacattctgtacgaacacgaaatgcctccagagcctttctgggaggctcacgacactctagaactgcagctgtcgtctcccccagccagagacgtggcggcaacactggcagtggctgtctcgttcgaggccgcctgcccgcagaggcctagccatctctggaagaacaagggcctgtgggtgcctgaggggcagcgcgccagaataaccgttgccgcgctggatgcgtcaaatctgctggcttccgtgccaagccctcaacggtccgaacacgatgtcctctttcaggtcactcagtttccatcacgcggtcagttgctggtgtccgaggagcccctccacgcaggccagccacattttctgcagagccaactcgcagccgggcagctggtgtatgcacacggcggcggcggcactcagcaggacgggtttcatttcagagcacacttacaaggaccagctggcgcctccgtcgcgggccctcagacctccgaagctttcgctatcaccgtgcgggatgtgaatgagcgcccacctcaacctcaggctagcgtgcccttgcggttgactcggggctcaagggctcccatttcaagagcccaactcagcgttgtggaccccgactccgcgccgggcgagatcgaatatgaggttcaaagagcgcctcataacggctttctatccctcgtgggaggaggcctcgggcccgtcactcgctttacacaggcagatgtggatagcggaaggctggcattcgtcgccaacggttcatccgtcgcgggaatctttcagttgtccatgagcgatggcgcatctccaccattacctatgtctctcgctgtggacattctaccgagcgcaatcgaggtacagctgagggctcccctcgaagtccctcaggccctgggtaggagcagcctcagccagcagcaactgcgggtcgtctcagaccgtgaagagcctgaggcagcctaccgcctgatccagggaccccagtacgggcatctccttgttggcggaagacctacttctgccttttcccaatttcagatcgatcaaggcgaggtggtgttcgcctttaccaacttttcatccagccacgatcactttagggtcctcgcactggccagaggggtgaacgcgtccgccgtcgtgaacgtgacagtacgtgctcttctgcatgtgtgggcgggcggtccctggccccagggcgccaccctccgcttggatccgaccgtcctcgatgcaggagagctggccaacagaacaggtagtgtccctcgattccggttgctggaaggcccaaggcatggccgcgtggtgagggtgccacgggccagaacggaacccggcggctcccaactggtggagcaattcacccagcaggatttagaggacggcaggctcggtctggaggtaggaagaccagaaggtcgggcccctggcccagctggcgactcattgacactcgagttgtgggcccagggcgtgccaccagcagtggcaagtctagatttcgcaactgaaccctataatgctgcccggccctactcagtcgcgcttctcagtgtgcctgaggcagcaaggactgaagccggaaaaccagagtcctccacacccaccggcgaacctgggccaatggcaagctctcctgagccggccgtagccaaaggcgggttcctgtcctttctggaagcgaacatgttctccgtgatcattcccatgtgtctggtgttgctcctgctcgcgctgattttgcctctgcttttttaccttcgcaaaagaaacaagaccgggaaacatgacgttcaagtgttaacggcaaagcctagaaatggtctagcgggcgacacagagaccttccggaaagtggagcctggccaggcgatcccccttaccgccgtaccgggccagggtccccctcccggagggcaaccggatcccgaactgctgcagttttgtaggaccccaaacccagccctgaagaatgggcaatactgggtttag

SEQ ID NO: 182860 - DNA, 984 bp, Artificial Sequence
  Description of Artificial Sequence: Synthetic coding sequence
gagcagcaccgggaggagcccgaggccgcctaccggctgatccagggcccacagtacggccatctgctggttgggggacggcccactagtgctttttcccagtttcagattgaccagggagaagtggtgtttgccttcacgaatttttccagcagtcatgaccacttcagggtcctggctctagcccgcggtgttaatgcctctgctgtagtcaatgtcactgtgcgagcactcctacacgtttgggccggcgggccctggcctcagggggccactctcagactggacccaacggtgctggatgctggagaactggctaacagaaccggttccgtcccacgatttcgtttactggagggaccccggcatggacgggtggtgcgggtccccagagcccgcaccgagcctggcggttcccagttagtggaacagttcacccaacaggaccttgaggatggcaggctcggactggaggtcggccggccagaaggaagggcaccaggacccgccggcgatagcctcacattggagctgtgggcccagggagtgccccccgccgtggccagcctggactttgcaaccgaaccttataacgccgcacggccttatagcgtggccctgctgtccgtgcctgaagccgcccggacagaggctggcaagccagagtcttcaactccaaccggggagcctggaccgatggcaagctctccagagcctgccgtcgccaagggtgggttcctcagtttcctggaggccaacatgtttagcgtaatcattcctatgtgtctggttcttctactgttggcattaatcctccctctgctgttctacctgcgaaaacgtaacaagaccggcaaacatgatgtgcaggtgttaacggcaaaacctagaaacggtctggccggtgatacagaaaccttcaggaaggtggagccaggacaggcgatacccttgaccgccgtgccgggccagggcccaccgtag

SEQ ID NO: 182861 - DNA, 2409 bp, Artificial Sequence
  Description of Artificial Sequence: Synthetic coding sequence
atggccgcccggggccggcgggcctggctgagcgtgctgctgggcctggttctcggcttcgtgctagcctctaggttagtgctgccacgagcatctgaactaaaacgcgccgggccacggaggcgagcatctccagagggatgtcgcagtggacaggccgctgcatcccaggcaggaggtgctcgcggagatgcccggggtgcccagttgtggcctcctgggtcagacccagatggcggaccccgtgacagaaacttcctgttcgtcggtgtcatgacggcacagaagtacttgcaaaccagggcagtggccgcataccgaacctggtcaaagaccatacccggtaaggtccagttcttctctagcgaaggttccgatactagcgtgcccataccggtggtacctctccgcggagtggatgatagctatccgccccaaaaaaaaagttttatgatgctaaagtacatgcacgatcactacctggacaagtatgaatggttcatgcgggccgatgatgatgtttacattaagggggaccgtctggagaatttcctgcggagtctgaatagttctgaaccattgttcttagggcagaccggcctcgggactaccgaagaaatgggaaagctagcactggaacctggcgaaaatttctgtatgggcgggcctggggtcattatgtctcgtgaagtgctgagaaggatggttcctcatatcggcaaatgtctccgagagatgtacactactcatgaggatgtggaggtgggacgttgtgtgcgccggtttgcgggggtccagtgcgtgtggtcatatgaaatgcagcagttattctacgaaaattatgagcagaacaaaaaggggtacatccgtgatctgcataactctaaaatccaccaggcgattactcttcaccccaacaagaatcccccctaccagtatcgacttcactcttatatgctgtctcggaagatttccgaactcagacataggaccattcagctgcacagggaaatcgtcctgatgtccaaatattctaataccgagatccataaggaagatttacaactcgggattcctccaagctttatgcgcttccagcctcgccagcgcgaggaaatcctcgaatgggagttcttgactgggaagtacctgtattctgccgtggacggccagccacccagaaggggaatggattccgcacagagggaagcactggacgacatcgtaatgcaggttatggagatgatcaatgctaatgccaagacccgtggtcgcattatcgactttaaagagatccagtatggctacagacgtgtcaatcccatgtacggggcagagtatatcctggatttgcttcttctgtacaaaaaacataaagggaagaagatgactgtcccagtcagaaggcatgcatacctgcaacagactttcagcaaaatccagtttgtagagcacgaggagttagacgcacaagagctggccaaacgtatcaatcaggagtccggctccttatcttttctgagcaactccctgaagaagcttgtcccatttcagctaccagggagtaagtctgaacataaagagccaaaagataagaagattaatatacttattccattaagcggccgcttcgatatgttcgtgcgattcatgggtaattttgaaaagacgtgccttatccctaaccagaatgttaaattggtggtgctccttttcaattccgattccaatccagacaaagctaagcaggttgagctgatgcgggattatcgaattaagtatccgaaggccgatatgcagatcctgcctgttagcggagagttcagcagggcccttgcccttgaggtcggaagttcccagtttaataacgaatctttactatttttttgtgatgtggatctggtgttcacaacagagttcctgcagaggtgcagggccaacacagtccttggtcaacagatctatttcccaatcatcttctctcagtacgacccgaagattgtttatagcggcaaagtaccgtctgacaaccatttcgcgttcacccagaaaacaggcttctggcgcaactacggattcgggatcacctgtatttataaaggcgatctggtccgagtgggaggattcgatgtgtctatccagggttggggactggaggacgtggacctcttcaataaagtggtacaggctggacttaagacctttagatcccaggaggtaggggttgtgcacgtccaccaccccgtgttttgtgatcccaacctggacccaaagcaatataaaatgtgtctgggaagcaaagcctctacctacgggtctacccaacagttagcggaaatgtggcttgagaaaaacgacccttcctatagcaaaagcagcaataacaacggcagtgtacgcactgcctag

SEQ ID NO: 182862 - DNA, 2649 bp, Artificial Sequence
  Description of Artificial Sequence: Synthetic coding sequence
atggccgtgcggagccggcggccctggatgagcgtggccctgggcctggtgctggggttcacagcagcctcgtggctcattgcaccaagagtggccgagctaagcgaaagaaagaggcgagggagttctctttgctcgtattatggccgctctgctgctgggcccagggccggggctcagcagcctctcccccaacctcagagtcgacccaggcaggaacagagccccccgcccgctcgccaggatctgcaggggcctcccctgcccgaggctgcccctggaattacaagtttccgcagcagtccatggcagcaacctccacccctgcagcagcggcgtagggggcgcgagcctgaaggtgcaaccggactgcctggtgcccctgccgccgagggagaacccgaagaggaagatggtggcgctgcagggcagaggcgtgacggaagacccggatcttctcacaacggctccggagacggaggggctgctgcaccgagtgctaggccccgagacttcctctacgtgggcgtgatgaccgcgcagaaatacctggggagcagggccctcgccgcccagagaacctgggcccggttcatccctgggagggtcgagtttttctccagccagcagccaccaaacgcaggccaacctccccctcctctgcctgtgatcgcactgcccggagtggacgacagttaccccccacaaaaaaaatcattcatgatgatcaagtatatgcacgaccactacctggacaagtacgagtggtttatgcgggcagacgatgatgtttacattaaaggcgacaaattggaggagtttctgcgaagccttaactcatccaaacctctgtacttaggacagacaggcctaggcaatatcgaggagctgggcaaattggggttagagcccggggaaaatttctgcatgggcggaccgggtatgatttttagtcgggaggtgttgcgacgcatggtcccccacataggcgaatgtctgcgtgaaatgtacaccactcacgaagacgtagaggtaggcaggtgcgtcaggagattcgggggtacgcagtgtgtctggagttatgaaatgcaacagctgttccacgagaattatgaacacaatcgcaaagggtacattcaggacctccataactccaaaatccatgcagctatcacccttcaccctaacaaacggcccgcctatcaataccggctgcataattacatgctcagccgaaaaatctcagaactcaggtaccgcacaattcagctgcatcgcgaatctgcactgatgagcaagctctcaaacacggaggtgagcaaggaagaccaacagctcggggtgataccgagctttaatcactttcagccccgggagcgcaatgaggttatcgaatgggagttcttgaccggcaaattactgtactccgccgcagaaaaccagcccccacgccagagtttgtcatccattctgaggacggctctcgatgacacagtgcttcaggtgatggagatgatcaatgagaatgcaaagagccggggccgcctaatagatttcaaagaaattcagtatggatatcgacgagttaaccctatgcacggggttgaatatatactcgacctgctgttactgtacaaacggcacaaaggaagaaaactcactgttcctgtgagacgccacgcgtatctgcaacaactattctccaagccattctttagggagacggaagaactcgacgtaaatagcttggtcgaaagtatcaatagcgaaacacagagtttctcttttatctcgaatagcttgaaaatcctctcctcattccagggagccaaagagatggggggccataacgaaaagaaagtgcacatcctcgtgcccctcatcggacggtacgacatctttcttcgctttatggagaacttcgagaatatgtgtctaattccgaagcagaatgtgaaactggtgatcatcctcttcagccgagacagcggccaggatagttcaaagcatattgagctgatcaaagggtatcaaaataaatatcccaaagccgaaatgactctgatcccaatgaagggcgagttttcacgcggactgggtctggagatggccagcgcccaattcgacaacgacaccctgctcctgttctgtgatgttgacctgatcttcagggaggatttcctgcaaaggtgccgagataataccatccaaggacagcaggtgtactacccgataattttctctcaatacgatcccaaggtcaccaatggcggcaaccccccaaccgatgactactttattttctccaagaagaccgggttctggcgcgactacggatacggtatcacatgtatctacaaatctgaccttttgggcgctggcggattcgacaccagcatccagggttggggactcgaggacgtggacctgtacaataaagtgatcttgtccggtctaagacccttccggtctcaagaggtgggcgtggtgcatatctttcatcccgtgcactgtgaccctaatctggatcccaagcaatacaaaatgtgtctaggcagcaaggcttctacattcgcttcaacaatgcagctagccgaactctggcttgaaaaacacttgggcgtaagatacaatcggacactgtcctag

SEQ ID NO: 182863 - DNA, 2868 bp, Artificial Sequence
  Description of Artificial Sequence: Synthetic coding sequence
atgcccagcctgcccgccccccccgcccccctgctgctgctgggcctactgctccttgggtctcggccagcccgcggagcaggtccagagcctcctgtcctgcccataaggtcagagaaagagccacttcctgttaggggggccgctgggtgcactttcggtgggaaggtatatgcgttggacgagacttggcaccctgacctgggtgaaccgttcggggttatgcgctgcgtgctgtgtgcctgcgaggcaccccagtggggacgacgaacacggggacccgggcgcgtatcgtgtaagaatattaagcctgaatgtccaactccagcttgcggccagccacgacaacttcccgggcactgttgccagacctgtccccaagagagaagctctagcgaacgccagccctccggcctgagttttgaataccctcgtgatcctgagcataggtcatattccgacaggggcgagccaggtgcggaggagagagcaaggggagatgggcacaccgacttcgtagccttattgacaggcccccgatcccaggccgttgccagggcccgagtatctcttttgagatcttccctaaggttctcgattagttaccggcgtctcgaccggccaacaagaatacgtttctccgattccaatggttctgttctgttcgagcaccccgccgcccctacgcaggatggtttggtctgtggcgtctggagggctgtcccacgcctaagccttcgcctcttgagagcagagcagcttcatgttgccctcgtcacccttacgcacccatctggcgaagtgtgggggcccctgatacgacatcgcgcactcgctgccgaaacgttcagtgctattttaacacttgaaggccctccccagcaaggagtagggggcatcacgctgcttactctgtccgatacagaggattctctacattttctcttattgtttagaggcctgttagagccacgcagcggcgggttaacacaggtgccgctgaggctgcaaatcctccaccagggtcagctgctgcgcgagcttcaggcaaatgtctccgctcaggagcccggattcgccgaggtgctgccaaatctaacagtgcaagaaatggattggcttgtgctaggtgaattacagatggccctggaatgggcagggagacccggtctgcgcatatctgggcacatcgccgccagaaaatcctgcgacgtgctccagtccgtgctatgtggcgcagacgccctcataccagtccagactggagccgccggctcagctagcctgacactgctgggaaatggaagtctgatttaccaggtccaggtggtaggcaccagttccgaggttgtcgctatgactctggagacaaaaccacagagaagggaccaacgcaccgttctttgtcatatggcaggtctgcagcccggtggccacaccgcggtgggcatctgtcccggactgggcgcacgcggcgcccatatgctgctgcaaaatgaattgtttctcaacgtaggcacgaaggattttccagacggggaactgcggggacatgtagccgctctgccctattgtgggcactcagcccggcatgacacattacctgtgcctctggcaggagccctagtgctgccaccagtcaaatctcaggccgccgggcatgcctggctctcactcgacactcattgtcacctgcactatgaagtccttctggctgggctgggtggctccgagcaaggaacagtgaccgcccatctgcttgggccacccggaacccccggtcctcggcgcctgctcaaaggcttctatggctccgaggcccagggcgtcgtaaaagatctcgaaccagaattgctgcggcacctcgccaagggaatggcttctttgatgatcactactaaaggatcccctcggggggagttgcggggccaggttcatatcgccaatcagtgtgaagttggaggtctccgcctcgaagctgccggtgctgaaggcgtccgagccctgggagcacccgacactgcttcagcagccccccctgtggtgcccggcctccctgcgcttgccccggctaagcctggcgggcccggtagaccccgcgatcccaatacctgcttcttcgaaggacaacaacgtcctcacggcgcacgatgggcacccaactacgatccactttgctcactgtgcacctgtcagagaaggaccgtgatatgtgatcctgtggtctgcccgcccccatcttgtccgcaccccgtgcaggcaccagatcaatgctgtcctgtgtgccctgagaagcaggatgttcgagatctcccggggctccctagaagcagagatcctggagagggatgctatttcgatggagataggtcttggagggcggccggtactcggtggcaccccgtggtgcctccttttggtttgataaagtgcgctgtgtgcacctgtaaaggaggcactggagaggtccattgcgagaaggtgcagtgtccaagactggcctgcgcccagccggttcgggtcaatccaactgactgttgcaagcagtgcccggtcggaagtggagcccatccacagctgggggacccgatgcaggccgacggtcccagggggtgccgctttgccgggcagtggtttccagagtcccaatcctggcacccctctgtgcccccctttggggagatgagctgcatcacgtgtaggtgcggcgctggagtgccgcattgcgagagagacgactgcagtctgccccttagttgcggaagtggcaaggagagccgatgctgctctcgctgcacggcccacagaagacctgcccccgagactcggacagaccccgagctggagaaagaggccgagggcagctag

SEQ ID NO: 182864 - DNA, 285 bp, Artificial Sequence
  Description of Artificial Sequence: Synthetic coding sequence
atgcccagcctgcccgccccccccgcccccctgctgctgctgggcctgttgttgctggggtcgagacctgcccggggcgctggaccagaaccacccgtgctccctattcgtagcgagaaggagcccctacctgtgaggggggctgccgggtgcacgttcggggggaaagtttatgctttagacgagacatggcacccagatctgggagagccctttggggtcatgcgctgcgtcctgtgtgcctgcgaggcaaccggtacactcaggccaagagagatgaagtag

SEQ ID NO: 182865 - DNA, 1512 bp, Artificial Sequence
  Description of Artificial Sequence: Synthetic coding sequence
ggcgagcacctgagccagaagggcccccacgtgcggccctgccggacaaaccctgggagcctggaggcccccgattccacgcctggcgcagccacagcacgcactagcgggcagtgcctaagccccggcgaatgggggagtggctcgagatgccatctgtcttggcctctggctatcgcccatcacacgctgttgtgtccacaggagccaggtttcgctgaggtgcttccaaacctcaccgtccaggaaatggattggctggtccttggggagttgcagatggctctggaatgggccgggcggcccggactgaggatctctgggcacattgcagcccgtaagtcttgtgacgtccttcagagcgttttgtgtggcgctgacgccctaatccccgtgcaaaccggtgcagccggctcggcttcacttacgctgctaggtaacggtagccttatctaccaggttcaagtggtgggaacttcttctgaggtggtggcaatgactttagaaacaaagccccagaggagggatcagcgtacagtgctgtgccatatggccggccttcagcccggaggacacacggccgtaggcatttgtcctggattaggagcaagaggagctcacatgcttctgcagaatgaactgttcctcaacgtgggaactaaagatttcccggacggcgaactacgtggtcacgtggccgccctgccatattgtggtcacagcgctcgccacgatacattgcccgtcccactggcaggagctttagtgctccccccagtgaagtcccaggccgccggtcacgcctggctttccctggacacccactgtcatttacattatgaggtgctcctcgctggattggggggctcagagcagggcacagtaacagcccatcttttaggcccacccggaactcccggtccacgaaggctgctcaaagggttttacggatcggaagcccaaggggtggtgaaggatctggagcctgaactgctcagacacctggctaagggcatggcttctttgatgattacgaccaaaggctctcccagaggcgagctgagagggcaggtgcacatcgcgaatcagtgtgaagttggggggctgcgactcgaagcagcaggcgcagagggtgtgcgcgcattgggtgccccggatacagccagcgcagcgccgcctgtcgtgcccggccttccagccctggcgcccgcaaagccgggtggacccggccgtcccagagatccaaatacctgcttcttcgaaggtcagcagcggccacacggcgcccgctgggctccgaattatgacccactgtgctctctgtgtacatgtcaaagaagaacagttatctgcgaccctgtggtgtgccccccaccaagctgcccacaccctgtgcaggcccctgatcaatgctgccctgtgtgccctgaaaaacaggacgtgcgggacctaccagggttaccaaggtcgcgtgaccctggtgaaggtggccattggcggggcgcactctag

SEQ ID NO: 182866 - DNA, 2748 bp, Artificial Sequence
  Description of Artificial Sequence: Synthetic coding sequence
atgcccagcctgcccgccccccccgcccccctgctgctgctgggcttgttactactggggtctaggccagcgcggggagccggtccggagccccctgtcctcccgatccgcagcgagaaggagcctctacctgtgcgcggggccgccggctgcaccttcggcgggaaagtctacgccctagacgagacttggcatcccgatcttggagaaccttttggggtcatgcgatgtgttctgtgtgcttgtgaggccccccagtgggggaggcggactcgaggccccggccgtgtaagttgcaaaaatattaaacctgagtgcccaacacctgcctgcggccagccacgtcagctgccaggtcactgttgccagacctgtcctcaggagagatcaagttccgagcgccaacccagcggactctctttcgagtaccccagggatcccgagcatcgttcatattctgaccggggggagccaggcgctgaggaacgtgcgagaggcgacggccatactgacttcgtagctctcttaacaggcccacgatctcaggcggtggctagagcccgcgtttccctcctgcggtcctccttacgcttcagcatctcctatcggaggttggacagaccgacacggattagatttagcgatagtaatgggtccgtgctcttcgaacatccagctgctccaacccaggatggattggtatgtggggtttggagggccgtgcctcgcctgagtctcagattactacgcgcagaacagcttcacgtggccttggtcacactgactcatcccagcggtgaagtgtgggggccactgataaggcaccgggcactggctgcggaaaccttctccgctattcttacacttgagggaccacctcagcagggcgtaggcggcatcaccttgctcacactgtcagatacggaggatagtctacatttcctccttctatttcgtggcctgctcgaaccgcggtccggcgggttgactcaggtacccttacgtctgcagattttgcatcagggtcagctccttagggaactgcaggcaaacgtctccgcgcaggagccaggctttgctgaagttcttcccaatcttacagtgcaggaaatggactggctggtccttggtgagctgcagatggccctggaatgggccggcaggccaggactgcgcatttctggccacattgccgcgaggaagagctgcgacgtattgcagagtgtcttgtgcggcgcagacgctctgatccctgtacagaccggcgccgcagggtctgctagcctgacattgttgggcaacggttccctaatctaccaggcagtcgggatttgccctggtctgggcgcccgaggagctcacatgctgttgcagaacgagttgtttctcaacgtggggacaaaagactttccagacggtgaactccgtggtcatgtggctgctctgccatactgcggtcactctgcacgtcacgataccctgcctgtgccactggccggcgctctggttctccctcccgtgaaatcccaggccgcgggacatgcctggttgagcctggacacacattgccacctgcactatgaggtcctgctggccgggttgggaggtagcgagcaaggtaccgttactgctcacctattaggtccccccgggaccccagggccgcggcgcttgcttaaaggcttttatgggagcgaggcacagggagtggtcaaggatcttgaacctgagctcctgcgccacctggccaagggtatggcctcgctcatgataaccactaagggaagccctcgaggggaactccgaggacaggtgcacatcgccaatcagtgcgaggtgggtggtcttaggctggaggctgccggagccgagggcgtcagggctctcggcgccccagacaccgcctcagcagcaccaccggtggtacctggcctgccagctctcgcacctgccaagccagggggcccgggtaggccaagggatcctaacacctgtttctttgagggtcagcagcgacctcacggtgccagatgggctcccaattacgatccattatgttccctctgcacgtgccagcgccggacagtgatctgtgaccccgttgtttgccccccccctagttgcccccaccccgtccaggctccagaccagtgctgcccagtctgcccagagaagcaagacgttcgggatctgcctggcctaccacgttcacgggacccaggggagggctgttacttcgatggagatcggagctggagagctgctggcacaagatggcatcctgtcgtgcccccatttgggctaataaagtgcgcggtctgcacttgcaaaggtggtaccggggaggtgcattgtgaaaaagtgcagtgcccacgcctggcctgcgcacagcccgtaagggtgaaccccacagattgctgcaagcaatgcccggtggggagcggcgctcaccctcaactcggagaccctatgcaggctgatggccctcgcggttgtcggtttgctggtcagtggtttcctgagagccagtcctggcacccatccgtgcctccatttggtgaaatgagctgcattacgtgccgttgtggcgcaggggtgccccattgcgaaagggacgactgctcactgcctctctcgtgcggatcaggaaaggagtcccgatgttgtagcagatgcacagcacaccgccgccctgcccctgaaactaggacagatcccgagttagaaaaggaagctgagggatcctag

SEQ ID NO: 182867 - DNA, 1494 bp, Artificial Sequence
  Description of Artificial Sequence: Synthetic coding sequence
atggactggctggtgctgggcgagctgcagatggccctggagtgggctggacgccctggactccgcatctctggccatatcgcagctagaaagtcatgcgatgtgttacagtccgtactgtgtggagccgatgccctgatcccagtgcaaaccggcgccgcgggatcagccagcctgaccctacttggaaatgggtcactgatctatcaggttcaggtcgtggggacttccagcgaggtcgtagcaatgacactggaaacaaaaccccagagacgggaccagcggaccgtactgtgccacatggccggcctgcagcccggtggccacactgctgtgggcatttgtcctggactgggggcccggggcgcccacatgctgttacagaacgaactgtttctgaacgtcggaaccaaggatttccccgatggagaacttcgtggccacgtggccgctctgccttattgcggtcacagcgccagacacgatacgcttccagtgccattggccggcgcacttgtccttcctcccgtaaaaagtcaagccgcaggccacgcatggctgtcactcgacactcactgccatttgcactatgaggtgctcctcgctggcctgggcggttctgagcagggcacggttactgctcatctcttggggccgcctggcacaccgggacctcgccggctgctaaaggggttctatgggtccgaggcacagggcgttgtcaaggacctcgagcctgagctgctgcggcatctcgccaagggcatggcaagcctcatgatcacaactaaggggagtcctagaggcgaactgcgaggccaacgccgtacggtgatctgtgaccctgtagtgtgcccaccgcccagctgcccacaccctgtacaggccccggatcagtgctgccccgtttgccccgaaaagcaggatgtccgtgatctccctggcctgcccaggtcaagggatcctggtgaaggttgctattttgacggagatcgcagttggcgcgccgccgggactcgctggcacccagtggtcccaccgtttgggctgatcaaatgcgccgtgtgtacgtgtaagggcgggacaggcgaggtgcattgcgagaaagttcagtgtcccagacttgcatgcgcacagccagtacgggtgaacccaactgattgttgtaagcaatgccccgtggggtcaggagcgcacccccaactgggggaccccatgcaggccgatggcccccgcggctgcagatttgccgggcaatggttccctgaaagtcagtcctggcatccttccgttccaccctttggcgaaatgagttgtattacctgtcgctgtggcgctggggtacctcactgtgagagggatgattgcagtctgcctctctcctgtgggtcgggaaaggagagccgatgctgctccaggtgcaccgcacacagaagacccgctccggagacacggaccgaccccgagctggaaaaagaggctgagggatcatag

SEQ ID NO: 182868 - DNA, 3126 bp, Artificial Sequence
  Description of Artificial Sequence: Synthetic coding sequence
atggagaacatgttcctgcagagcagcatgctgacctgcatcttcctgctcatcagcggcagttgcgaattatgcgcagaagagaatttttcaaggtcatatccctgcgatgaaaaaaaacagaacgatagtgtcatcgctgagtgttccaacaggcggcttcaagaagtcccccaaacggtcggtaagtatgtgacagagctggacttatctgacaacttcatcacccacatcactaatgaatctttccaaggtctccagaatctcacaaaaattaacctgaaccataaccctaacgttcagcaccagaacgggaatcccgggatccagtccaatgggctgaacatcaccgacggcgcctttctcaacctgaagaacttaagagaactgctcctcgaagacaaccagctgccccaaatcccgtccgggctgcccgaatccttaaccgaactgtctctgattcagaataacatctataatatcaccaaggaagggatcagcaggcttattaaccttaagaacctctatctggcttggaactgttacttcaataaagtctgcgagaaaaccaacattgaggatggcgtgtttgagacccttaccaatcttgagctgctgtccctcagttttaactctctcagccacgtcccccctaaacttccctcttctctgcgtaaattattcctttccaacacacagattaaatatatctctgaggaggacttcaaaggcctcataaatctgacgctgctcgaccttagcggaaactgtccccgctgctttaacgctccatttccctgcgttccttgtgatggaggcgcatcgatcaacatcgacagattcgcctttcaaaatctcacacagctgagatacctcaatctgtccagtacgagtctgaggaagatcaacgcagcttggttcaagaatatgccacatctcaaagttctcgatctggagtttaactatctcgtcggcgagatcgcttccggcgctttcctgacaatgctgcctaggctagaaatcttagacctttcattcaactatatcaagggtagttaccctcagcacataaatatctccaggaatttctccaagctgctgtctctccgggccctgcacctccgcggctacgtgttccaggaacttagagaggacgactttcagcccctcatgcagctgccgaacttgtccacaataaatctgggtataaacttcattaagcagatagactttaagctgttccagaattttagtaatttagaaatcatttatctgagtgagaataggatctcaccgctagtcaaagacacaagacagagctatgccaattcctctagttttcagagacacatacgaaagcgacgctcaactgactttgaatttgacccgcacagcaatttttatcactttactagacccctgatcaagccccaatgtgccgcctacggcaaagctcttgacctgtctttgaacagtatcttctttattggtcctaaccagttcgagaatctccctgatattgcctgcctcaatctgtcagctaatagcaatgcccaggtgctgtccggaaccgaatttagcgccatcccacacgtgaaatacctagatctgacgaacaatagactggatttcgacaatgcctcggccctgacggaactgtctgatcttgaagtgctggatttatcctacaactctcattacttccggatcgctggggtcacacaccatctggagtttatacagaatttcactaacctcaaggtgctcaatctgagccacaataatatctacacactgacagacaagtataacctcgaatcaaaatcactggtcgagctcgtattcagtggcaatcgattggatatcctatggaacgatgacgacaaccgctatattagcatattcaaaggcttgaaaaacctgacaaggcttgatctgtccttaaaccggctgaaacatatcccgaatgaagcgttcctgaacctgcctgcctctctgaccgagctgcatattaacgacaacatgctaaagttttttaactggaccttattgcagcagttccccagattggaactgcttgatctgcgcgggaataaactgctgttcttaactgatagtctgagtgacttcacgtcttccttgcgcacactgttattgtcccacaaccgcataagccatctcccctcaggtttcttgagtgaagtctcttccttgaagcatttggacctttcctctaacctgctcaagacgatcaataagtcagccctcgaaacgaaaactacaactaaactatccatgctggagctgcacggcaatcccttcgagtgcacctgcgacattggcgattttcgacgttggatggacgaacacctcaatgtgaagatcccccgactggtggacgtgatctgcgctagccccggggaccagagaggcaaatctatagtttcccttgaactgaccacgtgcgtgtctgacgtgacggctgtcattttgttcttctttaccttcttcatcaccaccatggtgatgctagccgccctcgctcaccaccttttctattgggacgtttggtttatatacaatgtctgccttgccaaggtcaaagggtatcgctcattatcaacctctcaaaccttttatgatgcctatatcagctacgataccaaggacgcgagcgtgactgattgggtgatcaacgaactacggtaccacctagaagagtcccgggataagaacgtgctgttgtgtctcgaagaaagggattgggaccccggactggccattatcgacaatcttatgcagagcatcaaccagtccaagaagacagtgtttgtgctgaccaaaaagtacgctaagtcttggaactttaagaccgccttttatctcgcacttcagcgtcttatggacgagaacatggatgtcataatctttatcctgctggagccggttctgcagcacagtcagtacctccggctgaggcagcggatctgcaagtcttcgatccttcagtggcctgacaaccccaaagccgaggggctgttctggcagaccctgaggaacgtcgtgttgacggaaaacgatagtcgctataataacatgtatgtggatagcatcaaacagtattag

SEQ ID NO: 182869 - DNA, 1377 bp, Artificial Sequence
  Description of Artificial Sequence: Synthetic coding sequence
atgcggaagaagtggaagatgggcggcatgaagtacatcttcagcctgctgtttttcttattacttgaggggggtaaaactgaacaggtgaagcactctgaaacatattgcatgtttcaggataagaaatatagggtcggggagcgatggcatccttaccttgagccatacgggctggtgtattgtgtgaattgtatttgtagtgaaaacgggaatgttctttgttccagggtgcgatgccccaacgtccattgcctctcccctgttcacatcccccacctgtgctgtccaagatgtccagaggatagtctgccacctgtgaataataaggtgacctccaaatcctgtgaatataatggaaccacctaccagcatggcgagcttttcgtggctgaaggcttatttcagaaccgacagcctaatcagtgcacccagtgttcttgttccgaggggaacgtttactgcgggctgaagacctgcccaaagcttacttgtgcatttcccgtctcagttcccgactcatgttgtcgcgtgtgccgaggagatggcgagttatcatgggaacactccgacggggatatctttcgtcaaccagcaaatcgggaagccagacatagctaccatagatcacattacgacccacccccaagtaggcaggctggtggtctgtctcgattcccaggggcgaggagccatagaggagccctcatggacagccagcaggcctccggtaccatcgtccagatcgtgataaacaacaaacataagcatggccaagtgtgtgtgtctaatggaaagacttacagtcatggggagagctggcatccaaatctcagagcctttggaatcgtggagtgcgtactttgtacctgcaacgtgacgaagcaggaatgtaaaaaaatccattgtcccaataggtacccttgcaagtaccctcagaaaatcgacggtaagtgttgtaaggtctgtccgggaaagaaggctaaggaagaattaccaggacagagctttgataataaaggctacttttgtggagaagagactatgcccgtgtacgagtctgtgttcatggaggacggcgagacaacccgaaagatagctctggaaaccgaaagaccaccccaagttgaggtgcacgtctggaccattcgcaagggcattctgcaacacttccacatcgaaaaaatcagcaaaagaatgttcgaagagttgccacattttaagctggtgactagaacaactctcagccagtggaagatctttacagagggtgaggcgcagattagccagatgtgtagctcacgcgtgtgccgtacagagctagaggatctggtcaaggttctgtatctggagagatctgagaaaggccactgttag

SEQ ID NO: 182870 - DNA, 1353 bp, Artificial Sequence
  Description of Artificial Sequence: Synthetic coding sequence
atgggcggcatgaagtacatcttcagcctgctgttcttcctgctgctggaaggggggaagaccgagcaagtgaagcatagtgagacctactgcatgttccaggacaagaaataccgggtaggcgagcggtggcatccctatcttgagccttatggtctggtgtactgtgtcaactgtatctgcagtgagaatgggaacgtgctctgtagccgggtgcgttgtcctaacgtgcactgcttatcacccgtccatattccccacttgtgttgcccaaggtgcccagacagcctgcctcccgtaaacaataaagttacttctaagtcatgcgagtacaacggcacaacataccagcacggcgagctctttgtcgccgaaggactgttccaaaatcgccaaccaaatcagtgtactcaatgttcctgctccgaaggcaatgtctactgtggcctgaaaacctgtccgaagctgacatgtgcatttcccgtcagtgtaccggattcctgttgccgcgtatgtcggggggacggggagctttcctgggagcattctgacggagatatcttcagacagccggccaatagggaagcgcggcactcctatcaccgctcccactatgatccacctccaagccgccaagccggaggcctgagtcgcttcccaggagcaagaagccatagaggtgccctgatggattctcagcaagcctctgggacaatcgtgcagatcgtaataaataacaagcacaaacatggccaagtctgtgtctctaacgggaagacatatagtcacggcgaaagttggcatccaaatctccgcgcgtttggaatagtagaatgcgtcctgtgtacgtgtaacgtgaccaagcaagaatgtaagaaaattcactgtcccaaccgatatccatgcaagtatccacaaaagatcgatggaaaatgttgtaaagtgtgccccggcaagaaagccaaagaactacccggccagtcgttcgataacaagggatacttttgtggcgaagaaacaatgccggtctatgagagtgtgtttatggaggacggggagaccactagaaaaattgctctggaaacagagcggccccctcaggttgaagttcatgtgtggaccatacggaagggaatccttcagcattttcacattgaaaagatatctaagcggatgttcgaagaattgccgcactttaagctggtcactcgcacaactctgtcacagtggaagatctttacggaaggtgaagcccagatttcccagatgtgctcgagccgcgtgtgtcgtaccgaactcgaggacctggtgaaagtactgtacctggagcgttccgagaagggacattgttag

SEQ ID NO: 182871 - DNA, 1371 bp, Artificial Sequence
  Description of Artificial Sequence: Synthetic coding sequence
atgcggaagaagtggaagatgggcggcatgaagtacatcttcagcctcctctttttcttgttgctcgaggggggaaagacagaacaggtgaagcatagtgagacctactgcatgttccaggataaaaaatacagagttggagaaaggtggcatccatatctggaaccatacggattggtgtactgcgtgaactgcatctgcagcgagaatgggaatgtgttatgctcccgggtcaggtgcccaaacgttcactgccttagccccgtgcacattcctcatctgtgttgccctcgctgccctgattctctgccccctgtgaataacaaggtaaccagtaagtcctgcgaatataacggcaccacatatcagcatggagagttgtttgtggccgagggtctgttccagaacagacagcccaaccaatgcactcagtgctcttgttccgagggcaatgtatactgcggcctcaaaacttgcccaaagttgacctgtgcattcccagtcagcgtccctgacagttgctgtagagtgtgtagaggagatggtgaactgtcatgggaacatagcgatggcgacatcttccggcagccagccaatcgcgaggcccggcatagctatcaccggtctcattacgacccccctccctcgagacaggccggtggattgtcccgtttccccggggctcggagtcatcgtggggccctgatggatagccagcaagcttccggaaccatcgtgcagattgttattaacaacaaacacaaacacggccaggtatgtgtctccaacggaaaaacttacagccatggagagagctggcatccaaaccttcgggctttcgggattgtggaatgcgtgctgtgtacatgcaatgtcacgaagcaggaatgcaagaaaattcattgcccaaaccgctacccatgcaagtatccccagaagattgatggcaaatgttgcaaggtttgccctggtaagaaggctaaagagctcccgggtcaatccttcgacaacaaaggatatttctgcggcgaagaaaccatgccagtgtatgagagcgtcttcatggaggacggcgaaacaacgagaaaaattgccttggagactgagcggcccccccaggtagaagtacatgtttggacaattcggaaggggattctgcagcacttccacattgagaagatcagtaaacggatgttcgaggaactcccacactttaagttggtcactaggactaccctctcccaatggaagatttttactgagggtgaggcacagatttcccaaatgtgttcgtcccgcgtatgcagaactgagctggaggaccttgtcaaagtactttacttagaaagatctgagaaaggacactgctag

SEQ ID NO: 182872 - DNA, 1134 bp, Artificial Sequence
  Description of Artificial Sequence: Synthetic coding sequence
atgcggaagaagtggaagatgggcggcatgaagtacatcttcagcctcctgtttttcctgctgctcgaaggtggcaagaccgagcaagtcaaacactctgaaacgtattgtatgtttcaggataaaaagtatagggtcggagagaggtggcacccttacttggagccctacgggttggtctactgcgtaaattgtatttgcagcgaaaacggcaacgtcctgtgttctagagtcagatgccctaatgtgcattgcctctcccccgttcacataccacacttgtgctgcccacgatgccccggggacggtgagctcagttgggagcactccgacggagacatcttccggcaaccagcgaaccgggaagctcgtcacagttaccatcgatcgcattacgatccaccacctagtcgtcaggccggaggcctttcccgctttccaggcgccagatcacatagaggggcgctgatggattcacagcaggcgtctggtactatagtacagatagtgattaataataagcacaaacatggccaagtctgcgtgagtaacgggaagacctactcgcacggagaaagctggcaccccaatttacgagccttcggcatcgtcgaatgtgtactttgtacctgcaatgttaccaaacaggaatgtaaaaagatacattgtccgaataggtacccatgcaagtatcctcagaaaatcgacgggaagtgttgtaaggtttgtcccggcaagaaggccaaggagcttccgggacagtcttttgacaataagggttacttctgcggtgaggaaacaatgccagtatacgaatccgtcttcatggaggacggcgagactacgcggaagattgccttggaaacagaacgcccacctcaagtggaagtgcatgtgtggaccataaggaaaggcatcctgcagcacttccatatcgagaagatcagcaagcgcatgttcgaggaacttccccatttcaaacttgttacacggaccactctgagtcagtggaagatctttacagagggagaagcgcagatttcccagatgtgcagtagcagggtctgccgcaccgaattggaggatctggtcaaggtgctgtacctggaaagatccgaaaaggggcactgttag

SEQ ID NO: 182873 - DNA, 1374 bp, Artificial Sequence
  Description of Artificial Sequence: Synthetic coding sequence
atgcggaagaagtggaagatgggcggcatgaagtacatcttcagcctcctgttttttctgctgctcgagggagggaaaactgagcaggtgaagcacagcgagacatactgcatgttccaggataagaaataccgggtgggcgagcgctggcacccctatctggagccctatggcctagtgtattgcgtgaattgtatttgctcagaaaatgggaacgtactgtgttcacgcgtccggtgtcctaacgtgcattgtctgtccccagtgcatatccctcacctctgttgcccccgctgccccgattctctacctccagttaacaacaaagtgacctctaaaagctgcgagtacaatggtaccacataccagcacggagaactgtttgtggctgagggcttgtttcagaaccgccagccaaaccagtgcacacagtgctcctgcagcgaaggcaatgtttactgcggtttaaaaacctgccctaagttgacctgcgccttccctgtctccgtgccagacagttgttgtcgggtctgcaggggggacggggaactgtcttgggaacactctgacggagatatttttaggcagccggcaaatcgagaagcgcggcattcgtaccaccgaagccattacgacccgcctcccagtcgtcaagcaggcggcctctcccgcttccccggggccagatctcatcggggcgccctgatggactcccaacaggcctcagggactatcgtgcaaattgttattaacaataagcacaagcatggccaggtgtgtgtttcaaacggtaagacatactctcacggagagtcgtggcatcctaatcttcgagccttcggcattgtggagtgcgttctctgtacctgtaatgtgactaagcaggagtgcaagaagatccactgcccgaatagatacccctgcaagtaccctcagaaaatcgatggaaagtgctgcaaggtctgtcccgggaaaaaggccaaagaggagctcccggggcagagttttgataacaaaggatatttttgcggcgaggaaacaatgccagtctacgagtccgtatttatggaggacggcgaaacaacgaggaagattgctttagaaacagagagaccgccacaggttgaagtgcacgtgtggacaatcaggaaggggatcctgcagcactttcacatcgaaaagatatcaaagcgaatgttcgaagaattgcctcattttaaactcgtgacacggacaacgttgtcgcagtggaaaatcttcaccgaaggtgaggcgcagattagccagatgtgctcatcacgagtgtgcaggacagaattggaggacctggttaaagtcctgtacctggagcgcagcgaaaagggccactgctag

SEQ ID NO: 182874 - DNA, 1137 bp, Artificial Sequence
  Description of Artificial Sequence: Synthetic coding sequence
atgcggaagaagtggaagatgggcggcatgaagtacatcttcagcttactgtttttcttacttttggagggcggtaaaaccgagcaagtaaagcattccgagacttactgtatgttccaagataagaagtatagggtgggagaaagatggcacccatatctggagccatatggccttgtctattgcgtaaattgcatttgctcagagaatgggaatgtgctgtgctcaagagttcgctgccctaatgtgcactgcctttcacctgttcatataccccatctctgttgcccgcgctgccctggcgacggagaactcagctgggagcactcagacggggatatcttccgacagccggcaaacagagaggccaggcacagctatcacaggtcccattatgacccaccccctagcagacaagcgggcggtctcagtaggtttcctggggcccggtctcaccgtggggccctgatggattcccagcaagctagcggaacaattgtgcagatagtcattaacaacaagcacaaacacggccaggtctgtgtctccaatgggaagacatactcccacggggaatcctggcatcccaacctgagggcctttgggatcgtggagtgtgtgttgtgcacatgcaatgtgactaaacaggagtgcaagaagattcattgtcctaatcgctatccttgtaaatatccacagaagatcgatggcaaatgctgcaaggtttgcccaggcaagaaagccaaagaggaattaccaggccaatcattcgacaataagggatatttctgtggcgaggagacgatgccagtgtacgaatctgtgttcatggaagacggcgagactaccaggaagatcgcactggagacggagcgacctcctcaggtcgaagtccacgtctggaccatccggaagggcatcctgcagcacttccatatcgagaagattagcaaaagaatgttcgaagaactgccgcactttaagctggtcactaggaccactctttcccagtggaagatttttacagagggtgaggcacagatatcccagatgtgttcttctcgtgtatgtaggacagagcttgaggatctggttaaggtgctctacctggagcgctcagagaagggccattgctag

SEQ ID NO: 182875 - DNA, 1356 bp, Artificial Sequence
  Description of Artificial Sequence: Synthetic coding sequence
atggtgcccgaggtgcgggtgctgagcagcctgctgggcctggccttactgtggtttcccctggactcacacgcacgcgcacgcccagacatgttctgtctcttccatggaaagagatactcaccaggagagtcttggcatccatacttggaacctcaaggcctcatgtattgtctgcggtgtacgtgtagcgaaggcgctcatgtgtcttgctataggttgcactgtcctcccgtacactgcccacagccagttacagagcctcagcagtgctgccccaagtgcgtggagccgcacacaccgtcggggttacgcgccccacctaaatcctgtcagcataatgggaccatgtaccagcacggagagattttctcagcgcatgagctgtttccctcacgcctgcctaaccagtgtgtgctctgctcctgtactgaagggcagatttattgtgggctgaccacctgtccagaacccggctgcccggcgcctcttcccctgcccgacagctgttgccaggcatgcaaagacgaggcaagcgaacagtccgatgaagaggactcggtacagtctctccatggcgtccggcatccacaggacccctgtagctcagacgctggccggaaacgtggaccaggcactccagctcctacagggctctctgcgccactttccttcatcccaagacactttcgaccaaagggagccggttccacgacagttaaaatcgtgctgaaagagaaacacaagaaagcctgtgtgcatgggggcaagacttatagtcacggagaagtatggcatccggcattccgggcattcggccccctcccttgtatcctgtgcacatgtgaggatgggaggcaggactgtcaaagggtgacatgtccaaccgaatacccttgccgccacccagaaaaggttgcaggcaaatgttgcaaaatttgtcccgaagacaaggccgaccccgggcattccgaaatcagctctacacgctgtcctaaagcgccagggagagttctggtccacacctcagtttctccaagcccggacaatctgcggcgcttcgctctcgaacatgaggccagcgaccttgtcgagatatatctctggaagctggtgaaagatgaagagactgaggcacagcgcggagaggttccagggccacgtccacactcacagaacctgcccttggatagcgatcaagagtctcaggaggctcgtctgcctgaacggggcaccgcactgcccaccgccagatggcccccaagacggagtttagagaggctgcctagccctgatccaggggctgaggggcacggccagtcacggcagagcgaccaagacattacaaagacatag

SEQ ID NO: 182876 - DNA, 846 bp, Artificial Sequence
  Description of Artificial Sequence: Synthetic coding sequence
atgtaccagcacggcgagatcttcagcgcccacgagctgttccccagccgtctcccaaaccagtgtgttctatgctcctgtacagaaggccaaatctattgcggtttgacgacatgccctgagcctggatgtcctgcaccattgccattgccagatagctgttgtcaggcttgcaaggcgggatccagttggggccttctctgctccgtcagcgactttcacccctcctgccacctgcaaaggcacccgcaggacccatgtagctcagatgcagggcggaagaggggcccaggtacaccggcccctaccggattatcagcaccactttcgttcatcccacggcacttccggcccaaaggcgcaggttcgacaactgttaagatcgtgcttaaagagaagcacaagaaggcttgcgttcatggcggtaagacatactcacatggggaagtctggcatcccgcttttcgagccttcgggcctctaccgtgcatcctgtgcacttgtgaggacggcagacaggactgtcaacgggttacgtgtcccaccgagtacccctgcagacatcccgaaaaggtggcgggaaagtgctgcaagatctgtccagaggacaaggctgaccctggccactccgagatctctagtaccagatgccctaaggcgcctgggcgagtcctcgtgcatacgtcagtttcgcctagtccagacaatctgcgcagattcgctctggagcacgaagcctcagatctcgtggaaatctacctgtggaagctggttaagggggtgtttctcgcacagaccctagagttgaaagtaacggcctcacccgacaaggtgactaagacgtag

SEQ ID NO: 182877 - DNA, 1290 bp, Artificial Sequence
  Description of Artificial Sequence: Synthetic coding sequence
atggtgcccgaggtgcgggtgctgagcagcctgctgggcctggccctgctgtggttccccctcgattctcacgcgagggctaggcctgacatgttttgcctgtttcacggcaaaaggtactcgccaggagaaagttggcacccttacttggaacctcaagggcttatgtattgtcttaggtgtacatgtagcgagggggctcacgtctcatgctacaggcttcactgtcctcccgtgcactgtccacagcccgtcaccgagccacagcagtgttgtccaaagtgcgtagagccccatactccctctggactcagggcacctcccaaaagctgccagcataacggtacaatgtaccagcatggagagattttcagtgctcacgagctgtttccttcccgactgcctaatcaatgtgtgctgtgctcttgtaccgaaggacagatttattgcggcctcacaacctgtccagaacctggctgtcccgcacccttaccactccctgacagctgttgtcaggcctgcaaagatgaggcctcagaacaatcagacgaagaggattcggtgcagtccctgcatggagtccgccacccgcaggacccttgctcaagtgacgccgggcgtaaaagaggacctggcacacccgcgcccaccggcctctcagctcccctgtccttcatcccccgacattttcgccctaagggcgcaggctcaaccaccgtgaagattgttttaaaggaaaagcataagaaagcttgcgttcacggcgggaaaacatatagccatggcgaggtgtggcatcccgcttttcgcgcattcggaccgctgccttgtatcctctgcacatgtgaggacggaagacaggactgtcagagagttacatgccccactgagtacccttgtagacatcctgaaaaagtagcggggaagtgctgcaagatctgtccggaagataaagccgaccctggacacagtgaaatatctagcactaggtgccccaaagcacctggacgcgtgctggtgcataccagcgttagcccaagccccgataacctccggcgtttcgccctggagcatgaggcttcggatttagttgagatctacctctggaagctggtgaaaggtatcttccacctgacccagatcaaaaaggtgagaaagcaggacttccaaaaggaggcccagcatttccggcttctggccgggcctcatgaaggccactggaacgtgttcttggcacagacactggagctcaaggtgacagcttcccctgataaagtaaccaaaacctag

SEQ ID NO: 182878 - DNA, 840 bp, Artificial Sequence
  Description of Artificial Sequence: Synthetic coding sequence
atgtaccagcacggcgagatcttcagcgcccacgagctgttccccagccggttacctaatcagtgcgttttatgtagctgtacagagggccagatttactgtggtttgaccacctgcccagagcccggatgtcccgcgcctctgccccttcctgactcatgttgccaggcttgcaaggatgaggcttctgaacagtcggacgaagaggactctgtacagtcccttcacggagtgcggcatcctcaggatccctgctcttcagacgccggaaggaagcggggcccaggtacgccagccccaaccggtctgtccgcgcctctctccttcattcctagacactttcggcctaagggcgctggctccactacagttaaaatcgtattgaaggagaaacataagaaagcttgtgtccatggcggtaagacttacagtcacggagaggtatggcatcctgcgtttcgagctttcgggccacttccctgcattctttgcacttgtgaagatgggagacaagactgccagcgtgttacctgtccaaccgagtacccttgccgccacccagaaaaagtggccggcaaatgctgtaaaatatgccccgaggataaagcagatcctggacactcagagatctcttcgacgagatgtccaaaggcaccggggagggtcctcgtgcacaccagcgtgtctccatctccagacaatctccggagattcgctttggagcatgaggcctccgacctcgtggagatctacctctggaaacttgtgaaagacgtgtttctcgcccagacacttgaactcaaggtaactgcctcccctgataaagttacaaagacgtag

SEQ ID NO: 182879 - DNA, 498 bp, Artificial Sequence
  Description of Artificial Sequence: Synthetic coding sequence
atggagatgttccagggcctgctgctgctgctgctgctgagcatgggtggtacctgggcgtccaaagaaccgctgcggccacggtgcaggcccatcaacgcaaccctcgctgtcgaaaaagaggggtgtccggtctgtatcaccgtgaatacaacaatctgtgccggctactgccctaccatgactagggttctccaaggcgtgctcccggccctccctcaggtagtgtgtaattatcgggacgttagattcgaaagtattaggctgcccggctgcccccggggcgtgaacccagtcgtctcttacgctgtagccctctcctgtcagtgcgcgttgtgccggcggagcactacagattgcggcggccctaaggatcacccgctgacatgcgacgacccccggtttcaagacagttctagctcaaaggctccccccccctctttgccctccccttccaggctgccaggaccaagcgatacaccaatccttccacagtag

SEQ ID NO: 182880 - DNA, 507 bp, Artificial Sequence
  Description of Artificial Sequence: Synthetic coding sequence
gccccccggatggagatgttccagggcctgctgctgctgctgctgttaagcatgggagggacctgggcctctaaggagcctttgaggcctaggtgcaggccaataaacgccacgctggccgtagaaaaagagggatgcccggtttgcatcacagtgaacacgactatctgcgccggatactgccccactatgaccagggtcctgcaaggggttcttcctgctctcccacaagtcgtgtgtaattaccgtgatgttcggttcgagagcatccgattgcccggttgccctcgtggtgtgaaccccgtagtgtcttatgcagtggctctgagttgccagtgtgcgctgtgccgccgaagtaccacggactgcggcggtcctaaagatcaccccttgacttgtgatgatcccaggttccaggacagcagttcgtccaaagccccaccgccgagcctaccctccccgagtcgcttgcctggaccaagtgataccccaattctgcctcaatag

SEQ ID NO: 182881 - DNA, 654 bp, Artificial Sequence
  Description of Artificial Sequence: Synthetic coding sequence
atggcccccggcagccggaccagcctgctgctggccttcgccctgctctgcctgccatggctgcaggaagctggcgccgttcagaccgtgccactgagtcgcctatttgatcatgcaatgctgcaggcacatagagcacatcaactagcgatcgacacctatcaggaatttgaagaaacctacatccccaaggatcagaagtattcctttttacacgactcacaaacgtctttctgtttctcagattcaatccctactcccagtaacatggaggaaacgcagcaaaagtctaatttggagttgctacgcatctcactcttgctgatcgagtcctggctggagccagtcagattcctccgatccatgtttgccaataacctcgtgtatgatacttctgatagcgatgactatcatctactgaaagacctggaggaaggtattcaaaccctgatgggccgcctcgaagacggcagtcgacgcactggtcaaatactgaaacagacttatagcaagttcgatactaatagccataatcatgacgccctgctgaaaaactatggactcctttactgttttagaaaggatatggacaaagtggaaacatttctccgaatggtccagtgccgctctgtggagggctcttgtgggttttag

SEQ ID NO: 182882 - DNA, 771 bp, Artificial Sequence
  Description of Artificial Sequence: Synthetic coding sequence
atggcccccggcagccggaccagcctgctgctggccttcgccctgttgtgcctgccttggctgcaagaagccggcgcggttcagaccgtgccactgagtcgtctctttgatcatgctatgcttcaagcgcacagagcccatcagctcgccattgatacctatcaggaattcgaagagacgtacattcctaaagatcaaaaatactctttcttgcatgattcccagacctcgttttgtttcagcgactctatacccactccttccaatatggaggaaacccagcagaaatcaaacctggagctattaaggatctctcttttgctgatagagtcctggctcgaacccgtgagattcctgcgcagtatgtttgcaaataacctcgtgtacgatacgtcagacagcgatgactaccacctcctgaaggacctcgaagaaggcatacagacactgatgggggttcgagtggcccctggggtgaccaaccctggtacacccttggcgagtcgtgccggcggcgaaaagtattgctgtcctttatttagttcgaaagcactgacacaggagaatagcccctactcttcgttcagactggtaaatccccccggactgagtcttcacccagaaggggagggggggaagtggattaacgagcggggccgtgaacagtgccctagcgcctggccgcttctgctgtttctgcattttgctgaggctgggaggagacagccgcccgattgggcagacccacaggctgatctacagcaagtgtag

SEQ ID NO: 182883 - DNA, 369 bp, Artificial Sequence
  Description of Artificial Sequence: Synthetic coding sequence
atggcccccggcagccggaccagcctgctgctggccttcgccctgctctgtctgccatggctgcaggaggccggcgcagtgcaaacagtgcctttgtccaggctctttgaccacgcaatgctgcaggcccaccgggcccatcagctggctatcgacacataccaggagtttcgtcttgaagacggctcccgccggacaggtcaaatcttaaaacagacttatagcaagttcgacacaaacagtcataatcacgatgccctgctcaaaaactacggcttgttgtattgcttccgaaaagatatggacaaagtcgagacattcctacgcatggtgcaatgccgttctgtcgagggcagttgcggtttttag

SEQ ID NO: 182884 - DNA, 552 bp, Artificial Sequence
  Description of Artificial Sequence: Synthetic coding sequence
atggcccccggcagccggaccagcctgctgctggccttcgccctgctctgcctaccttggctgcaggaggccgagacctacattccaaaagaccagaaatactccttcctccacgatagtcagacatcattctgttttagtgactctattcccacaccgtctaatatggaagagacacaacagaaaagcaatctggagctcttacgcatctctctcctactgatcgagtcttggctggagcccgtgagattcttacgcagcatgttcgcaaataacctggtatacgatactagtgactcagacgattaccatctacttaaggatctggaggagggaatccaaactctgatgggtcgcctggaagatgggagccggcggaccggccagattctgaagcagacatactcaaaattcgacactaacagccacaaccatgatgccctcttgaaaaactacggcctgctttactgtttccggaaggacatggacaaagtagaaacatttttgcgaatggtccaatgccgatccgttgaaggaagttgcggattttag

SEQ ID NO: 182885 - DNA, 504 bp, Artificial Sequence
  Description of Artificial Sequence: Synthetic coding sequence
atggccgccggcagccggaccagcctgctgctggccttcgccctgctctgcctgccctggctccaggaagccggagctgtccagaccgtaccactatctagactcttcgaccacgccatgctgcaggcccatcgagcccatcaactggctattgacacatatcaggaattcgaagagacatatattccaaaggatcagaagtactcattcctgcatgattctcagacgtcgttttgctttagcgattcaattcccacgccaagcaatatggaggaaacgcagcagaagtccaatcttgagctcctccgcatttctctactgttgatcgagtcctggctggaaccggtgaggtttctgagaagcatgttcgccaacaacctggtgtacgacaccagtgacagtgacgattaccacctgctaaaggacctggaggagggaatccagacactaatgggagttcgtgtggctccaggcgttgcgaacccaggcacccccctagcttag

SEQ ID NO: 182886 - DNA, 369 bp, Artificial Sequence
  Description of Artificial Sequence: Synthetic coding sequence
atggccgccggcagccggaccagcctgctgctggccttcgccctgttgtgtctgccttggctccaagaagccggtgccgtgcaaaccgtgcctctctcacggctattcgatcacgcaatgctgcaagcacacagggctcaccagctggcgatcgatacgtatcaagaattcagacttgaggacggaagcaggcgaaccgggcaaatcttaaagcagacatatagcaagttcgacacaaactcccacaaccacgatgctctcctgaagaattacggacttctttactgttttagaaaggatatggacaaggtggaaacgtttttacgcatggtgcagtgcaggtcggttgaagggtcatgtggcttttag

SEQ ID NO: 182887 - DNA, 654 bp, Artificial Sequence
  Description of Artificial Sequence: Synthetic coding sequence
atggccgccggcagccggaccagcctgctgctggccttcgccctgttatgtctgccatggctacaggaagccggcgctgtgcagactgtgcccctgtcccgactgtttgaccatgcaatgttacaggctcaccgcgcacaccaattggcaattgacacctaccaggaatttgaggagacctatataccgaaagatcagaaatacagctttctgcatgacagccagaccagcttctgctttagcgatagtataccaactccttccaacatggaggagactcagcaaaaatctaatctggagctgctacgtattagcctcttattgatcgagtcttggcttgagcctgtccgtttcctgaggtcaatgtttgccaataatctagtgtatgatacatccgatagtgacgactaccacttgctgaaagatcttgaagagggaatccaaactctgatgggaagactggaagatgggtcacggaggacaggccaaattttgaagcagacatatagtaagtttgacacaaacagtcacaaccacgatgctctccttaaaaactatggcctgctgtactgctttagaaaagacatggacaaggtcgaaacattcctgaggatggtgcagtgcaggtcagttgagggatcctgcggcttttag

SEQ ID NO: 182888 - DNA, 483 bp, Artificial Sequence
  Description of Artificial Sequence: Synthetic coding sequence
atggccgccggcagccggaccagcctgctgctggccttcgccctgctctgcctgccctggctccaggaagccgatagcattcctacaccatctaatatggaggagacacagcagaaatccaatctcgaactgctgcggatttccctgctgctcatcgaatcatggctcgagcctgtgcgatttctgcggtccatgtttgccaataacctggtatacgacacctccgactcggacgattaccacttattaaaggacctggaggaaggaatacagacattaatgggcaggctggaggatggatcaagacggactgggcaaatccttaagcagacttactcaaagttcgacacaaacagtcacaaccatgatgcgctgttaaaaaactatggattactgtattgcttccgcaaggatatggacaaagtggagacattcttaagaatggttcagtgccgctccgttgaagggagttgcggattctag

SEQ ID NO: 182889 - DNA, 498 bp, Artificial Sequence
  Description of Artificial Sequence: Synthetic coding sequence
tgaggcagccggaccagcctgctgctggccttcgccctgctgtgcctcccatggttgcaggaagccggagccgtgcagaccgttccgctctcccggctgttcgaccacgcaatgctacaagcccaccgtgcccatcagctagccatcgacacctaccaagagttcgaggagacgtacattcccaaggaccagaaatattcctttttgcacgactctcaaaccagcttttgcttttctgattctatccccactccgtcgaacatggaggagactcagcagaagtcaaacctggagctgttacgcataagcttactgctgatcgagagctggctggagcccgtaaggtttctccgatcaatgtttgctaataacctggtttacgataccagcgactcagacgactatcacctgctgaaggacctggaggaaggaatccaaacgctgatgggagttagggtggctccaggtgtggcgaatccagggacccctttagcgtag

SEQ ID NO: 182890 - DNA, 669 bp, Artificial Sequence
  Description of Artificial Sequence: Synthetic coding sequence
atggccgccggcagccggaccagcctgctgctggccttcgccctgctgtgtcttccctggcttcaggaagctggggctgtgcagaccgtcccattaagtcgcctattcaaggaggccatgctgcaggcacacagagcacaccagctggcgatcgatacatatcaggagtttatctcttcatggggcatggaggcctacatcactaaagaacaaaaatactcttttttacatgacagccagacctctttctgtttcagcgatagtataccgacaagcagcaatatggaggagacccagcagaaaagcaacctcgaattgttacatatcagtctgttattgatcgagtctcggctggagccagtgcgttttctgagaagcacatttactaataatcttgtctatgacacctctgactccgacgattaccacctgctgaaagacctagaagagggaatccaaatgctaatgggccgcctggaggacggatcacaccttactgggcagacactgaaacagacatacagcaaattcgacacaaatagccataatcacgatgccctcctcaaaaactatggattgttacactgcttcaggaaagacatggataaggtggaaacattcttgcgtatggtgcagtgcaggagcgtcgaaggcagttgtggcttctag

SEQ ID NO: 182891 - DNA, 387 bp, Artificial Sequence
  Description of Artificial Sequence: Synthetic coding sequence
atggaggagacccagcagaagagcaacctggagctgctgcacatctcccttctgctgatcgagagcagactggagccggtcaggttcctgagaagtacgttcacaaacaatctcgtgtatgatacctctgactctgacgactaccatctcctcaaagacctggaggagggtatacagatgctgatgggaagacttgaggatggatcccacctgaccggccagacattaaagcagacttactcaaagtttgatacaaattcacacaatcatgacgcgctccttaagaattatggcttgcttcactgcttccggaaggatatggacaaggtggagacttttcttcggatggttcagtgcaggtcggtggaagggagctgcgggttctag

SEQ ID NO: 182892 - DNA, 522 bp, Artificial Sequence
  Description of Artificial Sequence: Synthetic coding sequence
atggccaccggcagccggaccagcctgctgctggccttcgccctgttatgtctaccttggctccaggaggctggggccgtacaaacagttccactctcccgtctgtttaaggaggccatgctgcaagctcatcgcgcccaccaactcgccatcgatacgtatcaggagtttatctcatcatggggcatgggcgccggacaaggatggcaggagggtgtgaccttcccccactggggatctaacggacgccgcctacgcagctctggcttattcagcgaagcaaagatgcaggccgatgaacaccggctgagccaggtgccgagacgggtgaccgttggagcaggtctccagcaccgcaaacagtggtccttcctcgtcggcggtccaagtccaagaaaaaagccaattagtcaacgcaatcgctccattcacagctgtatgacaccacggccgcctagtgccagccagacgttgttcagacatccccctacgtggaggaaacggtcccggaatccaacttag

SEQ ID NO: 182893 - DNA, 420 bp, Artificial Sequence
  Description of Artificial Sequence: Synthetic coding sequence
atggccgccgacagcatccccaccagcagcaacatggaggagacccagcagaaatcaaaccttgagttactgcacatctctttacttttaattgagtccaggctggaaccagtccgcttcctgcgcagcaccttcactaacaacctggtgtacgatactagcgatagcgacgactaccatctgctcaaggacctggaagaggggattcaaatgctcatgggcaggttagaagatgggagccatttaactggtcaaaccctgaagcagacctatagcaaatttgatactaacagtcataatcatgatgcgctcctgaaaaattacgggctgctccactgcttccggaaagacatggataaggtcgaaacctttctcagaatggtgcagtgcagatccgtggaaggaagttgcggattctag

SEQ ID NO: 182894 - DNA, 1962 bp, Artificial Sequence
  Description of Artificial Sequence: Synthetic coding sequence
atggccgacaccctgcccagcgagttcgacgtgatcgtgatcggcacagggctccctgaaagcattatagccgcagcctgttccagatcagggaggagagtgttgcacgtagatagccgctcctattatggaggcaactgggcctccttctctttttcggggctcttgtcctggttgaaggaataccaggagaattccgatattgtgtctgactcccccgtgtggcaggaccagatcttggagaatgaggaagctattgccctcagcaggaaggataaaaccattcaacatgtggaagtattctgctacgcgtctcaagacctacatgaggacgtggaggaggccggagcactgcagaagaaccatgctctcgtcactagtgccaattccacagaggccgccgactcagcgttcttgccaaccgaggacgagagtctgagcacaatgagctgcgagatgctgaccgaacaaacaccatcttccgatccggaaaatgcgctggaagtcaatggcgcagaggtcaccggcgaaaaagagaaccactgtgatgacaagacttgtgtgccctcaacatccgctgaggatatgtccgaaaatgtgcccatagcggaggatacaaccgaacagcccaagaaaaatagaattacttactcccagattatcaaggagggccgcagattcaacatcgacctcgtctcaaaactgttatattctcgcgggctcctgattgatctccttataaaatccaatgtcagccgctatgcggaattcaagaacatcacgaggattctcgcctttcgagagggcagggtagaacaggtcccatgtagtcgggccgatgtcttcaatagtaaacagctaactatggttgaaaaaaggatgctcatgaaatttctgacattctgcatggaatatgaaaagtaccctgacgagtataagggatatgaagagatcacattctacgaatacctaaagacccagaaattgactccgaatcttcagtatatcgtaatgcacagtatcgctatgactagtgaaaccgcaagttccaccattgacggcctcaaagctacgaaaaatttcttacattgcctggggcgttacgggaacacaccttttttattccctctttacgggcagggcgaactgcctcagtgcttttgtaggatgtgcgccgtgttcggcgggatttactgccttcgtcactctgtgcagtgtctagtcgtcgacaaagaaagtcggaagtgtaaagcaataattgaccaattcgggcagcgcataatcagcgagcactttctcgtagaggattcttactttccagaaaatatgtgttctcgggtgcagtatcgccaaatttcacgcgccgtcctcatcaccgatcggtccgtccttaaaaccgactcagaccagcagatttccatcctaacggtgcccgctgaagaacccggcacctttgctgtgcgcgtgattgagctctgctctagcacaatgacctgcatgaagggcacctacttggtccacttaacatgcactagtagcaaaaccgctcgagaagacctggagtcagtggttcaaaaactctttgtgccttacaccgaaatggaaatcgaaaacgagcaggtcgagaagcctagaatcctttgggcgctctacttcaatatgcgtgattcatctgacatctctcggtcgtgctacaatgacctccccagtaacgtttacgtctgtagtggaccagattgtgggcttggtaacgataatgccgtgaaacaggccgaaactttgtttcaggaaatctgtcctaacgaagacttctgtccaccaccaccaaacccagaagacatcatcctggatggagacagtctgcagcccgaagccagcgagtcctcagctattccagaggccaacagcgaaacgtttaaagaatccacgaacttgggtaacttagaggagagctctgaatag

SEQ ID NO: 182895 - DNA, 333 bp, Artificial Sequence
  Description of Artificial Sequence: Synthetic coding sequence
atggccgacaccctgcccagcgagttcgacgtgatcgtgatcggcacaggtctcccagaaagcattatcgccgcagcctgcagtagatctggacgtcgtgtgctgcatgtcgatagccggtcgtactacggcgggaactgggcatcttttagtttcagtgggctgctttcttggctgaaagagtaccaggaaaatagcgatatcgtctcagattcacccgtatggcaggatcagatcctggagaacgaggaagccatcgcacttagccgcaaggataagacaattcagcatgtcgaggtgttctgctacgcccgctccacactgctcctgtag

SEQ ID NO: 182896 - DNA, 1518 bp, Artificial Sequence
  Description of Artificial Sequence: Synthetic coding sequence
atgagctgcgagatgctgaccgagcagacccccagcagcgaccccgaaaatgctctggaggttaacggagccgaagtcaccggagagaaagaaaatcactgtgacgacaagacttgcgtgccgtctaccagtgccgaagacatgagcgagaacgtgccgatcgctgaggatacgactgagcagcccaagaagaatcggatcacttatagccagatcataaaagagggaagaaggttcaatattgatctggtctccaaactcttgtactcgcgggggttactaatagacctgctcatcaagagcaatgtgtctcggtacgccgagtttaagaatattaccagaattctagcttttagagagggccgagtggaacaggttccctgcagtcgcgccgacgttttcaattcaaagcagctgaccatggttgagaaacgcatgcttatgaagttcctgactttctgtatggagtacgagaaataccccgacgaatacaagggatacgaggagatcactttctatgagtacctcaaaactcagaaattaactcccaacctacaatacatcgtgatgcattcaatcgcaatgacatctgagactgccagctcaacaattgatggccttaaagccactaagaatttcctgcactgcctgggtagatacgggaacactccgttcctgttccctttatatggacagggcgaactacctcaatgtttctgtaggatgtgtgctgtgttcgggggaatttactgcttgaggcattccgttcagtgcctcgtggtggataaagagtcaagaaagtgcaaagctattatcgatcagtttgggcagcgcattatctccgagcacttcttggtggaagactcctattttccagaaaacatgtgcagccgcgtccagtacaggcaaattagccgagccgttctgatcactgatcggtctgttttaaaaacagactccgaccagcaaatttccatactcactgtgccggccgaggaaccaggaacatttgctgtcagggtcatcgagctttgcagctctacaatgacatgtatgaaggggacctatctggtccacttgacttgcaccagtagtaagacagcccgagaagacctggagtcagtcgtgcagaagctcttcgtcccatatacagagatggaaatcgagaatgaacaagtggaaaagcctcgtattctttgggctttgtatttcaatatgagggacagcagtgacatctctagatcatgctataacgacctgccatccaacgtgtacgtgtgcagcggaccagactgcgggctgggcaacgacaacgccgttaaacaggccgaaacactctttcaggagatttgccctaatgaggacttctgcccaccaccacccaaccctgaagatatcattcttgacggggactcactgcagccggaggctagtgagtctagcgcaattccagaggccaatagtgaaacgttcaaggaaagcacaaatcttggcaatttagaggagagttctgaatag

SEQ ID NO: 182897 - DNA, 1971 bp, Artificial Sequence
  Description of Artificial Sequence: Synthetic coding sequence
atggccgacaacctgcccaccgagttcgacgtggtgatcatcggcactggcctccctgagagcatacttgctgccgcttgtagtcgttcagggcagagagtgctgcacattgacagtcgaagctattatggcgggaactgggccagtttctcatttagcgggttgctatcatggttaaaagagtatcagcagaataatgatattggcgaggagtctacagtcgtgtggcaggacctgatacatgaaacagaggaggctataactttgcgaaaaaaggatgaaaccatccagcacactgaggcgttctgctatgcatcccaggacatggaggacaacgtggaggaaatcggggcgttgcagaagaaccctagtctgggcgtgtctaacacctttaccgaagtgctggacagcgctctgcccgaggagtcccaactgagttatttcaattccgatgaaatgcccgcgaagcacacgcagaagtcagacaccgagatctccctcgaggtgactgacgtcgaggagagtgttgaaaaggagaaatattgcggcgacaagacatgtatgcacaccgtttctgacaaggatggggacaaggatgaatctaaaagtacagttgaagacaaagccgacgaaccgattagaaaccgaatcacttactctcagatagtgaaggaaggtcgccggttcaatattgacctggtcagtaaattgctttactcccaaggacttctcatcgatttgctgattaagtctgatgtgtccaggtacgtggagtttaagaacgttacccgaatcctggccttccgagaagggaaggttgagcaggtgccctgctcacgagctgatgtcttcaactccaaggaactcacaatggtggagaagcgtatgctcatgaagttcctgaccttctgtttggaatacgagcaacaccctgatgagtaccaagcttttcggcagtgttccttttctgagtatctgaagacgaagaaactaacaccaaaccttcaacacttcgtgttgcactcaatcgccatgacgtccgagtcatcctgcaccacgatcgacgggctgaacgcaacaaaaaacttcctccagtgtctgggccggtttggaaatacccctttcctctttcctctctatggacagggagaaatccctcagggtttctgcagaatgtgcgcagtctttggcggcatatattgtctgcgccacaaggtacagtgtttcgtggtagacaaagagagtggtcgttgcaaggccattattgaccactttggccagcggattaacgctaagtatttcattgtggaggacagctacctgtctgaagaaacatgttccaacgttcagtataaacaaatttcccgagcggtcctgatcacggatcagtcaatcctcaaaaccgatttagaccagcaaacttcaatattgatcgtgcctcctgctgagccaggagcatgcgcagtgcgagtgaccgagctttgttcttccactatgacctgtatgaaagatacatatctggtgcacctcacctgctcttcatctaagaccgctagagaggacctagagtctgtggtgaaaaagctgtttacaccttacaccgaaaccgagatcaacgaagaggagctgacaaagccccgcctgctgtgggcactgtattttaatatgagagattctagcggtatctctcgcagcagctacaacggtcttccctcgaacgtgtacgtctgctcagggcccgattgcggcctgggcaatgaacacgcagtaaagcaggccgaaacactctttcaagaaatatttccaacagaagagttctgcccccctccaccaaaccccgaggacatcatttttgacggagatgacaaacagcccgaggctcccggcacgaataatgtggtgatggctaaactcgagtccagcgaggaaagcaagaacctggagagccccgagaaacatttacagaattag

SEQ ID NO: 182898 - DNA, 1641 bp, Artificial Sequence
  Description of Artificial Sequence: Synthetic coding sequence
atggagcagcggcgggtgaccgacttcttcgcccggcggcggcccgggccccccaggatcgcgccccccaaactcgcatgccggacaccatccccggcccgcccggcgcttagggctcctgcctcagcgacaagtggcagccggaagcgcgcccggcctccagctgctcctgggcgggaccaagcccgcccgcctgccagacgccggctgaggctgtccgtagacgaggtgagctctccctctactcccgaggcccccgacatccctgcatgtcccagtcctgggcagaaaattaaaaaaagtaccccggcggcaggtcagcccccacacttaacatcagcccaagatcaagacacgatctccgagctggcctcctgcctgcagcgcgctcgggaactgggagctcgcgtcagagccctgaaagcatccgcacaggacgcaggcgagtcatgtacccccgaggctgagggacggccggaggagccctgcggcgagaaggctccagcataccagcggttccacgctctcgcccagccaggccttcccggcctggtgctgccatataagtaccaagtgctcgccgagatgtttagaagcatggatacaattgtagggatgttacacaatcgcagtgagacacccacattcgccaaggtccagagaggtgtccaggacatgatgcgccgcagattcgaagaatgtaacgtcgggcagattaaaacggtgtatcccgcttcctatcgttttcgccaggaacgatccgttcccactttcaaggacggcacccgtagatctgactatcagcttacgattgaacctcttctggaacaggaggcagatggggctgcgccacaactgactgcaagtcgcctgcttcaacgccgacagatcttctcgcagaagttagtcgagcatgtcaaagagcatcacaaagctttcttagcgtccctgtcaccagccatggtggtgcctgaagatcagctgaccagatggcatcccagattcaacgtcgatgaggtccccgacattgaacccgccgctctcccgcagcccccggccacagagaaattgaccacggctcaggaggttctcgcgcgagcgcgtaatctcatcagtcccaggatggagaaagcactgagtcagctcgcactgcggagcgctgccccaagctccccaggaagtccccggcctgccctgcctgctacaccaccagctaccccccccgcagcttccccaagtgctctaaagggggtttctcaggacctgcttgagagaattcgggccaaggaggcccagaagcagctggcccaaatgacacgctgtccagagcaggaacagcggttgcaaagactggaaaggcttccagaactagccagagtactgaggtccgtcttcgtgtccgagcgcaaaccagcattgtccatggaagtagcatgtgccagaatggtaggatcctgttgtaccatcatgtctcccggcgagatggagaagcatctgctgctcctgagcgaattgctccctgactggctgtctctgcaccgcatccgtactgacacttatgtcaagttggataaggccgccgatctcgcccacattactgcgcggcttgctcaccaaacccgagcagaggagggtctgtag

SEQ ID NO: 182899 - DNA, 306 bp, Artificial Sequence
  Description of Artificial Sequence: Synthetic coding sequence
atgcagcagcagcagcagctggccagcgcccggaaccggcggctggcgcagcaaatggaaaaccgccccagtgtccaagccgccctaaaactgaaacagaaatcattgaagcagcgtctgggaaagtccaacatccaggccagactgggtcgtcctatcggtgcacttgcgcgaggcgccatagggggcagggggctgccaataatccaacgagggcttccacgcggagggctcagaggcggaagggcgacgcgcacactgctgagaggaggcatgtctctcaggggacagtgttgcgtgccatag

SEQ ID NO: 182900 - DNA, 672 bp, Artificial Sequence
  Description of Artificial Sequence: Synthetic coding sequence
atgctgaagaacaagcagcccacccccgtgaacatccgggccagcatgcaacagcagcaacaactggccagtgctcgcaaccgccgcctagcccagcagatggagaaccgtcccagcgtgcaggcagctctcaaactgaaacaatccctgaagcagcgacttggcaaaagtaatatccaggctcgactcggacgccctataggagccttggcacgcggcgctatcggaggccgggggttgccaatcattcagcggggactccctcgcggcggtttaagagggggccgcgccacaagaaccttattacggggcgggatgagcctgcgggggcagaatctcttaagaggagggagagccgtagctccccgaatgggacttcgtagggggggtgtgcgcgggcgtggaggccccggaagaggtgggttgggccgcggtgccatgggaaggggaggcatcggggggcgcggcagagggatgatcggacggggcaggggcgggtttggcggccgtggccgagggagaggaagaggtaggggcgccctcgcacgcccagtcctcacaaaagagcagttagataaccaattggacgcatacatgtcaaaaacaaagggacaccttgacgcagagttagacgcttatatggcccagacagacccagagaccaacgactag

SEQ ID NO: 182901 - DNA, 609 bp, Artificial Sequence
  Description of Artificial Sequence: Synthetic coding sequence
atggccgcccagagcgcccccaaggtggtgctgaagagcaccaccaaaatgagtctcaacgagagattcactaacatgctgaagaataaacagcctacacctgtcaacatacgggcctcaatgcaacaacaacaacagctggccagcgcccggaacaggaggctagcacagcagatggaaaatcggcccagtgtgcaggctgccctgaagctaaaacagtctctgaagcagcggttggggaagtcaaacatccaggccagactggggcgccctataggcgcattggccagaggggcgatcggaggacggggcttaccaatcatacaacgaggtctacctcggggtggtctgcggggaggccgggctacccgaactttgcttcgcggagggatgagtctgagaggccgcggcatgatcgggagggggcgcggtggctttggggggaggggcagggggagggggcgaggccggggcgcgctcgcaaggcccgttttgactaaagagcagctcgataatcagctggacgcatacatgtccaaaacgaagggccacctggatgctgagctagacgcttacatggctcagacagaccccgaaacgaacgactag

SEQ ID NO: 182902 - DNA, 747 bp, Artificial Sequence
  Description of Artificial Sequence: Synthetic coding sequence
atggccgcccagagcgcccccaaggtggtgctgaagagcaccaccaaaatgtctctgaacgaaagattcaccaatatgctgaaaaacaagcagcctacaccagtgaacatccgcgcctctatgcagcagcagcagcagctagccagtgccaggaacaggcgactggcgcagcagatggaaaatcggccaagcgtgcaggccgccctcaagttaaagcaatccctaaagcagcggcttggtaagtccaatatccaagctagactggggagaccgatcggagcactggcccgaggtgccattgggggaaggggcctgcccataatccagcgtggtctgccacgcggaggattgcggggaggccgggctactagaacgctccttagaggagggatgtcgttgagaggacaaaacttactaaggggcggtcgtgcagtggccccacgaatgggtttacgtcgaggcggagtccgagggcggggcggaccaggtaggggaggtctcggacgaggggccatgggacgggggggaattggagggaggggcaggggaatgatagggcggggccggggaggctttggcgggcggggacgaggacgtgggagaggccggggggccctcgcacggcccgtgttaacgaaagagcagctggacaaccagcttgacgcctacatgtccaagaccaaaggacatctggatgccgaactggatgcttatatggcacagacagatcctgagacgaatgattag

SEQ ID NO: 182903 - DNA, 609 bp, Artificial Sequence
  Description of Artificial Sequence: Synthetic coding sequence
atggccgcccagagcgcccccaaggtggtgctgaagagcaccaccaaaatgtctttaaatgagcgcttcactaatatgttaaaaaataaacagcccacgccagtgaacattagagccagcatgcagcagcagcaacagctcgcgtcagcccgcaacagaaggctcgcccagcagatggaaaacagaccaagtgtgcaggcggcactcaaacttaaacagtccctcaaacagagacttgggaagtccaatattcaggccagactcggtaggccaatcggggccctagccaggggggccatcggcggtcgtggccttcccatcattcagcggggactgccgaggggtggactgagagggggtcgcgccactaggaccctcctgagaggcggaatgtctctgaggggccgcggaatgattggtaggggaaggggggggtttggcgggagagggaggggtcgaggccgaggtcggggcgcacttgctagaccagttcttactaaggagcagctggataatcagctcgatgcctacatgtcaaaaaccaagggccatctggatgccgagttagatgcctatatggcccagactgatccagaaacaaacgattag

SEQ ID NO: 182904 - DNA, 636 bp, Artificial Sequence
  Description of Artificial Sequence: Synthetic coding sequence
atggaggagctgagcagcgtgggcgagcaggtgttcgccgccgagtgtattttatcaaagcgcctacgcaaaggaaaactggagtatttagtgaagtggcggggctggtccagtaaacataattcatgggaaccagaagagaatatcctcgatccccggctgctgttggcttttcagaaaaaggagcatgagaaggaagtgcagaacaggaaacggggtaagcgaccaagaggccgacccagaaagctgactgccatgtcgagctgtagccgccggtcaaagctcaaagtcggcgggtgcgccgggtacgccgatcccacctcccagcatcccttgggcgtggggggccgtcagcgcgaggggctcgggccctcaggccgcggatggcatttctgtcagcaaagcgttccacttctgggaaagcaagagccgcctttctttttgagcctgtcattttgctgccaaggtccccagcccgccgagagctcctctcctcccctacccggagcgtcttgtttcagcttaagctgtaccccgctgtgttgggttgcaggctccaattgttgccgacaggccctgtttcctccccgcgggtccctgggtgacggtaaggaacaggaagcgtgtgtacagtag

SEQ ID NO: 182905 - DNA, 1599 bp, Artificial Sequence
  Description of Artificial Sequence: Synthetic coding sequence
atggaggagctgagcagcgtgggcgagcaggtgttcgccgccgagtgcattctgtccaaacgactgaggaaaggtaagctcgagtatctggtaaagtggaggggctggtcgtccaaacataattcttgggaaccagaagaaaacatactggatcctaggttgctgcttgcatttcagaagaaggagcatgaaaaagaggtgcaaaaccggaagaggggaaagcgacctcgcggccggccgagaaagctgaccgccatgtcctcctgcagccgccggtccaaactcaaagagcctgacgcgccttcaaagtctaagtcaagctcctctagtagttcctctacttcatcgtcatcttctagtgacgaagaagatgattccgacttggacgccaagcgaggtcctagaggccgggaaacccatccagtgcctcaaaagaaagcccagatcctggttgcaaagccagaactgaaggaccccattagaaagaagcgcggtcggaagccccttcccccagagcagaaggcaactcgccggccagtcagccttgctaaggtgctgaagacagctaggaaagatctgggagcaccagccagcaagctaccccctcccctgagcgcgcctgtcgccggtctcgccgctctgaaagcacatgccaaagaggcctgcgggggaccctcagctatggccacacccgagaacctggctagcctcatgaagggcatggccagttcacctggtaggggagggatatcctggcaatcaagcattgtccactacatgaaccggatgacccagtcacaggcacaggcagcatcgcgcctggctctcaaagctcaggcaacaaataaatgcggtcttgggctcgacttgaaagtcaggacacaaaaaggcgagttaggtatgagtcctcctggtagtaaaatccctaaggctccctctggcggagccgtcgagcagaaggtaggaaataccgggggaccgccgcatacccatggggcgagccgagtgcccgcagggtgtcccggtccacagcctgcgccaacacaggagctgagtctgcaggttcttgatcttcagtctgttaaaaacggaatgccaggggttgggttgctcgctcgacatgcaaccgccaccaagggcgtccctgcaacaaatcctgcaccaggaaagggaaccggctcaggtctgattggagcatcaggggcaactatgcctacagatacgtcaaagtctgagaaactggcatccagggcagtggctccgcccacccctgcgagtaagcgcgactgcgtgaagggcagtgcaacgccctccgggcaggagagtcgtactgcccctggcgaggctcggaaggccgcaacactgccggagatgtccgccggggaggaatcgagttcatccgacagcgaccccgacagcgcatcaccaccttccaccgggcaaaacccgtccgtttcagttcaaactagtcaggactggaagcctactcgaagtttaatcgaacatgtctttgtaaccgacgttacagctaatctaataacagtgactgtcaaggaatcacctacttctgtgggcttttttaatcttcgacactactag

SEQ ID NO: 182906 - DNA, 1935 bp, Artificial Sequence
  Description of Artificial Sequence: Synthetic coding sequence
atggaggccgagcggggccccgagcggcggcccgccgagcggagctccccgggtcagaccccagaagagggcgcccaggccctggcagaatttgcagcccttcacgggccggcacttcgtgcctctggagtacccgagagatattggggtcgcctgctccacaagcttgaacacgaagtgttcgatgctggagaggtgttcggtataatgcaagtggaggaggtggaagaggaggaagatgaagcggcaagagaggtgaggaaacaacagccaaatcccggcaacgagctctgttataaggtgatcgttacgcgggaatcaggcctgcaggctgcacaccccaattcaatttttttgatagatcacgcttggacatgccgagtcgagcacgctcgccagcaactccagcaggtgcccggcctgcttcaccgaatggctaacttgatgggcatcgaattccacggagagctcccctccactgaggctgtcgctttagtgcttgaggaaatgtggaaattcaaccaaacctaccagctggcccatggcacggctgaggaaaagatgcccgtctggtatatcatggacgagttcggcagtcggatccagcacgccgacgtaccatcattcgccaccgcaccttttttttatatgcctcagcaggtggcctacactctgctgtggccactgagggatctcgacaccggagaggaagtaacccgagacttcgcgtacggagaaactgatcctctcattcgcaaatgcatgttattgccatgggcaccgacagatatgttggatctctcctcttgcactccggagccaccggctgagcattaccaagccatcctagaggagaataaggaaaaattgcccctggacatcaatccagtggttcaccctcacggtcacatcttcaaggtatataccgatgtgcagcaggtggcctcatcgttgacacacccacgcttcactctgacacagtccgaggccgatgctgacatcctcttcaacttctctcattttaaggattacagaaaactctcacaggagagacccggcgtcttacttaatcagtttccatgtgaaaacctccttactgtaaaggactgcctggctagcattgctcgcagagctggcggcccggaaggtcccccttggcttccccgaacctttaatcttcggacagagctcccacagttcgtgagctacttccagcagagggagaggtggggggaggacaaccattggatctgcaagccttggaacctagcccggtcccttgatacccacgtcactaaatccttacattccatcatcaggcacagagagagtacacctaaagtggtctccaagtatattgagagtcccgtgcttttcctgagggaagacgtcggcaaagtgaagttcgatattaggtatattgttctcctccggtctgtacggccactgcgtctgttcgtttatgacgtgttttggttgcgtttttcaaaccgagccttcgctctgaacgacctggatgattacgagaagcattttacagtcatgaattatgatcccgacgtggttttgaagcaggttcactgtgaggagtttatccctgagtttgaaaaacagtatccagagttcccttggacagatgtacaggctgagatctttagagcgtttacggaactgtttcaagtggcttgcgccaagccaccccccctaggactgtgtgattacccctcatcaagggctatgtacgccgtggacctgatgctcaagtgggacaacgggcctgatggcagaagagtgatgcaaccacagattctggaggtcaactttaaccctgactgcgaaagggcctgcagatatcacccaacatttttcaacgacgtgttttctactctgttcttggatcagcctggcgggtgccacgtgacttgcttggtgtag

SEQ ID NO: 182907 - DNA, 477 bp, Artificial Sequence
  Description of Artificial Sequence: Synthetic coding sequence
atggagctgagcgccatcggcgagcaggtgttcgccgtggagagcataaggaaaaagagagtgcggaagggcaaggtggagtacctggtcaagtggaaggggtggcccccaaaatattctacttgggagccagaagagcacatactggacccccgcctggtaatggcctacgaggagaaggaagagcgcgacagggcttcaggctaccggaaacggggccccaaaccgaaacgcctcctgctccaggagccgcccgcacctgatgtcctgcaggcagccggcgagtgggagccagccgcacagcctccagaggaggaagctgacgccgacttggccgaagggccacccccatggactcccgccctgccctcaagcgaagtcaccgtgaccgatatcaccgccaactctataaccgtgacctttagggaagcacaggccgcagaagggttctttcgggataggagcggtaagttttag

SEQ ID NO: 182908 - DNA, 366 bp, Artificial Sequence
  Description of Artificial Sequence: Synthetic coding sequence
atggagctgagcgccatcggcgagcaggtgttcgccgtggagagcatccggaagaagagggtcagaaaaggaaaggtggagtacctagttaagtggaagggctggccccctaaggaagagcgagatcgcgcatcgggctaccggaaacgcggtcccaaaccgaaacgactgcttttgcagaggctgtactcaatggatctgcggagctcccacaaagctaagggcaaggagaagctctgtttttccctgacatgcccactgggctccggatcaccagagggcgtcgtcaaggccggggcaccagagcttgtggataaaggcccactcgtgcctacacttcctttcccactgaggaagccgcggtag

SEQ ID NO: 182909 - DNA, 5133 bp, Artificial Sequence
  Description of Artificial Sequence: Synthetic coding sequence
atgaacggccacagcgacgaggagagcgtgcggaacagcagcggcgagagtagtcagagcgatgacgactcaggtagcgcttcaggatctggctctggcagttcgagtggcagcagtagcgacggtagcagctcgcaatcgggttcttctgactctgatagtgggtcagagtccggctcccagtctgaaagtgaatctgatacttcccgcgaaaataaagtgcaggcaaagccaccgaaggtagatggcgcggaattttggaagtctagcccttccattctcgcggtgcagagatctgcgatcctaaagaagcagcagcagcagcagcaacagcaacagcaccaagcctcatcaaacagcgggagtgaagaggactccagctccagcgaagattctgacgactcctcctcagaagtcaagagaaagaaacataaggatgaagactggcagatgtccggcagcgggtccccctcgcagagtggctccgattcggagtcggaagaggagcgcgaaaaatcttcttgtgatgaaacggagagcgattacgagcccaaaaacaaggtcaagagccgaaagccacagaacagaagtaagtccaagaatggcaagaagattctcggccagaagaagagacaaatagattcgtcagaggaggatgacgatgaagaggactacgacaacgataagcgaagcagtaggagacaggccacagtcaacgtttcatacaaggaggacgaagaaatgaagaccgatagtgatgatttgctcgaagtgtgtggcgaggacgtccctcaacctgaggaggaagagttcgaaacaatcgaaagatttatggattgcaggataggacgtaaaggtgcgactggggctacaacaactatttatgcggtcgaggccgatggcgacccaaatgccggatttgagaaaaacaaagagcccggagaaatacaatacctgatcaaatggaaagggtggtctcatatccataatacttgggagaccgaggagacactcaagcaacaaaacgtgcgtggaatgaaaaaactcgacaactacaagaaaaaggaccaggaaacaaagcggtggctgaagaatgcttctcccgaggatgtggagtactataactgtcaacaggagctcactgacgatctgcataagcagtaccagattgtcgagagaataatcgcccactccaatcaaaaaagtgccgctggttaccccgactattattgtaaatggcagggattgccctattccgaatgcagttgggaagatggggcgcttatctctaagaagttccaggcatgcattgacgaatatttctcgcgcaaccaatctaaaacaacacccttcaaggattgtaaggtcctgaagcaacggccgagatttgtcgccctgaaaaaacagcctagctacattgggggccatgaaggactggaactcagagattatcagctgaacggcctgaactggcttgcccacagttggtgcaaaggaaactcatgcattctagccgatgaaatggggctcggtaagacaattcagaccatctcttttcttaactacctcttccatgaacaccagctctatggccccttccttctggttgttcccctatctaccctcaccagttggcagagggaaatccaaacctgggccagccagatgaatgccgtggtttatctgggcgacattaactctcgcaatatgatcaggactcacgagtggacccatcatcagacaaagcgattgaagtttaatatcttactgactacatacgagatcctgctgaaggacaaagcgttcttaggaggcttgaactgggccttcatcggagtcgacgaagctcacaggcttaagaatgacgattcgctgctatataagactttgatcgactttaaatcaaaccatcggctgctcattactggtaccccgctgcagaacagtcttaaggagctctggtcgctgctccactttataatgcccgaaaagttttcctcttgggaggattttgaagaagaacacggcaaagggcgagaatacggatacgcctcactgcacaaggagcttgaacccttccttttacgcagagtgaaaaaagacgtggagaaaagccttcctgcaaaggtggagcagattctgcgcatggagatgtcggcactgcaaaagcagtactacaagtggattctaacccggaactacaaagccctatctaaaggcagcaaaggatcaacttcagggttcttgaacattatgatggagctaaaaaagtgctgtaatcattgttatctcatcaaacctccagataataatgaattttacaataaacaggaggctttgcagcatctgattcggtccagcggtaagctcattctgctggacaagctgctgatccgactgcgggaacgcgggaatagggtcttaatattcagccagatggttcgtatgttggacatccttgccgaatacctgaaatataggcaattccccttccaacgtttagacggcagcatcaaaggagaactgcgcaaacaagccttggaccactttaacgcagaggggtctgaagatttctgtttccttttgagtacaagagctggcggcttgggcatcaacttagccagcgctgatacagtcgtgatcttcgattcagactggaatccacagaacgatctacaagctcaggctagggcacaccgcatcggtcagaaaaagcaggtgaatatttatcgactggtaacaaagggaagtgtcgaggaggatatattggagagagctaagaaaaagatggtgctggaccacctggtgatccagagaatggacaccactgggaaaactgtcctgcatacaggttcagcgcctagtagctctacaccctttaacaaagaagaactgagcgccatcctcaaattcggggccgaagaactgtttaaggagccagaaggcgaggaacaagaaccacaggagatggatattgatgagattctgaagcgggcggaaactcatgagaatgagccagggcccctgaccgtgggagacgagctgctttcacagttcaaggttgccaacttcagtaatatggatgaggacgatattgagctggaacctgagagaaattccaagaactgggaggagataatcccagaggaccaacgcaggcgtctcgaagaggaggaaagacagaaagaactggaggagatctacatgcttccgagaatgcggaattgcgcaaaacaaatttccttcaatggaagtgagggcagaagatcacggtcccgacggtattcgggttcagatagcgactcgatttcagaagggaaaaggcctaagaagcgcgggcgcccacgtacaatccccagggagaatattaaaggcttctcggatgccgagatcaggcgctttattaagtcttacaaaaagtttggagggccgctcgagagactagatgccattgcacgggacgccgaactggttgataagtcagaaacagacctgagacggctaggagagttggttcataatggctgtatcaaggctctgaaagactcttccagtggtacggaacgcacaggcggcagactgggtaaggttaaagggcctactttccgcattagcggagtccaggtgaatgccaaactcgtgatttcacacgaggaagaactgatacctttgcacaaatccatccctagcgaccccgaagagcgcaagcagtacacaatcccgtgtcacacgaaagcagcccacttcgatatagactggggaaaggaggatgatagcaatctgttgatcggcatctacgagtatggttatgggagttgggagatgataaagatggatcctgacctgtcactgacacacaaaattttgcctgacgatcctgataagaagccacaggcaaagcaattgcagacaagggccgactatttaattaagctgctgtctcgggatcttgctaagaaagaggccctgtccggcgccggcagctccaagcgcaggaaagcccgagctaaaaagaataaagctatgaagagtatcaaagtgaaggaggagataaagtctgactcttcccctctgccaagtgagaagagcgacgaagacgatgacaaactgtccgaaagcaaatctgacggaagggagcgcagcaagaagtcgtcagtgagtgatgccccagtacacatcactgctagcggcgagcctgtgccaatctccgaagagtcagaagagctcgatcagaagacgttttctatctgcaaggaaagaatgcggcccgttaaagctgccttgaaacaattagaccggccagaaaagggcctctctgaacgtgagcaactcgagcatacgcggcagtgtctcatcaaaattggcgaccacatcacagagtgcctgaaagagtacactaaccccgagcagatcaagcagtggcgcaagaacctgtggatttttgtgagcaagttcactgaattcgatgctagaaaactccataaactttacaaacatgccattaagaaacggcaagagtcccagcagaactccgaccagaactccaatctgaatccgcacgtgataaggaacccagatgtggaaaggctgaaggaaaataccaaccatgatgattctagccgcgacagctatagcagcgatcggcacctgacccagtatcacgaccaccacaaggacaggcatcagggggatagctataaaaaatccgattctcggaagcgcccctactcgtctttctccaatgggaaggaccatcgggattgggaccattataaacaggacagcagatattatagcgaccgtgaaaaacatagaaagttggacgaccatcgcagccgcgaccaccggagtaatctggaaggctcccttaaagatagatctcactctgaccatagatcacacagcgaccaccgcctacactcggatcaccgttcgtccagtgaatacactcatcacaaatcgtccagagattacagatatcatagtgactggcagatggaccaccgtgcctcatcttccggcccacgcagccccctagatcagcgctctccatatggttcccgaagtcctttcgaacactctgtggaacataagtcaacgccagaacatacttggtctagcagaaaaacttag

SEQ ID NO: 182910 - DNA, 903 bp, Artificial Sequence
  Description of Artificial Sequence: Synthetic coding sequence
atgttcagcttcaccggcgtgctggtgatctacgaggtgctgaagaagtgtattggaaagctgatttctctccgggtatgcagcatcgagggctgcgtttgcgtctacgtttttgtgcctggggggaaggaattccatgaaaagctgaacatattccaccaaactaacctcatttgtctgtttctgaactcctcacgcaatctctggattttcgtgtcaaagttcactgaattcgatgcccggaagttgcataaactctacaagcatgcaatcaaaaagcgacaggaatcacagcaaaactctgaccagaactctaatctcaatccacacgttattagaaaccccgatgtggagcgcctaaaggagaacaccaatcacgatgatagctccagggacagctacagctctgaccggcatttgacacaatatcacgatcatcacaaggaccgccaccaaggggactcctataagaaaagcgatagccgaaagagaccatattcttcgttttcaaacgggaaagaccaccgcgactgggaccactataagcaggactctcgctactatagtgatagagagaaacaccggaaactggacgaccatcgaagtagggaccaccgctcgaacctcgaggggtctctcaaggaccgctcgcactctgaccatcgatcccattccgatcaccggctgcacagtgaccatcggagtagctccgagtatacccatcataagagctcacgcgactaccgctatcactcggattggcagatggaccatagggcatcatcaagcgggccacgcagcccactggaccaacggtccccatacgggtccaggagtccattcgaacattctgtggaacacaagtccaccccagagcatacttggagctctcgaaagacctag

SEQ ID NO: 182911 - DNA, 624 bp, Artificial Sequence
  Description of Artificial Sequence: Synthetic coding sequence
atgaacggccacagcgacgaggagagcgtgcggaacagcagcggcgagtcatctcagtctgacgacgactctggctccgcatcgggctccggatccggttcctcctccggtagctccagtgacggcagttcttctcagtccgggtcatccgattcagactcaggctccgagtctgggtcacagtctgagtccgaatccgatacttcgagggaaaacaaggtacaggctaagcccccaaaggtggatggagcagagttttggaaatcatctcccagcatcctggcggtgcagcgctccgccatcctgaaaaaacagcagcagcagcaacagcaacagcagcatcaggcgtctagcaattcgggctcagaggaggactcttcttctagcgaagattcagacgactcatcttctgaggttaagagaaagaagcacaaggatgaggactggcaaatgagcgggagtggaagccctagtcagtccggttccgattcagaatccgaggaggagcgtgaaaaatcttcttgtgatgaaacagagtccgactacgagcctaagaataaagtgaaaagccggaaacctcagaatagatccaagtctaagaatgagaagaagaaaaagaagtag

SEQ ID NO: 182912 - DNA, 660 bp, Artificial Sequence
  Description of Artificial Sequence: Synthetic coding sequence
gtgggcgccgaccgggacagccccaccctgctgcccgccggcggctccaactggcttgcccagcgctttcattgccagaatggctgcatcctgggcgatgaaatgggactgggtaaaacatgtcaaacaattgccctgtttatctacctcgccgggcgacttaacgacgagggcccctttttgatcctgtgtcctctgtcggtggagcagctagaaagacgaaacgctgagatctgttcccggagtttcctatgcaatatttgcggcgacaaagaagagcgcgcctgcctgcaacaggacctgaaacaggagtcccggtttcacgtcctcctgaccacctacgaaatttgcctcaaagatgcgagctttttgaaatccttcccatggtcagtccttgttgttgatgaggcacatcggctaaagaatcagagttcactcctccacaagacactcagcgagttttccgtggtgttctctctgctgctcacaggaacccccatacaaaactccttgcaggaattgtattcactacttagcttcgtcgaacccgatcttttcagcaaggaagagtgggaaatattattcaacgcaacaagaatcctcaggaagaacctatcccagcaagtgaactgtactaactcctgctcccatttctgttag

SEQ ID NO: 182913 - DNA, 1851 bp, Artificial Sequence
  Description of Artificial Sequence: Synthetic coding sequence
atgagcgccctgcagaagaagtactacaaggccatcctgatgaaggacttggacgcttttgaaaatgaaaccgcaaagaaagtgaagctccagaatattctctcgcaactgcgcaagtgcgtggaccacccctacctgttcgacggagtggaacccgaaccattcgaagtgggggatcatttgactgaggcgtctggcaagctgcacctcctcgacaagctgcttgccttcctgtacagcggggggcatagagtgcttctgtttagtcagatgacgcagatgttggatattttgcaagactatatggactaccgtggttattcctacgagcgcgttgacggctccgtgagaggcgaggagagacacttagccataaagaactttggtcagcagccaatcttcgtgttcttgctgagcactcgagccggcggcgtgggcatgaacctgaccgctgctgataccgtgattttcgttgattccgactttaatccacagaatgatctccaagccgctgctcgtgctcaccggatcggccagaataaatcagttaaggtcatccgtttaatcggacgggacaccgtggaggaaatcgtgtacagaaaagctgcctccaaattacagttgacgaatatgatcattgaaggcggtcacttcactctgggcgcacagaagcccgccgctgatgccgacctgcagctgtctgagatacttaagttcggcctggataaactgctggcatcggaagggagcacgatggacgaaattgacctcgagtctattctgggggaaacgaaagacggccaatgggtatcagatgccctgccggcggccgaagggggtagtcgggatcaggaagaaggaaagaatcatatgtatctatttgaaggaaaggactactctaaagaacccagcaaggaagatcgcaaatcctttgaacaactcgtgaacctgcagaaaaccctcctggaaaaggcttcacaggaggggagatcactgagaaacaagggctccgttctgatccctggtctggttgaggggtcaactaagcggaagcgggttctctctcccgaggaactggaagatcgccagaagaagaggcaggaggcggcagcaaaacgcaggcggctaattgaagagaaaaaaaggcaaaaggaggaagccgaacacaagaaaaaaatggcttggtgggaaagcaataattaccagagcttttgtctgccatccgaggagtcagagcccgaagatttggaaaacggagaagaatcctcagccgaactggattaccaggatcctgacgcgacttctttaaagtacgtatccggcgacgttacccacccgcaggccggcgctgaagacgccttgattgtgcattgcgttgacgattctggccactggggacggggcggactgtttactgcactggagaagaggtcagccgaacccagaaagatctacgaactcgctggcaagatgaaggacctaagcttggggggggttctcttatttccagtggatgacaaggaatctaggaacaagggtcaagacctgctcgccctaatcgtggcacagcacagagatcggtcaaatgtgctgtcaggtatcaagatggccgccctcgaggaaggactgaagaagatctttctggccgcaaaaaagaagaaggcgagcgttcacctaccacgaataggacatgccactaaggggtttaactggtatggtactgagcgattgatccgcaagcatctcgctgctcgggggatccccacgtacatttactacttcccaagatcgaagagtgccgtgctacacgcccaaagcagctcatcttctagtagacagctcgtgccatag

SEQ ID NO: 182914 - DNA, 2694 bp, Artificial Sequence
  Description of Artificial Sequence: Synthetic coding sequence
atggagcgggccggcgccaccagccggggcggccaggcccccggcttcttattacggctgcacaccgaaggacgtgccgaggcggccagggtgcaggagcaggatctcaggcaatggggcctcaccggcatccaccttaggagctaccaacttgaaggcgttaattggctagcgcagcggttccactgccagaacggctgcatcctcggcgatgaaatgggactgggtaaaacatgccagaccattgcgctctttatctacctcgccggcaggctgaacgacgaagggcccttcttgattctctgccccctgtccgtgttgagcaattggaaggaagagatgcaacggtttgcccccgggttatcgtgcgtaacatatgcgggagacaaagaggagagagcttgtctgcagcaggacctcaagcaggagtcacgtttccatgttctgttgacaacatacgagatatgcctgaaagatgcatctttcctgaagtcattcccttggtctgttcttgtggttgatgaggcccataggttgaaaaaccagagctcattactccacaaaacactgagcgagttctctgtcgtcttttccctgctcttaactggcacccccatccagaactccctgcaagagctctatagtctcctgagctttgttgaacccgaccttttttctaaggaagaggtcggtgactttatacagcgctaccaggacatcgagaaagaatcggagagcgcgagcgaactgcataagctactccagcctttcctgctccgtcgcgtcaaggcggaggttgctaccgagctccccaagaaaactgaggtcgtgatttaccacggcatgtccgctctgcagaagaaatattataaagctattctaatgaaggacctggatgccttcgaaaacgagacggcaaagaaggtcaaactgcagaacatattaagccagctgaggaagtgcgtggatcatccttatctattcgatggggtggaacctgaaccctttgaagtcggagaccacttaaccgaggcttccggtaagttgcatttgctcgacaagctgcttgcgttcttgtacagcggcgggcatagggtgctgctgttttctcaaatgacccagatgctcgatatactccaagactatatggactatcggggttacagctacgagagggtggacggctctgtccgcggtgaggaaaggcatctggccattaaaaactttggtcaacagcctatttttgtctttctcctgtccacccgggccggcggagtgggtatgaatttgactgccgccgatacagtgatatttgtagactcagactttaacccccaaaatgacctgcaggcagccgcccgtgcccataggattgggcagaacaagtctgtgaaggtaatccgtcttattggcagagacaccgtagaagaaatcgtgtataggaaggcggccagcaagctgcagctcaccaacatgataatagaaggaggccatttcactctgggcgcacagaaaccagcagcggatgccgatttgcaactgtcggaaattttgaagttcggcctggacaaactccttgcatcagaaggctccactatggatgaaatcgacctggagtctatactgggggaaaccaaggatggacaatgggtgagcgacgctctccctgctgcagaaggaggaagtcgagatcaggaggaaggaaagaatcacatgtacctgtttgaaggtaaagactacagcaaggaacccagcaaggaagatcggaagagcttcgagcagctggttaatctacaaaaaacactcttggagaaggcatcccaggagggaagaagcctgagaaacaaggggagtgtacttatacctggtttggtggaaggctccacgaagcgaaagagagttctgtcgcccgaggagctggaggacaggcagaagaagcgccaggaggccgcggccaagaggagacggcttatcgaggaaaagaaacgccaaaaagaagaagcagaacacaagaagaagatggcttggtgggagagcaacaattaccagagtttctgcctgccttctgaagagtccgagcctgaggatctggagaacggagaagagtcttccgccgaacttgattatcaagatcccgacgcaacttctcttaagtatgtcagtggcgacgtgactcacccacaagcaggcgctgaagatgcactgattgtgcattgtgtcgacgattctggacattgggggaggggcgggctttttaccgccttagaaaaaagaagcgcggagccgcgcaagatctatgaactggcgggaaagatgaaggacctgagccttggcggggtgctcctctttcctgttgacgacaaggaatcgaggaacaagggccaagacctattggctctgatcgtggcgcagcacagggaccgcagcaacgtgctctctgggataaaaatggcagccttggaagagggactgaagaaaatttttctggccgccaagaaaaagaaagcatcagtgcacttaccccggattggacatgcgactaaaggattcaattggtatgggacagagcgccttatacggaagcacctggccgccagaggtattcccacgtacatttattacttcccgcggtctaagtcagctgtgctccatgcacagagcagcagctcttcctccagacagttggtgccttag

SEQ ID NO: 182915 - DNA, 2082 bp, Artificial Sequence
  Description of Artificial Sequence: Synthetic coding sequence
atggagcgggccggcgccaccagccggggcggccaggcccccggcttcctgctgagattacatacggagggccgcgccgaggccgcacgcgtgcaagaacaggatcttcgccagtggggactgacagcaagtgagctgcacaaactattgcaaccttttcttctacgcagggttaaggcggaggttgctactgagcttccgaaaaaaaccgaagtcgtgatctatcatggaatgtcagcactgcagaaaaagtattataaggccatcctaatgaaagatctggatgcctttgaaaatgagacagcaaagaaggtgaagctgcagaatatcctttcccagctgcgcaaatgcgttgatcacccctacctgtttgatggagttgagcccgagccgtttgaggttggagaccacctaactgaagcttctggcaaactgcacttactagataaactgctggccttcctgtacagcggaggtcatcgagtgttgctcttttcccagatgacccagatgcttgatattttacaggactacatggactataggggctacagctatgagcgagtggacggctctgttcggggcgaggaacgtcacctggcaatcaaaaacttcggtcagcaaccgatctttgtcttcttactgtcgactagggctggaggagttggcatgaacttgaccgcagccgatacagtgattttcgtcgactctgacttcaaccctcagaatgacttgcaggctgcagccagagctcatcggattggtcagaacaaatctgtcaaggtgatccgtctaatcggtagagacactgttgaggagatcgtttaccggaaagcagcaagcaagcttcagctcactaacatgattatcgagggcggtcattttacccttggtgcccagaagcccgccgcagacgccgaccttcagctcagtgaaatactaaaattcggactcgacaaacttctagcctcggaagggagcaccatggatgagattgatttggagagcatcctaggcgaaacaaaggacggacaatgggtaagtgacgctttaccggccgccgagggggggagtcgagatcaggaggaaggaaaaaaccacatgtacttgttcgaaggaaaggattacagtaaagaacccagtaaggaggaccggaaaagttttgagcagcttgtgaacctccagaagaccctgctggaaaaagcaagtcaggagggaaggtctctgagaaataagggaagtgtgttaatccccggactagtggaaggctcaactaagcgaaagcgagtgctgtctcctgaggagctggaggataggcagaagaaacggcaggaagcagccgctaagagacgtcgcctgatcgaggagaagaagcggcagaaagaagaggccgagcacaagaaaaagatggcctggtgggagtcaaacaactaccaaagtttttgtcttccttcggaggaatccgaacccgaggacctcgaaaatggcgaagagagctcagctgaactcgattatcaggaccccgacgctacttccttgaagtacgtttccggcgacgtgacgcatccacaggccggggcagaggatgctctaatcgtgcattgtgtagacgactcaggtcactggggaagagggggcttgtttactgccctggaaaagcggtctgccgagccccgcaagatctacgagttagctgggaagatgaaagatctttctcttggtggagtgttactgttccctgtagatgataaggagtctcggaataaggggcaagacttgcttgctctgattgtagcccagcaccgagatcggtctaacgtgttgagcggcatcaaaatggccgctctggaggaaggcttgaaaaaaatctttcttgccgccaagaaaaaaaaagcaagcgtgcacctgcctcgcattggccatgccacaaagggatttaattggtacggcaccgaacgattaatacggaaacacctggcagcgagagggatccccacctacatatattacttccctcgctccaagtctgccgtcctgcatgcacagtcaagctcttcatccagccgacagctggtcccatag

SEQ ID NO: 182916 - DNA, 2412 bp, Artificial Sequence
  Description of Artificial Sequence: Synthetic coding sequence
atggagcgggccggcgccaccagccggggcggccaggcccccggcttcttgctgcgattgcatacagaagggcgggcagaggccgcacgcgttcaagaacaggacctgcggcaatggggtctgacagggattcaccttcggtcctatcaattggaaggcgttaactggcttgcccaaaggtttcattgtcagaatggctgtatcctcggggacgaaatggggcttggtaaaacctgccaaacaattgccctgttcatctacctggccggccggctgaacgatgaaggacctttcctcatcctctgcccactcagtgtgctcagcaattggaaggaggagatgcaacgatttgcgcctgggctttcttgtgttacctatgccggtgataaggaggagagagcttgtcttcaacaggatctgaaacaggaatcacgttttcacgtgctcctaacaacgtatgaaatttgcttaaaggatgcttcttttctcaagtctttcccctggtctgttcttgtggttgacgaagcccacagactgaagaaccagtccagcttgctgcacaaaaccctctccgagtttagtgtcgtgttttccctgctgcttactggaacccccatccagaactcactgcaggagttgtattcactgctaagttttgttgagccagatttgttttcaaaggaggaggtcggcgacttcattcagcgctaccaggacatcgagaaggagtccgagagtgcctctgagctccacaagctgttacagcccttcctgctgcggcgggttaaggccgaagtagccacggagctaccaaagaagacagaagtcgtcatttaccacggcatgtcagcccttcagaagaaatactacaaggccatactgatgaaagatttagatgcatttgagaatgaaacagccaaaaaagtaaaactgcagaacatactgtcacagctgcggaagtgtgtcgatcatccttatttgtttgatggcggtgtcggaatgaacctgaccgccgcggatactgttatttttgtcgacagtgatttcaatccccaaaacgatttacaggctgctgcaagagcccaccgcattggccagaataagagcgtcaaagtaatcagattaatcggtcgagacacagtggaagagatcgtctaccgtaaggccgcttctaaactgcagttgacaaacatgatcatcgaggggggccattttacactgggggctcagaagcctgccgctgacgccgatctccaattaagtgagattttaaaattcggtctggacaagcttctggcttccgagggttcaactatggacgagatagatcttgagtccatactgggcgagaccaaggatggacagtgggtgagcgacgcactccccgctgctgagggggggtctcgggaccaggaggaggggaagaaccatatgtacttattcgaaggcaaggattattcaaaggagcccagcaaggaggatcggaagtccttcgagcaactggtcaatcttcagaaaacccttctcgagaaggcctcgcaggaaggccgtagtctcaggaacaaaggcagcgtgctgattcccggacttgtcgaagggtcaaccaaacgcaagcgcgtgctctcacccgaggagctggaagacaggcagaaaaaacggcaggaagcggctgcgaagcgccggaggttaattgaggaaaagaagagacagaaggaagaagccgaacacaagaagaagatggcatggtgggaaagcaacaattatcagtcgttttgtctgcccagcgaagagtctgagcctgaagatttagaaaacggcgaggaatctagtgctgaactcgactaccaggaccccgatgcgacaagccttaaatatgtgagcggcgacgttacacatcctcaggccggcgctgaagatgccctcattgtgcattgcgtcgacgactcagggcattggggaagaggagggctgttcacagccctggagaagcggagcgctgagccacggaagatctatgagttggcgggcaaaatgaaggacctatctctgggcggagtgctacttttcccagtggacgataaagaatcccgcaacaaagggcaggatctactggcactgattgtggctcagcatcgcgatagaagcaatgtactgtcaggcataaagatggcggccctcgaggagggtcttaagaaaatttttcttgccgcgaagaagaaaaaggccagtgtgcaccttccccgtatcgggcacgctaccaaggggtttaactggtacggcacggagcggctgatccgcaaacacctggccgcacgtgggatccctacttacatatactattttccaaggtccaaaagtgctgtgctgcacgcacagtcatccagtagctcgtctcgtcaactggttccatag

SEQ ID NO: 182917 - DNA, 1305 bp, Artificial Sequence
  Description of Artificial Sequence: Synthetic coding sequence
atggccgtgagctgggagatgcggtgggcctggggccggcccgccagatttgccccaggcttgtcctgtgtgacatatgccggcgacaaggaggaacgagcttgcctgcagcaggatcttaaacaggaatctagattccatgtgcttcttactacctacgaaatatgcctcaaagatgcatctttcctgaagtctttcccttggagcgtcctcgtggtggatgaagcgcaccggctaaagaaccagtcaagcctcctccacaaaactctgagtgaattcagcgtagtgttctccctactgcttactggaacgcctatccagaacagcctgcaggagttgtattcactactaagcttcgtggagcccgacctctttagcaaagaagaggtgggcgactttattcagcgctaccaggacattgagaaggaaagtgagagtgcctctgagctgcataaactgctccaaccgttcctgctccgcagagtaaaagccgaagtagcgaccgagctccccaagaaaacagaagtggtcatatatcatgggatgtcagcccttcaaaaaaaatactataaggcaatccttatgaaagacttagacgcttttgagaacgaaacagctaagaaagtgaagttacaaaatatcctgtctcaacttcgtaaatgtgtggaccatccctacttattcgatggggtggagccagagccgttcgaagtcggggaccatctcacagaagctagtggcaagctccatctacttgacaagctcctggccttcctatattccggaggtcatcgagtcctgctgttctctcagatgacgcagatgctggacatactccaggactacatggactacaggggctactcttatgagcgcgtggacggttccgtgcgaggggaagagagacatctggccatcaaaaactttggccaacagcctatcttcgtgtttttgctgtcaactagggcaggcggcgtcgggatgaatctcacagctgcagatacagttattttcgtagatagcgacttcaatccccagaacgacttgcaggcagcagctcgcgctcacagaattggccagaacaagagtgtgaaggtgatccgccttatcggccgcgatacagtcgaagaaatcgtttacaggaaggctgctagcaagctgcagctgacaaacatgattatcgagggtggccactttacgctcggggctcagaaaccggccgcagatgcggatttgcaggtccgttacagcaacttggtctggataaattgctggcctctccgcggggctccatggatgaagtag

SEQ ID NO: 182918 - DNA, 5487 bp, Artificial Sequence
  Description of Artificial Sequence: Synthetic coding sequence
atgatgcggaacaaggacaagagccaggaggaggacagcagcctgcattctaatgcctcttctcatagtgcttcagaagaagccagcggctccgactccggaagccaatccgagtccgaacaaggtagtgaccctggctctggccacgggtctgagtccaattcctcctctgagtctagtgagtcacagtctgagtctgagtctgaatcggcaggcagcaagtctcagcccgtcttgcctgaagctaaagagaaacctgccagcaagaaggaacgtatcgccgacgttaaaaagatgtgggaggagtatcctgacgtgtacggagtgcggcgctcaaatcggtcaaggcaggaaccaagcagatttaatatcaaagaagaggccagtagcggttccgaatccggttctccgaaacggagggggcagcgacagctcaaaaagcaggagaaatggaaacaagaaccatcggaggacgagcaggagcagggcacttccgcagaaagcgagcccgaacagaagaaagtgaaagcaagaagacccgtgccccgccgcacagtcccaaagcccagggtgaagaaacagcctaaaactcaaagaggaaagcgtaagaagcaggacagcagcgatgaagacgacgatgatgacgaggctccgaagaggcaaacaaggagacgagctgccaaaaacgtgagctataaagaagacgacgacttcgaaacagacagtgacgacttgattgaaatgactggtgagggcgttgacgaacagcaggataattccgagaccatagagaaagtgctagatagccggcttgggaagaagggcgccaccggggccagcactacagtctacgcaatagaggcaaacggtgatccctctggagatttcgatacagagaaggatgagggggaaatccaatatctgatcaagtggaagggctggtcttatatacattctacctgggagagtgaggaaagcctccaacagcaaaaagtaaagggactgaagaaacttgaaaatttcaagaaaaaagaagacgaaataaagcagtggttaggtaaggtgtctcccgaagacgtggagtattttaattgccagcaagaactggcctcagaactgaacaagcagtaccagattgtggaacgtgtcatagccgtaaaaaccagcaagagcacactagggcagacggactttcctgcccacagtagaaagcccgccccctcaaatgaacctgaatacctgtgtaagtggatgggtctcccatacagtgagtgttcttgggaggacgaagcactaatcgggaaaaagttccagaattgtatcgactctttccattcacggaacaactcaaaaacaatccccacgcgcgagtgtaaagctttgaagcagaggccgcgtttcgtggcactcaaaaaacagcctgcatatctcggaggtgagaatctggagctccgggattaccaactcgagggcctcaactggctggcccactcatggtgtaagaacaatagcgtcatactcgcagacgagatggggctcgggaagactattcagacaatttcatttctgtcctacctgttccaccagcaccagctgtacggcccattccttatcgtggtgcccctgtctaccctgaccagctggcagagggaatttgagatctgggccccggagattaatgtcgtggtgtacattggcgatctgatgagccggaacacaatacgagagtatgaatggatccactcccagacgaaaagacttaagttcaatgccctcatcacaacctacgagattttactgaaagataagaccgtgttggggtcaatcaactgggcctttctgggagttgacgaggcccaccggctcaagaacgacgacagtctgctatacaagacactgatcgacttcaagagcaaccaccgccttttaatcacaggtactccactgcagaattctctgaaggagctttggagcctgctccacttcatcatgccggagaaatttgaattctgggaggactttgaagaggaccatggtaagggccgggaaaatggctaccaatccctgcacaaagtgctagaacccttcctcctaaggcgtgtcaagaaagacgtcgagaaatcgctgccagccaaagtggaacagattctccgcgtggagatgtcagccttacagaaacaatactataagtggattctgacacggaattataaggcattagctaaaggtacgcgcggcagcacgagtggtttcctgaacattgttatggagctaaagaagtgctgcaatcactgctaccttattaagcctccagaggaaaatgaaagagaaaatggacaggagatactcctctcgctcatccggagttctgggaagctcattctgctcgataagctcttgaccaggctgcgggagaggggcaacagagttcttatcttttcacaaatggttcgcatgctggatatactggccgagtacctcactatcaaacattacccattccagaggctagatgggagtataaagggcgagataaggaagcaggccctggaccactttaatgctgatggttcagaagacttctgcttcctgctctccaccagggcaggaggcctgggaatcaacctcgcgagcgcagacaccgtagtgatcttcgactctgactggaacccacagaatgacctgcaggcccaggcccgggcccatagaattgggcagaagaaacaggtgaatatttaccgcctggtcactaagggtacggttgaggaagagattattgaaagagccaagaaaaagatggtgcttgaccacttggtgatccaaagaatggataccactggaaggactattctcgaaaataactctggtagatctaactccaatcctttcaataaggaggagcttacagcaatcctgaaattcggagcggaagatctgttcaaagaactggagggggaagagagcgagcctcaagaaatggatattgatgaaatcctccgactggccgagactcgggaaaacgaagtctccacctccgcaactgacgagctgctgtcacagttcaaagttgctaattttgccaccatggaggacgaggaggaactggaggaacggccccacaaggattgggatgaaattatccctgaggagcagagaaaaaaagtggaggaggaggagagacaaaaagaattagaggaaatttacatgctaccccgaattcgctcatccactaagaaggctcagaccaacgacagcgactcagacactgagtccaagagacaagcacaacgatctagtgcatcagagtcagagacagaagacagtgacgatgacaaaaaacctaaaaggagaggccgaccgagatccgtgaggaaagacttggtcgaaggcttcaccgatgccgagattcgccggtttatcaaagcatacaaaaaatttggcctgcccttggagcgactggagtgtattgcccgcgacgccgaacttgtagataaatctgtggccgatctgaaacgattaggcgagttgattcacaattcttgtgtctccgctatgcaggaatatgaggaacagctgaaggaaaatgcatccgaaggcaagggcccaggcaagaggcggggtcctaccatcaagattagcggggttcaagttaatgtcaaatccattatccagcacgaggaggagtttgagatgctccacaagagcattcctgtagatcccgaggagaagaagaagtactgcctgacttgtcgtgtgaaggccgcccatttcgacgtggaatggggggttgaggatgactcacggctcctgctggggatatacgagcacgggtacggtaactgggaactcattaagacagatcccgaactgaaattgactgacaagatccttccggtggagacagataagaaaccccaggggaaacagctgcaaacaagagcggattatttgctgaagttgctgcgcaagggcctggagaaaaagggcgccgttacagggggagaggaagctaagctaaaaaagagaaagccaagggtgaaaaaggaaaacaaagtgccaagattgaaggaggaacacggcatagagctgtctagccccagacattccgacaacccttcagaggaaggcgaagtgaaggacgacggtctggagaagtctcctatgaagaaaaagcagaaaaaaaaggagaacaaggagaacaaagaaaagcagatgtcctccaggaaagacaaggaaggcgacaaggagcgcaaaaaatctaaggacaaaaaggaaaagcctaagtccggcgacgctaaatcttctagcaagtccaaaaggtcacaaggccctgtgcacatcaccgctgggtccgaacccgtacctataggagaggacgaggacgatgacctggaccaggaaacctttagtatttgcaaggagcgtatgcgtccagttaaaaaggccctcaaacagcttgataagccggataagggcctgaacgtccaggagcaactggaacatacacggaactgtctgctgaaaattggtgataggattgcagagtgtttgaaggcatatagcgatcaagaacatatcaagctgtggaggcggaacctgtggattttcgtgtcaaagttcactgaattcgatgcccgtaaactgcataagctctataaaatggcccacaaaaagaggagccaagaggaagaagaacagaaaaagaaagatgatgtgacaggaggaaaaaagcccttccgcccagaagcttctggtagctcccgtgactccctgatttcccagtcacatacttcacataacttgcaccctcagaaaccccacttgccagctagtcacggcccacagatgcacgggcacccacgcgataattataaccaccctaacaaaagacactttagcaacgcagaccgcggtgactggcagcgtgaaagaaaattcaactacggaggagggaataataatccaccgtgggggagtgatcggcaccaccaatacgaacaacactggtacaaggaccaccactatggggaccgtcgacatatggatgctcaccggtctgggtcctacagaccgaacaacatgagtcgaaagcgtccctatgatcagtattcttctgatcgagaccatcgggggcatcgcgactactatgatcgccaccaccacgacagtaagcggagacgaagcgatgaattcaggccacaaaactatcaccagcaggatttccggagaatgagcgaccatcgtccagccatgggctatcacggacagggtccgagtgaccattacagaagcttccacaccgataagctcggcgagtacaagcagcctctgccaccactacaccctgcggtctctgacccccggtcccctcctagccagaaatctccccacgatagtaaatcccctctggaccaccgtagtccattggaacgttcactggaacaaaaaaacaacccagattacaactggaacgtgagaaaaacgtag

SEQ ID NO: 182919 - DNA, 1506 bp, Artificial Sequence
  Description of Artificial Sequence: Synthetic coding sequence
atgatgcggaacaaggacaagagccaggaggaggacagcagcctgcacagtaacgcttcatctcatagcgccagcgaagaagccagcgggagtgacagcgggtcacagagtgagtctgagcagggaagtgaccccggctccggccacgggagcgagagtaacagtagctccgagagtagcgaatcccagtcagaaagtgaatcagaaagtgcgggctctaaaagtcaacccgtgcttccggaagccaaggagaagcccgcctcaaagaaagaaaggattgccgatgttaagaagatgtgggaagagtatccagacgtttatggagtgcggagatctaaccggtcccgccaggagccttcacgcttcaacatcaaagaggaagcctccagtggtagtgagagcggcagccccaagcgtcgcggccagcgccaactgaagaaacaggagaagtggaagcaggagcctagcgaggacgagcaggagcaggggaccagtgccgaatctgagcccgagcagaaaaaagttaaggcgaggcgtccagtgccaagaaggactgtaccgaagcctcgggtcaagaagcagcctaagactcaacgcggtaagcgcaaaaaacaggattccagcgatgaagatgatgatgatgacgaagcccccaaacgccagacaaggcgtagggctgctaagaatgtctcatacaaagaggatgacgactttgagaccgacagtgacgatctgatcgaaatgacaggcgagggtgtagatgaacagcaggataactctgagactattgaaaaggtgctggactctcggcttgggaaaaagggcgcaaccggcgctagtacaacagtgtacgccatagaggcaaatggtgacccctctggcgactttgacacggaaaaagatgagggtgagatacagtacctgataaaatggaaggggtggagttacattcacagcacatgggagagtgaagagagcttgcaacagcaaaaggtcaaaggactgaaaaaacttgagaacttcaagaaaaaggaagacgaaataaagcagtggttaggaaaggtgtcccctgaggatgtcgagtactttaattgccagcaggaactcgcctccgagttgaacaaacagtatcagatagtggaaagagtgatcgccgttaagacatctaagtccacccttgggcagactgactttcctgcccatagtagaaagcccgcaccctctaatgagcctgagtatctgtgtaagtggatggggcttccctactctgagtgcagttgggaagacgaagccctgatcgggaaaaaattccagaactgtattgattctttccatagccggaataacagcaaaaccattccaacccgcgagtgcaaagccttgaaacagaggcctaggttcgtggccttaaagaagcaacctgcctatctgggcggtgagaatcttgaactgagagattaccagcttgaaggtttgaactggctggcccatagctggtgtaagtag

SEQ ID NO: 182920 - DNA, 1545 bp, Artificial Sequence
  Description of Artificial Sequence: Synthetic coding sequence
atggcccacaagcagcgggaggactacctgaacctgagcccctgcgtttttacttggtaccggactttctctcagttggcctttgacggcgaaaaattgtcgcattctgcttctgaggaagcaagcggaagcgactccgggagtcagagcgagagtgaacagggtagcgatccaggttctggacacggcagcgagagcaattcctcgtctgagtcatctgaatcccagagtgagtccgaatctgagagcgccggctcgaagagccagcccgtgctgcccgaggccaaagagaagcctgcgtctaagaaggaaaggattgccgacgtgaagaagatgtgggaagagtatcctgatgtctacggcgtcagaaggagtaaccgatcccggcaggaaccatcgcgctttaacataaaagaggaggcctcctcgggtagcgagtcggggtcgcccaagaggaggggtcagcggcaattgaaaaaacaggaaaagtggaagcaagaacctagcgaggacgagcaagaacagggtactagcgctgagtccgagccagaacaaaaaaaagtgaaagcgaggcggccggttccccgaaggactgtgcctaaaccgcgcgtcaagaagcagcctaagacccaacgcggtaaaaggaagaaacaagattcttctgatgaagatgacgacgacgatgaagccccaaagagacagaccaggcggagagccgccaaaaacgtcagctacaaggaagacgacgattttgagaccgattctgatgacctgattgaaatgacaggagagggtgtagatgaacaacaggataattcagagaccattgaaaaggtactggacagccgcctcgggaagaaaggcgctaccggtgcatcaaccactgtgtacgccatcgaagcaaacggcgatccttcaggtgactttgacactgagaaggatgagggagagattcagtatctgatcaagtggaaaggctggagctacattcacagcacctgggagagcgaggaaagcctgcagcagcagaaggtcaaggggctaaaaaagctcgagaactttaagaagaaagaggacgagatcaagcagtggctcgggaaagtgtcgcccgaagatgtcgaatactttaactgtcaacaagagttagcctcagagctgaacaaacaataccagattgtagaacgggttatcgccgtgaaaacctctaagagcacattgggccagaccgattttccagcacattcaaggaaacctgctccttctaatgagcccgagtacctgtgcaagtggatggggctgccctattccgaatgctcttgggaggacgaagctctgatcggaaagaagttccagaactgcatcgacagctttcattcaaggaacaacagcaagaccattcccacccgggagtgtaaggccctaaagcaacggcccagatttgtcgcacttaaaaagcagcctgcctacctgggcggcgaaaatctggaactgagggattatcagctcgagggcctcaattggttagcccatagctggtgcaagtag

SEQ ID NO: 182921 - DNA, 552 bp, Artificial Sequence
  Description of Artificial Sequence: Synthetic coding sequence
atgatgcggaacaaggacaagagccaggaggaggacagcagcctgcacagtaatgcgagttcacattcagccagcgaggaggcgagtggatcagactctggttcacaaagcgaaagcgaacaagggtctgatccagggagtggccacggatccgaatctaattctagttcggagtctagtgagtcacaatccgagtcagagtctgagagcgcaggctctaagtctcagcccgtgctccctgaggccaaggagaaacctgcttccaaaaaagaacgcattgctgacgtgaagaaaatgtgggaagaatatcccgacgtctacggcgtgcgacggagcaacagatcccgacaagagcctagccgattcaatattaaagaggaggcctcctctgggagcgagagcggatccccgaagcggcggggccagaggcagctgaaaaaacaggaaaaatggaagcaagagccttccgaggacgagcaggaacaggggactagtgctgagtctgaaccggaacagaaaaaagtaaaagcaaggcgcccagtgcctagatag

SEQ ID NO: 182922 - DNA, 5220 bp, Artificial Sequence
  Description of Artificial Sequence: Synthetic coding sequence
atgatgcggaacaaggacaagagccaggaggaggacagcagcctgcactctaatgcaagctcccacagtgccagcgaagaggcttcaggaagcgacagtggcagccagtctgagtccgaacagggctccgaccctggtagtggacatggctccgagtcaaatagcagcagcgaatcatctgagagccagtctgagtccgagtccgaaagcgcaggctcaaaaagtcagcctgtgctgcccgaagctaaagagaagcctgcctcaaagaaagagcgcatcgccgacgtcaagaaaatgtgggaggagtaccctgacgtctacggtgtgaggcgctctaaccggagtcgccaggagcccagccggtttaatatcaaggaggaggctagcagcgggagtgagtctgggtcgcccaaacggcgaggccaaaggcaactcaagaaacaggagaagtggaaacaggaaccttctgaagacgagcaggagcagggtaccagtgccgaaagtgagcccgagcagaagaaggtaaaagcccgtaggcccgtacccaggcggacagttccaaagccacgggtgaagaagcagccaaagacgcagagaggcaaaaggaaaaagcaggactcatctgatgaggacgatgacgacgatgaagctccaaagcggcagacccgaaggcgagctgcaaaaaatgtttcttacaaagaagacgatgatttcgagacagacagcgacgatctgatcgagatgacaggcgagggggtggatgagcagcaggataactcagagaccattgagaaagtattggacagtcgactggggaagaagggcgctaccggagcttccaccactgtctatgcaatcgaggcaaacggcgacccttccggagacttcgacaccgaaaaagatgagggagaaatccaatatctgattaagtggaaaggatggagttatattcacagcacttgggaaagcgaggagagcctgcagcagcagaaggtgaagggcctgaagaaactcgagaatttcaagaaaaaggaagacgaaatcaagcagtggctcggaaaggtgtcccccgaggatgtagagtattttaactgccaacaggagttggcaagcgagctgaacaaacaataccagatcgtcgaaagggtgatcgccgttaagacttctaaaagcacactgggacagacagatttcccagcccacagtaggaagcccgctccttcaaatgagccggaatatctctgtaagtggatgggtctgccttacagcgagtgcagctgggaagacgaagccctgatcgggaagaagttccaaaattgcatcgactccttccactcccgcaataactccaagacaatcccgactagggagtgcaaggctctcaagcaacgccctagatttgtggccttgaagaagcagccggcttatctggggggagagaacctagagctgcgagactatcaattggagggattaaattggcttgcccactcctggtgcaagaataactctgtgattctggccgacgagatgggtctgggaaagacaatccagaccataagtttccttagctacctcttccaccagcaccagctgtacggtcctttcctgatcgttgtgccactgagcacactgacgtcttggcagcgggagtttgaaatttgggcgccagagatcaacgtggtggtctacattggggacttgatgagtcggaacactatccgggaatacgagtggatccacagccagactaaacggctcaagttcaacgccttgattacaacctacgaaattctcctgaaggacaaaacagtgttgggctcaatcaattgggcattcctaggcgttgatgaagcccaccgcctaaagaacgatgatagcctgctgtataaaacactaatcgactttaagagtaatcatcggctcctgataactggtacacccctgcaaaacagtctgaaggaactgtggtcactcctccatttcatcatgcccgagaagtttgagttttgggaggacttcgaggaggaccatggaaaagggcgtgaaaatggatatcaatcactgcacaaggtcttggagcccttcctcctgagaagggtcaaaaaggacgtcgaaaagtcactgcctgccaaggtggagcagatcttgcgggtcgagatgtctgctctgcagaaacagtactataagtggatcctaaccaggaactataaggccttggctaagggtaccagagggagcacgtcgggattccttaatatcgtgatggagctgaagaagtgctgcaaccattgttaccttataaaaccccccgaagagaacgagcgtgagaatggacaggagattctgctaagcctgatccgcagcagcggaaagctaatcctgttagacaagctactgacaagattacgtgagaggggaaatcgtgtactcatatttagtcagatggtaaggatgctggacatcctggcggagtacttaacgataaagcactacccttttcagagactggatggcagtattaaaggagaaatccgaaaacaagccctggatcactttaacgcggacgggagcgaggacttttgcttcctgctgagcacccgggcggggggccttggtattaaccttgcgagtgccgacacggtggttatcttcgattctgattggaatccccagaacgacctgcaggcccaggcccgagcgcacaggattggccagaagaagcaggtaaacatctatcgccttgtgacgaaaggaaccgttgaggaagaaatcatcgaacgggctaaaaagaaaatggtcctggaccatctggtcatccaacggatggacactaccgggaggaccatcctcgagaataactctggacggagcaactccaacccttttaacaaggaagagctcaccgcaatcctcaagttcggagcagaggatcttttcaaggaactggagggagaagagagcgaacctcaggagatggatattgacgagattctgagactggcagaaacacgagagaatgaggtgtcaacaagtgctactgatgagctcctgagtcagtttaaggtcgcaaattttgcaactatggaagacgaggaggagttagaggagcgaccccataaggactgggatgagataattcccgaggagcagcggaagaaagtggaggaagaggagcggcagaaggaattggaggaaatctacatgttgccgcggataagatctagcacaaagaaggcccaaacaaatgatagcgattcagataccgaatctaagcgccaggcgcagagatcctcagcttctgaaagcgagacagaagatagcgatgacgataaaaaaccaaagaggcgggggcgcccacggagcgtgagaaaggatcttgtcgagggcttcacagatgcagaaattaggagatttatcaaagcctacaagaaattcggcctcccactggaacggctggaatgtatcgcacgcgatgccgagcttgtcgacaaaagcgttgccgacctcaagcgactaggagagctgatccacaactcatgcgtatccgccatgcaggagtacgaggaacagttgaaagagaatgccagcgaggggaaaggccctgggaagcgcagaggacccactatcaagattagcggagtgcaagtcaatgttaagtccatcatacagcacgaagaagaatttgagatgctccacaaatcaatcccagtggaccccgaggagaagaagaagtattgtctgacttgtagggtcaaggctgcacatttcgacgtggagtggggagttgaagatgatagccgccttctacttggaatttatgagcacggttatgggaattgggagttgattaaaactgatccagagttgaaacttaccgataagatcctccctgttgagacagataaaaaaccgcaagggaagcagcttcagacccgcgccgattatctgctgaaattgttacgaaagggattggaaaagaaaggggctgtgaccggcggcgaggaggctaaactgaagaagcgcaagccacgggtcaagaaggagaataaggtgcctcgcctaaaggaggagcacggaattgagctgagctctcctaggcactcagataatccttcggaggagggggaggtaaaagatgatggcctagagaaaagcccgatgaagaagaaacagaaaaaaaaagaaaataaggagaacaaggagaagcagatgagcagcagaaaggacaaggagggcgataaggagcgtaaaaagtccaaggataagaaggaaaagcctaagtccggggacgcaaaaagctcgtccaagtctaaaaggagccaaggccccgttcacataactgcaggatctgagcccgtgcctattggggaggatgaagacgatgatcttgaccaggagacgtttagcatctgcaaggagaggatgagacctgtgaaaaaggccctgaaacagttggacaaacctgataaagggctgaacgttcaggaacaactcgagcacacgagaaactgcctgctgaagatcggagacagaatcgcagagtgtctgaaagcctacagtgatcaagaacatattaagctgtggcgtcggaacctctggatctttgtgtctaagttcactgagttcgatgccaggaagcttcacaaactgtataagatggcccataagaagaggagccaggaagaggaggaacagaaaaagaaggacgatgtcaccggcgggaaaaaaccttttagacccgaagcttccggttcttcacgtgattcactgatctctcagtcacacacttcccacaatttgcacccacagaaacctcacctccctgcaagtcacgggcctcagatgcacggacaccctagagacaactacaaccatcccaacaaaagacatttcagcaatgccgatcggggcgattggcagcgggaaaggaagtttaattacggcgggggtaataacaatcccccttggggttcagatagacatcaccagtatgaacagcactggtacaaggatcaccactacggagaccggagacacatggacgctcacagatctgggagctatcgaccaaataacatgagccgaaagagaccctatgaccaatactccagcgatcgtgatcacagagggcatagagactattacgatcgatatgcaaaggggtgcgagacaccgggcgcgaacttgtgtcaagaactgtttttagggcgtaaatag

SEQ ID NO: 182923 - DNA, 6003 bp, Artificial Sequence
  Description of Artificial Sequence: Synthetic coding sequence
atgaaggccgccgacaccgtgatcctgtgggcccggagcaagaacgaccagctcagaatctccttcccaccaggtctatgttggggggatcggatgccagacaaagacgacattaggctcctgccctctgccctgggggtgaaaaaaaggaagcgcggacctaaaaagcagaaagaaaacaaacctggtaaaccaaggaagagaaagaagcgggactccgaagaggaattcggctctgaaagagatgaatatcgagagaagtcagagtccgggggaagtgaatatggcacgggccccggaagaaaacgtcgtaggaagcacagagaaaaaaaggagaaaaagacgaagaggagaaaaaagggagaaggtgacggcgggcagaaacaggttgagcagaaaagctcagctacactacttttgacttggggcctggaggacgtggagcacgtcttctctgaggaggactatcacacgctgaccaactacaaagcattctctcagtttatgcgcccacttatcgcgaaaaagaaccctaaaataccgatgagtaagatgatgacaattttgggggctaaatggcgcgaatttagcgctaataatccattcaaaggaagtgctgccgccgtcgccgcagcagccgccgccgcggcagctgcagtggccgagcaggtcagcgccgcagtaagcagtgccacacccatcgctcccagcggccctcctgccctgcctccccccccagccgctgacatccagccacctcctatcaggagagctaagacaaaagaaggaaaggggccagggcacaagcgaaggagcaagtcgccaagggtgcccgatggcagaaagaagcttagagggaagaaaatggctccactcaagatcaagctgggcctgctcggagggaaaagaaagaagggaggaagttatgtttttcagtcagacgagggaccagagcccgaggcggaagagtctgacctggacagcggtagcgtccacagcgcatctggaaggcctgacggacctgtgagaaccaagaaactgaagcggggtcgccccggtagaaagaagaagaaagtgctgggttgtccagcggtggcgggcgaggaggaagtagatggctatgagacagaccaccaggactattgtgaggtgtgccagcagggaggcgagataattctttgtgacacttgcccgcgggcctaccatttggtgtgtctcgaccctgagcttgatcgcgctcctgagggaaaatggagctgcccccactgtgaaaaggagggcgtgcaatgggaagcaaaagaagaggaggaggagtatgaggaagagggagaagaagagggggagaaggaggaagaggacgaccacatggaatactgtagggtctgcaaggacggcggagaactactatgctgcgatgcctgcatcagttcctatcatattcattgtcttaatccacccctccccgacattccaaatggcgaatggttatgccctcggtgcacctgccctgtgctcaaggggagagttcagaaaattctgcattggcggtggggcgagcctccggtagcagtgcccgccccccagcaggctgacggtaatcccgatgtccccccgccccgaccccttcagggacgatccgagcgggaatttttcgtgaaatgggtgggcctgtcttactggcattgctcctgggctaaagagctgcagctcgagatatttcaccttgtcatgtatagaaactatcagagaaaaaacgatatggacgaacccccccctctggattacgggagcggagaagacgatggcaaatcggacaagcggaaggtgaaggaccctcactatgccgagatggaagaaaagtattataggttcggcataaagcctgagtggatgacagtacacaggataattaaccattctgtggacaaaaagggcaattaccactaccttgtaaagtggagggatctgccgtacgatcagtccacatgggaggaggatgaaatgaatatcccggaatatgaggagcataagcagtcttattggcgacaccgggagctgatcatgggtgaggacccagcgcagcccagaaaatataaaaagaaaaaaaaggagttacagggagatggtcccccctcttcaccgaccaacgatcccactgtgaaatacgaaactcagccaagatttattactgcgactggcggtaccctgcacatgtaccagctagagggactcaactggttgcgctttagctgggcccagggcactgatacaatcctagcagatgaaatgggattaggcaaaaccattcagaccatcgttttcctgtacagcctttataaagaggggcacaccaaaggtccgtttctggtgagtgctccccttagcaccatcatcaattgggagcgcgagttccagatgtgggccccgaaattctacgtggtcacctacaccggcgataaggactcccgcgctattattcgggaaaacgaattttcatttgaggacaatgctataaaaggcggaaaaaaggcctttaagatgaaacgagaagcacaggttaaattccatgtcctgctgacttcttacgagctcatcaccattgaccaggcagcgctcggctccatccgatgggcttgtctggtggtggacgaggcccataggttgaaaaataaccagtccaaattctttagagtgctgaacggttacaaaattgaccacaaattactgttgacagggaccccgttgcaaaacaatctggaggagctgttccacctgctgaattttcttacacctgaaagattcaataacctcgaaggtttccttgaggagtttgctgacatctcaaaagaggaccaaattaagaagcttcatgacttgttaggacctcacatgctccgccggctgaaagcagacgtatttaaaaatatgcccgctaaaaccgagcttatagtaagggtggagctatcgcctatgcagaaaaaatattacaaatacatactgacacggaattttgaagcactcaactccagaggcggcggcaatcaggtctctctgctgaacatcatgatggatctgaaaaaatgttgcaaccatccctatctttttcctgttgcggccatggagagtcccaagttgccctccggagcgtatgagggtggcgccctgataaaatctagtggcaaactgatgctgctccaaaaaatgctgcgcaagctgaaagagcaaggacatagggtgttaattttctcacagatgaccaaaatgctggacctgctggaagactttttagattatgaggggtacaaatacgagcgcatcgacggtggcattactggagctttgaggcaagaggcgattgataggttcaacgcccctggggcacagcagttctgctttttactctccacacgcgccggcggcctcggaatcaatctcgctaccgcagacacagtaatcattttcgattccgattggaacccccataacgatatccaggcctttagccgggctcacaggattggccaggcaaacaaagttatgatctacagatttgtgacccgagcttcagtggaggagcggatcacccaggttgcaaagaggaaaatgatgctgacacacctcgttgttcgcccgggtctgggctcaaaggcaggctcaatgtccaagcaggagcttgacgacatcctgaagttcggcacagaagagttgttcaaggacgagaacgaaggggagaacaaggaggaggattctagcgtgattcactacgacaatgaggctatagccaggctgctcgaccggaatcaggacgctacagaggatacagatgtacaaaacatgaatgaatacctgtctagctttaaggtcgcacagtacgttgtgagggaagaagataagatcgaagaaatcgaaagggaaatcattaaacaggaggaaaatgtcgaccccgactactgggaaaagctattgcgccaccattacgaacagcagcaggaagacctggcgagaaatctgggtaaaggcaagcgagtgcggaaacaggtgaactataatgacgcagcacaggaggatcaggataatcagagcgagtattccgttggctcagaagaagaagacgaagactttgatgaaaggcccgagggacgtcggcagagcaaacggcagctcagaaatgagaaggataagcccctgccccccctccttgccagggtaggcggcaacatcgaagtactcggcttcaatactcgacaaaggaaggccttcttaaatgccgtgatgcggtgggggatgcctccacaagacgccttcaccactcaatggctcgttagggacctgagggggaagaccgagaaggagtttaaagcctatgtgagccttttcatgcgtcatctctgtgagcccggtgctgacgggagcgagacattcgccgacggagtgcctcgcgagggcttgagcaggcagcaagtgttgactagaataggcgtaatgagtctcgtgaaaaaaaaggttcaggagtttgaacatatcaatggaagatggagcatgcccgagctgatgcctgacccctctgcagatagtaagcgatccagccgtgccagttcacccactaaaacctcccctactacgccagaggcctccgccacaaactcaccttgtaccagtaaacccgctacacccgctcccagcgagaagggcgagggcatccgcaccccactggaaaaagaagaagctgaaaaccaggaagagaaaccggaaaagaactctcggattggcgagaaaatggaaaccgaagctgacgccccatctcccgccccaagcctgggcgagaggttggagccccgcaagatcccccttgaagacgaggttccaggggtcccgggcgagatggagcccgagcccggttacagaggcgaccgcgaaaaaagcgcaacagagtcaacccccggagagcgcggcgaagaaaagcccttggatggacaggagcatagagagcgccctgagggggaaacgggggacctgggaaaacgcgaagacgtcaaaggcgaccgggagctcaggcccggtccgagagacgagccccggagcaacggcaggagagaggaaaagactgagaaaccccgatttatgttcaacatagcggatggcggctttacagagctgcacactctgtggcagaatgaagaacgtgcagctatctcgtccggcaagctaaacgagatctggcacaggcgacacgattattggctcttggctggtattgtgctgcacggctacgccagatggcaagacatacaaaacgatgcccagttcgcgataattaatgaacccttcaagacagaggctaataagggcaatttcctggagatgaagaacaagtttctagctaggcgattcaaactgttggagcaggcccttgtgatcgaggaacagctgcgccgcgcagcttacctgaatctaagccaggaacccgctcatcccgctatggcactgcacgcgagattcgctgaggcagaatgcttggctgaatcacaccagcacctgtccaaggaaagcctggccggcaacaagcctgccaatgccgtgctgcataaagtgttgaaccagctcgaagagctgttgagcgatatgaaggcggacgtcacaagacttcctgctacactgagtcgcataccacccatagcggctcgcttgcaaatgtctgaacggagtattctatcccgcctagcgtctaagggcaccgaaccccaccctactccagcgtatcctccaggcccgtacgcaacgcctccaggctacggggccgccttcagtgcagcgcctgtgggggcactcgccgcggcgggggccaactactcccaaatgccagccggcagcttcataacagccgctacaaatgggccaccggttctggttaagaaggaaaaggagatggtgggagcgttggtgtccgacggcctggaccggaaggagccacgggccggagaggtcatttgcatcgacgattag

SEQ ID NO: 182924 - DNA, 5901 bp, Artificial Sequence
  Description of Artificial Sequence: Synthetic coding sequence
atgaaggccgccgacaccgtgatcctgtgggcccggagcaagaacgatcagctccgcatctcctttccgcccggcctatgttggggcgaccgtatgcctgacaaggatgatattagattattgccctcggctctgggagtcaagaagaggaaacgcgggcctaaaaaacaaaaagagaataagcctgggaaaccccgcaagagaaagaaacgggactctgaggaagagtttggatcagagcgtgacgagtaccgcgagaaatcagagtccggtggctcagaatacggaactgggcctggaagaaagcggaggcgcaaacatcgagagaagaaggagaaaaagacaaagaggcgaaagaagggcgaaggcgatggcgggcagaaacaagtggagcagaagagcagtgccaccctgctccttacttgggggctggaggatgttgagcacgtgttttctgaggaggattatcacactctaactaattacaaggcattttcccagtttatgcggccccttatagcaaagaagaaccccaagatcccaatgagcaagatgatgactatcttaggggccaaatggcgggagttcagtgctaacaatccctttaaaggtagcgccgcggccgtcgccgctgccgccgctgctgcggcagcagcggtcgccgaacaggtctccgcagcagtctcaagcgcaacacctattgcgccaagcgggccacccgctctacctcccccaccggctgcggacatccagcctccacctatccggagggccaagacgaaagagggcaaagggcctggacacaaaaggcgatccaaatccccccgagtcccagacgggcggaagaagctccgcggtaagaagatggcacccctgaaaattaaattaggcttgctggggggcaaacgaaaaaaaggcggcagctatgtttttcagtctgatgagggtcccgagccagaggcggaggaatctgatctcgatagcggatctgtgcattctgcctcgggacggccagacggccccgtccgaactaagaagttgaaaagaggccgccctggtaggaagaagaagaaggtgctcggatgtcccgctgttgcgggtgaggaggaggtcgatggttacgagaccgaccaccaggattattgcgaggtctgtcagcaaggcggagagatcatactctgcgacacctgtccacgggcttatcaccttgtttgtcttgaccccgagcttgatagggcccccgaggggaagtggagttgccctcattgcgaaaaagagggcgtccagtgggaagccaaagaggaagaagaggagtacgaggaggaaggtgaagaggagggcgaaaaggaggaagaagatgaccatatggagtactgtcgagtttgcaaagatgggggtgagctgctatgttgtgatgcatgcattagctcgtaccacatccactgtctcaacccccctctaccggacatcccaaatggtgagtggctttgtcctagatgcacttgcccagtgctgaagggtagagtgcagaaaatcctccattggaggtggggcgagccgcccgtcgccgtccctgccccccagcaggctgacggaaatcccgacgtgccacctcccagacctctgcaaggcagatctgagagagagttctttgtgaagtgggtgggtctgtcgtactggcattgctcctgggcaaaagagctgcagctggaaatttttcacctggtcatgtaccggaactatcagcgaaaaaacgatatggacgaaccccccccgcttgattatggctctggggaggacgatggcaagtctgacaaacggaaggttaaagaccctcactacgccgagatggaagagaaatactacaggttcggaataaaacccgagtggatgactgtacaccgtatcattaatcattccgtggacaagaagggtaattaccactacctggtaaagtggcgcgacctcccatacgatcagtccacttgggaagaggacgagatgaacattcccgaatatgaggaacacaagcaatcatattggcggcaccgggagctgattatgggggaggatcccgcccagcccagaaagtacaagaagaaaaagaaagagcttcagggcgatggccccccatcttcccccaccaatgaccccactgtcaagtatgagacccaacctagattcatcaccgccaccgggggcaccttacacatgtaccagctggaagggctgaactggctgcggttcagttgggctcaagggacggatacaattttggccgacgaaatgggacttgggaaaaccatccaaactatcgtcttcctctactcgctgtataaggaggggcacacgaagggcccttttttggtcagtgcccccttgtctactattataaattgggaacgtgagtttcagatgtgggccccaaaattctacgtggtgacgtacacgggcgataaggattctcgggccattattcgggagaatgaattcagcttcgaagataacgccatcaaaggcggaaaaaaagcttttaaaatgaagagagaggcccaggttaagttccacgtgctgctgacctcctacgagctcataactatcgaccaggccgccctgggaagcatcaggtgggcctgtttggtagtagatgaggcccaccgcctgaagaacaaccaaagcaagttttttcgggtgttaaacggatacaagatcgaccacaagttgctgctgacagggacccctctgcaaaacaatctggaagagctgttccacctcctcaattttctaaccccggagcgtttcaacaacttagagggtttcctcgaggagtttgccgatatctctaaggaggatcaaattaaaaaactgcacgacctcctcggacctcacatgctgcgtagattgaaagccgacgtttttaagaacatgcctgccaaaaccgagctcattgtgagagtggaactgtcacctatgcagaagaagtactataagtacattttgacccggaacttcgaagctctgaattcaagaggcgggggaaatcaggtgtctttgcttaacatcatgatggacctcaaaaagtgctgtaaccacccttatctctttcctgtggcagccatggagagccctaagctcccttctggagcatacgaagggggagctttgataaagagcagtggcaagcttatgcttctgcagaaaatgctccggaagttgaaggagcagggtcatagggtgttgattttttcacagatgacgaagatgctagacttactggaggatttcttggattacgaaggatacaagtatgaacgcattgatgggggcatcactggggccctccggcaggaggctatcgaccgattcaatgctccaggagcgcaacaattctgtttcctactttctacaagagcagggggtttgggcatcaacctggccaccgccgacactgttataattttcgatagcgattggaacccccacaacgatattcaggccttctctagggcccaccgcatcgggcaggccaacaaggttatgatataccggttcgtaacccgcgcgtcggtagaggaacgtattacccaggtcgccaagcgcaagatgatgctgacccacctggttgtccggccaggtctggggagcaaagccggaagtatgagcaaacaagagttggatgatatcctaaaatttggtactgaagagctgtttaaagatgagaacgaaggcgaaaacaaagaggaggactcaagcgtgatacactatgataatgaggcgattgcacgactgcttgatagaaatcaggacgcaacagaggacaccgatgtgcaaaacatgaacgagtacctcagctcattcaaagttgctcagtacgttgtgcgggaagaggataagattgaggaaatcgagcgggagatcataaagcaggaagagaatgtggatcccgactactgggaaaagctccttaggcaccactatgaacaacagcaggaggacctagcgcgtaacttaggaaagggaaagagggtgaggaagcaagtgaactataacgatgcggctcaagaggaccaggacaatcagtccgaatacagtgtgggttcagaggaggaggacgaggactttgatgagaggccggagggcagaaggcagtctaagcggcagctgcgaaacgagaaagataaaccgctcccccccctcctcgcgcgtgttggaggcaatattgaggtgttgggcttcaacactaggcagcgtaaggctttcctcaacgcggtgatgaggtggggaatgccaccacaggacgcgttcactactcagtggctggttcgagatctcagagggaaaacagagaaagagttcaaggcatacgtgtccttatttatgagacacctctgcgagcccggcgctgacggcagtgaaacgtttgcagacggggtgccccgcgaaggcctgtctaggcagcaggtgctgacccggatcggagtgatgagcctggtcaaaaagaaagtccaagaattcgagcatattaatggccgctggtcaatgcctgagcttatgcccgatccttccgcagactccaagcgcagcagccgggcctctagccctaccaagacgtccccgactaccccagaagcttccgcaacaaactccccatgtacatcaaaacctgctacgcctgcaccttctgaaaaaggggagggaattcgcacaccacttgagaaagaagaggctgaaaaccaggaagagaagcctgaaaaaaacagtcggattggggagaagatggaaactgaggccgacgcccctagccctgcaccttctctcggggaacgattggaaccaagaaagatcccactggaagacgaagtccccggcgtgccgggcgagatggagcctgaacccggctatcgcggagacagagagaagtccgaggacgtgaagggggatagggaactgcgacccggaccaagggacgaacctcggtcgaatggccggagggaggaaaagaccgagaagccacgatttatgttcaacatcgcagatgggggcttcacagagctacataccttgtggcagaatgaggagcgcgccgcaatttccagcggcaaattgaacgaaatttggcaccggcgccatgactactggcttcttgcagggattgtccttcacgggtatgctaggtggcaggacatccagaatgatgcgcagttcgcaattattaacgaaccatttaagacagaagccaataagggcaattttctcgaaatgaagaacaagtttctagccaggcgatttaaactgctggagcaggccctggtcattgaagagcagcttagaagggctgcttatttgaacctcagccaagagcccgcccatcccgcaatggcacttcacgctcgatttgccgaggctgaatgcttagcagagagtcatcagcaccttagcaaggagagcctggcggggaataagccagctaacgccgtgctacataaggtactgaaccagctggaggagctcctctccgacatgaaggctgacgttactcgactgcccgccacactgtctaggatcccaccaatcgcagctcggctccaaatgagtgaaaggagcatactgtctcggctggcttctaaaggcacggagcctcacccgactccagcataccctcctgggccctacgcgacgcccccgggatacggcgcagcctttagcgctgccccggtgggtgctttggccgcagcgggtgctaattatagccagatgcctgccgggtccttcatcaccgcagccacaaacggtccccccgtcctcgtgaaaaaggaaaaagaaatggttggcgcccttgtctcagacggtctcgaccggaaggagcctagggccggagaagtcatctgcattgatgactag

SEQ ID NO: 182925 - DNA, 6180 bp, Artificial Sequence
  Description of Artificial Sequence: Synthetic coding sequence
atggccagccccctgcgggacgaggaggaggaggaggaggagatggtggtgtccgaagaagaagaggaagaggaagaggagggggatgaggaggaagaggaggaggtggaagcagccgacgaagatgatgaagaggacgatgatgaaggagttctgggccgggggccgggacatgataggggcagagaccgacactccccaccagggtgccatctgttcccacccccaccccctccgcctccccctctgcctccccctccccccccaccgccgcctgacaaggacgacatcaggctcctgcctagtgcactgggcgtgaaaaaacgcaaacggggccccaaaaagcaaaaggagaacaaaccaggcaagcctagaaaacggaagaagcgtgatagcgaggaggagtttggcagtgagagagacgagtaccgcgaaaagtcagagtccggagggtctgagtacggcacgggtccaggccgcaagaggcgccggaaacacagggaaaagaaagagaagaagactaagagacgaaaaaagggcgagggtgacggaggccagaagcaagttgaacaaaaaagcagcgccaccctactcctgacgtggggccttgaggacgtggaacacgtattctctgaagaggattaccacacgttgactaactataaggcttttagtcagttcatgaggcctctaatagcaaaaaagaatcctaaaataccaatgagtaagatgatgaccatcttaggcgctaagtggcgcgaattcagcgctaataaccccttcaaaggtagcgcggccgccgtggccgctgctgcggctgcagctgccgcagcagttgccgaacaggtgtccgctgcggtatcttcggccactcccatcgccccctcaggcccccctgctctacccccccccccagccgctgacattcagccccctccaatccgtcgtgcaaaaacgaaagaaggaaagggtcctggacacaagcgccggtcgaaatcccctagggttccggacggtaggaaaaaactcaggggaaaaaaaatggcacctctcaaaattaagctcgggttacttggtgggaagagaaagaaaggcggtagctatgtgtttcagtcggatgaaggccctgagcccgaggctgaggagtccgacctggatagtggctcagtacacagcgcaagcgggaggcccgatgggccagtgaggacaaagaagctgaagcgcggaagacctggcaggaaaaagaagaaagttctggggtgtccggccgttgcaggcgaggaggaggtggatggatacgaaaccgaccaccaggactactgtgaggtatgccaacaagggggggagatcatcctgtgcgacacctgccctagggcctaccatctggtttgtctggaccccgaactcgatcgggctcctgaaggaaaatggagttgtcctcactgtgagaaagagggcgttcaatgggaggcaaaggaggaggaggaggagtacgaggaagagggtgaagaagagggcgaaaaggaagaggaggacgaccacatggagtattgtcgcgtgtgcaaagacgggggagagctcctgtgctgcgacgcatgtatatctagttatcatattcattgcctcaatcctccattgccggacatcccaaatggagagtggttatgcccacggtgtacctgcccagtcctcaaggggcgtgttcagaaaatcctgcactggagatggggagagcctcctgtagccgtccctgctcctcaacaggccgacggaaaccccgacgtaccaccacctagaccactgcagggtcgtagcgagagagagttcttcgttaagtgggtcggactcagttattggcattgttcatgggccaaagaacttcaactggagatttttcatcttgtcatgtacagaaattatcagagaaaaaacgacatggacgagcccccacccctagactacggcagcggagaggatgatggtaaatcagataagcgcaaggttaaagacccccactacgctgagatggaagagaaatactaccggtttggaatcaaacctgaatggatgaccgttcaccgtattatcaatcattccgtggataagaaagggaattatcactacttggtgaagtggcgggatctaccctacgatcagagtacctgggaggaagatgaaatgaacatccctgagtatgaggaacataagcaatcctattggcgacatagagagttgattatgggagaggatcccgcccagccccgcaaatataagaagaaaaagaaggagctgcagggcgacggtcccccatcaagtcccacgaacgacccaaccgtgaagtacgagacacaaccacgcttcatcactgccaccggtggtaccctgcatatgtaccagctggaggggttgaactggctgaggttctcatgggcgcagggcacagataccatattagccgatgaaatgggcctagggaaaaccatccagactatagtctttctatattccttgtacaaggagggacatacaaaggggccctttctagtctcagcccctctgagtacaatcatcaattgggagagagagttccagatgtgggcgcctaaattttatgtggtgacgtataccggggataaagatagccgggcaatcatccgagagaacgagttttcatttgaggacaatgccatcaaagggggaaaaaaggcttttaagatgaagcgagaggcccaggtgaaattccatgtgctgctaacctcatatgagttgatcacaattgaccaggctgctctgggctccatcagatgggcctgcctggttgttgacgaagctcaccggctgaagaacaatcagagtaaattttttcgcgtgttaaatggctacaagattgatcataaattgcttcttacgggcacacctctccagaacaaccttgaagagttgtttcatctcttgaactttcttacacctgagaggtttaacaacttggaaggcttcctggaggagttcgctgatatcagcaaagaggatcagatcaagaaactccacgaccttctcggcccccacatgctgaggcgtctgaaggctgatgtgttcaagaatatgcctgctaagactgagctgattgttagagttgaactctcacccatgcagaaaaaatactacaagtatatccttacaagaaatttcgaggcactgaattctcgcgggggcggtaaccaggtgtctctgcttaatattatgatggatctcaaaaaatgctgcaaccatccatacctctttcctgtcgctgcaatggagagcccaaagcttccttctggtgcttatgaaggaggggctctgattaagagctccggcaagcttatgttactccagaagatgctgaggaagctcaaagaacaaggtcaccgtgtcctcattttctcacagatgacgaagatgctggaccttctggaagacttcctggattatgaaggttacaaatatgagaggatagatgggggaattacgggggcactccgacaggaggcaatcgatcgattcaatgccccaggggcgcaacagttttgctttctgctcagcacgcgggcaggaggactggggatcaacctagccaccgccgacactgtgataattttcgatagcgactggaacccccacaatgacattcaagcctttagcagggcccacagaattggtcaggcaaataaagtgatgatctatagatttgtcacaagagcctccgtagaggagcgtatcacccaggtcgctaaaagaaagatgatgctcacccaccttgtggtgcgccccggcctcggctctaaggccggatctatgtctaagcaggagctggatgatattctgaaatttgggacagaggaactttttaaagatgaaaacgagggagaaaataaggaggaagactcttcagttatccattatgacaacgaggccattgcaaggcttctggaccgtaaccaggatgcaactgaagatacggatgtacagaacatgaacgaatacctgagctccttcaaggtcgcccagtacgttgttcgcgaggaggataagattgaagagattgagagggagatcattaagcaggaggaaaatgtggaccctgactactgggagaaattgcttcgacaccactatgaacagcagcaggaagatctggccaggaatctggggaagggcaaacgcgtgagaaaacaggtcaactacaacgatgctgcccaggaagaccaagataaccagtccgagtactctgttggatccgaagaggaagacgaagacttcgacgagcgtcccgaggggaggcggcagtcaaagagacagctaagaaacgagaaagataaacccctgcctcccttattggcgagggtgggggggaacatagaggttctggggttcaatacaagacagagaaaggcttttctcaatgccgtgatgcggtggggtatgccacctcaagacgctttcacaacacagtggttagtgcgagatcttcggggaaagactgaaaaggaattcaaagcctacgttagcctgttcatgcgtcacctgtgcgaacccggcgccgacggaagtgagacctttgccgatggggtgccgcgggaggggctgtcacgacaacaggttctgacgcgcattggcgtgatgtccttagttaaaaaaaaggttcaggagttcgaacacattaacggtcgctggtcaatgccagagctcatgccagatccgagtgccgactcgaaaaggtcgtctcgggcttcatctccgacaaagacgagccctactacaccagaagcgagcgcgacaaacagtccgtgcacatccaagcctgccacacctgcaccttcagaaaagggcgaaggaattagaacacccctggaaaaggaagaggccgagaaccaggaagagaaaccggaaaagaactccaggataggcgaaaagatggaaactgaagcagacgcccctagtcccgccccatccctcggggaacggttggagccaaggaagatcccattagaagatgaggtgcctggggtccctggcgagatggaacctgaacccggctatcggggggatcgggagaaatccgctaccgaatcaaccccaggtgagagaggtgaggaaaaacctttggacggccaggagcacagggaacggcccgagggggaaacgggtgacttaggaaagagagaggacgtgaagggcgacagagaactccggcctgggcccagagacgaaccgaggtccaacggccgtagagaagagaagacggagaaaccacgctttatgtttaatatcgctgacggtggattcacagagttgcatacgctttggcagaatgaggaacgggcagcaattagttccggaaaattaaatgagatatggcatagacgtcatgattattggttactagcgggcattgtgctgcacggatatgcacgctggcaggatattcagaatgatgcacagtttgcaatcattaacgagcccttcaaaacggaagctaataaagggaatttcttagagatgaagaataagtttctcgcacgacgttttaaactgctcgagcaagcccttgtgatcgaggaacagctccggagagccgcgtatctcaacctttcacaagaacctgcccacccagctatggcgttgcatgctagatttgccgaggcagagtgcttggccgagagccaccagcatctcagcaaggagagtctggccggcaataagcctgccaatgcagttttgcacaaggttctgaatcagttagaggaactgctgtcagatatgaaggccgacgtaacccgccttcctgccaccttgtcgagaatacccccaattgctgctcggctgcagatgtctgagcgatccattctcagccggctggcatcaaagggcactgaaccgcaccccactccggcctaccctccaggcccctacgccacgccacccgggtacggggccgctttcagtgcagctcccgtgggggctcttgctgccgccggcgccaattatagccagatgcctgctggaagtttcattaccgccgccacaaatgggccgccagtcctcgtgaagaaggagaaagaaatggtcggtgcgctcgtaagcgacggcttagataggaaggaaccccgcgccggagaggtcatctgcatcgacgactag

SEQ ID NO: 182926 - DNA, 5865 bp, Artificial Sequence
  Description of Artificial Sequence: Synthetic coding sequence
atgcggggccccgtgggcaccgaggaggagctgccccggctgttcgccgaggagatggaaaacgaggatgaaatgtcagaggaagaggatgggggactagaagccttcgacgacttctttccagtggagccagtgtcactgccaaaaaagaagaagcctaaaaagctcaaggagaacaaatgtaagggcaaacgaaaaaagaaggaggggtccaatgacgagctatccgaaaacgaggaagacctggaagaaaagtcagagagcgagggttccgactacagccccaataagaaaaagaagaaaaaactgaaagacaagaaggagaagaaggccaagcggaagaagaaggatgaggatgaggacgacaatgacgacggctgcctcaaggagcccaaaagttcgggccagctgatggctgagtggggcttagatgatgttgattacctcttctccgaggaggactatcatacactcacaaattataaggcatttagccagttcctgaggccactcatcgctaaaaaaaacccaaaaataccgatgagcaaaatgatgaccgtcttgggagccaaatggagggagttcagcgctaataatccattcaaagggtcttccgctgcagctgctgctgccgccgtggctgccgcagtggaaacagtgacaatatcacccccattagctgtgtcccccccccaggtaccccagccagtgcctatcaggaaggccaaaaccaaagagggaaaggggcctggggttcggaagaaaattaaaggctcgaaagatggtaagaaaaaagggaagggcaagaagacagccgggctgaagttcaggtttggcgggatctccaacaagagaaaaaaaggctcatcttctgaggaggatgagagagaggagagtgatttcgacagcgccagcatacacagtgcttccgtgcggtcggagtgtagcgcggctttggggaagaagtctaagaggcggcgtaaaaagaagcggatcgacgacggtgatggttacgaaaccgaccaccaagactattgtgaagtgtgtcagcaggggggggagatcatcctgtgcgatacctgccctagggcgtaccacctggtttgtctcgacccagagcttgagaaagcacccgaaggcaaatggagctgtccccattgcgagaaagaggggatccagtgggagccaaaggacgacgacgacgaggaggaggaagggggatgtgaagaggaggaggacgaccacatggagttttgccgcgtttgcaaggatggaggagagctgctttgctgcgacgcttgtccttctagctaccacttgcattgccttaatccccccctgcccgaaatcccgaatggcgaatggttgtgtccgagatgtacgtgccctcctctgaagggaaaggtccagcgcattcttcactggaggtggacagagccacccgccccattcatggtgggactcccggggccagatgtggagccttccctcccgccacctaagccactggagggcattcctgagagggaattctttgtcaaatgggctggtctatcttactggcactgcagctgggttaaggaactgcagttagaattgtatcatacagtgatgtacaggaactatcaaaggaagaacgacatggatgagcctcctcccttcgactacgggtctggggatgaggatggcaaatccgaaaagcggaaaaacaaagacccattgtacgcaaaaatggaggagcggttctatagatacggaattaagcccgagtggatgatgatccaccggatactaaatcacagcttcgacaagaaaggggatgtccattacctaatcaagtggaaagatctaccatatgatcaatgcacttgggaaatcgacgacatcgacatcccatactacgacaatctgaaacaagcctactggggccaccgcgaattgatgcttggggaggacactcgactgcccaagcgtctgctcaaaaaagggaaaaaattgagggatgacaagcaggagaagcctcctgacacccctatcgtcgatcccactgtgaagtttgacaaacagccttggtatatcgacagcaccggaggaacactccacccatatcagttggaagggttgaattggctacgtttctcctgggcccagggaacagatactatcttagctgatgaaatgggccttgggaaaaccgtgcagacaatcgtgttcttatattccttatacaaagaggggcatagcaaggggccttatctggtctctgcccccctctccacaatcatcaattgggagcgagaatttgaaatgtgggcacctgatttctacgtggtgacctatactggtgataaagagtcccggtcggtgattcgcgaaaacgaattctcattcgaagataatgctatccgatccggaaagaaggtcttccgaatgaagaaggaggttcagattaagttccatgtgcttctcacgtcctatgagcttattaccattgaccaggccatcttgggaagtatcgagtgggcctgtttggtagtggatgaagcacaccgcctgaagaacaatcagagcaaatttttcagagtgttgaactcctataagatagactacaagctgctgctgaccggcactccactgcagaataacctggaggagctgttccacctccttaacttcctgactccagagcggttcaataacctcgaaggcttcctggaagaattcgcagacatctctaaggaggatcaaattaaaaagctgcatgacctactaggtccgcacatgctcagaagactgaaagctgatgtgttcaagaacatgcctgcaaagacagaactcatcgtccgtgtggaactcagtcagatgcagaaaaaatattacaagtttatcctgacgaggaactttgaagctcttaactctaaaggcggcggaaaccaggttagtctcctgaacataatgatggacttgaagaagtgttgcaatcacccttacctgttccctgtcgcagccgtggaagcccccgtgctgcccaacgggtcttacgacggctcttcactcgtgaaaagcagcggcaaactcatgctgctgcagaaaatgctgaagaagttgcgcgacgagggtcatcgtgtgcttatcttttctcaaatgactaagatgttggatttactcgaggacttccttgagtatgagggctataagtacgagagaattgacggcggcataaccggaggtctcaggcaagaggctatcgaccgctttaacgcacctggggcacagcagttctgctttctgttgtccacgcgcgctgggggactgggaataaatctggcgaccgcggatacagtgatcatctacgactcagactggaatccacataacgatattcaagccttcagcagagcacaccggatcggacagaataaaaaggtgatgatatatcgcttcgtgacccgcgcttccgtcgaggagaggatcacccaggtggcaaagaggaaaatgatgcttacccacctggtggttaggcctgggctgggatccaagtctgggagcatgaccaagcaggaattggatgatattcttaagtttggcaccgaagaactgttcaaagacgatgtcgagggtatgatgtctcagggccagaggcctgtcactcctataccagatgtgcagtcatctaagggaggcaacctcgccgccagcgcaaagaagaaacacggttctactccaccgggagacaataaggatgtggaggattcaagtgttattcactacgatgatgctgcaatctcgaagttgctcgacagaaatcaggacgcaactgacgacacagaattacagaacatgaatgagtatctttctagctttaaggtggcccagtacgtggtcagggaggaggatggggtcgaagaggtagagcgggagatcatcaaacaggaggagaacgtcgaccctgattactgggagaagctcctgagacatcattacgaacagcaacaagaagatctggctcgtaacctaggaaaaggcaaacggattagaaagcaagtcaattacaatgatgcctcccaggaagaccaggagtggcaggacgaactctctgacaaccaaagtgagtactccatagggagcgaggacgaagacgaggacttcgaggagaggccggaaggacagagcggacggcgccagagcaggcgccagctcaaatccgacagagataagccgctgccacccttgctggctcgcgtgggggggaatatagaggtgctcggttttaatgcccggcagagaaaggcctttctcaacgctattatgaggtggggtatgcccccccaggacgcgttcaacagccattggctagtgcgggatctccgcggcaaaagtgagaaagaatttcgggcttacgtcagtctgtttatgcggcacctgtgtgagccaggcgctgatggggcggaaacctttgccgatggggtcccaagggagggcttgagtagacagcacgtcctgacacggattggagttatgagcttagtcagaaagaaggtgcaggagttcgaacatgtcaatggtaaatacagtacgccagatctgatacctgagggtcctgagggaaaaaagagtggagaggtgatcagtagtgatcccaacacacctgtgccagcttcccccgcccacctgttgcccgcccccctagggctgcccgacaaaatggaggcccagcttggctatatggacgaaaaggatcctggcgcacagaaaccgcggcagccactggaggttcaagctctcccagctgcccttgatagggtagaatcggaggacaagcacgaaagtccggcctccaaggagcgagctcgggaggaaagacccgaagagacggagaaggcaccccccagcccagaacaactaccaagggaagaagtgcttccggaaaaagagaagatactggacaaacttgagctttcactgatccattctcggggggattcatcagagttacgacctgatgacacaaaggcagaagagaaagagcccatcgagacccagcagaacggcgacaaagaagaagacgatgagggcaagaaggaagacaaaaaagggaagttcaaatttatgtttaacatcgccgacggcggattcaccgaactacataccctctggcagaatgaggagcgcgccgccgtctcttcagggaaaatctacgatatttggcaccgccgtcatgactactggctattggcagggattgtgactcatgggtacgccaggtggcaggatatccagaatgatccaaggtatatgatactcaacgaaccttttaagtcagaggtgcacaaaggcaactatcttgaaatgaagaataagttcctggctcgcaggttcaaattgttggaacaagccctggttatcgaagagcagctgagacgggctgcctatcttaacatgacccaggaccctaatcatcccgcgatggccttgaatgcaaggctggccgaggtggaatgcctcgctgaaagccaccagcatctgtccaaagagtctctggctgggaataagccagcaaacgccgttttgcacaaggttctgaaccaactggaggagctgctgtctgacatgaaggcggatgttacccgactgcccagcatgctgtccaggatcccaccggttgcagctagactacaaatgtcggagagatctattctctcgagattgaccaatagggcaggcgaccccaccatccagcagggagcctttggttcaagtcagatgtactccaataatttcggtcctaatttccgaggacccggccccgggggtattgtgaactacaatcagatgcccttgggcccttatgttaccgacatctag

SEQ ID NO: 182927 - DNA, 2427 bp, Artificial Sequence
  Description of Artificial Sequence: Synthetic coding sequence
atgatctaccggttcgtgacccgggccagcgtggaggagcggatcacccaggtcgccaagagaaagatgatgctaacccatctcgtggtccgccctggactggggtccaagtccgggagtatgacaaagcaggagctggacgacatcctgaagtttggcaccgaagagctgtttaaggacgacgtggaaggaatgatgtcacaagggcaacggccagtgacacccatacctgacgtgcagtcctctaaagggggcaacctggcagcctctgcaaaaaagaaacacggctcaactccaccaggtgacaacaaggatgtggaagacagctccgtcatccactacgacgatgcggccatcagcaaattgctcgaccgcaatcaagatgccaccgatgacactgagctccagaacatgaatgaatacctgtcttcttttaaggtggctcaatacgtggtgcgcgaggaggatggggtagaagaggtcgagcgagaaatcattaaacaagaggagaatgtggaccccgactattgggaaaaacttctgcgccaccactacgagcagcagcaggaagatttggcccggaatctgggaaagggaaagcgtattcggaagcaggtcaactacaacgatgcaagccaggaggaccaggagtggcaggacgagttgagtgacaaccaaagcgaatactcaatcggatccgaggatgaagacgaagactttgaagaaaggcctgaagggcagtcagggagaaggcagagccgaagacagttgaagtctgaccgggataaacctttaccccctttgttggcacgcgtgggaggaaacattgaagttctgggcttcaacgcccggcaaaggaaggcctttcttaatgctatcatgaggtggggcatgcccccccaagacgccttcaattcccactggctggtgcgtgatctgaggggcaaaagtgagaaggagttcagggcctatgtgtctctgtttatgcggcacctgtgcgaacccggagccgacggcgcagagaccttcgctgatggagtgccccgtgaagggttgagcagacagcatgtcctgacgagaattggcgtcatgagtttggtccggaagaaggtgcaggagtttgagcacgtcaacgggaagtattctaccccagatctgattccagaggggcctgaaggaaagaaatccggggaggtaatttcttcggacccaaacaccccggtaccagcctctcctgcgcatttattgcccgctcctctgggactaccagacaagatggaggcccagctggggtacatggacgagaaagatcctggcgcacaaaaaccacgtcagccacttgaagtgcaggcgctccccgcagctctcgatcgagttgagagcgaggacaagcacgagtcccccgcatcaaaagagcgagccagagaggagcggccggaagaaacggagaaagcgccaccaagtccagaacagctccctcgagaggaagttctcccagagaaggaaaaaatcttggataagcttgaactctctctaattcactcccggggggattcatctgaactccgccccgacgacacaaaagcagaggaaaaggagccaatagagacgcaacagaatggagacaaggaggaagatgacgaagggaagaaagaagacaagaagggcaaattcaaatttatgtttaacatcgccgatggaggatttacagagttacacacgttgtggcagaatgaggagagagcagctgtgagcagcgggaagatctacgacatttggcataggcgtcatgactattggctgttggcgggcatagtgacacacggatacgcccggtggcaggatatccaaaatgatcctcggtacatgatattgaacgagccatttaaaagcgaagtgcacaagggcaactacctcgagatgaaaaacaaatttcttgcaaggcgctttaagctcttggaacaggccttagtcattgaagaacagctgagaagggctgcctacctgaatatgacccaggaccctaatcatccggccatggcgctgaacgcccgcctcgcggaggtcgagtgtttggcagagtcccaccaacatctcagtaaagagtcactggctggaaacaagccagctaatgcggtgctccacaaggtcttgaatcagttagaagagctcctttcagacatgaaggccgacgtgacccgtctgccctctatgctgtctagaattccgcctgttgccgccaggcttcagatgtcagagcgatccatcctgtcccgactaactaatagggcaggggacccaactattcagcaaatctcttctcggcccagagattttcccgtgctgcagcgctcgtttcccgcggaacccagactccccggtcacttgcctgatccccatggccgggaaaaactgccaccgttctag

SEQ ID NO: 182928 - DNA, 3588 bp, Artificial Sequence
  Description of Artificial Sequence: Synthetic coding sequence
atggtgggcctgcccggccccgacgtggagcccagcctgccccccccaaaacctttagaagggatcccagagcgggaattcttcgtcaaatgggcgggcctcagttattggcattgcagctgggttaaggagctccagctcgaactgtaccacaccgtgatgtaccggaactaccagaggaagaacgatatggatgagcctccacccttcgattacggatccggtgatgaagatggaaagagcgagaagaggaagaacaaggatccactgtatgctaaaatggaagaaaggttttaccggtacggcattaaaccagagtggatgatgatacatcggatcctcaaccactcattcgataaaaaaggcgacgttcactatttaattaagtggaaggacttaccttatgatcagtgtacgtgggagatcgatgatatcgacatcccctactacgacaatcttaagcaggcttattggggccatagggaacttatgttaggcgaggacactcgcctgccaaaaagattgctcaagaaggggaagaagctgcgagacgacaagcaggagaagcctcccgacactcccattgttgatcccacagtaaaatttgacaagcaaccctggtatatcgattcgaccgggggcacgctgcacccataccagctggaaggcttaaactggctaagattctcttgggcacaaggaacagacacgatcctcgccgatgagatgggactcggcaaaacagttcagaccatagtgttcctatatagcctgtataaggaaggccacagcaaaggtccttacctggtaagcgcacccctcagtaccatcataaattgggaacgcgaatttgaaatgtgggcacctgacttctacgtcgtcacgtatactggtgacaaggaatctcgatctgtcatccgcgagaatgaatttagttttgaggataatgcgattcggagtgggaagaaagttttcagaatgaagaaagaggtgcaaataaaattccatgtacttcttacttcctacgaattgatcaccattgaccaggccattctggggagtatcgaatgggcctgcttggtggtcgacgaagcccatagactgaaaaacaatcaatctaagttctttagagtgctcaactcttacaagatcgattataaactgctgctcaccgggactccccttcaaaacaacttagaagagctattccatctgctaaatttcttgacccctgaacggtttaataacctcgaggggtttctggaggagttcgccgacatctcaaaagaagaccagataaagaaactgcatgacttgttgggaccccacatgctgagacgtctaaaggccgatgtctttaaaaacatgcccgctaaaacggaactgatcgtcagggttgaactgtcccagatgcagaaaaaatactataagttcattctgacgcgcaacttcgaagctctgaattctaagggcggtggtaatcaggtgtccctacttaacatcatgatggatttgaaaaaatgctgcaatcacccgtatctttttcctgttgcggccgtagaagcccccgtgctgcctaacggatcctatgatggcagctccttagtcaaatcaagcggtaagctgatgttgctccagaaaatgctgaaaaagttgagggacgaaggacatcgggtcctgatattttcacaaatgactaagatgctggatctgctcgaggactttcttgagtacgagggctacaagtatgaaagaattgacggcggaatcaccgggggcctacggcaggaagctattgatcgttttaatgcccccggagcccagcagttttgtttcctcttgtcgaccagagcggggggactgggcattaatctcgcaaccgcggataccgttattatctatgactcagattggaatcctcacaatgacattcaggcctttagtagagcacacagaattgggcaaaacaagaaagttatgatatacagattcgttacacgtgcaagcgtggaagagcgtattacccaggtagcaaagcggaagatgatgctcacccatctggtcgtgaggcctggcctgggctccaaaagcggttctatgacaaagcaggagctagatgacattctcaagttcggaaccgaagaactgtttaaggatgatgtggaggggatgatgtcacagggccaacgaccagtgacacctattcctgatgttcagtccagcaagggaggtaatctggccgcaagcgccaaaaaaaaacacggttcaaccccacctggtgacaacaaggacgtcgaagattcatccgtcatccactacgacgacgccgcaattagcaagctgctcgatagaaaccaggacgctacagacgacacggagctgcagaatatgaacgaatacctttcatctttcaaggtggcacagtatgttgtcagagaggaagatggggtcgaggaagttgaacgcgagattattaaacaggaagagaacgtggatccagattattgggaaaagcttctccgccaccactacgagcagcagcaggaggacctggctagaaacctcggcaagggtaaacggatacgtaagcaggtcaattataatgacgcctcccaggaggatcaggaatggcaggacgagctctcggataaccagtccgagtactcgatcggcagcgaggatgaagacgaggatttcgaggaacggcctgaaggacagtctggaaggcgccagagtaggagacagctcaagagcgacagagataaaccacttcccccactcctggctcgcgtggggggcaatattgaagtgctcggatttaatgcccgacagcggaaggctttcctgaacgccatcatgcgatggggcatgccaccccaggatgctttcaatagccactggctggtccgcgatctgagagggaagtccgaaaaggagtttcgggcctacgttagcctctttatgaggcacctctgcgaaccaggcgcggatggagctgagactttcgccgacggagtgccgagagaaggcctgtctaggcaacatgtgctcaccaggatcggagtcatgagcttagtgcgtaaaaaagtgcaggagtttgagcacgtcaatggcaagtatagcacaccagatctgatacccgaaggccctgaggggaagaaatcaggtgaggttataagttccgatcccaatacacctgttcccgcctcacctgcacaccttctgcctgctccacttggtttgccggacaagatggaggcccagctgggatacatggacgagaaagatcctggcgcccagaaacccagacaacccttagaagtgcaggcacttcccgccgccctcgatagggtggagtctgaggacaagcacgagtcaccagcttccaaggagagagctcgtgaggaaaggccggagcaaacaccaccagctcaggcgcaactcaggggcgggagacctctctctcccgggactgcacccggatggcagagagagggcccgggactaggcgcacgacgggcgaggagcccctcacagggtggccccggaggcggaggcagcagctttggatctcaggccccactgtag

SEQ ID NO: 182929 - DNA, 2427 bp, Artificial Sequence
  Description of Artificial Sequence: Synthetic coding sequence
atgatctaccggttcgtgacccgggccagcgtggaggagcggatcacacaggtggccaaaagaaaaatgatgctgactcatctggtcgtgcggccaggcctgggatccaaatctggttcaatgacaaaacaggaattagatgacatcctgaagtttggaactgaggagttgttcaaggacgatgttgaagggatgatgtcccagggccaaaggccagtgacacctataccagacgtccagagtagcaaggggggaaacctggccgccagcgcaaagaaaaagcacggctcgaccccacctggagataacaaggatgtggaagactcctcggtaattcactacgatgatgccgctattagtaagctgctcgaccggaatcaggacgctaccgacgatacagaactccagaatatgaatgagtacctgtctagtttcaaagtggcccagtatgttgtgcgggaggaggacggggtcgaagaggttgagcgggagataattaagcaagaagagaacgtggaccccgactattgggaaaagctcctccgccaccattacgagcagcagcaagaagacctggcccgaaaccttggaaaggggaagcggatcaggaaacaggtgaactataacgatgcctcccaagaagatcaagagtggcaggacgagctgagcgataaccagtctgaatattctattgggagtgaggacgaagatgaggatttcgaggagaggccagagggccagtcaggaagaagacaatcccgtagacagctgaaatcggacagagataagccactgcctcccctgctggcgcgggtaggcggtaatatcgaggtgctgggcttcaatgccaggcagaggaaggcattcctcaatgccatcatgagatgggggatgcctccacaggacgcattcaactcccactggctggttcgagacctccggggcaagagcgagaaagagtttagggcctatgtgtccctgtttatgcgccatttgtgcgagcctggcgctgatggcgcagagacctttgcagatggtgtgccacgagagggcttatcacgccagcacgtgttgacgagaatcggggttatgtctcttgtaagaaagaaggtgcaggagtttgaacatgtgaacggcaaatactcaactcccgatcttatcccagaggggcccgagggcaagaaatctggggaagtaatcagttccgaccctaacacccccgtgccagcttccccagcccacttattgcctgccccacttgggcttcctgataagatggaggctcaattgggctatatggacgaaaaagatccgggcgctcagaaaccacgccagccactggaagtccaggccctaccagccgcattggatcgtgtagagtctgaggataaacacgaatcccctgcatctaaagagcgtgcccgcgaggagcgccccgaagagacggagaaagcccctcccagccccgagcagctccccagggaagaggtgctgcctgagaaagaaaagatccttgataagttggaactaagcctcatccattcacgcggggattctagcgagctgcggcctgatgataccaaggccgaagagaaggagccgatcgagacccaacagaacggggacaaagaggaggatgatgaggggaaaaaagaagacaagaaagggaagttcaagtttatgttcaacattgccgatggaggatttactgagttacacacattatggcaaaatgaggaacgagcagcggtatcaagcggcaagatctacgacatctggcaccggagacatgactactggctgctcgccggcatcgtgactcacggttatgcaagatggcaggatatccagaatgatccccgctatatgattctgaacgaaccttttaagagtgaagtacataagggaaactacctcgaaatgaaaaacaagttcctcgcacgaaggttcaagcttttggaacaggccctggtgattgaagaacagctgagacgcgccgcctacctaaacatgacccaggaccctaatcaccctgccatggccctgaatgctaggcttgcggaggtagaatgtcttgccgaatcccatcagcacctgtccaaggagtctctagcgggtaataaaccggcaaatgcggtactccacaaggtgctgaaccaactggaagaactgctgagcgacatgaaggcggacgtcacccgcctcccttcaatgctatctagaatacctcccgtggccgccagattacagatgtctgagagaagtattctgagcagattgactaatcgcgccggcgatcccacgatacagcagatatcgtcccgcccccgggatttccccgtgcttcaacggagtttccctgccgagcccagactacccggtcacctcccagacccgcatggtagagaaaagctacccccattttag

SEQ ID NO: 182930 - DNA, 3288 bp, Artificial Sequence
  Description of Artificial Sequence: Synthetic coding sequence
atgatccaccggatcctgaaccacagcttcgacaagaagggcgacgttcattatctgattaagtggaaggatctcccttacgatcagtgtacatgggaaattgatgatatcgatattccttattacgacaacttaaaacaagcctactgggggcaccgcgagctcatgctaggcgaggatacgaggctgcctaagcggcttcttaagaaaggtaaaaagctcagggacgataaacaggaaaagccccccgacacccccattgtggaccccaccgtcaagtttgacaaacagccttggtacatcgattccactggcggcaccttgcacccctaccagctcgaggggttgaattggttaaggttttcttgggctcagggcactgatacaattctagctgacgagatgggacttgggaagacagtccagacgatagttttcctgtactcactctacaaagagggtcacagtaagggcccttatctggtaagcgcacctctctcaacaatcataaattgggagagggagtttgaaatgtgggctcctgacttctacgtggtgacttacacgggcgacaaggaaagccggtccgtgattcgagagaacgaattctcatttgaggataatgctattaggtccggtaagaaagtttttcggatgaaaaaagaggtacagattaaattccacgtgcttctgacttcctatgagcttatcacaatagatcaggccatcctaggaagtatcgaatgggcgtgcctcgtggtggacgaagcccaccgtctgaagaataatcagtcgaaattttttagagtcctgaactcctataagatcgactacaagctcctgctcactgggacccccttgcaaaataatctagaagagctcttccacttgctgaactttctcacgccagaacgctttaacaacctggagggcttcctggaagaatttgctgacatctccaaggaggatcagatcaagaaattacacgatctgctgggcccccacatgctgcgaaggctcaaagctgatgtttttaaaaatatgccagctaagacggagcttatcgtgcgagtagagctttcacagatgcagaagaagtattacaaattcatcctcacccgcaatttcgaagccctaaacagtaagggcggcggaaatcaagtcagcctgctcaacatcatgatggatctcaagaagtgttgcaatcacccctacttatttccagttgccgccgtggaagctccagtacttccaaacggaagctacgacggaagcagtttggttaagagctccggtaagcttatgctgttgcaaaaaatgttgaaaaaactgagagatgaaggacacagggtgttgattttctctcaaatgaccaaaatgctggatctgctggaggatttcctcgagtacgagggctacaagtatgagcgaattgacgggggcatcaccggcgggctgagacaagaagctattgacaggtttaatgcacctggagcgcagcagttttgcttcctgctatccacgcgggcagggggcctcgggattaacctggcaaccgctgatactgtgatcatttatgatagcgactggaaccctcataatgatattcaagccttctcccgcgctcacaggatcggacagaacaagaaagtaatgatttaccggttcgttacgagggcttccgtagaagagagaataacgcaggtggcaaagcggaagatgatgcttacccacctcgtggtgaggcccggcctcggatctaaatcaggttccatgacgaaacaggaactcgacgacattttgaagttcggtaccgaagagctgtttaaagacgatgtggaggggatgatgtcgcagggtcaacgcccagtcacgcccatacccgacgtgcagagctctaagggtgggaacctcgctgcttcagccaaaaagaagcacggctctactcccccaggcgacaacaaggatgttgaggattcatcagtgattcactacgatgacgccgctatcagcaaactgttggatcgtaatcaggatgctacagatgatactgagctgcaaaatatgaacgagtatctgtcctcatttaaggtggcccagtacgtcgtcagggaggaagatggcgttgaggaagtcgaacgggagataatcaaacaggaagagaacgtcgacccggactactgggagaagttattgcgccaccactacgagcagcagcaggaggacctcgcccgcaatctcggtaagggcaagcggattcgcaagcaggttaactacaacgatgcttctcaggaagaccaggaatggcaggatgaactgagcgacaatcagtccgagtactccattggatctgaggacgaggacgaagacttcgaggaaagacctgagggccagagcggccggcgtcagagtcgcagacagctcaaaagcgaccgtgacaagccactgccaccactgctggcccgtgtaggaggcaacatagaggtgctggggtttaacgctcgtcagcggaaagccttcctgaacgctataatgcgctggggaatgcctccgcaggacgcctttaattctcattggctcgtgcgggacctgcgcggcaagagtgaaaaggaattcagggcatatgtttccctttttatgagacacctttgtgagccgggagctgacggagctgaaacctttgccgatggggtacctcgcgaagggctttccagacagcatgtcctcacacgcatcggagtaatgagcttggtgcgaaagaaggtccaggaatttgaacacgttaatggcaagtactcaacacccgatttaattcctgaagggcccgagggcaagaaatctggggaagtgatcagcagtgaccccaatacacctgtacctgcgagcccagcgcatcttttgcctgccccccttgggttacctgacaaaatggaagctcaactggggtatatggatgaaaaggaccctggagctcagaagccaaggcagcccttagaagtgcaggctttgcccgccgcccttgaccgtgtcgagtcagaagacaagcatgagagtccagcctcgaaggaaagagcccgggaggagcggcccgaagaaaccgaaaaagcgcccccaagtccagaacaattacccagagcctcatgctccgtcacgcaggccggagttcagtggaggcataggctgatgggagcttttatcagttcagctcaggctacactccccccccagctcccagagcagcgccggtgctttcttcgcaggcgtagaagctggacaagctggtcttag

SEQ ID NO: 182931 - DNA, 3258 bp, Artificial Sequence
  Description of Artificial Sequence: Synthetic coding sequence
atgatccaccggatcctgaaccacagcttcgacaagaagggcgacgtccactatctgatcaagtggaaagacttaccttatgatcagtgcacgtgggaaattgacgatattgatatcccctactatgacaacttaaaacaggcttactggggccatcgtgagctcatgttgggggaagatacacgactgccaaaaaggcttcttaaaaagggaaaaaaactccgggatgacaagcaggaaaagccccccgacacccctatcgtcgacccaactgttaaattcgataagcaaccatggtacattgactctactggcggaactctgcatccctaccagctcgaaggtctgaactggttacgtttctcctgggcccagggcacagataccatcctcgcagacgaaatgggactcggcaaaacagtccaaaccattgtgttcctgtacagtctttataaggaaggccattcaaaaggcccctatctcgtctcagccccactcagcacgataattaattgggagcgggagtttgagatgtgggcacccgatttttatgtggtcacttatactggcgataaagaatcccgatccgtgatcagggagaatgaattttcgtttgaagacaacgctattcggtctggaaaaaaagtttttcggatgaagaaagaggttcagattaagtttcacgtactgttaaccagctacgaacttatcaccatcgaccaggccattttggggagcatcgagtgggcatgcctcgtggtggatgaggcgcacagactcaaaaataatcaatctaagttctttcgagtgctcaatagctataagatagattataaacttctgcttaccggaacccccttacaaaacaacttggaggagctgttccatctcctgaattttctgactcctgagcggttcaataatttggagggctttctcgaagaattcgcagacatctctaaggaggatcagattaaaaagctgcatgacctgttaggacctcacatgctgaggaggctgaaggctgacgtttttaagaatatgccagccaagaccgagctgatcgtaagggtggagctgagccagatgcaaaaaaaatactataagtttatcctgacgagaaatttcgaggcgctgaactctaaaggcggggggaaccaggtgtccctgctgaacatcatgatggatctgaagaaatgctgcaaccacccttacctgttcccagtagcggccgtagaagctccagttctgccaaatgggagttacgacggaagttcgctggtgaagtcaagcggaaaactcatgctccttcagaaaatgttgaagaagttgagagacgagggccacagggtcctgatcttcagccagatgacaaagatgctggacttgcttgaggatttcctggagtatgaggggtacaagtatgagcggattgacggcggcattacaggcggacttaggcaggaagcaatcgaccgctttaatgcgcccggggcccagcaattctgcttcctcctgtcgacacgggcaggaggcctaggcatcaacctggctaccgcagataccgtgataatctacgactctgattggaacccccacaacgatatacaagccttttcccgcgcccatcgtatcggccagaataagaaagtaatgatctaccggttcgtgaccagggcgtctgttgaggagaggatcacccaggtcgctaagcgtaaaatgatgctcactcatctggtggtacgccctggcctgggtagtaagagcgggtccatgaccaaacaagagctcgacgacatactgaagttcggcacagaggagttgttcaaagacgatgtcgaaggcatgatgtcccagggtcagcgacccgtgacccctattccagacgtgcagagtagcaaaggcgggaatttagccgccagcgccaaaaaaaagcacggttctacgcctccaggagacaataaggatgtggaggacagttctgttatccattacgacgacgctgctatttccaagctcctggatagaaatcaggatgccacggacgacaccgaactccaaaacatgaatgagtatttgagttcatttaaggtggcacaatatgtcgtgcgggaggaagatggcgtggaggaggtagagcgggagataatcaaacaggaagagaatgtggaccctgactactgggaaaaactactccgacatcactacgagcaacagcaggaagacctggcgagaaatctgggtaaaggcaaaaggatcaggaagcaggtgaactataatgatgcctctcaagaagatcaagaatggcaagacgaacttagcgataaccagagtgagtacagtatagggagcgaggatgaggacgaggacttcgaggaacggcctgaaggccagtctggtcggcgacagtctcgcaggcagctgaagtcggaccgagataagcccttgcctcctcttctcgcccgtgtcgggggaaacatcgaggtgctgggatttaacgccaggcaaaggaaagcatttctcaacgcaattatgcgatggggtatgccaccacaggatgccttcaattcccactggctggtgcgtgacctcagaggcaaaagcgagaaagagtttcgggcctacgtcagcctttttatgagacatttgtgcgagccaggagctgatggcgccgaaaccttcgcagatggggtgcccagagaaggtctgtctaggcagcacgtcctgacacggattggcgtaatgtctctggtcagaaaaaaagtccaggagttcgagcacgtcaatgggaaatacagcacccctgacctgatccctgaaggccctgaaggaaagaagtctggagaagtgatctcatccgatcccaatacacccgttcctgcaagcccggcacatctactccccgctccactgggactccccgataaaatggaggctcagctgggctacatggacgagaaggatcccggagctcagaaaccgaggcagccactggaagtacaggcactgcccgcggcgctagatagagtcgaaagcgaggataagcacgaatctcccgcgagcaaagaacgggctcgcgaggagagaccagaagaaactgaaaaggcaccaccaagtccagagcagctgccccgcgcttcctgttccgtcacccaggctggcgtacagtggcggcatttaggctcatgggagccactgtccccaagactgaaacgccctagccacctgagttttttaaaccgcgggggcgccagttag

SEQ ID NO: 182932 - DNA, 8994 bp, Artificial Sequence
  Description of Artificial Sequence: Synthetic coding sequence
atggccgaccccggcatgatgagcctgttcggcgaggacggcaacatcttctctgaagggcttgagggtctgggcgagtgcggatatccagagaaccctgttaacccaatgggtcaacagatgcccattgatcagggattcgcctccttgcagccctcattacaccacccttcaacgaaccagaatcagactaagctgacgcactttgaccattacaaccagtacgagcagcagaagatgcacctcatggatcagccaaacagaatgatgtcgaacacaccagggaatggtctagccagcccccattctcagtaccacacccctccagtgccacaggtgcctcacggggggagcggcggaggccagatgggcgtctaccctgggatgcagaatgagagacacggacagtcctttgtggactcctcatctatgtgggggccacgggctgtacaggtgccggaccagattagggctccctaccagcaacagcagccccagccgcagccgccccagcctgctccgtccggcccaccagcccagggccatccccagcacatgcagcaaatgggaagctacatggccagaggggatttttcaatgcagcaacacggtcagccacagcaacggatgagccagttcagccagggccaggagggactgaaccagggcaacccttttatagctaccagtggcccgggccacctcagtcacgtcccacaacagtcaccatccatggcgccatcactacggcactcagtgcagcagtttcaccatcatccttccactgctctccatggagagagcgtcgcccatagccctagatttagtcctaaccctccacagcaaggagcagtcaggccgcagacattgaacttctcttcccgaagccaaaccgtaccatctcccacgattaataacagtggccagtactcccgctatccttattcgaatctgaaccagggcctggtcaacaatactggtatgaatcagaatcttgggctcactaataacacccccatgaaccagtccgtgcctcgatatcctaatgcagtcgggttccctagtaattcgggacaggggctgatgcaccagcagccaatccacccgtctggatccctgaaccaaatgaatacacagaccatgcatcccagccagcctcagggaacttacgcatcaccccctcccatgtctccgatgaaagcgatgtcaaaccctgccggcactccaccacctcaagtgagacctgggagcgcagggatcccaatggaggtgggttcttaccctaacatgcctcacccacagccttcccatcagcctcctggggcgatgggcattggacagaggaacatgggcccacggaatatgcaacaatctcgcccatttatagggatgagcagcgcccctagagagctgacaggtcacatgaggccaaatggctgcccaggtgtcgggctcggagatccacaggccatacaggaacgcctgatccccgggcagcagcaccctggccagcagccatcctttcagcagttgccaacctgcccccctctgcagccccatccaggcctgcaccaccaaagctccccgcctcaccctcaccaccagccatgggcccagctacatcccagcccacagaacactccgcagaaggttccggtgcaccaacactcaccttccgaaccattcttggagaagccagtcccagacatgacacaggtgtcgggccccaacgctcagcttgtgaagagtgatgattacttgccatcaatcgagcagcagccccagcagaagaagaaaaagaagaagaacaaccacatcgttgcagaggatccaagcaaagggttcggaaaggacgactttcccggaggagttgacaatcaggagctgaacaggaactctctcgacggttcccaggaggaaaagaagaaaaaaaagaggagtaaggccaaaaaagatccgaaggagcccaaagagccgaaggaaaagaaagagccaaaagaacctaagacacctaaggcccctaagatcccaaaagagccaaaggaaaaaaaagccaaaacagcaacgcccaaacccaagtcgtcaaaaaaaagttcaaataaaaagcccgattcagaggccagcgcactcaagaaaaaagtgaataaggggaaaactgaagggtccgagaactccgacctggacaagacccctccaccaagtccaccacccgaggaagatgaagatcccggtgttcagaaacgccgctcaagccgtcaggtgaaacgtaagcggtacacagaggacctcgagtttaagatttccgacgaggaagcggatgacgctgatgccgcggggagagatagcccaagcaacacatcccagtctgaacagcaggaatcagttgacgccgagggaccagtggtcgagaaaattatgtcctctcggagcgtgaagaagcaaaaagagagcggtgaggaggtcgaaatcgaggaattttatgtcaaatataaaaacttctcatacttgcactgccagtgggccagcatcgaagatctggagaaggataaaagaatacagcagaaaattaagaggtttaaggcaaagcagggacagaataagttcctgtccgagatcgaggatgagctttttaaccctgactacgttgaggtagataggatcatggatttcgccagaagcaccgatgaccggggtgaacctgtgacccactatctggtaaagtggtgttcactgccctacgaagattctacatgggaacggcggcaagatattgaccaggccaagattgaagagttcgagaaactgatgtctcgcgaaccagaaaccgaacgggttgagaggccaccggccgacgactggaagaaaagcgaaagctctagagagtacaaaaacaacaataaactgcgcgagtatcagctggaaggcgtaaactggcttctgtttaactggtataatatgcggaactgcatcctggccgatgaaatgggcctgggcaaaactattcagtccattacctttctctatgagatctacctcaaggggatacatggaccattcctagttattgcaccactttcaaccattcctaactgggagagggagttcagaacatggacagagctcaacgtggttgtctaccatggatctcaggcttcaagaagaactatccaactgtacgagatgtactttaaggacccacagggtagggttattaaaggttcatacaagttccacgcgattatcactacttttgagatgattttgacagactgccctgagctgaggaacatcccttggcgctgcgtcgtaatcgacgaggctcatagactgaaaaatagaaactgcaagttactcgagggactgaagatgatggacttggaacacaaggtattgctcaccggcacaccgctccaaaacacagttgaagaactgttctccctgctccacttcctggagcctagcagatttccttctgaaaccacattcatgcaggagtttggagatcttaagacagaagagcaagttcaaaagctgcaggccatcttaaagcctatgatgctgcgacggctgaaggaagatgtggagaaaaacctggcaccaaaggaagaaactataatcgaagtggaattgacgaacattcagaaaaagtattatcgggcgattctggaaaaaaattttacttttctatctaagggaggtgggcaggccaacgtgcctaaccttcttaacacgatgatggaactgaggaaatgctgcaatcatccttacctgattaatggggccgaagaaaaaatcctcgaggagttcaaggaaacccacaacgccgagtccccggatttccagttgcaagccatgattcaggctgcaggaaagctggtcctgatagataagctcctgccgaaactaaaggccggcggccatcgagtccttatcttttcacaaatggttcgttgcctagatattttggaagattatctgatccagaggcgctatccatatgagaggatcgacggacgggtaaggggaaacttgcggcaggccgctattgatagattttctaaacccgatagcgacagattcgtgtttctgctatgcaccagggccggaggcctgggaatcaacctcacagctgcagatacctgcatcatatttgacagtgactggaaccctcagaacgatctgcaggcacaggccagatgccacagaataggccagagtaaaagcgtcaaaatttatcggctcattaccaggaatagctatgaacgagagatgtttgacaaggcttcactaaagctcggattagataaagctgtgctgcagagcatgtcaggccgggagaacgccactaacggagtccagcagttgagcaagaaggaaatagaggacttgttacgcaagggcgcctacggtgcattgatggacgaagaggatgaaggttctaaattctgcgaggaggacattgatcagatactgctccgtagaacccacaccataacaatcgaaagtgaaggtaaggggtcaaccttcgccaaagcctcattcgtggccagtggtaataggactgatattagcctggatgacccaaacttttggcagaagtgggctaagaaggcggaactcgatatagatgccctcaacggtcgcaacaatttggtgatagatacaccgcgggtccggaagcaaactcgtctgtacagtgccgtgaaggaagatgaactgatggagttttcagacctggaatccgattccgaggagaagccctgcgcaaaaccaagacggccacaagacaagtctcagggctatgctcgctctgagtgtttccgggttgagaagaacctcctcgtttatggctgggggcgatggaccgatatactgtcccacgggagatataagcgccagctgacagaacaggatgtggagaccatctgtcgaaccattttagtgtactgtctgaatcactacaagggagatgagaacataaagagctttatctgggatttgatcactcctaccgcagacggccagacccgcgctcttgtcaatcactccggcttgagtgctcctgtgccaaggggtaggaaaggcaagaaggtgaaagcacagtccacgcaaccagtggtacaggatgccgactggttggcaagttgtaatcccgatgccctgttccaggaagactcttacaaaaaacaccttaagcaccactgtaacaaggtgttgctcagagtgaggatgttatactatttacgccaggaagtcatcggagatcaggcagacaaaatcttagagggggctgattctagcgaggcggacgtttggattcctgagcctttccacgccgaagtgcctgcggactggtgggataaggaagctgataagagtctactgattggagtgttcaaacatggttatgaaaaatacaattctatgagggctgatccagctctctgcttcctggaacgcgtggggatgcccgatgcaaaggctatagccgcagaacagcgcggcacggatatgctagccgacggaggggacggtggagaattcgatagggaggatgaagatcctgaatacaaacccacacgtaccccatttaaggacgagatagatgagtttgccaacagcccaagcgaggataaggaggagtccatggaaattcacgccaccggaaagcacagcgagtcgaacgctgaactcgggcagctgtactggccgaatacatcaaccctcacgacaagactcagacgcctgatcactgcctatcagagaagttataaacggcagcagatgcgacaggaggctctaatgaagactgacagaaggcggaggaggccgcgggaggaggtacgggcattggaggctgaacgcgaggctatcatttctgagaagcgacagaagtggactagacgcgaggaggccgatttctaccgggtcgtgtccacttttggagtgattttcgatcccgtgaagcagcaatttgattggaatcagtttagggctttcgctcggctggataagaaatccgacgagagtctggaaaagtatttctcatgttttgtagccatgtgtagacgggtctgtcgcatgccagtaaagcctgacgatgaacctcctgacctctcgagtattatagaaccgatcactgaagagagagctagtcgcaccttgtaccggatcgaactgctcaggaagatccgggagcaggttctccatcaccctcagctgggtgaacgcttaaagctctgccaaccgagtcttgacctccccgagtggtgggagtgtggccgccacgacagagatctgttggtcggagcagccaaacacggcgtctctcggaccgattaccacattctgaatgatcctgagctgagcttcctcgacgctcacaagaatttcgcccagaatagaggagctgggaataccagcagcctcaatccactggctgtggggttcgttcagacacctcccgtgatctcctccgcacacattcaggatgagcgcgtcctggaacaggcggaggggaaggtggaggaacctgagaacccagccgccaaagagaaatgcgaagggaaggaagaggaagaggagacggacggcagtggaaaggagtccaaacaggagtgcgaagcagaggcgtcttcagtgaagaatgagctgaagggcgttgaggtgggcgctgatacaggtagcaagtccatcagtgagaagggatccgaggaagatgaggaggaaaagctcgaagacgatgacaaatcggaggagtcttcacagccggaggcaggagccgtttcccgggggaagaactttgatgaggaatcaaacgcaagtatgtccaccgccagagacgagactagggatggtttttacatggaggacggggacccctccgtcgcacagctgctgcacgaaaggacttttgctttttcgttctggcctaaggatagagtgatgattaaccgactggacaatatctgcgaagctgtcctaaaaggaaaatggcccgtgaataggcgacagatgtttgattttcagggactgattcctggatataccccaacgacagttgattcccccctgcagaagaggagttttgcagagctttctatggttggtcaggcatccatctccggaagcgaagatataactaccagcccacaactgtcaaaggaggacgcattgaatcttagtgtcccccgtcagcggagaaggcgtagacgcaaaatcgaaatagaggctgaacgcgccgcaaaaagacgtaatctgatggaaatggtagctcagctaagggaatcacaggtcgtcagcgagaatggtcaagaaaaagtagtcgacttgagcaaagcttcacgagaggccacttcatctacctctaacttcagctccctctccagtaagttcattcttcctaatgtctctacccccgttagcgatgcttttaaaacacagatggagctcctgcaagcaggactctcccggactccaactcgccacctcttgaacgggagtctcgtggacggggagccgcctatgaagcgccgcagggggcggcggaagaatgtggaaggcctggacctgctattcatgagccacaaacgcacttctttgtcggccgaggacgccgaagtgacgaaagcatttgaagaggacatcgaaacgccacccacacgtaatatccctagccctggacagttagatcccgacacaaggatcccagtcatcaatttggaggacggcactaggcttgtgggagaggatgcccctaagaacaaggacctcgtcgagtggctgaagctgcaccctacttacactgtggacatgccttcctacgtcccaaaaaacgcagacgtgctgttttcttcctttcaaaagcctaagcagaaacggcaccgatgccggaacccaaacaagttagacattaacactctcacaggagaagagcgagtccccgtggtaaataagagaaatggtaagaaaatgggcggcgccatggcaccccccatgaaggacttaccacgctggcttgaagagaatccggaattcgccgtggcccccgactggacagatattgtgaagcagagcggttttgttccggaaagtatgtttgaccggttactaaccggaccagttgttcggggtgaaggagcaagccgcagggggcggcgccctaagtcggaaatcgcgcgggccgccgccgctgcagcagcggtggccagtaccagcggcatcaatccacttctcgtgaactcactgtttgctgggatggatctaactagtctgcagaatctgcagaatttgcagtccctgcaactagctggccttatggggttcccccccggcctggctacggccgccaccgccgggggtgatgcaaaaaatcctgccgccgtgctgccgctgatgttgcctggcatggcgggtctaccgaacgtctttggactggggggtcttctgaacaaccccctgtctgctgctaccggcaacacgactactgcaagcagtcagggcgaacccgaggacagcaccagcaaaggcgaagagaagggtaacgaaaacgaggacgagaataaagacagcgaaaaatccacagacgccgtttctgctgccgactcagccaatggttcggtaggcgccgcaacggcacctgccggcctacctagcaacccacttgcgttcaatcccttcctgctcagcactatggccccaggcctgttctatccctctatgttcctcccacccggtctgggaggactgaccctccctggcttccctgctttagcgggactgcagaatgcagtgggctcctctgaggagaaggctgccgacaaagctgagggaggtcctttcaaggacggggaaacactcgaggggtctgacgctgaggagagcttggataagaccgctgaaagctctttgctagaagatgaaattgcacaaggagaggagttggatagtctggacggcggggacgaaatcgagaataacgaaaacgacgaatag

SEQ ID NO: 182933 - DNA, 8994 bp, Artificial Sequence
  Description of Artificial Sequence: Synthetic coding sequence
atggccgaccccggcatgatgagcctgttcggcgaggacggcaacattttttctgaaggtcttgaaggccttggcgagtgcggataccccgagaaccctgtgaatcccatgggtcaacagatgcccatcgatcagggctttgcttccctgcaaccgtccctacatcacccgtccacgaaccagaaccagaccaagctcactcatttcgaccactacaaccagtatgaacagcaaaaaatgcatctaatggaccagccgaatcggatgatgtccaacacacctggcaatggcctggcaagtcctcatagccaataccacaccccccctgtaccccaggtccctcacggcgggagcggcggagggcagatgggggtttatccagggatgcagaacgagcggcatgggcagagttttgtggattcttccagtatgtggggcccccgcgctgtgcaggtaccggatcagatcagggccccataccaacaacagcagccccagccccaaccgccacagcctgctccgagcggcccacctgcacagggccatcctcaacatatgcagcagatgggttcgtatatggcccgaggtgacttctccatgcaacagcacgggcagcctcaacaacgaatgtcccagtttagccagggacaagaaggcctgaaccagggaaatcccttcatcgcaacgtctgggccagggcatttgtcacacgtccctcaacaaagcccatctatggctcctagtttaaggcactcagtccagcaattccaccatcatccgtccaccgcccttcatggagagagtgtcgctcattccccgcggttcagtccaaacccgccacaacagggggcagtacggccacagaccctgaatttttccagccggtctcagactgtgccgtccccaacgattaataactctggccagtactctcgctacccttactccaatctcaatcaaggcctggtgaacaacacagggatgaaccagaaccttgggctaaccaataatacccctatgaatcaaagtgtcccccgctacccgaatgcagtaggcttccccagtaactctggccagggcttgatgcaccaacagccaatacatccttcaggctctttgaaccagatgaacactcagacaatgcatccctctcagccacaaggaacttatgcctcgcccccacctatgtccccaatgaaagctatgtccaaccccgctggcaccccgccaccacaggtccgccccgggtccgccggtatccctatggaggtgggcagttacccaaatatgcctcacccccaaccctcacatcagccacctggcgcgatgggcatcgggcaaaggaatatgggcccccgtaatatgcagcagtcgagacccttcattgggatgagttctgctcccagggagctgaccggccacatgcgacctaacggttgccctggggtcggtttaggcgatccgcaggcaattcaggagagactcattcccggccaacagcaccccggccagcagccttccttccagcagcttccaacatgtccccccctccagccgcaccccggactccatcaccagtcatctcccccacatccccaccatcagccttgggctcagttgcacccttcacctcagaacaccccgcagaaggtccccgtgcatcagcattccccctctgaaccttttctggaaaaaccagtacccgacatgacacaggtctcagggcccaacgcccaactggtgaagagcgatgactatttaccttctatcgagcaacagcctcaacagaagaaaaagaaaaagaagaacaaccacattgtggccgaagatccctccaagggatttgggaaagatgattttccaggaggtgtggataaccaggaacttaacagaaacagtcttgacggctcgcaagaggagaagaagaagaagaaacgcagcaaagctaaaaaggaccccaaggaacctaaagagccaaaggagaaaaaagagccaaaggagcctaagacacctaaggcccctaagataccaaaggaacctaaagagaagaaggcaaaaaccgccaccccgaagccaaagtcttcaaagaaatcttccaataagaagcctgacagcgaggcctccgccttgaagaagaaggtgaacaagggcaaaaccgaggggtctgaaaactctgacctcgacaagactcccccccccagcccaccccccgaagaagatgaagacccaggagtgcagaagagacggagcagccgccaggttaaacgcaagagatacaccgaggacctggaatttaaaatctctgatgaagaggcggatgacgcagacgctgccggacgcgatagtccatccaacacctcacaaagcgagcagcaagagtcggtcgacgcggagggcccagtggtggaaaaaattatgtcatcacgctccgtcaagaagcagaaggaatccggggaggaagttgagattgaagagttttacgtaaaatataagaacttcagctacctgcactgccagtgggcatcaatcgaagatctggagaaggacaagcgcattcagcagaaaatcaagaggttcaaagccaaacagggtcaaaacaagtttctatccgaaattgaggatgagctgttcaaccctgattacgttgaggtggataggattatggacttcgccagatccactgacgatagaggggaacccgtcacccactacctggtgaaatggtgtagcctgccgtacgaggacagcacatgggaacggcgtcaggacatcgatcaggcaaagatcgaggagttcgagaaacttatgtctagggagccagagacagaaagagtggaaaggcctcctgccgacgattggaagaaatctgagtccagcagggagtacaaaaacaacaacaaactgagagagtatcagttagagggggtgaactggctgctgtttaactggtacaacatgaggaattgcatcttggctgatgagatgggccttggaaaaaccatccaaagtataacgttcttatatgagatctacttgaagggcatccatggcccttttctcgtgatcgccccactgtctactattcctaactgggagcgggagtttcgcacttggaccgaactgaacgtggtggtttatcacgggtcacaagccagtcggagaacgatccaactatatgagatgtactttaaagatccacaggggcgcgtgatcaagggcagctacaagtttcacgcaattattacaacatttgagatgatcctcactgattgcccagagctgcgaaatatcccctggcgttgcgtcgtgatcgatgaagcccaccggctcaagaatcgtaattgtaaactcctggagggcctgaaaatgatggatctcgagcacaaggtgctcctcacgggcaccccacttcagaacactgtcgaggaactgttctcactgttgcacttcctcgaaccctctaggtttccgtcagagacaacattcatgcaagagtttggcgatctgaagaccgaggagcaggtgcagaagctgcaggccattctgaagccgatgatgctgcggcgattgaaagaggacgtggaaaaaaatctggctccaaaggaagaaacgattattgaggtggagcttactaacatccagaaaaagtattaccgtgcgattctagagaaaaacttcactttcctcagtaagggcggagggcaggctaacgttccaaatctgctgaatacaatgatggagctaagaaagtgctgcaatcatccgtacctcattaacggagccgaggaaaagatactagaggagtttaaagagacccacaatgccgagtcgcctgacttccagcttcaagccatgatccaggctgctggtaagctggtgctgattgataaactgctccctaagttaaaagctggcggacatcgcgtcttaatcttttctcagatggtgcgctgtctggacatcctcgaggattacctaatccagcgccgctacccttatgaacgcatcgacggccgtgtcaggggtaacctgcgccaggctgcaattgacaggttttctaagcccgatagcgaccgcttcgtgttcctgctgtgcaccagggcaggtggcctgggtataaatctcactgcagccgatacctgtattattttcgactctgactggaatccccaaaatgatctgcaggctcaagcccgctgccataggatcgggcagagcaaatctgttaaaatctataggttgataacccgcaacagctacgaaagagagatgttcgacaaggcttctctgaaactgggactggataaagccgtcctccagtccatgtcaggccgcgaaaacgcaaccaatggcgtgcagcagttgtctaaaaaggaaatcgaagatctcttaaggaagggtgcttacggtgcgcttatggacgaagaagacgagggctctaagttctgtgaggaggatatcgaccagatcttgctgaggcgcacacacacaatcaccatcgagtccgaggggaagggttctacctttgccaaggcgagctttgttgcatctggtaacaggaccgatatttccttggatgatcccaatttttggcagaagtgggctaagaaagcagagctggacatagatgctctgaatggccgaaacaatttggtcatagatactcctagagtgagaaagcagactcggctctacagcgccgtgaaagaggatgaactgatggagttctccgacctcgagagtgacagcgaggagaaaccgtgcgccaaacctcgccgcccacaggacaaaagccaagggtatgcgcgaagcgaatgctttagagtcgagaagaatcttctcgtgtacggttgggggcgctggactgatattctgtcccacgggaggtacaagcgacagctgactgagcaggatgtcgagactatctgtcgtaccatcttagtctactgcctaaatcattacaagggcgatgagaacatcaagtctttcatttgggacctgattacacctactgctgacggccagactcgcgccctggttaatcatagcggcctgtccgcccctgtgccaaggggcaggaagggaaaaaaggtaaaagctcaatcaacgcagccagtggtgcaggatgcggattggcttgccagctgtaacccggacgcgttgttccaagaggactcttataaaaagcacctcaaacaccactgtaataaggtcctgttgcgcgttcggatgctgtactatctcagacaggaggtgattggagaccaggccgataagattctggaaggggctgactcctccgaagcagatgtctggattccagaaccctttcacgctgaggtgcccgccgactggtgggataaagaagctgacaagtctctgctaattggcgtgtttaaacacgggtatgaaaaatacaacagtatgcgagccgaccctgcattatgctttctggagcgggtgggcatgcccgatgcgaaggccattgctgcagagcagagggggactgatatgctggctgatgggggggatggcggagaatttgaccgtgaagacgaagaccccgaatataagcctacaagaactccgtttaaagacgagatcgatgaattcgctaattcccctagtgaagataaggaagaatctatggagatccacgccactggcaaacatagtgagagtaacgcagagctgggccagttgtactggcctaatacttctacactgactacgcggcttcgccggctcattaccgcatatcaacggagctataagagacagcaaatgcgacaggaagccctgatgaaaaccgatcggcggcggcgacggccacgcgaggaggtgcgggctttggaggcagaaagagaggcaattattagtgaaaaacgccagaaatggactaggcgagaagaggctgacttttacagagttgtgagcacatttggtgtcattttcgacccggtaaaacagcaatttgactggaatcagttccgcgctttcgcccgcctcgataagaagtccgatgagagcctcgagaaatatttcagttgtttcgtggccatgtgtcgccgggtatgccggatgccagtcaagcccgatgacgaaccccctgacctctccagtatcattgagcctataaccgaggaacgggccagccgtactctgtatcggatcgagttactgcgcaaaattcgggagcaggtcttacatcacccacagctaggcgagcggctgaaactctgccaaccctccttggaccttcctgaatggtgggagtgtggccggcacgatcgtgatcttcttgtgggagctgcaaaacacggcgtctctcgaaccgattaccatatccttaatgaccccgaactgtccttcttggacgctcacaaaaattttgcccagaaccggggcgccggaaacacatcttcgctgaatccgctggcagtaggtttcgtgcagacaccaccggtgatttcatcagctcacattcaggacgagagagtgctcgaacaggcggagggaaaggtggaagaaccggagaaccctgctgctaaagaaaagtgtgagggcaaggaagaggaagaggaaacggacggcagcggcaaagagtccaaacaggaatgtgaggcagaggcgtcctctgtcaagaacgagttgaagggggtggaggttggcgctgacactggatccaagtcaatcagcgaaaagggttccgaggaggatgaggaggagaagctggaggatgacgacaagagtgaggagtcctcccaaccagaagccggtgccgtcagtagagggaagaatttcgatgaggagtcgaacgcttctatgagtaccgccagagacgagacccgggacggcttctacatggaggacggcgatccttcagtagctcaactgcttcacgaaagaactttcgcgttctccttctggcctaaggaccgggtcatgatcaacagactggacaatatctgtgaagcagtccttaagggcaaatggccggttaatagacggcagatgtttgacttccaaggactaatccctggatatacccctaccaccgttgattcacccctgcagaaaaggagttttgcagagctttcgatggttgggcaagcctccattagcggcagcgaagacataactacctcaccccagctgtccaaagaagatgccttaaacctgtctgttcctcgccaacgcagacgccggaggagaaagatcgagatcgaagccgagcgggcagccaaacggcggaatctgatggagatggtggcccagcttagagagagtcaagttgttagcgagaacggccaggaaaaagtggtcgacctgtcaaaggcgtcccgggaggccacgagtagtactagtaatttctcctccctctcaagtaagttcatcctcccgaacgtaagcactccagtgtctgacgctttcaagacccagatggaactgctgcaagctggactgtccagaacccctactcgtcacctcttaaatggcagcctggtagacggcgagcctccgatgaagcgaagacgcggtcgccggaaaaacgttgaaggtctggatctgctcttcatgtcgcacaaaagaactagtctgtctgcggaagatgccgaagtgactaaggccttcgaagaggatatcgagacgccccccactcgtaatatccccagccccggccagctcgacccagatactagaatacccgtcatcaatctcgaagacggaactcggctggtcggagaagacgcaccaaaaaataaagatctggtggaatggctcaagctccatccgacctatacagtggatatgccttcgtatgttccaaagaacgctgatgttctgttctcttccttccagaaacccaaacaaaaacgacataggtgccggaacccgaacaaattggacatcaatacattgaccggtgaagagcgggtccccgttgttaacaaaagaaatggtaagaaaatgggcggcgctatggccccgcctatgaaggacctcccacggtggctcgaggagaaccctgagttcgcggtggccccagactggacagacattgttaagcagtccgggttcgtccccgagagcatgtttgatcggttgttgactggccctgtggtgaggggagagggcgcctctagacgggggcgacggccaaagagtgaaatagctcgcgcagccgctgctgcggctgcagtggcgagtacctcaggtatcaacccccttttggtgaattctctgttcgccggaatggacctcacaagccttcagaatctgcagaatctgcagagtcttcagctggccggcctgatgggcttcccgccaggtcttgccaccgctgcaacagccggcggggacgccaagaaccccgccgccgtgctgcccctgatgctccctggcatggccggcctaccaaacgtgtttggacttggcggactgcttaataatccgctctccgctgctactggtaacacaacaacagcgagctcgcagggtgaaccagaagactctacaagcaagggagaggagaaagggaatgaaaatgaggatgaaaataaagactcagaaaagtcaacagatgccgtgagcgccgcggactccgccaacggcagcgtcggggccgccaccgctccagccgggctaccttccaatcctctcgcctttaacccatttctgctctccacgatggcaccaggtctgttttacccctctatgttcctgcctcctgggctgggcggactaactctgccagggtttcctgccttggccgggttacagaacgcagtaggctcctcagaagaaaaggctgccgacaaggctgagggtggcccatttaaggacggcgaaaccttggaggggagtgatgccgaagagtccctcgacaagacggcagaatcctccctgttagaagacgagatcgcacagggggaggagcttgatagtctcgacggaggggatgagatcgaaaataatgaaaatgatgaatag

SEQ ID NO: 182934 - DNA, 102 bp, Artificial Sequence
  Description of Artificial Sequence: Synthetic coding sequence
atggccgaccccggcatgatgagcctgttcggcgaggacggcaacatattcagcgagggcttggagggtctcggggagtgtgggtaccccgagaatccatag

SEQ ID NO: 182935 - DNA, 6906 bp, Artificial Sequence
  Description of Artificial Sequence: Synthetic coding sequence
aagggcgagagcaagcggatcaccctggtgctgcagcagccccagtccgggggacctcaggggcaccgacacgtggtactaggttcactcccagggaagatcgttctccagggtaatcaactggctgcgctgactcaggcaaagaatgcacaaggacagcccgctaaggtggtgaccatacagctgcaagtacagcaaccacaacaaaaaatccagatcgtgcctcagcccccctcgtcacagccccagccacagcagccaccctccactcagcccgtgaccctgtctagcgttcaacaggcacagattatgggtcccggacagagtcccgggcagcgcctgtccgtgcctgtgaaagtggtactgcagcctcaggccgggtcatctcagggcgccagctctggactatccgtagtgaaagtgctgagtgcctctgaggtggcagcactaagctctccagcctcgtctgctccacactcaggcgggaaaacaggaatggaagaaaaccgccggctcgagcaccaaaaaaagcaagaaaaagctaatcgtattgtggccgaggcgattgcacgtgcccgcgccagaggggagcagaacatcccacgcgttttaaatgaggacgagttacctagcgtccggccagaggaagagggcgagaagaaacgtagaaaaaaatcagctggggagcgccttaaggaagagaagccaaaaaagtccaagacttccggcgcttccaagacaaagggcaaatctaaacttaacactatcacccccgtagtgggcaagaagagaaagcggaatacgtctagcgacaatagcgacgtggaggtgatgccagcccaatcacccagagaggatgaagagagtagcatacagaagagaaggagcaatcggcaggtgaagcgcaagaagtacactgaagatcttgatattaagatcactgacgacgaagaggaggaggaagtcgatgtcactgggcctataaaacctgaaccaatcctgcccgagcccgttcaagaaccggatggcgaaacgctcccaagtatgcagttcttcgtcgaaaacccatctgaggaggatgctgccatcgtcgacaaagtgctaagcatgcgcatcgttaagaaggagctccccagtggacaatatacagaggcagaggagttttttgtcaagtacaaaaattacagctacctgcactgcgagtgggccaccattagtcaactggagaaggataaacggatccaccagaagttgaagcgttttaagacgaaaatggcccaaatgcgccacttcttccacgaggacgaggagccgttcaatcctgattatgtggaagtggatcgcattctggatgagtcccatagtatcgacaaagataacggcgagcccgtgatttactaccttgtgaaatggtgctccttaccatatgaggactcaacatgggagcttaaggaggatgttgatgagggcaagattagggagttcaagagaatccagagccgtcatcccgaactgaagagggtcaatcgccctcaggccagtgcctggaaaaaactggagttgtcccacgagtacaagaacaggaatcaacttagggagtatcaattggagggcgtgaactggctcttattcaactggtataacagacaaaattgcatattagccgacgagatgggattgggcaagactattcagagcatcgccttcctccaggaagtgtataatgtgggaattcatgggcccttcctggtgatcgcaccactgtcgacaatcacaaattgggagcgggaatttaacacatggacggagatgaacaccattgtctatcatgggtccctggccagcagacagatgatacagcagtatgaaatgtactgcaaagatagcagaggccgcctgataccaggggcatataagtttgacgctcttataaccaccttcgagatgatcctgtcggattgtccggaactaagagagatcgaatggaggtgtgtcatcattgatgaagcacaccgtttgaagaatcgcaattgtaagctgctcgatagcctcaaacatatggaccttgagcacaaagtcctgctgactggtacgcctctacaaaatactgtggaagaactgttcagtctgctccatttcctcgaaccgagccaatttccatcagaaagtgaatttctgaaagattttggggatctcaagacagaagaacaggtgcagaagcttcaagccatcttgaaacccatgatgctgcgccggctgaaagaggacgttgagaagaatcttgcccctaaacaggaaacgataatcgaagttgaactgaccaatattcaaaagaagtactaccgagccatcctggagaaaaatttctctttcttgagcaagggtgcaggacatactaacatgcccaacctcctcaacaccatgatggaactcaggaagtgttgtaatcacccttatcttatcaatggagccgaggagaaaattttgaccgaatttagggaagcatgtcatataattcctcatgattttcacttgcaagcgatggtgagaagcgccggaaaactggtgcttatcgacaagttgctacccaagctgaaagctggggggcacaaggttctgatattctctcaaatggtgcgatgcttggatatcttagaagattatttgatacagagaaggtacctttatgaacgtatcgacgggcgcgttcggggaaacctgagacaagcggccattgaccgattctctaaacctgattcggatcgttttgtctttctcctgtgcacccgcgccgggggcctcggtataaacctcaccgccgccgacacatgcatcatcttcgacagcgactggaacccccagaacgatctccaagcccaagctcggtgccacaggatcgggcagagcaaagctgtcaaagtgtaccggctaattaccagaaattcttacgaacgcgagatgtttgacaaagcaagcctcaagcttggtctagacaaagctgtgctccaatccatgagtggacgtgatggaaacattactggcatccagcagttctccaaaaaggaaatcgaggatttgctgcggaagggagcttatgccgcaatcatggaagaggacgacgaagggagcaagttttgtgaggaggatatagaccagattctgctgcgtcgcactaccacaatcacaatcgagagtgaaggcaaaggctctaccttcgccaaagcctcgtttgtggcgagcgaaaatcgcaccgacatcagtctggatgaccctaacttctggcagaaatgggcaaagaaagcggatctcgacatggatctgttgaattctaagaataacttagtgatagacacaccccgagtgcggaaacagacgaggcactttagtacactgaaagatgacgacctcgtggagttctccgacctagagtctgaggacgacgagaggccgcggtcacggaggcatgatcgccaccacgcttatggcaggacagactgttttagggtggagaaacacttgctcgtgtatggctggggaagatggagagatatcctaagccacggccggtttaaacgcagaatgacagagcgcgacgttgaaactatctgcagggccattctggtttattgtctgcttcactataggggagatgaaaatatcaaaggcttcatttgggacctgatctcccccgctgaaaacgggaaaaccaaagagctccagaatcactccggcttgagcatccctgtcccacggggccgtaaaggcaagaaagtcaagagccagtcgacattcgacatccataaagccgattggatcaggaaatataatcctgacacgttgtttcaggatgagtcttacaagaaacatttaaaacatcagtgtaacaaggtgttattgagggtcaggatgctatactaccttagacaggaggtcatcggagatcaggcagaaaaagtgcttggcggcgccattgcttccgaaattgatatttggttccccgtcgtcgatcaactggaagttccaacaacatggtgggatagcgaagccgacaaatcactactgatcggcgtcttcaagcacggttacgagaaatacaataccatgagggctgacccggctctctgtttcctggagaaggctggccgaccagatgacaaagctatcgctgcagagcatcgagtgttagacaacttttccgacatcgtggaaggggtggatttcgataaggattgcgaggaccctgagtacaaacctctccagggacccccaaaggaccaagacgatgaaggcgatccgttgatgatgatggatgaggaaatatcagtaatcgatggagatgaagctcaggtgactcagcagcccgggcatcttttctggcctcccggcagcgcgctgacagcaagactgcgccgtctggtgacggcctaccagcggagttataagcgggagcagatgaagatcgaagcagccgaacggggagacagacggcgcagacgatgcgaggccgcctttaagttgaaggaaattgcacgtcgagagaaacaacagcggtggaccagacgggagcagacagacttttaccgcgtcgtgtcaacttttggagtcgagtacgatcctgatacgatgcaatttcactgggatcgctttagaactttcgctaggctggataaaaagactgatgagagcctgaccaaatactttcacggattcgttgctatgtgccgacaggtatgccggttaccccctgctgccggtgatgagcccccagatcctaacctgttcattgaaccaatcacagaagaacgcgcttcaaggacgctatatagaattgagctattgagacggctcagggaacaggttctctgtcaccccctcctcgaggaccgtcttgccctgtgccagccgcccgggcctgagcttccgaagtggtgggagcccgtgagacatgacggcgagctgctccgaggcgccgcccgccatggagttagtcagactgattgcaatattatgcaggaccccgatttcagttttctagctgcacgcatgaactatatgcaaaaccaccaagctggcgcgcctgcccccagcctttcacgatgctctacccctctgctgcatcaacagtacacctcacgtaccgccagcccactacctctgagacccgacgcgcccgtggagaaatcccctgaagagaccgctacccaagtgccatcgttggaatctctgaccctgaagctggagcatgaggtggtggccagatcacgaccaacaccgcaggactatgagatgcgtgtgtcccctagcgacacaaccccactggtcagccggtccgtgccacctgtgaagctggaggatgaagatgattccgactctgaactggatctctctaaacttagcccttcctcttcttcgagctcctcaagcagcagctcttcaagtagtactgatgaatcagaagatgagaaagaggagaaattgacggatcaatcacgtagcaagctctacgacgaagagagccttctgagtcttaccatgtcacaggacggcttcccaaacgaggatggcgagcaaatgaccccagagctgcttctcctgcaggagagacagcgggcgtcagagtggccaaaggacagagtactgatcaatcgcattgatctcgtgtgtcaggctgtcctatccgggaagtggccgtcttctaggagaagccaggagatggtgacaggtggcatcctgggacccgggaaccacctgcttgactctccttccttgacacccggagaatacggcgacagtcctgttccaaccccacgatccagcagcgccgctagtatggccgaggaggaggcttcagcagtctcgaccgccgctgcacagttcacgaagctgaggagagggatggacgagaaagagtttaccgtgcaaatcaaggatgaggagggccttaaacttacatttcagaagcataaactgatggctaatggtgttatgggagatggccacccactgttccataaaaagaaggggaaccggaagaaactggttgagctggaggtcgaatgtatggaggagccaaaccatctggacgttgacctcgaaacccgcatccccgtgatcaacaaggttgacggtacgctgctggtaggcgaggacgctcctcgcagggcggagctcgaaatgtggctacaaggtcacccagagttcgctgtcgaccctcgtttcctagcctatatggaggaccgacgtaagcagaagtggcagcgatgtaagaagaataacaaggccgaactgaactgtctggggatggaacctgtccagacagcgaactctcgaaatgggaagaagggccatcacactgaaaccgtgtttaatcgggtgctcccaggccctattgcccctgagtcgagcaaaaaaagggcccgcaggatgaggccagacctcagtaaaatgatggctctgatgcagggaggaagcacagggagccttagtctccataacacatttcaacatagctcctccgggctgcagagtgtttcttccctggggcatagttcggcaaccagcgcttcactgccctttatgccatttgttatggggggcgctccttcttcacctcacgtagatagcagtaccatgctacatcaccatcatcatcatcctcacccccaccatcaccaccaccatcaccctggtttgcgggccccagggtatccctcttctccagtgacaactgccagcggtacaactctgaggttacctcccctgcaaccagaggaggatgatgacgaagacgaagaggatgatgatgacctgtcgcaaggatacgatagttcagagcgggacttctcgttaattgatgatccgatgatgccggctaattcagatagtagtgaggacgccgacgactag

SEQ ID NO: 182936 - DNA, 7746 bp, Artificial Sequence
  Description of Artificial Sequence: Synthetic coding sequence
atggccgaccccatcatggacctgttcgacgaccccaacctgttcggccttgattctctcaccgatgacagctttaaccaggtgacgcaggaccccattgaggaggctcttggcttgcccagttcacttgacagtctagaccaaatgaatcaagacggggggggcggtgatgtcggtaattcctcagcttccgaacttgtgccaccccctgaggagacagcccctacagaactgtctaaggaatcaacagcccctgcccctgaatctattactctgcacgactatactacgcagccagctagccaggaacagccagctcagccagtgctacaaacctctacccctactagcggtctgttgcaggtcagcaagtctcaggagatcttgtcacagggcaatcctttcatgggcgtctcggcaactgccgtctcctcctctagcgccggagggcagcctccacaaagcgcccctaaaattgtgatccttaaagcaccaccctccagctctgtcaccggcgcccatgttgcacaaattcaggctcagggaattacatcaacggcccagccactggtggcaggaacagccaatggtggaaaagtcacctttactaaggtgctgactggcaccccactccggcccggtgtgtccattgtgagtggcaatacggtacttgccgctaaggtgcccggcaaccaggccgccgtgcagcggattgtccagcccagccgcccggttaaacagctggtgttgcagcccgttaaaggctcggcacccgctggcaaccccggcgctactggtccccctcttaaacctgcagtcacgctgaccagcaccccgactcagggagagtcaaagcgaattaccttagttttacaacagcctcaaagtggtggtccccagggccaccggcatgtcgttctgggctccctccctggaaagattgtgttgcaagggaaccagctagctgccttaacccaagcgaagaacgctcagggacagcccgctaaagttgttaccattcagctacaggtgcagcagccccagcagaaaatccaaattgttccccagccccctagcagccagcctcagcctcagcagcccccatccactcagcccgtcaccttatcttctgttcagcaggcgcaaatcatgggtccaggccaatcgcccggtcagcggctcagtgtcccagttaaagtggtgctacagccacaggcaggttcaagtcagggggcgagttctggattgtccgtggttaaagtactctctgctagcgaggtggcggccctttcttcccctgcgtcaagtgccccacacagcggtggcaagaccggcatggaggaaaatcgcaggctggagcatcagaagaagcaggagaaggccaatcggatagttgcagaggccatcgccagggcacgagctcgaggcgagcagaacattcccagagtgctcaacgaggacgagctcccctccgtcaggcctgaggaagaaggcgagaagaaacgacgcaaaaaatccgccggagagcgcttaaaggaggagaagcccaagaagagtaaaacatctggggctagcaaaacaaaggggaaatcgaagctaaatacgataaccccagtggtgggaaagaaaaggaaacgaaacacgtcaagcgacaattccgacgtagaggtgatgcctgctcagtctccaagggaggacgaggagtcttccattcagaaacgcagaagcaacaggcaggtgaaacgtaaaaagtatacggaggatctggacattaaaattacagacgatgaggaggaggaggaggttgatgtgaccgggcctatcaagcctgagcctatcttgccggagcccgtgcaggaacccgatggagagacactgccttcaatgcagttttttgtcgagaacccatccgaagaggacgcagctatcgtggacaaggtgctctcaatgcggatcgtgaagaaagaactgccctcagggcaatacaccgaagcagaggaatttttcgtgaagtacaaaaactattcatacctgcactgcgagtgggccacgatttcacagctggaaaaggacaagcgaatacatcagaagttaaaacgtttcaaaaccaagatggcccagatgcgccacttcttccacgaggatgaagagccttttaaccctgactacgtggaggtagatcggatcctagacgagagtcacagcatcgacaaggataatggcgaacccgtgatttactacttggttaagtggtgtagcctgccttacgaggactcaacgtgggaactgaaggaggacgtagatgagggcaaaatcagagaattcaagaggatccagtcaaggcaccccgagctcaaacgggtcaacagaccacaggcctctgcctggaagaaattggaactcagtcatgagtacaagaatcgaaaccaactgcgggagtaccaactggaaggggtcaactggctgctgtttaattggtacaatcggcaaaattgtatactcgccgatgagatgggactcggaaagaccatccagtcaattgcgtttcttcaggaggtgtataacgtcggaatacacggacctttcttagtgatcgcaccactgtccacaattacaaactgggaacgcgagttcaacacttggaccgagatgaacaccatcgtttatcacggcagcctggcgtctagacagatgatccagcaatacgagatgtactgcaaagactcccggggccgcctgatccctggggcatacaaatttgacgctctaattactacattcgagatgatccttagtgattgtccggagctaagggaaattgagtggagatgcgtcatcatcgatgaagcccatcgtctaaaaaaccgcaattgcaagctccttgactctctaaaacatatggacctcgaacacaaggtgttgctgacgggcacaccgctccaaaatacagttgaggaattattttcgttgttgcattttctggaaccgtcgcagtttccatcagaaagcgagttcctcaaagattttggcgatctgaaaacagaggaacaggtccagaagctgcaggccatcctaaagcccatgatgctaagacgccttaaagaggacgttgaaaagaatctagcccctaaacaggagacaatcatcgaggtagagctgacaaatatccagaagaagtactaccgtgcaatactggaaaaaaactttagctttctgtccaaaggagccgggcacaccaatatgccgaacttgttgaatactatgatggagctaaggaagtgctgcaaccacccatacctgattaacggtgccgaagaaaaaatcctcacggaattcagagaggcttgtcacataatcccccatgactttcatctgcaggccatggtgcggtcagcagggaagctggtgttaattgacaagctgttgcccaagctcaaagccggtggacacaaagtgttgatttttagccagatggtgcgctgtctggatattttagaggactacctgatccagagacgttatctgtacgagcgaattgatggccgagtgcgaggcaacctgcggcaggcggccatagaccgattcagcaaacctgacagcgatcgctttgttttccttctctgcacaagggcggggggattgggcattaatttgacagctgcagacacctgtattattttcgattcggactggaaccctcagaatgacctgcaagctcaagcgaggtgccacagaattggccagagcaaagccgtgaaggtttacaggctcatcaccagaaacagctatgagagggaaatgttcgacaaggcatcactgaagctgggtcttgacaaagcagtcctccagagcatgagcggcagggatgggaacatcactggaatacagcaattttcaaagaaggagattgaggacctccttagaaagggggcctacgcggcaatcatggaggaagacgatgagggcagcaagttttgcgaggaggacatcgaccagatcttgcttcgccgcaccacaacaatcacgatcgagtccgaaggtaaggggtccacatttgcgaaggcatcctttgtggccagcgaaaataggactgacatttctctggacgaccctaacttttggcagaagtgggcaaaaaaggccgacttggacatggatctcctcaactccaagaataatctcgtgatagatacaccaagagtcaggaaacagaccaggcacttctcaacgctgaaagatgacgacctggttgagttctcagatctagagtcggaggatgacgagagacctaggtctcgaagacacgatagacatcatgcttacggccggactgactgcttccgcgtggaaaagcacctgctcgtctacggatggggtcgctggcgcgacatcttgtctcatggccggtttaagcggcgcatgactgaacgggacgtcgaaacgatctgtcgggccatcctagtctactgtctactccactatagaggagatgagaatatcaagggcttcatctgggacctgatcagtccagccgaaaatgggaagactaaagagctgcagaatcacagcggactctccattccagtaccccgtggaaggaaaggtaagaaggtcaaaagtcaatcaaccttcgatattcataaagccgactggatccgaaagtacaatccagatactctcttccaggacgagagctataagaagcatctgaaacaccaatgtaataaagtgcttcttcgggtgaggatgctgtattatctgcgacaggaagtgattggcgatcaggccgaaaaggtcctcggcggggccatcgccagcgagattgacatttggtttccagtagttgatcagctggaggttcccactacttggtgggattccgaggccgacaagagcttacttatcggcgtctttaagcacggttacgaaaaatataataccatgagggcagatcccgcattgtgctttcttgaaaaagccggacgccccgacgacaaagccattgctgcagagcaccgcgtgctggacaacttctccgacatcgttgagggtgtagattttgacaaagattgcgaggatcccgaatataaacctctgcaaggcccacctaaggatcaagacgacgaaggcgatcccctgatgatgatggacgaagagatttcagttatagacggcgacgaggcccaggtgacacagcaaccaggccatctgttctggccacccggatccgccctcaccgcacgactgagacgactagtgactgcctaccagaggagctacaagcgcgagcaaatgaaaatcgaggctgcagagagaggggacaggagacggcgcaggtgcgaggcagcttttaagcttaaggaaattgcacgccgggagaagcaacaacgctggaccaggcgtgaacaaacagacttttacagagtggtgtccacatttggtgtagagtacgaccccgatactatgcagttccactgggacaggttccggactttcgcacgtctggataagaaaaccgatgaatcattaactaaatattttcacggttttgtggcaatgtgccgccaagtgtgtcgtttaccgcctgctgcgggggacgaaccacccgatcctaacctgtttattgagccaattactgaggagagagcctccagaaccctctaccgcatcgagctgttgcgtagactgcgcgagcaggtcttatgtcatcccctcctggaggatcgtcttgctctgtgtcagccaccggggccagagctgcctaaatggtgggagcccgttagacacgacggagagctgctacgcggggccgctcggcacggagtttctcaaacagactgcaacattatgcaggaccctgacttctcctttctcgctgctcgcatgaactatatgcagaaccatcaggctggagcccctgcaccctccctcagcagatgctccaccccactcttgcatcaacagtatactagtcgaaccgccagtccactcccacttcgaccggacgctcccgtagaaaagagcccagaggagactgctacacaggtgccgtccttggaatcgttgaccctgaagttagaacacgaagtagtggccaggtcacggccaactcctcaggactacgaaatgagagtgagcccctcagataccactcccctcgtgtctagaagcgtgcctcctgttaagttagaggacgaggatgactctgattctgagttggacctttcaaaactgtccccatcgtcctcatcaagttccagctcaagtagttcctctagttccactgacgagtcagaagacgaaaaagaagaaaagctgacagatcagagcaggtcaaagttgtatgacgaggaaagcctcttgtctctcactatgagtcaggacggcttcccaaatgaagatggagaacagatgacccccgagctgctacttctccaggagcggcagcgggcatccgaatggccaaaagacagagtcctgatcaaccgcattgatctggtgtgccaagcggtcctgagcgggaagtggcccagctcgaggcggtcccaggagatggtcacaggcgggatactcggacctgggaatcacctgttggattccccaagtttgacacccggtgagtatggcgactctccagttcctacaccccgctcttcctcggcggcgtccatggccgaggaggaggccagcgcagtctccactgctgcagcccagtttactaagctccgccggggcatggacgagaaagagtttacggtacagattaaggatgaggaaggactgaagctgacttttcagaaacacaagttaatggcgaacggagtgatgggagacggccatcctctcttccacaaaaagaagggaaaccgaaaaaagctggttgagctagaggttgaatgtatggaggaacccaatcatctcgatgtggatcttgaaactcggatcccagtgatcaacaaggttgacggaactctgctagtgggcgaagatgccccaagaagggcagagcttgaaatgtggttgcaggggcaccctgagttcgcagttgaccccagatttctggcatatatggaggaccggaggaagcagaagtggcaacgctgcaagaaaaataacaaggctgaactgaactgcctgggcatggaacccgtccagaccgcaaactctaggaatggcaagaagggccaccacactgagactgtgtttaatagagtccttccaggtccaatagcccccgagagcagcaagaagcgcgcccgccgaatgagacctgatctcagcaagatgatggctctgatgcagggaggaagtaccggctccctttctttacacaatacttttcagcacagcagcagtggattgcaatcggtgagcagcctagggcactcctcagccacctctgcatctctcccatttatgccgttcgtcatgggcggcgctccctcatcaccccacgtggatagctctaccatgctccatcatcaccatcaccaccctcacccgcaccaccaccatcaccatcacccaggattacgggccccaggctacccctctagccccgtcacaaccgcctcgggaactacgttaaggcttcctcctttgcagcccgaggaagatgacgacgaggatgaagaagacgatgacgacctgagtcagggatatgactccagcgagagggatttctccttgattgatgatcctatgatgcccgccaactccgattccagcgaggatgccgatgactag

SEQ ID NO: 182937 - DNA, 6909 bp, Artificial Sequence
  Description of Artificial Sequence: Synthetic coding sequence
atgaagggcgagagcaagcggatcaccctggtgctgcagcagccccaaagtggcggccctcaaggtcaccgccacgtggtactaggctcactgcctggtaagattgtgctacaaggcaaccagctggctgctctgacccaggccaaaaatgcccagggtcaacctgccaaggtggtgaccattcagctgcaagtccagcaaccccagcagaaaattcagattgtgccacaacccccttcttcgcagccgcagccgcagcagcctcctagcacacaaccggttacgctgagtagcgtgcaacaggctcagataatgggacccggacagtctcccggacaacgcctctccgtgccggtaaaggtggtactccagccccaggcaggtagttcacagggcgcaagctctggcctgtctgtggtaaaagtcttatcagcctctgaagtggctgctttatcaagtcccgcctcctctgcgccacattctggcggaaagaccggcatggaggagaaccgccgcttagagcatcagaaaaagcaggagaaggccaatcgaatcgtggcagaagccatcgctcgcgcccgcgcacgcggcgagcagaatatacccagggttttgaatgaggacgagcttcccagcgttcgcccggaggaggagggagagaagaaacgccgcaaaaaatcggccggcgaaagactgaaagaggaaaaaccaaagaaaagcaagactagcggcgcttcaaaaaccaagggaaagagtaaactgaacactatcacccctgtggtgggcaaaaaacggaagagaaatacttcttccgataactcagacgtggaggtgatgccagcccaatcgccgcgtgaggacgaggaaagctccattcaaaagagaaggtctaaccgccaagtgaagcgcaagaagtacaccgaagatttggatattaagatcactgatgacgaagaggaggaggaagtggacgtgacaggccccatcaagcctgagcccatcctgcccgagccagtgcaggagcccgacggcgaaacacttcctagtatgcaatttttcgtggaaaacccctctgaggaggatgccgcaattgttgataaagtgctgtcaatgcgtattgttaagaaagaactgccctccggccagtacacagaggccgaggagttttttgtgaagtacaagaactactcttacctgcactgcgagtgggctactattagtcagctggaaaaggataagaggatccaccagaagctaaagcgattcaagactaagatggctcagatgagacacttttttcacgaggacgaggaaccatttaaccctgattatgtggaagtggatcgtatcctcgacgagagccactctatcgacaaggacaacggggagcccgtgatttattacctggtgaaatggtgctctctcccctacgaagactccacttgggaactgaaagaagatgtagacgagggcaagattagggaattcaagcgcatccaatcacggcaccccgaattgaaacgggttaaccggccccaggcctccgcctggaagaagttggagctttcccatgagtataaaaacaggaaccaactcagggaatatcagctggagggcgtgaattggctgctcttcaactggtacaacaggcagaactgcatcctggcagatgagatgggccttggcaaaaccatccagagcattgcattcctgcaggaagtctataacgtaggaatccacggtccattccttgtaatcgcccctctttctacgattactaactgggaacgtgagtttaatacatggactgaaatgaacaccatagtgtaccatggctctctggcctccagacagatgattcagcagtacgagatgtactgcaaagactctcgtggccgattaatcccaggcgcttataagttcgacgctctaataacgacctttgagatgattctcagtgactgtccggaactcagggagatcgagtggaggtgtgtcatcatcgacgaagcccaccgtctgaaaaaccgaaactgtaagctcctggactctctgaaacatatggacctcgagcataaggtcctgctgacagggacccctctgcagaatacggtcgaagagttgttcagtctcctgcacttcctcgaaccttctcagtttccttctgagagtgagtttctcaaggatttcggagatctgaagacggaggaacaggttcagaaactgcaggctattttgaaaccgatgatgctcagaagattgaaagaagacgttgaaaaaaatctggcccctaaacaggaaacaatcattgaagttgagctgaccaatatccagaaaaaatattatagggcgatccttgaaaagaatttctcttttttgtcgaagggagctgggcacactaacatgcctaatctgttgaataccatgatggaactgcggaaatgctgtaatcacccttatctgatcaacggcgctgaggaaaaaatcctcaccgaattcagagaagcgtgtcatattattccccacgacttccatctgcaggcgatggtgcgctcagcgggcaagctggtgctgattgacaaactgctccctaagttgaaagctggggggcataaggttctcatcttttcccaaatggtacgctgcctagatattttagaggactaccttattcaaaggaggtacttgtacgaacgcatcgacgggcgggtgcgcgggaatttgcggcaggctgcaatagaccgcttctccaagcccgactccgatcggttcgtgttcttactctgtactcgggccggaggcctcggcataaatcttactgccgccgatacctgcattatcttcgacagcgattggaacccacagaacgatcttcaagcgcaggcacgctgtcaccggatagggcagagcaaagctgtcaaggtgtaccggctgataacacggaatagctatgaacgtgagatgttcgacaaggcttccctgaagctggggttggataaggccgtgttgcagagtatgagtggccgtgatggcaatattaccggcatacaacaattttcaaagaaggaaatcgaagatctgctccggaagggggcatacgcagccattatggaggaggacgatgaagggagcaagttctgcgaggaagacatcgatcagattttattaaggaggacaactacgatcacaattgaatcagaggggaaaggcagcacatttgccaaggccagctttgtagcctctgagaaccggacagacatcagcctggacgaccccaatttctggcagaaatgggctaaaaaagccgacttggacatggacctgctgaatagtaagaataatttggttatcgacaccccccgcgtccgtaagcagactagacacttcagcacattaaaggatgacgacttagtggaattctccgacttagagagcgaggacgacgagcgtcctaggtcacgacgacacgaccgacaccacgcttacggacggacagactgtttccgcgtggagaagcatctgttggtgtacgggtgggggcgctggcgcgatatcttgtcacacgggcgatttaagagacggatgacagaaagggatgtagagaccatctgtagggctatcctcgtttactgcttgctgcactaccggggagatgaaaacatcaaagggtttatttgggacctgatctctccagctgaaaatggaaagaccaaagaactacaaaaccacagtggattgagcattccagtgccaagaggtaggaagggcaaaaaggtgaaatcacagtcaacctttgatatccacaaggccgattggattcgaaagtataaccccgatactctatttcaggatgagtcatataaaaaacacctaaagcatcaatgtaacaaggttctcctgagggtgagaatgctttactatctgaggcaagaggttattggcgaccaggcagagaaggtcctcggcggagccattgcatctgagattgacatctggtttcccgtggttgaccagctggaagtccctacgacgtggtgggattccgaagcagacaaatcactcctgatcggggtgttcaagcatggttatgagaaatacaacacgatgcgcgcagatcctgccctgtgctttctagaaaaggcgggcagacctgacgacaaagcaatcgccgccgaacatcgcgtcttggacaatttctccgatatcgtggagggtgtcgactttgacaaggattgtgaggaccccgagtataaaccgctgcaggggccccccaaagatcaagatgatgaaggcgaccctctaatgatgatggacgaggagatttcagtgatcgacggcgatgaggcccaggtaactcagcagccgggtcacctcttttggccccccgggtcagctttgaccgcccgcctgagacggcttgtgactgcttaccagaggagctacaagagggaacagatgaagatcgaggctgccgagcggggcgatcgtaggcggagaagatgtgaagcggcattcaagctgaaagagatcgccagacgtgagaagcagcagaggtggacaaggcgcgagcagaccgatttctacagggtggtctccacttttggtgtggagtatgatcccgacacaatgcagtttcattgggatcggttcagaacgttcgcccgcctcgataagaagacagacgaaagcctgacaaagtattttcacggctttgtcgctatgtgtcgtcaagtgtgcagactgccacccgcagctggcgacgagccacctgacccgaacctgttcattgagcccattactgaagaaagggcctccagaacattgtacaggatcgaactgctgagaaggcttcgtgagcaggtgctgtgccatcctctcctcgaggatcgcttagcactgtgccagccccctggtcccgagctgccaaaatggtgggagccagtcagacacgatggagagctgctgcgtggggcagcaaggcatggagtcagtcagaccgactgcaatattatgcaagacccggacttttcttttctggctgcacgtatgaactacatgcaaaatcaccaggccggcgccccagcgccatctctgtctagatgctctacacctttgctgcaccagcagtatactagccgcactgcatccccccttccactgaggcctgatgcccccgtcgaaaagtcacctgaggaaaccgccacccaagtgccttcactggagtctttgactctgaaactcgaacacgaggtagttgccagatcaagaccaaccccccaggattatgagatgcgagtcagtccctccgatacaacccctttagtctcacgctctgtgcctcccgtgaaactggaagatgaagacgattccgactccgaactcgatttatctaagctgtcaccatcttccagctcatcctctagctccagctcctcctcatcatcaacagatgagagcgaggatgaaaaagaggagaagctgaccgaccagtcacggagtaagctctacgacgaagagtcattactgagccttacaatgtcgcaggatggcttccccaacgaagatggagagcagatgactcccgagctccttctgctccaggaacgccaacgggcatccgagtggccaaaggatcgcgtactgatcaaccgtatcgatctcgtgtgccaggcagtgttgagtggaaagtggccctcttcccggaggtctcaggaaatggtgactggggggatcctgggcccaggcaaccatctcctggatagcccttccttgactccaggagagtatggtgattccccggtgcccacccctcggtcgagcagcgcagcatctatggctgaggaggaagcatcggccgtctctacagccgccgcacagttcaccaaattaaggagaggtatggacgagaaggaatttaccgtgcagattaaggatgaggagggcctcaaactgacgttccaaaaacacaagcttatggccaacggggttatgggcgacggccacccgctttttcataagaagaaaggcaataggaagaagttggtagaactggaagtggaatgcatggaagaacctaatcacttagacgtcgatctagagacaaggattccagtgattaacaaggtggatggtactctgctggttggtgaagatgccccacggagggctgagttagagatgtggttgcaaggtcatcctgagttcgctgtagacccccggtttctggcatatatggaggatcgaaggaagcaaaagtggcaacggtgcaaaaaaaacaataaagcggaactgaactgcttaggcatggagcctgtgcagactgccaattcaagaaatggcaaaaaaggccaccatactgagaccgtattcaatagagttctgcctggtcctatcgctccagagtcatctaagaaacgggcccggcgcatgcgtcctgatctttccaagatgatggccctcatgcagggaggttctacaggcagtctgtctctccacaataccttccagcactccagctctggcctgcagagtgtgtccagcctcggacacagttccgctacaagcgcttctttacccttcatgccttttgtgatgggtggggcgccctcatctccacacgtcgactctagcactatgctccaccaccaccaccaccacccccatcctcatcaccatcatcaccatcatccgggtctgagagcacccggctacccatcctcccctgtaacaacggctagcggaaccactttgagactaccccctctgcagcctgaagaagatgacgatgaagatgaagaggacgacgacgacctgtcccaggggtacgattcatctgagcgcgactttagtctgatagatgatcctatgatgcctgccaatagcgacagctccgaggatgcagatgactag

SEQ ID NO: 182938 - DNA, 7746 bp, Artificial Sequence
  Description of Artificial Sequence: Synthetic coding sequence
atggccgaccccatcatggacctgttcgacgaccccaacctgttcggcctggacagtctgaccgatgactcctttaatcaggtgacacaggaccctatcgaggaggctctaggcctgcctagtagtctggatagccttgatcagatgaatcaggacggaggggggggtgacgtgggcaatagctctgccagtgaactagtgcctccaccagaagaaacggcaccaaccgagctgagtaaggagtccactgcgccagcccctgagagcataacgctgcatgattacacaacacaacccgccagccaggagcagccggcacagcctgtactgcaaacctcaacacctacgtcggggcttctacaggtatctaaaagccaagagattctgagtcaggggaacccttttatgggagtctcggcaactgccgtctctagttctagtgcaggaggtcagccgccccaaagcgccccgaaaattgttatcttgaaagcacctcctagcagctctgtgacgggcgcacatgtggctcagatacaggctcagggaatcaccagcacagctcagcctctggtggccggtacagcgaatggagggaaagttactttcacaaaagtgctcactggcaccccactgagacccggtgtctcaattgtgtctggcaacacggtgttggccgctaaggtccctggtaatcaagccgctgtccagcgcatcgtccagccgagccgacccgtcaaacagcttgtcctacagccggtgaaaggctcagcccccgctggaaacccaggtgctacggggccacccctgaagccagcagtcactctcacgagcaccccaactcagggagaaagtaagaggattactttggtcctccagcaaccacaatccgggggaccccaaggccatcgacacgtcgtcctcgggtccttgcctggtaagattgtgctgcaagggaaccagctagctgctctgacacaagccaagaacgcccagggccagccagctaaagtggtgacaattcagcttcaggtacagcagcctcagcaaaaaattcagatagtccctcagcctccaagcagccaaccacagccacagcagcctcccagtactcagccagttacgctgagctcagtgcaacaggcacagattatggggcccggccagtctccgggacagcgactgtccgtgccagtcaaggtggtgttgcaacctcaggcaggaagctctcagggcgcctctagtggcctttctgtggtcaaggtgctgtccgcctcagaggtcgctgcattgtcaagccccgcctcttctgcacctcatagcggaggcaagactggtatggaagagaatcggcgcctggagcatcaaaagaaacaggagaaagccaacagaattgtcgcagaggccattgctcgagcccgcgccaggggcgaacagaatattcccagggtgctgaacgaagatgaacttccaagcgtacggcctgaggaggagggagagaagaagagacggaaaaaatccgccggtgagcggctcaaggaggaaaagcctaagaagtctaaaacctcaggcgcctcgaaaaccaaggggaagtccaagctcaataccattactccagtagtgggtaagaagcgaaaacggaacaccagttccgacaacagcgacgtcgaagtgatgcccgctcagtctcctcgcgaggacgaagagtctagtatccagaagagacgctctaacaggcaggtgaagagaaagaaatacaccgaggatctggacataaagatcaccgacgatgaagaggaggaggaagtagatgtgactgggcctattaaacccgagcccatcttacccgagccagtgcaggaacctgatggggagactttgccctctatgcagtttttcgtcgaaaacccgtcggaggaagacgctgccatcgtcgacaaggtgttgtccatgcgcatagtgaagaaggaactgccctctgggcagtatacggaggccgaagaattctttgtaaagtacaagaattattcgtacctgcattgtgaatgggctacaatctcacagctggaaaaggacaaacgaatccaccagaagctcaagagattcaaaaccaagatggcacagatgagacacttttttcacgaggatgaggagccctttaatcccgactatgtggaagtggatagaattcttgacgagtcccacagcattgataaggacaatggcgagccagtgatatactacttagtcaaatggtgtagcctcccgtacgaggactctacctgggagctgaaagaggatgtagacgagggcaagattcgggagttcaaacgcatacaatcaaggcacccagagttgaagcgggtgaataggccccaggcatcggcctggaagaaactggagctgtctcatgagtacaaaaaccggaatcaacttcgagagtaccagctggagggcgtcaattggttgctgttcaattggtataatcgccagaactgtatcctggccgatgagatgggccttggtaaaactatccagagcattgcgttcctccaagaagtctacaacgttgggattcacggacctttccttgttatcgcccctttgtccaccatcaccaattgggaaagagagtttaatacctggacagagatgaatacaatcgtctatcatggcagccttgcaagtcggcagatgatccagcagtacgaaatgtattgtaaggattctcgggggcggttgattcccggcgcctataagtttgatgcactgattactactttcgaaatgatcttgagcgactgccccgagctcagagagattgagtggagatgtgtgatcatcgacgaggcccacagactgaagaaccgtaactgtaagctgctcgacagcctgaaacacatggacttggaacacaaggttttgcttaccgggacgcccctacagaatactgttgaggagctattttcgcttctccatttcctggagccctcccagtttccatccgaatccgaatttctgaaggacttcggggacctgaaaacagaagagcaggtgcagaaattacaggcaatcctgaagcccatgatgctgaggaggctcaaggaagatgtggagaaaaaccttgcccctaaacaagagacaataatagaagtagagctcacgaatatacagaaaaaatactatagggccatcttggaaaaaaacttctccttcttatctaagggagctgggcacaccaacatgcccaacctactgaacaccatgatggagctgcgaaaatgctgcaatcacccttatcttattaacggggctgaagagaaaatcctgacggaatttcgcgaggcctgccacataattccccacgacttccatctgcaggctatggtacggtccgccggaaaactggtccttatagacaagctactgcctaaacttaaagccggggggcacaaggtgctgattttcagtcaaatggttcgatgcctcgatatcttagaagattatctgatacagcggcgatacctgtatgagagaattgacggtcgggtgcggggtaacttaaggcaggccgcaatcgacagattttccaaaccagactctgatcgattcgtctttctcttatgtacaagagccggaggcctgggtatcaatcttaccgccgctgatacctgtataattttcgattccgattggaacccccagaacgatctgcaggcccaagctcggtgccacaggattggtcaatcaaaggctgtgaaagtgtacaggctcattacccggaattcttacgagcgtgaaatgtttgataaagctagtctcaagctgggcctcgataaagccgtcttacaaagtatgagcggcagagatggcaatattactggcatacagcaattttcaaaaaaggaaatcgaagatcttctccgaaagggcgcatatgccgcaatcatggaggaggacgatgaagggtcgaagttctgcgaagaagacattgatcagatcctcctccgacggaccacaacaattacgatcgagtccgagggaaagggcagcacattcgccaaggcgtcattcgtagcctccgagaacaggaccgacatcagtctggacgatcccaacttctggcagaaatgggcgaaaaaggcggacctcgacatggacctgctcaattccaaaaacaacctggtcatcgacactccccgcgtcagaaaacagactagacatttcagcactctgaaggacgacgatctggtggagtttagcgacttggaatctgaggatgacgaacgaccaagatctagacgtcacgacagacatcatgcctatgggcgtaccgattgtttccgggtggaaaaacaccttctggtgtacgggtggggccgctggagagacatcctttcacatggtcggtttaaacgtagaatgactgaaagggatgtggagacaatctgcagagccatcctagtatactgccttctgcactaccgcggggatgagaacattaaaggcttcatttgggatctgattagccctgccgaaaacggtaagacaaaggagttacagaatcattccggactcagcatccccgtgccccgcggaagaaagggcaaaaaggtaaaaagccagtcgacatttgacattcataaggctgattggatacgcaagtataaccccgataccctgtttcaggatgaaagctacaagaaacacctcaaacaccagtgcaataaggtgcttctccgcgtacgaatgctctattacctgaggcaggaagtaattggggatcaggccgaaaaggtgctcgggggtgccatcgctagcgagattgacatttggttccccgtggtcgaccagttggaagtgcctactacgtggtgggattcagaggcagataaatctctccttatcggcgtgtttaaacatgggtacgaaaaatacaacaccatgagagctgaccctgcgctgtgttttctcgagaaggcgggaagaccagacgacaaagctatcgcggcggaacatcgggtgttggataatttctctgacatcgtagagggggtcgacttcgataaggattgtgaagacccggagtataaaccattgcagggccctcctaaggatcaggatgacgagggggatccactgatgatgatggatgaagagatttctgtgattgacggagacgaggctcaagtgactcaacagccagggcatctcttttggcctcctggttctgcacttactgctaggctaagacgcctggtgactgcctaccaacgatcctacaaacgggagcagatgaagatagaggccgctgagcgcggcgacagacgcagacgtagatgcgaggcggctttcaagttaaaagaaatcgccaggcgtgagaagcagcagagatggactagacgtgagcaaacagatttttaccgtgtcgtctccacctttggcgtggagtacgatcccgatacaatgcaattccattgggataggttcagaactttcgcacgccttgacaagaagactgacgagagtttaacgaagtatttccatggattcgttgccatgtgtcgccaggtgtgtcggctgccacctgccgcgggagatgaaccacctgatcccaacctgttcatagaaccaattaccgaggagcgcgcctccaggaccctgtacagaattgagttgctccgtcgcctacgcgagcaggtactttgccatccgttgctcgaagacaggttagccttgtgtcaaccccctgggcccgagctgcctaaatggtgggagcctgtccgccatgacggggagctgttacgaggagctgcaagacacggtgtgtctcaaactgactgcaatatcatgcaagatcctgatttctccttcttagccgcacgcatgaactatatgcagaaccatcaggcaggagctccggcaccctccctctccaggtgcagtacgcctctgttgcaccaacagtacaccagccgaacagcttcgcctctccccttacgtccagatgctcctgtggagaaaagtccagaggagacagctacgcaggtgccgtcacttgagagcctgacactgaaactggaacatgaggtcgtggcacgatctcggccgacaccccaggattacgagatgagggtctcccccagtgacacaactccgctcgttagcagatctgttccacccgtgaagttagaagatgaagatgattctgactccgaacttgacctatccaaactcagtccatcctcttcctcctcatcaagcagctccagttcttcatcctctaccgacgaaagcgaagacgagaaggaggagaaactgacagatcagtctcgctctaaactttatgacgaggagtccctgctttctcttacgatgagtcaggacggatttccaaacgaggacggtgagcagatgacccctgagctgcttctgctgcaggaacgccagcgcgcctccgagtggccaaaggacagagtgctgataaatcgtattgacctggtgtgtcaggccgtgctgtcaggaaagtggcccagcagtcgacggtcacaggagatggtgacagggggtattttgggtccaggtaatcatctgctggactcaccttcacttacccccggggagtacggcgattctccggtccccactcctagatcttcttccgccgctagtatggctgaggaagaagccagcgccgtgtcaaccgctgctgcacagttcaccaagcttcgtcgtggaatggacgagaaggagttcacagtgcaaatcaaagatgaggagggtctgaagctgaccttccagaagcataagcttatggctaacggggtgatgggggacgggcacccattattccacaaaaagaaagggaataggaagaaactcgtggagctggaagtggagtgtatggaggagcccaaccatttagacgttgacttagagaccagaatccctgtgatcaataaagtcgatggaactctgctggttggagaggacgcccctaggcgggccgagctggaaatgtggctgcagggccatccagagtttgccgttgatccacgcttcctggcttacatggaagatagacgcaaacagaagtggcagcgttgcaagaagaataacaaagctgagctgaactgcctcgggatggaacccgttcagaccgcaaactctcggaatggaaaaaaaggacaccacactgagacggtattcaacagggtgctccccgggcccattgccccggagagcagcaagaaacgtgcccgacgtatgcgcccagatctttccaagatgatggcccttatgcaaggcggcagcacggggtccctttctctgcacaatacgtttcaacattccagctctgggcttcagagtgtctcttctctggggcattcatcagcaacatctgcaagcctaccttttatgccctttgtgatggggggtgccccatcctcacctcacgtggactccagcaccatgcttcaccatcaccatcaccacccccatcctcatcaccaccatcaccaccacccaggcctccgtgctcctggctacccatcttccccagtgaccacagcctctggaacaactctgagactaccgccattgcagcctgaggaagatgacgatgaagatgaagaagatgacgacgacctaagtcagggatacgatagtagcgaacgcgactttagtctcatcgatgaccccatgatgccagcaaactcagactccagcgaagacgcggacgattag

SEQ ID NO: 182939 - DNA, 1797 bp, Artificial Sequence
  Description of Artificial Sequence: Synthetic coding sequence
atgaccttccaggccagccaccggagcgcctggggcaagagccggaagaagaattggcagtatgaaggccctacccagaagctgttcctgaaaagaaacaacgtgtccgcgcccgatggcccatcagacccgtctatttctgtgtccagcgagcagtctggagctcagcagccccccgccttgcaggtggagaggatcgttgataagcgtaagaataagaaaggtaagacagagtatctcgtacggtggaaggggtatgactccgaagacgacacctgggagccagagcaacacctagttaactgtgaagaatatatccacgattttaacaggcggcacactgagaagcagaaggagagcactctgacgagaactaatagaaccagtccaaacaacgcacgcaagcaaatctctcgcagcacgaattcaaattttagcaaaacaagccccaaggcactagttatcggaaaagatcacgaaagcaagaatagccaactctttgcagcatctcagaagttcagaaaaaacacagctccaagtctctcgtctagaaagaatatggacctggcaaagtctggaataaagattttggtccctaagagccctgtcaaatcccgcacagctgttgatgggtttcaatccgaaagtccagaaaagctggatcccgtggagcagggccaggaagatactgtggcaccagaggtagccgcagaaaagcctgttggagccctgctgggccccggcgcagaacgcgcacggatgggctctcgcccaagaattcaccccctggtaccacaggtccccgggccagtaaccgcggctatggccaccggtctggcagtcaatgggaaagggaccagcccgttcatggatgcactaactgctaacggtaccaccaatatccagacctccgtgactggcgtcaccgccagcaaaagaaagttcatcgacgataggcgcgaccagcccttcgataagaggctacgtttttccgtcaggcaaacagagtcagcatacaggtacagagatatcgtggttaggaagcaggatggcttcactcacattctcttaagcactaaaagtagtgagaacaattctctcaaccctgaagtgatgagggaagtgcagtcagcactgagcacagctgctgcggatgattctaagctcgttctgctcagtgcagttgggtccgtgttttgttgcgggctggacttcatatatttcatccgccgtcttaccgatgaccggaaacgcgagtccactaagatggccgaggccatcaggaatttcgtgaatacatttattcagtttaaaaagcctattatcgtggctgtgaacgggcctgctattggcttgggggccagtattctgcccttgtgcgacgtggtgtgggccaacgagaaggcctggttccagactccatacaccaccttcgggcagtcaccggacggctgctcaaccgtaatgttcccaaagattatgggaggggcctccgccaatgagatgttactctccggtcgcaagctgaccgcccaggaggcctgcggcaaggggctagtcagccaggttttttggcccggaacctttacccaggaagtcatggttcgcattaaggaactcgcctcctgtaatccggtggtgcttgaggagagtaaggccctggttagatgcaacatgaagatggagttagagcaggccaacgaaagagagtgcgaggtcctcaagaagatctggggttctgctcaaggaatggactctatgctcaagtacttacaaaggaaaatcgacgagttctag

SEQ ID NO: 182940 - DNA, 1239 bp, Artificial Sequence
  Description of Artificial Sequence: Synthetic coding sequence
atggacctggccaagagcggcatcaagatcctggtgcccaagagccccgtcaaaagcaggaccgccgttgacggctttcagtcggagagcccagagaaacttgaccccgtggagcaaggccaggaggacactgtcgcacccgaagtggcagctgaaaaaccggtgggagcacttcttggccctggtgcagaacgggctaggatgggcagccgccctaggatccacccgttagttccccaggtgcccggccctgttacagctgcgatggctactggattggcggtgaatgggaaaggcacttcccccttcatggatgcactgaccgctaatggtacgacgaacatccaaacctctgtgacaggtgtcaccgccagtaagcgaaaattcatcgacgacagacgtgatcagccgtttgataagaggctcagattttctgtgcggcagactgagtctgcttatcgctaccgtgacattgtcgtacggaagcaggacggatttacacacatcctgctgtctaccaaatcttctgagaacaatagcctcaatcctgaagtgatgcgagaagtgcaaagcgctctctctaccgccgccgctgatgattctaaactggtgctgctgagcgcagtgggatccgtcttctgctgcgggctggatttcatctattttatacgccggctgaccgacgataggaaacgggagagtacaaaaatggctgaggcgattagaaattttgtcaacacgtttattcagttcaagaagccaatcatcgttgcggtgaacgggccggccatcgggctcggcgcaagcatccttcctctttgcgacgtcgtctgggcaaatgaaaaagcatggttccagacaccatatactacattcgggcagtctcccgacggctgctccacagtcatgttcccaaaaattatgggaggagccagtgctaatgagatgctcctttcaggccggaagctgacagcacaagaggcatgtggcaaaggcctggtgtcccaggtgttttggccaggcacctttacccaggaagttatggtgagaataaaagaacttgcgtcttgtaaccccgtggtgctcgaggagtccaaggccctggtgcggtgcaacatgaagatggagctggagcaggctaatgagagagaatgcgaagtactaaaaaagatctggggctccgcccagggaatggactctatgctgaaatatctgcagcggaagatcgacgaattctag

SEQ ID NO: 182941 - DNA, 1635 bp, Artificial Sequence
  Description of Artificial Sequence: Synthetic coding sequence
atggccagcgaggagctgtacgaggtggagcggatcgtggacaagaggaagaataaaaagggtaaaactgagtatcttgtccgctggaagggttacgactcagaggatgacacatgggagcccgagcagcacttggtaaattgtgaagaatacatccacgacttcaaccggcgccataccgagaaacagaaggagagcacactgacacggacaaacaggacttccccaaacaacgccagaaaacaaatcagtaggtcgacaaactctaacttttcaaagacatcacccaaggcacttgtgatcggcaaggaccatgagtctaaaaattctcagctgtttgccgctagccagaaatttcgtaaaaatacggcaccatcgctttcttctaggaaaaacatggatttagcgaagtccggcataaagattctggtccccaagtcccccgtgaaatcccgtactgcggtggacggattccaatcagagtctcccgaaaaactcgacccagttgagcaaggccaggaggacactgtggcccccgaggtagccgctgagaagcccgtgggcgcactccttgggccaggcgcagagagagctaggatggggtcaagacctagaatacacccactcgtgccacaggtgcctggaccagttacagcggctatggcaaccggtctggccgttaatggtaagggcacctccccgttcatggacgcgttaacggcgaacggcacaacaaatattcagaccagtgtgaccggggtaaccgcctccaagcggaaattcatcgacgatcgacgtgaccaaccgtttgacaagaggctccgcttctcggtgaggcagactgagagcgcctacaggtaccgggatatcgtggtgagaaaacaagatggtttcactcacatactgctgagtacaaaatcaagtgagaataattctctgaatccagaggttatgcgcgaagtgcaaagtgctctgagcaccgcggccgccgatgattccaaactagttctgctaagcgcagtgggatctgtgttctgctgtggactcgacttcatctacttcatcagacgattaaccgatgatagaaaacgcgagagtactaagatggctgaagctattaggaatttcgtcaacaccttcatccagtttaaaaagcccataatcgtggccgttaatgggcccgccattggattgggcgcttcaatcctaccgctctgtgacgtggtttgggcaaacgagaaggcttggtttcagaccccatacacgacatttggacagtctcctgacgggtgctctaccgttatgttcccaaagattatgggcggcgcctcggccaacgaaatgttgctctctggccgaaagctgacggcccaggaggcttgcggcaagggcttagttagccaggtgttttggcccggcactttcacccaggaggtgatggttaggatcaaggaattagcctcgtgcaaccctgtagtacttgaagagtccaaggcattggttcggtgcaacatgaaaatggagcttgagcaagccaatgagcgggagtgtgaggtcttaaaaaagatatggggttctgcacaagggatggattccatgctgaagtacctgcaacggaagattgacgagttttag

SEQ ID NO: 182942 - DNA, 1239 bp, Artificial Sequence
  Description of Artificial Sequence: Synthetic coding sequence
atggacctggccaagagcggcatcaagatcctggtgcccaagagccccgtgaagtcgcggaccgcagtagatggtttccagagtgaatcaccagagaaattggacccagtcgagcaaggtcaagaggacactgtggctcccgaggttgcggctgagaagccagttggcgcccttctggggccaggtgctgaacgggctcgcatgggctcgagacctaggatccaccccctagttccgcaggtccctggcccagtcacggcggccatggccaccgggttggcggtcaatggaaagggcacctccccctttatggatgcactcacggcgaacggtaccacgaatattcaaacgtccgttacaggggtgaccgcttccaaaagaaaattcatcgacgaccggagggatcaaccattcgataaacgcctgagatttagcgttcgccagaccgaatcagcttatcggtatagggatattgtcgtgcggaagcaggatggcttcacgcacatcctgctgtcaacgaaaagtagcgagaacaattctctgaatccggaagtcatgcgcgaagtgcagtccgcactgagcaccgcagccgccgatgactcaaagctggtcctgctgtcagctgtgggctcagttttttgttgcggtctggactttatttacttcatcaggagactcaccgacgacaggaagagggagtctaccaaaatggccgaggccatcaggaatttcgtcaacacgttcatccagtttaagaagcccattattgttgccgtgaacgggcccgctattgggctcggagcatctatcttaccactgtgcgacgtagtttgggctaatgagaaggcgtggttccaaacaccttacactaccttcggtcagtcacccgacgggtgttccaccgtaatgttccctaagattatgggcggcgctagcgcgaatgaaatgctgttgtccggtaggaaactcactgcgcaggaagcctgcggtaaaggcctggtcagccaggtcttctggcctggcacctttacccaggaagtgatggtgaggatcaaggagcttgcttcctgtaaccctgtggtactcgaagagtcgaaagcgctggtccggtgtaacatgaaaatggagctggaacaggcgaacgagcgtgagtgtgaggtgttgaaaaagatttggggatctgctcagggtatggactcaatgctgaagtatctgcagcggaagattgatgagttctag

SEQ ID NO: 182943 - DNA, 1665 bp, Artificial Sequence
  Description of Artificial Sequence: Synthetic coding sequence
atggccagccaggagttcgaggtggaggccatcgtggacaagcggcaggacaaaaatggcaatacacaatatctggtacgttggaagggttatgataaacaagacgatacgtgggagcccgaacaacacttgatgaactgcgagaagtgtgtccatgactttaacaggagacagaccgagaagcaaaaaaaacttacctggaccactacttcaagaatcttttccaacaatgctaggagaaggacatcacgaagtaccaaagccaactactccaagaattccccaaaaacaccggttacggataagcaccacagatccaaaaatcgaaaactgttcgctgctagtaagaatgtgagacggaaggctgcgtctatattaagcgacacgaaaaacatggagatcattaatagcacaatagagacgctcgcaccagatagcccttttgaccacaagaccgttagcggattccaaaagctggaaaaactcgaccccatcgccgctgaccagcaggatacggtggttttcaaggttacggaaggcaaattactccgcgatcccctctcaaggccaggcgccgaacagaccggaatccagaacaagacgcagatccaccccctcatgtctcagatgtccggctccgttaccgccagcatggctaccgggtcagctacccgcaagggaattgtagtcctgattgacccactggcggcaaatggcacaactgatatgcacacctcagtgcctcgagtgaaaggcggacagcgcaatatcacggatgactctagagatcaaccatttatcaaaaaaatgcacttcactatccgtctgacggagtcagccagtacctaccgagatatcgtagtgaaaaaagaagacgggttcactcaaattgtgctctcaactcggagcaccgagaaaaacgcgctgaatacggaggtcattaaggagatcgtgaatgctttgaattctgccgctgctgatgatagcaaactagttctctttagcgctgcagggtcagttttctgctgtggcctagattttggctatttcgtcaaacatctgcggaacaaccgaaatactgcatctctagagatggtggataccatcaaaaattttgtgaacacattcattcagttcaagaaaccgatcgttgtctccgtgaatgggcctgctatcggcttgggggcctcaattctccctctctgtgatttagtgtgggcaaatgaaaaagcatggttccaaactccctacacaactttcgggcagtctccagacgggtgctcatctatcacctttccgaagatgatggggaaggccagtgcgaatgaaatgctgatagccggccgcaaactcaccgccagagaggcatgcgcgaaggggttggtcagtcaagtgttcctgacagggacattcacccaggaggtgatgatccaaattaaggagttagcctcttacaatccaattgttctggaagagtgtaaggcccttgtgcggtgtaatatcaagctggaactcgagcaagctaatgagcgtgaatgcgaggtgttgaggaaaatctggtcatccgcccaaggaatagagagcatgctgaagattccgttgttgggctataaggctgcctttccaccacggaaaactcagaatgatcaacgttggtgcccttag

SEQ ID NO: 182944 - DNA, 1623 bp, Artificial Sequence
  Description of Artificial Sequence: Synthetic coding sequence
atggccagccaggagttcgaggtggaggccatcgtggacaagcggcaagataagaatgggaacacacagtatctcgtgaggtggaagggatacgacaaacaggatgatacttgggaacccgaacagcacctgatgaattgtgagaagtgtgtgcacgactttaatcggcgccagaccgagaaacagaagaaattgacctggactaccacatctaggatattttctaacaatgccaggcggaggacatcgcgcagcaccaaggccaattatagtaaaaacagtcccaaaacaccagttacagataaacaccatagatctaaaaaccgcaagttgtttgctgcttccaagaatgtacgcagaaaggctgcaagcatactttccgacacaaagaatatggagattataaattctactattgagacactggcaccggatagccctttcgaccataagactgtctcgggtttccaaaaactagagaagctggaccccattgctgcagatcagcaggatacagtggttttcaaggtgaccgagggaaaattgctgcgtgaccctttaagccggccaggtgcagaacaaaccggaatccagaataaaactcagatccaccctctgatgagccagatgtcggggtctgtgaccgcctctatggccacggggtcagctactcggaagggcattgtcgtgctcatcgacccccttgccgcgaacgggaccacagacatgcacacctctgtaccccgtgtcaaaggaggccaacgtaatattacagatgattcgcgggatcagccattcattaagaagatgcatttcacaatacgtctcacggagtccgcaagtacctatcgtgatattgtggtgaagaaggaggacggattcacacagatagtgctttcaacccgcagtactgagaagaatgctttgaacactgaagtaatcaaggaaatagttaacgcactgaacagcgccgccgcagatgactccaaactggtgcttttcagtgcggccggctccgtcttttgttgcggactcgatttcgggtatttcgtgaaacacctgcgaaataaccgcaataccgccagcctggagatggtggataccatcaaaaattttgtgaacacctttattcagtttaaaaaaccaatcgttgtgtctgtgaatggtccagccattggcctgggagcttctatactccccctctgcgacctggtctgggcaaatgaaaaagcatggttccagaccccatatacaacgtttggacaatcccctgacggctgttcttctatcactttcccaaagatgatgggcaaggctagcgccaatgaaatgctgatagcaggccggaaactgacagccagggaggcttgtgcaaaaggtctggtaagccaggtattcttgaccggaactttcacccaggaggtgatgatccagattaaggaactagcaagctataaccccattgtacttgaggagtgcaaagcattagtaagatgtaatatcaagttagagctggagcaggctaatgaaagggagtgcgaggtgctgaggaagatttggtctagtgcgcagggaattgaaagcatgcttaaatacgtggaaaataagattgatgagttctag

SEQ ID NO: 182945 - DNA, 1170 bp, Artificial Sequence
  Description of Artificial Sequence: Synthetic coding sequence
atgggcaagatggccgccgccgtgggcagcgtggccaccctggccaccgagcctggagaagacgcctttcggaaactttttagattctataggcagtcaagacccgggactgcagatctagaaggagttatcgacttttctgcagcccacgcagcaagaggtaagggtccaggcgcacagaaggtcatcaagagccagcttaatgtgagtagcgttagtgaacagaacgcttaccgggccggtttacaacccgttagcaaatggcaagcgtatgggcttaagggatacccaggttttatcttcatacctaatccgtttcttcccggttaccagtggcattgggtgaagcaatgtctaaagctctacagtcaaaaaccaaacgtctgcaacttggacaagcacatgagcaaggaagagactcaagatctgtgggagcagtcaaaagaattcctaaggtataaagaggctaccaaaagaagacctcgtagcctgctggaaaaattaagatgggtgactgtcggataccactataactgggattctaaaaagtactctgcggaccattacaccccattcccgagcgatctcggctttttgtccgaacaggtggccgcagcttgtggattcgaggacttcagagccgaggccggaatactcaattattaccggctggactccacactgggcatacatgtggaccgtagtgaactcgatcactccaagcctcttctctcgttctctttcggacaaagtgctatttttttgctaggcgggctacagcgcgatgaggcacccacagccatgtttatgcatagtggggacattatgattatgtcaggatttagccggctgttaaaccacgccgtgcctagagtgctcccaaatccagagggagagggacttccccattgcctggaagcacccctccctgcagttttaccaagagactctatggtggaaccgtgtagtatggaagattggcaggtgtgcgcttcctacctgaaaacggctagggtgaatatgaccgtcagacaggttcttgctactgaccagaatttccctttggagcccattgaggacgagaaaagagatatctccactgaggggttttgccacctggacgaccagaactctgaggtcaagagggccaggattaatcctgactcctag

SEQ ID NO: 182946 - DNA, 921 bp, Artificial Sequence
  Description of Artificial Sequence: Synthetic coding sequence
atgcggagcgccgccgtgctggccctgctgctgtgcgccggccaggtcactgcccttcccgtgaatagcccaatgaacaagggagacacagaggtgatgaaatgtatcgttgaagtcatatccgacacactgtcaaagccatctccgatgcccgtgagccaggaatgcttcgaaactttgcggggcgatgagcgtatactcagcatcctaaggcatcagaacctgctgaaggaacttcaggatttggcactgcagggggctaaggaaagggcccatcagcaaaagaagcactctgggttcgaggatgaactgagcgaggtgctggaaaatcagtcttcgcaggcggaactcaagggaaggagcgaagccctcgccgtggatggggccggcaagccaggcgccgaggaggctcaagaccccgagggaaagggcgagcaagaacacagccagcagaaggaggaagaggaggagatggccgtggtccctcaaggattgttcaggggcggcaagagtggggagcttgagcaagaggaggagcgtctcagcaaggagtgggaagactccaagcgctggtctaagatggatcagcttgccaaggagcttacagcagagaagagactcgaaggccaagaagaggaggaagacaatagggattctagcatgaagttatcgtttagagcccgtgcttatggatttcgcggcccgggaccccagttgaggaggggctggcggccttctagccgagaggatagccttgaagcgggactgcccttgcaggtaaggggatatccagaggagaagaaggaggaagagggaagcgccaaccggagacctgaggaccaggagctcgaatcactgtcagcaattgaggccgagcttgaaaaggtcgcccatcaactccaagccctgagacgggggtag

SEQ ID NO: 182947 - DNA, 2034 bp, Artificial Sequence
  Description of Artificial Sequence: Synthetic coding sequence
atgcagcccaccctgctgctgagcctgctgggcgccgtgggcctggcggccgttaatagcatgccagtggataaccggaaccataacgagggtatggtaactagatgtattattgaagtactgtccaatgccctgtctaagtcgagcgctccccctatcacccctgaatgcaggcaggtgcttaagacctcacgcaaggatgttaaggacaaagagacaacagaaaacgagaacaccaagtttgaggtgagactgctacgcgaccctgccgacgcctctgaagcccacgaaagctcatcgcgcggagaagcaggtgcacctggggaggaggatattcaaggccccaccaaagctgatactgaaaagtgggccgagggaggcggtcacagccgagagagagccgacgagccgcagtggtcactgtatccatctgactctcaagtgagcgaagaggtgaagacaaggcactcggagaaatcacagagggaagatgaggaagaagaagagggagagaactatcaaaagggagaaaggggagaagacagctctgaggagaagcatctggaagaacctggggaaacccagaatgcctttctcaatgagagaaagcaggccagcgccatcaaaaaagaggagctagtagcgaggtcagagacgcacgccgcaggccattctcaggaaaagacacatagccgcgagaaatccagccaagaatctggcgaagagactggaagtcaggaaaatcacccccaagaatcaaaggggcagccccgctcccaagaggagagtgaggaaggcgaagaagacgccaccagcgaggtggataaacggcgcacaagacccagacatcatcatggaagaagtcgccccgataggtccagtcaagggggctcacttccctccgaggaaaagggccacccacaggaggagagcgaggaatctaatgtgagtatggcttcccttggcgaaaagagagatcaccatagcactcattatagagcctccgaagaggaacccgagtacggggaagaaatcaagggataccccggagtgcaagcgcccgaggatctcgaatgggaacgataccgtggaagggggtcagaagaatatagagctcccaggcctcagtccgaggaaagctgggacgaggaggataagagaaattacccctctctggagttagataaaatggcccacggatacggggaggagtcggaggaagagcgaggcctggaaccaggtaagggcagacaccaccgtggacgaggtggcgagcccagagcatatttcatgagcgacacaagagaagaaaaaaggttcctgggggaaggtcatcacagagtgcaggagaaccagatggataaggccaggcgacatccacagggcgcatggaaagaacttgataggaattacctgaattatggagaggaaggggcccccggcaaatggcaacaacagggcgacctccaagatacaaaggaaaatcgagaggaggcgcgttttcaggataaacaatactcctctcaccacaccgcagagaaaaggaaacggctgggggagctttttaatccctattacgaccccttgcagtggaaaagctctcacttcgaacggcgggacaatatgaacgataatttcttggaaggcgaagaggaaaacgagttgaccctcaatgaaaagaatttttttcccgaatacaattacgactggtgggagaagaagcctttttcggaagatgtgaactgggggtatgagaagagaaatctcgcaagagttcccaaactggatcttaagcgccagtatgaccgagtggctcagctcgaccaactactgcactaccgcaagaaatcagcagagtttcctgatttttacgattcggaggaaccggtcagcacccatcaggaggcggagaacgaaaaggatcgggcggaccagactgttctaacagaagatgaaaaaaaggagctggaaaacttagcagcaatggacctcgagctgcagaaaattgctgaaaagttttctcagagagggtag

SEQ ID NO: 182948 - DNA, 870 bp, Artificial Sequence
  Description of Artificial Sequence: Synthetic coding sequence
atgcccgtggacaaccggaaccacaacgagggcatggtgacccggtgtataatagaagtgctgagtaacgctttgtccaagagcagcgcgccacctatcactccagagtgccgccaggtgctgaaaacatcacggaaggacgtcaaggataaagaaactactgagaatgaaaacaccaagtttgaggtgcggctgctgcgtgatcctgctgatgcatctgaagctcacgaaagctcctccagaggtgaggcaggggccccaggcgaggaagatatccaaggccctaccaaagccgacaccgagaagtgggcggagggcggtggtcacagcagagaaagagcggatgagccccagtggtctttatatccgagtgactctcaggtgagcgaggaggttaaaacgaggcatagtgagaagtcacagcgcgaggatgaagaagaagaagagggagagaactaccaaaagggggagcgtggggaggatagctcagaggagaagcacctagaggaacccggcgaaacgcagaatgcttttcttaacgagcggaaacaggcaagcgccatcaagaaagaagagctggtcgcgaggtctgaaacacacgctgccggacactctcaggagaagactcatagtagagaaaagtccagccaagagtccggagaagaaactggctctcaggaaaaccacccccaggagtctaagggacagccgcgctcccaggaagaaagcgaggagggtgaagaggatgcgacgtcagaggtagataaacggcgcacacgccctcgacatcaccacggccgatcccgtcccgatcgttcctcccagggcggcagcctccccagcgaggagaaagggcatccccaggaatag

SEQ ID NO: 182949 - DNA, 1806 bp, Artificial Sequence
  Description of Artificial Sequence: Synthetic coding sequence
atgcccgagcgggagctgtggcccgccggcaccggcagcgagcccgtaacacgagtaggtagctgtgatagtatgatgtctagtactagtaccaggagtggtagctccgacagttcatatgacttcctgtccaccgaagagaaggaatgtctgttgtttcttgaggaaaccattgggtcactcgataccgaggccgacagtgggctatccaccgacgagtccgaacctgctaccacaccgaggggttttcgtgccctaccaatcacccagcccactccccggggagggcccgaagagacgatcacccaacaggggagaactccccgaacggtaacagaatcaagctcatcgcacccgcctgaacctcagggactgggcttgcgctcaggctcatacagccttcctcgcaacatccatattgctcgctctcagaactttcggaagtcaactacccaggcatctagtcacaacccgggggagccaggcagactagcaccagagccagagaaggagcaggtatcccagtcttctcagccccgtcaagctcccgccagccctcaggaggcggctctggacctcgatgtggtgctgatacctcctcctgaagccttccgggatactcaacccgagcagtgtagggaggctagtctacccgagggacccggccagcaaggtcacacaccacagttacacacaccatcctcttctcaagagcgcgaacaaacaccgagtgaggcaatgtcacagaaggcaaaggagacagtgagcactcggtacactcagccacagccccctcctgcagggctccctcagaatgccagggctgaggatgcacctctgtccagcggtgaggacccaaactcgcgacttgcaccactgaccacccctaaacccagaaagttgcctccaaatattgttctcaagtcttcccgaagcagcttccattctgatccccagcattggctgtcccgacacacagaagcagctcctggggatagcggcctcatctcatgctcgctgcaggagcagaggaaggctcgcaaggaagcactggaaaagctgggcctcccacaggaccaggacgaacccggactgcatctgtcaaagcccactagctccatcagaccaaaggaaactagggcccaacatctcagccctgcccctggtctcgcccagccagccgctcccgcgcaggcgtccgccgccatccccgctgcagggaaagcactggcccaggcacccgccccagcccctggacctgcccaaggtccgctgccaatgaagagtcccgccccaggtaacgtagcagcctccaagtccatgcctatttctatcccgaaggcaccccgcgcaaacagcgccctcaccccccctaagcctgagagcggcttgacgctgcaggaatctaacaccccaggattaagacagatgaacttcaagtccaatacactggagcggtcaggtgtgggcttgagttcctaccttagcactgagaaagacgcgtctccaaagacttccactagcctcggtaagggatcatttttggacaaaatcagcccatctgtgcttcggaactctagacccaggccagcatctctcggcaccggaaaggatttcgcaggcattcaggtggggaagctggcggaccttgaacaggagcaatcctcgaagcgactgagttatcagggtcagtccagagacaagctgccacgcccaccttgtgtgtccgtgaaaataagtcctaagggcgttcccaacgagcaccgccgcgaagcgctcaagaaactaggactgctgaaagagtag

SEQ ID NO: 182950 - DNA, 1068 bp, Artificial Sequence
  Description of Artificial Sequence: Synthetic coding sequence
atgagccagaaggccaaggagaccgtgagcacccggtacacccagccccaacctcctccagccggcttgccccagaatgccagagccgaggatgcccctttgagcagcggtgaggacccaaactcccgacttgctccgttaactacgccgaagcctcggaagctgccgcccaatattgttctaaaaagcagcagatctagttttcacagcgacccacaacattggctatccagacacaccgaggcagcacctggcgatagcggactgatttcttgtagcctccaggagcaacgaaaagcaaggaaggaggccctcgagaagcttggcctgccgcaggatcaggacgaacctgggctacatctgtctaagcccacgtctagcatccggcccaaggaaacaagggctcagcatctcagcccggcacccgggctagcccagccagcagcccccgcacaggctagcgcagcgatccccgcagcggggaaggcgcttgctcaagccccggcaccagcccctggcccagcacagggcccgctgccaatgaagtcaccagctcccggcaatgtggcagcctctaagtcaatgccgatttccattcccaaggcaccacgagctaatagcgcgctgacacctccgaagcccgaaagcggactgaccctacaggagtctaatacacccggcctgcgtcagatgaatttcaagtccaacacattggagaggtccggcgtcgggttatcttcatatcttagcaccgagaaagacgcttcaccgaaaacctcaacaagcctgggaaaggggtctttcttggacaagatttctccctcggtgctgcggaattcgagacccagacctgcctccctagggaccgggaaagattttgccggaatccaagtcggcaagctggccgacctggagcaggagcagagctctaaacgcctgtcctatcagggacagtcccgggataaactcccccggcctccgtgcgtgagtgtgaagatttcacctaagggagtgccgaacgagcataggcgggaggccttaaaaaagctcggcctgctcaaggagtag

SEQ ID NO: 182951 - DNA, 1050 bp, Artificial Sequence
  Description of Artificial Sequence: Synthetic coding sequence
atggccggccccgccatccacaccgcccccatgctgttcctggtgttgctgctgcccctggaactgtctctagcgggtgcgctggccccaggcactccagcccggaacctccccgaaaatcacatcgatctacctgggccagccttgtggacaccacaagcttcccaccatcggcgccgcgggcctgggaagaaagagtggggtccaggcttaccttcccaggcccaggacggagcagtggtcacagctaccaggcaggctagcaggttgcccgaggccgaggggctgctgcctgaacagagccccgccggactcctgcaggacaaggatctcctcttgggcctcgccctcccctatcccgagaaggaaaaccgtccccctgggtgggaacgaacacgaaagcgatcaagggagcacaagagaagacgcgatagactgcgactacatcaaggcagagctctcgtcagaggcccctctagcctgatgaaaaaagcagagctgtccgaagcccaggtgctggacgctgccatggaagaaagttcaacttcattagcaccaaccatgttttttctcacaacttttgaggccgcgcccgccaccgaggaaagtctcatactacctgtgactagcctgcgccctcagcaagctcagcctagatcagatggggaggtgatgcctaccctggacatggcactatttgactggacagactatgaggacctcaaaccagatggatggccctctgctaaaaaaaaggagaagcatcgcggaaaacttagctcagacggaaacgagacttcccccgccgagggagagccttgtgaccaccaccaagattgcctgcctggcacctgttgtgacctcagagagcacctctgcacacctcataataggggtctgaacaacaaatgtttcgacgattgtatgtgtgtggaaggtcttaggtgctacgccaaatttcacaggaatcgtcgcgtgacccggcggaaaggtcgatgtgtcgaacctgagactgccaacggagatcagggaagcttcatcaatgtttag

SEQ ID NO: 182952 - DNA, 477 bp, Artificial Sequence
  Description of Artificial Sequence: Synthetic coding sequence
atgtgcttcagccgggccgacgccgccgacaactaccccttcggcacttgccagcaacgcaaactctttcctcactttcatccacctaatctgatcggcaacaagttcgtgcctctgcgcgggtctccacaccgaggtcccgggtgctactttagcgacgaaatgacaccccacgccggcagatatcaaaaggtttccccccaacaggaaaagcacaagcaaaacttcgctccgttcaacgtgctcgtcccacggtttaaaaattacccgaaggacacatactatccctcccccggggcctacaatcccgagaaaaaaccaccacccaaaattgcctggcctatgaaattcggaagccctgactgggcacaggttccttgtcttcagaagcggaccctaaaggccgaactgagcacagataaagactttcgaaaacacaggaacagagttgcttacctgtctctatattacaattag

SEQ ID NO: 182953 - DNA, 576 bp, Artificial Sequence
  Description of Artificial Sequence: Synthetic coding sequence
atgtgcttcagccgggccgacgccgccgacaactaccccttcggcacatgccagcagcggaagctgttcccccatttccatccaccaaatttaattggaaacaagttcgtccctctcagggggagccctcatcgcgggccaggatgctatttttctgacggttatggcttggcctatgacttgtccaagatccccacgagtatcaagggatataccctgggagcccggaccgcagttagattcaaacccatccagaaggaaatgacccctcacgccggccgatatcagaaagtcagtccacagcaagaaaaacataaacagaattttgcacccttcaacgtattagtccctagattcaaaaactaccccaaagatacctattacccatctccaggagcctacaatccggaaaaaaaacctccccctaaaattgcttggccaatgaaatttggctcgcccgactgggcccaggttccttgtctgcagaaaagaacgcttaaggccgagctgtcgacagataaggacttccgaaaacaccggaatcgggtcgcctacctgagcctttattataattag

SEQ ID NO: 182954 - DNA, 2055 bp, Artificial Sequence
  Description of Artificial Sequence: Synthetic coding sequence
atgtgggtgctgctgcggagcggctaccccctgcggatcctgctgcccctgcgcggggagtggatgggccggaggggcctgccgagaaacttggccccagggcctccccgaagaaggtatcggaaggagaccctacaggctctagacatgcctgtccttccagtgacagccaccgagatccgtcagtatttacgtggacatggaatccccttccaagacggccattcatgcctcagggcactgtcacccttcgccgagagctcccagttgaaaggccaaaccggcgtgaccacctccttttctttgttcattgataagactaccggtcatttcctttgtatgaccagtctcgctgagggatcctgggaggacttccaagccagtgtggaaggcagaggggacggtgctagggaaggtttcctgctgtctaaggctcccgagtttgaagattcagaagaggtccgaagaatttggaatcgggctattcctctctgggagttacctgaccaggaggaagttcagctcgccgacactatgttcggactaaccaaagttaccgatgacaccctcaaacgctttagcgttcggtacttacggcctgcccgatccctagtctttccatggtttagcccgggaggctctggactgcgcggtctgaaactgcttgaggctaaatgtcaaggggatggcgtgtcttatgaggagaccacaatcccaaggcctagtgcataccacaaccttttcggcctgccccttatatcccgccgagacgccgaagttgtgctcacatcccgcgagctggactctctggctctgaaccagagcacagggcttccgaccctcacactgccccgcgggacaacgtgcctgccgccggccctgctcccatacctcgagcagtttcgccggatcgtgttttggctcggcgatgaccttcgcagttgggaagccgcgaagctatttgcccgaaaactaaatccaaaacgatgcttcctagtcagacccggggaccaacagcccagacctttggaggctctcaatgggggtttcaacctctcccggatcctgcgcacagcacttccggcctggcataaaagtatcgtatcttttaggcagctaagagaggaagtgctcggggagctatctaatgtggaacaggctgctgggctccggtggagcagattccctgacctgaataggattctaaagggccatcggaagggtgagctaacagtattcacagggccaactgggtctggcaaaacaacatttatttcggagtatgccctggacctctgttctcagggtgtaaataccttgtggggctcctttgagatttcaaacgtgaggttagctagagtcatgctcacccagtttgccgagggacggctcgaggatcagttagataaatatgaccattgggctgaccggttcgaggatcttccactctactttatgactttccacggccagcagagtatccgaactgtgatcgacacgatgcagcacgcagtctacgtctacgacatctgccacgtgattattgataacctacaattcatgatggggcacgagcagctatccacagaccggattgctgctcaagattacattattggagtcttcaggaaattcgctacagacaacaactgtcacgtgaccctggtaattcaccctaggaaagaggatgacgacaaagagttacagacggcaagcatctttgggtcagccaaggcaagtcaggaagccgacaacgtgctgattctccaggaccgaaagctggtaaccggtcccggcaagaggtatctacaagtgagcaagaaccgctttgacggcgacgtgggggtgtttcccctcgaattcaataagaacagtttgacgttttccatcccacctaagaacaaggcacggctgaagaaaataaaagacgacactggcccagtcgcaaaaaaaccttcaagcggaaaaaaaggcgctacgacccaaaatagtgaaatttgctccgggcaggcacctacccccgaccaacccgatacctctaagagaagtaaatag

SEQ ID NO: 182955 - DNA, 1749 bp, Artificial Sequence
  Description of Artificial Sequence: Synthetic coding sequence
atgtgggtgctgctgcggagcggctaccccctgcggatcctgctgccactgcggggcgaatggatgggacgtcgcgggctgcctcggaatcttgctccagggcctccacgtaggcgctaccgaaaagagaccctccaggcgctcgatatgcccgtgctccctgtcactgccactgagatcagacaatacttacgtggtcatggtattccgtttcaggacgggcacagttgcctgcgggccctctctccgtttgcagaatcatcccagttaaaaggacaaacaggggtgacaacaagtttttccctgttcattgataagacgacgggacatttcttatgtatgaccagcttggctgaaggcagctgggaagacttccaagcatcagtagaagggaggggtgacggcgccagggaaggcttcctgttgagtaaagcccccgagttcgaagattccgaggaggttcggagaatatggaatagagctattccactttgggagctgccggatcaggaggaagtccaattggcagacacgatgttcggtctgacaaaggtgacagacgatacgctgaagaggttttctgtccgatatttaaggcctgcaagaagtttagttttcccctggttcagccccggcggcagcggcctgcgtggcttaaagctgctggaagcgaagtgtcagggggacggcgtttcttatgaggaaacaactatcccccgcccttccgcctatcacaatttattcggcctgccactcataagtaggcgggatgcagaggtggtgctgacatcccgagagctggactccctggctcttaatcaatccaccgggcttcctactcttaccctgcctagggggacgacctgccttccgcctgcactgttaccctacttggagcagttccgtcggatcgtgttttggctcggagacgacctccggtcatgggaagctgccaaattgtttgcacgaaagctgaatcctaagcgatgcttcctcgtgaggccaggtgatcagcagcccagacctttggaggcactgaatggaggcttcaacctgtcccgcatacttcgcactgccttgcctgcatggcacaaaagcattgtgtcatttaggcagctgcgagaggaggtgctcggggaactgagcaacgtcgagcaggccgccggcctcaggtggagtagatttcctgatcttaataggatactgaaaggacaccgaaaaggggaactcaccgtcttcaccggccctactggtagcggcaaaactaccttcatctctgaatatgcactggatctctgtagccagggagtcaacactctttgggggtctttcgaaatatcaaacgtaaggcttgctcgggtgatgttaactcagtttgcggaggggaggttggaagaccaattggacaagtacgatcactgggctgaccggttcgaggatctgcctctgtacttcatgacgttccatggccagcagtccatcagaacagtgatcgataccatgcaacacgccgtgtacgtctacgatatctgccacgtgatcatcgataatctacagtttatgatgggacatgaacaactttccaccgaccggatcgctgctcaggactatatcattggagtgtttcggaagtttgcaacagacaataattgtcatgttacactcgtgattcacccccggaaggaggacgatgataaggaactgcagacagcaagcatcttcggctcggccaaggtgagtggtttgtag

SEQ ID NO: 182956 - DNA, 1029 bp, Artificial Sequence
  Description of Artificial Sequence: Synthetic coding sequence
atgcccttcctgctgggcctgcggcaggacaaggaggcctgcgtgggaactaataatcaatcatatatttgcgatactggtcattgctgcgggcaaagccagtgctgcaactactactacgaattatggtggttttggttggtgtggacgattattatcatactttcctgttgttgcgtttgtcaccataggcgcgctaagcaccgcctgcaagcccagcagcgccagcatgagatcaacctgatagcctacagggaagctcacaactacagtgcgctacctttttattttcgtttcctgcccaattacctccttcctccttatgaagaagtggtgaaccgcccccccacacctccacctccttactctgcctttcagcttcagcaacagcagctgctgccaccgcagtgtgggcccgccggagggtcacccccaggtatcgatccaacccgcggctcacagggggcacagtctagccccttatctgaaccctcacggagctctacgcgacctccatccattgccgacccagacccctcagacctccctgtagatagagcagcaacgaaggctcctggcatggagcccagtggcagcgtggctgggctgggggagttggaccctggagcctttctggacaaagatgccgagtgccgggaagaattgcttaaggatgatagttcagagcatggcgctccagacagcaaggagaagactccagggcgacacagaagatttacaggcgactctggaatcgaagtttgcgtttgtaacagaggccaccacgatgacgacctgaaggagttcaataccctcatagacgacgcactggatggtccacttgacttttgtgactcgtgccatgttcgacccccaggtgatgaagaggagggcctgtgccagagcagcgaggagcaggccagggagccaggccacccacatcttcctagaccgccggcctgtctcctgttgaacactattaatgaacaggatagtccaaatagccagtcaagctccagcccatcctag

SEQ ID NO: 182957 - DNA, 1092 bp, Artificial Sequence
  Description of Artificial Sequence: Synthetic coding sequence
atggagcggcggcggctgctgggcggcatggccctgctgctgctgcaggccctgccctcccctctttctgctagggctgaacccccgcaggacaaagaagcatgcgtgggtaccaataatcaatcttatatctgtgacaccgggcattgctgtggccagagccagtgctgcaactattattacgagctctggtggttctggcttgtttggaccattatcataattttatcttgttgctgcgtatgccaccaccgccgggcaaagcaccggctgcaagcccaacaaaggcagcacgagatcaatcttatcgcatacagggaagctcataactattcagcactgcctttttactttcggttccttcctaactatctgcttcccccatatgaagaagtggttaatcggcccccaacccctcctcccccatacagtgccttccagctccagcagcagcagcttctgcctccacagtgcggccctgccggtggatcgccaccaggtatcgaccccacacgtggtagccaaggtgcacaatcctcccccctgtccgagccgagcagaagttccacccgcccaccctccatcgccgatccggatcctagtgacctgcctgttgatcgagcggctaccaaagcccctggtatggagcccagcggtagtgtagccggactcggggagttagatcccggggcctttctggataaggacgcagaatgcagagaagagctactgaaggatgactcgtcagagcatggcgcaccggacagtaaagagaagactcctggcaggcataggagattcacaggcgattccgggatcgaggtctgtgtgtgcaatcgggggcaccatgacgacgatctcaaggaattcaacactttgatcgatgacgctctggacggtcccctcgatttttgcgactcctgccacgtcagacctcccggcgatgaagaggagggtctgtgccagtcgagtgaggagcaggctagagagccgggacacccccacctcccgcgccccccggcctgtctgttgctcaacactatcaatgaacaggacagtccaaatagtcagtcctcgtccagcccttcttag

SEQ ID NO: 182958 - DNA, 1056 bp, Artificial Sequence
  Description of Artificial Sequence: Synthetic coding sequence
atggccaccgacgtgcagctggccgactaccccctgatgagccccaaggcggagctaaagcttgaaaagaagagcggccggaagcctcgctccccaagggattcgggaccccagaaggagctggttatccccggcatcgttgacttcgaaaggatcagaagagccctcagaacacccaagccacaaacacctgggacgtattgctttggacggctgtcccatcactccttctttagcagacaccatcctcaccctcagcatgtgacccacatacaggatctcactggtaagccagtctgtgtggtgcgcgactttccggctccgctgccagagtcaacagtgttcagcggttgtcaaatgggaatccccaccatttcagtcccaatcggcgacccacagagcaacagaaatcctcaactaagtagcgaagcttggaaaaaagagcttaaggagctagcctctcgagtcgcgtttttaacaaaggaggacgagctcaagaagaaagagaaggagcaaaaggaggagcctctgcgagaacagggggccaaatatagcgcagaaacaggccggctgattcctgcttcgactcgcgcagtgggccggagaaggagtcatcaaggacagcaaagccagtcttcttcgcggcatgaaggtgttcaggcattcctgctccaggaccaggagctcctggttctggaactgctgtgtaggatcctcgagacagacctgctttcagccattcagttctggctgctctatgcaccccccaaagaaaaggacctggcacttggcctcctgcagactgccgtcgcccagctgctgccacaaccactagtcagcatccccactgaaaaactgctaagccagctgcctgaggtccacgaaccaccccaggagaagcaggaacccccgtgctcccaatccccgaagaagacaaaaatcagccctttcactaagtccgaaaaacccgagtacattggcgaagcgcaggttctgcaaatgcatagctcacagaacaccgagaaaaagacctccaagccacgcgctgagagctag

SEQ ID NO: 182959 - DNA, 321 bp, Artificial Sequence
  Description of Artificial Sequence: Synthetic coding sequence
cagtgcgccgagctgtggggcagcgtgcggaagaacagcgacaagttccttctgtctcgcaaccttcacccaagtaaggaggagtacagacagcaaataaaaactccaggcgaggagtggagacagattttggtgcattggagaagctcttccccaccggatgctttcaaacctgaacatagagaggaggatatagaagcggaaggccgcgagcttagggggcctaatacatgtacatgcctggcccaggagcagcctcagggatttagaggtgtctctgtgtcgaccaccttcactgccgtgcccgactctctgccatag

SEQ ID NO: 182960 - DNA, 753 bp, Artificial Sequence
  Description of Artificial Sequence: Synthetic coding sequence
atggccaccgacgtgcagctggccgactaccccctgatgagccccaaggctgaactgaagctggaaaagaagagtggccgaaaacccaggtctcctcgggactccgggccgcaaaaagaactggtcatacctgggatcgtggattttgagagaatccgccgtgccctcagaacccccaagccccagacacccggcacatattgttttgggcggttatctcatcactccttcttcagccgccatcacccccatcctcagcacgtaactcatatccaggatctcaccggaaagcccgtctgtgtggtccgggactttcccgcacctctcccggaatcaacagtatttagtgggtgtcaaatgggtatccccaccattagcgtgcccataggagatccccagagcaatcggaacccacagttgagctcagaggcttggaaaaaagaattgaaagaactggcaagtcgggtagcctttctcacaaaggaagacgagctgaaaaaaaaggaaaaagagcaaaaggaagagcccctgagggaacagggggccaaatactctgccgagacaggtcgcctcatacccgcttccacccgggccgtgggtcgaaggcggtcccaccagggccagcagagccagtcctcatccagacacgagggggtgcaggccttcctgctgcaggatcaagaactcctgaaaaaaacaagtctgtgggactcctgtagacagcaatggctctcttctttcccatccccttag

SEQ ID NO: 182961 - DNA, 951 bp, Artificial Sequence
  Description of Artificial Sequence: Synthetic coding sequence
agccccaaggccgagctgaagctggagaagaagagcggccggaagcctcgatcccctcgggactctggcccccagaaagagctggttatacccggcatagtcgactttgagcgcattcgccgagcccttcggacgcctaaaccacagacaccaggaacctattgtttcgggcggctgtctcaccactcattcttctcccgccaccatccacacccccaacatgtcacccatattcaagatctgacgggaaagcccgtgtgcgtggttcgggactttcctgccccgctccctgaatctaccgtcttctccgggtgccagatgggcataccgacaatttcagttcccattggggatccccagagcaaccgcaatccgcagctctcctctgcttggaagaaagagctcaaggagctggcctctagagttgcctttctcaccaaagaagacgaactcaaaaaaaaggaggatactacgtccctgaactggaattgtaagtccagacggcctcaagcccccggactgtccgggaccgatctgggcgctgccgaactcggaattaaaaaggagcagaaggaagagccactgagagagcagggtgccaagtactctgccgagaccggtcggctcattcctgcatctacacgagctgtggggcgtagacgttcacaccagggacagcagtcacagtcttcaagccggcacgagggcgtgcaggcctttctccttcaggatcaggaactcctgggtggattgacctcccccggcgcgcccgtgtccgacccaggtaaccggctggcaaagcggaaccctgttctggcggcactacgaagcgcccagggtaagaggccaaggagcggtacacccgctgattcctcaggcagcgctccctctcctgcccctagtctccatccatatagaaaagcaccaaaaccagcatcccggtctgcttag

SEQ ID NO: 182962 - DNA, 498 bp, Artificial Sequence
  Description of Artificial Sequence: Synthetic coding sequence
atgtacatcagccccaaggccgagctgaagctggagaagaagagcggccgcaaaccccggtcacctagagactctggacctcagaaggaactggtcattcccggaatcgtcgatttcgagcgtatcaggcgggccctgcggacccccaagcctcaaacccccggcacttactgctttggaaggttgtcccatcacagttttttctcacgacaccatccccatccccagcatgtgacgcatatccaggacttaactggtaagcctgtgtgtgttgttagggatttccccgcaccgctcccagagtcaaccgtcttctctggctgtcaaatgggtattccaaccattagcgtccctattggagaccctcagtcgaatcgcaacccacagttgtcctcagcctggaaaaaggagctgaaggaactcgcaagtcgcgtcgccttcctgacgaaagaagacgaactgaagaagaaggaagtcggcgccgagcaccgtagctag

SEQ ID NO: 182963 - DNA, 672 bp, Artificial Sequence
  Description of Artificial Sequence: Synthetic coding sequence
atgctgtgggtgcagcggaagcggcggcggaaggagaccagcgagtgtccctccgataaggacaaatctccagaaagtcataaggccaaaaatgaaagttggattaaatctcatttttcgagactgtcagaagagaagctggcacttgacaacaatgcctcagctagtgggaatgcgacccagaccgagagcggttcggaagaggtatccagtactgtgcacatcgaaactttcactacgagacatggggaggttggctcagccctacacagggaaagcttcaccagccggcagaagacatccggacccagtgtgatccaggagatccaccaggagtctggaaaggccccatccacagacgaggccacatgggccgctgtagcagcatgcactaaagaaattgacacgcaaggacggcacttggcacattctatgctacagcgggcgattgcgtatcagcactccggacacctagagagcaaggacatcaaccaggaagaactgcgggccctggaagaagtggaaatgaagcttcaaaagaacttccttacacagcgtgagaatacaatcgccggagctaaccatacccatactttctatgggcatagccaccactcccatcacgggcacccctcccaccagtcccattctttgcccaaccgccgccattag

SEQ ID NO: 182964 - DNA, 399 bp, Artificial Sequence
  Description of Artificial Sequence: Synthetic coding sequence
atgggccggacctggtgcggcatgtggcggcggcggcggcccggccgacgttctgcagttccacgctggccacatctctcgtcacagtcaggcgttgaaccccctgaccgctggaccggcacccctggttggccgtcccgcgaccaggaagcaccaggctcaatgatgccgccagccgcagcacaacctagtgcccatggggctctagtaccccccgccactgcacatgagccagtcgaccatccagctttgcactggttggcctgctgctgctgcttaagcctgcccgggcagttgcccctcgctatcagattgggatgggatctcgacctcgaggccggacccagctctggcaagctgtgcccccgcgcgcgtcgctggcaacccctgccatcctag

SEQ ID NO: 182965 - DNA, 537 bp, Artificial Sequence
  Description of Artificial Sequence: Synthetic coding sequence
atggccagcttcctggtgtggcccctgcggaccgccctgcggggcggtaaatcgtgggcgggcccaggagtaggctgtggcggcgacggagctcggggcggcggagagttgtctctgagtaacttggatctccctggcgctggagaggctggccttgaacatcaccccctgttagggcacctctttatcagtgctgttcctcgttggccgcacttaagcagccagtcaggggtcgagccacccgacaggtggaccggtacgcccggctggcctagcagagaccaggaggcgccaggttcaatgatgcctcctgcagccgcgcaaccgtccgcacatggcgcattagtgcctcctgccacagcccacgaaccagtggatcatccggccctccactggcttgcgtgctgttgctgcttaagcttgccaggccagctgcctcttgccattcgcctagggtgggacctggatttggaagctggacccagctcaggcaagctctgtccccgagctagacgctggcagcccctgccatcttag

SEQ ID NO: 182966 - DNA, 1350 bp, Artificial Sequence
  Description of Artificial Sequence: Synthetic coding sequence
atgtggaccgccctggtgctgatctggatcttcagcctgagcctgagcgaatcccatgccgctagtaatgatcctcgaaacttcgtgccgaataagatgtggaagggcctcgtaaagagaaacgcatctgtcgagacagtagacaacaaaacatctgaagatgtgaccatggctgcagcctcccctgtgacactgactaaaggcaccagcgctgcccatcttaattccatggaggtgaccacagaggatacatcacgaaccgacgtgtccgaacctgcgactagcggcggcgcagccgatggtgtgactagtatcgctcccaccgctgtagcgtcttcaactacagcagcttccataacgacagctgcatcgagcatgacggtggcctcaagcgcgccaactacagccgcctcctcaacaaccgtcgcaagtatcgctccaacaaccgctgccagcagcatgaccgccgcaagctctacacccatgactctggctctccccgcccctacatcgacttccacaggacggaccccgagtactaccgcaacggggcacccaagtctgtctaccgcattagcacaggtacctaagtcaagtgcactcccgcggaccgccaccctggctacgctggcaacccgggctcagactgttgcgaccactgcaaatacgtctagtcccatgagcacccgtcccagtccttccaaacatatgccgagtgatacagcagcctctcctgtccccccaatgcgtccacaggcccaaggacctatctcacaagtcagcgtggaccaacctgtggtcaacacaaccaataaatctacacccatgccaagtaataccactcctgaaccagctccaactccaactgtggtgacaaccacgaaggcccaggcaagggagcccactgcctctcctgtgcctgtgccccacacttcccccattcccgagatggaggcaatgtcccctaccacccagccatcacccatgccgtatacccaacgggccgccggccctggcacttctcaggcccccgagcaggttgagacggaggccacccctggaacggattccacaggacccacaccaaggagtagcggaggaactaaaatgcccgccaccgattcctgccagccatcaactcaggggcagtacatggtcgtcaccacagaaccgctcacacaagcagtggtggataagaccctcctccttgtagtgctcctgctcggagtgacgctttttatcaccgtgctagttctgtttgcacttcaggcgtatgaatcctacaaaaagaaggattatacgcaggtagactacctgatcaatggaatgtatgccgattctgagatgtag

SEQ ID NO: 182967 - DNA, 78 bp, Artificial Sequence
  Description of Artificial Sequence: Synthetic coding sequence
atgtggaccgccctggtgctgatctggatcttcagcctgagcctgagtgagagccacgcggcttctaacgatccatag

SEQ ID NO: 182968 - DNA, 3969 bp, Artificial Sequence
  Description of Artificial Sequence: Synthetic coding sequence
atgcccgtggtgtggcccaccctgctggacctgagccgggacgagtgtaaaaggatcttacgaaagttggagctggaagcctatgccggagttattagtgcattgcgtgcccagggcgacctcacaaaggagaaaaaggatctgctgggcgaactcagcaaggtactctctatcagcaccgagcgccatcgcgccgaggtcagacgtgcagttaacgacgagagactcaccacgatcgcacataacatgtctggtcccaacagctccagtgagtggtcgattgaaggacgacggctagtgcctttaatgcctaggcttgtgccccaaaccgccttcaccgtgaccgccaacgctgtggccaatgccgcaatccagcataatgctagtttacccgttcccgccgaaaccggctcaaaagaggtcgtttgttatagttacacgagcacgacgtcaacgccaacctcaacgccggtaccctccgggtctattgctactgtgaagtctccacggccagcctcaccagcctcaaatgtggttgtcctgccttcaggttctacagtttacgtcaagtccgtaagttgctcagacgaagacgaaaagcctcgtaaacgaagacgcacgaacagcagttcaagtagtccagttgtattgaaagaggtccctaaggcagtcgttcctgttagtaaaaccatcaccgtgccagtgtctggcagccctaaaatgagcaatattatgcagtcaatcgccaatagtctaccacctcacatgtcaccagttaagatcacattcacaaagcccagcacccagaccaccaacacgactactcaaaaagtgattatagtaacaacctcaccctcttccactttcgtgccgaatattctaagtaaatcccacaattacgctgcagtgaccaagctggtgccgacaagcgtaatcgcctctacaacacagaaaccccccgtggttatcaccgctagccagtcctctttggtgtcaaattcctctagtggaagctcttcttctacaccaagccccattcctaatacggtggcagttactgctgtggtctctagcactcccagcgtggtaatgagcacagtggcccagggcgttagtacttccgcgatcaaaatggcctcaactcggctgccgtcgccgaaaagcctggtctcagcaccaactcagatcctggcccagttcccaaagcaacaccagcaaagccccaagcagcaactgtaccaggtccaacagcagactcaacaacaggtagcgcaacccagccccgtcagccaccagcaacaacctcaacagagtcccctccctcctggaattaaacccaccatacagatcaagcaggaaagcggggtgaaaattattacccagcaggtgcagccaagcaagatcttaccaaaacccgttacagccaccctgcccacttccagcaacagccccattatggtcgtgagctccaatggggcgattatgacaactaagctggtgacgacccctacagggacccaggctacctatactagacctaccgtctctccttctatcggccgtatggcagctactcctggcgccgccacctatgtcaagactacttccggcagcatcatcacagtggtgccaaagtctctggcaaccttaggcgggaagattataagcagtaatattgtatcgggaacgactacaaaaattaccactatcccaatgacttccaagcctaacgtcattgtcgtgcagaaaactaccgggaaaggcacaaccatccaaggtcttcccggcaagaatgtggtcacaacgctcctaaacgcgggaggcgaaaagactattcaaacagtgcctaccggagcaaaacctgcgatcctgacggcaactagacctatcacaaaaatgatcgtaacacagccgaagggcatcggatctactgtccagcccgccgctaaaattataccaaccaaaatcgtgtacggccagcaggggaagacccaggtgttgattaaaccaaagccggtcacttttcaagccacagtggtgtctgagcaaaccaggcagcttgtcaccgaaaccctacagcaggccagcagggtggctgaggccgggaacagcagtattcaggaagggaaagaagagccacagaactacaccgactcttccagttccagtacagagtcctctcagagtagccaggactctcagccggttgtgcatgttattgcgtcaaggaggcaggactggtccgagcacgaaatcgccatggagaccagtcccacaattatttatcaggacgtgtcctctgagtctcaatcggcgacaagcacaataaaggctctgctcgagctgcagcagaccactgtcaaggaaaaactcgagtccaagcctcgtcaaccaaccatcgatttgtcccagatggcggtcccaatccagatgacccaggaaaagagacatagtccagagtccccttcaattgccgtggtcgaaagcgagctcgtggccgaatacatcactactgagcgtacagacgagggcacagaggtagcttttccacttcttgtgtcccatcgatcgcagcctcagcagccatcccagccacagcgaacacttttacaacatgttgctcagagccagacggctacacagacgtcggttgtggtgaagagtattcctgctagtagcccgggcgccatcacccatatcatgcagcaggccttaagctcccataccgcgtttaccaagcattctgaggaacttggcacagaggagggagaagtagaagagatggacaccctggatccgcagaccgggctcttctacaggagcgccttgacccagagccagagtgcgaaacagcagaagctcagtcagcctcccttggaacagacccagctgcaggtcaaaaccctccagtgctttcagactaagcagaagcagacaattcatctccaggctgaccagcttcaacataaactgccgcagatgcctcagctttctatacggcatcaaaagctcactcccttacagcaggagcaggctcagcccaaacctgacgtgcaacatacccagcatccgatggtggcaaaggatcgccaactgccaaccctgatggcacagccaccccagactgtggttcaggtgctcgccgtgaaaacaacacaacagctgccaaaattgcagcaggccccaaatcagcccaagatttatgtacagccgcagaccccccagtctcagatgtctctgcctgcttcttcggaaaagcaaaccgcttcccaggtggagcagcctattatcacccaagggagttctgtaacaaagatcacttttgagggacgacaaccgccgacagtgacaaagataaccggaggcagttccgtccccaagttgacctcacctgtgacgagcatttcaccaattcaggccagtgaaaagactgccgtgtcggacatcctcaagatgtccttgatggaggcccagattgatactaatgtggagcatatgatcgttgacccacctaaaaaggccctcgctacatccatgctgacaggggaggctggctcgcttccttcaacccacatggtggtggccggcatggccaatagcacgccgcaacagcaaaaatgccgggaatcatgctccagcccatcaaccgtcggctcatcacttactacgaggaagatagatcctcctgcggttcccgctacaggacagtttatgcgcattcagaacgtgggacagaaaaaggcagaagagagtccggcagaaattattatacaagcgataccacagtatgctattccatgtcactcgtcttctaacgttgtggtggaaccaagcggcttgctggaactcaacaattttacatcccaacagctcgatgatgaagaaacggcaatggaacaagacatagactctagtactgaagatggcactgaaccaagtccaagccagtcaagcgccgaacggagttag

SEQ ID NO: 182969 - DNA, 3468 bp, Artificial Sequence
  Description of Artificial Sequence: Synthetic coding sequence
atgcccgtggtgtggcccaccctgctggacctgagccgggacgagtgcaagcggattctgaggaagctggaactggaagcctatgccggggttatatcagctttacgtgcccagggcgatctcaccaaagagaagaaggacctattgggcgagctgtctaaggtgttgtccatatccactgaacgccaccgcgccgaggttcgacgcgccgtgaacgatgagcgtctgaccacaatcgcccacaacatgagcggacctaacagctcctcagagtggagcattgagggtaggcgcctggtgccattaatgccacggcttgtcccacagaccgcgttcactgttactgcgaacgcggtggctaatgcagccatacagcacaacgcttctttgccagtgccagccgaaacggggagcaaggaggtcgtgtgctattcctatacaagtaccacatcaacgccaacgtctaccccagtccctagtggaagtatcgccacagtgaaaagccccagacccgcgagcccggcatcaaacgtcgtagtgctgccttcaggctccacagtttatgtcaagagtgtatcctgctccgacgaagacgagaaaccccgcaagcgaaggaggacgaacagctcctcgagttctccagtggtattgaaagaggtgcccaaagcagtagtgccagtctccaagacaatcaccgtgccagtttctggttcgcctaaaatgagcaacatcatgcaatcgatcgcaaatagcctgcctccacacatgtcgcccgttaaaattacgtttaccaaaccatccacacaaacaacaaacactacaactcagaaggttattatcgtgaccacttctccaagctcgacttttgtaccaaatattttgtctaagagtcataattacgcagctgtaactaagctggttcctacttccgtaatcgcctctaccactcaaaagcctcccgttgtcatcacagcctcccagagttcactagtgtccaactcttcttctggttctagctctagcacccccagcccaattccaaacaccgtggccgttaccgccgtcgtgagctcaacaccgagtgtggtcatgtcaaccgtggcccagggcgtttctacttctgcaattaagatggcatccacacggctcccttcacctaagtccctcgtctcagcacccactcagatcctggcccaatttccgaagcaacaccagcagagcccaaagcagcagctgtatcaggtccagcaacagacacaacagcaggttgcccaaccaagtcccgtgtcacatcagcagcagccacagcagtctcctctgcctcctggcattaagcctacgatacagataaaacaagaaagcggggtcaaaattataacacagcaggtccagccctccaagatcctgcccaaacccgttaccgccacactccccactagtagcaacagcccaataatggtggtgagtagtaatggcgcaatcatgactaccaaacttgtcaccaccccaaccggtacacaggctacatacacaaggcccaccgtgtcaccaagcatcggcaggatggctgctacccctggcgctgccacttacgttaaaactaccagcgggagcataatcactgtggtgccaaaatcacttgctacgttgggaggtaagatcatctcctcaaatatcgtgagcggaactacgactaagatcactaccattcccatgacttccaaacccaacgtcatcgtcgttcagaagaccactggcaaggggaccaccattcagggtctaccaggcaaaaatgtggttaccaccttgcttaacgcaggcggtgagaaaacgattcagacagtccctaccggcgccaagcccgccatcctgacagccactagacccatcacgaaaatgatcgttacccagcctaaaggaattggctccactgtccaaccggccgcaaagattatcccaaccaagattgtgtatgggcagcagggaaagacccaggtcctgattaagcctaaacctgtgaccttccaagccacggtggtgagcgaacagacacgtcagttggtaactgagacccttcaacaagcttccagagtagccgaggcaggtaacagctctatacaagaaggaaaagaggaacctcaaaattataccgatagtagttcctccagcaccgagagttcccagtcatctcaggactcccagcctgtggttcatgtgatcgcatcgcgcaggcaggactggtcagagcatgaaatcgcaatggagacatcacccacaatcatttaccaagatgtatcttccgaatctcagagtgctaccagcacaattaaggccctgctagagcttcaacaaaccacagtgaaagaaaagttggaaagcaagcctcggcaaccaaccattgacctgtctcagatggctgtgcctattcagatgacccaggagaagcgacacagtccagagagccccagcattgcagtggtcgagtcagagctggttgccgaatacatcactacagagcgcacagatgagggcacggaagtggcattcccattactcgtgtcacatcggtcccaacctcaacaaccttctcagcctcagcgtaccctcctccagcatgttgcccagagccagaccgccacccagaccagtgtggtcgtgaagagtattccagcatctagccctggcgcaatcactcatattatgcagcaggcactgtccagtcatactgcgtttacgaaacactccgaggagcttggtacagaagaaggcgaggtggaggagatggacacacttgacccccagaccggtctgttctatcgttcggcactaacccaatcccagagtgcgaaacaacagaagctgtctcagccaccactggaacaaacccagttacaagtcaagactctgcagtgcttccaaaccaagcagaaacagacaattcacctgcaagccgatcagcttcaacacaaattaccacagatgccgcagctgagcatacgccaccagaagctcaccccattacagcaagagcaggcccagcccaaacccgatgtccaacatactcaacatcccatggtggctaaggaccgacagctgccaaccctgatggcacaacccccccagaccgtggtccaggttctcgctgtgaagaccacccagcagctccctaaactacagcaagcccctaaccagcccaagatttatgtccagcctcaaaccccacaaagccagatgagcttaccagcctcgtcggaaaagcagaccgcgagtcaggccataccacagtacgctatcccttgtcatagtagttcaaacgtcgtagtcgagccgtccggactcctggaactgaataactttacaagccaacagctggacgatgaagaaacagctatggagcaagatatcgactcatctacggaggacgggaccgagcccagcccaagtcagtcatccgccgagcggtcctag

SEQ ID NO: 182970 - DNA, 3015 bp, Artificial Sequence
  Description of Artificial Sequence: Synthetic coding sequence
atgcccgtggtgtggcccaccctgctggacctgagccgggacgagtgtaaaaggatcctgcggaaactcgaactggaagcctacgccggcgtgatctcagcactgcgtgcacaaggtgacctgactaaggaaaagaaagaccttctgggggaactgtcaaaagtcctttccatctctactgaacgccatcgcgctgaggtccggagagccgtgaatgacgagaggctgacaacaattgcgcataacatgtcaggcccgaattcatcctcagaatggagcattgagggtcgtaggctggtccctctgatgccccgactggtgccccagactgcattcactgtcacagcaaatgcggtcgctaacgcagccattcaacataatgcctctctcccggtcccagccgagacggggtccaaagagggcgtgagctgctcagatgaagatgagaaacccaggaaacgccgtagaaccaactcgagtagcagttcaccagttgttctcaaagaggttccaaaagccgtggttccagtgtccaagacaatcaccgtccctgttagtgggtcccccaagatgtccaacatcatgcagtccatcgcaaatagtttgccgccccatatgtcaccggtaaagattaccttcacaaaacccagtacacagaccaccaacactacaacccaaaaggtgataatagtgacaaccagcccctcatccacctttgttcctaacatattgagcaagtctcataactatgctgctgtcacaaagctcgtgccgacaagcgttatagcctcaaccacacaaaaaccccccgtcgtgatcaccgctagtcagtccagcctggtcagcaattcttcatcaggtagttcatcctctaccccatccccaatccctaacaccgtggcagtgactgccgtggtgtctagtaccccttcagtggtaatgagtacagtggcacaaggtgtatctaccagcgccatcaagatggcaagtactcgactgccctctcccaagtcactggttagcgctcccacccaaatactggcacagttccccaagcagcaccagcagagccctaagcagcagctctaccaggtgcagcaacagacccagcagcaagtcgcccagcccagccctgttagccaccagcagcagccacagcaatctcctctcccacctggcatcaagccaaccatccagatcaaacaggaaagcggggttaaaatcatcacacagcaggtgcaaccctctaagatcttgcccaagcccgtgacggctattctgaccgccacgagaccaatcacgaagatgatcgtgactcagccgaagggcataggaagcactgtccaaccggccgccaagatcataccaacaaagatcgtctacgggcagcaagggaaaacacaagttctaattaagccgaagcccgtaaccttccaggcaactgtagtgagtgagcagactcgccagttggtcaccgagacgctccaacaggccagcagagtcgccgaagccggtaattcatccatccaagagggcaaggaagagccccagaattataccgatagttcgagctcttcgaccgaaagtagccaaagtagccaggttagccaccggtcccaaccacagcaaccatcccagcctcaacgcaccttactgcagcacgttgcccaatctcagaccgcaacgcaaacatctgtggtggtcaaaagtattcccgcaagctctccaggcgccatcacacacatcatgcagcaagcacttagctctcacactgcatttaccaagcacagcgaggagctgggcaccgaagagggcgaagtggaagagatggacaccctggatccccagactgggcttttctataggtccgccctcacccaatcccagagcgccaaacagcagaagctgtcacagccaccgctggagcagacacagctccaggtaaaaactctgcaatgctttcaaactaaacagaagcaaaccatccatttgcaggctgaccaactccagcacaagttgcctcaaatgccacagcttagtatacgccatcaaaagctgacccccctccaacaagagcaggctcaacctaagccagatgtccagcacacgcaacacccgatggtcgctaaagaccgccaactgcccaccttgatggctcagccaccccaaacggtggttcaagtactcgccgtgaaaacaacccagcaactgccgaagctgcagcaagcacctaaccaaccgaaaatttacgtacagccacagacaccacagtcccaaatgtctctcccggcttcctcagagaaacagaccgcatcacaggtggagcagccgatcataactcaggggtcaagtgtgaccaagattacgtttgaaggccgtcagcctccaaccgtgaccaagatcacgggagggtctagcgtgccgaaactcacctcaccagtaacctccatttctcctatccaagcatctgaaaaaaccgccgtttctgatattctaaagatgtctctcatggaagcccaaattgacaccaatgtggagcacatgatagttgaccccccgaagaaagccctcgccacctcaatgctgactggggaagcagggtcattgccgagcactcatatggtggtcgctggaatggccaattctaccccccagcagcaaaaatgtagagaaagctgttcttcacctagcaccgtcggatcctccctgactacccggaagatcgatcctccagccgtcccggctacaggccagtttatgcgcattcagaacgttggacagaaaaaagccgaagagagccctgccgagatcatcattcaggctatcccccagtacgctattccctgtcatagctcctcgaacgtcgttgtagagccttcaggactcctggagctgaataacttcacaagtcaacagcttgatgacgaggagaccgcaatggaacaggatatcgactcatccacagaagacggaactgagccctccccttctcagagcagtgccgagcggagctag

SEQ ID NO: 182971 - DNA, 3969 bp, Artificial Sequence
  Description of Artificial Sequence: Synthetic coding sequence
atgcccgtggtgtggcccaccctgctggacctgagccgggacgagtgcaaacggatcctccggaaactcgaactggaggcctatgccggagttatttctgccttacgcgcacagggcgacttgaccaaagaaaaaaaggacctcctgggagaactctcaaaggtcctcagtattagcacagaacggcacagggccgaggtgcgaagggctgtcaatgatgagagattgaccaccatcgcccataatatgagtgggcctaacagcagctccgagtggtccatagagggccgcagactggtgccacttatgccccggctggtgcctcagacggccttcactgttactgctaatgctgtcgctaacgccgccattcagcataacgctagcctccctgtgcccgcggagacaggcagtaaagaggtcgtgtgttattcatacacaagcactaccagtactcctacatccacacctgttccctccggaagcattgctacagtaaaaagtcctcgtcccgctagcccagccagtaatgtggtggtcctcccctctggctcaaccgtctatgtcaaatccgtgagctgctcagacgaagatgagaagccccgtaaacggcggaggacgaatagtagcagcagctcccccgtggtgctaaaggaggttccgaaggccgtcgttcctgtctctaaaacaataaccgtgccggtgagcggttcccccaagatgagtaacattatgcaaagcatcgcaaatagcttgcctcctcacatgtcccctgtgaaaatcactttcaccaaacctagcacccagactaccaacaccaccactcagaaggtaatcattgtcacaacatctcccagcagcaccttcgtgcctaatattctgtcaaaaagccacaactacgctgctgtgaccaagttggtgcccactagtgtgatcgcgagcacaacacagaagcccccagttgtgattaccgcttcacaatcatcacttgtatctaattcgagcagcggtagttcctctagcacacctagtcctatacctaacacagtggccgtaactgcagtcgtcagtagcaccccatccgtggtcatgtctacagtggcccagggggtcagtacatccgcgattaagatggcctcaacccggttaccgagcccaaagagcctggtgagtgcaccaacccaaatcctggctcagtttcctaaacagcaccaacagagtcccaagcagcaactgtaccaggttcagcagcagactcagcagcaggttgcccagccgtcccctgtgtcccaccagcagcagcctcagcaatctccgctgccgcctggcatcaagcccacgatccagatcaagcaggaatctggcgtgaagatcatcactcagcaggtgcagccttccaagattctgccaaagccagtcaccgccaccctgcctactagctccaattcacccattatggtggtgtcttctaatggcgccatcatgaccactaaactggtcacaaccccaacaggtacacaggcgacatacacaagacccaccgtcagccccagcataggtcggatggccgctactcctggggccgcaacctacgtcaagacaacatctggttccattatcaccgtggtgcccaagtctcttgccaccctcggtggcaaaatcattagcagcaatattgtgtctggtaccactactaaaattacaacaattcctatgacttccaagcccaatgtgattgtggtacaaaaaacaactggcaagggtacaacgatccagggcctccccggcaagaacgtggtaaccaccctccttaacgctgggggcgaaaagactatccagaccgtgcccaccggagccaaacccgcaatcctcaccgccacacgacctattaccaagatgattgtgacgcagccaaaggggatcggttccactgttcagccagcggccaagatcataccgaccaagatagtctacggccagcaggggaagacacaagttttaatcaaacccaagccggtgacttttcaggccacagtggtgtccgaacagaccaggcagttagttacggagactctgcagcaggctagccgcgtcgcagaggcaggaaatagctctattcaggaagggaaagaagagcctcagaactacactgactctagcagcagcagcactgagtcctcacaaagctctcaggatagccagcccgtggtccacgtgatcgcctcgcgacggcaggattggagtgaacatgaaatcgctatggagacttctcctaccataatatatcaggatgtgagctcggaatctcagtctgccacatccacaatcaaggctcttctggagctgcagcagacaaccgtcaaagagaaactcgagtctaagccgcgacagccaactatcgacctgtcgcaaatggccgtgcccattcagatgacccaggagaagcgtcattctcctgaaagtccttcaattgctgttgtcgagagtgaacttgtagccgagtacattaccacagaacgcaccgacgaaggcacagaggtcgctttcccattgctcgtgagccacaggagccagcctcagcagccttcccagccccagagaactctgctgcagcacgtcgcacagagccagacggctacacaaactagcgtcgtggtaaagagcattcccgcatcaagtcccggcgccattactcacataatgcagcaggccctaagtagccatactgcctttaccaaacacagtgaggagctgggcaccgaagagggtgaagtagaagaaatggacaccctcgacccacaaacgggcctcttctatcgttcagcgcttacccagagtcagtcagcaaagcaacagaagctcagtcagccccccttagaacagacccaactgcaggtgaaaacccttcaatgttttcagacgaaacagaagcaaaccattcatctgcaggcagatcagctgcagcataaactgccacaaatgccccaattgtccatacggcaccagaaactgacgccactgcaacaggagcaggcccagcccaagcccgacgtacagcacacgcagcatccaatggtcgccaaagaccgccaactgcccacacttatggcacagccccctcaaacagtggttcaggtgctcgcggtcaagactacgcagcagctgccaaaactccagcaagccccaaatcagcccaaaatctacgtgcaacctcagacaccacaaagtcagatgtcgctgccagcatcgtctgagaaacagacagcctcgcaagtggagcagccaattattacacaggggagtagcgtcaccaaaatcactttcgagggtaggcaaccaccaaccgtgaccaagattaccgggggatcctcggtgccaaaattaacttctcccgtcacgtctatatcacctattcaggcttccgaaaagacggccgtgagcgatatactaaagatgtcattaatggaagcccagattgatacgaacgttgagcatatgatagtggatcctccgaagaaggctctggccacctcgatgttgacaggcgaagcaggatctctgccgtcgacccatatggttgttgctggaatggctaatagcactccccagcagcagaagtgcagagagtcctgttcaagccccagcacggtgggctcctctttgacgactcgcaaaattgacccccccgccgtacccgcaactgggcagttcatgcggatacagaatgtggggcagaaaaaggccgaggaaagccctgccgagataatcatacaggctatcccacagtatgcaattccttgccacagctccagcaatgtcgtggtcgaacccagtggtttgctggaactcaacaactttacttctcagcagctggacgacgaggaaactgcgatggagcaagacatcgatagctcaactgaagacgggacagagccatccccttctcaatcttcggccgaaagaagttag

SEQ ID NO: 182972 - DNA, 624 bp, Artificial Sequence
  Description of Artificial Sequence: Synthetic coding sequence
atggccgtgttccacgacatgctgctgcagcccctgggcatgttcctgtgcctgtctctgcagctgtcatcagccacattcatacggtattcctccacttgctttaccttcgatgaatactatactatcaccttagacattaaagcctcaagccatatatacgagagcaatgcagtgtacagtgtgtttgttccagtgaacgactctgtttatgcagtagtcatgaagacacttgatgagaactcggacagcgcaggcctctggcagagagctgacaagaactgctattctaattccacgtactatgtgaaagaccaatatatgacagtgttggaggcccagtggcaagcaccggaaccagaaaatattacggaagtcgaaatccaggcctttactgtgcagatcagagcgctgccaatattgtcgaccctgaaactacgagagaaactatccacactggcattagcggccaagataccgcagtcatcagctttcaagccattctttatgattacccccaagtcaatcagactggagggattggctaaccaggtcttttcttcaccaattacggaggccatctacattctcctcgctttccttaccagtactctgttattttag

SEQ ID NO: 182973 - DNA, 3708 bp, Artificial Sequence
  Description of Artificial Sequence: Synthetic coding sequence
atggaccacaccgccagccagaacgcccaggacctgatcggcatcccacaccttggagtgagcggctcttccaccaagtggcactccgagctgagtccgaccgagggaccacactctgctgggtcaagcacaccaggcttcctgtctcctatggcagagctgtcccacccctctccgccacctcctgcccttggttccctcctacagctccccgatggcagcccatcatggtccatgcttgaagtcgcgtccggccccgcaagtacccagcagatcaaagccggtgtccccggcagagtccacaatggcgtctccctccctaccttcaagaacacagagactgccacgcacgaggcggaacccccattgttccagactgccgaatcaggggccattgagatgacttctcgcaaacttgcttcagctactgccaacgacagcgctaatcctctgcaccttagcgctgcgccggaaaattctcgcggcccagccctttccgcagaacacacctcttccttggtgccatcgctgcacatcacgactctggggcaggaacaggcaatcctgtctggcgccgtgcccgcctcgccttctactggcaccgcggatttcccgagtatcttgacgtttctacaaccaactgagaatcacgcatccccatctcctgtaccagagatgccaacccttcccgcggagggatcagacggttcaccgcccgcaacccgcgatcttttactttcctctaaggtaccaaatctcctgagcacctcgtggacattcccacggtggaaaaaagatagtgttactgcaattctcgggaaaaacgaggaagcaaacgtgaccattccattacaggcatttcccaggaaggaggttctgtcgctacataccgtcaacggatttgtctccgacttttccacaggctccgtatcatctcccataattacagccccaagaaccaatccccttccatcaggtcctccactgccttcgatcttgagtattcaggcgacccagacagtcttccctagcctcgggttttcatccaccaagcctgaggcctacgctgcggcagttgaccattctggactgcccgccagtgctagtaaacaggtccgagcatctccgtcttctatggatgtctatgactccctcactatcggggacatgaaaaaacccgcaactacagacgtcttctggagcagtctgtctgctgaaacaggaagccttagcaccgagtccattatctcgggcctccaacagcaaaccaattacgatcttaatggacatacaatcagcacgacatcatgggaaacccatctggctcctacggctccacctaacggtctgacaagcgcagcagatgcaatcaaaagtcaggacttcaaagacacagctggccattccgtgaccgccgaaggattcagtattcaggacctggtgctcggtacttctatcgaacagccagtgcaacagtcagacatgacaatggtgggtagtcacattgacctttggccaactagtaataataaccattctcgtgatttccagacagcggaggtcgcatattactctcccaccacccgacactctgttagccacccccaattgcagctccctaaccagccagcccaccctcttctgctgacttctcctggtcctacaagcaccggatcgctccaggaaatgctaagtgacggcacagatacaggaagcgaaatttcctccgacattaacagctcccctgaaagaaatgccagcactccattccagaatatactgggctaccattcagccgccgagtcatctatatccaccagtgtttttccaagaacatcatcgagggtattgcgagcctcccagcaccctaagaaatggaccggagccgctaccaatgccgccgataccgtctcctcaaaggttcaaccaaccgccgccgccgctgtgaccctgtttttgagaaagtcgtctcctcccgccctcagcgctgctctcgttgccaagggcacctcgagtagcccactggccgtggcctcaggccctgccaagagcagctccatgaccactctagcaaaaaacgtaacaaataaggccgcatccggccctaaacggacacctggggccgtacatacagctttcccatttactccaacctatatgtacgctagaaccggacacacaaccagcactcacacagctatgcagggcaacatggatactgcaagcggactcttgagcaccacatacctgcccagaaaaccccaggctatgcacacaggcctcccaaacccaaccaacctggagatgccaagggcctccacgccccgccccctgactgtcacagcagccctcacttctataactgccagtgttaaggcgacccgtctgccacctctgcgtgcggaaaataccgatgctgtgctgcctgcagcatcggctgccgtggtgacaactggcaaaatggcatctaaccttgagtgccagatgtccagtaagctgcttgttaagactgtgctcttcctgacacagagaagagtgcagatctcagaatccctgaagttcagtatagccaaggggctaacgcaggctctccgtaaggccttccaccagaatgatgtgagcgcacatgtcgatatcttagagtatagccataacgtgacggtgggttactacgcaaccaagggcaaactggtgtatctgcctgcggtggttatcgaaatgttgggcgtttatggagtgtcgaacgtcactgccgatttaaagcagcataccccccacctgcagtcagtcgctgttttggctagcccttggaacccccagcctgccggctattttcaacttaagactgtacttcaatttgtctcccaagcagacaacattcagtcctgcaaatttgctcaaacaatggaacagagattgcaaaaagcattccaggacgcagagcgaaaggtgctgaatacgaagagcaatcttaccattcagattgtgagtacctcaaacgcttctcaagcagtcaccttggtctacgtagtaggtaaccaatcaaccttcctaaatggcacggttgcgtcttcgctcctgtcccagctctccgctgaactagtgggcttttatctcacgtaccctcctttgactatcgccgagcccctggagtatcctaacctggatattagcgagaccactcgggactattgggttatcactgtgttgcagggtgtggacaacagcctcgttgggctgcacaaccagtcatttgcaagggtaatggagcagagactcgcccagctatttatgatgagccagcagcaggggcgtcggtttaagagagctaccacccttggctcatataccgtccagatggttaagatgcagcgcgtaccgggcccaaaggatccagccgagctgacctactataccctctacaacgggaagccactgttaggcaccgccgccgccaagatactttcaaccatcgactcccaacggatggctttaaccttgcaccacgtagttctgttgcaggccgatccagtcgttaagaacccccctaacaacctttggattatcgctgccgtcctggctccaatcgccgtggtgacagtcatcatcattataattaccgcagtattatgccggaagaataagaacgatttcaaacctgatacaatgataaatttgccccagcgggcaaagcaagtggctcagtag

SEQ ID NO: 182974 - DNA, 5550 bp, Artificial Sequence
  Description of Artificial Sequence: Synthetic coding sequence
atggaccacaccgccagccagaacgcccaggacctgatcggcatcccccatctgggcgtcagtggatctagtacgaagtggcattcggaactgagtcccacggagggaccacactctgccggttcatccacgccgggatttctctcacctatggctgaactctctcacccaagcccccctccgcctgctcttggcagcctgttgcaacttcccgatgggagcccatcttggtctatgctggaagtggctagcggacctgcctcgacacaacagatcaaagctggggtgcccgggcgagtccacaatggcgtgtccttgccaacctttaagaacacagagaccgctacccacgaagcagagcctcctctgttccagaccgcggagtccggggcaatagagatgacatctagaaaactggccagcgcaactgccaacgattctgccaatccgttacacttgtccgccgcaccagagaatagccgaggtccggctctttcagccgagcatacatcatcccttgttcccagcctgcacattacaacacttggccaggagcaggcaattctgagcggagctgtgcccgcatcccccagcacaggaaccgcggatttcccaagcattctgaccttcctgcaaccgaccgagaaccatgctagtcccagccccgtgcccgagatgccgaccctaccggcagagggttctgatggctcacctccagctacgcgagacctcctgctaagctccaaggtccccaatctgttatccacatcctggaccttcccccggtggaagaaggactcagttaccgctattctcgggaaaaacgaagaagctaatgtcacaatcccgctgcaggcattcccaaggaaggaggtcctcagcctgcacacggtgaacgggtttgtaagtgacttttccacagggagcgtttctagccctatcataaccgctccgcgcactaatccgctcccttctggacctccactcccctccatcttaagtattcaggccacgcagacagtgtttccaagcttaggattttcttctaccaaaccggaagcctacgcagcagccgtggaccactccgggctgccagctagtgcgtccaagcaggtgcgggcctcaccaagctccatggacgtctacgattctctgaccatcggcgatatgaagaagccggccactacagacgtgttttggtcatctctgagcgctgagacaggctctctctctacagagagtattatcagcggattgcagcaacagacgaactatgatctgaatggccatacaatcagcactacctcgtgggaaactcatttagcaccaactgcgccgcctaacggccttacatctgcagcagatgctattaaatcccaggattttaaggacacggctggacacagcgtcaccgccgagggtttttcaatccaagacctggttttaggtaccagcattgagcagccggtccaacagagtgatatgactatggttggaagccacatcgacctctggccgacatccaataacaaccatagcagagatttccagacggccgaagtggcctactactcccctactaccaggcactccgttagccacccccagctgcagttgcctaatcagcctgcacaccccctgctacttacaagcccaggaccaacttcgactggcagcctgcaggagatgctatcggatggcaccgatacggggtccgagatttcaagcgatatcaacagctcaccagaaaggaacgcatcaactccgtttcagaacatcctcggataccattctgcagccgaatcttccataagcacatctgtcttcccgagaacctcctctcgcgtcttgagggccagccagcaccctaagaagtggactgccgacaccgttagctctaaggtgcagcctacagccgctgccgcagtgaccctattcctgcgtaaaagttccccgcccgctttaagtgcagccctcgtggctaaaggaacatcgagcagtccgcttgcagttgcctccggcccagctaaaagttcatctatgaccacccttgcgaagaacgttacaaacaaggccgctagtggaccaaagagaacaccaggagccgtccacacagcatttcccttcacaccaacatatatgtatgctcggaccggccacactacctctacccatactgccatgcagggtaacatggatacagcctctggattactatcaaccacttacctcccacgcaagcctcaggccatgcatacgggcttgccaaatcccaccaatctggagatgcctagagcaagtacgcctagacctctgactgtgaccgccgctctgaccagtattaccgcatccgtcaaagcgacacgcctgccaccattgcgagcggagaataccgacgcagtcttacctgctgcgtccgctgctgtggtgacaacaggcaaaatggcttcgaacctggagtgtcagatgtcatccaagctgctggtgaaaacagtgctgttcctcacacagcgtcgggtacagatttcagagtccttaaagttctccatcgccaagggcttgacccaggcattgaggaaagcctttcaccagaatgacgtcagcgctcacgtggacattctggagtattctcacaacgtgaccgtgggttattacgccaccaagggaaagcttgtatacctccctgctgtggttatcgaaatgttgggcgtttatggggtctccaatgtcacagccgacctgaaacagcatactcctcatcttcagtctgtggccgtgcttgcctccccctggaaccctcaacctgccggttactttcaactaaaaacggtactgcagtttgtcagtcaggcagataatatccagtcctgcaagttcgcccaaacgatggaacagcggttacagaaagcctttcaggatgccgagcgtaaagtcctcaatacaaaatccaatctgacgatccaaatcgttagtacgagcaacgcctcccaggcggttacactggtgtatgtagttggaaaccagagcactttcttgaacggaactgtcgcttcttcactgctcagtcagctgtcggcagaactagtcggattctatttgacgtacccccctctgacaatagccgagcccctggaatacccaaatcttgacatttccgaaaccacacgcgattattgggtcatcactgttctgcaaggggttgataattctttggtaggactgcacaaccagtcttttgctcgggtgatggagcagaggctggcccagctgttcatgatgtcccagcagcagggccgtcgtttcaaacgcgccaccacattagggtcttacacagtgcagatggtaaagatgcaaagagtgccaggacccaaagacccagcggagctcacatactacacgctatataatggcaaaccactcttagggaccgctgccgccaaaattctttccactattgatagtcagcgtatggcgcttactcttcaccatgtcgtgctgttacaagccgacccggtggtaaaaaatccacctaataacctatggattattgcagcagtactggcgccaatcgcagtggttaccgtaatcattataatcattacagctgtcctttgccggaaaaacaaaaacgattttaagccagacacgatgataaacctacctcagagagcaaaaccagtgcaagggttcgactacgctaaacagcatctcggacaacagggtgcagatgaggaggttatccccgtgacccaagagactgtggtcctgccccttccaataagagatgcgccccaggagcgcgatgtagcacaggatggctctaccattaagacagccaagtcaaccgagacgcgaaaatctcggagcccgtccgaaaatgggagcgttatttctaatgagtccggcaaaccgagttcaggcaggcgctcccctcaaaacgtgatggcccaacagaaggtcactaaggaagaggcaagaaaaaggaacgtacctgcctcggatgaagaagagggtgccgtgcttttcgataatagttccaaggtggccgcggagccatttgatacctcttcaggaagcgtccagctgatcgcgattaagccaaccgcacttcctatggttcctcctacatccgataggtcacaggagtccagtgcggttctgaacggagaggtaaacaaggcactgaaacagaagtctgacatagagcactatcgaaataagcttcgtttaaaagccaaaagaaagggctactatgatttccccgccgtggagacatcgaagggcctcaccgagcgcaagaaaatgtatgagaaggcacccaaggaaatggaacacgtacttgatcccgactcggaactgtgcgcccctttcactgaaagcaagaaccgtcagcagatgaagaattctgtgtataggtccaggcagtccctaaatagcccatccccaggcgagacagaaatggatctcctagttactcgtgagaggcctagaagggggatccgcaattccggatatgataccgaacccgagattatcgaggaaaccaacatagatcgcgttcccgagccaagaggctactctaggagtaggcaagtgaagggacacagcgaaacatccacgttgagctctcagccttccattgatgaggttcggcagcagatgcatatgctgctcgaggaagccttctctttagcaagcgccggtcacgccgggcagtccaggcaccaagaggcctacggttccgcacagcatctgccgtatagtgaagtggtcaccagcgcgcctgggaccatgactaggcctagggctggggtgcaatgggttcctacttataggccggaaatgtaccagtattccctccctagacctgcataccgcttctcccaattacctgagatggtcatggggtctcccccaccacccgtgcctcctaggactggacccgttgctgttgcttctctccgccgctcaacaagcgatattggctctaagacacgtatggccgaaagcacaggtcccgagccagcccaactgcacgattctgcctcttttacacaaatgtcacgtggacctgtgtccgtgactcagctcgatcagtcagccctcaactatagcgggaacaccgtgcctgctgtcttcgctatccccgccgcaaatcggccaggcttcaccgggtactttattcccacacctccttcttcgtacagaaaccaggcgtggatgagttacgcgggcgaaaatgagctgccttctcaatgggccgatagtgtgccgctgcccggatacattgaagcctacccaagaagcaggtaccctcagtctagtcctagtcgattaccccgccagtattcccaaccggcaaatctccacccaagcctggagcaagccccggctcctagtacagccgcctcgcagcagtccctcgcggaaaatgaccctagtgatgctccactgactaatatctccactgccgccctggtcaaggctatcagggaggaagttgccaagcttgcgaaaaaacagaccgacatgtttgagtttcaggtctag

SEQ ID NO: 182975 - DNA, 5568 bp, Artificial Sequence
  Description of Artificial Sequence: Synthetic coding sequence
atggaccacaccgccagccagaacgcccaggacctgatcggcatcccgcacctgggcgtgtcagggtcgtcaaccaagtggcatagcgagctatctcccacagagggccctcattccgccggttctagcacgcccggttttctgagtcccatggcggaactttcccacccgtcaccccctcctcccgcgctgggatctcttcttcaactgccagacggcagccccagctggtcaatgctcgaggtcgcctccggcccggctagcactcaacagattaaagctggtgtccccggcagggtgcacaacggggtctcgctgccgacattcaagaacactgaaacggcaacccacgaggccgagcctcccctgttccagaccgctgaaagtggagctattgagatgacatctaggaagcttgcatccgccacagccaacgacagcgctaacccactgcatctgtcagctgcaccagaaaattcgcgtggaccagccctgagcgcagagcacacctcgtctctagtcccctctctccacataaccaccctggggcaggagcaggccatccttagcggtgctgtgcccgcatcaccatccactggcacagcagacttccctagcatcctgacatttctccagcctaccgagaaccacgcatccccttcccctgtacctgagatgccaacattgcctgccgaaggatcggatggtagtccaccagctacgcgcgacctgcttttgtcatctaaagttcccaatctgttatctactagttggactttcccaagatggaaaaaggacagcgtcaccgccatcctgggcaagaacgaagaagccaacgtgacaatcccacttcaagccttccctcgaaaggaggtgctcagcctgcacacagtgaatgggttcgtgtcagatttctcaaccggaagtgtctctagtcctattattactgctccaaggacaaaccctctgcctagcggtcctcccctccctagcatcctcagtatccaggctacccagactgtgttcccgagtctgggattctcatctactaagccagaagcttacgccgccgcagtcgaccatagcggactgcctgcttcagcctcaaagcaggtgagggcgtcccctagttccatggatgtatatgactccttaactattggagatatgaaaaaacccgcgaccactgacgtcttctggtcatctctgagcgctgaaacgggttccctgtcaacagagtccattatcagtggcttgcagcagcagacaaactacgacctgaatggccacaccatttctactactagctgggagacccacctggctcctactgcccctcctaatggcctcaccagcgcggccgacgctattaaatctcaggatttcaaagacactgcaggacactctgttacagcagaaggtttttcaatccaggatctggtcctgggaaccagcatcgaacagccggtgcagcagtctgacatgacaatggtcgggtctcatatcgacctctggccaacttccaacaataatcacagcagagatttccagacagccgaagttgcctactactccccaaccactagacattcggtttcccatcctcaactacagctgcctaaccagcctgcgcaccctctgctcctcacaagtcccggacctactagtactggatctctccaagagatgctctccgacgggaccgacaccggctctgaaatttcatccgacattaattccagtccagagcggaacgcctccacaccctttcagaatatcctggggtatcactcagctgcagagagctccatatctacctccgtattccccagaactagctctcgggttctccgcgcatcccagcatccgaagaaatggaccggggccgctaccaacgctgctgacacagtcagctctaaggtgcagcccaccgccgcagccgctgtaaccttgttcctgcgcaaatcgtccccgccagccctaagcgccgcgctggtcgcaaagggaactagttctagccctctcgcagtggcctctggccctgccaagtctagttcgatgaccacactggccaagaacgtgaccaataaagcggcgtcagggccaaaacgaacccccggcgcagtgcacacagccttcccattcacccccacttacatgtacgcaaggactggtcatacaacatccactcacacggccatgcagggcaatatggataccgcttcaggattactgtcgaccacgtacctgccccgaaagccccaggctatgcacaccggactgcccaaccccaccaatttggagatgccacgagcgtcaaccccccggccattgaccgtgactgccgccctgacctctattaccgcgtctgtgaaggctacaaggctgccaccactgagggccgagaataccgacgctgtcctccccgcagcttctgctgccgttgtgacgacaggaaaaatggcgagtaacctggaatgccaaatgagttctaaactgttggtgaagaccgtcctgtttctcacccagcggcgcgtgcagataagcgaaagcttgaagttttctattgcaaagggtctgacccaggctctccggaaggcattccatcaaaatgacgtgagtgctcatgtggacattcttgagtacagccacaatgttactgtgggctattatgcgaccaaggggaaactggtctatttaccagccgtcgtaattgaaatgctcggcgtgtatggtgtctccaacgtcactgcagatttgaagcagcacaccccgcaccttcaatctgtggctgtgctcgcttctccctggaatcctcagccggcagggtattttcagttgaagactgtcctacaattcgtttcccaggccgacaacatccagagctgcaagttcgcccagaccatggagcaacgcttgcaaaaggctttccaggacgctgagaggaaggtgctgaacaccaagtccaacctgacaattcagatcgtgtccactagcaatgcatctcaagctgtgaccctcgtctatgtagttggtaaccagtccacatttctcaatggcacagtggcttcctccctgctttcccaattgtctgccgaactggtgggcttttatctgacttacccccctctgaccattgcagagcccttggaatacccaaacttagatatatctgaaactactagagactattgggtcataaccgtcctccagggcgttgataactcactcgtgggcctgcataaccaatcttttgctcgcgtgatggagcagcgcctcgcacagctattcatgatgtcacagcaacagggccgccggtttaagcgagccacaacgctcggctcatacaccgtccagatggtgaagatgcaaagggtgcccggcccaaaggaccccgccgaactcacctactacactctttataacgggaaacccttgctcggcaccgccgccgctaagattctttctactattgacagtcagagaatggcgctgacactgcatcatgtggtactgctccaggctgacccggtagtcaagaacccccccaataacctgtggatcattgccgctgtgctcgctcctattgcagtggtaaccgtgatcattataataataaccgccgtcctctgccgcaagaataagaacgatttcaagccggacacaatgattaacctgccacaacgggctaagcctgtccaaggcttcgattacgcaaagcagcatctgggccagcagggtgccgacgaagaagtaattccagtgactcaggaaacagtggtattgccgttgcccataagagacgcccctcaggagcgcgatgtcgcgcaggatggatcaaccattaagaccgcaaagagcacagagacgcgcaagtcacgctctccgagcgaaaatgggagtgtaatctccaacgagtctggcaaaccctcgagcgggcgcaggtctccacagaacgttatggcacagcaaaaagtcacaaaggaggaggcacggaaacgaaacgtgcctgcctccgatgaggaggagggcgccgtgctgtttgataactcctctaaagtagccgcggaaccattcgatacgtctagcggaagcgtgcagttgatagcgataaaacctactgctctacctatggtgccacctacctcggataggagtcaggagtcaagcgctgtactgaacggggaggtgaataaggctctaaaacaaaaatcggatatcgaacattatagaaataaactgcggctgaaggctaagcgtaagggctattatgatttcccggcagtggaaacgtctaaaggcctgacggagcggaaaaagatgtacgaaaaagcccccaaggagatggagcacgtgctcgaccccgacagtgagctgtgcgcaccattcaccgaatctaagaataggcaacaaatgaagaactccgtataccggtctcgccaatccttgaactcaccatcccccggcgagactgagatggacttgctggtcacacgcgagaggccaagaagagggatcagaaacagtggttacgatactgagccagagatcatcgaagagacaaacatagaccgagtcccagaacctagggggtactccaggtccagacaggtgaaaggacacagtgagacatctacgctgagttcgcagcccagtattgacgaggttcggcaacaaatgcatatgctgctcgaagaggcatttagcctagcctctgcaggccatgctggccagagtaggcatcaggaggcctatggtagcgcccagcatttgccatatagcgaagtggtgacttctgctcccgggacgatgacaagacccagagctggcgttcagtgggtcccaacatacaggccagagatgtatcagtacagtttgccccgtccagcctatcgctttagccagctgcctgaaatggttatgggttctccaccccccccggtgcctcctcgaaccggtcccgtggccgtggccagcctgcggagatctacttccgatattggcagtaaaacacgcatggccgagtctactgggcccgagccggctcagctgcacgacagcgcctcttttacccagatgtccagaggcccagtctctgtgactcaactcgatcagagtgccctcaattacagcggcaataccgtgccagcagtttttgccattcctgcagccaatagaccaggatttacaggatatttcatcccaactccgcccagctcctataggaaccaggcttggatgtcttacgccggcgaaaatgaactgcccagccagtgggcagactccgtacctttgcctggttacattgaggcatatccgagatcacgttatccccagtccagtccatctcggctcccgagacagtattctcagcctgccaatctgcatccatccctggagcaggctcccgcaccatcaaccgcggcctcccagcagagcctggccgagaatgatccctcagatgcacccctcactaatatctccactgccgctctggtgaaggctatccgcgaagaggttgctaaattagctaagaaacaaacagatatgttcgagttccaggtgtag

SEQ ID NO: 182976 - DNA, 5067 bp, Artificial Sequence
  Description of Artificial Sequence: Synthetic coding sequence
atccccgagggcctgagcgccgagcacaccagcagcctggtgcccagtttacacataacgacgctcggccaggaacaggccatcctttcaggagctgttccagcctccccttccacaggcacagctgatttcccctccattctgacattcctccagcccacagaaaatcacgccagtccaagcccagtaccggagatgccgacactgcctgcggaaggaagtgatggaagtcctcctgccaccagagaccttctcttgtccagtaaagtgcccaacctgttgagtacaagctggacatttcctagatggaaaaaagacagtgttacagctattctgggcaaaaacgaggaagctaacgtgaccataccacttcaggcctttcccaggaaggaggtgctgagtctgcataccgttaatggattcgtgtcagatttcagcactgggtctgtgagctcacctatcatcaccgctccgcgcacaaacccgcttccgtccggtccgccgttaccatccattttgagcatacaagccactcagactgtgtttccaagcctggggtttagcagcaccaaacctgaggcctacgcagcggcggtggatcacagcggcctgcctgcctcagcctcaaaacaagttcgcgcatctcctagttctatggacgtgtacgactcactaaccatcggggatatgaagaaaccagccactacagatgtcttctggtcttctttgagcgccgagacagggtcactcagcactgagtcgatcatatccgggcttcagcagcaaaccaattacgacctgaatgggcatacaattagcactactagctgggagacgcatttggcgccaacagccccccccaacggtctcacttccgccgccgacgccataaagagtcaggattttaaggatacagccggacacagtgtgactgcagaaggcttcagcattcaggatctagtgcttggtacatcaattgaacagcctgtacagcagtcagatatgacgatggtgggaagtcacatagacttgtggcccacctccaataataatcatagccgagattttcaaaccgctgaagtcgcctactattctccaacaacaagacattcagtctctcatccacagctgcaattacccaaccagcctgcacaccccctattgcttacgtctcctggcccaactagcacaggttcccttcaagagatgctatctgatggcaccgacaccggatcggaaatttcttcagatatcaattcatccccggagaggaacgctagcacaccttttcaaaatattttgggctaccacagtgctgcagaatcctccatctctacttcggtttttcccagaacatcgagccgggtgctgcgcgcatcccagcatccgaaaaagtggactgctgatactgtgtcgagcaaggtacaacctacagcggccgcagctgtgacactgtttcttcggaagtcatctccacctgctttgagcgcagctttggtggccaaaggcacctcatcttctcccctggccgtagcctccggccctgccaaatccagttcaatgacaactttggctaaaaatgtcaccaacaaagctgccagtggaccgaaaaggacacccggggcagttcacacagcctttccattcactcctacttacatgtatgctaggaccgggcatactactagcacacatactgcagcacggaaacatggtcattgtctatggccagtcgtgtataacttgccaccccgcaagcctcaggctatgcacaccgggcttccaaatcccactaacctggaaatgccacgggcctctacaccaaggccgctcactgtcaccgcagcactgacatctatcaccgccagcgtcaaggctactaggctgcccccactgcgggctgagaacacagatgccgtgctgcctgcagcttctgctgctgtggtgacaacagggaagatggccagcaatctggaatgtcagatgtcatcgaagttactggtgaagactgtgctgtttctcacccaaaggcgggtgcagatatccgagtctctgaaattttccatcgcaaagggcctgacccaggccctcagaaaggcctttcaccagaatgatgttagcgctcacgtcgacatcctcgagtactcacacaacgttaccgtcggatattacgccacaaagggtaagctggtgtatcttcctgctgtggtgattgagatgctgggcgtgtatggagttagcaatgtaaccgccgatttaaaacagcacaccccacatttacagtccgtcgccgtgctggcaagtccgtggaatccccaaccggcgggctacttccagctgaaaaccgttctgcagttcgtttcccaggctgataatattcaaagctgtaagttcgcccagacaatggagcaaagacttcagaaagctttccaggatgcagaaagaaaggtgcttaacactaaaagcaacctgacaattcagatagtatcaacgtctaacgcctctcaagccgtgactctggtctacgttgtggggaatcagagcactttcctgaacggcacagttgcctcctctctactgagtcaactgtcagccgagcttgttggtttttacttaacttatccaccccttaccattgcagagcctctggaatatcctaatttggatattagtgagacaactagagattattgggtgattacagtgctacaaggcgtggataattctctggtcggtctacacaatcagtcattcgctagagtcatggagcagcgcctggcccaactgttcatgatgtcacagcagcagggcagacgattcaagcgcgccacaacactgggatcatacacagtgcagatggttaagatgcagagagtgcccggtccaaaggatcctgctgaacttacttattacacattatataatgggaaacccctgctgggcaccgccgcggccaagatactgagtacgatagattctcagcgcatggccctcacactccatcatgtggtgctgctgcaggcagatccagtcgttaagaaccctccaaacaacctgtggattattgcggcagtgctggcccccatcgctgtggtgactgtaataataattatcattaccgccgtcctatgtcgaaaaaacaagaacgactttaaacccgacaccatgatcaacctaccacagcgggccaagcccgttcagggcttcgactacgcaaaacaacatttgggccagcagggggcagatgaagaggttattcctgtcacccaagaaactgtggtgctgccccttcctatcagagatgctccccaagagcgcgatgtagcccaggacgggtcgacaatcaagactgcgaaaagcacagagactcgaaaaagccgaagtccatctgagaacggtagtgttatctcaaacgaaagcggcaagccaagctccggtcgccgttcaccccagaatgtgatggcacagcaaaaagtaaccaaggaagaggccagaaagcgtaatgtgcctgctagtgacgaggaagagggtgcagtcctctttgataacagtagcaaggtcgccgcagagcctttcgacacatctagtggttcagtgcagcttattgcgatcaaacccaccgcacttccaatggttccaccaacctcggacaggagtcaggagagttctgcagtcttgaacggagaagttaacaaggcgctcaagcaaaagtctgatattgaacattatcggaacaagctacgactcaaagcgaaacggaaagggtattacgacttccccgcggtagagacatcaaagggtctcactgagcgaaaaaagatgtatgaaaaagcccccaaggaaatggaacatgtcttggaccccgactctgaactctgtgcgcctttcactgagtcgaagaatcgccaacaaatgaaaaacagcgtataccgatctaggcagtccctgaactccccatcccccggggagacagaaatggatctgttggtgactagagaaagaccccgcaggggtatacgtaattctggatacgatacagaacccgagatcattgaagagaccaacatcgaccgcgtgcctgaaccccgcggatattccagatcccgccaggttaagggtcattcagagacttccacactgagtagtcaacccagtatagatgaggttaggcagcagatgcacatgctgcttgaggaggcattttccctcgcctctgctggtcacgccggccaaagcagacaccaggaggcctatggcagtgcccagcacctcccatactccgaggttgtgacgtccgctcccggcacgatgacgcgccctcgggcaggcgtgcagtgggtgcccacatacaggcctgaaatgtatcagtactccctccccaggcccgcctatcgcttctctcagctgccagagatggtcatggggagccccccacctcctgtacctcctaggactggtccagttgctgtagcatctctacggcgctcaacttctgacattgggtcaaagacacgcatggccgagtccaccggaccagaaccggcacaactgcacgactccgccagttttactcagatgagtagggggccagtgagcgtcacacagctggaccagagtgcactcaattactcagggaacaccgtgccagccgtgttcgccatcccagcagctaaccgacccggtttcactggctatttcattcccacacctccaagcagttacaggaatcaggcttggatgtcttacgccggggagaatgaactgccaagccagtgggccgattccgtacctctgcctggatacatcgaggcatatccccggtcccgttatcctcaatcctccccttcgaggctccctcgacagtattcacagcccgccaacctccacccgagcttggagcaggccccagctccttctacagctgcctctcagcagtcattggctgaaaacgatccctcagatgcacctcttacaaatatcagcactgcagccctggtgaaggccattagggaggaggtcgctaaactggctaagaagcagactgacatgttcgaatttcaagtatag

SEQ ID NO: 182977 - DNA, 783 bp, Artificial Sequence
  Description of Artificial Sequence: Synthetic coding sequence
atgatggacccctgcagcgtgggcgtgcagctgcggaccaccaacgagtgccacaagacctactatactcgccataccggatttaaaactctacaggagctgtcatccaatgacatgttgttgctgcagctgcgcacaggcatgacgcttagcgggaataacacaatttgttttcaccacgtgaaaatttacatcgatcgcttcgaagaccttcagaaaagctgctgcgacccttttaacatacacaagaagctcgccaaaaagaacctgcacgtcatagatctcgacgatgctacttttctaagtgctaaatttggacggcagttagtgccaggctggaaactgtgccccaaatgcacacagattatcaatggatctgtagacgtggacaccgaagacagacaaaagagaaaacccgagtctgatggacgaactgctaaggcactgcgatctctgcagtttacaaatcctggcaggcagacagagttcgcccctgagaccgggaagcgagagaaacggcgcctgactaaaaacgccaccgccggcagtgataggcaggtaatcccagcaaaatccaaagtctacgactcacagggacttctgatcttctctggaatggatctctgcgactgcctggatgaggattgtctgggctgcttctatgcctgcccggcctgcggctccacgaaatgcggggctgaatgccgatgtgacagaaagtggctttacgaacaaatcgagatcgaaggtggagagattattcataacaagcatgcggggtag

SEQ ID NO: 182978 - DNA, 507 bp, Artificial Sequence
  Description of Artificial Sequence: Synthetic coding sequence
atgatggacccctgcagcgtgggcgtgcagctgcggaccaccaacgagtgccacaaaacttattatacccggcatactgggttcaagaccctccaagagctatcatctaacgacatgctgttgctgcaactccggactggcatgactctctcaggtaacaatacaatctgcttccatcacgtaaagatctacatcgataggtttgaagatttgcagaagtcctgctgtgacccctttaacattcacaaaaagttggcaaaaaaaaacctgcacgtcatcgatctggatgacgccacattcctcagcgcaaagtttgggcggcagctggttcccggatggaaattgtgccccaagtgcacccagatcatcaacgggtcagttgacgtggacactgaagatcgacaaaagcggaagccagaatcagatggcagaacagccaaagccttgagaagtcttcagtttactaaccctggccggcaaacagagtttgctccggagaccggctag

SEQ ID NO: 182979 - DNA, 180 bp, Artificial Sequence
  Description of Artificial Sequence: Synthetic coding sequence
atgcggcagctgaagggcaagcccaagaaggagaccagcaaggacaagaaggagcgcaaacaagccatgcaagaggctcggcagcaaatcacaacagtcgttctccccactctggcggtagttgtactgctcatcgtggtgttcgtgtacgtggctaccaggcctacaatcactgagtag

SEQ ID NO: 182980 - DNA, 180 bp, Artificial Sequence
  Description of Artificial Sequence: Synthetic coding sequence
atgcggcagctgaagggcaagcccaagaaggagaccagcaaggacaaaaaggagcggaagcaggctatgcaggaggcaaggcaacagatcactactgtggtccttcccaccctggccgtggttgtgctacttatcgtggtcttcgtctatgtggcgacccgcccaacaatcaccgaatag

SEQ ID NO: 182981 - DNA, 144 bp, Artificial Sequence
  Description of Artificial Sequence: Synthetic coding sequence
atgcggcagctgaagggcaagcccaagaaggagaccagcaaggacaagaaggagcggaaacaggcgatgcaggaggcgcgacagcaaatcacaacagtggtgcttcctacattggccgtagtagtcctgctgattgtcgtctag

SEQ ID NO: 182982 - DNA, 180 bp, Artificial Sequence
  Description of Artificial Sequence: Synthetic coding sequence
atgcggcagctgaagggcaagcccaagaaggagaccagcaaggacaagaaggaaaggaagcaggccatgcaggaggcccgtcaacagataaccacagtggtgcttcccaccctagccgtggtggttctcttaattgtggtctttgtgtatgtggctacccggccaacgattacagagtag

SEQ ID NO: 182983 - DNA, 159 bp, Artificial Sequence
  Description of Artificial Sequence: Synthetic coding sequence
atgcggcagctgaagggcaagcccaagaaggagaccagcaaggacaagaaagagagaaaacaggcaatgcaggaggcccgccaacagattaccactgtggtgctgcccactttggcagtggtcgttctgcttatcgtggtcttcgtctacgtagcttag

SEQ ID NO: 182984 - DNA, 3336 bp, Artificial Sequence
  Description of Artificial Sequence: Synthetic coding sequence
atgcactggctgcccgccggccacgacatcaacggcgccctggagcccagcaacattgacacctcaatcttagaggagtatatctccaaagaggacgcatcagacctgtgcttcccagacatatcagctcctgcgtcatcggcttcctatagtcacggtcaacctgctatgcccggctctagtggggtgcatcacctctccccccccggcgggggtccaagtcccggtagacacgggcctttgcccccaccgggctacggcaccccactgaattgtaataataataatggaatgggagcagcccctaagccatttcccggagggaccggacctcccattaaggccgaaccaaaagcaccctatgccccagggactctccctgatagtcctccggactctgggtcagaagcttacagtccccagcaggtgaacgagccccaccttctgaggacgatcactcccgagactctctgtcatgttggtgtcccaagccggcttgagcacccaccacctccccccgcccacctgcctggacctcctcctccccccccaccgcctcctcactaccccgtgctccaacgggacctgtacatgaaagctgagcctccgattccacattacgccgccatgggtcagggactggtacccacagaccttcatcacactcaacagagccaaatgctccaccagttactgcagcaacacggagctgagctcccaactcaccccagtaagaagcgaaaacacagtgagagcccaccgagcaccttaaatgcccagatgctgaacggaatgatcaaacaagagccgggaactgtaaccgctttacccttgcatccgacacgggccccgagtcccccttggccaccccagggcccgttgagtcccggaccaggctctctccccttatcaatcgccagggtgcagacccccccctggcatccacccggtgccccgtcgcccggcttgctgcaggacagcgattccctgagtgggtcttatctggaccctaactaccaatccatcaagtggcaacctcaccagcagaataagtgggccacactctatgatgccaattacaaggagctgccaatgctgacttatagggtcgatgcagacaaagggtttaactttagcgtcggtgacgatgccttcgtttgccagaagaaaaatcactttcaggttacagtctacattggcatgctgggcgaacccaagtacgtgaaaaccccagaggggctgaagcctctcgactgtttttatttgaagctgcatggagtgaaacttgaagccttaaaccagtcaattaatatcgagcaatcgcaaagtgacaggtcaaagcggcccttcaatcctgtcacggtgaacctgccacctgaacaggtcacaaaagtgaccgttggccggcttcacttctcagaaactacagcgaacaatatgaggaagaaggggaagccaaacccagatcagcggtatttcatgttggtggtggctctgcaggcacatgcccagaaccagaactacacactcgctgcacagatctcagaaagaattattgttagggccagcaatcctgggcagtttgagagcgattccgatgttctatggcagagagctcaggtgccggacaccgtatttcatcacggtcgtgtcggcattaataccgacaggcccgatgaagctctggtcgtccacggaaatgtcaaagtaatgggctcactgatgcaccccagcgatttacgggccaaagagcatgttcaagaggtggatacaacagagcagttgaagaggatcagtcgaatgaggctcgttcattacaggtataagccggagttcgccgcctctgctggtatcgaagcgaccgcacctgaaaccggcgtgatcgcacaggaggtaaaagaaatcctgccggaggccgtgaaggacactggagatatggtttttgcaaatggaaaaacaatagagaatttcctggtagtcaacaaggagaggatctttatggaaaatgttggagctgtgaaggagctctgcaaactcaccgacaaccttgagacaaggattgatgagctggagcggtggtctcacaaactggcaaaactgcgtcgccttgacagtctaaagtcaacaggctcatctggtgccttttcccatgccggatctcaatttagcagggccggatcggtacctcacaagaagaggccccctaaagttgcctcgaagagctcttctgtggtgccagatcaggcatgcattagccagcgtttcctccaggggactattatcgcactcgtggtcgtcatggctttttcagtggtcagcatgagtactctctatgtactcagtcttcgcacagaggaagatctggtggatacagatggcaggagctcccagagttttggcactacgcagctgagacagagccccttaaccaccgggctgcctggcatacagccatctctgctccttgtgacaaccagcctgacatcctccgcacccggaagcgccgtgagaacattggatatgtgttcatctcacccgtgcccggtgatttgttgtagctctccaacaaccaatcccaccaccggtccctcactcggtcccagctttaatccaggccacgtcctgagtcccagcccaagtcccagtactaatagatccggcccgtcccagatggcactgcttccagtcaccaatatacgtgcaaaatcatggggcctgagcgtaaacggcatcggccacagcaagcatcataagtcactggaacccctggcctctccggccgtgccctttccaggggggcagggcaaggccaagaattcaccttctctgggcttccatggaagggcccggaggggcgccttgcagtccagtgtggggcccgctgaaccaacctgggctcaaggccagtcagaacctgtgccatcacttacttcgatccaggtgctggagaatagtatgtcgataaccagccaatattgtgcaccaggagacgcttgccgacctgggaacttcacataccacatacctgtgagctctggcacacctctccatctatctcttacacttcaaatgaactcctctagtccagttagtgtggttttatgcagtctcaggtctaaggaagagccatgtgaagagggaagcctacctcaaagtctgcacactcatcaagatacccagggcacctcacacagatggccaatcaccatactgtcctttagagagttcacataccatttcagagtggctttgttgggccaggctaattgttccagcgaggcccttgcgcagccagctaccgactatcacttccacttttaccggctctgtgattag

SEQ ID NO: 182985 - DNA, 3456 bp, Artificial Sequence
  Description of Artificial Sequence: Synthetic coding sequence
atggaggtggtggacgagaccgaggccctgcagcggttcttcgaggggcacgacatcaacggcgcgctggagccttcgaacattgataccagcatactcgaagaatacatctccaaggaggacgccagcgatttgtgctttccagatatttctgcaccggccagcagcgccagttattcccatgggcaaccagcaatgccagggtcctccggagttcaccatctgagccccccaggtggaggcccatctccgggtcgccatggcccattgcccccacccggctatggaactccattgaattgcaacaataacaacggcatgggagccgcacccaagcctttcccagggggcaccggtcctccaatcaaggctgaaccaaaagcaccttacgcaccaggtaccttgcccgattcccccccagacagtggttccgaggcctactctcctcagcaggttaacgagccccatttgctcaggactataacacctgagacactttgccatgtaggcgtccccagcaggctggaacacccaccccctcctcccgcgcatcttcctgggcccccacctccccccccccctcccccacactacccagtgctgcagcgcgatctctacatgaaggctgaaccgcccattccacattatgctgctatgggccaagggctggtacccaccgatctacaccacacacagcagtcccagatgctccatcaactgcttcagcagcacggcgccgaattgcctacccatccttcaaaaaagcggaaacacagcgaatcacccccatctacgttaaatgcccaaatgctaaatgggatgattaagcaggagcctggaactgtcacagctttgccattgcaccccacccgtgcacctagccccccgtggcctccacaaggcccgctgagtcccggcccaggctctctgcctctatccatagccagggttcagacaccaccgtggcatccgcccggagccccctcgcctggtctattgcaggattcagatagcctctctggttcctacctggatccaaactatcagtcgataaaatggcaaccccaccaacagaataagtgggctacactgtacgacgccaattataaagaactgcccatgctcacatacagggtcgatgccgacaaaggctttaacttctcagttggcgacgacgcttttgtgtgtcagaagaagaaccatttccaggtgacagtctacattggcatgctgggcgagccgaagtatgtcaagactcctgagggattgaagcccctagactgcttttacctgaagctccacggggtcaaattggaggccttaaaccaatccatcaacattgaacaaagtcaatccgaccgaagtaagcggcccttcaatccggtgactgtgaacctgccacctgagcaggtcaccaaagtgactgttggacgccttcatttctccgagacaacagccaacaatatgcggaagaagggcaagcctaatcccgaccagagatatttcatgctcgtggtggctttgcaggcacatgctcagaaccagaactatacgctggcagctcagatcagcgaacgaataatcgtgagagcgagtaatcctggacagttcgagagcgatagcgatgtcctatggcagcgtgcccaggtgcccgacacagtctttcaccatggccgggttggtattaacaccgatcgtcccgacgaagccctcgtggtccacgggaatgtaaaagtaatgggctccttaatgcacccttccgacttgagggcaaaagaacacgtccaagaggttgacaccaccgagcaattgaaaagaattagccgcatgaggctggtacactataggtataaacctgaatttgctgcatccgccggcattgaggccactgcccccgagactggagtgatcgctcaggaagtgaaagagattcttcccgaggcggtgaaggataccggggatatggtgttcgccaatgggaaaaccattgaaaacttcctcgtggtgaacaaagagcgtatttttatggaaaacgtgggcgcagtcaaagagctctgcaagctgaccgataacctggagacacgcattgatgagctggaaaggtggtcccacaaacttgccaaactacgccgtctggatagcctgaagtctaccgggagtagcggagcattctcccacgcagggtcccaattcagcagagctgggtctgtgccccataagaagagaccacctaaagtcgcctcaaagtccagcagcgtggtcccggaccaagcatgtattagccaaaggttccttcaaggcaccatcattgcgctggtggttgtgatggcctttagtgtcgtgtcaatgtctactctgtacgtgttgtctctgagaacagaggaagatctcgtggatactgatggatctttcgcagtgagcacatcctgcttgctggcattgcttagaccacagcccccaggcggctccgaggctctatgtccttggagcagccaatcattcggtactacacagctccgccagagtcccctgacgactgggctcccagggatccaaccaagcctattactcgtcacgactagcttgacttcgtctgcccctggtagcgctgttagaaccctcgatatgtgttctagccatccgtgccctgtcatctgttgttcctcgccaaccaccaacccgacaaccggccccagcctgggaccgtcatttaacccagggcacgttcttagcccttcgccaagtccctccacaaaccgaagtgggccatcccagatggcccttctgcccgttacaaacattcgtgctaaatcctgggggctgagtgtgaatggaattggccattcgaaacatcataaatctctggaacctctggcttcgccagctgtacccttccccggggggcagggcaaggcgaagaattctcccagtctgggttttcatggccgggccaggcgcggagcactgcagtcttcggtgggacccgctgagccgacatgggcacaggggcagtcagcctccctgcttgcggaacccgtcccatccctgactagtattcaggtcctagaaaacagcatgagtatcacttcgcagtactgtgcgccgggtgacgcctgccggcccggtaactttacctatcatatccccgtaagctctggaacccccctccacctttccctgacgttgcagatgaactcttcaagccccgtgagtgtcgtcctgtgctccttgcgcagtaaagaggagccgtgtgaggaggggagcctaccacaatccctgcacacacaccaggacacccaggggacgtctcatcggtggccaattactattctaagcttccgcgagttcacttaccacttcagagtagccctactgggccaagccaactgttccagtgaggccttggctcagccagctacagattaccattttcatttttacagactatgcgactag

SEQ ID NO: 182986 - DNA, 1449 bp, Artificial Sequence
  Description of Artificial Sequence: Synthetic coding sequence
atgctgacctaccgggtggacgccgacaagggcttcaacttcagcgtgggggatgatgctttcgtatgccaaaaaaaaaatcattttcaggttaccgtgtatatcggcatgctgggcgaacctaagtacgtgaagacacctgaaggcttaaagccactcgactgcttttatttaaaactgcacggcctcgaagccctgaaccagagcatcaacattgagcagtcacagtccgacagatcgaagcgcccattcaaccctgtgacagtgaatctcccccccgaacaagttacaaaggttacggtagggagactgcacttctcagagaccactgctaacaacatgagaaaaaagggcaaaccaaatcctgaccagaggtactttatgctggtggtcgcactgcaggcacatgcccagaatcaaaattatactctggcggcccagatctctgagaggattatcgtgagagcgtccaacccagggcagtttgagtctgactctgacgtactctggcagcgagctcaggtccccgatactgtgttccaccatggccgagtgggtattaacaccgaccgcccggatgaggcattagtagtgcatgggaatgtgaaagtgatgggaagcctgatgcacccgtcagacctacgggcaaaggaacatgtccaggaggtggatacaactgaacaattgaagcggatttctaggatgcgactcgttcactatcgttataagcctgaattcgccgcttcagctggaatcgaggctactgcaccagaaactggcgtcattgcacaggaggtgaaggaaattcttcccgaggccgtgaaggatacaggagacatggtattcgccaatggtaagactatagagaatttcctggtggtaaataaggtctgcggcctgaaatatgtggtgtattgtgaggatgacgtgtgtcacctccccgtgctgagtcttggcgcaaaagaggcttgggcagtgaaagaactgtgtaagctcactgataatctcgagactcgcattgatgaacttgaaaggtggtctcacaagttggctaagttgaggaggttagatagcctgaagagtactgggagtagcggagccttctcgcatgccggctcacagttttccagagccggctccgtgccccacaagaaaaggccccccaaagtagctagcaaggtcggctcgtcaagcgtggttccagatcaagcttgcatcagccagcgattcctccaaggcactattatcgcgttggtggtggtgatggccttccgccaccacctaggggcccagccccaggaacaaggacctcagccctgcccccgggagagagcgctggatggaggtagcagttccaacggccacccatttttatggctgcaaaggggggttcatgttcacaccgtgcgggccgaacctgcacaccggggcggaccagggcgacactag

SEQ ID NO: 182987 - DNA, 789 bp, Artificial Sequence
  Description of Artificial Sequence: Synthetic coding sequence
atggccgcccccagcggcaccgtgagcgacagcgagagcagcaactcgtcctctgatgcggaggagctggaacggtgtcgcgaagccgctatgccggcttggggtctcgaacagaggcctcacgtggcaggtaagcctagggcaggagccgccaactcccagctgtctacttcccagccaagcctcagacacaaggtgaatgaacatgaacaggacggaaacgagcttcagaccacccccgaatttcgggcgcatgtggccaagaaactaggagctctgctcgattcgtttattaccatttctgaggcagctaaagaacctgctaaggctaaagttcagaaggtggccttggaagacgacgggtttaggctttttttcactagtgtgcctggcgggagggaaaaagaggaaagtccacagcctcgccggaagcgtcagcccagctcctcatccgaggacagtgatgaggagtggcgacggtgtagggaggccgcggtctcagcttcagacatccttcaggagagcgccatccacagccccggcaccgtggagaaggaggctaagaagaaacgaaagcttaagaagaaagctaaaaaggtcgcgagtgttgatagtgccgtcgccgccaccaccccaacctcgatggccacggttcagaaacagaaaagtggggagttaaacggagaccaggtgagccttgggacgaaaaagaaaaaaaaagccaagaaagcttcagagacaagcccattcccgccagccaagtccgcgacagccattccagccaactag

SEQ ID NO: 182988 - DNA, 666 bp, Artificial Sequence
  Description of Artificial Sequence: Synthetic coding sequence
atgttctgccagaaccccggcgccgccaacagccagctgagcacctctcagccatcgctgcgccataaagttaacgaacacgagcaggacggaaacgaactgcagactactccggaatttagggcccatgtggcaaagaaactcggtgcactgctggacagcttcataactataagcgaggcagcaaaggagcccgccaaagccaaagtgcagaaagtcgcccttgaagacgacggattccggctgttttttacctcagtgccaggcggccgagaaaaagaggaaagcccccagccccggaggaagagacaaccatcatcttcctccagtgaggactctgacgaggagtggagaaggtgtcgggaggccgctgtgagcgcaagtgacattcttcaggaatcagccatccactcacccgggactgtggagaaagaagctaagaaaaaacgaaaactgaaaaagaaagctaagaaggtcgcgtctgtggattccgctgttgccgcaacgactccgacgtctatggccactgtgcagaagcagaaatccggggagcttaatggcgaccaggtatcactcggcacaaaaaagaaaaagaaggccaagaaggcctctgagacaagtcccttccctcctgccaaaagtgccactgctattccagcgaattag

SEQ ID NO: 182989 - DNA, 699 bp, Artificial Sequence
  Description of Artificial Sequence: Synthetic coding sequence
atgcccgcctggggcctggagcagcggccccacgtggccggcaagccccgggctggggctgccaactcccagctgagtacttctcagccatctctgcggcataaagtgaacgaacacgaacaggacggaaacgaactgcagacgacgcctgaatttagggcacatgtggcgaaaaagcttggagcgctcttggattcttttatcaccatctcagaggccgcgaaggagcctgccaaggctaaagtacagaaagtggccttggaagatgatggattcaggttgttcttcaccagtgttccgggtggccgggagaaagaagagagtccacaaccaaggcggaagaggcaaccctcctcctcatctgaagacagcgacgaggagtggcgcagatgtagagaagctgctgtctcagcatccgatatcctccaagaatccgccattcactcaccggggactgtagagaaggaagccaagaagaaacgcaagctcaaaaagaaagctaaaaaggtggcctccgtggatagcgccgtggcggccacaactccgacatctatggcgactgtgcagaaacagaagagcggagagttgaacggcgatcaggtatccctggggacgaagaagaagaagaaggccaagaaagcatcagagacctcgccctttcctccggccaaatctgccacagccatccccgccaactag

SEQ ID NO: 182990 - DNA, 1497 bp, Artificial Sequence
  Description of Artificial Sequence: Synthetic coding sequence
atggacgtgaccgaccactacgaggacgtgcggaagatctacgacgactttttaaagaatagtaatatgttagatttaatcgatgtgtaccagaagtgtagagctctcacctctaactgtgagaattataatacagtctcaccgtcacagctactggatttcctgagtggcaagcagtatgccgttggggacgagacagaccttagtattcctacatctcctacctctaagtacaaccgggacaatgaaaaggtccaactgctggcgcgcaagatcattttttcatacctcaacttactggtgaattccaaaaacgacctcgccgtcgcatatatcctgaatatacctgaccgtggactaggtagagaagctttcaccgacctcaagcacgctgctagagaaaagcagatgagcatcttcctggtggctacttcattcataaggacaattgagctcggcggcaaaggctacgctccaccacctagtgatccccttcgcactcacgtgaaaggtttgagtaacttcatcaacttcattgacaaactggatgaaattctgggtgagatacctaaccccagtatcgccgggggccagattcttagcgtgattaaaatgcagttgattaagggtcaaaactcacgggatcctttctgcaaggctattgaggaggtggcacaggatctggacctgcgcattaaaaatatcatcaactctcaagagggcgttgtggccttatcaactacagacatttcgcctgcgcgtcccaagagtcatgccataaatcatgggactgcctactgtgggcgggataccgttaaggcacttctcgtgctgctcgatgaggaagctgctaacgctcccacgaaaaataaggctgagcttttgtacgacgaggagaataccattcaccaccacggcacaagcatcctgacactatttaggtcacccacccaagttaacaactctatcaagcctctcagagaaagaatatgtgtgtctatgcaagagaaaaaaattaagatgaaacaaactctcatccgctctcagttcgcctgcacctacaaagatgactatatgataagtaaagacaactggaataatgttaacctggcatctaaacccttgtgcgtgctttacatggagaacgacttatccgagggggtcaacccttccgtaggacgatccaccatcggcacctcattcggaaacgtgcatctcgatcgatccaagaatgaaaaggtttctcggaaaagtacctcacagactggcaataagtcaagcaaaaggaaacaggtagacctggatggcgaaaacatcctgtgcgataataggaacgaacccccccagcataagaatgcaaaaattcctaagaaatcaaatgactcacagaaccgtctctacggaaagctcgcgaaggtggccaagtcaaacaagtgcacggcaaaagacaagctcatttccggacaggccaaacttactcagttcttccggctgtag

SEQ ID NO: 182991 - DNA, 1740 bp, Artificial Sequence
  Description of Artificial Sequence: Synthetic coding sequence
atggccgtgttcaaccagaagagcgtgagcgacatgatcaaggagttccgtaagaactggcgtgccctttgcaactcggagcggaccaccctctgcggagctgattctatgctgcttgccctgcaactgtcaatggctgagaataataagcagcacagtggcgagtttaccgtttcgctgtcagatgtcctgctgacgtggaagtatctgcttcacgagaagcttaatcttcctgttgaaaacatggatgtgacagaccactacgaggacgttcggaagatttatgacgacttcctgaagaatagcaatatgttggatttaattgacgtgtatcaaaaatgtcgagccttgacttcgaattgtgaaaattacaataccgtgtctccatcccagctcctggattttctgtcaggtaagcaatacgccgttggcgatgaaactgacttaagtatacctacctctccaaccagtaagtacaatagggacaatgaaaaggtgcagctcctggcacgaaaaatcatatttagttaccttaatcttctggtgaactcgaaaaacgatctcgccgtcgcctatatcttgaatatccccgataggggtttgggaagggaggcttttaccgatcttaagcacgccgcaagagagaagcagatgtcaatctttctagtcgccacatctttcattcgcacaatcgagctcggtggcaaaggatatgctccacctccatccgaccctctaagaacccacgtgaaggggctctccaattttattaatttcattgacaaactagacgagattttgggagaaatccccaatccaagcatcgctggcggccagatcctgagtgtgattaagatgcagttgatcaaggggcagaattcccgggatcctttttgcaaagcgatcgaggaagtcgcacaggacttggatttgagaataaagaacattattaactctcaggagggagtcgtggcgttgtctacaacagacatctcccctgcacgccccaaaagccacgcgattaatcacgggaccgcttattgcgggcgtgacactgtcaaagcgttgttggtgctcctggacgaggaagccgctaacgcaccaaccaagaacaaagccgagctactttatgatgaggagaacacaatccaccatcacgggacctccatcctgaccctgtttagaagccccacccaggtgaataatagtattaagcctctacgggagaggatctgcgttagcatgcaagagaaaaaaataaagatgaagcagacacttattaggagccagttcgcctgcacttacaaggatgactatatgatctctaaggataactggaacaacgtcaatctagcctccaaacctctctgcgtgctctacatggagaacgacttgagcgagggagtgaatccctctgtgggcaggtctacaatcggcacctcatttgggaacgtacatctggacaggtcaaagaatgaaaaggtgtcgagaaaatccaccagccagactggaaataagtcttctaagcgcaaacaggtggacctggatggggaaaatattttgtgcgacaacaggaatgagcccccacagcataaaaacgccaaaatccctaaaaagtctaatgactcccagaacaggctgtacggcaaactggcaaaggtcgcaaagtcgaacaagtgcactgctaaggacaaactgatcagcggccaagccaagctgactcagttttttagactgtag

SEQ ID NO: 182992 - DNA, 894 bp, Artificial Sequence
  Description of Artificial Sequence: Synthetic coding sequence
atggccgtgttcaaccagaagagcgtgagcgacatgatcaaggagtttaggaagaactggagagcactgtgtaattctgagcgtactaccttatgcggagctgatagcatgctcctcgctttgcagttgagcatggctgagaacaacaaacaacattccggggaatttactgtctcactgtcggacgtcctgcttacgtggaagtatctcctgcacgagaagttgaaccttcccgtggagaatatggatgtgaccgaccactacgaggacgtgcgcaaaatctacgatgacttcctgaagaatagtaatatgttagacctgatcgacgtgtatcagaaatgtagggcgttgacatctaattgcgaaaattacaataccgttagcccttcacagttgctggactttctgagtgggaaacagtatgctgtaggggatgagaccgacctctctatcccgacctcgcccacctctaagtataacagggacaatgagaaagtgcaactgctggccaggaaaattatcttctcctacctgaacctgctggttaattccaagaacgatctggccgtggcatatatcctgaacatccctgatcggggactcggaagagaagcctttacagacctcaagcatgctgcccgcgaaaagcagatgtcaattttcttggtggccacaagtttcattaggaccatagaattgggtgggaagggctacgccccccctccatccgatccgcttagaactcacgtgaagggtctaagtaactttattaatttcatcgataagctggatgagatcttgggagagattccaaatcctagaggatgcaaaagtatctgctggaaaatcaacaactggaacgagttctggaagtgcagctcagggcagaaatag

SEQ ID NO: 182993 - DNA, 1497 bp, Artificial Sequence
  Description of Artificial Sequence: Synthetic coding sequence
atggacgtgaccgaccactacgaggacgtgcggaagatctacgacgactttctgaagaactctaacatgcttgatttaatagatgtttatcagaagtgccgggccctgaccagcaattgcgaaaactataatacagtgtcaccatcccaattattggattttctttctggtaagcagtacgcggtaggcgacgaaacagacctctccattcccaccagccccacgagtaagtataatcgggataatgaaaaagtgcagctgttggcacgcaagatcattttttcctacctgaatctcctggtgaactcgaaaaatgacctagcagtagcctatattctgaacattcccgaccgcgggctggggagagaagcatttactgatttaaaacacgccgcgagagagaagcagatgtctatcttcctagtcgctactagtttcatcaggaccatcgaactcggcggtaagggatacgccccccctccatcagaccccctccgcactcatgtcaaagggctttctaactttatcaactttattgacaaactggatgagatcctcggcgagataccaaatccaagcatcgccgggggccagatcttgtccgtcattaagatgcagctcatcaaaggtcagaactctcgggatccattctgcaaggccattgaggaagtggctcaagacctggatctccggattaagaatatcattaactcacaggagggcgttgtggccctgtctactacggatatatctcccgctcgccccaagagccatgccatcaaccacggcaccgcatattgcggccgcgatacggtgaaggcgctgctggtcctcctggatgaggaggcagccaatgctccaacaaagaataaagctgagctcttgtacgacgaagaaaacaccatacaccatcacggaacctcaattcttacactattcaggagcccaactcaggtgaacaattctatcaaaccactccgggagcgaatctgcgttagcatgcaggagaagaagatcaagatgaagcagaccctgattaggtctcagtttgcttgtacgtataaggacgactatatgatctcgaaagacaattggaacaatgtaaatctcgccagtaaacctttgtgtgtgctgtacatggagaacgacctgagcgaaggggtgaacccatcggtcgggcggtccacaatagggacctcatttggcaacgtccacctagaccgttcgaagaacgaaaaagtctccagaaaaagtactagccagactgggaacaagtcaagcaagagaaagcaagtggatttagacggtgagaacatcctctgtgacaaccgaaacgagcccccccagcacaaaaacgctaagattcctaagaaaagcaacgactcccagaataggttgtacggtaagctggccaaggtggcaaaaagtaacaaatgtaccgcgaaggacaagctgatcagtgggcaagctaagctcacccaattcttccgattgtag

SEQ ID NO: 182994 - DNA, 813 bp, Artificial Sequence
  Description of Artificial Sequence: Synthetic coding sequence
atggcccggttcgccctgaccgtggtgcggcacggcgagacccggttcaacaaagaaaagattatccagggacagggggtcgatgagccactgtcggagaccggatttaaacaggccgccgcagccgggatctttctgaacaacgtgaaattcacccacgccttttccagcgatttgatgaggaccaagcaaactatgcatgggatccttgaacggagcaaattttgcaaagacatgacagtgaagtacgattcaagattaagggaacgcaagtacggggtcgtggagggaaaggccctaagtgagctgcgcgccatggccaaggctgcccgggaggaatgccccgtcttcactcccccgggcggcgaaacgcttgatcaggttaagatgagaggcatcgactttttcgaattcctgtgtcagctgatcctgaaagaggccgatcagaaggagcaattttcccagggcagtccttccaattgcttggagacgtctctagctgagatctttcctctaggcaaaaaccattcttcgaaggtgaacagtgattccggaattccaggattggctgctagcgtgttggttgtctcccatggtgcgtatatgcgctccttgttcgattacttccttactgatctcaagtgctccctcccagcgactttgagcaggtcagaactgatgtcagtcacacccaacaccggaatgtcactgttcatcataaacttcgaggaaggtagagaagtcaaacccaccgtgcagtgcatctgcatgaacctgcaagatcatcttaacggcctgactgaaactaggtag

SEQ ID NO: 182995 - DNA, 501 bp, Artificial Sequence
  Description of Artificial Sequence: Synthetic coding sequence
atgagcaccgtgggcctgttccacttccccacccccctgacccggatctgtcctgctccttgggggctgaggttgtgggaaaaactgacactcctctctccagggatcgctgtcacaccggtgcaaatggcgggcaagaaggactatccggccctgctgagtttagatgagaatgagcttgaagagcaattcgttaagggccacggaccaggcgggcaggccaccaataagacctcaaattgcgttgtgctgaaacacatcccctctggtatcgttgtcaagtgccatcagactaggtctgtcgatcagaaccgaaaactggcgcggaagatcctgcaagagaaggtggacgttttctataacggcgagaattcaccggttcataaggagaaacgggaggccgctaagaagaagcaggaacggaaaaagagagcaaaagagaccctcgagaaaaaaaaactactcaaggagctctgggagtcaagcaaaaaagtgcactag

SEQ ID NO: 182996 - DNA, 501 bp, Artificial Sequence
  Description of Artificial Sequence: Synthetic coding sequence
atgagcaccgtgggcctgttccacttccccacccccctgacccggatatgccctgctccatggggactccgcttgtgggagaaactgacattactatctccgggcatagctgttacccccgtgcagatggctggcaagaaggattaccccgcgctgctatcgctggatgagaatgaactggaagagcagttcgtgaaaggccacggccctggaggccaagctacaaataagacgagtaattgtgtggtgctcaagcatattccatccgggatcgtggttaagtgccaccagactagaagtgtcgatcagaaccgcaaattggccaggaagatcctgcaagagaaagtggatgtcttctacaacggggagaacagtcctgtacataaggaaaagagagaggccgccaagaaaaagcaggagcggaaaaagagggccaaggagaccctggaaaaaaagaagttgcttaaggaattgtgggagtcaagcaagaaggttcactag

SEQ ID NO: 182997 - DNA, 501 bp, Artificial Sequence
  Description of Artificial Sequence: Synthetic coding sequence
atgagcaccgtgggcctgttccacttccccacccccctgacccggatttgtcccgctccctggggccttcgcctgtgggaaaaattgaccctgctcagccctgggatagccgtgacacctgttcaaatggccggcaaaaaggattatcccgccctcctcagcctcgacgaaaacgagttagaggagcaattcgtgaaaggacacggtccaggagggcaagccacaaataagacatctaattgcgttgtgctcaagcacatccccagtgggattgtggttaagtgccatcagacacgctccgttgaccagaatagaaaactcgcccggaaaatactgcaggagaaggtggacgtcttctacaatggggagaactcccccgttcacaaagaaaagcgcgaagcagccaagaagaaacaggagaggaagaagagagcgaaggaaacacttgaaaagaaaaaactcctgaaagaactctgggagtcaagcaaaaaagttcattag

SEQ ID NO: 182998 - DNA, 111 bp, Artificial Sequence
  Description of Artificial Sequence: Synthetic coding sequence
atgagcaccgtgggcctgttccacttccccacccccctgacccggatctgccccgccccctggggtctcaggctctgggagaaattgaccctgttatcccccggcatttag

SEQ ID NO: 182999 - DNA, 417 bp, Artificial Sequence
  Description of Artificial Sequence: Synthetic coding sequence
atgagcaccgtgggcctgttccacttccccacccccctgacccggatttgtcccgcaccctgggggctccggctatgggaaaagctcaccctactgagtccaggaattgccgtgacacccgttcaaatggccggcaagaaagactaccccgccctactgtctcttgacgagaatgaattggaggaacagttcgtaaaggggcatggaccaggaggccaagccaccaacaaaacgagcaattgcgtggtactcaagcacattccctctggtattgtggtgaaatgccatcaaacccgatcagttgatcagaacaggaagcttgccaggaaaattctgcaggaaaaggtcgacgtcttctataatggcgagaattctcccgtacataaagaaaagcgtgaggccgcaaaaaagaagtag

SEQ ID NO: 183000 - DNA, 291 bp, Artificial Sequence
  Description of Artificial Sequence: Synthetic coding sequence
atgagcaccgtgggcctgttccacttccccacccccctgacccggatttgccctgctccgtggggcttgagattgtgggagaaactgacgttactgtcacccggtattgccgtcacaccggtgcagatggcagggaagaaagattacccggctctgctcagcctggacgagaacgagcttgaggaacagtttgtgaagggccacggccccgggggccaggccacaaacaaaacttcgaattgtgtcgtgctcaagcacatccctagcggtattgttgtcaaggtggactag

SEQ ID NO: 183001 - DNA, 423 bp, Artificial Sequence
  Description of Artificial Sequence: Synthetic coding sequence
atgagccggttcctgaacgtgctgcggagctggctggtgatggtgagcattattgcgatgggaaatactcttcagtcattcagagaccatacattcctgtacgaaaaactgtacacagggaaacccaatttagttaatggactccaagcacggactttcgggatctggaccctgttgtcgtctgtcatcagatgtctgtgcgcgattgacattcacaataagaccctctatcatataactctgtggacattcctcctggcattggggcactttcttagcgaactgttcgtttatggcacggcggctccgacaatcggagttttggctccactcatggtagcttcattctcaatcttgggcatgctagtgggtttacgctacctggaagtcgagccagtgtcacgccagaagaagaggaattag

SEQ ID NO: 183002 - DNA, 1443 bp, Artificial Sequence
  Description of Artificial Sequence: Synthetic coding sequence
atgaaccggaccaagggcgacgaggaggagtactggaacagcagcaagtttaaggcttttaccttcgacgacgaagatgatgagttgtcgcagctgaaggagtccaagcgagctgttaattccctgagagacttcgtcgacgacgacgatgacgatgacttggagagagtttcctggtcaggtgaacctgtgggctctatctcctggagcatcagggagacagccggcaactcgggatcaacccacgaaggcagagagcagcttaagtcaagaaatagtttctcatcctatgcacagctcccgaagccaacaagtacgtattctctatcatcttttttccgggctctcagcgacactcctgcaaagagctacgctccagagctgggtaggcctaagggcgaatatcgggactatagtaacgactggtcaccaagtgatactgtgaggcgcctccggaaaggcaaagtgtgttccctggagcgatttaggtctcttcaggacaaactgcagttactggaggaagccgtgtctatgcacgatggtaacgtgatcactgccgtcttgattttcctgaagcgtacactgtccaaggagatcctgtttagggaactggaagttaggcaggttgctctacggcatcttattcattttctaaaagaaattggcgatcaaaaactcctgcttgatcttttccgctttttggacagaacggaggaactagccctgagccattatagggagcacttgaacattcaggatccagataagagaaaagaatttctcaagacctgtgtcggactccctttctcagctgaagattccgcccacattcaggatcattatacactgctcgaaagacagatcatcatcgaggcaaatgatagacacctggaatcagccggccagaccgagatctttagaaagcacccccgcaaagccagcattcttaatatgccacttgtcaccacgctgttttattcttgtttctaccactacacggaggctgagggtaccttctccagcccagtaaacctcaagaagaccttcaagattccggataaacaatatgtgctgacggcccttgctgctcgcgccaagctcagggcctggaacgacgtagatgccttgttcaccacaaaaaattggctcggctacacaaagaagcgagctccaattgggttccatcgcgtggtagagattctccacaagaataatgctcctgtccaaattcttcaggagtatgtgaacctcgtggaagatgttgacacaaaacttaatctggctacaaagtttaaatgccacgatgtagtcatagatacttaccgagatttgaaggacaggcaacagttgctagcctacaggtctaaggtggataaggggagcgccgaggaggaaaaaatagacgccttgctgtccagctctcagatacgttggaagaactag

SEQ ID NO: 183003 - DNA, 1482 bp, Artificial Sequence
  Description of Artificial Sequence: Synthetic coding sequence
atgaaccggaccaagggcgacgaggaggagtactggaacagcagcaagtttaaggctttcactttcgatgatgaggacgacgaattatcgcagctgaaggagtctaagagagctgttaactccctccgggacttcgtcgacgacgatgacgatgacgatttggaaagagtgtcctggtcgggtgagcccgtgggctcaattagctggtccattagagaaaccgccggaaacagcggttctacccacgagggtagggaacagctaaaaagcagaaattcttttagcagctatgcccagctgccaaagccaacttctacatactccctgtcctcctttttcagggggcggacccggccggggtcattccagtctctgtctgatgccctgtcagatacacctgccaagtcatatgctcccgaattggggagacccaaaggagaatatagggattattctaatgactggtccccttcagataccgtgcgccggctgcgcaaaggcaaagtatgttccctcgagaggttcagatccttacaggataagctgcagctgctggaggaagctgtaagcatgcatgatggcaatgtgatcaccgccgttcttatcttcctgaagcgcacactctccaaagagatcctgtttagagagctggaagtgcgccaagtggctctccgccacctgattcatttcctgaaggagatcggagaccaaaagctcttacttgacctttttcgatttctggacaggacagaggagctggctctctcccactaccgcgagcacctgaatatccaggacccagataagcggaaagaatttctaaagacatgtgtgggactccccttttcggccgaggatagtgcccatatccaggaccattatacactgttagagcggcagatcatcattgaggctaatgaccgtcaccttgaatcggccggacagactgaaatttttcggaagcaccctcgcaaggcatcgatcctgaatatgccactagtcaccacactgttctattcctgcttctatcactacaccgaagccgaaggcactttttcttcccctgtcaatctgaagaaaacttttaaaatccccgacaagcagtatgtgctgaccgccctagccgcccgtgccaaattgagagcttggaacgatgtggatgcactctttacaactaaaaactggctgggatacacaaagaagagagcacccattggcttccaccgcgtggtggagatccttcacaagaacaacgcgccagtacagattctacaggaatacgtcaacttagtggaagatgtcgacacaaagctaaatctcgccacaaaatttaaatgccacgatgtggtcatcgacacatatagggatctgaaagacaggcagcagctgctggcttaccggagcaaggtggacaaggggagcgccgaagaagagaaaatcgacgcgctgctgtcctcatcacagataaggtggaagaattag

SEQ ID NO: 183004 - DNA, 1335 bp, Artificial Sequence
  Description of Artificial Sequence: Synthetic coding sequence
atgaaccggaccaagggcgacgaggaggagtactggaacagcagcaagtttaaggcctttactttcgatgatgaagacgacgagttatcacagctgaaagaatcaaagagggctgttaacagcctgcgagacttcgtggatgatgatgatgacgatgacctggagcgggtctcttggtcaggggagcctgttggttcacggactcgcccaggcagttttcagtccctaagcgacgctctgagcgacacccctgctaagtcctacgcgcctgagctggggcgccccaagggggagtaccgcgattacagcaatgattggagtcctagcgacaccgtgcggcgcttgcggaaaggcaaggtatgctcactcgagcggtttaggagcttgcaggataagttgcagttgttagaagaggccgtgtctatgcatgatggcaacgtgatcacagccgtcttgatatttttgaagcggacattatccaaggagatcttattcagagaactcgaggtgcggcaggtcgcactgcgccatctcattcattttttaaaggaaataggagatcaaaagctgctgttggaccttttcaggtttctggacaggacagaggaacttgcactaagccactacagggaacatctgaatatccaggatcccgataaaaggaaggaatttctcaagacttgtgtgggtttgccgttctccgctgaagactccgctcatattcaggatcattacactcttttggagcgacagataattattgaagccaatgacaggcacttggagagtgccggtcagactgaaatcttcagaaagcacccaagaaaagcttccatattgaacatgccgctcgtaactactctgttttattcctgcttttatcactatactgaggctgagggaactttttcctcccctgtgaacctcaaaaagaccttcaagattccagacaaacagtacgttctgactgccctagccgctagggcaaaattgcgagcatggaacgacgttgatgccctgttcaccaccaagaattggctcggatatacaaaaaagagagcccctattggctttcatagagttgtcgaaatactacacaagaataacgctccagtgcagatccttcaggaatatgtgaacctggtagaggacgtggacacgaaactgaatctggctactaaatttaaatgtcatgatgttgtgattgacacatacagggacctcaaggatcggcaacagctgctggcttatagaagtaaggtggataaaggctctgctgaagaggagaaaattgacgcactgctgagcagctcacagatccgctggaaaaactag

SEQ ID NO: 183005 - DNA, 1482 bp, Artificial Sequence
  Description of Artificial Sequence: Synthetic coding sequence
atgaaccggaccaagggcgacgaggaggagtactggaacagcagcaaattcaaggctttcacattcgacgatgaggacgacgaactgagccagttgaaagagtccaagagagcagttaattccctgagggatttcgtcgacgatgatgatgacgacgatctggaaagagtctcttggtcaggagagcctgtaggtagcatcagttggtctatccgggagaccgccggcaattctggttccactcacgagggacgggagcaattgaaaagccgaaactccttttcctcctatgcacagttaccaaagcctacctctacatattctctctcatccttcttccgcggccgcacacggcccggatctttccagagcttgtccgatgcgttatcagatacccctgctaagagctatgcgccagagctgggtcgccctaaaggcgaatacagagattactcaaatgactggtcaccaagtgataccgtaagaaggcttagaaagggtaaggtctgttcattggagcggtttcgctcactgcaagataaactgcagctcctggaagaggccgtgtccatgcatgatggcaacgtcatcaccgccgtgctgatttttttaaagcgcacgctctcgaaagagatcctatttagagaactggaagtaagacaggtggctttgcgtcacctgatccacttcctcaaggagatcggcgatcagaaattgctgctagacctctttaggtttcttgataggacggaggaactcgccctctcccattacagagagcacctcaacatccaagaccccgataagcgaaaggagtttctgaaaacatgcgtggggctgcctttctccgccgaggattccgcgcatatccaagaccattacaccctcttggagcgacagattatcatcgaggcaaatgatcggcacctggagtccgcaggacagacagagattttccgaaaacaccctcgcaaagctagcatacttaacatgcctctggtaactacgctcttctacagttgtttctaccactacaccgaggccgaaggaacgttttcctcacctgttaaccttaagaagacctttaagatacccgacaagcagtacgtgctgactgccctcgcggccagggctaagttgagagcatggaacgatgttgacgccctttttacgaccaagaactggctcgggtacacaaagaagcgtgcaccaatcggttttcaccgcgtagtggagattctacacaagaataatgcgcccgttcagatcctccaagagtacgtaaatctcgtcgaagatgtagacacgaaacttaatctcgccaccaagtttaagtgccacgacgttgtgattgacacttaccgggatctgaaagatcgccagcaattactggcctatcggtccaaggtagataaaggctcagctgaagaggaaaagatagatgccctcctgagttctagccaaatcagatggaagaactag

SEQ ID NO: 183006 - DNA, 1560 bp, Artificial Sequence
  Description of Artificial Sequence: Synthetic coding sequence
atgaccaccggcctgatcctgttcttccagagcggccggcccctgggagccggcgtgcgcctaggactcgggcttcgaatgaataggaccaagggggatgaagaggaatactggaacagcagtaaattcaaagcattcacctttgacgatgaagacgatgaattgtcccagctgaaggagtctaagcgggcagttaatagtctacgcgactttgttgacgatgacgacgatgacgacttggagagagtttcttggtctggcgagcccgtcggtagtatatcatggtcaattcgtgagacagccggcaactcaggctcgacgcacgaggggagagagcagctgaaaagccgtaatagcttttcttcgtacgcccagttgcctaaaccaacttccacatactctttgagcagcttcttccgagggcgcacaaggcccggctccttccagagcctgagcgatgccttatccgataccccagccaagtcctatgcccccgagctagggcgccccaaaggagaataccgcgactatagtaacgattggtcgccaagcgacacagtgcgaagactccgaaaaggtaaagtctgttctctcgaaaggtttaggtctctccaagacaagctgcaattgttggaggaagctgtatccatgcatgacgggaacgttatcaccgccgtgctcatatttctgaaacgcacattgtcaaaggagattctctttcgtgagctggaggtgagacaggtggcgctgcgccacctgatccattttctgaaggaaatcggcgatcaaaagctcctgttagacctgttccgattcctggacaggacagaggagcttgctctctctcactatagagaacatctgaatattcaagaccctgataaacgcaaggaattcttaaaaacatgtgtcggactaccgtttagtgccgaggatagcgcccacatccaggaccattatacccttctcgaacggcaaataattatcgaagccaatgatagacatctggaatcagcaggccagactgagatatttcgcaagcacccccgcaaagctagcattctgaatatgccgttagtcaccactctcttttattcttgcttttatcactatacagaggcagagggtactttttcttctccagtgaacctcaagaagaccttcaagatacctgataagcagtatgtgctgacggcactggcagctagagcaaagttgagagcttggaacgacgtggatgccctctttacaacgaaaaattggctgggctatacgaagaagcgggcaccgatcggtttccacagagtggtcgagatcttgcataagaataatgctccagtacagatccttcaggaatacgtgaaccttgtcgaagatgttgatacgaaactgaacttggcaacaaaattcaaatgccacgatgtggttattgatacatatcgcgacctgaaagaccggcagcagttgctcgcctatcgctcaaaggtcgataaggggtcagccgaggaagagaaaattgatgccctgctgagcagcagtcagatcaggtggaagaattag

SEQ ID NO: 183007 - DNA, 138 bp, Artificial Sequence
  Description of Artificial Sequence: Synthetic coding sequence
atgaaccggaccaagggcgacgaggaggagtactggaacagcagcaagttcaaggcatttacgttcgatgatgaggatgatgaactttctcagctcaaggaatcaaagcgggccgtgaactctctgagggacttttag

SEQ ID NO: 183008 - DNA, 1482 bp, Artificial Sequence
  Description of Artificial Sequence: Synthetic coding sequence
atgaaccggaccaagggcgacgaggaggagtactggaacagcagcaagttcaaggcgttcaccttcgacgatgaggatgatgagctcagccagctcaaggagtccaaaagagccgtcaattcccttcgcgactttgtcgacgatgatgacgacgacgatctggaaagggtgtcctggagtggagagcccgtgggctcgatctcttggagcatacgcgagacagctggcaactcaggatcgacacatgaagggagggaacagctgaagtctcgcaattccttttcatcctacgctcagctgcccaaacccacttccacatacagtttgagctccttcttccggggacggactaggcctggatccttccagtcactttctgatgcattgagtgacactccagccaagagttatgcacctgagctcggtcgaccaaaaggggagtatagggactattcaaacgactggagtccgtctgatactgtgcgtcggctcagaaaggggaaggtttgttccttggagagatttcggagcttgcaggacaagctgcaactcctcgaggaggccgtgtccatgcacgatgggaacgtcatcactgccgttcttatattcctgaagcggaccctctcaaaggaaattctgtttcgggaacttgaggtaaggcaggtggccctaagacacctgatacactttttgaaggagattggcgatcagaaactccttctggatctgttcaggtttctcgacagaacggaagaactcgccctgtcacattacagagaacatctcaacattcaggaccccgacaagcggaaggagtttctgaagacatgtgtaggactgcctttcagcgccgaggacagcgcgcacatccaagaccattacactttgctcgaacgccagataatcatcgaagctaacgaccgtcacctggagagcgctggccagactgagatctttaggaaacacccccgcaaagccagcattctcaatatgcccctggtgaccactctgttctacagctgcttttaccactacacagaggccgaagggactttttcttcaccagttaatctgaagaagactttcaaaattcccgataaacaatatgtcctgaccgcactggcggctcgcgccaagctgcgagcctggaatgacgttgacgccctttttaccacaaaaaattggttggggtacaccaagaaacgcgcacccatcggcttccaccgcgtcgtggagatcctacacaaaaacaatgcgcctgtgcaaattctacaggagtacgtgaaccttgtagaggacgttgacaccaagctgaatctagctaccaagttcaagtgtcatgacgtcgttatcgacacgtatagggatctaaaggaccgacagcagttactagcttacaggtcgaaggttgacaaaggaagtgcggaagaagagaagatcgatgccctgctctcctcttctcaaatccgatggaagaactag

SEQ ID NO: 183009 - DNA, 735 bp, Artificial Sequence
  Description of Artificial Sequence: Synthetic coding sequence
atgttccggcggaagctgaccgccctggactaccacaaccccgccggtttcaattgcaaggatgaaacggagtttcgcaacttcatagtttggttagaggaccagaaaatccgtcactacaagatcgaggataggggcaacctgagaaatattcattcctctgattggcctaagtttttcgaaaaatatctaagggatgtgaactgtccttttaaaattcaggaccgccaggaggccatcgactggttgctgggattagctgtgcgcctagagtatggggacaacgccgaaaagtacaaagatttggtgcctgataactcaaagaccgccgataacgcaactaaaaatgcggagcccctgatcaacctcgatgtgaacaacccggactttaaggccggtgtaatggccctcgccaacctgcttcagatccagagacacgatgattatttggtaatgctcaaagcaatacgcatattagtgcaagagcggctgacacaagatgctgtagccaaggctaatcagaccaaggaggggttacctgtcgccctggataagcatatccttggattcgatactggcgacgccgttcttaatgaagctgcccagatcctcaggctgctgcatatcgaggaactgagagagttgcaaaccaagattaatgaggcgattgttgccgtgcaggccatcattgcagacccaaagaccgatcatcgtttggggaaggtggggcggtag

SEQ ID NO: 183010 - DNA, 177 bp, Artificial Sequence
  Description of Artificial Sequence: Synthetic coding sequence
atgctgcagagcatcatcaagaacatctggatccccatgaagccctattacacgaaagtctaccaggagatctggattggcatggggttgatgggtttcatcgtctataaaatccgtgcagcggataagcggtcaaaggccctgaaggcctcagctcccgcacccggccaccactag

SEQ ID NO: 183011 - DNA, 228 bp, Artificial Sequence
  Description of Artificial Sequence: Synthetic coding sequence
atgaagctgtacggcacccggggcagcgacatcagccacttccagtgtcaaatgctccagtctatcataaagaatatttggatccctatgaagccctattatactaaagtctatcaagagatttggatcggcatgggactcatgggattcattgtctacaagatcagagccgcagataaacgtagcaaagccctgaaggcctcagctcctgccccgggacatcattag

SEQ ID NO: 183012 - DNA, 177 bp, Artificial Sequence
  Description of Artificial Sequence: Synthetic coding sequence
atgctgcagagcatcatcaagaacatctggatccccatgaagccctactatactaaagtctaccaagaaatctggatcggaatgggtctcatgggcttcatcgtatacaagattagagcggctgacaaacgctctaaagccttaaaggcatctgcccctgcccccgggcatcattag

SEQ ID NO: 183013 - DNA, 177 bp, Artificial Sequence
  Description of Artificial Sequence: Synthetic coding sequence
atgctgcagagcatcatcaagaacatctggatccccatgaagccctattataccaaggtgtatcaagaaatctggattggaatgggtctaatgggcttcatcgtctacaaaatacgagcagccgataagcgcagcaaagctcttaaagccagtgctcccgcccctggccatcactag

SEQ ID NO: 183014 - DNA, 2928 bp, Artificial Sequence
  Description of Artificial Sequence: Synthetic coding sequence
atgacccagcagccccaggacgacttcgaccggagcgtggaggacgctcaggcttggatgaaggctgttcaggaccagcttcaggtgaacgacaatacacaggggcctagagccgcccttgaggcacgcctttgggagacagagaaaatttgccagctcgagccggaaggtcgcgtgcgagtagatctggtcctccggatggctgaggccctgctggcatgttgtcccggcgaccagaagccggggattctggccaggctgaaggacataaaggcccagtgggaggaaaccgtcacctacatgacacattgccactcacgcattgaatgggtgtggctgcactggagcgagtatttgctcgcccgtgacgagttctatcgctggtttcagaagatgatggttaccttagaacctcatatcgagctgcagctcgggctgaaggaaaagcagtggcaactgagccacgcgcaagtcctgcttcacaatgtggataaccaggccgtcctgctcgataggctgctggaggaggctgcttcattattcaatcgcattggagaccccagcgtagacgaggacgcccagaagcggatgaaggcagagtacgatgcagtcaaggccaaggctcaaaaacgagtggatttactcgagcaggtcgcccgcgagcatgaggagtaccaggccggagtggacgagttccagctctggctgaaagccgtagtcgaaaaggtgaatggttgtctaggccgtaattgcaagctgcctattacacaacgactgtctacccttcaggatatcgcgaaagactttccccgaggcgaggagtctctggagacactcgaggagcagtcagctggagtcatccgaaacaccagccctttgggggcagagaagatcacaggagaacttgaggagatgcgtaaggtactggaaaaactccgggccttgtgggaagaggaagaggaaaggctccgcggccttttgcggtctaggggcgcctgggagcaacagatcaaacaactggaagcagagctttccgagttccggatggtactgcaacgtctagcgcaggaaggacttcaacctgccgctaaagcaggtaccgaggatgagctagtggcgcattggagaagatacagcgctacaagagcagcactggctagcgaagaaccccgcgtggaccgcctgcaagcccagcttaaagaactgattgtgttccctcacaatctgaagcccttgtcagactccgttattgctacgatccaggagtaccagtccttgaaagtgaaatccgcacgactcaggaatgcagccgccgtggaactctggcagcattttcagcgacccctgcaggacctccagttgtggaaagcactcgcacagcggctgctggaggtcaccgcgtcactgccggacctgccaagcctccatacatttctaccacagattgaagccgcactcatggaatcctctcgactgaaggagctccttacgatgcttcagctcaaaaaagacctgttaatcggaatattcggccaggaacgcgctactgcccttttagagcaagttgcgggcagtatgcgggaccgggatctcctgcataatagtcttctgcagagaaaaagcaagctacagagtcttcttgcgcagcacaaagatttcggagccgcctttgaacctctgcagcgaaaactgctggaccttcaggttcgggtccaagccgagaaaggactccagcgagaccttcctggaaagcaagcccagctgtcaagattacagggcctccaggaagagggactggatctgggtgcacaaatggaggccgccagaccactggtgcaggagaatcctaaccaccagcacaaaatggatcagctgtccagcgacttccaggcgcttcagaggtcactcgaggacctggtcgatcgttgtagacagagcgtccaggagcattgcacattctcccatcagcttctcgagttgaggcagtggattgtggttacaacccagaaattggaggctcacaggggtgaggcaggacccggggatgccgagagccaagaggcagagttcgagcgtctcgtggcagaatttcccgagaaagaggcccagttgtcgctcgtggaggcccagggctggctggtcatggagaagagttctcctgaaggggccgcagtggtgcaagaggagctgagggagctggcagagtcctggagggcacttcggctgctcgaagagtctctcctgtctttgatccgtaattggcacctgcagcggatggaagttgattccggtaagaagatggttttcactaataacatccccaaatccggttttctgataaatcccatggatccaataccacgtcatcggcgtcgcgcgaatttacttcaagaggaagaggggtctcacgaagacttcagccaactcctgcgcaactttggtcagtggctgcaggtggagaatagcaagctggttaggatcatcgccatgcgtacgagcaccgccgaagatctgagaactcggaagtccaagctgcaggagttggaagctcgcgtccctgaggggcagcacttatttgaaaacttgctccgtttaggtcccgccaggggaacttccgacgagctggaggatttgcggtaccaatggatgctttacaagtcgaaattaaaagactcaggccatctcctcactcaatcctcaccaggcgaaccaaccgggttccaaaaaactcgcaggtggagagggctaggatccttgttccgacgagcctgctgtgtagctcttcctctccagctcctgcttcttttgttcctgctgctgttatttctgttgccaatcagggaggaggacagaagctgtaccctggccaacaacttcgcccggtcattcaccctaatgttgagatataacgggccccccccaacttag

SEQ ID NO: 183015 - DNA, 1791 bp, Artificial Sequence
  Description of Artificial Sequence: Synthetic coding sequence
atgacccagcagccccaggacgacttcgaccggagcgtggaggacgcacaggcctggatgaaggcagtgcaggaccagctgcaggtgaacgataacacacaaggtcctagggctgctctcgaggcgaggctgtgggagaccgaaaaaatctgtcagctggagcctgaggggcgcgtccgggttgacctcgtgttaaggatggccgaggcgttactcgcctgttgtcccggcgaccaaaaacctggcattctggctagacttaaggacattaaggcccagtgggaggagacagtcacatatatgacgcattgtcactctcgaattgaatgggtgtggctgcattggtccgaatatctgttggcccgcgatgagttctaccgctggtttcagaagatgatggtcaccctggagccacacatcgagctccagctggggctcaaggaaaagcaatggcaactttcccacgcccaagtcctattgcacaacgtagataatcaggccgtcctactggatcgccttctggaagaggccgctagtctcttcaacaggattggcgacccaagcgtggacgaggacgcccagaagcgcatgaaggccgaatacgacgctgtgaaagctaaggctcagaagcgcgtcgacctgcttgagcaggtggcaagggagcatgaagaataccaggctggggttgatgagttccaactgtggcttaaagcagtcgtggaaaaggtgaatgggtgcctcgggcggaactgtaaattaccgataacgcagcggctgtcaacattgcaggatatagctaaagactttccgaggggagaggagagtctcgaaactctcgaggagcagagtgccggcgtgatcagaaatactagcccactgggcgcagagaagattaccggcgagctggaggagatgcgaaaggtgttagagaaattgcgtgccctatgggaagaagaggaagaacgactacgagggctcctacggagcaggggcgcgtgggagcagcagatcaagcaacttgaggctgagctgtcggagttcagaatggtgctccagaggctcgcccaggaagggctgcaacccgccgcaaaggcgggaaccgaagacgaattagtggcacactggcgccggtattcagcaaccagggcagccctcgcaagcgaagaaccccgggttgaccgcctacaagcacaactgaaagagctcatcgtattcccacacaacctgaaaccactgagtgactctgtgatcgccacaatacaggaataccaatcacttaaggtcaaaagcgccaggctgagaaatgctgctgcagtggagctgtggcagcacttccagcgccctctgcaggacctgcagctctggaaagcgctggctcagcgcctgctcgaagtaacagcatctctgcctgatctgcccagcctgcacacttttcttccacaaatcgaggccgcactaatggaatcatctaggctcaaggaacttctaactatgttgcagctgaagaaggatctcctgatcggtattttcggccaggaacgggccaccgctctattggaacaggtggcgggctcaatgcgcgatcgggacctgctgcacaactctttgttacagcggaagagcaaactccagtcccttctggctcaacacaaagactttggggcggcatttgagcccctgcagagaaaactcctcgacctgcaggtgcgagtacaagccgagaagggtctgcagcgcgatctacctggaaagcaggcccagctatcgaggctccaggtccgcggcctttag

SEQ ID NO: 183016 - DNA, 2913 bp, Artificial Sequence
  Description of Artificial Sequence: Synthetic coding sequence
atgacccagcagccccaggacgacttcgaccggagcgtggaggacgcccaagcctggatgaaggcagtgcaggatcagctgcaagttaatgacaacactcagggccccagagcggctctggaagcacgcctgtgggagactgagaagatatgccagcttgaacccgagggtcgagttcgtgtcgatttagttctacgcatggctgaggccctgttagcatgttgtccaggcgatcagaaaccaggcatactggccagactgaaagatatcaaggctcagtgggaggaaaccgtaacctacatgacccattgccactcacgtatcgagtgggtatggcttcattggtccgaatacctcctcgcccgggatgaattctatagatggttccagaaaatgatggtgacgcttgagccccacatagagctgcagctggggcttaaagaaaagcagtggcagctcagccatgcccaggttctgctgcacaacgttgataatcaggcagtgctgttggaccgtctcttggaagaagcagccagtcttttcaaccggatcggtgaccctagcgttgatgaggacgcccaaaagcgtatgaaagcggagtacgacgccgtgaaggccaaggctcagaaaagggtggacctacttgagcaggtagctcgagaacacgaggagtaccaggccggcgtggacgagtttcaactgtggcttaaagcagtggtggagaaggtaaacgggtgcctagggcgaaactgtaagctaccgattacacagagactgtccacgttgcaagatatcgctaaggacttcccccggggtgaggagagcctggaaactcttgaagaacagtctgccggagtgatccggaacaccagtcccctgggtgcagaaaagattacaggggaacttgaagagatgaggaaagtcctcgagaagcttcgcgctctgtgggaggaagaagaggaaaggctaagagggctactgaggtcaaggggagcatgggagcagcaaatcaaacaactggaggccgagctgtcggagtttagaatggtgctgcagcggctagcccaagaaggccttcagcccgccgctaaggctgggacagaagacgagttagtcgcccattggcggagatactcagcaacacgagccgcgctggcaagcgaagaaccccgcgttgatcgcctgcaggcacagttaaaagaactgatcgtcttcccccataacctgaaacccttatccgatagtgttattgccaccatacaagagtaccagtccttaaaagtgaaatcagctagacttagaaatgccgccgcggtggagctgtggcagcacttccagcggcccctgcaggatctgcaactctggaaagctcttgctcagaggcttcttgaagtcacagccagcctgccagatctgccttcccttcatacattcttgcctcagatagaggcggccctaatggagtcctctcgcttaaaggagctgctgactatgctgcagctcaaaaaagacctgctgattggaatctttggccaggagagggcgaccgcattattagaacaggtggcgggaagtatgcgtgaccgcgatctgttgcacaatagcctgctgcaacggaagagcaagctccaatctttactcgctcagcacaaggatttcggagctgcctttgagcctctgcaacgaaaactactcgatctgcaagtcagagtgcaggccgaaaagggactgcagcgggacttgccaggtaaacaggcgcagctgtctcgccttcagggcctgcaggaggaaggactggacttgggggcacagatggaggcagccagaccccttgtccaggaaaatccgaatcaccagcataaaatggaccagctgagtagcgacttccaggctttgcagaggtcactcgaagacttggtggatcggtgccggcagtccgtgcaggagcattgtacctttagccaccagctgctggaactcaggcagtggatcgtagtcaccacccaaaagctggaggctcaccgcggagaggcgggacccggtgatgccgaatctcaagaagccgagttcgaaaggctggtagcggagtttccagaaaaagaggcccagttgtctctcgttgaagctcaggggtggcttgtgatggaaaagagctcaccagagggcgctgcggtcgtccaggaagaactacgtgagctggcagagtcttggcgtgccctgcggctgctggaggaatcattgctgtcactcataaggaattggcacctccagaggatggaagtagacagtgggaagaaaatggtattcacaaacaatatcccgaaatctggcttccttattaacccaatggaccctattccgcgccacaggagacgtgaggaggaaggctcacatgaagacttttcccagctgctgagaaatttcggccagtggctgcaggtggagaacagtaaactggttcgtataatagccatgcgtacctcaacagctgaagatcttaggacaagaaagagcaagcttcaggagctcgaagcacgcgtcccagagggacagcatctttttgagaatttgttgcggctgggacccgcccgaggaacttcggatgaactagaagatctccggtatcagtggatgctatacaagagcaagctgaaggactccggccacctgctgacccagtcttctccaggagagcctaccggattccaaaagacaaggcggtggcggggacttgggtcactcttccgtcgcgcctgttgcgtcgccctgccccttcaactgctgttactactctttttgctgctgctgtttctactccctattagggaggaagatcggagctgcacacttgcaaacaattttgcacgctcgttcaccctaatgctgaggtataacggaccaccgccaacgtag

SEQ ID NO: 183017 - DNA, 3471 bp, Artificial Sequence
  Description of Artificial Sequence: Synthetic coding sequence
atgggcaacctgctgagcaagttccggcccggctgccggcggcggcccctgcccggccctggacgcggcgctccagcaccactttccagggacgcttccccacctgggagagcccacagtgtcccaaccccccgcccctttagaggtcttttcagacggaatgcccgccgccggcctagtgcagcctccatttttgttgctccgaagcgtccttgccccctcccacgtgccgcagctgcacctttaggcgtcctccctgctgtggggtggggtttagctattcgaaagaccccgatgctgccagcgagaaatccaccaagattcggtcatccttcgtctgtacggatcccacccccaagcaggatgttcacactcttgctgccctctccacgggaacctgctgttaaggcacgcaagccaatcccggcgaccctgctcgaggaaacggaggtctgggcccaggagggcccacgacgcgtgaagaaggatgaggatcccgtgcagattgagggagaggatgatgagaagcgcactcctctcagttcaggcgaggcctcttccacatctaggtcccaagggactcaaggagacgtagctagctttagatgttctcctggcccactggagggtaacgtgtaccataagtttagcgagaactcgatgtcagagaaagctcaggcttcgcctgccagctcatgcctggaaggtcctgctatgccatccacccacagccaagccggttgtgctcgccatctggggaagcccgacccagatgcaacagcgccgccggagccggctgtcggctgttctttactgcaacaaaaactagccgcagaagtgttgaacgaggagcctcctccttcaagcttgggtctccccatccctctgatgagcggcaagcgcatgcccgatgagaaaccattctgcatcccccctcggagtgcggctccccctcgggctgcgcgtaaccgcccttgcaaacgtaaaatgagtatccctttactgctgccattgcccccctcgttgccgctgctgtgggatagaggggagctgcctccccccgccaagctgccttgtctttccgtggaaggtgatttgcatactctcgaaaagtcccccgagtataagcggaacagcagaattttagaagataaaactgagacgatgaccaattcttctataactcaaccggccccatctttttcacaacctgtgcagactaccgatagcttaccgctcactacatacacgagccaggtcagtgcccccttgccgattcccgatctggccgacctcgccaccggcccacttattcttcccatcccgcccctttccacaacacccaaaatggatgaaaagatagcctttacgataccaaatagtcccctcgccctgcccgccgacctggtgccaattcttggagatcagagcaatgagaaaggaggctcctacaatagtgttgtcggagcagcccccctgacgtctgatcctcctacccctccctctagtacaccatcattcaaaccacccgtcacaagggaatcccccatttctatgtgtgtggactctcccccgcctctctcatttctgacactgctgcctgtaccttccaccggcacctctgtgattacatcgaagcctatgaactctacttcagtgatctcgactgtcaccacaaatgcgtctgcccatcttacgtcccagaccgccgtggatccggaggtcgttaatatggatacaactgcccccagccaagtggtgatctttacatcgtcactgagctcccgggtgtcatccctgcccaattcccagattcactgctccgctgagcagagacatccaggcaaaacaagcgtctatactagccctctacccttcattttccacaacactaccccgagcttcaaccagctgttcgggaaggaggccacccctcaaccaaagttcgaagcccctgacgggcagcctcagaaagccagcttgccctccgcctgtgtgttcctgtcacttcccatcattcctcctccagataccagcactcttgtaaactctgcatctacagcttccagttcgaaacctccgatcgaaaccaacgcaatgcacacgacgccaccttccaaggctgtaatactacagtctgcctctgtgtccaagaaatacttgccattttatctggggttgcccgggtctgggaacactcaaccctccggtaatacagccagcgtgcaaggatccacctcgctgcccgcacagtctgttcgggctccagccacagcatcaaatcaccctctgaacccgggagcaactccccagccaaaattcggagccccagacggaccgcagcagaagacttcgctcccaagtgcccatgactttctgagtttgcctattatggtccctcctgacacatccacattggtgtcatctgcctcagccgcttcactgagcaaaccagccatagatacaagcgacatgaacaccacccctccctcaaaaactgtgatcctgcagtctacattcgtgagccgaaaagaggagtacatccgcttttacatgggtctaccaggcagtggtaatacgcttcatagtgactctatagcctcagcccaagtatcaacgtcgtttcccgcccaggccgatcgccgtccaacgaccacatcctcccacccactgaataccggaagtatctcacacagtactctcggagccactgatggtcagcagaaatcagatagctcttttatcctgggcaaccccgccacacccgcccctgtcatcggactgacctctccatctgtccagcctctgtctggtagtataattccaccagggttcgcggaactcacctcaccttacacagcgctcggaactcctgtgaacgccgagcccgtggagggacacaatgccagcgcatttcctaatggtacggctaagacctccggctttcggattgctaccggcatgcccggtacgggggacagcactctgctggtaggcaacactattcctggaccccaagttatcatggggcctggtactcctatggatggaggatccatcggctttagcatgtctgcaccagggcccagtagtacttctggcgagttgaatataggacaaggccaaagcggtacgccctctactaccagcgttttcccgtttggacaagcggcctgggacccaacaggccacagcatggcagctgctccacagggcgcctctaatattcctgtcttcgggtacacctctgccgcggcctacattcccggtctggacccccctacacaaaactcatgctcgggaatgggcggggatggcacacgcagtatcgtggggggtccctgtgtgcctgctttccagcagtgcatactgcagcatacatggactgagcggaagttctacacttcaagtacccattactacggccaggagacgtatgtgcggcgtcatgtttgctttcaactcccatag

SEQ ID NO: 183018 - DNA, 5733 bp, Artificial Sequence
  Description of Artificial Sequence: Synthetic coding sequence
atggcctgctgccacaaggtgatgctgctgctggacaccgccggcggagccgccaggcatagcagggtgcggagagctgccttgcgattactgacctacttgtcttgtcggtttgggttggcccgcgttcactgggcatttaagttctttgattctcaaggcgctcggagcaggccttctagggtgagcgacttccgcgaactgggctcccgatcatgggaggacttcgaagaggaactggaggcccgcctcgaagacagggctcatctgcccgggccggcccccagagctacacatacccatggcgccctcatggaaaccttgctggattaccagtgggaccgcccagagatcaccagccctacaaaaccgattctaaggagtagtggtcgtagactgctggatgtggaaagcgaggccaaggaggcggaagcagctttgggaggacttgtcaacgctgtctttctgctggcaccttgcccccacagccaaagagagctccttcagttcgtctctggctgcgaggcccaggctcagaggcttccacccacacccaagcaggtcatggaaaagctcctccctaagagagtgagagaagttatggtggcaagaaaaatcaccttttattgggtcgatacgaccgaatggtctaaattgtgggaaagtccggaccacctgggatactggactgtatgcgagctccttcaccacggcggtgggacagtgttaccctccgaatcatttagctgggacttcgcccaggcaggcgaaatgctgttgcggtctggcatcaaactcagcagtgaaccccacctcagtccatggataagtatgttaccaaccgacgctaccctgaataggcttctctataattcgccggaatatgaggcctcgttccctcggatggaaggcatgctcttcttgcccgtcgaagcaggcaaggaaatccaggagacctggaccgtcaccctggaacccctggctatgcaccagcgacattttcagaagcccgtgcgcatctttctcaagggctctgtggcgcagtggtcattgcccacatcttctacattgggtactgactcctggatgttgggatccccagaagagtctacggctacccagaggctgctgtttcagcaactagttagccgtcttaccgccgaggaactgcacctggtggctgacgtggatcccggcgagggacgccccccaattactggcgtcatatcacctttgtctgcctccgctatgatcctcacagtgtgcagaaccaaagaggcagaattccagcggcacgtgctccaaactgccgtcgcagatagcccaagggatactgcctcattgtttagcgacgtggtggattccattcttaaccagacccacgattcactggccgatactgcaagcgcagcctcacccgtgccagaatgggctcagcaagagctcggacacactacaccttggagtccggctgtcgttgagaagtggtttccattttgcaacatcagcggggcctctagcgatctgatggagagtttcggcctgctgcaggctgcaagtgcaaacaaagaagagagcagtaagaccgaaggtgagcttattcactgcctcgccgagctttaccagcggaagtctagagaggagagtacaattgcccaccaggaggacagtaaaaaaaaacgtggggtccctagaacgccagtgaggcaaaaaatgaatacaatgtgccgttccttgaagatgctgaacgtggcgcgccttaacgtcaaagcccaaaagctccaccctgatggtagccctgatgtggcaggtgaaaaagggatccaaaaaatcccatcgggtagaaccgtggataaactggaagaccgcggcaggaccctgaggtcaagtaagccaaaggattttaagaccgaggaggagctgctgtcttatattagagaaaactaccagaagactgtagccacaggtgagattatgctgtatgcttgcgcaagaaacatgatttccaccgtgaaaatgttcctgaaaagtaagggaacaaaagagcttgaggtgaattgcctcaaccaggtcaagtcttcgctactgaagacttcgaagagtttgcggcagaacttgggcaaaaaactagacaaagaagataaggtgagagagtgccagctccaagttttcctccgactggagatgtgcttacagtgtccaagcatcaatgagagtaccgacgatatggaacaggtagtcgaggaggtgaccgatctcctgcggatggtgtgcttgactgaagattccgcatatctcgctgagtttctcgaagagatcctgaggctgtacatcgattcaataccaaagactctgggtaacctctacaactcactcgggtttgttatcccccagaaattggccggcgtgctgccaacggactttttttctgatgactctatgacccaggagaacaagtcccctttgttgtccgttccattcctcagctcagccaggcggtctgtgagcggatcccctgagtctgacgagctgcaagagttaagaacgcggtccgccaaaaagcggaggaagaacgccctgattcggcacaaaagcatcgccgaagtttcacagaacctgcgccagattgaaatcccgaaggttagcaaacgggccaccaagaaagagaactctcacccagcacctcaacagcctagccagccagtgaaggatacagtgcaggaggtgactaaggttcgcagaaacctctttaaccaggaattactctctcccagtaagagatccctgaaaagaggactaccgcgctcacactccgtaagcgctgtcgatggactggaggataaacttgacaactttaagaaaaacaaagggtatcacaagctgctcacaaaatcagtagctgagacccccgtgcacaaacagatcagcaagcgattgctacatcgccagattaaaggtaggtcctcggatccaggccccgacataggggtggtcgaagagagcccggagaagggggacgagatttcccttcggaggagcccaagaatcaaacaactgtcattctccaggacacattcagctagcttctattctgttagccagccgaagagtagaagcgttcagcgcgttcatagctttcagcaagataagtctgaccaacgtgaaaattcccccgtacagagcattagaagccccaagtcactgctcttcggggcaatgtcggaaatgatctcaccgtctgaaaagggatctgccagaatgaagaagaggtcccgcaacaccttggatagtgaagtgccagcggcttatcagactccaaaaaagtcccatcagaaaagtctgtcattttccaagactacccccagaaggatatcacataccccccagaccccactgtacacgcctgaacggctgcagaaaagccccgccaagatgacacctaccaagcaggccgcgttcaaggaaagcctgaaagacagtagttcccctggtcacgacagccctctcgactcaaaaattacgccacagaagcggcacacacaagctggcgagggaacttccctcgagactaaaacaccgcgcacccctaagaggcaggggacgcagccacccggtttcctgccaaattgcacttggccccacagcgtgaattccagtcccgagtcaccttcatgccctgcaccccccacatcttccaccgcacaaccccggcgcgagtgcttgactccaattagagatccactgcgcactcctcccagagccgccgctttcatgggtacacctcaaaatcagacccaccaacaaccacatgtactaagggctgccagagcggaggaaccggcacaaaaactgaaagataaagccatcaagacacctaagaggccagggaactccacggtgacatcttcaccccctgtgacgcctaaaaaacttttcacctccccgctctgtgatgtgagcaaaaagtcaccatttcgcaaatctaaaattgaatgtccttcacctggggagttagaccagaaagaaccgcagatgtcgccgtccgtcgccgcgagtctgtcatgtccggttcctagtactccacccgaactgtcacagcgcgctacactggacacggtacccccgccgccccctagtaaggtgggaaagaggtgtcggaagacttcagaccccaggaggtcaatcgtggaatgtcagccagacgcctccgccacaccaggcgtgggtacagctgactctcctgcagcccccaccgacagccgcgatgatcagaagggtcttagcctgtctccccagtctccaccggagcgccgcggctaccccggacccgggctacgctcagattggcacgcctcaagccctctcctgataacctccgacactgagcacgtcaccctcctgtccgaagccgaacaccatggcataggggatctcaagagcaacgtcctgagcgtcgaagaaggagaagggcttcgaaccgccgacgcagaaaagagctctcttagccaccctggcatccctccttcccctccatcgtgcggccccgggtctccactcatgccctctagagatgttcactgtacaactgatgggcgacaatgtcaagcctctgcacagctggataacctccctgccagcgcctggcactccactgactctgccagtccccagacatacgaagtcgaattggagatgcaggctagcggcctgcccaagctgcgcatcaagaagatcgacccttcttcctcactggaggctgagccgctttcaaaagaggagagctccttgggggaggagtccttcctaccagctctgtccatgcctcgcgccagccgttccctcagcaaaccagagcccacgtacgtatctcctccctgcccccgcttgagccattctacaccaggtaagtccagagggcagacttacatatgccaggcttgcacgcctacccacgggccttcgtcaacaccatcgccttttcagaccgatggagtaccttggacgccaagccccaaacattcaggcaaaacaactccagacattataaaagactggccccggcgcaaacgggctgttgggtgtggtgccggttcttcttccggcagaggtgaggtgggcgccgacctgcccggctccttgagcttacttgaatcggagggtaaagatcacgggctggagctgagcatacaccggacccctatactcgaggacttcgagctggagggcgtctgccagcttcctgaccagtcgcccccccgaaattccatgccaaaggccgaagaggcctcctcctggggtcagttcggtcttagctcacgaaaacgggtgctgctcgccaaggaggaagcagacaggggcgctaaaaggatttgcgatttgagagaggatagcgaagtctcgaagtctaaagaaggatccccttcctggtcagcctggcagttaccgtctacaggcgatgaggaagtgttcgtttcgggtagcaccccgcctcctagctgcgccgtccgctcctgtctgagcgctagcgcgctccaagcccttactcagtcacccctactcttccagggcaaaacgcccagctctcagagtaaggaccctagggacgaggatgtggatgtgctgcccagcactgtggaagatagccccttcagccgggccttctcccggcggaggcctatatccaggacttatactaggaagaagttgatggggacctggctggaggacctgtag

SEQ ID NO: 183019 - DNA, 354 bp, Artificial Sequence
  Description of Artificial Sequence: Synthetic coding sequence
atgaagctgagcagcgccgccggccaggagagccccggccacccccatccatcccctccagcttggacactcaagaaaccttccgaaagcgtcgcgcaacgcgctatgtgcagcgctcgggcctgcccagtggcctgcccagtcggctgtcccatcgcatgtcctgtctcttgcccagtggcctgtcctgtggggtgtccagtaggctccatggccactgccccccaaggcctaagccctcaggagtgggaagcagatcgcgaaaccgggtcctcatcccatgcaggcacaacccagtgcagcatccactccccatcctcaagttcaaggcacctatcaagaacacagacatag

SEQ ID NO: 183020 - DNA, 627 bp, Artificial Sequence
  Description of Artificial Sequence: Synthetic coding sequence
atgagcagcgagcccccccccccctaccccggcggccccaccgccccactgctggaagaaaagtcgggggcgccccccacacctggacgctcgtcaccggccgtaatgcaaccgccgcccggtatgcccctaccccccgctgacattggcccaccaccctatgaacctcctggtcatcccatgccacagcctggcttcatcccgccccacatgtcagcagatggcacatacatgccacctggattctacccgccacccggacctcacccgcctatggggtattatccccctgggccctacactcctggcccctacccaggtccaggcggtcacacagctacagtgctggtgcccagcggagccgcaaccacagtgaccgtgttgcagggtgagatatttgagggtgcaccagttcagactgtttgcccccactgtcagcaggccatcactaccaaaatcagctatgagattgggctgatgaatttcgtcttaggcttcttctgttgctttatggggtgtgatctgggctgctgcttgataccttgcctcatcaacgactttaaggacgttacccacacttgtccctcttgcaaagcttacatttacacctataagcggctgtgctag

SEQ ID NO: 183021 - DNA, 765 bp, Artificial Sequence
  Description of Artificial Sequence: Synthetic coding sequence
atgagcctggcccggggccacggcgacaccgccgccagcaccgccgcaccactgtccgaggagggcgaagtgacaagcggactgcaggccctggccgtggaagatactggcggaccatctgccagtgccgggaaggccgaggacgaaggagagggagggagggaagagacggaaagagagggttctgggggtgaggaggctcagggcgaagtccccagtgccggtggggaggaaccagccgaggaagactctgaagactggtgcgtaccctgctctgatgaagaagtggaactccccgctgacggccagccctggatgcccccacccagcgaaatccagcgcctgtatgaactactcgcagcccatggtacgctggaactgcaggccgaaatcctaccgcgaaggccaccaactccagaggcgcagtcagaggaggaaaggagtgatgaggaacccgaggctaaagaggaggaagaggagaagccccatatgcctaccgaatttgatttcgacgacgaacccgtgacacccaaggattcactaattgatagaagaaggactcctgggtccagcgcaaggagccagaaacgggaggctagactggacaaagtgctctcggacatgaaaagacacaagaagctggaggaacaaatcctcaggacagggcgcgatctctttagcctcgattcagaggatccaagcccagcttccccaccgctgcgttcatcaggcagctctctgtttcctcggcaaagaaagtactag

SEQ ID NO: 183022 - DNA, 2010 bp, Artificial Sequence
  Description of Artificial Sequence: Synthetic coding sequence
atgggcagcgaccccagcgcccccggccggcccggctggaccggctctctgctcggcgatagggaggaggcggcaagaccaagacttctgccattattactggtcctactcggatgcctgggcctcggtgtcgccgctgaggatgctgaagtccacgctgaaaactggttgcgtctttacggatacttgccccagccaagcagacacatgagcacaatgaggtctgctcaaattctggccagcgcactggcagaaatgcaacggttctacggaatccccgttactggcgtgctggatgaggaaaccaaagagtggatgaaacggccccgatgcggcgtcccagatcagttcggcgtgcgcgtgaaggcaaatctgcgccggagaagaaaacgctacgctctgacggggaggaagtggaataaccaccacctgacctttagcatccagaattacacagagaagttggggtggtaccattcaatggaggcggttaggcgggctttcagggtctgggaacaggccacacccctggtgtttcaggaagtgccctacgaggatatccgcctgcgtagacagaaggaggcggacattatggtgctgtttgcctctggctttcacggcgactcatcccctttcgatggcaccggaggattccttgcccatgcatatttccctggtccgggactcggcggtgacacccacttcgacgcagacgaaccttggacgttctccagtaccgacttgcacggcaataatttgttcctggtggctgtccatgagcttggccatgcactcggcttagaacactcttctaatcctaatgccatcatggcccccttctaccagtggaaagatgttgataatttcaagcttcctgaagatgatctgcgcggcattcagcagctgtatgggacccctgatggccagccccagccgacccaaccactccccaccgtcacacctaggcgaccagggcgacctgatcatcgcccgcctagaccaccacagccacccccccccggcggtaagcctgagaggcccccaaagcctggcccccctgtgcagcctagggccaccgagaggccagatcagtacgggccaaacatctgcgacggagactttgacacggttgcaatgctccggggcgagatgtttgtcttcaagggaagatggttctggcgggtgcgccacaaccgcgtgttggacaattatcccatgcctataggtcacttttggagaggtctgccaggtgatatctccgctgcctatgaacgccaagacggaaggttcgtcttcttcaaaggggaccgatattggttgtttcgggaggcgaacttggagcccggctaccctcagcccctgacctcttacggattgggaatcccgtatgacaggattgatacggcgatatggtgggaacccacaggacatactttcttctttcaggaggaccggtattggagatttaacgaagagactcagagaggcgaccccggctacccgaaacctatcagtgtttggcagggcattcctgcgagtcccaagggcgcctttttgtctaacgacgctgcctatacttacttctacaagggcacgaaatactggaaattcgataacgagcggctacggatggagccaggctatcccaaatcgattctccgggattttatgggctgccaggaacacgtggagcccgggcccaggtggcccgatgttgcacgccctcctttcaacccgcacggaggagcagaaccaggcgcagacagtgcagagggtgatgtgggcgatggggatggagattttggcgctggcgtgaacaaagatggggggagccgtgtggtggtacagatggaggaggttgcacgcacagtgaacgtggttatggtcctggtgcctctgttgcttctgctgtgcgtcttggggttgacttacgccctggtacagatgcagagaaagggcgctcctagggtactactgtactgtaagcgcagcttgcaggaatgggtctag

SEQ ID NO: 183023 - DNA, 561 bp, Artificial Sequence
  Description of Artificial Sequence: Synthetic coding sequence
atgagcgccgcccccctggtgggctacagcagcagcggcagcgaggacgaatccgaagatggcatgaggaccagacccggagacggttcccacagacggggccagtccccgctccctagacagcgctttccagtccctgactccgttttaaacatgttcccaggtacagaagaagggcctgaggatgacagtaccaaacatggggggcgagtgagaacattcccccacgaaagaggaaactgggctacacacgtctatgtaccgtatgaggcaaaggaagagtttcttgatcttctggacgtcctcctgcctcacgcccaaacctacgtcccccggttggtcaggatgaaggtattccatctttcgctctctcaatcagtagtcttaaggcatcattggattctgcctttcgtgcaagcacttaaggcacgtatgacaagtttccactcccctcaccctggccctcactgcctgatcggcaccaaagatgctcccgttacacaagagatccccaaagaccttggcgcactcagacaggaaccaggctctcagaccagatag

SEQ ID NO: 183024 - DNA, 744 bp, Artificial Sequence
  Description of Artificial Sequence: Synthetic coding sequence
atgagcgccgcccccctggtgggctacagcagcagcggcagcgaggatgaatcagaagatggaatgcggacacggcctggagatgggtcacatcgtcgggggcaatcccccttaccgcgccagagattccctgttcctgattctgtactgaacatgtttcccggaacggaagaggggccagaggacgactccacgaagcacggaggacgtgtgcgtacatttccgcacgaacggggcaactgggcaacccacgtctatgtgccatacgaggccaaggaagaattcctcgatttattggatgtgctgcttccccatgcgcagacctacgtgccgcgcctggtgcggatgaaagtatttcacctgtccctgagccagtccgtggtgttgaggcaccactggatactgccttttgtgcaggccctgaaggcgcgcatgacatccttccaccgtacattcattggcctcgaagttacaagtgggcatgcgcaattcttggacctcgttagcgaggtggatagggttatggaggagttcaacctcacgactttctaccaagacccatcattccatctgtccctcgcatggtgtgtgggtgacgctcggctgcagctcgagggccagtgtcttcaggagttgcaagcaatcgtggacggcttcgaagacgctgaggtcctgctgcgggtccacacagaacaggtgagatgcaagtctggcaataagttcttttccatgcctctaaagtag

SEQ ID NO: 183025 - DNA, 642 bp, Artificial Sequence
  Description of Artificial Sequence: Synthetic coding sequence
atgagccccctgccccggcagcggttccccgtgcccgacagcgtgctgaacatgtttccagggactgaggagggaccagaggacgactcaacaaagcacggaggtagagtgcgcacatttccacacgaacgtggaaactgggcaacacatgtctatgttccgtacgaggccaaagaggagttcctggacttattggatgtcctgctgccacatgcccaatcagtcgtgctccgtcaccactggatcctgcctttcgtgcaggctttgaaggccaggatgaccagcttccacaggtttttcttcactgccaaccaggttaagatctatacaaaccaagaaaagacgcgtaccttcatcgggctggaggtgacaagcggacacgcccagttcctggacctggtgagtgaggtggatagggttatggaggagtttaatttgaccacattttaccaggatcctagtttccacctatcccttgcatggtgcgtgggcgatgcccgactgcagctggagggccagtgccttcaggaattacaggctattgttgacggtttcgaagatgcagaggtgttgctgagggtacatactgagcaggtaaggtgcaagtccggaaacaagttcttcagcatgcccctcaagtag

SEQ ID NO: 183026 - DNA, 1683 bp, Artificial Sequence
  Description of Artificial Sequence: Synthetic coding sequence
atgggcagcaccgacagcaagctgaacttccggaaggccgtgatccaactgacaactaagactcagccagtcgaagccacagacgatgcctacgatcccgtgggctatgggatcccatacaaccatctgttgtttagtgactacagagaaccactggtagaagaagcggctcaggtgctgattgtcactttggatcatgatagcgcctctagtgctagcccaactgtagatgggaccactaccggcactgccatggacgacgctgaccctcctgggccagaaaaccttttcgtaaactatctcagtcgtattcatagagaggaagattttcagtttattttgaaggggatagcaagactcctctcgaacccactcttgcagacatacttgcccaacagtactaagaagatccagtttcaccaggaactgctggtgttgttctggaagctgtgcgacttcaataagaagttcctgtttttcgtactgaagtcaagcgacgtgctggatatactggttccaatcctcttcttcttgaatgatgctagagctgaccaaagcagggtgggcttgatgcacataggcgtgtttatcctgttacttttgtctggcgagcgcaactttggcgtgcggctgaataagccgtacagtattcgtgtgcctatggacattccagtgttcacgggtacccacgcagaccttctcatcgtggtctttcataagatcatcaccagcgggcatcaacgcctccaaccgctctttgattgtctcctgaccatcgtggtcaatgtatccccataccttaagtccctgagcatggtgacggcgaacaagctgttgcacctgctggaggccttctccacgacttggtttctgttttctgccgctcagaaccatcatctcgtcttttttctgctggaagtgttcaacaatatcatccaataccagtttgacgggaactcaaacctcgtatacgctattattcgaaagagatccatcttccaccaactagcaaacttgccaacagatcctcccactattcataaggccctgcaacgacggcgccgtacgccagaacctctctccagaacgggcagtcaggagggtaccagtatggaaggttctagaccagctgctccagctgagcctggcaccttgaaaacgagcctcgtggccacgcctggaatcgataaactgaccgagaagtcccaggtttccgaggatggaacactgcgttctctggagcctgagccacagcagagccttgaggacggtagccccgctaaaggcgaaccgtcccaggcttggagagaacagagaagaccgtccacgtcttccgctagcggtcagtggtcccccacacctgaatgggttcttagttggaaatccaagttaccgttacagacaataatgcgcctcttgcaggttttggtgcctcaagtcgaaaagatctgcatcgacaaaggcttgaccgatgaatccgagatcctgcgattcctacagcacggcacacttgttggactgctgccagtgccccatcccattttaattaggaagtaccaagccaactccggaactgcaatgtggtttaggacttacatgtggggtgtgatctatctaagaaacgtggacccccctgtctggtacgacaccgatgtgaagctctttgaaatccagcgagtttag

SEQ ID NO: 183027 - DNA, 2367 bp, Artificial Sequence
  Description of Artificial Sequence: Synthetic coding sequence
atgggcagcaccgacagcaagctgaacttccggaaggccgtgatccagctgaccacaaaaactcagcctgtggaagcaaccgatgacgccttctgggaccagttttgggccgacaccgctactagcgtgcaagatgtgtttgcccttgtgcccgccgccgaaatccgcgccgtccgggaggaaagccccagtaacctggccacattgtgctataaagctgttgagaagctggtgcagggcgccgagagcggctgtcattcggagaaggaaaagcagatcgtcctgaactgctctcgactgctcacccgcgtcctcccatatatattcgaagatccagattggcgcggatttttttggagcactgtgcctggcgccgggagggggggacaaggagaggaagacgacgaacacgcacgtccactggcagaatccttgctgcttgctatagcagatcttctcttttgtccagacttcactgtacagagtcacagaaggtctacagtggacagcgccgaagatgtccacagcctggactcgtgcgaatacatttgggaggcaggcgtaggatttgctcacagcccccagcccaattacattcacgatatgaaccgcatggaactcctaaaactccttctcacatgcttctccgaggctatgtacctgccccctgcgccagaatctggaagcactaacccttgggtacagtttttctgttcgactgagaaccgccacgctctaccgctgttcacgtccctactaaacacggtctgcgcctacgatcccgtggggtatgggataccctacaatcacctcctgttctcagactatagggaacctttagtcgaggaagccgctcaagttttgatcgtgaccctagatcatgactccgcatcatccgcaagtcctacagttgacggaacaaccactggaactgcaatggatgatgcagacccaccaggcccggagaacctctttgtgaattatctatctagaatccaccgggaggaggattttcagttcatcttgaagggcatagcccggctgctctcaaacccactgctgcagacatacctgccgaatagtactaagaaaattcagtttcaccaggaactgctggtgctgttctggaagttgtgcgacttcaacaagaaatttttgttttttgtgctgaagtcctctgacgttctggacattttggtgcccatcttgttttttcttaatgacgctcgagctgatcaatctcgggtgggccttatgcacataggcgtgtttatactgttgctgctgtccggtgagcgcaacttcggggtgcgtctgaacaaaccctactcaattagggtgccaatggatatcccggtgttcacggggactcacgctgaccttttgattgtcgtgtttcacaagatcatcaccagtggccaccaacgccttcaacccctgttcgactgcttattgactatcgttgttaacgtgtctccatacctgaaaagcctcagtatggtcaccgcgaataagctactgcacctcctggaagccttcagcaccacatggtttttgtttagcgctgcacaaaaccaccatctcgtctttttcctgctggaggtctttaataacatcatccagtaccagttcgacggaaattcaaacttggtgtacgctattatcaggaagagatcaatcttccaccaacttgccaacctgcccacagaccctccgacgatccacaaagcactacagcgtagacgccgcaccccagagccgctcagccgcactggttcccaagaggggacctccatggaagggagccgacccgccgctcctgctgagccagggacactgaagacctcactcgtggccacccctggtattgataaactgacggaaaaatctcaggtgtctgaagacgggacccttcgtagcctcgagcccgaaccccagcagtcactggaagacggcagcccagctaaaggggaaccatcacaagcgtggagagaacagcgtcgcccttccacctccagcgcctcaggacagtggtctcccacccctgagtgggtcctctcctggaagagcaagctgcctctgcagaccataatgcggctgctgcaggtactggttcctcaggtagagaagatatgtatcgacaaggggcttactgatgaatctgaaatcctgcgcttcttgcagcatggtacactagtcggactccttccggttccgcatccgattctgatccgaaagtaccaggcaaatagcggaacagctatgtggttcagaacatacatgtggggagtgatctacctgcgcaacgtggatcctccagtctggtatgacacggatgtgaagctgtttgagattcaacgagtctag

SEQ ID NO: 183028 - DNA, 810 bp, Artificial Sequence
  Description of Artificial Sequence: Synthetic coding sequence
atgagcagcgaccacctgaacaacagcaccctgaaggaggcccagttcaaggatctgttcttgaagaaagccgagctcgagtttgctcagatcattattattgtcgtagtagtcacggtaatggtggtggttatagtgtgtctgctgaaccactataaagtatccacccggagcttcatcaaccgccctaaccaatctcgccgacgtgaggacggcctaccccaggagggatgtctctggccctctgattctgccgcccctagattgggagccagtgagattatgcatgcgccgcggagtagagacaggtttaccgccccaagctttatacagagagatcgttttagtcgctttcaacctacctatccatatgtccagcacgaaattgacctgccgcccacaatctccctgagcgatggggaagaaccccccccataccaaggaccctgtactctacagctgagagatccagaacagcagatggagcttaacagggaaagtgttcgagcacctcctaatcggaccatattcgattccgatcttatcgatatcgcaatgtatagcgggggcccttgtccccccagttcaaatagcggcatctcagccagtacctgtagtagcaacggtcggatggagggaccacctcctacatatagcgaagtgatgggacatcaccctggtgcttccttcttacatcatcagagatctaacgctcatcgcgggtctcgactgcagttccagcagaataatgccgagagcacaatcgtgcccatcaagggcaaagacagaaagccaggaaacctcgtgtag

SEQ ID NO: 183029 - DNA, 921 bp, Artificial Sequence
  Description of Artificial Sequence: Synthetic coding sequence
atgcccgaggccggcttccaggccaccaacgccttcaccgagtgcaaattcacttgtacctccggtaagtgcctatacctgggctcactggtttgcaaccagcagaacgactgtggtgataactctgacgaggagaattgcctgctggtgacggagcatccaccccctgggattttcaactccgagctcgaatttgcccaaattatcattatcgtggttgtcgttaccgtaatggttgtggtaatcgtctgcttgctgaaccattacaaggtcagtactcggtcatttattaacagacctaaccaaagccggagaagagaagacggattgccgcaggagggatgtctatggccttcagactcagccgcgccaaggctgggcgcctcagagatcatgcacgctccgcgttcacgggatcgatttacggcccccagcttcattcagagagatagattctccagatttcagccaacttacccatatgtgcagcatgaaatcgacctacccccaacaatctccctgagtgacggagaggagcccccgccctaccaagggccgtgcacgctgcagcttcgcgaccccgaacagcagatggaactcaatcgggagtctgtccgggcaccacccaatcgaacaatcttcgattcagatctgatcgatatcgcaatgtattcagggggtccttgtccgccttcctctaacagcggaattagcgcaagtacatgttcaagcaatgggcggatggagggtcccccccctacatatagtgaagtgatgggccaccaccccggagccagcttcttgcaccaccagagatcaaatgcccaccgcggttcaagattgcaattccaacaaaataatgccgagagcacaattgtccctatcaaaggtaaggaccgaaaaccaggcaatctggtctag

SEQ ID NO: 183030 - DNA, 747 bp, Artificial Sequence
  Description of Artificial Sequence: Synthetic coding sequence
atggccgccgagctggagttcgcccagatcatcatcatcgtggtggttgtgacggttatggtggtcgtgatcgtctgtctgctcaatcattataaagtgagtaccagaagcttcattaatcgtcccaaccagtcacgcagaagggaggatggactgccccaggaggggtgcctgtggccaagcgattcagccgctcctcgcttaggcgcatccgaaatcatgcatgcccctagaagtagggaccgctttactgctccaagctttattcagcgtgatcgcttttcaagatttcagccgacctacccgtacgtccagcatgagattgacctacccccaacgatctccttatcagacggcgaagagcccccgccctatcaaggcccctgtacccttcagcttagggatcccgaacaacagatggaattaaatcgggaaagcgtccgggcaccccccaaccggacaatcttcgattctgatctgatcgacatagcaatgtactctggggggccttgccctccgtcttctaattctggtatttctgcttccacgtgttcctctaacggccgaatggagggcccacctcctacatattctgaggttatgggacaccaccccggtgccagctttttgcaccatcagaggtctaacgcccaccgaggtagtcggctgcagtttcagcaaaacaacgcagagtcgaccatagtcccaatcaaaggaaaggaccgcaaaccaggcaacctggtgtag

SEQ ID NO: 183031 - DNA, 756 bp, Artificial Sequence
  Description of Artificial Sequence: Synthetic coding sequence
atgagcagcgaccacctgaacaacagcaccctgaaggaggcccagtttaaagacttgttcctgaagaaggcggagcttgagtttgcccagatcatcatcatcgtggttgtggtgaccgttatggtggtcgtaatcgtgtgtctcctgaatcactacaaggtgtccacccgctcattcatcaacagacccaaccaaagtcgccgtagggaggatggtcttccacagatcatgcatgcacctaggtctcgagatcgcttcacagccccgtctttcatccagcgtgacagattcagcagatttcaacctacatatccttacgtgcagcacgaaattgatctgccccccacaatcagcctgagcgacggtgaagaacctccaccttaccagggaccctgcaccctccagcttcgcgatccagagcagcagatggagctaaatcgtgaaagcgtgcgcgctccccctaatagaactatattcgatagtgatttgatagatattgcaatgtatagtggggggccatgtcctccatcaagtaactcagggattagcgctagtacatgctcctccaatgggcgaatggaaggcccgcccccgacatactccgaagttatggggcatcatcctggtgccagtttcttgcaccaccagcggagcaatgcccaccgtggctcaaggttgcagttccaacagaacaatgcagaatccacaattgtgcccataaaaggcaaagatcgtaagccaggcaacctggtctag

SEQ ID NO: 183032 - DNA, 867 bp, Artificial Sequence
  Description of Artificial Sequence: Synthetic coding sequence
atgcccgaggccggcttccaggccaccaacgccttcaccgagtgcaagtttacatgcactagcggcaaatgtttgtatctgggttccctggtgtgtaaccagcagaacgattgtggagacaattcagatgaggagaattgcctgcttgtgacagaacacccccccccaggcatcttcaactctgagctggagttcgctcagatcatcataatcgtggtagtggttacagtgatggtggtcgttattgtttgtttgctgaatcactacaaggtctctaccagaagctttattaatagaccgaatcagtccaggagacgggaagacggcctgcctcagatcatgcacgctcctcgctcccgagatcgattcacggctccttcattcatccagcgggacagatttagtcgattccaacctacatacccctatgtccagcacgagatagatctccctcctactatttcattgtctgatggagaagagccaccaccctatcagggaccttgcacactgcagctgcgggaccccgagcaacagatggaactaaacagagagtctgtccgagcaccacccaacagaacgattttcgacagcgatcttatcgacatagcgatgtacagcgggggcccttgtcctcctagttcaaatagtgggatatctgcatccacttgcagttccaatggacgcatggagggcccacctcctacatactccgaagtgatgggacatcatccaggtgcctcatttctccatcaccagcggagcaatgcgcaccgcggcagccgtttgcagttccagcagaacaacgctgagtccactatcgtccctataaaaggcaaggacagaaaacccggaaatttagtgtag

SEQ ID NO: 183033 - DNA, 693 bp, Artificial Sequence
  Description of Artificial Sequence: Synthetic coding sequence
atggccgccgagctggagttcgcccagatcatcatcatcgtggtggtggtgaccgtgatggttgtagtgatagtgtgcctgcttaaccactacaaagtctcaacccggagcttcatcaaccggccaaatcagtcacgtcggcgggaggacggccttccccagattatgcacgctcctagaagcagggaccggttcaccgctccatcatttattcaacgagacagattcagccgatttcaaccaacctacccttacgttcagcacgaaatagatttgccaccaactataagcctgtccgatggtgaggaacccccaccgtaccagggcccttgcactctgcagcttagggatcctgagcagcaaatggagttaaacagggagagtgttcgcgcaccccccaataggaccatcttcgacagcgacctgatagacatcgccatgtatagcggtggtccatgccctccgtcatccaatagtggcatttccgcttcgacctgctcaagtaatgggcggatggaagggccccctcccacctatagtgaagtgatggggcaccatcctggggcaagcttcctgcaccatcaacgaagcaacgcacatcgtggcagtcgacttcagttccaacaaaataacgcagagtcaacaatagtccccattaagggcaaagaccggaagccgggaaatcttgtgtag

SEQ ID NO: 183034 - DNA, 1119 bp, Artificial Sequence
  Description of Artificial Sequence: Synthetic coding sequence
atggccaagagcaagaccaagcaccggctgtgcagccaggagagctccgttagcgcgctcctggcctcttgtaccctgtccggctcaaacagttccaatagtgacggctcgtttcattataaagataaactctatagaagcgctagccaggcactgcaggcttacattgatgactttgacctaggtcaaatctacccaggagcaagcacgggcaagataaatatcgacgaggactttacgaacatgagtcagttctgtaattacatatataaaccaaacaacgcgtttgaaaacctggatcacaagaagcacagcaattttatttcttgcaggcgccacactgttaatgacattgatagtatgtcattgaccactgacgacctcctccgactaccagccgacgggtcgtttagttatacctatgttggtccctctcaccgtacatctaagaaaaacaagaagtgtagaggaagattgggcagcctcgatatcgagaagaatcctcacttccagggaccgtacacatctatgggcaaggacaattttgtaacgccagtaattaggagcaacataaatggcaagcagtgtggcgacaagatcgagctcctcattttgaaagcaaagcgaaacctggagcagtgtacagaagaacttcccaaaagcatgaagaaagacgactcgccatgctctctggataaactcgaagccgatcgaagctgggagaatatccctgttacattcaaatcgcctgtgcccgtgaactctgacgattctccccagcaaacgagccgggccaagagcgctaaaggagtccttgaagactttttgaataacgacaatcagtcatgcactctgtctggaggaaaacaccatggacctgtggaagccctgaaacagatgctcttcaatctgcaagccgttcaagagaggtttaaccagaataaaacgaccgaccccaaagaggaaatcaaacaggtgtctgaagatgatttcagcaaacttcagctgaaggagagtatgatcccaattacaaggtcgctccagaaggctctccatcacctctctagattacgcgatctggttgacgatacgaacggcgagaggtctccgaagatgtag

SEQ ID NO: 183035 - DNA, 1602 bp, Artificial Sequence
  Description of Artificial Sequence: Synthetic coding sequence
atggccaagagcaagaccaagcaccggctgtgcagccaggagagctccgtgtccgcactcctcgcctcatgcacactctcaggtagtaattcctcaaattcggacggtagcttccactacaaagacaaactgtataggtcggcaagtcaggcactgcaggcgtatatcgatgattttgacttgggtcagatttacccaggggcatctacaggcaaaatcaatattgacgaggacttcactaacatgtcccaattttgcaactacatctataaacccaataatgctttcgaaaaccttgaccataaaaaacactcaaattttataagctgcagaagacacaccgttaatgatattgactcaatgtccctcacgactgacgatctcttgcgcctccccgctgacgggtctttttcgtatacctatgtaggcccttctcaccggactagtaagaagaacaagaagtgccgcggacggctagggagtctagacatcgagaagaacccccacttccaggggccatatacctccatggggaaggataatttcgtaacacccgtaatcaggagcaatatcaacgggaagcagtgcggacgcctgaaaaaccccaagctcatgaatcgaacaaataactgtatcagtgagagcagcctcagctttcctaaaaagtcctcattcaaggacagctctgagcactcattagaaaaaaactatcctcgatggctgacatcccagaagagcgatctaaacgtttctggcataacatcaatcccagacttcaagtaccctgtgtggctccacaaccaggacctgttgccagatgctaactctcagagagtgtatcagatttttaaagacgatcagtgcagtccacgtcatagtcatcaggctcagggcacatcgcgtctgattaacaagctggattgttttgaatatgcctttgaaccctctaacttttctaatagcctcagcgacgacaaggaactagtcaatgaatataaatgcgactttgaacactctcagtgccagtgcgagaatcctctgttaccagggcagagcaccaagcccttttccggcgataaaattgaactgctcattctgaaagcaaagcgtaacctggagcagtgcaccgaggaactccccaaaagcatgaaaaaagatgactcaccctgctctctggacaaattagaggctgacaggtcttgggaaaacattccagtgacctttaagtcacctgtgcctgtgaacagcgatgatagcccacaacagacttcccgcgctaaaagcgcaaagggagttctggaagactttctgaataatgacaaccagagctgcaccctgagtggcgggaagcaccatgggccagtggaagctctcaagcaaatgctttttaacttgcaagccgtgcaagagagattcaatcaaaataagactaccgacccgaaggaagagatcaaacaggtaagcgaggatgatttctctaaattgcaattgaaggagagcatgattcccatcactaggtcccttcagaaagctctacaccatctgtctagactgagagatctggtcgacgacacgaatggggagaggagtccgaagatgtag

SEQ ID NO: 183036 - DNA, 522 bp, Artificial Sequence
  Description of Artificial Sequence: Synthetic coding sequence
atggccgcccccagcggcggctggaacggcgtgggcgccagcctgtgggccgccttgctcctgggcgctgtagctctccgtcccgccgaggccgtcagcgagcctactacggtggcttttgatgtgaggcctggcggtgtggtgcactccttttcccacaatgtcgggcccggagacaagtacacatgcatgttcacatatgcctcccagggcggaactaacgagcagtggcagatgtcactgggcaccagtgaggatcatcagcacttcacttgcaccatctggcggccccaaggaaagagctacctctattttacgcagttcaaggcagaggtcagaggtgccgaaattgaatacgccatggcctactccaaggccgcttttgagagggagagtgatgtacccttgaagactgaggagttcgaggtgactaaaaccgccgtcgctcaccggccaggcgcattcaaggctgaactgtcaaagctggttatcgtcgccaaagccagccgtaccgagctgtag

SEQ ID NO: 183037 - DNA, 426 bp, Artificial Sequence
  Description of Artificial Sequence: Synthetic coding sequence
atgaccatcatggtggaggacatcatgaagctgctgtgcagcctgtccggcgagcggaaaatgaaggcagccgtgaaacactccgggaagggagcactggtaacgggagctatggcgttcgtcggagggctggtgggggggcctcctggtctggccgtcggcggcgccgtaggaggactccttggggcctggatgacttctggacagttcaaaccagttcctcagatcctgatggagctgcccccagctgaacagcagaggctctttaatgaggccgctgcaatcatccgccatctggagtggacagatgcagtccaactcaccgcgctcgtgatgggaagcgaagcacttcagcagcagctgctggccatgttagtgaattacgtaactaaggagctcagggccgaaatccagtacgatgattag

SEQ ID NO: 183038 - DNA, 324 bp, Artificial Sequence
  Description of Artificial Sequence: Synthetic coding sequence
atgaccatcatggtggaggacatcatgaagctgctgtgcagcctgtccggcgaacgaaagatgaaagccgccgttaaacatagcggcaaaggggcgctggtgactggcgcgatggcatttgtgggaggcctcgtgggaggacctcccggtctggcagtgggcggtgccgttggcgggctgcttggcgcctggatgacttccggccagttcaaacctgttcctcagatactgatggagttgcctcctgccgagcagcagcggttattcaatgaagccgctgccattacacgtccctgttcctcctcatgctggccctgctggtag

SEQ ID NO: 183039 - DNA, 459 bp, Artificial Sequence
  Description of Artificial Sequence: Synthetic coding sequence
atggagcggctgaagagccacaagcccgccaccatgaccatcatggtcgaggacattatgaagctgctgtgttccctctccggggaacgcaaaatgaaggctgcggtcaagcacagcgggaagggggctctggtcacaggagcaatggcatttgttggaggcttggtagggggccccccggggctggccgtggggggggcagtggggggcctgttaggggcctggatgaccagcggacaattcaagccggtgccacagattctgatggaattgccaccagcggaacagcaacgcctcttcaacgaggccgcagcaatcatacggcatcttgaatggacggatgcagttcaactcacagcactggttatgggaagcgaagctcttcagcagcagctgctcgcaatgctggtcaattatgtgacaaaagagctccgcgcggaaatccagtacgatgattag

SEQ ID NO: 183040 - DNA, 648 bp, Artificial Sequence
  Description of Artificial Sequence: Synthetic coding sequence
atggagaagaacccccccgacgacaccggccccgtgcacgtgcccttgggacacattgtggctaacgaaaagtggaggggtagccagctggcccaggaaatgcaggggaaaattaaactgatcttcgaagatggattgacacccgacttctacttaagcaacaggtgttgtattttatatgtcaccgaggccgacctcgtcgcaggaaatggctaccgcaagcgactggtgcgagtaaggaatagtaacaacctcaagggaatcgtggtggtagagaagacacggatgtccgagcaatatttccccgccctccagaagttcaccgtactcgatctcgggatggtgctgctgccagtggccagccagatggaggcctcatgtctggtgattcagctcgttcaggagcaaaccaaagagccaagcaagaacccactgctgggaaagaaaagggcactgttgctgagcgagcccagtctgttacggacagtgcaacaaatacccggcgtgggtaaagttaaagcacccctgctgctacaaaagttcccaagtatccagcagttgagtaatgcatctatcggtgagctggaacaagtcgtcggacaggctgtggcccaacagatccacgcttttttcacacagccaaggtag

SEQ ID NO: 183041 - DNA, 648 bp, Artificial Sequence
  Description of Artificial Sequence: Synthetic coding sequence
atggagaagaacccccccgacgacaccggccccgtgcacgtgcccctcggccatatcgtggccaacgaaaaatggaggggcagtcagctggcacaagagatgcaaggtaaaattaaattaatatttgaggatggattgactcccgatttttacctgtctaatagatgttgcattctgtacgtgacagaagctgatctcgtcgccggcaacggctatcgaaaacggctggtgagggtacggaatagcaataaccttaagggcatagtcgttgttgaaaaaaccaggatgagcgagcaatatttcccggcactacagaaattcacagtgctcgatctgggaatggtgctgttgcccgtggcttcccagatggaggccagctgtttggtgattcagctggtccaggagcagaccaaggagccttcaaaaaacccactgttaggtaaaaaacgggctctcttgcttagcgaacctagcctgctgcgaacagttcagcagattccaggcgtgggcaaagtgaaggctcccctacttcttcagaaatttccctccatccagcagcttagtaatgcctctattggcgagcttgagcaggtcgtcggacaggcagtggctcaacaaattcatgcatttttcacccaaccccgctag

SEQ ID NO: 183042 - DNA, 1227 bp, Artificial Sequence
  Description of Artificial Sequence: Synthetic coding sequence
atgagcgagcacgtggagcccgccgcccccggccccggccccaacggcggaggcggcggacccgctcccgcccgggggcctcgcactcccaacctgaatccgaaccctctgatcaacgtgagagatagactctttcatgctttgttcttcaaaatggctgttacctatagcaggctgttcccaccagcgtttaggagactgtttgaatttttcgtacttctcaaggcccttttcgtcctgtttgtgttggcctatatccacattgtgtttagtcgcagtccaatcaattgtcttgagcacgttagggataagtggccgcgcgaggggatcttacgggtcgaagttaggcacaactccagccgcgctcccgtgttcctgcagttctgtgattccgggggtcgcggctcattcccgggacttgctgtcgagcccgggtccaacttggacatggaggatgaggaagaagaggagcttactatggagatgtttggcaatagcagcattaaattcgaactggacatcgagcccaaggtcttcaagcctcccagctctacagaagccctgaacgactcacaggaatttccttttcctgagactcctaccaaagtttggcctcaggatgagtacatagtggaatattccctggagtatggtttccttcggctgagtcaagccaccagacagcgcctgagcattcccgtgatggttgtgactcttgacccaaccagggaccagtgcttcggtgaccggttcagcaggctcctgctggatgagtttctgggctacgacgacatactgatgtcatctgtgaagggattggccgaaaatgaagagaacaagggattcctgcggaacgtggtgtccggcgaacattatcggtttgttagcatgtggatggcgcgtactagctatctggcagcattcgccattatggtcatctttaccctgtcagtctctatgctgctgaggtacagtcatcatcaaatcttcgtgttcattgtggatctgctccaaatgcttgaaatgaatatggccattgctttccctgctgcgcccctcctgacagtgattctggctctggtcgggatggaggccatcatgtctgaattcttcaacgacacaactaccgccttttatattatacttattgtttggctggccgaccagtacgatgccatctgttgccacaccagtacttcaaaaagacattggctccgtattccttag

SEQ ID NO: 183043 - DNA, 1863 bp, Artificial Sequence
  Description of Artificial Sequence: Synthetic coding sequence
atgagcgagcacgtggagcccgccgcccccggccccggccccaacggcggcgggggcggccctgcccccgccagaggtcctaggacccctaacttgaacccaaatccactgatcaacgtgagagatcgcctctttcatgcccttttctttaagatggctgttacatatagtagattgttcccccccgcttttcgtcgccttttcgaattttttgtactgttgaaggctctattcgttctgttcgttcttgcctatatccacattgtgttctctaggagccccattaactgcctagagcatgtcagagataagtggccacgagagggtattctgagggttgaggtccggcacaattcttcaagagccccagtgttccttcagttttgtgattcaggcggtcgtggctccttcccaggactcgccgttgaaccaggctctaacctggacatggaggatgaagaggaagaggaactgacaatggaaatgttcggaaacagcagcatcaaattcgaattggatatcgagcctaaggtgttcaagccaccctcctcaacggaagctctcaacgattcccaagagtttcctttccccgagacccctacgaaagtgtggccccaggacgagtatatcgtcgagtacagcctagagtatggattcttgcggctaagccaagccactcggcagcggttgagcattccggtgatggtagtgactctcgatccaacgcgggaccagtgttttggtgacaggttttcacgcttgttacttgacgagttcctggggtatgacgatatactgatgtctagtgttaaaggcctggctgagaatgaggagaacaaaggatttctcagaaacgtggtctctggtgaacattataggttcgtgtcaatgtggatggcgcgcacctcctacttagctgccttcgccattatggtcatcttcaccctgagcgtgtccatgctgctccgctatagccatcatcagatttttgtcttcatagtggatcttctacagatgctggaaatgaacatggccatcgcgtttccggccgctcccctgctaaccgtcatcctagcactcgttggcatggaagccataatgagtgagttttttaacgatacaactaccgcattctatattatcttaattgtatggctggcagaccaatacgacgcaatctgttgtcataccagcacatcgaagcgccattggctgagattcttttatctctaccacttcgccttctacgcttaccactatagatttaatgggcagtattcctccctcgcactggtgacatcctggttgttcattcaacactcaatgatctacttttttcatcactacgagcttccagccatcctccaacaggtgcggatccaggaaatgttgctccaagcccccccgctaggccctggaacccccactgcactgccagacgacatgaataataactccggcgcgcccgctaccgcccctgactccgctggccagccacctgcactgggacccgtgtccccaggcgcctctggcagcccggggccagtggcggctgcaccaagttctctggtcgcggccgcagcgtccgttgctgccgccgctgggggcgatctgggatggatggccgaaactgccgcgattattaccgacgcctcctttctcagcggactatctgcttctctgctggagagacgtccagccagccctctggggcccgctggggggctgcctcacgcaccccaggattcagttcctccttcagactccgccgctagcgatacaactcccctcggcgctgcagtgggcggtccctcgccagcatcaatggcaccaaccgaggcaccttccgaagtcggcagctag

SEQ ID NO: 183044 - DNA, 447 bp, Artificial Sequence
  Description of Artificial Sequence: Synthetic coding sequence
atggccgccagccccgcccggcccgccgtgctggccctgaccggcctcgcattgttgctccttctgtgttgggggccggggggcatttctggcaataaactcaaactcatgctccaaaagagagaagcccctgtaccaaccaagaccaaagtagccgtggatgaaaacaaagccaaggagtttttggggtcgctcaagagacagaaaaggcagttgtgggatcgcactaggcctgaagtgcagcagtggtatcagcagttcctgtacatgggcttcgatgaggccaaattcgaggacgacatcacctattggttgaaccgcgataggaatggccatgagtactatggcgattactatcaacggcattatgatgaggacagcgccattggcccgcgatctccttatggttttagacacggagcctctgtgaactacgatgattactag

SEQ ID NO: 183045 - DNA, 2964 bp, Artificial Sequence
  Description of Artificial Sequence: Synthetic coding sequence
atgacccccgccctgcgggaggccaccgccaagggcatcagcttctcgtcattgccatcgaccatggaatccgataagatgctttacatggaaagccctcggaccgtggatgagaaactgaagggcgatacattcagtcagatgctcggtttccctacaccggagccgacactcaataccaacttcgttaatctgaagcacttcgggtccccccagtcatctaagcactaccagactgtgttcctaatgaggtccaatagcactcttaacaagcacaacgaaaattacaagcagaaaaagctgggcgaacctagttgcaacaaattgaaaaacatcctatataatggttccaatatccagttgagcaagatttgcctgtcgcattctgaggaattcatcaaaaaagagccattatctgacaccacttcccaatgcatgaaagatgtacaaatcatcctggactcaaatatcactaaagacaccaacgtagataaggtgcaactgcagaattgcaaatggtaccaggagaacgcactgctcgataaggtcaccgacgccgaaattaaaaagggcctgcttcattgcacacagaagaagattgtgccgggtcactccaacgtgccagtgtcgtctagcgccgcagaaaaggaggaagaagtgcatgcgaggttgctccactgtgtttccaaacaaaagattcttttaagccaggccagaaggacccagaagcacctgcagatgctgttggccaagcacgtcgtcaagcactatggtcagcagatgaaactcagcatgaagcatcagcttcccaaaatgaagacttttcacgagccaaccactatccttggtaacagtcttcccaaatgtaccgagattaagcccgaagttaacaccctgaccgccgaaaacaaattatgggacgacgctaaaaatggttttgcacgctgtacagctgccgagatccagaggtttgctttttccgccacaggactgttgtcccacgtcgaggaaggcctagattccgacgccacagactcctcttcagacgatgacttggacgagtacaccctcagaaagaacgtcgcagtgaactgctcaacagaatggaagtggctggttgaccgcgcccgagttgggtcaagatggacatggctgcaggcccagatttctgaccttgagtgtaagattcaacagctgacggacatccatcggcagatacgagccagtaaagggatagtggtcctcgaggagtgtcagctgcctaaggacattttgaagaagcagatgcagttcgctgaccaggcggcttctttgaacatcctgggcaatcctcaagtgcctcaggagtgccaggacccagttcctgagcaagattttgaaatgagtccttccagtcccactcttttattacgcaacattgagaagcaatctgctcagttgacagaaattataaattcactgatcgcccctctcaacttgagccctacctcctcacccctgagttccaagagctgcagtcataagtgtctagctaatggaatctaccggtcagcctccgaaaatctggatgaactcagctcatcttccagctggcttttgaatcagaagcacagtaagaagaagcggaaggatcgaactaggcttaagagtagcagtctcacattcatgagtactagcgccagaacacggccactgcaaagctttcacaaacggaagttatacagactgtccccaaccttctattggactccacaaacgctaccttcgaaggaaacagcttttttgaatactacccagatgccatgcctccagtccgcttcaacctggtcttcttatgagcataacagcgaatcttatctcttacgtgaacacgtctctgaactggatagctcattccacagtgtgcttagcctgccgtcagatgtgcctctgcattttcacttcgaaacgctgctgaagaaaaccgaaatcaagggaaacctggccgaaaacaaatttgtggatgaatacatcatcagcccatctcctgtacattccaccctcaatcagtggaggaatgggtattccccaatatgcaagccacaaatccgctccgagagcagtgcccagttgctacaagggcgaaagaaacgtcatctctcagagacagcgctgggggagaggaccaagctggaagagtccgatttccaacacacagaatcaggtagccattcaaatttcacagcggtgagtaacgttaatgttctgagtcggatccaaaactcaagcaggaacaccgccaggagacgactgagaagtgaaagttcctatgatatagataacatcgttatacccatgtctctcgtcgcccctgccaagctggaaaagctgcagtacaaggagatcctgaccccgagctggaggatggtggtcctgcaacccttggacgaatataaccttggcaaagaggagatcgaagatctatctgatgaagtctttagcttgcgccataaaaaatacgaggagagggaacaggctcgctggagcttgtgggaacaatcaaagtggcatcggcgaaattcaagagcttactcaaagaacgtagagggccaggacctgctgttgaaggaataccctaataatttctcttcatcccagcaatgcgccgctgcctccccacccggacttccttcagaaaaccaggatctgtgcgcgtacggcctgccctcgctgaatcagtcccaggagactaaatctctctggtgggaacgccgcgcctttcccctgaaaggcgaggacatggccgcactgctttgtcaggacgagaaaaaggatcaggtggagagaagcagcacagcctttcacggcgaaatcttcggtacatccgttcctgaaaacggacatcacccaaaaaagcagtcagatggcatggaagaatataagaccttcggcctgggcctaactaatgtgaagaaaaatcgatag

SEQ ID NO: 183046 - DNA, 687 bp, Artificial Sequence
  Description of Artificial Sequence: Synthetic coding sequence
atgagctacgccgagaagcccgacgagatcaccaaggacgagtggatggagaagctcaacaacctccacgtgcagcgtgccgatatgaatcgactgattatgaactatttagtaactgagggcttcaaggaggccgcggaaaagttccgaatggaatcaggaatagagccgagtgtcgatcttgagacactggatgagagaattaagattcgagaaatgatcctgaagggacagattcaggaggctattgcccttattaacagtcttcaccctgagttgctggatactaaccggtacctgtacttccacttgcagcagcagcatctgattgaactgatacgccagagggagacagaagcagctcttgagtttgcccagacacagctggctgaacaaggagaagaatcaagggagtgtctgacagagatggagcgtaccctcgcccttctggcgttcgactccccagaggaatctccatttggggacctgctgcacacaatgcagaggcaaaaagtatggagtgaggtgaatcaagctgtgctggactatgagaatagagagtctaccccaaaactcgcgaaactgttaaagcttctgctgtgggctcagaatgaactcgatcagaagaaggtcaagtatccaaaaatgacagatttatctaagggcgtgattgaagagcccaagtag

SEQ ID NO: 183047 - DNA, 468 bp, Artificial Sequence
  Description of Artificial Sequence: Synthetic coding sequence
atgagctacgccgagaagcccgacgagatcaccaaggacgagtggatggaaaagttgaataatctgcacgtgcagagggccgatatgaatagactcattatgaattacctagtcacagagggttttaaggaggccgccgagaagttccgaatggagtcgggtatagagccctccgtcgatctggaaactctggatgagcgaattaagatcagggaaatgatcctgaagggccagattcagcaggtggtgcatgattgttggcgaaaggagcgggtatttatactcagcgacctcccatcttctattagcgccgcaagccacccgcccagttctgccggctctgcagacgtactcctgctgttcacccacaggactgtcccttgttccgtggtcgggcgtcgcgaggtggtgcaggggtgcgtccactgtctgagagtcggtacagttgacggccatatggcgctgtag

SEQ ID NO: 183048 - DNA, 3534 bp, Artificial Sequence
  Description of Artificial Sequence: Synthetic coding sequence
atggacgtgtaccccccccggcggcagggcctgccccgggcccggtcacctgggggaagttcacggggctctccttcggtttcatgctccaggctgcggcaggtgcagtcgatattgacccagagcagcaagtcgagacctgatggcattctgtgtatcctcgggattgacagccgctataacgaagggtgccgggaattggcaaattacctcttgtttggactttacaatcaaaatactagtgacttcgaaaaaacaggattctccgaagaggtcctggacgatgtaataattctgatcaaaagcgactccgtacacctgtactgcaaccccgtgaacttcaggtacctcctcccttatgtggctcactggagaaatctacattttcactgcatgacagaaaacgagtatgaggacgaggaagcagcagaagaatttaagataacaagctttgtggatatggtgagggactgcagcaggattggaatcccctattctagccaaggtcatctgcagatctttgatatgtttgttgtcgagaaatggccaattgtgcaggccttcgcactggaaggaattggaggagatggcttcttcactatgaagtacgaattgcaagacgtgagcctcaatctgtggaatgtgtacagcaagatggatcctatgtccctagagtccctgctcagcgatgatctcgttgcattcgaacatcagtggacatccttttttgccaactttgacactgaaattccattcttactggaacttagtgagagtcaggcaggcgaacccttcaggagttactttagccacgggatgatttcaagccatattactgagaacagccccaaccgccaaccttttgttctgtttggcaatcacagcacccgggaaaatcttaatgctggcaacttcaattttcctagtgaagggcacctcgtccgcagtactggacctggtggtagcttcgctaagcacatggtcgcccagtgtgtcagcccgaaaggccctctcgcttgtagccgtacctactttttcggcgccacccacgtaccttatttggggggcgatagtaaactgccaaagaagacagaacagatccgtcttctgtcacagatttacgcagcggtgatcgaggcagtgctggccgggatcgcctgttacgccaaaacctcttccttgactaaggccaaggaggtcgctgaacagacgctgggatcaggcctggactcctttgaattaattccttttaaggcagccctgcgaagcaaaatgacgttccatattcatgctgtaaataaccaaggaagaatagtcccactggattcggaagatagtttatcctttgttaagaccgcctgtatggctgtgtatgatatcccagacctgctaggcgggaacggttgcctcggatctgtggtgttttccgagtcattcctcacctcccagatcctggtaaaagaaaaggatggaacggtaacaacggagacctcatcagttgtgctaacggcagcggtcccacggttttgttcttggttagtagaggacaatgaggtcaagttatcagaaaagactcagcaagccgttcggggtgacgaaagctttctgggaacctatctgactggaggcgaaggagcgtatctgtactctagcaatctgcagtcctggccggaggaagggaacgttcattttttcagctccggcttgctgtttagtcattgccgacaccgctcaattatcatttcaaaggaccacatgaattctatatctttttatgacggtgattccacatctaccgtggctgctcttctgattgattttaaatcatcactgcttcctcatcttcctgtgcactttcacggatcctctaacttcctgatgatcgctttgtttccaaaatctaaaatataccaggctttctacagcgaggttttctctttgtggaaacagcaggataacagcggaatcagtctcaaagtgattcaagaggatgggttgtctgtggagcagaaacgcctccatagctcggcccagaaattgtttagcgccctgagccagccggccggcgagaaacgttcttccctgaaactactgagcgccaagctgcccgagctggactggtttctgcagcacttcgctataagctcaatttctcaggagcctgttatgcgaacacatctgcccgttttgctacagcaggccgagattaacaccactcatcgaattgagtcggataaagtgattatctctatcgtgaccggcctccccggctgtcatgccagtgaactgtgcgcattccttgttactttgcacaaagaatgtggcagatggatggtgtacaggcagatcatggacagttccgaatgctttcacgctgcccacttccagagatacctctcttcagcgctcgaagcgcagcagaaccggtctgcacggcagtcagcttatatccgtaagaagacaagacttctcgtcgtgcttcagggctacaccgatgtcatagatgtggtgcaggcccttcagacccacccagatagcaatgtgaaggcctccttcaccattggcgcgattacagcttgtgttgagccaatgtcctgctacatggagcacaggtttctcttccccaaatgcctggaccagtgtagccagggactcgtctccaacgtggtatttacctcacacactacggaacagcggcaccctcttctagtgcagctgcagtccctcatccgcgccgcaaatcccgcagcggcctttatactggccgagaacggcatagttactcggaacgaagatatcgaactcatcctctccgagaattctttcagctccccagagatgctcaggtctcgctacctgatgtaccctggctggtatgagggcaagctgaatgccggcagcgtgtatcccctgatggtccaaatttgtgtgtggtttggacggcccctggagaagacacgatttgtcgcaaaatgtaaggcaatccaaagttcgatcaaaccctcaccattttccgggaatatttatcatatcttgggaaaggtaaaattttccgattcagaacgcactatggaggtatgctataacaccctggcgaactcgctgagtattatgcccgtgctggagggccctacgccaccaccagacagcaagagtgtctcccaggattctagcggtcagcaggaatgttacctggttttcatcggctgcagcctgaaggaagattccatcaaagactggctgcggcagagcgctaaacagaaacctcaacgcaaggctttaaagactagaggaatgctgacgcaacaggaaattcgctccatacacgtgaagcggcacttagaaccactccctgcaggttacttttacaacggcacccaatttgtgaatttttttggcgacaaaaccgacttccacccgttaatggaccaattcatgaacgattacgtcgaggaagcaaatagagaaatcgagaagtataatcaggaattggagcaacaggagtaccatgacctttttgagttaaagccctag

SEQ ID NO: 183049 - DNA, 1488 bp, Artificial Sequence
  Description of Artificial Sequence: Synthetic coding sequence
atggagggctgcctgggccaggagctgttcagcaaccacatgttcctgacatccttatctagtccgaacagacagccctttgtgctgtttggtaaccactcaacccgggaaaatctcaacgctgggaatttcaatttccctagtgaggggcaccttgtgcgcagcacaggcccgggcgggagtttcgctaagcacatggtcgcgcagtgcgtgagtcctaaaggccccttagcctgttctaggacttacttcttcggcgctactcacgtcccttacttgggtggggacagcaagctgcccaagaagaccgagcagatgttattatctcagatctatgccgccgtaattgaggcggtgttagcagggatcgcttgctacgctaaaacctcctcattgaccaaggccaaagaggtggcagagcagaccctgggcagtggcttagactcattcgagctcattcccttcaaggctgctttaaggagcaagatgacatttcacatccacgctgttaacaatcaaggaaggatcgtgcccctcgattccgaggattccctatccttcgttaagacagcgtgtatggccgtttatgacattccagatttgctgggagggaatgggtgtctggggtccgtcgtatttagcgagtccttcctgacctcccaaatcctggtcaaagaaaaggacggaaccgttacaaccgagacctccagcgtggtcttgaccgccgccgtgcctaggttttgttcttggctggtggaggacaacgaggtgaagttgagcgaaaagacgcagcaggccgttaggggggacgagtccttcctgggcacatacctgacaggaggtgagggcgcttatctgtactcctccaatcttcagagttggcctgaggaaggcaacgtccattttttttctagcgggctcttgtttagtcattgtcggcaccgaagcatcataatcagcaaggatcacatgaactctatcagcttttacgacggtgattcgacctccactgtggcagcccttttaattgacttcaaatcatccctgttacctcatctgcccgttcacttccatgggtctagcaatttcttaatgattgcccttttcccaaagtccaagatctatcaggccttctacagtgaagttttcagcctctggaagcagcaggacaactccggcatatctcttaaggttatacaggaagacggactgagcgtcgagcagaaaagactgcactcatctgcccagaaactgtttagcgccctgtcacaacctgcgggagaaaagaggtccagcctaaaactcctgtctgcaaaattacccgaactcgattggtttttgcagcactttgccatatctagcatttctcaagagcccgtcatgaggacacatttgcccgtgttgctgcagcaggctgaaattaacaccacacatagaatcgagagcgacaaaatggacggcgtttctccaaaccatggacagttgtag

SEQ ID NO: 183050 - DNA, 615 bp, Artificial Sequence
  Description of Artificial Sequence: Synthetic coding sequence
atgggcgaggccgaggtgggcggcggcggcgccgccggcgacaagggacccggcgaggccgctacctctccagcggaggagaccgtcgtttggagtccagaggtggaggtgtgcctttttcatgccatgctggggcataaacctgtgggagtaaacagacatttccatatgatttgcatccgggataagttttcacagaacattggtagacaggtacctagcaaagtcatttgggaccacctgagcacaatgtacgacatgcaggcacttcacgagtctgaaatcctgcccttcccaaacccagaaaggaactttgttctccctgaagaaatcatccaggaagtgagggagggcaaagtgatgatcgaggaagaaatgaaggaggagatgaaagaggacgtagacccacataacggcgctgacgacgtgttttcttcctcagggtccctaggcaaggctagtgagaagtcaagtaaggacaaggagaagaattcctctgatctagggtgtaaggagggtgccgacaagagaaaacggtcccgggtgacggacaaggtactgacggctaacagtaatcctagtagtccttcggctgccaagcggaggagaacctag

SEQ ID NO: 183051 - DNA, 1278 bp, Artificial Sequence
  Description of Artificial Sequence: Synthetic coding sequence
atgtaccccagcaacaagaagaagaaggtgtggcgggaggagaaggagcgcttgctgaagatgaccctagaggagcgccggaaagagtacttgcgggactatatacccctgaattctatactgagctggaaggaagaaatgaagggcaaaggacagaatgacgaggagaacacccaggaaacctcacaggtcaaaaaatccttgaccgagaaagtgtccctctacaggggtgacattactctgctggaggtggacgcgatcgtcaacgcggctaatgcgtctctactgggcggtgggggtgtggatgggtgcattcatagagccgctggcccttgccttctggctgagtgtcgcaacctgaacggctgtgatacaggccatgcaaagatcacttgcggatacgatctgcctgcgaagtacgtcatccataccgtgggccccattgctagagggcatatcaatggctcacataaagaagatctggccaactgctacaagtcctccctgaagttagtcaaggagaataatattcgtagcgtagcattcccatgtatctccacgggcatatacggcttccctaacgagccagccgctgttatcgccttaaatactattaaagaatggcttgccaaaaatcatcacgaggtcgacaggatcatattctgcgtgtttctcgaagttgatttcaaaatctacaaaaaaaaaatgaacgaattcttctccgtcgacgacaacaatgaggaggaagaggatgttgaaatgaaggaggattcagatgagaatggccccgaagagaaacagtcggtggaagaaatggaggagcagtctcaggacgctgacggcgtcaacactgtgacagtgcccggtccagcttcggaagaggcagtggaagattgtaaggacgaagattttgccaaggatgagaacataacaaaggggggcgaagtaacggaccattcagtgagagaccaggaccatccagacgggcaggaaaatgacagcaccaagaacgagatcaaaatcgagaccgaaagtcagtccagctacatggagaccgaggaattgtcctcaaaccaggaggatgccgtaatcgtcgagcaacctgaggtaatcccactcactgaggaccaggaggagaaagagggagaaaaagcacccggagaggacacccctaggatgcccggcaaaagcgagggatcctctgacctagaaaacacacccggcccagatgcaggagctcaagacgaggccaaagagcaaaggaacggcaccaaatag

SEQ ID NO: 183052 - DNA, 1248 bp, Artificial Sequence
  Description of Artificial Sequence: Synthetic coding sequence
atggccttcctgatgcacctgctggtgtgcgtgttcggcatgggcagttgggtcactatcaatggtctgtgggtggagctacctttactagtgatggaactgccagaggggtggtatctgccctcctacttaacagtagtgatccagctggcgaacatcggacccctcctggtgaccctcctccaccatttccgtcctagctgtctcagcgaagtgcccatcatctttaccctgctgggtgttgggaccgtcacttgcatcatattcgccttcctatggaacatgaccagctgggtcctagacggccaccacagcattgcgttcctcgtgttgacattctttctcgccctagtggattgcaccagctctgttacttttctcccttttatgtcacggctgcccacgtattacttgaccacattctttgtgggcgaagggctgtctgggcttctgccggccctggtggcacttgcacagggatcaggactgactacctgcgttaatgtgactgaaataagtgatagtgtcccgtccccagtccccacgcgtgaaactgatatcgcccaaggcgtgcccagagctcttgtgagcgctctgcctggcatggaggctccgctgtctcacttggagtccagatacctgcccgcacacttcagtcccctagtgttttttcttttgctctctataatgatggcttgctgcttggtggctttctttgtcctccagagacagccaagatgctgggaggccagtgtagaggacctgctcaacgaccaagtgactctgcattcaattcgtccacgagaagagaatgatctcgggcccgctggaactgtcgactccagtcaaggacagggctatcttgaagaaaaagctgccccttgctgccctgcacatcttgcatttatttataccctggtcgccttcgtcaacgcgttgaccaatgggatgcttccaagcgtgcagacttacagctgtctgagctatggtccagtagcatatcacctcgctgccactttatcaattgtcgctaatcctctggcgagcctggtgagcatgtttctccccaaccgctcactgctgtttctcggcgtactgagcgtgctcggcacctgctttggtggttacaatatggcaatggccgttatgagcccttgtcctctcctccagggtcattggggaggcgaagtgttgatcgtatctatcagaccggtggggctgcttccacttcgaacgccacacccctag

SEQ ID NO: 183053 - DNA, 1038 bp, Artificial Sequence
  Description of Artificial Sequence: Synthetic coding sequence
atgctgcggcccgccggcctgtggcggctgtgccggcggccctgggctgcgcgcgttccggctgaaaatttgggcagaagagaggttaccagcggggtctctcccagagggtctacaagcccccgcaccctgaatatcttcgaccgagacctgaagcgcaaacagaagaattgggctgcccgtcagcctgagccgaccaagtttgattacctgaaggaagaagtggggagtcggatagccgacagagtgtacgacatccctaggaacttcccactggctctggatttgggatgtggccgcggttacattgcacagtaccttaacaaggagaccattggcaaattttttcaggctgacatcgccgagaatgcacttaagaactcttcagagactgagatccccaccgtgtccgtgttggccgacgaagaattcctgcccttcaaagagaacactttcgatttggtggtttcgtctttatccctgcactgggtcaacgatctgcccagggcactcgaacagatacattatatcctgaaacccgatggagtgttcataggcgccatgttcggaggagacacactgtatgagttgaggtgctccctgcagcttgcagaaacggaaagggagggcggtttcagtccgcatatctctccattcaccgccgtgaacgacctgggacatctgcttgggcgcgccggcttcaacaccctcaccgtggataccgacgaaatccaggtgaactacccaggcatgtttgagcttatggaggacctccaaggaatgggagaatccaactgcgcatggaataggaaggctctgctccatcgtgacacaatgctagccgccgcagccgtctacagggagatgtatcgcaacgaagacgggtcggtgcctgctacttatcagatatactacatgattggatggaagtatcacgagtcccaagctagacctgcggagagaggaagcgccaccgtgtccttcggggaattgggcaaaatcaataatttgatgccacccggcaagaagtcacaatag

SEQ ID NO: 183054 - DNA, 954 bp, Artificial Sequence
  Description of Artificial Sequence: Synthetic coding sequence
atgctgcggcccgccggcctgtggcggctgtgccggcggccctgggcagcccgggttcccgccgagaatcttggcaggcgggaggtgacaagtggcgtatcacctagaggaagcaccagccctaggactctcaatatttttgacagagatctgaagcggaaacagaagaattgggccgctaggcaaccagaaccgacgaaatttgactatttgaaagaagaggttggttcccgtatcgcagacagagtgtatgacattccccgcaactttccactcgcactggacctggggtgcggaaggggctacatagctcaatatctgaataagctgcaactgttccattgccggaagcttttggaatctttcagcaagctgacactccagaagatgttgtgcctgcactgggtgaatgatctgcctagggccctcgagcagatccattacatcctcaagccagacggagttttcatcggagcaatgtttggtggcgacactctgtacgagctccgttgcagtctgcagctcgccgaaaccgagcgcgagggaggattttctcctcacatatccccttttaccgccgtgaacgacttggggcaccttttggggcgagcgggttttaacacgttgactgtggatacagatgagattcaggtgaattaccccggaatgttcgagctcatggaggatctacagggcatgggcgagagtaattgtgcgtggaatcgaaaagcacttctgcatagggacacgatgctcgccgccgccgccgtttatcgtgaaatgtaccgaaatgaagatggctcagtaccagctacataccagatctactacatgatcggatggaagtaccatgaaagccaagcccggcccgccgagcggggatccgccaccgtcagcttcggcgagttagggaagatcaacaatctgatgccaccagggaagaaaagtcagtag

SEQ ID NO: 183055 - DNA, 804 bp, Artificial Sequence
  Description of Artificial Sequence: Synthetic coding sequence
atgctgcggcccgccggcctgtggcggctgtgccggcggccctgggctgccagagtacccgcagaaaatctgggtaggagagaggttaccagcggcgtgagcccgaggggttcaaccagtccaaggaccttgaacatttttgaccgagacctcaagcgtaaacaaaagaactgggccgctaggcaacccgagcccactaagtttgactatttgaaagaggaagttggatcccggattgcagatcgagtctacgatattccccggaactttccacttgccctggacctgggttgtgggcgcggttatatcgcccaatatctcaataaagagacaattgggaagttttttcaggctgacatcgcagagaacgccctgaaaaactctagtgaaacagaaataccgacagtgtctgttcttgcggacgaggaatttctgcccttcaaagagaataccttcgatcttgtggtgtcgtctctgagcctccattgggtcaacgatctgcctagggcgctggaacagattcactatatcctgaaacctgacggcgttttcattggggctatgttcggtggcgatacactctacgagctccgctgctctcttcaactggcagaaacggagagggagggagggttcagtccccacatctcaccctttactgcagtcaatgacctcgggcatctgctgggtcgggccggttttaacactctgaccgtcgatactgacgagattcaagttaattatcccggcatgtttgaactcatggaagatctccaggaacaaaagagccgtatgctcacatag

SEQ ID NO: 183056 - DNA, 771 bp, Artificial Sequence
  Description of Artificial Sequence: Synthetic coding sequence
atgaagctgacccggaagatggtgctgacccgggccaaggccagcgagttacactccgtgcggaaactgaactgctggggttccagattgaccgatatcagtatttgtcaggagatgccatcccttgaggtgatcactctgtccgtcaattccatctcaacactggagccggtgagcagatgtcagcggctctccgagctgtatctcaggaggaatcggattcctagcttggcggaactgttctacctaaagggcttacctcgactgcgcgttctgtggctcgcagagaacccttgctgcgggactagccctcaccgatacaggatgacagtgcttcgtacactcccccggctgcagaaactcgataaccaggccgtgacagaggaggagctctcccgggcactttcagagggggaagagatcactgcggctcctgaaagggaaggaacaggccatggcggacctaagctgtgttgcaccctgtcatccttgtcctccgcagccgagacaggacgggatcccttggacagtgaggaagaagcaacctctggcgctcaggacgaacgggggctcaaaccaccatcccgaggccagttccccagccttagcgctagggacgcaagcagcagccaccgcgggcggaatgtgttgacagctatcctcctgctgctgagggagctggacgccgaaggtctggaagctgtgcagcaaactgtagggtcccgattgcaagcgcttagaggtgaggaggtgcaggagcacgcagagtag

SEQ ID NO: 183057 - DNA, 654 bp, Artificial Sequence
  Description of Artificial Sequence: Synthetic coding sequence
gtgacccagggcccccagggcctgcgggccagcggccggagctgcgtcggaccatttttgtctcacctcgggagggatcgcacccctggcgtgctgaccgaattaaggtgcgtggtgcctgccaggctaaccgccctggagagatcaagaaagcctcgggggagagggagagggcggtatatcaccttgttacccgtacctgaggccgatcccattctggagcgtgtgccacagcctgaattctgctcttgtgtgaattccatatccactcttgaaccagttagccgctgccaaaggcttagtgagctctacttgaggcggaatcggatcccttccctcgccgagctgttctacttaaaaggtttgccgcgtctgcgtgtgctgtggctggcagaaaatccatgttgtgggaccagccctcataggtatcggatgaccgtcctgaggacacttccgcgccttcaaaagctggacaatcaggccgtaacagaggaggagctgtcaagagcactgagtgagggggaggagatcacagctgccccagaacgcgaaggcaccgggcacggagggcccaagctctgttgcacactatcaagtctgtcgtccgccgcagagaccggacgggaccctctggactccgaagaggaggcctag

SEQ ID NO: 183058 - DNA, 1128 bp, Artificial Sequence
  Description of Artificial Sequence: Synthetic coding sequence
atgaagctgacccggaagatggtgctgacccgggccaaggccagcgagctgcacagcgtgaggaagcttaactgctggggctcacggctcacagacatatcaatctgtcaagagatgccttcccttgaagttattaccctgtccgtgaacagtatatctacactggagcccgtgagtcgctgtcagaggttatccgagttgtatctccgcagaaaccggataccctccctcgcggagctgttttacctcaaggggttgccaagactgagagtgttatggttggccgaaaatccttgctgcggtacatcccctcatcggtaccgcatgacagtgcttcgcaccctgcctaggctgcagaagctcgataaccaagcagtcaccgaggaggagctcagccgcgctctgagcgagggagaggagataacggcagcccccgagagggaggggactggccatggcggacctaagctatgttgtacacttagctcccttagctcggccgcagagacaggacgggatcccttggatagtgaggaggaagccacaggggctcaggatgagcgaggattaaagcccccctccagagggcagttcccaagtctgtccgcccgtgatgcctcctctagccaccgaggacgggtatcaggtggcccactcggcgccgccgcagccagtgctcattgtacacactgtaccgagaccgtcggccgcgaacatggagcctctcagggtccagtcggacgggagcacggggcttcccaaggcctcgaggagttgtgcccgcggggatcctgcgtgtgcgggtcggtcaacgcccacaccagagtcacaagagcgccccatggtgctgtgttagccccccaacccttacttctttcgtggagcgtggaatgtggtccgggtccatgctgggctgaagggaaccgtagccatgtagaagaagttccccatacacgtccccaggctgggttgctatgcagcgactctccgagcgttcccaacgtcttaaccgccattctgctcctgctgcgtgaactcgatgctgagggcctagaagcagtccagcaaacagttgggagcaggttacaggccctgcggggcgaggaggtccaagagcacgcggaatag

SEQ ID NO: 183059 - DNA, 807 bp, Artificial Sequence
  Description of Artificial Sequence: Synthetic coding sequence
atggccgccgtgcgggtgctggtggccagccggctggccgccgcctcagcattcacctccctttctccaggtggaaggactcccagtcaacgggcagctctgcacctgagtgtaccccggccagcagcccgagtggctctcgtactgtcggggtgcggagtgtacgatggcaccgagatacacgaagcgtcagctatcctggtgcacttgagtcgagggggggccgaagttcagatattcgcaccagatgtacctcagatgcacgttatagaccacaccaaggggcagcccagcgaaggcgaatcacgaaatgtacttaccgaatctgcccgcatcgccaggggtaagattacagacctggccaatctgtccgccgccaaccatgatgcagccatttttccaggcgggtttggcgccgcaaaaaatctatccacctttgctgtggatggcaaggactgcaaagtgaataaggaggtcgagcgagtcctgaaggaatttcaccaggccgggaaacccatcggcctatgttgcatcgcacctgtgctggcagctaaagtactaagaggtgtcgaagtcactgtggggcacgaacaggaggaaggaggaaagtggccatatgccggaaccgctgaagccattaaggcactgggggccaagcattgtgtcaaggaggtggtggaagctcacgttgaccagaagaacaaggtggtgacaactccagcgttcatgtgtgagaccgctcttcattacatccacgacggcattggtgccatggtacgaaaagtgctggaattgactggcaaatag

SEQ ID NO: 183060 - DNA, 714 bp, Artificial Sequence
  Description of Artificial Sequence: Synthetic coding sequence
atggccgccgtgcgggtgctggtggccagccggctggccgccgccagcgcattcacctctctctctccgggtgggaggacgccatcccagcgcgcagccctgcatctgagcgtccctcgccctgcagctagagtggcccttgtgctcagcggctgtggagtgtatgacggaaccgagatacacgaagcctccgcgatacttgttcacctatctcgggggggcgccgaggtgcagatttttgctcccgacgttccgcaaatgcacgtcatagatcataccaaagggcagccttcagagggagagtcgcggaatgttcttaccgagtccgctcgaattgcccggggtaaaattaccgacctggccaacctcagcgctgctaaccacgatgctgccattttccctggcggattcggtgccgccaagaatctgttatgctgcatcgctcccgtgctcgccgcgaaagtgctgagaggggtagaggtgaccgttggtcacgaacaagaggagggcggcaagtggccatatgcgggtaccgccgaggctattaaagcccttggcgcaaaacattgtgtgaaggaggtagttgaggcacatgttgaccagaagaacaaagtcgttacaacacccgcctttatgtgtgagacggctctccattacattcacgatggaataggggcgatggtgcgcaaagtgctggagctgaccggcaaatag

SEQ ID NO: 183061 - DNA, 1023 bp, Artificial Sequence
  Description of Artificial Sequence: Synthetic coding sequence
atggccgagggcggcgagctgatgagccggctgctgagcgagaacgcagatttaaagaaacaggttcgtctgctgaaagagaaccagatgctccgcagacttctttcccagtcctgccaggagggcggcggacatgacctgcttcctccccgtgctcacgcgtacccagaggccggctcgcccggtagtggagttcccgattttgggagatttacttcagtggccgacacaccctctcagctgcaaacttcttcactcgaagacctgttatgttcccacgcccccctctcttcagaggatgatacatcccccggctgcgcggccccctcccaggcgccctttaaagccttcctgagtcctccagagccccattcacatagaggtacggatcgcaagctcagtcctctcctctcgcccctgcaggacagcctggtagacaaaacattactggagccacgggaaatggtacgccccaagaaggtctgcttttccgagagttcccttccaaccggggatcgcacgaggcgtagttactatctgaatgagatccaatcttttgctggagccgagaaagacgctagggtcgtaggagagatcgcctttcagctcgaccgtcggattctcgcctatgtttttcccggggtcaccaggctgtacggttttacagtggccaatatccccgagaaaatagaacagacttccacaaaatctctggacggcagtgtggacgagaggaagctgcgtgaactcacccagcgatatctagccctcagcgctcgcctcgaaaaattgggctacagtagagacgtgcatccagcctttagtgaattcctaatcaacacttatgggattctgaaacagagacctgatttacgggccaatccgcttcattcatcccctgctgccctccgcaagcttgtcattgacgtggtcccccctaaattcttaggagactcactcctgttgcttaactgcctctgcgagctgagcaaggaggatggcaagcctctgttcgcctggtag

SEQ ID NO: 183062 - DNA, 561 bp, Artificial Sequence
  Description of Artificial Sequence: Synthetic coding sequence
atggtgcggcccaagaaggtgtgcttcagcgagagcagcctgcccaccggtgatcgcaccaggcgtagctactatctgaatgagatccagtcgttcgcaggcgcggagaaggacgcccgagtggttggagagatcgcatttcagctagacaggcgcatattggcctacgtgttcccaggcgtgacacggctttacggctttaccgtggctaacatcccagaaaaaattgagcagacttctacaaagtccctggacggcagcgtcgacgaacgcaaactgcgcgagcttacccagcggtaccttgctctgtccgccagactcgagaaattgggttacagccgcgatgtgcatccagctttttctgaattcctgattaatacctatggcattttaaaacagcggccagacctgagggcgaatcctctccacagttcccctgcagcactacgaaaattagtcatcgatgttgtgccacccaagttcttgggggactccctcctcctgctcaattgtctctgcgagctctcaaaagaagatggcaaaccactctttgcctggtag

SEQ ID NO: 183063 - DNA, 438 bp, Artificial Sequence
  Description of Artificial Sequence: Synthetic coding sequence
atggtgcagctgatcgcccccctggaggtgatgtggaacgaggccgcagacttgaagcccctcgccctgtctaggagactggaatgcagcggaggaatcatggctcattacagccctgacctgctcggcccagaaatggaaagcagatatttcgctcaggtcgggttagagcacttggcctcatcttctccccctgcatttggctttttaaaatgcctagattactctatttcggtcctctgctcagcgaccagcttagcgatgctcgaggacaatcccaaggtaagtaaactggcaacaggagactggatgttgactttaaaacctaagagtatcacagtaccagttgaaataccatcaagcccactggccggaagaccaagacggagaagacgcctgcggtgcccccacgaccagcactcccaaggcacctgctag

SEQ ID NO: 183064 - DNA, 429 bp, Artificial Sequence
  Description of Artificial Sequence: Synthetic coding sequence
atgatcagcaccgcccgggtgcccgccgacaagcccgtgcggatcgcgtttagtcttaatgacgcttcggatgacaccccccctgaggattcaatacctttagtgtttcccgagcttgatcagcagctgcagccacttcccccctgccatgattccgaggagtctatggaagtattcaaacagcattgccaaatagctgaagaataccatgaggtgaagaaggagatcaccctcctggagcagcgtaagaaagagctcatagccaagttggatcaagccgaaaaagagaaagtagatgctgcggaactggtccgcgaattcgaagccctcaccgaggagaaccgcactctgcggctggcccagtcacagtgtgttgaacagctcgagaagctgcgaattcagtatcagaaacggcagggttcaagttag

SEQ ID NO: 183065 - DNA, 729 bp, Artificial Sequence
  Description of Artificial Sequence: Synthetic coding sequence
atggtgcagctgatcgcccccctggaggtgatgtggaacgaggccgcagacctgaagccattggctctgtctaggcgtctggagtgctcgggcggaatcatggcccactatagtccggatctcctgggccccgagatggaatccagatactttgcacaggtcggtctggaacatctcgctagttctagtccacccgcattcgggttcttaaagtgtctagattatagcataagcgtgctctgttcagctactagcctcgctatgctggaggataacccaaaggtttctaagctggcaacaggcgattggatgctgactctgaaacctaaatccattactgtgccggtggaaatcccaagcagtcctcttgacgacacaccccccgaggactccatccctttagtgttccccgaactggaccagcaactgcagccactgccgccatgtcacgactctgaggagtctatggaggtctttaaacagcattgccaaatcgctgaggagtatcacgaagtcaaaaaagagattaccctgttggagcaacggaagaaggagctgatcgcgaaactcgatcaggcagagaaggaaaaggtagacgcagctgagctagtgcgggaattcgaggccctgaccgaggagaaccgcactctgagattggcgcaatcccagtgtgtggaacagctagagaagctacggatacagtaccagaaaaggcagggttcatcatag

SEQ ID NO: 183066 - DNA, 429 bp, Artificial Sequence
  Description of Artificial Sequence: Synthetic coding sequence
atgatcagcaccgcccgggtgcccgccgacaagcccgtgcggatcgcattttcgctcaacgacgccagtgacgacaccccgccagaagactccattccactggtgtttcctgagctcgatcagcaactgcagccccttcccccctgccacgatagcgaggaatctatggaggtcttcaagcagcattgtcagatagccgaggagtatcatgaagtgaagaaggaaatcaccctgcttgagcaaagaaagaaagagctgatcgccaagttggatcaggcagaaaaagagaaagtggatgcggccgaattagtacgagagtttgaggcgttaaccgaggagaatcgtacactgcggctggctcagtctcagtgtgtggagcagctcgagaagttacgcattcaatatcagaagcgccagggctccagctag

SEQ ID NO: 183067 - DNA, 429 bp, Artificial Sequence
  Description of Artificial Sequence: Synthetic coding sequence
atgatcagcaccgcccgggtgcccgccgacaagcccgtgcggatcgcattttccctgaatgacgctagcgatgacacaccacccgaggatagcatcccattagtttttcctgaactggaccaacagctgcagcctctgcccccttgccacgacagcgaagagtctatggaggtgttcaagcagcattgccagatcgccgaggagtaccacgaagtcaagaaggagataacactattggagcaaaggaagaaagaactgatcgcgaaactggatcaagcagagaaggagaaagttgacgctgcagaactcgtacgtgagttcgaagcactgactgaggagaaccgaaccctgcgcctggctcagagccagtgcgtggaacagctggagaaacttaggatccagtatcagaagaggcaggggtcaagctag

SEQ ID NO: 183068 - DNA, 429 bp, Artificial Sequence
  Description of Artificial Sequence: Synthetic coding sequence
atgatcagcaccgcccgggtgcccgccgacaagcccgtgcggatcgcgttctccctcaatgacgcaagcgatgacacaccacccgaagactcaatcccactggtgtttcccgaactcgaccagcagctccagccgctgccaccttgccacgacagcgaagaaagcatggaggtcttcaaacaacactgccaaatcgctgaagagtatcacgaggtgaagaaggagatcactttgctggagcagcggaagaaggaactgattgccaagttggatcaggcagaaaaggaaaaggttgatgcagcggagctggttagagaattcgaagcattaaccgaggaaaatagaaccttgcgactcgcgcagtcgcagtgcgttgagcaattagagaaattgagaattcaataccagaagagacaagggtcttcctag

SEQ ID NO: 183069 - DNA, 429 bp, Artificial Sequence
  Description of Artificial Sequence: Synthetic coding sequence
atgatcagcaccgcccgggtgcccgccgacaagcccgtgcggatcgcttttagcctcaacgacgcaagcgacgacactccccccgaagacagtattcccctggtcttcccagagctcgatcagcagctgcagcctcttccaccgtgccatgatagcgaagaatcaatggaggtgttcaagcagcactgccagatcgctgaagagtaccacgaggtcaaaaaagagatcacactccttgaacagcgtaagaaagaactgatcgcaaaattggaccaagccgagaaagaaaaagtcgacgccgccgagctggtgcgcgaattcgaggctttgacagaagaaaatcggaccctgagactcgcacaaagccagtgtgtggaacaactggagaagctcagaatccagtatcagaaacgtcaggggtcttcctag

SEQ ID NO: 183070 - DNA, 429 bp, Artificial Sequence
  Description of Artificial Sequence: Synthetic coding sequence
atgatcagcaccgcccgggtgcccgccgacaagcccgtgcggatcgccttttctctgaatgacgcttctgatgataccccacccgaggactctattcccctcgtatttcccgaactggaccagcagctccagccccttcctccttgtcacgacagcgaggagtctatggaggttttcaagcaacactgccagatagccgaggaatatcatgaagtcaaaaaagagattaccctcctggagcagcgcaaaaaagaactcatcgcgaaattggaccaggccgagaaggagaaggtggacgccgcagagctcgtgagagagttcgaagcccttactgaagaaaacaggactctgaggctggcccagagtcagtgcgtcgaacagctggaaaaacttaggatccagtatcagaaacggcagggatccagctag

SEQ ID NO: 183071 - DNA, 729 bp, Artificial Sequence
  Description of Artificial Sequence: Synthetic coding sequence
atggtgcagctgatcgcccccctggaggtgatgtggaacgaggccgctgatctcaaaccactggccctctcaaggagactggagtgttccggcggcatcatggcccattacagcccagacctgctgggccctgaaatggagagccggtatttcgcacaagttggactggagcatctcgcttcgtcatctcctccggcattcggattcctcaaatgcctcgactattctatctccgtgctgtgtagcgctacatcactcgctatgcttgaggacaaccccaaggtctctaaacttgccacaggggattggatgttgaccctgaaaccaaaaagtataactgtccccgttgagatcccaagttccccccttgacgacaccccacccgaggatagcattccacttgtgttcccggagcttgatcagcagttacaaccattgccgccctgccacgattctgaggagagtatggaggtgttcaagcagcattgccaaattgcagaagaatatcacgaagtgaaaaaggagattactctgcttgaacaaaggaagaaggagcttatcgcgaagttagatcaagctgagaaggagaaagtggacgctgcggagctggtgcgggagttcgaagcactgacagaagagaataggaccttacgtttggcccagagccaatgcgtagaacaactggagaaattaagaatccagtaccagaagagacagggatccagttag

SEQ ID NO: 183072 - DNA, 135 bp, Artificial Sequence
  Description of Artificial Sequence: Synthetic coding sequence
atggtgcagctgatcgcccccctggaggtgatgtggaacgaggccgccgacctgaagccattggcgttatcaaggcgcctggagtgctcaggtggaattatggcccactactcaccggatcttcttggcccatag

SEQ ID NO: 183073 - DNA, 285 bp, Artificial Sequence
  Description of Artificial Sequence: Synthetic coding sequence
atgatcagcaccgcccgggtgcccgccgacaagcccgtgcggatcgcgttcagcctgaatgatgcctctgacgacaccccacctgaggactcgatcccccttgtattcccagagctcgatcagcagttgcagccattaccaccttgtcatgattctgaagagagcatggaggtttttaagcaacactgtcagattgctgaggaatatcacgaggtgaagaaagagatcaccttacttgagcagagaaaaaaggaactaattgctaagcttgatcaggccgaatag

SEQ ID NO: 183074 - DNA, 411 bp, Artificial Sequence
  Description of Artificial Sequence: Synthetic coding sequence
atgctggtgagcagcagcagcctgacccccttcccccccgtgcggaccgcagacgacaccccaccagaagactcaatccccctggtgtttccagagctggaccagcagcttcagcctctgccaccttgccacgactctgaagaatccatggaagttttcaaacagcactgccagatagcagaggaataccacgaagtgaaaaaggagatcacactacttgagcagagaaaaaaagagctgatcgctaagctggaccaggctgaaaaagagaaagtagacgccgctgaactcgtcagagagtttgaagctctgactgaggagaaccgcacccttcgtctcgcccaatcccagtgcgtggaacagctggagaaactgaggatccaatatcagaagcggcaaggatccagctag

SEQ ID NO: 183075 - DNA, 786 bp, Artificial Sequence
  Description of Artificial Sequence: Synthetic coding sequence
atggtggtggtggccgccgcccccaaccccgccgacggcacccccaaggtgctcctactctcagggcagcccgcctccgctgctggcgctccagccggtcaggcacttcccctgatggtccctgcgcagcggggcgcctcccctgaagcagcatctgggggcttgccacaggcaagaaagagacagcgactgacgcatctgagcccagaagagaaggctctccggcgaaagttgaagaacagagtcgctgcccaaacggcccgggatagaaaaaaagcccggatgagcgagcttgagcagcaagttgttgacctggaggaggagaaccaaaaactgctgttagaaaatcagctgctgcgcgagaagacgcatggcttagtcgtcgagaatcaggagctacgacagagattaggaatggatgctctggtggctgaagaagaagccgaagctaagggaaatgaggttcgtccagtggcgggtagtgctgagagcgcagccctccggttgagagcacctcttcagcaggtgcaggcgcaactaagccccctgcagaacattagcccctggatcttagcagtgttgaccctgcagatccagagcctgatctcctgttgggcgttttggaccacgtggacccagtcctgcagtagtaacgctctaccacagtccttgcccgcctggagatccagtcagcggtccacccagaaagatcccgtaccttatcagccccctttcctgtgtcaatggggtaggcaccagcctagctggaaaccgttgatgaattag

SEQ ID NO: 183076 - DNA, 528 bp, Artificial Sequence
  Description of Artificial Sequence: Synthetic coding sequence
atgagccggagctacaacgacgagctgcagttcctggagaagatcaacaagaattgttggcgtatcaaaaaggggtttgttcctaatatgcaggttgagggcgtgttctacgtaaacgacgcgttagagaagctgatgttcgaagagctgagaaacgcatgtagaggcggcggtgtgggcggctttctcccggccatgaagcagataggcaacgttgctgcgcttccggggatcgtgcatcgctctattgggctgcccgacgtacatagcgggtacgggtttgctatcggcaacatggccgcctttgacatgaatgatcctgaggccgtggtctctcccggtggtgtaggtttcgatataaactgcggtgtccgactgctcagaaccaacctggatgagagcgatgtgcaacctgtgaaggagcagttggcacaggctatgtttgatcacatccccgttggagtcggttctaagggcgatatgatgcgcgccgtacattgccccgagcaaaatctcgacgttatctag

SEQ ID NO: 183077 - DNA, 2304 bp, Artificial Sequence
  Description of Artificial Sequence: Synthetic coding sequence
atgagccacgccgtgaccatcgaggagccccaggcccagccccaggtcagtcagactcgctatcgggaacggtccagagccggatctcatatctcatccaaccgcgcctacgattttctctatgaccctctcttcattgtgagcagcgaaaaggaccacacgcaagccaatatccaggcgaccctgatcagatccaggcttaggaaggtcccgcgcttcaaaactatgttttccaatttgattcattacccgaggtactcactgtattggtccaagagcgatcccgtgcccccctttatctcgagagaatggaagggccataaagaaaagcaccgggaagccctgcggcagcttacaacaaccgacgccagttttcagatgcccaaagaggtgtacgaggacccagaagttacaggtaaaaatcgatacaagtatttcgagcggccgtttctgccattctttcagcagatgccatttaacgttgtgtacgccgttagcaaagccgagccgtacactttcccacctacatcgacgaaacacctctcaattccctccaagtccacagttggaacacagacagactacagggacgccgacgtgcagacagacccatatagtgcagagtatgtggtgtgtcaggatagcatcccggaacttttgactctggccaccctgacctgggggcgaggtctgccagccggtcaagctgaggtagagatgatcgagcgggcccgtgaaaagcgcgcatgggaagcatctcttcccgctctctctgacacaagccagtttgagaaacgacgaaaaatgatgaacgaaatggaaagaaaagaatgggcgtttcgtgagcaggaaatcgagaaactccaggagatcaggcttgaagtgctgaaggagttgctccgtaagcgggaagaaaaccagaatgaggttaatatgaaacatctgaatgcacgctggtccaagctccaggagggcaaggaggccaaaatggcgaagatccaacggacgcacgttagcaccataaggaaactggtcggaaagagaaaaaatatcgaaggcaaattagaacgccgaaatattataaaagactacagtgattacgctagtcaagtatacggccctctgtccaggctgggctgcttccctgacaacaacagcgaggatttcgtagttaaaaattactatcttaatacttacgagggtttggtggagctcgagagctgtctaccagacttcgtcacccagccccagataagggccccaaaaccaaaggtcatcacaactaaggccggcttcttgaaaagggcggctcgacttgactacgaactagcagaggttcacaaggcacttctcgataagaagaacaaggtactggaagtcaagaagcctccaaggtttctccagcggaatcccatcccccagcctagactgcccactccaactctggagatgaccagtaatgaggaagaggaaatggagatggctgtgatctatctccagaagctgcttagaggccgcgtcgttcagaacatgatgttcgaaggcaaagagaaacggctcgagctcattcaggagcttagaacctgccatgcactgcaagaagacgagaagctcgtaaaaaaggcggagaaacaggtgaccctggccctgcagcgacaacgaaacctccatgaacacaaagtaagcttagtggagaatcacctggcagggctcgagggcagggccttggcagacatgtttgattttcttagcaaggagctggtcagactccaggaagagcggagaatccacgcttttgttatgctggcagagagacagaggagagtccgggaagccgaggaatccggaaggaggcaagtggagaaacaacgccttcgcgaagaggacgagatatttaaagaggtagtgaaagtccaccatagcactatttcatcttatctggaagatatcattctgaacactgaggctaacaccgctgaggagcaagcgagggccgagatcgaaaagatggccgaaaagataaacgatatcgcatatgagatggaatcacggagaacatatttgcagtctgaggaaatcgtggccgaactcgtgtattcctttttaattcccgaagttcaaaagtatttcgtcaaagagaaggtaaggaatgcgcagaggaaacatatcttagctgctcatcagatcatccactcctacactgaaagtatggttcagaagaagcttaccgagggggagcaagacgaggccagcaatgccgccatgctcctggagaaggaaactcagaacgagaacaatagctag

SEQ ID NO: 183078 - DNA, 564 bp, Artificial Sequence
  Description of Artificial Sequence: Synthetic coding sequence
atgagccacgccgtgaccatcgaggagccccaggcccagccccaggtcagtcaaactcgttatcgcgagaggtcaagggctggctcacatatcagctcaaacagagcttatgacttcctctacgatcctctatttatcgtgtcttctgagaaggaccacacccaggccaatatccaggctaccctgataagatcacgcctgagaaaggtcccccgttttaaaacaatgttctccaaccttatccactatccacgctacagtttatactggtccaagagtgacccagtgcccccattcatttctcgggaatggaaggggcataaggagaaacaccgggaggccctgagacaactgaccacaaccgacgccagttttcagatgcccaaggaggtatacgaggacccagaggtgacaggcaaaaatcgttataaggggcaaaaccacaccctatttttactattgctcctttctacatacccgagcctgcaaagcctgctctgggcccttaggttgatcataggaatgctgacattcaaacagatccacacactccagaacatgtag

SEQ ID NO: 183079 - DNA, 717 bp, Artificial Sequence
  Description of Artificial Sequence: Synthetic coding sequence
atgagccacgccgtgaccatcgaggagccccaggcccagccccaggtctcccagacccggtatcgtgaaagaagcagagccgggtcccacatcagtagcaacagggcatacgacttcctgtacgaccccttattcattgtctcttccgagaaggatcacacacaggcaaatatacaggctactttaattcgcagtcggctccggaaggtgccccggttcaagactatgtttagcaacttaatccattatcccaggtactctctatattggtccaaaagtgatcctgttcctccatttatatccagggagtggaagggccacaaagagaagcatcgcgaggcactcaggcagctgaccaccacagacgcctcctttcagatgcccaaagaggtttatgaagaccctgaagtcaccggcaagaacaggtacaaatactttgagagaccttttctgccattttttcagcaaatgccctttaacgttgtgtacgctgtctcgaaagcagagccatatacgttcccaccgactagtactaagcatctatccattccatctaaatccactgttggcacccagaccgattatcgggacgccgacgtacagaccgacccatacagcgctgagtacgtcgtgtgtcaagacagcatcccggagctgctgaccctggccactctcacctggggggaattggtcaaccttcttactattggacgatag

SEQ ID NO: 183080 - DNA, 654 bp, Artificial Sequence
  Description of Artificial Sequence: Synthetic coding sequence
atggacctggcccagcccagccagcccgtggacgagctggagctgtctgttctggagagacagcctgaggagaacacaccgctgaacggggctgataaggtcttcccctccctggacgaggaggtacctcccgctgaggcaaacaaagagtccccctggagtagctgtaacaagaacgtggttgggcggtgtaaactttggatgatcattacctcaatcttcctcggcgtgattaccgtaattattattggactatgcctagctgctgtgacctatgtagatgaggatgagaacgagatattggaactcagttccaataagacattttttataatgctgaagatacctgaagaatgcgtggctgaagaggagctcccacatctgcttacagagcggctaacggatgtgtatagcacaagtccaagtttgggcaggtacttcacctccgtggaaatcgttgactttagcggcgaaaatgcaactgtgacatacgacctgcagttcggagtgccaagtgatgacgagaactttatgaagtacatgatgtcagaggagctggttctcggaattctgctgcaagatttcagggaccagaatatcccgggttgcgagtcactcggactggaccccacatcattactcctctatgagtag

SEQ ID NO: 183081 - DNA, 444 bp, Artificial Sequence
  Description of Artificial Sequence: Synthetic coding sequence
atggacctggcccagcccagccagcccgtggacgagctggagctgtccgtgctggaaaggcaacctgaggagaatactccacttaatggggctgataaagtttttccaagcttggacgaagaagttccgccagctgaggccaacaaggaaagcccctggtcatcctgtaacaagaacgtagtgggacgctgtaagctgtggatgatcattacatccattttcctgggggtaatcacagtgatcattattggattgtgtcttgcagccgtgacctatgtggatgaagacgagaatgagattctggaattatcttccaacaagacctttttcattatgctgaaaattcctgaggagtgtgttgctgaggaggaactgccacacttactgacagagcgagaagtggggcttaaacctaatcccgaagccctggtgggatttgagtag

SEQ ID NO: 183082 - DNA, 753 bp, Artificial Sequence
  Description of Artificial Sequence: Synthetic coding sequence
atggacctggcccagcccagccagcccgtggacgagctggagctgagcgtgctggagagacagcccgaggaaaacaccccattgaatggggccgataaagtgttcccttcactggacgaagaggtcccccctgctgaggctaacaaagaaagcccgtggtctagctgtaataagaatgtggtgggccgatgtaaattatggatgattattaccagcatattccttggcgtgataacagtgatcattataggactctgccttgctgcagtcacctacgtcgacgaggacgagaatgaaatacttgaactcagctcaaacaaaacattttttattatgttgaagattcccgaggaatgtgtagcggaggaagagcttccccatctgctgaccgaaaggaatgaggttatggaagccgggctctgcctgaaagcggtcctgtaccaggttcttgagatgaaaggaattcattcggtcctgcagaaacgtttttgtgggctgattcagaaacaccaacaacatcagagaggaggggactcttttttgtcaaggttttactctctggctctttcacccgtcaagcaattgccctccaccgcttctgccggttcctctctcgacaagggcaggaagcccgcccgggtgggggccatcggaagtgcaggaatgagccattgctggcgatctcttgttttctgtcttttcctcttttgtttcgtactgttctttgaaacgggatcccggagtgttgcctag

SEQ ID NO: 183083 - DNA, 1293 bp, Artificial Sequence
  Description of Artificial Sequence: Synthetic coding sequence
atgtggcggctggtgccccccaagctgggccggctgagccggagcctgaagctcgcagcactgggctcactgctggtacttatggtgctgcactcccctagtctgctggcatcttggcaaaggaatgagctaacagataggcgcttcttgcagctgaataaatgtccagcttgcttcggcaccagttggtgtaggaggttcctgaacggacaggttgtctttgaagcatggggcagactaaggcttttggatttcctgaatgtcaagaatgtatacttcgcccaatatggcgagccccgggagggcgggagaagaagggttgtgctcaagagattggggtcccagagagagcttgcccaactagaccagtccatttgtaagcgcgctactggaaggccacgctgtgacctcctgcaagccatgccacgtacagaatttgcaaggctgaacggtgatgtgaggctgctcacccctgaggccgtggagggctggagtgatctggtccattgtcccagtcagaggctgttggaccgactcgtgcggcggtacgcagagaccaaggactctggcagcttcttgctgaggaacctcaaagattccgagcgcatgcagctgcttttaacactggccttcaaccccgagcctctagtcttgcagtccttcccctccgatgagggctggcccttcgcaaagtatctcggagcatgcggacgcatggttgccgttaattacgtgggcgaggagctgtggtcttactttaatgccccctgggagaaaagagtcgatctcgcttggcagctgatggaaattgctgaacagctgacaaataatgatttcgagtttgcgctgtatttgcttgatgtttcttttgacaacttcgccgtcggcccacgtgacggaaaagtgattattgtcgacgccgagaatgtcctcgtggctgacaaaaggctaattcgtcagaataagccagaaaactgggatgtgtggtatgaatcgaagttcgatgattgtgacaaggaagcctgtctgtccttcagcaaagaaatcctgtgtgcccgggctactgtggaccataattactatgcagtgtgtcagaatctcctgtcgagacatgctacgtggcgcggtacgtctggaggattgctccacgatccgccaagcgagatcgcaaaggatgggaggctcgaggctctcttggatgagtgtgcaaaccctaaaaagaggtatggcaggtttcaggccgcaaaggagctgagggagtacctggctcagctgagcaataatgtaagatag

SEQ ID NO: 183084 - DNA, 666 bp, Artificial Sequence
  Description of Artificial Sequence: Synthetic coding sequence
atgaagagcgagaacggcaccgtggtgggcagcttccccagcgacgagggatggccctttgcaaaatatctgggggcctgtggtcgcatggtcgccgtgaattacgtgggggaggaactgtggtcctacttcaatgccccatgggagaagagagtcgatctcgcttggcagctcatggaaatcgccgagcagcttacaaataatgattttgagtttgctctttatctcttagacgtgtcgttcgacaacttcgcagtgggacctcgggacggcaaggtcatcattgtcgacgccgagaacgtcctggtcgctgataaaaggctcatacggcagaacaagcccgaaaactgggacgtatggtacgagtccaagttcgatgactgcgataaggaagcatgcctgagtttttctaaggagatactctgtgcccgggcaaccgtggatcacaactattacgcggtatgccagaatctgctgagcaggcacgcaacatggagagggacttccgggggacttctccatgacccgcccagtgagatcgctaaggatggacgcttggaggcgcttctggatgagtgcgctaacccaaagaaaaggtacggccgatttcaggctgctaaagaattgcgggagtacctggctcaattgtctaataatgtccgctag

SEQ ID NO: 183085 - DNA, 5079 bp, Artificial Sequence
  Description of Artificial Sequence: Synthetic coding sequence
atgcggcggcccccccccctgggccccaccaccgccagcggccccgagggaaatgtccgaaatctacaaaagcgacaagcccctgggccgggggcagctggtgggtgcgggcctgaggcaggggggtgtagggaaaacaagcagaaacggaggatggtcgccagagccactccgggacggggggaagtggaatcagataagagtgtagccgcttcaggtgcagggaaggcagcacggcgtcaagtagaaggccgtcgaggtcccgtaagcccctcagactcatccgacccccggggcctggaagccgcaaaagaagcagaactaccgctccagacagaacggcacaccaaagagaagcgcaaggtcacagaggcctcttccgacgatcctcagcctggcctggaccttgtccggaaggagagcctgacctccagcgagtctttccagacagtagaatgccttcagtcactgggcaaggaatccataatcgagggtatcaagcggagaattaggaataagaagcttaaatctcttgaaaacccgccacttaagattactgaaaacgaggccacccaaaatatcaaggtggaatttcaagatgagttgtacaagaacacacccaagtattcttgcaacatcctgagcccggaggtggaaaacaatagtgtgctcaagttaagggattgcaactgttttccccactccaaggggtgcaatgacgagaataatcttccatataagcccgatggcggatgcatgcacgttgccgaaaacttcagcaagaaggaaaaccttcgcagcctggccgagaagtccgataccaactccataccacagctgctacagacagaggaaaacgtgatgggcgttaacaagctgctcccagaagaatctgacctctaccagtcaaagaccaatggcctgctttcctgtttgcagcacgaaaagaacaagtacagtattgaggagagctctgtaggtcgcaaaccccgtaaacgcatgaagctgagcgagaaggccgacgaaaccgtgacagagatgaacttctctaacgagtacaacaagtccgagctgatgctgcaagagaaccagatgatagctgacggcaaggaggccgaaactaagtctccccttaatgtactgcgtaaagtgagtcacaacaccgtcagtttaatggatcacctgctgagcgtcccagagacggttgaaaaggaaacatctagcgaacatcacgtcaatgctgtgttccaaaaaaccattgagcccctcctgaaggaggaaaccgagaatgctagcgaaccactcggttacgagtccatggcatcaaaagaagactttaagtcaatgaaaagcttcatcggtaagagccccaacgagtaccacattgagaggcgcagttcaagagaggacctcaggtcagcatcagaggagctaaagctgtcttgccagcgcacaatacctatgacaggaaaaaggacatggccttactattcttgtgcaaggatctcagcctggtgctggaagaaggcctccctgccagagtcatcttacttcctgcgcgggagccaggaatcgtgccgccaggtagacgtgcctaaacatcaaaccaatcaaacccatctgaccgatagcaaactgcttctccagagcagcctcaccgagacaaacaccgaatcatcctcaaaagagaagctggactccaacagcaactgtttaagctcagtatctgcagtcgaacccaccctcatggtcattaaagaacccatcattaaagacgataagaagatcaaaagtgaagagctatcgagacgtggatcagaggtcatatccaacacgacggaagacacgcagctgacctccgaaacacagagcctcactggtaataagaaaaaagccagaggtaacttgaccaagcttaacctcacggccacttccaaagacggtcaagaggccaataatagcgcaggcaagacaatacatcgtaaggcttgcatcgcccagcaaacctttattgtgccagatttagtgaagatcctgaacaccggcaggctgactaactttaaaatcccactcttaaagaacaagagcgagaagcggaaggaggtgaatgcgaaaagctcagagcgagaagcatacagccccttagagctgttggacaatctgagtggggcggatgtgcggcagaatagatccaaggaaaatgtgtccatgatgatgcttggcccgcagacattgagtatcagaaattcagtaacacccgtccaggcctccagtgatagcttttacaataagaagtcatactccattagtccctctttcacaaaacaaggtaacaattctaagccatctaaccacgtcagcgaacctggaaacattgtgagcaataaggaggtagcgtccctgaccgttgagaacaacgccttctcatgcgatcctggatatgttgaaaaatcacccagcttctgctgtaacgaacaggagaccttcagacctgtcagtagtgaagtgcgaggtcgaaagataaccaagaattttagcgaggtgggcttccccgacatcttgaaggcctatgaggatgatgtcctgctaatcgatgtcatccaagatgatcctgatctatttggcgtgtcaaatgagggagaattgagcttcacatctgaggtgccaaaaatctcccaggaacccaacgttgccggcgagcatcagtcaactgactcaaagtatatggaaactcccgtgaagaaagaaccaagcgacgatctgagagaactgccggtgctagactgcggttggattaaacctgacatctgcgcctcaaacagcgctgagtctgaaatcaagagagatccaaaggatgtgaacacatctctgggggaagtggccaatgagacctccgaaaatgaaacactgggcgatttttccgagcagataaagggcagcgacctggatgagaagcaccggttcacagacaaagttattacaaaggaggagaaggagaatatatacgaggtttgtaaatcgaaggactctaggaatgcagattttatggtgggcgaatgccagtttgcagtgccagtgcctaagcccctgtgtctcctcgtgccaccactaaatttgtcgggcagacaggaagacactatcctaaacacttggatgaatgacttcaggttcctaggcaaacattcagtcctgaagcttcagaatcccgaaacatgcgagatcttcaaacgggagaaaaacgtgggggtgtttcagaagtcattgggcttgatgatcccctataagtattgcaagtttcactttaacacattgaggggctgcgagcggcctctttgcaagtttgcccacgtaccggagcagggcgacgagaaggtgtgtatggatgtgttcaaaaaatatattaacattaacgagctgtgtctgctgcagcgagcggtcaacatctttatggagtactataggaagtttcctccaggggtgtactttgatctccaggtcctgaacgatctgctcaattctctgctgaaacattgcctgttaaaagaggtcttccagatcgtcaatctgagcataatggtgaaaatgttacccagcctgaagatcctgttaaatattttcgagtatgtcgccaccatgaagttgagaaatgcagttcccgcccttattgatatcttctgtaaactggttgaagccggaatggtgctagatccagagcacttcaattatattgtcaagctgttgtaccaagtgcaggcttcaaaacaggaaattacagctgtccttgaaatgaaatctcgtctgcaaatgcgtcggttcaagaagaattggaagtgtgacctggactctgccctcaacaagttagaacactgtaaggagaaaggtgattggaccaaactggggaagctgtacatcaatgtcaaaatgggctgtgaaaagtttgccgacttccagacattttgcgcgtgtattgctgaaacattgacaaagaattacgaagacgagcgaccagatatccccttttgcgagtttgcagagaccgtgtccaaggatcctcagaatagcaaggtggacaaaggagtgctggggagaattggcatctccgccatgtacttctatcataaactcctgcagtggagcaaaggccgaaaagtattggaaaaactgtatgagctcaaaattcattttacctccctgaagggccttatcggtccagagaagttggcttcacgctgccagatcgtgaatgtggccgccgagatattcctgaagtctggaagcctcgatggagccatatgggttatgagggaaagtgaatggatcatcaacacccccctatggccctgtgaccgacttgacgtgctgaatcgacacaacctgctctgcacgattgcacatgagatactcgccaaatctctctatcgccagacctttgaggttcttcagaatcttccagggtttcagaattcacaggaaacagtggaagttagccagtactccctgctatttaacaaattactgggtagctgtattgagagttctagtctgggaatgagctccagcgtggctgagtttatgatcagtaagagtattcctattgatttctcgtttcttcgtcgcttgattacttcattaggacggtccaggctgtggctcaaggcacgggctcactacaagtccgccctgtcgttggggtgttatcccccactggagggcaatctataccgcaagttgctgcttattccctcatacttaagtgaaattgaaatgcttctcgcgattgagatcttcatggtctcaaacgcctcttctatacaaagccccggaacgagcactcagatcctgcagattgtactgaagaggtgcgaagataaccaatcacgctccaacgatgattaccaggccgccgtggagcggctcatcatggctgctaggatttcagatcccaagctgtttgtcaaacacatgaccgtaaatgtgaataaggagcaggtctacagccttgagcattgctccgccttgaaatggctgaaagagaacatgaaatgggctggtaaagtgtggctcttcagtaaccactag

SEQ ID NO: 183086 - DNA, 207 bp, Artificial Sequence
  Description of Artificial Sequence: Synthetic coding sequence
atggtgtactaccccgagctgttcgtgtgggtgagccaggagcccttcccaaacaaggacatggaggggaggcttcccaaaggacgtttaccggtgcctaaggaagtcaataggaagaaaaatgatgaaactaacgccgccagcctcacccctttaggctctagtgagctaagaagccctcgaatcagctatctgcattttttctag

SEQ ID NO: 183087 - DNA, 207 bp, Artificial Sequence
  Description of Artificial Sequence: Synthetic coding sequence
atggtgtactaccccgagctgttcgtgtgggtgagccaggagcccttccccaacaaagatatggagggacgactaccgaaaggccggctccccgtcccaaaagaggtgaacagaaagaaaaatgacgagactaacgcggcatcactgactcccctcggcagcagcgaactccggtcccctcgcatcagctacctgcacttcttctag

SEQ ID NO: 183088 - DNA, 339 bp, Artificial Sequence
  Description of Artificial Sequence: Synthetic coding sequence
atgaagggcgtgtggaactacagcgccctgagccggcgggaggacgaaactagaacccagcgatctcggatgacagatcgggttccatgcagcaaatgcttccaggttcactgtcagatcagtgtattgaattgcgtgtactatcctgaactgttcgtatgggtgagccaggaaccctttccaaacaaagatatggagggtcggcttcctaaagggagactgccagtgcccaaagaggttaacaggaagaagaatgatgagactaatgctgcctccttaactccgctgggaagttcagaactgagaagcccgcgaatctcttacctgcatttcttctag

SEQ ID NO: 183089 - DNA, 207 bp, Artificial Sequence
  Description of Artificial Sequence: Synthetic coding sequence
atggtgtactaccccgagctgttcgtgtgggtgagccaggagccctttccaaataaggatatggaaggcagacttcccaagggtcggctccccgtacctaaggaggtcaaccggaagaagaacgacgaaaccaatgctgcaagcctgacccctctcggcagctcagagctgaggagtccgcgtattagctatctccactttttttag

SEQ ID NO: 183090 - DNA, 207 bp, Artificial Sequence
  Description of Artificial Sequence: Synthetic coding sequence
atggtgtactaccccgagctgttcgtgtgggtgagccaggagccctttcctaacaaggatatggaaggcagactgcccaaaggtaggctgccggtacccaaagaagtgaaccggaaaaaaaacgatgagactaacgctgcgagccttacgcctttgggatcttccgagctcagaagtccaagaatctcgtacttacacttcttctag

SEQ ID NO: 183091 - DNA, 207 bp, Artificial Sequence
  Description of Artificial Sequence: Synthetic coding sequence
atggtgtactaccccgagctgttcgtgtgggtgagccaggagccctttccaaacaaggacatggagggccgactgccaaagggccgcctgcctgttcccaaggaggtcaacaggaagaagaacgacgagactaacgccgcctcactgactccgctgggttccagtgaactgagatcgcctcgaatcagctatctccactttttctag

SEQ ID NO: 183092 - DNA, 207 bp, Artificial Sequence
  Description of Artificial Sequence: Synthetic coding sequence
atggtgtactaccccgagctgttcgtgtgggtgagccaggagcccttccctaataaggacatggagggcagactgcccaagggacggttgcccgtgccaaaagaagtcaatcgcaagaagaacgacgaaacaaacgcagccagtctgacccctcttggcagtagcgaattacggtctccgcgcattagctacctgcattttttttag

SEQ ID NO: 183093 - DNA, 207 bp, Artificial Sequence
  Description of Artificial Sequence: Synthetic coding sequence
atggtgtactaccccgagctgttcgtgtgggtgagccaggagccctttcccaataaagatatggagggtcggctgcctaagggcaggctcccagtgcccaaggaggttaatagaaagaaaaatgacgaaacaaacgcagcctccctaacgcctctgggcagttctgaacttcgctcaccccggatatcttacctgcacttcttttag

SEQ ID NO: 183094 - DNA, 207 bp, Artificial Sequence
  Description of Artificial Sequence: Synthetic coding sequence
atggtgtactaccccgagctgttcgtgtgggtgagccaggagccctttccaaataaagacatggaaggacgtctgcctaaaggccgcctccccgttcctaaagaggtaaacagaaaaaagaacgacgagactaatgccgcatctctgacacctttggggagcagcgagttacgatcccccagaataagttatttgcatttcttttag

SEQ ID NO: 183095 - DNA, 18 bp, Artificial Sequence
  Description of Artificial Sequence: Synthetic coding sequence
atggtgtactacccctag

SEQ ID NO: 183096 - DNA, 102 bp, Artificial Sequence
  Description of Artificial Sequence: Synthetic coding sequence
atggtgtactaccccgagctgttcgtgtgggtgagccaggagcccttccccaataaagatatggaggggaggttgcccaaaggacgtctgccagttccctag

SEQ ID NO: 183097 - DNA, 207 bp, Artificial Sequence
  Description of Artificial Sequence: Synthetic coding sequence
atggtgtactaccccgagctgttcgtgtgggtgagccaggagccctttccgaacaaggatatggaaggccgactgcctaaggggcggctgcccgttcctaaggaagtgaatcggaagaaaaacgatgagactaacgctgctagcctgacacccctcggttcatcagagttgcgttcccctaggatctcttaccttcacttcttctag

SEQ ID NO: 183098 - DNA, 207 bp, Artificial Sequence
  Description of Artificial Sequence: Synthetic coding sequence
atggtgtactaccccgagctgttcgtgtgggtgagccaggagccctttcctaataaagacatggagggaagactgccaaagggccggctccctgttccaaaagaagtgaacagaaagaagaacgacgaaacaaacgctgcatccctgaccccgcttggctcttccgaactccgctcgccgaggatatcctaccttcattttttttag

SEQ ID NO: 183099 - DNA, 198 bp, Artificial Sequence
  Description of Artificial Sequence: Synthetic coding sequence
atggtgtactaccccgagctgttcgtgtgggtgagccaggagcccttccccaacaaagacatggagggcaggttgccaaagggtcgtctgcctgttcccaaggaagttaaccgtaagaagaatgatgagactaacgccgcctcacttacgcctctgggaagctctgaattgcgaagcccaagaatctcctatctgtag

SEQ ID NO: 183100 - DNA, 735 bp, Artificial Sequence
  Description of Artificial Sequence: Synthetic coding sequence
atgcactacggcgccgccacccacatccagaacagccggagccacggattagaaaccgtcccaggacatcagaggcttgagcgaggggcaggaggtgagacccctgaattccctggatgccatagccctgctccccccgagaatttcggcaatgagctcctgcccctgtccgctccgcttcagggtcttagcgaaggactgtaccccccagggcgaaacaagaccttacctgccggcgtactccgtgaaggcgcagtgcagtttctgcacaggggactctgcaactcaaatctcagctctgaagctagcgcccggccatcaggcacccaagatgagcttcacagtagccgcaggaaaacaggccagactagacgtgagggggccagaaagcacttagtgtgttcattccggctatatcccttcacagtccacaccgtgagccccggaaactctcacctagctttgtaccaggtgttcaaggcagtcaaactctgcccatctgagacctccttcttccttagccgaaagtccctcaagtcttccgatccctggcaccctccttctctcagccccaatagctggaacaggcaagccggattccgcgcctggagtagccatctgatctctctgagccttacatgcagtgattcccagagccgccgagtgtcctcttctcagcagccaccgttacactctttaagttctcacaggagggctgcacatgttcctgagtag

SEQ ID NO: 183101 - DNA, 480 bp, Artificial Sequence
  Description of Artificial Sequence: Synthetic coding sequence
atgtaccggcggaagagcggctggaccggctgcgccatcacctgctctccatgcaccgccatgacccagctgcggaactgcatgaggctgtctagaagttgctcgctgacatgggagacaccgcgttggtacatggccggaagagtggccacttccacctctggttgccattgctggatgagccgccgagacctaacaccactccctcaccccagtgagcctggggtcctggactgtctcgggccatgccacctcctgcctctgctgagccccggatcgccctgctgggtacttggtttgcactttagcctgcacccgccctccgccgcaagcgcctcccacgccctaacaatcaccagcctgccccccggccttctccctttcgtgggagttgagttaactgcccacccacaagctttgatgggtagggggttcccaagtggcatgggcgccgcaggcagacatctttgctttctctag

SEQ ID NO: 183102 - DNA, 480 bp, Artificial Sequence
  Description of Artificial Sequence: Synthetic coding sequence
atgtaccggcggaagagcggctggaccggctgcgccatcacctgctcaccgtgtactgctatgacacaactgcgcaattgtatgcgactctcacgttcttgtagtctgacttgggagactcctagatggtacatggccggtagggtggcaactagcaccagtggttgccactgctggatgagtcggcgcgatctgacaccacttcctcatccatcagaacctggagtcttggactgtctgggaccttgtcacctgcttccgctgctgagcccagggtctccctgctgggtactgggcctgcacttctctctccatcctccctcggctgcatccgccagtcatgctctaactataacctcattaccccccggcttacttcctttcgttggtgtcgagctgactgcccacccgcaggccctgatgggtagaggatttcccagcggtatgggcgccgcgggacgtcatctttgcttcttatag

SEQ ID NO: 183103 - DNA, 480 bp, Artificial Sequence
  Description of Artificial Sequence: Synthetic coding sequence
atgtaccggcggaagagcggctggaccggctgcgccatcacctgctccccttgcaccgctatgacccagctgcgaaattgcatgagattatctcggagctgctctctgacatgggaaacccctcgctggtacatggcggggcgtgtggcgaccagcacatcaggttgtcattgctggatgagtcgccgagatctgacacctctgccacatcctagcgagccaggcgtgctcgactgcctgggcccctgtcaccttctgcccctactgagcccaggcagcccatgctgggtactcggactccacttttcccttcaccctccgagtgccgcttccgctagccatgcactcacgatcacctccctcccacctggcctgctccccttcgtcggagtcgaattgaccgcgcacccgcaggcacttatgggacgaggattcccctccggtatgggcgccgcagggagacacctttgttttctttag

SEQ ID NO: 183104 - DNA, 480 bp, Artificial Sequence
  Description of Artificial Sequence: Synthetic coding sequence
atgtaccggcggaagagcggctggaccggctgcgccatcacctgctcaccttgtacggccatgacacagttgaggaattgtatgcgactttcacggagctgttccctgacatgggagaccccacgctggtatatggccggccgggttgccactagtacttccggatgtcactgttggatgagcaggcgagatctgacgccactgcctcatccctctgagcctggcgtcttggattgtttggggccttgccacctgcttcctttgttaagccccgggtctccctgttgggttctgggactgcatttctcgctccacccacccagcgccgcttctgcatctcacgcattgacgatcactagtctccctccaggtctgctgccttttgtgggcgtggagctaacagcacacccgcaagcgttgatgggtaggggcttcccaagtggtatgggggctgccgggcgccacctttgctttctgtag

SEQ ID NO: 183105 - DNA, 294 bp, Artificial Sequence
  Description of Artificial Sequence: Synthetic coding sequence
atgagcagcgcccccgagccccccaccttcaagaaggagccccccaaagagaaggagtttcaatccccaggattgcgcggggtgcggacaactactctgttcagggcagtcaatcctgagctatttatcaagcccaacaagccagtcatggccttcggcctagtcaccctttcactctgcgtggcctatataggttatctccatgcaatccaggaaaacaagaaggatctttatgaagcgatagactccgagggccacagttacatgcggaggaagacctctaaatgggactag

SEQ ID NO: 183106 - DNA, 768 bp, Artificial Sequence
  Description of Artificial Sequence: Synthetic coding sequence
atgaccaagaccagcacctgcatctaccacttcctggtgctgagctggtacacctttctcaattactatatttcccaggagggcaaggatgaggtcaagcctaagatcctggctaatggggcccgttggaaatacatgacacttctgaatttactccttcagacaattttttatggggtgacttgcctggacgatgttctcaaacgcactaagggaggcaaagacattaagtttctgacggcgttcagggatctacttttcacaacactggccttccccgtgtcaacttttgtgtttttagcattctggatcttgtttctgtacaatagagatctcatatacccaaaagttctagataccgttataccagtgtggctgaatcatgcgatgcatacttttatcttccctattacgctcgccgaagttgtgctgagaccccacagttacccttccaaaaaaactggactgactttactcgccgctgcgtccatcgcctacatttcgaggatcctctggctctatttcgaaacaggcacatgggtttatcctgttttcgccaagctttctctgctcggacttgcagctttcttctccttgagttatgtgtttattgcctccatctatctactgggtgaaaagcttaatcactggaagtgggtaagcgttcagatcttgcagcgttggagactggaatctgttggcatctgtttccaatggcctgattggaagtcgcctgctaagcaccagctcgtgaagaacatccggtag

SEQ ID NO: 183107 - DNA, 510 bp, Artificial Sequence
  Description of Artificial Sequence: Synthetic coding sequence
atgaccaagaccagcacctgcatctaccacttcctggtgctgagctggtacaccttcctcaactattacatttctcaagagggtaaagatgaagtcaaaccaaaaattctcgctaatggtgcacgctggaagtatatgaccttgctaaatttactgctccaaacaatcttttatggcgttacatgcctggatgatgtgctgaagcgcaccaagggtggaaaggacatcaagtttctgaccgcatttcgagatctgctgttcaccacgctggcattccctgtctccaccttcgtctttttggccttctggatcctgttcttgtataacagagatctgatctaccccaaagtgctggacacagtcatacccgtgtggctcaaccacgccatgcacactttcatttttcccattaccttggctgaggtagtcctaagacctcattcctatccttccaagaagactggtcttacgctactggccgccgccagtattgcctatatctcgaggtag

SEQ ID NO: 183108 - DNA, 693 bp, Artificial Sequence
  Description of Artificial Sequence: Synthetic coding sequence
atgaccaagaccagcacctgcatctaccacttcctggtgctgagctggtatacttttctgaactactacatcagtcaggagggcaaggacgaagtgaagcccaagatcctcgcaaatggagctaggtggaaatacatgacgttgctgaatttactcttacaaacaatattctatggagtgacatgcttagacgatgtgctcaagaggacaaagggcggaaaggacatcaaatttctgaccgcctttcgcgacctattgttcacaaccctggctttcccagtatctacatttgtgtttcttgcattttggatcctcttcctgtacaatcgggacttgatataccctaaggtgctcgataccgtaatcccagtgtggctgaatcacgcaatgcacaccttcatcttccccattactctcgccgaggtggtgttaaggccacactcttatccaagcaagaaaaccgggctcaccctgctggcagccgccagcatagcctatataagccgcattctttggctttattttgagaccgggacctgggtctatcctgtgttcgcgaaactttcacttctgggtctggccgccttcttctctctgtcttatgtctttattgcctcaatatacttgttgggtgagaagctcaaccattggaagtggggcgatatgcgtcagccacggaagaaacgcaaatag

SEQ ID NO: 183109 - DNA, 507 bp, Artificial Sequence
  Description of Artificial Sequence: Synthetic coding sequence
atgaccaagaccagcacctgcatctaccacttcctggtgctgagctggtataccttcctgaactactatatctcgcaggaaggcaaggatgaggtgaaacccaaaatccttgctaacggagccaggtggaagtatatgacactgcttaatctgctgttacagactatattctacggggtcacatgcctggacgacgtgctcaagcgcactaagggggggaaggatatcaaattcctcacggcattcagagacctgctgttcacgaccttggcatttccagtctcaacctttgtgtttctcgctttttggattctcttcctttataacagagacctcatttatcctaaggttcttgacaccgtgattccagtctggctcaaccatgctatgcacacatttatattccccattaccctggcagaagtcgtcttgagaccccatagttaccctagcaagaaaacaggattgacactcctggccgcagcctctatcgcctacatttcctag

SEQ ID NO: 183110 - DNA, 675 bp, Artificial Sequence
  Description of Artificial Sequence: Synthetic coding sequence
atgagcttcgtggaggacgtgaccatcggcgagggcgagagcatccctccagatacccagtttgtcaaaacctggcgcatacagaattcaggggctgaggcctggccacccggagtctgtttgaaatatgtgggtggcgatcagtttggtcacgtaaatatggttatggtgcggagcttagaacctcaagagattgcggacgtgagcgtccagatgtgttctccttcccgggccggcatgtatcaggggcagtggagaatgtgcacagccacaggactgtattacggcgacgttatctgggtcattctatctgtggaagtggggggtctgctgggggtgacgcaacagctgagtagttttgagacagagtttaacacacagccgcacagaaaagttgaggggaattttaaccccttcgcaagtccccagaagaatagacagtcggacgagaataacctgaaggatccaggtggctcagagttcgactccattagcaagaatacgtgggcgcctgcccccgacacatgggcaccagctcctgaccagactgaacaggaccaaaatcgtctctcccagaattctgtgaacctcagtccctccagtcacgctaataatttgagcgtggttacctactccaaaggcctgcacggtccgtacccctttggccaatcatag

SEQ ID NO: 183111 - DNA, 897 bp, Artificial Sequence
  Description of Artificial Sequence: Synthetic coding sequence
atggagggcatggacgtggacctggaccccgagctgatgcagaagtttagctgccttggcaccactgacaaagatgtgttaatatcggaatttcagagactcctaggattccaactgaaccctgctggctgcgcattttttctggatatgactaactggaacttgcaggccgccattggcgcctactatgacttcgaaagcccaaacatctcagtcccttctatgtcatttgtggaagatgtgaccattggagaaggcgagtccatccccccggatacacagttcgtgaaaacatggcggatccagaattccggcgccgaagcctggcctcctggagtgtgtctgaaatacgtggggggcgatcagtttggccatgtcaatatggtgatggtcagatctctcgaaccccaagagatcgccgatgtatctgtgcagatgtgttccccctcccgggcgggaatgtatcagggccagtggaggatgtgcacagccaccgggctctactacggagacgtgatctgggtcattttgtctgtggaagtaggcggccttctcggggtcactcagcagctgagcagttttgagaccgagttcaatactcagccgcaccggaaagtggagggaaacttcaacccgtttgcctcccctcaaaagaaccgacagagtgatgagaataacttgaaggaccctggcggtagtgagtttgattccatatcaaaaaatacttgggcccctgctcccgatacttgggcccctgctcctgaccaaactgaacaggatcagaatcgcctgtctcaaaacagcgtaaacttgagcccctcttcacatgccaataatctgtcagtagtgacatattccaagggtcttcatggaccgtacccctttggacagtcttag

SEQ ID NO: 183112 - DNA, 699 bp, Artificial Sequence
  Description of Artificial Sequence: Synthetic coding sequence
atggagggcatggacgtggacctggaccccgagctgatgcagaagttctcatgtctgggaaccactgataaggatgtgctgatatccgagtttcaacgacttctgggcttccagctgaacccagccggctgtgccttcttcctcgacatgactaattggaatctccaagccgccataggagcctattacgacttcgagtctccaaatatcagcgttcccagtatgtcattcgtcgaagacgtcacaattggggaaggcgaaagtattccgcccgacacccagtttgtgaaaacatggaggatccagaacagtgatgtaatatgggtgatactgagcgtcgaagtcggggggctgctgggcgttacccagcagctttccagttttgaaacagagttcaacacccagcctcataggaaagtagaaggaaattttaacccctttgcctctccgcagaagaatcgacagagtgatgagaacaacctgaaggaccccgggggtagcgaatttgactctatttcgaagaatacttgggcccctgccccagacacttgggcccccgcccctgatcagactgaacaggaccagaatcgtctctcacaaaacagtgtcaatctgtccccttcttcgcacgcaaacaatctgtcagttgtgacctattccaagggtttgcatggcccctacccctttgggcagtcttag

SEQ ID NO: 183113 - DNA, 126 bp, Artificial Sequence
  Description of Artificial Sequence: Synthetic coding sequence
atgggcgacatctacatcacctggatcggctgcggcctggaccggttgcagtgggagaatgtcagcgctatgatcgaggaagtgtttgaagcaaccgacattaagattaccgtatataccctgtag

SEQ ID NO: 183114 - DNA, 459 bp, Artificial Sequence
  Description of Artificial Sequence: Synthetic coding sequence
atggccagcagcctgaacgaggaccccgagggcagccggatcacctacgtcaaaggagacctgttcgcatgcccgaagacggattctctagcccattgtatcagcgaagactgtagaatgggggcaggcatcgcagtgttgttcaagaaaaaatttggaggagtgcaagagctgttgaatcagcagaaaaagtctggtgaggtagctgtcctgaagcgagacgggcgctatatttattatctgattactaagaagagagcaagtcacaaacctacttatgagaaccttcagaaatctctggaggccatgaagagccactgtttgaagaacggtgttacagacctcagcatgccccggataggatgtggtttggacaggttacaatgggaaaacgtctcagcaatgattgaagaggtgttcgaggcaactgatattaagattactgtatataccttgtag

SEQ ID NO: 183115 - DNA, 459 bp, Artificial Sequence
  Description of Artificial Sequence: Synthetic coding sequence
atggccagcagcctgaacgaggaccccgagggcagccggatcacctacgtgaagggggatctgttcgcatgccctaagaccgattccttagcacactgtatcagtgaggactgccggatgggcgctggaattgccgtgctcttcaaaaagaaatttggtggagtgcaggagctgctgaaccagcagaagaagtcaggcgaggtggctgtcctcaagcgggatggaaggtacatctactatctgatcactaagaaaagagctagtcataagcccacttacgagaatctacagaagagcttagaggcgatgaaatctcactgcctgaagaacggcgtaacggacctgtctatgcctaggattggatgcggactcgaccgcttgcagtgggagaatgtgagtgctatgatagaagaggttttcgaagctaccgacattaagattaccgtgtacacattatag

SEQ ID NO: 183116 - DNA, 459 bp, Artificial Sequence
  Description of Artificial Sequence: Synthetic coding sequence
atggccagcagcctgaacgaggaccccgagggcagccggatcacctacgtgaagggcgacctgttcgcctgtccgaagaccgactcgttggcacattgcatctccgaggattgccgaatgggagctggcattgctgttttgtttaaaaaaaagttcggaggggtgcaagaactgctgaatcagcagaagaagtctggagaagtggctgtgctgaagagggacggacgttacatctactatttgattaccaaaaagcgtgcatcacacaaacctacctatgagaacctgcaaaaatctctggaggccatgaaatcccattgtctgaaaaatggtgtgaccgacttgagcatgcctaggataggctgtgggttagatcgactgcaatgggagaatgtttcagctatgatagaagaggtttttgaagcgaccgatattaaaataaccgtctacacactctag

SEQ ID NO: 183117 - DNA, 459 bp, Artificial Sequence
  Description of Artificial Sequence: Synthetic coding sequence
atggccagcagcctgaacgaggaccccgagggcagccggatcacctacgtgaagggcgatctattcgcatgtccaaagaccgactcgctcgcccactgcattagtgaagactgcaggatgggcgccggcattgcagtgctgtttaaaaaaaagttcggcggggtacaggagctgcttaatcaacagaaaaagagcggagaggtggctgtgttgaagcgcgacggacgttacatctactacttgatcactaagaaacgggctagccacaaacctacctatgagaacctgcaaaagtcgctggaagctatgaaaagccactgcctcaaaaacggggtgaccgacctgtcaatgccaagaatcggctgcggtctcgacagactgcagtgggagaacgtgagtgcgatgatagaggaagtgttcgaggctacagacattaaaataacagtctacactctgtag

SEQ ID NO: 183118 - DNA, 396 bp, Artificial Sequence
  Description of Artificial Sequence: Synthetic coding sequence
atggccagcagcctgaacgaggaccccgagggcagccggatcacctatgtgaagggggacctcttcgcctgccccaagaccgactccttggctcactgcatttcagaagattgtcgcatgggggctgggatagcagtactcttcaagaaaaagtttggcggggttcaggaactgcttaaccagcagaaaaagtcaggcgaggttgccgtgctcaagcgagatggcaggtacatctactatttaattacaaaaaaacgggcttctcacaagcccacctacgagaacctgcaaaaatctctggaagctatgaagagtcactgcctcaaaaacggagtgacggacctctctatgcctcggattgggtgtggactcgacaggctgcagtgggagaattag

SEQ ID NO: 183119 - DNA, 1371 bp, Artificial Sequence
  Description of Artificial Sequence: Synthetic coding sequence
atggaggccctgggcgacctggagggcccccgggcccccggcggcgacgatccagccggcagcgctggggaaacacccgggtggttgtcaagagagcaggtgttcgtgcttatctctgcagcctctgtcaatctaggctccatgatgtgttactccatcctgggacctttcttccccaaagaagccgagaagaaaggcgcatccaacaccattattgggatgatttttggatgtttcgccctcttcgagctgctcgcctcgctcgtcttcggaaactaccttgtccacatcggtgccaaattcatgttcgtggctggcatgtttgtgtctggaggagttactatcctgttcggcgtgttggaccgggtgcctgacggccccgtgtttattgccatgtgtttcctagtgagagttatggatgcggtgtcatttgcagccgctatgaccgcaagttcctctatactggctaaagcctttccaaataacgttgccaccgtgcttggctccctggagaccttctcaggcttaggcctgatcctcggacccccagtgggaggattcctctaccagagtttcggttatgaggtcccgtttattgtgctagggtgcgttgtgctcctgatggtgccgctcaatatgtatatcttgcctaattacgagtcagatcccggcgaacatagtttctggaaactcattgccttgccgaaggtgggcctgatcgcgtttgttataaacagcctctcttcgtgttttggatttctggatcctacactgtccctgttcgtgctcgaaaagtttaacctccctgcagggtatgttggattggtgttcctaggcatggcgctgtcttacgccatcagttcccccttgtttggattactaagcgacaaaaggcctccactgaggaagtggttacttgtgttcgggaatctgattacagctggatgctatatgctgctcggtcccgtcccgattctgcatatcaaatcacagctgtggctgctcgtccttattctggtggtcagtgggctgagcgccgggatgagcattataccaacatttcctgagattctgagctgtgcccacgaaaatggctttgaagagggtctctccacactgggcctggtttctgggctgttctctgccatgtggtcaattggagcattcatgggtccaaccctggggggatttctctacgagaaaattgggtttgagtgggctgcggccatccaggggttgtgggccctaattagcgggctcgctatgggactgttctacctcctcgagtattctcgtcggaaacgttcaaagagtcagaacattttaagcacagaggaggaaaggaccacactactgcctaacgagacttag

SEQ ID NO: 183120 - DNA, 324 bp, Artificial Sequence
  Description of Artificial Sequence: Synthetic coding sequence
atggaggccctgggcgacctggagggcccccgggcccccggcggcgacgacccagccggctctgctggagagacccctgggtggctttcgcgcgagcaggtgtttgtcctcatcagcgccgcttcggtcaacctgggatcaatgatgtgttattcaatcctaggcccattcttcccaaaggaggcagagaaaaaaggggccagcaatactatcattggaatgatcttcggctttcagtttaccagctggatatgcggtacctctatccccggatacggaacagtgctttgtcacctttttacgacaatttggtcccccaagtag

SEQ ID NO: 183121 - DNA, 324 bp, Artificial Sequence
  Description of Artificial Sequence: Synthetic coding sequence
atggaggccctgggcgacctggagggcccccgggcccccggcggcgatgaccctgctggctccgcaggcgaaacccctggttggttgagccgagaacaagtgttcgtccttatttcggcagcgagtgtgaacctgggttctatgatgtgctattctatcctcggcccattttttccgaaggaggccgagaagaagggagcatcaaacacaattatagggatgatctttggctttcagtttacatcctggatctgcggcacctccataccaggttacggaaccgtactctgccacctgtttacaacaatatggagccccaagtag

SEQ ID NO: 183122 - DNA, 711 bp, Artificial Sequence
  Description of Artificial Sequence: Synthetic coding sequence
atgttctgcttcgtgcgggtggccggcatcctgggcatctggaagttgtcatgtacgtattggtctaagatctacgtctgcagcaggaacgtgtgtctccggcgtagctataacagcctatggggctcattggagaccttcagcgggctcggcctgattttaggacctcctgtgggaggttttctttaccagagcttcgggtacgaagtaccctttattgtcttaggctgcgtggtcctcttaatggtccctctgaacatgtacatacttccaaattatgagagtgatcccggagaacactctttctggaagcttatcgccctgcctaaggtgggcttgatagcttttgtcattaattctctgtccagctgcttcggttttctcgatccaactctttcactgtttgtgttagagaaatttaacctccccgccgggtatgtaggtttagtcttcctgggcatggcactcagttatgccatcagcagtcctctgtttggcctcctgtctgataagaggccacccttgaggaagtggctgttggtctttgggaatttgattacagcaggctgttacatgcttttaggtcctgtgcccattcttcacatcaaaagtcagttatggctgcttgtcctcattctggttgtgagtggattgtcagctggcatgtccatcatcccaacctttcccgagatactgagctgtgcacagtag

SEQ ID NO: 183123 - DNA, 654 bp, Artificial Sequence
  Description of Artificial Sequence: Synthetic coding sequence
atggacgccccccggcggttccccaccctggtgcagctgatgcagccaaaagccatgccggtggaagtgctgggtcacctaccgaagcgcttctcgtggtttcactcagagttcctcaaaaaccctaaagttgtacgcctggaagtgtggctggtcgagaaaatatttggacgaggcggggagaggatcccccatgttcaaggcatgagccagatcctgatccacgtgaatcggctggaccctaatggagaagccgagatcctggttttcggtcgaccctcgtatcaggaggatacaatcaagatgatcatgaacctggcggattaccaccgccaactgcaggccaaaggtagcggtaaagcgctggcccaggatgtggcaacacagaaggcggagacacagcggagctctattgaggttcgtgaggctgggactcagagatctgtggaagtacgcgaagcaggcacacagaggagcgtggaagtgcaggaagtgggcacccaagggagcccggtggaggtccaggaagctggaacacagcagagtttacaagcagctaataaaagcggcacacaacgctcacctgaagcagcaagtaaagccgtcacgcagcgtttcagggaggatgcacgggaccctgttactcgtctttag

SEQ ID NO: 183124 - DNA, 1416 bp, Artificial Sequence
  Description of Artificial Sequence: Synthetic coding sequence
atgcccagcgagacccacgccatgctggccaccctggcccgggtggccgcgcttcgccgcacatgcctgttctctgggcgcggtgggggaagaggactctggacggggcggcctcagagcgatatgaataatatcaagccactagagggcgtaaagattcttgatttgacaagagtgctggctggtcccttcgctacaatgaatttaggtgacctgggtgcggaagtcattaaagtggagcgccccggcgccggggatgacactagaacgtggggccctccgtttgtaggcaccgaatctacctattaccttagcgtgaatcggaataaaaagtcaatcgctgtcaatattaaggatccaaagggtgtcaaaatcattaaggaactggccgcagtttgcgacgtttttgtggaaaactacgtgcctggaaaattatctgcgatgggactggggtatgaggacattgacgaaatcgcacctcacataatctactgttccatcacaggatacgggcagactgggccaatttctcagagggcgggatacgatgccgtcgcatccgctgtttcggggttgatgcatatcaccggtcccgaaaacggggatcctgttcggcccggagttgcgatgacggacctcgcgacagggctgtatgcttatggcgcaattatggctggtctgatacaaaagtataagacgggcaagggcctttttattgattgtaacctgctgtcctcacaggtggcgtgcttatctcacatagccgcaaattacctcataggacagaaggaagccaaaaggtgggggaccgcccacggatctatcgtgccatatcaagcgttcaaaaccaaggatggatacatcgtcgtgggagccgggaacaaccagcaattcgctaccgtgtgtaagatcttggacctgcctgagctgatcgacaattcgaaatataagacaaaccaccttagggttcataaccgcaaagagctgattaagatcttgtcagaacggtttgaggaagagttaacctcgaaatggctgtacctgtttgagggttccggtgtgccatacgggccgatcaacaatatgaaaaacgtcttcgccgaaccccagaacgcggtgtccggttttcagtcactcctacactctctggcccacggcccatttctgcacctgcagggttcagcccgtgtgctccataacggccttgttatggaaatggaacacccaacagtgggcaagatttccgtgccaggccccgcggtgcggtatagcaagtttaagatgtcggaggccagaccaccaccgctgctgggacagcacacaacacatatcttaaaagaggtcctccgctacgacgacagagctattggagagttactgagcgccggagtggtggaccagcacgaaacccactag

SEQ ID NO: 183125 - DNA, 1338 bp, Artificial Sequence
  Description of Artificial Sequence: Synthetic coding sequence
atgcccagcgagacccacgccatgctggccaccctggcccgggtggctgccctgaggcgcacttgtctgttttccggcagaggcggtggaagaggcctgtggacaggtaggcctcagagtgatatgaataatattaagcctcttgagggcgtgaagatccttgatctaacgcgcgtgttagccggtcctttcgccacaatgaatctgggagatctgggtgctgaggtcatcaaagtggagcgaccaggcgcaggggatgatactcgaacctggggaccaccatttgtaggcaccgaaagcacatactatctgagcgtcaaccgaaataagaagtccattgccgtgaacattaaggatcccaagggcgtgaaaattattaaagagctggccgcggtttgcgacgtgttcgtcgagaactatgtaccaggcaagctgtcagcaatgggacttggatatgaggacatagacgagatagctccccacataatttactgtagtattactgggtatgggcagactggtccaatatcacagagagccggatacgatgctgtcgcctccgccgtgtctggcctcatgcatatcaccggccctgagaacggggatcccgtgcggcccggcgtcgctatgactgatctggcgaccggcctgtacgcatacggggccattatggctggcctcatccaaaaatacaagacgggcaagggactgtttatcgattgtaacctcctgtcctcacaagtggcttgtctgtctcacatcgcagctaactatctcatcggacagaaagaggcgaagcgttggggcacagcccatggtagtattgtgccctaccaggctttcaagaccaaggacggctacattgtggtgggtgccggaaataaccaacagtttgccacagtgtgtaagattttagaccttcccgagttgatagacaacagcaagtataagacaaaccaccttagagtacataatcgcaaagaactgatcaaaatactgagtgaaaggtttgaggaagagttaacctcaaaatggctatatctttttgagggctctggcgtgccctacggacctatcaacaacatgaaaaacgtcttcgcagagccccaggttctgcacaatggcttggtaatggagatggaacaccctactgtgggtaagatttcggtgcccggacccgccgtgcgttactcaaaattcaagatgagtgaggctcgccccccgcccttgctcgggcaacatacgactcatatcctcaaagaggtactcagatacgatgacagggccatcggcgaattgctgagcgcaggggtagtggaccagcacgaaacgcactag

SEQ ID NO: 183126 - DNA, 609 bp, Artificial Sequence
  Description of Artificial Sequence: Synthetic coding sequence
atgctggccaccctggcccgggtggccgccctgcggcggacctgcctcttttccgggcgcggtggcggcagaggactttggacagggagacctcaatccgacatgaacaatataaagccactggagggggtaaaaatcttggacctcaccagagtgttggcaggtccttttgctaccatgaacctgggggacctgggcgctgaggtgattaaggtggagaggccaggcgccggagacgatacccggacttgggggcctccctttgtagggactgaaagcacctattatctgtccgtcaataggaacaagaagtctatagccgtcaatataaaagatcccaagggggtgaagatcataaaagagctggccgccgtttgtgatgtgttcgtagaaaactacgttccaggcaagctgtctgcgatgggactgggctatgaggatattgacgagattgccccccatattatctactgtagcatcacggagaaggggttctctcacgtagcacaggacgggctagatcttcagacatcatctaatctgcctgccctggtgtctcagagtgccggaataaccggaatgtcccatagggcgtggccaactagctag

SEQ ID NO: 183127 - DNA, 1194 bp, Artificial Sequence
  Description of Artificial Sequence: Synthetic coding sequence
atgcccagcgagacccacgccatgctggccaccctggcccgggtggctgctttacgacgaacgtgcctatttagcgggagaggaggtgggcgggggctgtggacgggaaggccccagagtgatatgaacaatattaaaccactggaaggggttaaaatccttgatctaacgcgggttctagccggtccttttgccaccatgaacttgggagatctgggtgccgaggtaataaaggtcgaacggccgggcgccggggacgacacccgaacctggggcccaccatttgtaggcacagagagcacatattacctctccgtcaatcggaataaaaagtctattgctgtcaatatcaaggacccaaagggcgtgaaaatcatcaaggagctcgccgctgtctgtgatgtgtttgtagagaattacgttcccggtaagctgtccgccatgggattagggtatgaggacattgacgagatcgctccacacataatctactgtagcatcacagggtatggccagacaggtccgatttcacagcgcgctggctatgacgccgtggccagcgcagtgagtgggctgatgcacattaccggacccgaagtcgcttgcctctcacatatcgcggcgaattatctgatcggccaaaaggaggccaagcgctggggcacagctcacggatccatcgtaccatatcaggccttcaagacaaaggatgggtacattgtggtgggggcaggaaataaccagcagtttgctacagtttgtaagatccttgatttgcccgagttgatagataacagtaaatacaagaccaaccacctccgcgttcataatcggaaggagctgatcaagatcctgtctgagcggtttgaagaagagctgacatcaaagtggctctacctatttgagggtagcggagtgccctatggcccgatcaataacatgaagaacgtgttcgccgagccgcaggtactccataacggccttgtgatggagatggagcatcccactgtcggcaagatctccgtgcctggccccgcggtccgttattccaagtttaagatgagtgaagcccgaccacctcccctacttggtcaacacaccacccacattttgaaggaagtgttacgctacgacgatcgggccatcggtgagttgttatcagcaggggtggtggaccagcacgagactcactag

SEQ ID NO: 183128 - DNA, 540 bp, Artificial Sequence
  Description of Artificial Sequence: Synthetic coding sequence
atgcagcggcagaacttccggccccccacccccccctaccccggcccagggggcggcgggtggggcagtgggagctcatttcgcggtacacctggggggggcggccccaggccgccttctccccgggacggctacggatctccgcaccacactcctccctacggtcctagatctagaccttacggctcttcacacagcccaaggcacggggggagcttcccaggcggccgctttggtagtcccagtcccggcggctaccccggatcatattcccgtagcccggccggctcccaacaacagtttggctactcgcctgggcaacaacaaacccatccacagggatctccccggactagcaccccttttggatctggcagggtgcgagaaaagagaatgagtaatgagttggagaattattttaagccgtcgatgctggaggacccatgggccgggttggaacctgttagtgtcgtcgacatatctcaacagtacagcaacacgcagacctttacggggaagaaaggacggtatttctgttag

SEQ ID NO: 183129 - DNA, 480 bp, Artificial Sequence
  Description of Artificial Sequence: Synthetic coding sequence
atgaagatcgtggacgagcgggagaagaacctggacgacaaggcctaccgaaacatcaaggagctggagaattacgccgaaaatactcagtcctcactgctgtatttgacgctggagattcttgggatcaaggacttacacgccgaccacgcagcttcccatatcgggaaggctcagggtatcgtcacctgtctcagggccactccataccacggctcaaggcgcaaagtctttcttcccatggatatttgtatgttacacggcgtctctcaggaagatttcctgcggcgcaatcaggacaagaatgtgagggatgtgatctatgatatagccagccaggcacaccttcatttgaagcatgctcggtcatttcataagacggtaccagtgaaagcgttcccagccttcctccagactgagataaaagatgccgacacccagggggtgtgcctggctcaacccgcatccctcgggaagtag

SEQ ID NO: 183130 - DNA, 1002 bp, Artificial Sequence
  Description of Artificial Sequence: Synthetic coding sequence
atggccgccagcgcccacggcagcgtgtggggccccctgcggctgggcatacccggactgtgttgccgccgaccccccctcggactctacgctcgcatgcgaaggttgcctggacccgaggttagcgggcggtccgtggccgcagctagtgggcccggagcctggggtacggatcactactgcctcgaactgctgcggaaaagggactacgaagggtacctgtgttctcttctgttgcctgctgagtcccgttcctctgtttttgccttgcgcgcattcaacgtcgagctggcccaggtgaaagactctgtgtcagaaaagactattggcctgatgagaatgcaattttggaagaaaaccgtggaggacatttattgcgacaaccctccacaccagccggtggctatcgaactgtggaaggccgtgaagcgacacaacttgacgaaacggtggctgatgaaaattgtggacgaaagagagaagaacttagatgacaaggcctaccgaaatatcaaagagctggaaaattacgccgagaatacacagtcttccctcctgtacctgaccttagaaattttagggattaaagatctccacgctgatcacgccgcatctcatatcggaaaggctcaggggattgtcacttgtctacgagcaaccccttatcacggctccagaaggaaggtttttctgccaatggacatctgtatgttgcacggagtgtcccaggaggacttcctgcgcagaaatcaggataaaaatgtgcgcgatgtaatatacgacatcgccagtcaggctcacctgcacttgaagcatgccaggtcttttcacaagaccgtacctgtgaaggcttttcctgccttccttcagacagtgtcactcgaggacttcttgaagaagattcagcgagtggactttgacattttccatccatccttacaacagaaaaacactctgctgccactctacctctatattcagtcatggaggaagacctattag

SEQ ID NO: 183131 - DNA, 846 bp, Artificial Sequence
  Description of Artificial Sequence: Synthetic coding sequence
atgcccatcagcatcagccacagcagctggctggtgcagcggaagagagactacgaagggtacctgtgctccctcctgctcccggctgagagccgcagctccgtgtttgccctgcgcgccttcaacgtggaactcgctcaggtgaaggactccgttagcgaaaagaccatagggctgatgcgtatgcagttttggaagaagacggtggaagacatttattgcgacaatcctccacaccaacccgtcgccattgagctgtggaaagccgtcaagcggcataatttaacaaaacggtggttaatgaagatcgttgacgagcgagaaaagaacctggatgacaaggcatatagaaatatcaaggaactggaaaactacgccgaaaacacccagagcagtctgctatatcttacgttggagattctcgggattaaggacctgcacgccgaccatgccgcatctcacatcggcaaagcgcaggggatcgtaacatgtctgagagccacaccataccacggttcccgcaggaaggtgtttctgcctatggatatttgcatgttgcatggggtctcccaggaagactttctgcgacggaatcaggataaaaacgtccgggacgtcatctacgatatagcttctcaggctcacctgcatctgaagcacgcccggtcctttcataagacagtgcccgtaaaagctttcccggcgtttttacaaactgtcagcttagaagattttctgaaaaagatccagagagtagactttgacatttttcacccctccttacagcagaaaaacacccttctgcctttgtacctgtatatccagtcgtggcgaaaaacttattag

SEQ ID NO: 183132 - DNA, 321 bp, Artificial Sequence
  Description of Artificial Sequence: Synthetic coding sequence
atgaaggccaagcggagccaccaggccgtgatcatgagcaccagcctgagggtctccccctccatacacgggtatcactttgacaccgcctctaggaagaaggcagtggggaacatttttgagaataccgaccaggagagcctcgagagactctttcggaactcaggtgacaagaaagccgaggagcgggcgaagatcatctttgccatagaccaggacgtagaggagaagactcgcgcccttatggccctcaaaaaacggactaaggacaagcttttccagtttctcaaactgaggaaatattctatcaaggttcattag

SEQ ID NO: 183133 - DNA, 1185 bp, Artificial Sequence
  Description of Artificial Sequence: Synthetic coding sequence
atggccggcgccgccatggccgagcggggccgggtgcccccccccgcaccggcacccagcacagaggggctgcctagagcttttctgcagtccctgcgcactctgttcgacatactcgacgatcgtagacgtggctgcgtccatctcagagaaatcgagtctcgttggcaagggacagatgcccgggagctccctaggggggtcctagagggtctgaggcaggtggcccctgcgtcaggttacctgacctttgagcgattcgtcgcaggcttacgtaccagcctgctctctgctgatggtggacctcgcgatccgacgcgcgcccctgccagaccgggggatcagcctccaccaccccctcagaggctggtgttcgcacctgccgatgaaccgcggacggtgcttgaacgaaagcccctgccactgggcgtgagagccccccttgcaggaccttctgctgcagctcggagccctgagcagctctgcgctccggcggaagctgccccatgtccagccgaacccgagaggagccagtcagccgcactcgagcctagctctagtgccgatgccggagctgtcgcctgcagggctttagaagccgactctggagacgctaggcgcgcaccccgagcccgtggcgagcgcagaaggcatactattgccagtggcgttgattgcgggctactgaaacaaatgaaagagctcgaacaggagaaagaggtcctgctgcagggcctcgagatgatggccagaggcagggattggtatcagcagcagctgcagagggtccaggagagacagcggagactgggccagtctagagcctctgccgattttggggctgccgggtcaccccggccactcggccggttgcttccgaaggtccaagaagtggctaggtgccttggagagctgctggccgcagcctgcgccagccgtgcgctgcccccatcctcgtctggtcctccctgcccagcactgacgtcgacatcaccacctgtgtggcagcagcaaacaatcttgatgctgaaagagcagaacaggttattgactcaggaggttacggaaaaaagcgaacggattacccagcttgagcaagagaagtccgcgctgattaagcagctcttcgaagccagagccttgtcacagcaggatggtgggcccctcgatagcacgtttatctag

SEQ ID NO: 183134 - DNA, 1035 bp, Artificial Sequence
  Description of Artificial Sequence: Synthetic coding sequence
atgcggcggccccggcagggcggcggcggcgccggcggcagcgccgccgcacgagctagggcgggcggacttggcggcggtagcgttcccgcgagggcccgcggggcacccgctgctgccagggccgcctggctcagagacttatgtgctcgcatggccagacctccccgtcagcaccccggcgtgtgggcctccctgttactgctgctgttgacaggacccgctgcgtgcgcagccagcccagccgacgacggagccgggccgggaggtcgcgggccccgcggccgggcgcgcggtgataccggtgcagatgaagccgtcccccgacacgactcttcatatggcaccttcgcaggcgagttctacgatttgagatacctgtcagaagagggctatcccttccccaccgcccctccagtggatccctttgcaaaaatcaaggtggatgactgtggtaaaactaaaggctgttttaggtacggaaagccaggatgcaacgctgagacatgcgactactttctatcctatcggatgataggagcggacgtcgaatttgaactgagcgcagacactgacggctgggttgccgtcggctttagctctgacaagaagatgggcggtgacgatgtcatggcatgcgtgcatgatgacaatgggcgggtacggattcagcatttctataacgtcggtcagtgggctaaagagattcagcggaaccccgctcgcgacgaggagggcgtgttcgaaaataacagagtgacatgtcggtttaaacggccggtgaacgtgcctcgggacgagaccatcgttgaccttcacctttcttggtattacctcttcgcctgggggccagcaattcagggcagcataacccgccacgacatcgactctccgcctgcgtccgaacgcgtcgtgtctatttacaagtacgaggacatcttcatgccatccgctgcttaccagacattcagtagcccattttgtctgctactgattgttgctcttacattttatttgctgatgggcacaccctag

SEQ ID NO: 183135 - DNA, 393 bp, Artificial Sequence
  Description of Artificial Sequence: Synthetic coding sequence
atgagcagcagcggcggcgcccccggcgccagcgccagcagcgcccctcccgcccaggaagaaggaatgacttggtggtacaggtggctctgccgcctctctggagtactcggagccgtcagttgtgcaattagcggactgtttaactgcattacaattcatcccctaaacatcgcagcaggcgtttggatgatgatggcagttgtcccgattgtgatttcattgactttgacaacgctccttggtaacgctatcgcatttgccacaggtgtcctgtacggtctctctgctctgggcaaaaagggcgacgctattagctatgccaggattcagcagcagcggcagcaagccgacgaggaaaaactggctgagaccctggagggcgagctgtag

SEQ ID NO: 183136 - DNA, 519 bp, Artificial Sequence
  Description of Artificial Sequence: Synthetic coding sequence
atgagcagcagcggcggcgcccccggcgccagcgccagcagcgccccaccagcacaggaagagggcatgacatggtggtatcgctggctgtgccggctcagcggcgtcttaggcgcggtctcctgtgccatctccggcctcttcaattgcatcaccatacaccccctcaacatcgcagcgggggtttggatgatcatgaatgcttttatcctcctgctgtgcgaagcacccttttgttgccaatttattgagtttgccaacaccgttgcagaaaaggtcgatcgactgcgcagttggcagaaagctgtgttctattgtggcatggctgttgtccccatcgttatctcactaacgctgaccactctgctcgggaatgcaattgctttcgctaccggagttctgtacggtctgtcggctttgggcaagaagggcgatgctattagttacgcgcgtatccagcaacagaggcagcaagcagatgaagagaaactggcagagactttggagggagagttgtag

SEQ ID NO: 183137 - DNA, 345 bp, Artificial Sequence
  Description of Artificial Sequence: Synthetic coding sequence
atgctgaccgccgccggcagcaccgccgagctgagcgcctgcgccatttctggacttttcaattgcatcaccatccaccctctcaatattgcagccggtgtatggatgatcatgaacgcattcattctgctcctttgtgaggctcctttctgctgccaatttatagagttcgcaaacacagttgctgagaaagtggatcgcctgagatcttggcagaaagctgttttctattgcggaatggccgtagtgccaatcgtcatcagcctgaccctcacaacgcttctgggaaatgctatcgccttcgccaccggggtcctctatggtctttctgccctgggtaagtag

SEQ ID NO: 183138 - DNA, 489 bp, Artificial Sequence
  Description of Artificial Sequence: Synthetic coding sequence
atgagcagcagcgccccccccgcccaggaggagggcatgacctggtggtacagatggctttgtagactgtccggagtgttaggagccgtgtcatgtgcaataagtggcctttttaattgcatcacgattcatcctctgaacatcgcagccggcgtgtggatgattatgaatgctttcattcttctactctgcgaagccccattctgctgccagtttatcgagtttgcaaataccgtggccgaaaaggtggaccgcttgcggtcttggcaaaaagcagtgttctattgtggaatggccgtcgttccaattgtgatctcccttactttgaccaccctactcggtaatgccatcgctttcgccacgggagtgctgtacggtctgagcgctcttggaaaaaagggcgacgcgatctcttacgcccgcatccagcagcagcgacagcaggcggatgaagaaaagctggcagagactctggagggcgaattgtag

SEQ ID NO: 183139 - DNA, 702 bp, Artificial Sequence
  Description of Artificial Sequence: Synthetic coding sequence
atgagcagcagcggcggcgcccccggcgccagcgccagcagcgccccccccgcacaggaagaggggatgacttggtggtatagatggttatgtcgcttgtcgggtgtcctgggggccgtgagctgtgccatcagcggactgtttaattgcattacaattcaccctctgaacatagctgccggagtttggatgatcatgaacgctttcatactcttgctgtgcgaagcacccttctgttgtcagttcatagagttcgctaacactgtggcagagaaggtcgaccgactgaggagctggcagaaggcagtgttctattgcgggatggctgttgtccccatcgtcatctctttgacacttaccaccttactgggtaatgccattgctttcgcaaccggggtgctatatggcttgtctgctctggggaaaaaggcacagacggaagctggatctttcgccgcacagcaccctagagagcccggaccattttcagagggcacaaggcaggccttcgccactcccgctgtggtaagtggagaaatccgaatgccagccggcgccatgcggagcccgatgcctggtagcagcagtcgcggtagtcgcagaatgagacgctccagtcgtaggccttggcgtggctcatgtgagggactcggcgctcctccctctctctcacccctgctggcactatgcggctcgaaatag

SEQ ID NO: 183140 - DNA, 576 bp, Artificial Sequence
  Description of Artificial Sequence: Synthetic coding sequence
atgagcagcagcggcggcgcccccggcgccagcgccagcagcgccccccctgctcaggaagaaggcatgacctggtggtatcgctggctttgccgtctctccggcgtgctcggtgccgtgagttgtgcgatatccggattatttaattgtattacaattcatcctctgaatatagccgccggcgtctggatgatgatggcggtcgtgcccattgtgattagccttactctaacgacgctgctcgggaacgccattgcttttgccacgggtgtcctgtacggcctctctgcccttggaaaaaaggcccagaccgaggcaggctccttcgccgctcaacatccaagggaaccaggccctttcagcgaaggcacacgccaggcattcgccacaccagccgtcgtgtcgggggaaatacggatgccggctggagcgatgcgatctcccatgcccggcagcagctctagaggaagccggaggatgaggcgctcttcccgccggccttggcggggtagttgcgaaggccttggggcccctccttcactgagcccgcttctggctctgtgtgggagtaagtag

SEQ ID NO: 183141 - DNA, 669 bp, Artificial Sequence
  Description of Artificial Sequence: Synthetic coding sequence
atgagcaccctgtgccccccccccagccccgccgtggccaagaccgaaattgcgcttagcggcaagtctcctctccttgctgctactttcgcttattgggacaacatattagggcctagagtgagacacatctgggctcctaagactgaacaggtcctcctgagtgacggtgagatcacctttctcgccaaccacaccttgaatggcgagatcttgcgaaatgctgagtctggcgctatagatgtaaaattctttgtcttatccgaaaaaggcgtgattatcgtgagtcttatcttcgacggtaactggaacggtgataggtcaacctacgggctgtccataatcctgccacaaactgaactctccttttatctgcctttgcacagggtttgtgtggatcgcctgactcatattattaggaagggcaggatatggatgcacaaagagcggcaagaaaatgtgcagaaaatcatacttgaggggactgagcggatggaggatcaaggtcagtcaatcatacctatgcttacaggtgaagtgattccagtgatggagttactgagttccatgaagagtcactccgtgcccgaagagattgacatcgctgacactgtcttgaatgacgatgacatcggcgatagctgccatgagggcttcctgctcaaatag

SEQ ID NO: 183142 - DNA, 669 bp, Artificial Sequence
  Description of Artificial Sequence: Synthetic coding sequence
atgagcaccctgtgccccccccccagccccgccgtggccaagaccgagattgcactctcagggaaatcacccttgttagcggccacctttgcctactgggataatatcctggggcccagggtgcgacacatctgggcccctaaaacagagcaagtcctgctctccgatggcgaaataacatttctcgccaaccacaccctgaatggcgaaattctgcgaaacgcagaaagtggtgctatcgatgtcaagttctttgttctctccgagaagggagtgatcatcgtgtccctcatttttgacggcaattggaatggcgataggagcacttatggactttccatcatcctgccacagacagaattgagcttctatttacctctgcatcgggtctgtgtcgaccggctgactcacattatccggaaagggcggatttggatgcacaaggaacgacaagagaacgtgcaaaagattattctagaagggacggaacgcatggaagaccaggggcagagtattattcctatgctgactggcgaggttattcccgtaatggagctgctaagctctatgaagtcacattcagtgcccgaagagattgacattgcagatacagttctgaacgacgacgacatcggagatagttgccatgagggatttctgttgaaatag

SEQ ID NO: 183143 - DNA, 1446 bp, Artificial Sequence
  Description of Artificial Sequence: Synthetic coding sequence
atgagcaccctgtgccccccccccagccccgccgtggccaagaccgaaatcgccctgagtggcaagagcccactactagccgcgactttcgcttattgggacaacatactgggtcctcgggtgagacatatctgggcccctaaaactgaacaagtacttctgtcggacggcgagattacattccttgctaatcacacactgaacggtgaaatcttgcggaatgccgaatcgggtgccatcgatgttaagtttttcgtgctctctgaaaaaggggttattatagtttccctcatttttgacggaaactggaatggggaccgttcaacctatggccttagcatcatcctcccccagaccgagctgtcattctacctgccactccatagagtgtgtgtcgaccgcctcacccacatcattcgcaagggcagaatttggatgcataaagagcgtcaggagaatgtgcaaaagatcatccttgagggtaccgagagaatggaagatcagggacagtcaatcatccccatgctaacaggggaagtcatacctgtgatggagctactttcaagcatgaaaagtcactccgtccctgaggagatcgatatcgccgacacggtgttaaatgacgatgatattggtgactcctgccatgagggcttcctgttgaatgccatctccagccacctccaaacctgcggctgttccgttgtagtaggcagttcagccgagaaagtgaacaaaattgttaggactctttgtctgttcctgacccctgctgaacgaaagtgttcccggttgtgtgaggcagaaagtagtttcaagtatgaatccggtctcttcgttcagggtctcctgaaggacagcacagggagttttgtcctgccgttccggcaggttatgtatgccccgtaccccactacccatatagacgtggacgtgaacactgtgaaacagatgcctccatgccatgagcacatctacaatcaaagacggtacatgcggagcgaactcacagcgttctggcgcgccacctctgaggaggacatggcccaagatacaatcatctataccgatgagtctttcaccccagacctgaatatctttcaggacgtattgcacagagataccctggtgaaggcctttctcgatcaggtgtttcagctcaagccaggcctgtccttgcggtctacattccttgcacagttcctgctcgtgttgcatagaaaggcgcttactctgattaagtatatcgaagacgacacgcagaagggcaagaaaccctttaagtccctgcgtaacttaaagattgacctggacctcaccgccgagggggacctgaacattatcatggccctggctgagaaaattaagcccgggcttcattctttcatcttcggccggccattctatacaagtgtgcaagagagagatgtgcttatgactttctag

SEQ ID NO: 183144 - DNA, 168 bp, Artificial Sequence
  Description of Artificial Sequence: Synthetic coding sequence
atgcagaaccagagcagcaccaaccaccccggcgccagcatgctgatgcatatccacctggatacatcatccctgaagacactgcacctcggaacactattctttctgttctacttggcccttacccagaatgaagaaaatatctgtgatggtaaagtgactctgtag

SEQ ID NO: 183145 - DNA, 225 bp, Artificial Sequence
  Description of Artificial Sequence: Synthetic coding sequence
atgcagaaccagagcagcaccaaccaccccggcgccagcatcgccttgtcccgcccgtcgctgaataaggatttccgcgaccacgcggagcagcaacatatagcagcccaacaaaaagctgccctccaacacgcacacgctcactcctccggctactttatcacacaggactctgcatttggtaacttgatccttcccgtgctgccccgcctggacccggagtag

SEQ ID NO: 183146 - DNA, 168 bp, Artificial Sequence
  Description of Artificial Sequence: Synthetic coding sequence
atgcagaaccagagcagcaccaaccaccccggcgccagcatgctgatgcatattcacctggacacgtcaagtctgaaaacactgcacctgggcacactgttctttttgttctatttagcgctcacccagaatgaagagaatatttgcgacgggaaggtgactctgtag

SEQ ID NO: 183147 - DNA, 315 bp, Artificial Sequence
  Description of Artificial Sequence: Synthetic coding sequence
atggccgccaacagcagcggccagggcttccagaacaagaaccgggtggctatactggctgaactggataaagaaaagcgtaagctgctcatgcaaaaccagtctagtacaaatcacccaggcgccagtatagcactcagtcgcccttccctcaacaaggactttagagatcacgctgagcagcagcacatagctgcacagcagaaggcagccctgcagcatgctcacgctcactcatcagggtacttcatcacccaggattctgctttcgggaacctgatcctccctgtattgccccgcctagacccagagtag

SEQ ID NO: 183148 - DNA, 2190 bp, Artificial Sequence
  Description of Artificial Sequence: Synthetic coding sequence
atgttcagcgccctgaagaagctggtgggcagcgaccaggcccccgggcgtgacaagaatatcccagcaggcctccagtccatgaaccaagctctgcagagacgtttcgcaaaaggggtgcagtacaatatgaagattgtgattagaggcgaccgcaatacgggcaagactgcattatggcatagactgcagggccggccctttgtcgaggaatacattccaacacaggagatccaggtcactagcatccattggagctacaagactaccgacgacatcgtgaaggtggaagtgtgggacgttgtggacaagggtaaatgcaagaagcgaggagatggcctaaaaatggaaaatgacccacaggaagctgagagcgagatggcacttgatgccgagttcctagatgtatataagaactgtaatggggtggtgatgatgttcgacatcacaaaacagtggaccttcaattatatcttgagggagctgccaaaagtgcctacccatgtgcctgtgtgcgtcctcggcaactatagggacatgggcgaacaccgcgtgattctccctgacgatgtgcgggacttcatcgataatcttgatagacccccgggcagcagttacttccgctacgccgagagcagcatgaagaacagcttcggcctgaagtatctgcataagttttttaacatcccattcctacagctccagcgcgagactttgcttaggcagcttgagaccaaccagttagatatggatgctacattagaggagttgagcgtgcagcaagagaccgaggaccaaaactacggcattttcctggaaatgatggaggctaggtcgcgcgggcatgccagccctctggcggcaaacggtcagtctcccagtcctggtagccaatcaccagtggtgccagctggtgcggtgagcacaggctccagttccccaggcacgccccaacctgcgccacaattgcccctgaacgccgctcccccttcttccgtcccacccgtgccacctagtgaagccctgcccccccccgcctgcccatccgcccccgcacctcgccgtagcattatctcccgcctatttgggaccagccctgctacggaggccgcccctcccccccctgaaccagttccagcagccgaagggccagccacagtacagagcgtcgaggatttcgtccccgacgatcgtcttgataggtccttcctggaggacacaacgccagcccgggacgaaaaaaaagtgggtgcaaaggcagctcagcaggacagtgattccgatggcgaggccctcggcggaaaccctatggtcgctggctttcaggacgatgttgatctcgaggatcaacctaggggaagcccccctttgcctgcggggccagttccctcacaagatattacattatccagcgaagaggaggctgaagtcgctgctcctacaaaaggccctgcccccgctccacagcagtgcagtgagccggagacaaagtggtcttccataccggccagtaagcctcgcagaggcaccgcacccacaaggaccgccgctcccccctggcctggtggcgtgagcgtcagaacaggaccagagaagcgctcctctacccgccctcctgccgagatggagccgggtaaaggggagcaagcatcctcaagcgagtcagacccagagggccccatcgcggcccagatgttgagtttcgtgatggacgaccccgactttgagtctgagggctccgatactcagcggcgtgccgatgactttcccgtcagagacgacccatcagacgtgacggatgaagacgaaggtcctgccgagccaccgcctccgcccaagcttcctcttcctgctttcagactaaaaaacgattcagacttgtttggactcgggctggaggaagccgggcccaaagagtccagcgaagagggtaaagaaggcaagaccccctccaaggagaaaaaaaagaaaaagaaaaagggcaaagaggaggaagaaaaagccgcaaagaaaaaatctaagcacaagaagagtaaagacaaagaggaaggaaaagaagagcgacggagaagacagcaacgaccaccaagatcaagggaacgaacggccgcggacgaactagaagcctttcttgggggtggcgcccccgggggtagacaccccggcggcggcgactatgaagagctttag

SEQ ID NO: 183149 - DNA, 1563 bp, Artificial Sequence
  Description of Artificial Sequence: Synthetic coding sequence
atgttcagcgccctgaagaagctggtgggcagcgaccaggcccccggaagagataagaacatcccagctgggctgcagagcatgaatcaggccttgcagaggcgcttcgctaagggggttcagtacaatatgaaaatcgtcatacgcggggatcgtaataccggaaaaacggcactgtggcatcgtctgcaagggcgtccattcgttgaggagtacatccccacacaggagatacaggtgacctcgatccattggagttataagactacggacgacatagtcaaagttgaagtctgggacgtggttgataagggcaaatgtaaaaagcggggcgatggtcttaagatggaaaatgatccccaggaggccgagtccgagatggccttagatgccgagttcctggacgtgtacaaaaattgcaacggggtggtaatgatgttcgacattacgaagcagtggacatttaattacattctaagggagctgccaaaagtgccaacacacgtacccgtgtgtgtcttggggaactaccgggatatgggggaacaccgcgtcatcctgcctgatgatgtgcgtgacttcatagacaacctggaccgtccacccgggtcgtcatatttcagatacgcagaaagtagcatgaaaaattcattcggcctgaagtacctgcacaagttctttaacatccctttcttgcagctgcagagggagacattgttacgccagctagagactaatcagctggatatggatgccacccttgaagaactgagcgtgcagcaagaaacagaagatcaaaactatgggatcttcctggagatgatggaggctcgcagccgcggacatgcctctccccttgcggctaacggccagtctccatcacccgggtctcagtctccagtggtgcccgctggggcagtctcaaccggctcaagctctcctggcactccgcaaccagcccctcagctgcccctcaatgctgcccccccgtccagtgtgcctccagttccgccatctgaggctctgcccccacccgcttgtccttccgcacccgcacctcgaagaagcatcatttccaggcctcccccctggggctggagactccggggagccctcggaagacgagggcaatggcccccatggggggggggaagggcttgtcactgtctgggtagacacctgcctctttatcaccggctttgtcgctgcccagtggccgcagtgtgtgcatccgaactcgaagaagccggccactggtggtctcccggctgggccctccaggtgctgggactccaggcccagtgtgagcctgccttgcaagaggggcgagggcagctggcttccgcccgcctaggagggcatcctgggcccctaggggccgagcccccagtgttcttgcgtgacgtcactgaagcccaagagggtccagttcgagtttgtttgcagcgtctagggagaggtagactggcggttggttgcgcacttccgcgtcacctgctggcactgcgggcacacttaggcccacagcatgcttacggctcggctagcggtcgcgaaccctag

SEQ ID NO: 183150 - DNA, 2193 bp, Artificial Sequence
  Description of Artificial Sequence: Synthetic coding sequence
atgttcagcgccctgaagaagctggtgggcagcgaccaggcccccgggcgggataagaacatacctgccggtttgcaatcaatgaaccaggcccttcagaggagatttgctaagggagtacagtacaacatgaagatcgtcattaggggcgatagaaatacagggaagacagctctctggcacagactgcaaggtagacctttcgtagaggagtatattcccacacaggagatccaggtgacatcaattcattggagttacaagaccactgacgacatcgtgaaagtggaagtgtgggacgtggtggacaagggtaaatgcaagaaaaggggagacggtttgaaaatggagaacgatccccaggaggccgagtcagagatggctttagacgcagagttcctggatgtctataagaattgcaacggagtagtgatgatgttcgatattactaagcagtggacattcaactacattctcagggaacttccaaaggtgccaactcacgtgcccgtatgcgtgctaggaaactatcgggacatgggcgaacaccgcgtgatactcccagatgacgtcagggactttatcgacaacctggattcaaggccacccggcagcagttatttcaggtacgccgaaagttctatgaagaatagcttcggcctaaagtacttacacaagttcttcaacattcccttcctccagctgcagcgggaaactctgctgaggcagctggaaactaaccaactcgatatggatgccacactggaggagcttagcgtacaacaggaaactgaagatcagaactacggaatattcctcgaaatgatggaggcccggtctaggggccacgccagtccgttagccgcaaacggccagagcccatctcctggatcccagagcccggtggtccctgctggcgctgtcagcacgggcagctcttcccccggaactccccagccagccccccagcttcccctgaatgctgccccacctagttccgtgccgccagtacccccctccgaagccctccccccaccagcgtgccctagtgcaccggctcctcggcggtctattatctctaggttgttcgggacctcacccgcaaccgaagctgcacctccacctccagagcccgtgcccgccgcagagggtcccgcaaccgttcagagtgttgaagacttcgtgcctgacgaccgactggacaggagctttctagaagacactacacccgctcgggatgaaaaaaaggtgggggctaaagccgcgcagcaggacagcgattcagatggagaggccctcgggggcaaccccatggtggctggctttcaggatgatgttgacctggaggaccagcctagaggaagcccgcctctcccggctggcccagtcccaagtcaggacataactttgtctagtgaggaggaagccgaagtcgctgctcccaccaaaggccccgctcctgctccccagcaatgcagtgagcctgaaaccaaatggagcagcatcccagcctccaagccgcgcaggggcacagccccaacacgcacagcggcccctccgtggcccggcggggtctcggtaaggaccggaccagaaaaaagaagctctacaagaccccccgccgaaatggaacctggcaagggggagcaggcgtcttcttctgaatccgaccccgagggaccgatagctgctcagatgctgtccttcgtcatggatgaccctgatttcgagtccgaggggtccgatacgcagagacgggctgacgattttcccgtgagagatgaccccagcgacgtgactgatgaagacgagggacccgccgaaccgcccccacctcccaagctgccgttgccggcattccgcctgaaaaacgatagtgatctgtttggactcggactcgaagaggcaggccccaaggagtcctccgaggaaggtaaggaagggaaaactccttctaaagagaaaaagaaaaaaaagaagaagggtaaagaggaggaggaaaaagccgcaaaaaagaagtcaaaacacaaaaagagtaaggataaagaagagggaaaggaagagaggagaagacggcagcagcgcccacctagatcaagggagagaacagccgccgatgaattggaggcgttcctgggcggcggcgctcctggaggacgtcaccccggaggcggagactatgaagagctgtag

SEQ ID NO: 183151 - DNA, 945 bp, Artificial Sequence
  Description of Artificial Sequence: Synthetic coding sequence
atgttcagcgccctgaagaagctggtgggcagcgaccaggcccccggcagggacaagaacatcccggctggattacagtctatgaaccaggctctgcagagaagatttgctaagggcgtgcagtacaacatgaaaatagtgattagaggcgatagaaataccggcaaaacggccttgtggcatcgcctccaaggccgacccttcgtcgaggagtatatcccaacacaggagatccaggttacttctatccactggagctacaagaccacggatgacatcgttaaggtggaggtttgggatgttgtggacaagggaaaatgcaaaaaacgaggcgatggactgaagatggaaaacgatccccaggaagcggagtctgagatggcactggatgctgaattcctagatgtttataaaaattgcaatggggttgtcatgatgttcgacatcaccaaacagtggacattcaattacattcttcgggaactgcccaaagtcccaacacacgtgcccgtctgcgtgttggggaactacagagatatgggcgaacaccgggtgatcctgcctgacgatgtccgcgattttatcgataaccttgaccgccctccggggtctagttattttcggtatgcagagtcttccatgaagaacagcttcggtttgaagtacttgcacaagttctttaatattcccttcctgcagcttcaaaaggatgtgagacttgctcaagaacgtgggtgtgccgtggtcctcgtctccgaggaggtcagaatgcccgccgggtgggactgttgttggggacgtctgggttggaaagagggtggaagccagacttgtccagttccagctttgctgggccggcctttgcttcctgccgaaccctctccacaccattgggtggattacagtttggagagctcccccctgttgagttgttcgatcccctag

SEQ ID NO: 183152 - DNA, 1566 bp, Artificial Sequence
  Description of Artificial Sequence: Synthetic coding sequence
atgttcagcgccctgaagaagctggtgggcagcgaccaggcccccggccgcgacaaaaacatccctgcggggctacaatctatgaatcaagctcttcagagacgctttgctaaaggagtgcaatacaacatgaagatcgtcatcaggggggaccggaacactgggaaaaccgctctttggcatagacttcaggggcggccttttgtcgaggaatatattcccactcaggaaatccaggtgacatccatacactggtcctataagaccactgatgatatcgtgaaagtggaagtgtgggacgtggttgataaagggaagtgcaagaagagaggcgatggcctcaaaatggaaaacgatccgcaagaggcagagtcagagatggctctggatgccgagttcctagacgtctataagaattgcaacggcgtggttatgatgtttgatatcaccaagcagtggactttcaactacatcctcagagagctgccaaaagtgcccacgcatgttcctgtgtgcgtcctcggtaattaccgcgacatgggagaacatcgcgttatcttacctgacgacgtacgggactttatcgacaacctggactcgcgcccgccggggtcctcatatttccgctacgccgagagttctatgaagaattcatttgggctgaaataccttcacaagtttttcaacatccccttcttgcagctgcagagagaaaccctgctgcgacagctcgagacaaaccagctggatatggacgctaccttggaggaactgtctgtacagcaggagaccgaagatcaaaactacggtatctttctggagatgatggaggcgcgctcgagaggacacgctagccctctggccgctaatggtcagtcaccaagtcctggctcgcagtcccccgtggtgcccgctggcgcggtctctacggggtcaagcagcccagggaccccgcagccagctccccagctgccactcaacgctgccccccctagctctgttcctcctgtgccccctagcgaagctctgccacctcccgcctgtcctagcgctcctgcccctcggaggtccattatttccagaccacctccgtggggctggcgcctgcgcggtgccctcgggaggagagggcagtggcccccctggggcggcggccgggcgtgtcattgtctcggaaggcatctgccactgtaccacaggctgtgtcggtgccctgtagcggctgtgtgtgcctctgagttggaggaggccgggcactggtggagtcctgggtgggccctccaagtgctgggcttgcaggctcaatgcgaaccagcgctgcaggagggccgcgggcagttggccagtgccagactcgggggtcatcctgggccccttggggcagagccacctgttttcctgcgtgatgtgaccgaagctcaggagggccctgtgagagtgtgcctgcagaggctgggacgcggcaggctggctgtgggttgcgccttgccacgtcatcttctggcgcttcgcgctcatctggggcctcagcacgcgtacggcagtgccagtgggcgtgagccttag

SEQ ID NO: 183153 - DNA, 1845 bp, Artificial Sequence
  Description of Artificial Sequence: Synthetic coding sequence
atggagaacgacccccaggaggccgagagcgagatggccctggacgcagaatttctagacgtttacaaaaactgtaacggagtcgtgatgatgttcgatatcacaaaacagtggacattcaactacatcttacgggaactgccaaaagtgcccactcacgtccctgtttgtgttctgggaaactatcgggatatgggcgagcatcgggtcatcctgccggatgacgtccgagattttattgacaatcttgacaggccacccgggtcaagctactttaggtacgctgagtcatctatgaagaactcctttgggctgaagtacctccacaagttcttcaatatcccctttctgcagcttcagcgggagaccctgctgcgccaattagagaccaaccagctggatatggatgcaacgctggaagaactcagcgtgcagcaagagactgaggatcagaactatgggatatttctggagatgatggaagcccgctcaaggggccacgcgtcaccactcgcggcgaacggacagagtcccagccccggcagtcagtcacccgtggtgcccgctggggcagtttccacaggtagctcttctcctgggacccctcagcccgcgccccagttgcccctgaatgccgcacctccttccagtgttccaccagttccccccagcgaagctcttcctcctcccgcctgccctagcgcccccgctcctaggcggagcatcatttcccgtctcttcggaactagccctgccactgaggctgcccctcctccaccagaaccggttcctgccgccgagggccccgccacagttcaaagcgtcgaggattttgtgcccgatgaccgccttgaccgatccttcctggaggatacaacgcccgccagagacgagaagaaggttggcgcgaaggccgcccagcaggactcggacagcgacggggaggctctggggggcaatccaatggtggcaggctttcaggatgatgtggacctcgaagaccaaccccgcgggtcgcctccattgcccgcaggacctgtgccttcacaggatataaccctcagtagcgaggaagaggccgaggtggccgccccaacaaagggtccagccccagcaccgcaacagtgctctgaaccggagacaaagtggagttcaatccctgcttcaaaacccagacgtgggacggcacccactcgtacggctgcacctccctggccgggcggagttagcgtcagaactggccccgagaagagatcttctactcgcccacccgctgagatggaacctgggaagggcgaacaggcgagtagttcagaatctgaccctgaaggaccaatcgcggctcaaatgctgtccttcgtcatggacgacccagatttcgagagcgaggggtctgatacccagagaagggctgatgattttccggttcgggatgacccttccgatgtaacagatgaagacgaaggaccggcggagccgcctcccccccccaagctcccgctgccagccttcaggctaaaaaatgacagtgatttgttcggactgggactggaggaagccggaccaaaagagtcgtcagaagaaggcaaggaaggcaagacgccatcgaaggagaagaaaaaaaaaaagaaaaaagggaaggaagaggaggaaaaagcagcaaagaagaaatccaaacacaagaagtctaaagataaggaagaaggcaaagaagagcgcagaagacgccagcagcggccaccacgctcacgcgagagaaccgcggcagatgaactggaagcattccttggtgggggcgctcccggcgggaggcaccctggcggcggggattatgaagagctgtag

SEQ ID NO: 183154 - DNA, 678 bp, Artificial Sequence
  Description of Artificial Sequence: Synthetic coding sequence
tgagacgacatcgtgaaggtggaggtgtgggacgtggtggacaagggaaagtgtaaaaagaggggggacggcctcaagatggaaaacgatccgcaggaagcagagagtgaaatggctttagacgctgagttcctggacgtgtacaaaaattgcaatggagtcgtcatgatgttcgacattactaaacaatggactttcaattacattctccgcgagcttccaaaagtcccgactcatgtgccagtctgtgtactgggtaactaccgcgacatgggtgaacatcgcgttatcctgcccgacgacgtcagggactttatagataatttggacaggccacccggctcaagctacttccgctatgctgagtccagtatgaagaacagtttcggtctgaaatacctgcacaaattttttaatattccattcctccagctgcagaaagatgtgagactggcgcaggaaaggggttgtgcagtggttctcgtgtcggaagaggtgcgcatgcccgccgggtgggattgctgctggggtcggctgggctggaaggagggagggtcacagacatgcccagtcccagcacttctgggacggccgctgcttccagctgagcccagcccgcaccactgggttgattatagcttggaatcctccccgctcctttcatgctctattccctag

SEQ ID NO: 183155 - DNA, 1416 bp, Artificial Sequence
  Description of Artificial Sequence: Synthetic coding sequence
atgaccgtgggcaccgtgaagatcgtgatccggggcgaccggaacacgggaaagaccgctctgtggcacagactccagggacgccccttcgttgaggagtatatccccactcaagagatacaggtcacgtccattcattggagctataaaactaccgatgacattgtaaaggtcgaggtatgggacgtggtggataaaggaaagtgcaagaaacgtggcgacggtcttaagatggaaaacgacccgcaagaggctgaaagcgagatggctcttgatgctgagtttctcgacgtgtataaaaattgcaatggagtagttatgatgtttgacattactaaacagtggacattcaactatattctgagagaactgcccaaggtacctacccatgttccggtatgtgtccttggaaattaccgcgacatgggcgagcacagggtcatactgcctgatgatgtgagagatttcatcgacaatcttgaccggccccccgggagttcttacttcagatatgccgagtcttcaatgaagaactcttttggactgaaatatttgcataaattttttaacataccttttttgcagctccagagggagaccctgttgcgtcagctggagacaaatcagttggacatggatgctactctcgaagaactatcagtacaacaggaaactgaagaccagaattatggtatatttctagagatgatggaagccaggtctagggggcatgcctctccactcgcggccaatggccagagtccttcaccggggtcccaaagtcccgtggtgcccgctggcgctgtgtcaacaggatccagctcacctgggacccctcaaccggctccgcaactgccacttaacgccgcccctcctagttctgtgcccccagtcccacctagcgaggccctgcccccccccgcatgccccagcgcaccagcacccaggcggtccataatttcacgcctctttggtacatctcctgccaccgaggcggctccaccacctcccgaaccggtcccagcagcggagggtcccgcgaccgtccaatccgtagaggattttgtcccagacgataggttagaccggtcatttcttgaagatacgacccctgcccgggacgagaagaaggttggagcgaaggcggcacaacaagacagtgattccgacggggaggctctaggcgggaacccaatggtggcaggcttccaggacgacgttgatctggaggaccagccgcgaggctctcctccgctgcccgctggccctgttccttcccaggatattaccctttcctccgaggaggaagccgaagtggccgcccctaccaaggggcccgccccggccccacagcagtgtagtgagcctgaaacaaaatggagcggagaagctcagcagcaccaggcgccttgttag

SEQ ID NO: 183156 - DNA, 1347 bp, Artificial Sequence
  Description of Artificial Sequence: Synthetic coding sequence
atgagccaccgggcctggctggccctgctgcccctggaggtggacggggatgatggactgtgtggtgccggcggacctgagcattctggtagctctcagcctcagcagcagcagcagcgggccccgtgccatctgagggcctccggccgcggtaggggcgcccgcctgctgactcggctcctgccctttagttttcttgaaatgatggaggcccgatctagagggcatgcttctcctctggcagctaatgggcagtcacccagtcccggatctcagagcccagtcgtgcctgccggggcagtgtcaacaggtagctcgtctccaggcacccctcaacccgcacctcagttgcccctgaatgctgccccaccttcttccgtgccccctgtacctcctagtgaggccctcccacctccagcatgccctagtgcccctgcgccccgtcgctcaataatctcccgtcttttcggcacctctccggcgactgaagccgcaccacccccaccagaaccagtcccggctgcagaggggcctgccaccgtgcagagcgttgaggacttcgtcccagatgaccgtttggaccgttcttttctggaagacacaactcctgcccgggacgagaagaaggttggcgccaaagccgcacagcaggacagtgacagcgatggagaagctctgggggggaacccgatggtggccggttttcaggacgacgttgatttggaggatcagccccgtggctcccctcccctgccagctgggccggtcccaagccaagatattactctcagctcagaggaggaggccgaggtggcggcaccgactaaagggcccgcccctgcaccacagcagtgctcagaacctgaaacaaaatggagcagcatccctgcaagcaagccacggaggggcacagctcccacccggaccgctgctccaccatggcccggcggcgtgagtgtgcggacaggtccagagaaacgcagcagtacacgaccacccgctgaaatggagccaggcaaaggcgagcaggccagctcgagcgagagcgaccctgagggccccatagcagctcagatgctgtcctttgttatggatgaccctgacttcgagtccgaaggctcagacactcagcggcgagctgacgacttccccgtgagagatgacccatctgatgtaacagatgaagatgaggggccagcagaaccccctcctcctcccaagctgccccttcctgctttcagactaaagaacgactctgacctcttcggcctgggactggaggaagccggccctaaggagagcagcgaggaagggaaggagggcaaaacaccctctaaagagaaatag

SEQ ID NO: 183157 - DNA, 648 bp, Artificial Sequence
  Description of Artificial Sequence: Synthetic coding sequence
tgaaagatcgtgatccggggcgaccggaacaccggcaagaccgccttatggcaccgcctgcagggcagaccctttgtggaagagtacatcccaacccaagaaatccaggtgaccagcatccactggagctataagactactgacgacatcgtcaaggtagaggtctgggacgtcgttgataagggaaagtgcaagaagcgcggcgacggattgaagatggaaaatgatcctcaagaggcggagtctgaaatggccctagatgctgagttcctcgacgtttacaagaactgcaatggggttgtcatgatgtttgatataaccaaacaatggacattcaattatattttgcgtgagctgcctaaagtgccaactcacgtacccgtgtgtgtgctaggaaattaccgcgatatgggcgagcacagggtgatcctgcctgacgacgtgagggactttatagacaatttggattcccgcccacccgggagctcttatttccgttatgccgaaagttctatgaagaactcctttgggctgaagtacctgcacaagttctttaacatcccatttcttcagctgcaggtgtcaacccatcacgtgggctggtctggttgttggtccctaacctcctttcaggtctcccccgtttag

SEQ ID NO: 183158 - DNA, 336 bp, Artificial Sequence
  Description of Artificial Sequence: Synthetic coding sequence
atgtacagccggctgttctacctgaagagcagctacatcatctactttgaacccttgttttctaacgctataattaacatcctgagcttcattaattctcttgcgtcccccctaaccattttctgtttcgctctgtcggcccaggctctcagtactattttttacttcaggatcttcatctttatttttcactcttggattcttctttttcatttttattttacttgtagttttaaaacatatgaacaccagcactcgaaaatggtacccgcctaccggatgcaaagccctagggcactgccccgtacctacctgtacgtgtggccctacaagtag

SEQ ID NO: 183159 - DNA, 342 bp, Artificial Sequence
  Description of Artificial Sequence: Synthetic coding sequence
atgaacttctacctgctgctggccagcagcatcctgtgcgccctgatcgtattctggaagtatcggagattccagcggaacacaggagagatgtcctcaaactccaccgccctcgccttagtgaggccatcgtcatctggccttattaactctaataccgataataacctggcagtgtatgacctgagccgcgacattttgaacaatttcccccattcgatcgcccgacaaaagcggatcctagtgaacctgtctatggtggaaaacaaacttgtggagttggagcacaccctgttaagcaagggtttccgaggcgccagcccccacaggaaatccacttag

SEQ ID NO: 183160 - DNA, 2853 bp, Artificial Sequence
  Description of Artificial Sequence: Synthetic coding sequence
atgacctggcggatgggcccccggttcaccatgctgctggccatgtggctggtgtgtggctccgagcctcatccccacgccaccatccgtgggagccacggcggcagaaaagtgccactggtgtctcctgatagttctcgccccgcaagattcctgaggcacactgggagaagtaggggtatcgagagaagtacacttgaggaacccaacttgcagcctctgcagcgtaggagaagtgttccagtactgcgcttagcgagacctaccgaacctcctgcaaggtctgatatcaacggtgcagcagtgcggccagagcagcgtcccgccgctcggggttccccacgggaaatgatcagggatgagggcagttcggcccgcagcagaatgctgcgcttccccagtggaagcagttcccctaacatattggccagtttcgccggaaaaaaccgcgtatgggtcatttctgccccgcacgcatccgagggttactaccggctgatgatgagcttgctgaaggatgacgtatactgcgagctcgccgaaaggcacattcagcagatcgtgctgttccaccaggcaggagaagagggggggaaggtcagaaggatcaccagtgagggccaaattttagagcagcctctggatccttccctgatacctaaactcatgtccttcctcaagctcgagaagggtaagtttgggatggttctgttgaagaaaacattacaggtagaggaaagatatccctatcctgtgcgtctcgaagctatgtatgaagttatcgaccagggacccatccgccgcatagagaagatcaggcagaaggggttcgttcagaaatgcaaggctagtggagtggaagggcaggtcgtagcggagggcaacgacggtggggggggcgccggtcggccctcgcttggttcagagaagaagaaggaagaccccaggcgtgcacaggtgccccccacccgagagagtcgtgtgaaggtcctgagaaagcttgccgctacagctcccgcactcccacaaccaccctccacgccacgggccacgactttgcctcctgcgcccgctacgaccgtgaccagaagcacctcccgggctgtgaccgtcgccgccagacctatgaccaccacggctttcccaactactcaaaggccctggactccaagtccttcccaccggcctccaactactactgaggtcattacagctcgcaggccaagcgtgagtgaaaacctgtatcctccttcacgcaaggatcagcacagagaacgcccccagaccacccgccggccatcaaaggccacgagtctggagtccttcaccaacgctccaccgacaaccatctctgaaccatcaactagagccgccgggcctggtaggtttagagacaacaggatggacagaagagagcacggtcaccgcgacccaaatgtggttcccggaccccccaagcccgctaaggagaagccccctaaaaaaaaagcccaggacaagattctctcaaacgagtacgaagagaagtatgatttatctcgtcccactgcctcccagctcgaggacgaacttcaagttgggaatgtgccacttaagaaagctaaagagtctaaaaagcatgagaagctggagaaacccgagaaggagaagaagaaaaagatgaagaatgagaacgctgacaagctccttaaaagcgagaaacaaatgaagaagagcgaaaagaaaagtaagcaggaaaaagaaaagtccaagaagaagaagggagggaagacggaacaagacggataccagaagccgacgaataaacatttcactcagagcccaaaaaagagcgtggccgatctactcgggagttttgaggggaaacgccggctcctcctgatcaccgctcccaaggctgagaataatatgtacgtccagcagcgtgacgaatacttagaatccttttgcaaaatggctacccgcaaaatttccgtgattactatttttggaccggtcaacaattctacaatgaagattgatcattttcagctggacaatgagaagccaatgagagtggtagatgatgaggatttagttgaccagcgcctgatctctgaactaaggaaagagtacggcatgacctataacgacttttttatggtgctcaccgatgttgatcttcgtgtgaagcagtactacgaggtccctataaccatgaaaagtgtttttgatctcatcgacacttttcagagtcgcatcaaagacatggagaagcagaagaaagagggaatcgtttgtaaggaggataaaaagcagagtctggagaactttctctccagatttcgatggcggcgcaggctcctagtaattagtgcgcctaacgatgaggattgggcctactctcaacagctgtcggccttgagcggccaagcatgcaactttgggcttcggcacataacgatcctgaagctactgggcgtaggcgaggaggttgggggagttctggaactgttcccaattaatgggtcctctgtcgttgagagagaggatgttcccgctcatctggtgaaggatatcagaaattatttccaggtgtctccagagtattttagtatgctcctggtggggaaggatggcaatgttaaatcatggtacccgagccctatgtggtctatggtaatcgtgtatgacctgatagactctatgcagctcagacggcaggaaatggctatacagcaatcacttggcatgcgttgccccgaggatgaatacgcaggatatggatatcactcctaccatcagggctatcaggatggatatcaagatgattatcggcatcacgagagttaccatcatggctatccctactag

SEQ ID NO: 183161 - DNA, 744 bp, Artificial Sequence
  Description of Artificial Sequence: Synthetic coding sequence
atgctgctgctgcccctgcccctgctgctgttcctgctgtgcagccgagcagaagctggtgagattatcggcgggacggaatgcaagccacattcccgcccatatatggcgtatctggaaatcgtcactagcaatggcccaagcaagttttgcggtggttttctaatacggcggaactttgttctcacagctgctcactgtgcaggcaggtccatcacggtcaccctcggagcccacaatataactgaggaggaagatacctggcaaaagttagaggtgatcaaacaattccggcaccctaaatacaacacgagtactctccaccatgatataatgctcctgaagttgaaagagaaagccagcctgaccctggccgttggaaccctccccttccctagccaattcaacttcgttccacccggacgtatgtgtcgggtggccggctggggcagaaccggagtgcttaaacccgggagtgacacactccaggaggtcaaattgcggctgatggacccccaagcctgttcccattttcgcgacttcgaccacaacttgcagctttgcgtcggcaatccccggaagaccaagagcgctttcaaaggcgatagcggaggcccattgctgtgcgccggcgtggcacaaggtattgtctcttatggacgctcagacgctaaaccacccgcagtgtttactcggatttcccattaccggccctggatcaaccaaattctccaggctaattag

SEQ ID NO: 183162 - DNA, 210 bp, Artificial Sequence
  Description of Artificial Sequence: Synthetic coding sequence
atgctgggcatcaccgtgctggccgccctgctggcctgcgccaccccagggcccaccgtgtggccatgggagagaaccacatggagatggaaaaccaaaaaggacccttgtctctgggtgtggacaccatccacttctacccgggacgggatgcccagctgttgtgcaatgatcttaccttctagttcactgcagagcatgtggtcttag

SEQ ID NO: 183163 - DNA, 807 bp, Artificial Sequence
  Description of Artificial Sequence: Synthetic coding sequence
atgctgggcatcaccgtgctggccgccctgctggcctgcgccagctcctgcggagtgccatcctttccgccaaatttgagcgcccgggtggtgggcggggaggacgcccgccctcattcttggccatggcaaatctccctacaatatctgaaaaacgatacatggcgtcatacctgcggcgggactctcatcgcttctaattttgttttgacagccgcccattgcatttccaacactcggacctacagggtcgctgtggggaaaaacaaccttgaagtagaggacgaagagggttctctcttcgtcggagtggacacaatccatgtgcacaagcggtggaacgcactcctgttgcggaatgatatagccctcatcaagctcgccgagcacgtcgagctgtctgacacaatccaggtggcatgtctgcccgagaaggactctcttctcccaaaggattacccttgctacgtcaccggatggggacggctctggactaatggaccaatcgcagacaagctgcagcaaggccttcagccggtcgtagaccacgctacctgttctaggatagattggtggggcttccgggtgaagaagaccatggtctgcgcaggaggcgacggcgttataagcgcgtgtaatggggactctggcggtccattgaactgccagctggaaaacggatcttgggaggtattcgggatcgttagttttggttctcgtagggggtgcaacacgaggaagaagccagtagtgtacactagagtctcagcttacattgactggattaacgagaagatgcagttatag

SEQ ID NO: 183164 - DNA, 795 bp, Artificial Sequence
  Description of Artificial Sequence: Synthetic coding sequence
atgctgctgctgagcctgaccctgagcctggtgctgctgggcagctcatggggctgcggtattcctgctatcaagcccgctttgtcctttagccagcggatcgtgaatggtgagaacgccgtccttggatcttggccctggcaggtttccctccaagacagcagcggatttcatttctgtggtggtagcttaatcagtcagagctgggtggtgaccgctgcccactgtaacgtgtcacccgggcgccacttcgtggtgcttggtgaatacgataggtcaagcaacgccgagcctctgcaagtattgtcagtcagcagagctatcacacacccatcatggaatagcactaccatgaacaatgatgttaccctactgaagttggcctctcccgcccagtatactactcggattagccccgtctgcctcgctagttcgaacgaggcattaacagaaggtctcacctgcgtgactaccggatggggacgactctccggcgtgggcaacgtgactccggctcatttacagcaggttgccttgcccttggtgacggtcaaccaatgtcgccaatactggggatcgagcataactgatagcatgatctgtgcggggggagccggggcctccagttgccaaggtgactccggtggccccctggtctgtcagaaaggtaatacctgggtgctcattggcatcgtgtcttggggcactaaaaactgtaatgtgagggcccccgctgtgtacacccgggtgtctaagttctcaacttggattaatcaggttattgcttacaactag

SEQ ID NO: 183165 - DNA, 795 bp, Artificial Sequence
  Description of Artificial Sequence: Synthetic coding sequence
atgctgctgctgagcctgaccctgagcctggtgctgctgggcagctcgtggggctgcgggattcccgctattaagcccgcactttccttttcacagagaattgtaaatggggagaatgccgtcctgggaagctggccgtggcaagtgagtttgcaggattcatctggcttccatttctgtggcgggtcccttataagccagtcctgggttgtcactgcggctcattgtaacgtgagcccagggcgccatttcgtggtcctgggagagtatgaccggtctagtaacgccgaaccacttcaagtgctctcagtgagtagggccatcacccatcccagctggaactcaacaacaatgaataacgatgtaacacttctgaagcttgcctcccctgcccagtataccacacgaattagcccagtgtgtttagcttctagcaatgaggcacttactgaagggttgacatgtgtaactactgggtggggccggctttctggggtcggaaatgtgacacctgcccaccttcaacaggtagccctccccctcgtgacagtgaatcaatgtagacagtattgggggagctcgattacagacagcatgatttgtgcagggggcgccggagcttcatcgtgccagggggattccggaggtcccctggtttgtcaaaagggcaacacctgggtgttgataggcattgtgtcatggggcacaaagaattgcaacgtccgcgcacctgctgtctatacaagagtgagcaaattcagcacttggatcaatcaggtaattgcctataactag

SEQ ID NO: 183166 - DNA, 792 bp, Artificial Sequence
  Description of Artificial Sequence: Synthetic coding sequence
atggccagcctgtggctgctgagctgcttcagcctggtgggcgccgccttcgggtgcggagtgcctgccatccacccagtcctatcggggttaagccggatcgttaatggcgaagatgccgtgcccggttcctggccctggcaagtttcattacaagacaagacaggatttcacttctgcggcggctctcttatttcagaggattgggtagtaaccgcagcccactgtggcgtccgaacctctgacgtggtggttgcaggagagttcgaccaaggttcagacgaggaaaacatccaggttttgaaaattgccaaggtgtttaagaaccccaagttttctattctgaccgtgaacaatgacatcaccctactgaaactcgcaacaccggcgaggttctctcagacggtaagcgccgtatgcctccccagtgctgacgacgattttcctgccggcaccctctgcgcgacaaccggatggggaaagacgaagtataatgcaaataaaacccccgacaagctgcagcaggctgccctgcccctcctgtccaatgctgaatgcaaaaaaagctggggtagacgcatcacagatgtcatgatctgcgccggtgcatccggcgtgtctagctgtatgggagattctggtggacctttggtttgccagaaagacggagcctggactctcgtcggcatcgtgtcttggggcagcgatacctgtagcacctccagccccggagtgtacgcgcgagttacaaaattaatcccctgggtccagaagatcctcgccgctaattag

SEQ ID NO: 183167 - DNA, 1119 bp, Artificial Sequence
  Description of Artificial Sequence: Synthetic coding sequence
atggccgcccccgtgccctgggcctgctgcgccgtgctggccgccgccgccgccgtggtctatgcacagcggcacagtccccaggaggcaccgcacgtgcagtatgaaaggctcggctctgatgtaacactcccttgcggcaccgctaactgggatgcggctgtgacctggagggtaaatggtaccgacctggcgcctgacctccttaacggcagccagctggtgctacacggccttgaactcggccattcgggactctatgcatgctttcaccgcgactcttggcatctcagacatcaggtgctgttgcacgtgggtctccccccccgcgagccggtgctgtcttgtaggtcaaacacctaccccaagggattctattgtagttggcatctcccgacccccacttacattcctaacacatttaatgtgactgtgttacatggctccaagataatggtgtgtgagaaggatccggccttgaaaaatcgctgccatattcggtacatgcacctctttagtacgattaaatataaagtaagcatatctgtgtccaatgccctcgggcataatgctaccgctataacctttgacgagttcaccattgtcaagcctgatcctcctgagaacgtggttgctaggccagttccctctaatccccggcgtctggaagtcacttggcagacaccctctacatggcctgatcctgaaagctttccactgaagttttttctgcggtaccgacctctgatcttagaccagtggcagcacgtggaattatcagatgggactgcacacacgataacagatgcctacgccgggaaagaatatatcatccaggtggctgccaaggataatgaaattggtacttggtctgattggtctgtggctgcccatgccactccctggacagaagaaccacggcacctcactactgaagctcaagcggcggagacgactacctcaacaacgagctcactcgcacccccacccacaactaagatttgtgacccaggtgagttaggtagtgggggggggccaagcgctccttttctggtgtcagtgccaattacccttgcattagctgccgctgctgccaccgcttctagcctacttatctag

SEQ ID NO: 183168 - DNA, 1119 bp, Artificial Sequence
  Description of Artificial Sequence: Synthetic coding sequence
atggccgcccccgtgccctgggcctgctgcgccgtgctggccgccgctgcagcagtcgtgtacgcgcagcgccactctccacaagaagctccccacgtgcagtatgaacgcttaggttccgatgtgaccctgccatgtggcaccgccaactgggacgccgcagtgacttggagagtgaacggcactgacctggcgccagacctactcaacggatcccaacttgtacttcacggcctggaacttggtcattctggattatacgcctgctttcatcgcgattcctggcacttacgccatcaggttctgctccatgtaggactccctccccgggagcccgtgctgtcatgccgatctaatacctacccaaaaggcttttactgcagctggcacctgcccacccccacatatattccaaacacattcaatgtgacagtgctccatggaagtaagatcatggtctgcgagaaggacccagccctgaagaatcggtgtcacatccgctatatgcatctgttctctaccatcaagtacaaagtgtcaatatccgtttcaaatgcactgggacataatgccaccgccatcacattcgatgaattcactatcgttaagccagatccaccagagaacgtagtcgcccgccctgtgccctccaaccctaggagactggaggtcacatggcagacaccctcaacatggcccgaccccgaatcctttccgctcaagttttttcttagatacagaccgctgatcctcgaccagtggcagcatgtagagttgtctgacggaactgctcataccattacagatgcctatgcagggaaggagtacattatccaggtggccgcgaaggacaatgaaatcggcacctggagtgactggtccgtggctgcccacgccacaccatggacagaggaaccacgccacctgacgacagaggcacaagcagctgagacaaccacaagcacaacatcctccctggccccacctcccaccacgaagatctgtgatcctggggaactcggcagcggggggggaccaagcgccccctttcttgtcagtgtcccaattacactggccctcgccgcagcagcagcaactgcttcctctctcctgatctag

SEQ ID NO: 183169 - DNA, 771 bp, Artificial Sequence
  Description of Artificial Sequence: Synthetic coding sequence
atggccgcccccgtgccctgggcctgctgcgccgtgctggccgccgccgccgccgtggtttacgcacagaggcactctccgcaggaggccccccacgtccaatatgaacggttaggtagcgacgttactctcccctgtgggaccgccaattgggacgctgccgttacgtggagggtgaatggaacagacctggcccctgatctccttaatggatcacaactcgtgctccacggactcgaactggggcactcagggttatatgcctgctttcaccgagacagttggcacctgcgccaccaagtgctgctgcacgtcggtcttccaccgcgtgagcccgtgttgtcctgtcgaagtaacacttatccgaagggattctactgctcctggcatctccctaccccgacgtacattccaaatacctttaacgtgaccgtgctccatggatctaagatcatggtttgtgaaaaagacccggccttgaaaaatagatgccacattcggtacatgcatctgtttagcaccatcaaatacaaggtgtccatttctgtgtcaaacgcacttggccataatgccaccgctatcacatttgatgagtttacaattgtgaaacccgatccccccgaaaacgtcgtggctcggccagttccttcaaaccccagaaggctggaggtgacctggcagactccgagtacctggccggatcctgagagttttccattgaagttcttcctgcgctatcgacccctcatcttagatcagtggcagcactag

SEQ ID NO: 183170 - DNA, 3909 bp, Artificial Sequence
  Description of Artificial Sequence: Synthetic coding sequence
atggagctgtacttcggcgagtaccagcacgtgcagcaggagtacggtgtgcatcttcgtctggcctccgacgatactcagaagtctcgatcttctcaaaattcaaaggctggatcatatggggtcagcatccgggtccaggggatcgacggacacccttatatagtcttgaataataccgaaagatgtctggctggcaccagttttagcgagaacgggccacctttcccgccgcctgttataaataacttgccccttcatagctcgaacggatctgtccctaaagaaaactcagaagagttacaactgcccgaaaatccctatgctcagccttccccgattcggaaccttaaacaaccacttctccacgagggaaagaatggcgtgctggatcggaaggatgggagtgttaagccgagtcatttgcttaactttcagcggcaccccgagctgctgcagccctacgacccagagaaaaacgagctgaacctccagaatcaccagccctctgaaagcaattggctgaagacccttactgaagaggggattaacaacaagaaaccctggacttgcttccctaagccgagcaatagtcagcctaccagcccgtccctggaagacccggctaaatctggcgtcaccgcgatcaggctgtgcagctccgttgtgatcgaagacccaaaaaagcaaacatccgtgtgcgtgaatgtgcagtcttgcactaaagaacgagtcggcgaggaagccctcttcacgtctggaaggcctctgacagctcactcacctcacgcccacccggagactaagaaaacgcgccctgatgtgcttccctttagaagacaggactcagcaggccccgtgctggacggagctcggagtaggaggagttcatcgtcctcaaccacccccacaagcgcaaactcactgtatcgctttctgcttgatgaccaggagtgtgcaattcacgccgacaacgtgaatagacatgaaaaccgacgctatattccttttctgccaggcacagggcgagacatcgatacaggctctattcccggcgtcgaccagcttatcgaaaagttcgaccaaaagccaggtttgcagaggagaggaagatccggaaagaggaaccgaatcaataccgacgacagaaagcggtctaggtcagttgattcagccttccctttcgggcttcagggaaactcagaatacctcattgagtttagccggaacctcggaaaaagcagtgagcacctgctccggccgtctcaagtgtgtcctcagcgaccactatcgcaagaaaggaggggaaaacagtcagtgggccggacatttgccaagctccagggtgccgcccacggcgcgtcatgtgcacactcgagacctccccagccgaacatcgacggcaaagtcctggaaacggaaggctctcaggagagcacagtcattcgcgcgcctagcttaggggcgcagtccaagaaggaggaagaagtgaagaccgccaccgcaactcttatgcttcagaatagggctacagccacttcaccggacagcggagctaagaaaattagcgtgaagaccttcccctctgccagcaatacccaagctacgccagacttactgaagggacagcaggaactcacgcaacagaccaacgaggaaaccgccaagcagatcctctataattatctgaaagaagggtccacagacaacgacgacgccacaaagcgcaaggtgaatcttgttttcgagaagattcagaccttgaagtctagagctgcaggctctgcacaaggcaacaatcaagcctgtaactcaacgtctgaagtgaaggacttactggagcaaaagagtaaacttactatcgaagtcgctgagttacagcgtcagctgcagttggaagtcaagaaccaacagaatattaaagaagagagggaacgcatgagggctaatttggaggaattgagatctcaacataacgaaaaggtggaggagaacagtacgcttcagcagcgcctagaagagtcagagggggagctccgcaagaacctcgaagaactctttcaggtgaagatggaacgagagcagcaccaaacggaaatcagggaccttcaggatcaactaagtgagatgcacgatgaactagacagcgccaagcgtagtgaggatagagagaagggtgctctgatcgaggaactgctgcaggcgaagcaagacctgcaagatctgctaatcgccaaggaggagcaggaagacctcttgcgtaaaagggaacgcgagctcacagctctgaaaggcgcgcttaaggaagaggtttcgtcccacgatcaggagatggataagcttaaggagcaatatgacgcggagttacaggccctgcgcgaaagtgtggaggaggccacaaagaacgtggaggtgctggcctctcgatctaatacatccgagcaggaccaggccggaacagagatgagggtcaagctcctgcaggaggagaacgaaaagttgcagggccgatccgaagagcttgagcgccgcgtggcccagcttcagagacagatcgaagacctcaagggagacgaggccaaagctaaagaaacactgaaaaaatacgagggggagatcaggcagttggaagaagctctggtgcatgctaggaaggaagaaaaggaggctgtgagcgcacgccgggccctcgagaatgaactggaagctgcgcagggcaatttgtcgcagacaacccaggaacagaagcagctaagtgagaagctgaaggaggagagcgagcagaaggaacagctgcggagattaaaaaatgagatggaaaatgagaggtggcacctgggtaagacaatcgaaaaattacagaaggagatggctgacatcgtcgaggctagccgcaccagcacattagagttacagaaccagttggatgagtacaaagaaaagaataggagggaactcgcagagatgcagcgacaattgaaggaaaagaccctcgaagcagagaaatctagactaacagccatgaaaatgcaagacgaaatgcggcttatggaggaggagctgcgtgattaccagcgggctcaggatgaggccttaaccaaacggcaactgctagagcagacactgaaagatctggagtacgagcttgaggcaaaatcacacctgaaggacgatcgtagccggctggtaaaacagatggaagacaaggtgagccaactggaaatggagctcgaggaggaacggaacaacagtgatctcctgtcagaaagaatatcccggagcagagagcaaatggagcaactgcggaacgagctgctgcaagaacgagccgcccggcaggaccttgagtgcgataagatcagcctggagcgacagaataaagacttgaagtctaggatcatccacctcgaaggttcctatcgatcttccaaagagggcctggtggtacaaatggaggcaagaatcgccgagctagaagataggttagagagcgaggagagggatcgcgccaatttgcagttgagtaacagaagactggaacgaaaagtaaaggaactggttatgcaggtggacgatgagcacctttcccttacggaccagaaggatcagcttagcctccgccttaaggctatgaagcgccaggtggaggaggccgaggaggaaattgatcgcctggaaagttccaagaagaaactgcagagggagctggaggagcaaatggacatgaacgaacacctacagggacagctgaactcaatgaagaaggacctgaggttaaagaagctcccctccaaagtcctggatgacatggatgatgacgacgatcttagtacagacggcggaagcttgtacgaggcacctgtgagctatacattctctaaggatagtactgttgcttctcagatctag

SEQ ID NO: 183171 - DNA, 2061 bp, Artificial Sequence
  Description of Artificial Sequence: Synthetic coding sequence
atgggcgagttcaaggtgcaccgggtgcggttcttcaactacgtgccgtctggaatccggtgtgttgcctacaataaccagagtaatagattggcggtgagcaggactgacggcacagtggaaatttacaatttgtccgccaactatttccaggaaaagttttttcctggacatgagagccgggctacggaggcactatgttgggccgaagggcagcgattgttttcagcagggctgaacggtgagattatggagtatgatcttcaggccctaaacatcaaatacgcaatggacgcctttggagggcccatctggtctatggctgcttctccgtccggctctcagttgttagtggggtgcgaagacggctccgttaaactttttcagataacacccgacaaaatccagtttgaaaggaactttgaccgccagaaatcccggattctgtcacttagctggcaccctagcgggactcacattgccgccgggagcattgattatatatcagtcttcgatgttaagagtgggtcggccgtgcataaaatgattgtcgaccgacagtacatgggcgtgtccaagaggaagtgcattgtgtggggcgtggcattcttgagtgacgggactattataagcgtcgactccgcggggaaggttcagttttgggacagtgctacgggtaccctggttaaatcacacctgattgccaatgctgacgtgcagagcatcgcagttgcagatcaggaggactcatttgtggttggtactgccgaagggaccgtgttccactttcaactggtgccagtgacaagcaattcaagcgagaaacagtgggtccgcacaaagcccttccaacatcacacacacgatgttcgaactgtggcacattcccctactgcactaatatcaggcggcactgacactcacctggtgttcaggccgttgatggaaaaagtggaggtgaagaactatgatgctgctcttcgaaagataacctttccccatcgttgcctcatttcctgtagtaaaaagcggcagctgctcctgtttcaattcgcacaccatctggaattatggagactcggtagtacggtggcaacaggcaaaaatggcgacactctgcctttatcgaagaatgcggatcacttgctacacctgaaaaccaaagggcctgagaacattatctgttcctgcatctccccttgtggatcctggattgcttacagcactgtcagtcggttcttcctctaccgcctgaactacgagcatgacaatattagtcttaaaagagtttcaaagatgcctgcattcctgaggtcagccctccagatccttttcagtgaggattctacgaagctgtttgtggcttctaatcagggggccctccacattgttcagctgtcaggcggatcctttaagcacctgcacgctttccaaccccagagtgggacggttgaggctatgtgcctgctggccgtcagtcccgacgggaactggctcgctgcctccggcacatctgctggggtgcacgtgtataacgtcaaacaactgaaactgcactgtacggtgccagcgtataattttcctgtcactgcaatggcaattgcccctaacaccaataacctggttatcgctcatagcgaccagcaggttttcgagtacagtatccctgacaagcagtatacagactggtctcggactgtccagaagcagggtttccaccatctgtggctccaaagggatactccaattacacatattagtttccatcctaagcggcctatgcacattctcttgcatgatgcttatatgttctgcatcatcgataagagcctgcctctgcctaatgacaagactctactttataacccttttcctcccaccaatgagagcgacgttattcgaaggcggaccgcccacgcattcaaaatttccaaaatctataaaccactgctgttcatggacctgctggatgaaaggaccctcgtagccgtggaacgacctctcgacgacatcattgcacaattgcctccgcctatcaagaagaagaagttcggtacatag

SEQ ID NO: 183172 - DNA, 1716 bp, Artificial Sequence
  Description of Artificial Sequence: Synthetic coding sequence
atgggcgagttcaaggtgcaccgggtgcggttcttcaactacgtgccttccggcatccggtgcgtggcatataacaatcaatctaacagactcgctgtttccagaacggacgggactgttgagatatataatctatcagccaactactttcaggaaaaattttttcccggacatgagtcccgcgcgacagaggcactgtgttgggccgaaggacagagattgtttagtgctggcctcaatggagagatcatggagtacgatctgcaggccttgaatattaaatatgcaatggacgccttcggcgggccgatttggagtatggctgcatcacctagtggatcccagttactcgtcgggtgtgaagacggctctgtgaaattgttccagatcacccccgataagattcaattcgaacgtaacttcgacagacagaagagtcgaattctgtctctgtcatggcatccaagtggcacgcacatcgcagcgggcagcatagactacatttctgtgtttgatgtgaagtcaggctccgcagtgcacaaaatgattgtggaccggcaatatatgggggtctccaagcggaagtgcatcgtctggggagtggctttcctgtccgacggaaccatcataagcgtagactccgccgggaaagtacaattttgggactctgctacaggaacactcgtgaaaagccatctaattgctaatgcagatgttcagagtatcgccgtggccgaccaggaggatagcttcgtggtcgggactgccgaggggacggtgtttcactttcagctagtgcccgtgactagcaatagctctgaaaagcaatgggtaaggaccaagcctttccaacaccatacacatgatgttcgcacagtggcacactcgccaaccgccctgatatcgggcggtactgacactcatctggtcttcaggccattgatggagaaagttgaggttaaaaactacgacgcagcactgcgcaagattacttttcctcatcggtgcctgatttcttgttctaagaaaaggcagttgctgttgtttcagtttgctcatcatctggagctttggaggctcggtagtaccgtggccacaggaaccgtggaggcaatgtgtcttttagcagtgtcaccggatggaaactggctggctgcttccggaaccagtgctggtgtacatgtgtacaacgtgaagcagctgaagctccattgtacagtacctgcgtacaactttccagttacggccatggcgatcgctcccaacactaataacttggtgattgcccattcagatcagcaggtgtttgaatattccattcccgataaacaatatacagactggtcgagaaccgtccaaaaacagggcttccaccacctctggttgcagagggacacccctataacccacatttctttccaccccaagcggcccatgcatatcctcctacacgacgcttacatgttctgcatcatagacaaatccctgcctttacctaacgacaagacacttctttataaccctttccccccaaccaacgagtctgatgttatcagaagaagaaccgcacacgcctttaaaatatccaaaatttacaaacctctgctttttatggacctgttggatgaaagaaccctggtcgccgtcgagcgcccacttgacgatatcatcgcccagcttcccccaccgattaaaaagaagaagttcggcacctag

SEQ ID NO: 183173 - DNA, 1023 bp, Artificial Sequence
  Description of Artificial Sequence: Synthetic coding sequence
atggccctgcggctgctgcggcgggccgcccggggcgccgccgccgccgccttactgcgcctgaaagcgtcccttgctgctgatattcctagattaggatacagctcctcttcccaccacaagtacatccctcgcagggccgtgctttacgtacccggaaacgacgagaaaaagatcaaaaagattccaagccttaacgtggattgcgcggtgctggactgcgaagacggagtcgctgccaataaaaagaatgaggctcgcttgaggatcgtcaagacgcttgaggacattgacctggggcctactgaaaagtgcgtcagggtgaactccgtgagctcaggactggccgaggaagacctagagacactgctgcagtcccgggtgttgccgtcaagccttatgctgccaaaagtggaaagtccagaggagatccaatggtttgctgacaaatttagctttcatttaaaaggtcgcaaactagagcagccaatgaacctcatcccattcgtcgaaacagccatggggctgctgaattttaaggccgtctgcgaagaaaccctgaaggtcggcccgcaggtaggtttgttcctggatgccgtggtctttggcggcgaggatttcagggccagcatcggggctacatcctcaaaggagacactggatattctctacgcgagacagaagattgtcgtcattgccaaggccttcgggttacaggctatagatctggtgtacatcgattttcgtgatggcgcaggcctgttaaggcagagccgggagggggcagctatgggatttacgggaaaacaggttatccatcccaatcagattgccgtagttcaggagcagttcagtccgagccctgaaaagatcaagtgggctgaggaactgattgccgcctttaaagagcatcagcagctgggtaaaggcgcctttactttccagggcagtatgatcgatatgcctctactgaagcaggctcaaaacacagttactctggcaacatctataaaagaaaagtag

SEQ ID NO: 183174 - DNA, 921 bp, Artificial Sequence
  Description of Artificial Sequence: Synthetic coding sequence
atggccctgcggctgctgcggcgggccgcccggggcgccgccgccgccgcactgctgcgactgaaagctagcctggcggcagacatacctcgcctggggtatagcagctccagccaccacaaatacatcccccggcgcgccgtgctgtatgtaccagggaatgatgagaagaagatcaaaaagattccaagtctcaacgtggattgtgccgttctcgattgtgaggatggcgtcgccgcgaacaagaaaaatgaggcgcgcctacgaatcgtgaagactctcgaggacattgacttaggccctaccgagaaatgcgtgagggtaaattcagtcagtagtgggctagcagaggaggatctggagacactgctgcagagcagagtgctcccatcctcgttgatgttgcctaaggtggaatctcccgaggagattcagtgggcagtctgcgaagagactcttaaggtgggaccgcaggtgggattatttttagacgcagttgtgtttggtggcgaggactttcgtgcgtctatcggggccacctccagcaaggagaccctggatatcctctacgcaagacaaaaaatcgtggtgattgccaaagcctttgggctccaggctattgatctggtctacatagatttcagggacggggctggcctgttaagacagtccagagaaggcgctgctatggggtttacgggaaagcaggtaatccatccaaatcaaattgccgtagtccaggaacagttttcaccttctcctgaaaagataaagtgggctgaggagctcatcgcagccttcaaagaacaccagcagctgggcaaaggggcgttcaccttccaggggtctatgattgacatgcccctgttgaagcaagctcagaacaccgtaacactggcaacctccatcaaagaaaagtag

SEQ ID NO: 183175 - DNA, 921 bp, Artificial Sequence
  Description of Artificial Sequence: Synthetic coding sequence
atggccctgcggctgctgcggcgggccgcccggggcgccgccgccgcagccctactgagactcaaagcttccttggctgccgacattcctcgactgggctatagttctagctcccatcataaatatatcccaaggagagccgtgctgtacgttcccggaaacgacgaaaagaagatcaagaagatcccatccttgaacgtggattgcgcggtgttggattgtgaggatggcgtggcagccaataaaaagaacgaagctagactcagaattgtcaaaacgctagaggacattgatctcgggcctacagaaaaatgtgttcgggtgaactctgtctcctctggcctggccgaggaggatttagagaccctcctgcagtcccgggtgttaccctcctctttgatgctccctaaagtagagagcccagaggagatccaatgggctgtctgcgaagaaacactcaaggtcgggccacaggtaggcctttttctggacgccgtggtcttcgggggagaagatttccgggcgtcaattggagctacgtccagcaaagagacactggacattctctatgcaaggcaaaaaatagtggttatcgccaaagccttcggactacaggcaatcgatctcgtttatatcgactttcgagacggcgccgggctcctgcggcagtccagagaaggcgccgccatgggcttcacgggaaaacaggtgatccatccaaatcaaatagccgtcgtgcaagaacagttctcaccgtcaccggaaaaaataaagtgggctgaagagctgattgccgccttcaaagaacatcaacagctgggcaagggtgcattcacgtttcagggttccatgatcgacatgcctctcttaaagcaggcacagaacaccgtgactctggcaacatcgataaaagagaaatag

SEQ ID NO: 183176 - DNA, 1023 bp, Artificial Sequence
  Description of Artificial Sequence: Synthetic coding sequence
atggccctgcggctgctgcggcgggccgcccggggcgccgccgccgccgccttattgaggttaaaggcctctcttgcagctgatatccctagactcggctacagcagcagcagccaccataaatacatcccccgacgggcagtcctgtacgtgcctgggaacgacgagaaaaaaattaaaaaaatcccctcactgaacgtggactgtgctgtgctcgattgtgaggacggagttgcggctaacaaaaaaaacgaagccaggctacgaattgtaaaaacacttgaggatatcgatctcggacccaccgaaaagtgtgtaagagtgaacagtgtctccagtggtctcgcagaggaggacctggaaactctccttcagtcgagagtgttgccctccagtcttatgttgccaaaagtagagagccccgaagagatacaatggttcgcagataaattttctttccacctgaaggggcgaaaactcgaacaaccgatgaacctcatccctttcgttgagactgccatgggactgctaaactttaaggcagtctgcgaggaaacactcaaagtcgggccccaagtaggcctgttcctcgacgcagtggtgttcggtggggaggactttagggcgtccatcggcgccactagtagcaaggaaacactcgatatcctttatgcaaggcaaaaaattgtggtcatcgccaaggccttcgggttgcaggccatcgacctggtgtatatcgatttccgcgacggagcaggactgctccgccagagccgtgaaggggccgcaatgggattcacgggcaagcaggtaatccacccaaatcagatagccgtcgtgcaagagcagttcagcccgtctccagagaagattaagtgggccgaggagttaatcgccgcgttcaaggaacatcagcagctgggtaaaggtgcatttaccttccagggaagcatgattgacatgcctctgctcaaacaagcacagaataccgttaccctggccacatccatcaaggagaaatag

SEQ ID NO: 183177 - DNA, 546 bp, Artificial Sequence
  Description of Artificial Sequence: Synthetic coding sequence
aacgaggcccggctgcggatcgtgaagaccctggaggacatcgacctgggcccaactgagaaatgtgtgcgcgtaaacagtgtctcatcagggctggctgaagaggacctcgagaccctgttgcagtctagagtcctgccatcaagtctgatgctgccaaaagtagagtccccggaagaaattcagtggtttgccgacaaattctcattccatttaaaaggccgtaagctggagcagcccatgaacctgatccccttcgtcgagaccgctatgggattgttaaacttcaaggcggtctgtgaagagaccctcaaggtagggccccaagtgggtttgtttctagatgccgtagtgtttggcggagaagattttcgtgcctccattggggtcaaagacatcagcctgagcctgttcctctgcgtgtgtgtatacatgtgtgtgtacattttcagcctccccctgaaagatgggcatctccacaataatgtgtatcttccaactatgaccatggtctttcatgataatggcatggatactacctcttag

SEQ ID NO: 183178 - DNA, 312 bp, Artificial Sequence
  Description of Artificial Sequence: Synthetic coding sequence
ctgcaggccatcgacctggtgtacatcgacttccgggacggcgccgggctattgaggcagagccgggaaggcgccgcaatgggattcactggaaaacaggtgatccaccccaaccaaatcgctgtcgtccaagagcaattctctcccagtcctgaaaagataaagtgggctgaggaacttatcgccgctttcaaggagcatcaacagttgggcaagggggcattcaccttccaaggctccatgatcgacatgcctctgcttaaacaggcgcaaaacacagtgacacttgcaacttcaatcaaagagaagtag

SEQ ID NO: 183179 - DNA, 270 bp, Artificial Sequence
  Description of Artificial Sequence: Synthetic coding sequence
gaggagctgatcgccgccttcaaggagcaccagcagctgggcaaggtgggaaggtattgttgcagctggctgtgcattcagccctttccatctagccccgggcagagatctcaaagtatctcccgggtgcccggaagatattgggtcttgggggcccggtcgtgggagtccaagggagcgtttacatttcagggatctatgatcgatatgccactgttgaaacaggcacagaataccgtgaccctcgcaacctcaatcaaggagaagtag

SEQ ID NO: 183180 - DNA, 444 bp, Artificial Sequence
  Description of Artificial Sequence: Synthetic coding sequence
aacgaggcccggctgcggatcgtgaagaccctggaggacatcgaccttgggcctactgaaaagtgtgttcgcgtgaactctgtttcatctggacttgcagaagaggaccttgagacccttcttcagtctagggtgcttcctagctcactgatgctgccgaaggtggagtcccccgaggagatccagtgggccgtgtgtgaggagactctgaaggtgggacctcaggtgggtttgttcctggatgcagtggttttcggcggtgaagacttcagggctagcatcggagtgaaagatatttctttgtctctattcctgtgtgtttgcgtgtatatgtgcgtgtacatattttccctgcccctcaaggatgggcacctgcataataacgtatacctgcccactatgactatggtctttcacgataatggcatggatacaacctcctag

SEQ ID NO: 183181 - DNA, 909 bp, Artificial Sequence
  Description of Artificial Sequence: Synthetic coding sequence
atggccctgcggctgctgcggcgggccgcccggggcgccgccgccgcggctctgcttagactgaaagcatcactggccgcagatatcccccggttgggctattcgtcgtcctcacaccataagtatattccacggcgtgcagttttgtatgtcccaggtaacgatgaaaagaagattaaaaaaataccatcactgaatgtggattgtgccgtgttggattgcgaggacggggtagcagccaataaaaagaatgaggctagacttcggatagtgaagaccctggaagatatagatcttggtccgaccgagaagtgtgtccgcgttaactcggtgtcaagcggcctggccgaggaggatctggagactcttctgcagtccagggtgctgccttcatcactcatgctccctaaagtggaaagtcctgaagaaatacaatgggccgtttgcgaggagactctgaaagtcgggccccaggtggggctgttcctagatgcggttgtgtttggaggcgaggattttagagcatctatcggcgcaacgtcgtctaaagaaactctcgatattctgtatgcacgccagaagatcgttgtaatcgcaaaagcattcgggcttcaggcgatcgacttagtgtatatcgactttcgcgacggggcaggactgctgaggcagtccagggagggagcagccatggggtttacaggcaaacaggtgattcacccaaaccaaatcgccgttgtgcaggagcagttcagcccgtcccctgaaaagatcaagtgggcggaggagctcatagcagcatttaaagagcatcagcagctcgggaaaacagttagctgttccgcaagccaggcgggcgttcagtggcgtgatctggggagcctccagcccccgccaccaggattcaaatag

SEQ ID NO: 183182 - DNA, 1401 bp, Artificial Sequence
  Description of Artificial Sequence: Synthetic coding sequence
atggccctgctgaccgccgccgcccggctgctgggcaccaagaacgcgtcatgcctggtgttagccgcccgccacgcaagtgcaagtagcacgaaccttaaggacattctagctgatcttattcccaaagaacaagcacgcatcaagacctttcgccaacagcacggcaagaccgttgtaggtcagattaccgttgacatgatgtatggtggcatgcgcggaatgaagggattggtttatgaaacgtctgtcctggaccctgacgagggcatccgttttcgcgggttttccataccagaatgccagaagctgctcccaaaggccaagggcggtgaagaacctctgcccgaaggactattctggctccttgtcactggccacatccctacagaggagcaggtgagctggctctccaaggagtgggcgaagcgcgcagctctgccctcccacgtggtgactatgctggataattttccaacaaacctccatcctatgagtcagctgagcgccgcggtgaccgccctgaactctgagtccaactttgcgcgcgcatatgcccaaggcatcagcaggactaagtattgggaattgatctatgaggatagtatggatcttatagcgaaactgccttgcgtcgccgccaaaatttataggaacctttaccgtgagggctctggtattggggcaatcgatagcaaccttgactggtcacacaactttacaaatatgttgggttatacagaccaccaattcactgaactgacccggctatacctgactatccactccgaccacgagggaggtaacgtttccgctcatacttctcacctggtgggaagcgctctcagtgacccctacttaagtttcgctgccgcaatgaatgggctggcggggccactgcatggcctggctaaccaggaagtcctcgtctggttgacccaacttcagaaggaggtgggaaaggacgtcagtgatgaaaagctgagggattacatttggaacaccttaaattcgggtcgcgtggtgcctggatacggccacgccgttttgcgcaaaactgatccgcgctatacttgccagcgagagtttgccttaaagcatcttcccaatgatcctatgttcaagctcgttgcccagctctataaaattgtgccaaatgtgttgctggaacagggaaaagctaaaaacccttggcccaacgtcgacgcccactcaggcgttttactgcaatattacgggatgaccgagatgaactactatactgtgctattcggagtgtcgcgagccctaggggtgctggcccagcttatttggagtagggccctgggattccccttagagcggcccaagtccatgtccacagaagggttaatgaaattcgtggactctaaaagtggctag

SEQ ID NO: 183183 - DNA, 537 bp, Artificial Sequence
  Description of Artificial Sequence: Synthetic coding sequence
atggccctgctgaccgccgccgcccggctgctgggcaccaagaacgcttcttgtctggttttggccgcccgccatgctagcgctagctcaacaaacctgaaggacatcctggctgacttgatacctaaagagcaagcccgaattaagacttttcgccagcaacatggtaaaacagtcgtcggtcagatcactgtggacatgatgtatggtgggatgcgggggatgaaaggattggtgtacgagacgtccgtcctggacccagacgaaggaattcgcttccgcggattttccatccctgaatgtcaaaaactactcccaaaggccaaaggaggtgaggaacctcttcccgaagggctattctggctcctggtaaccggtcatatccctaccgaggagcaggtctcttggttgagcaaggagtgggccaagcgtgctgctctgccatcccatgtcgtcacaatgcttgataactttccaaccaatttacaccccatgtcgcagctcagtgctgctgttacagcgcttaattctgagtag

SEQ ID NO: 183184 - DNA, 6084 bp, Artificial Sequence
  Description of Artificial Sequence: Synthetic coding sequence
atgctgaagttcaagtacggcgcccggaaccccctggacgccggcgcggccgagccaatcgcgtctcgggcctccagactgaatctcttctttcagggcaagccacctttcatgacacaacagcagatgtctcctttatccagagagggtatcctggatgctctgttcgtcctgttcgaggagtgcagccagcccgcactcatgaagataaaacatgtttcaaatttcgtgagaaagtattcagacaccatagctgagcttcaggaattacagccatctgccaaagattttgaggtaaggagcttggtggggtgcggccatttcgccgaagtgcaggtagtgcgcgagaaggccaccggggatatttatgcaatgaaggtgatgaaaaagaaagctctcttggcccaggagcaggtgtcatttttcgaagaagagaggaacattttaagtcgcagtacaagtccctggataccccagctgcaatacgccttccaggataagaatcacctctacctcgtgatggagtatcagcccggaggggatttgctctcactcctgaataggtatgaagaccagctggatgaaaatctaatacagttttacttggcagaattgatactggcggtacacagcgtgcatcttatggggtacgtacatcgcgatattaaaccagagaacattttagtggaccggacgggccacatcaagctggtcgacttcggcagcgccgccaaaatgaatagtaacaaaatggtgaacgcaaagttgccaatcgggacccccgactacatggcgcccgaagtcctcactgtgatgaacggtgatggaaaagggacttacgggcttgactgcgactggtggagtgtgggcgttatcgcctacgagatgatctacggccgaagcccttttgccgaggggactagtgcacgaactttcaacaatattatgaacttccagagatttttgaagttccccgatgaccccaaggtgtcatctgacttcctagacttgatccagagcctgctgtgcgggcaaaaggaacggttgaaattcgagggcctgtgttgccacccattcttctcaaagatagactggaataacatccgcaacagtcctccaccgttcgtcccgaccttgaagtcagacgatgacactagcaacttcgacgagccagaaaagaacagctgggtcagctcgtcgccttgtcagttgagcccttctggcttctctggcgaggagctgcctttcgtcggcttcagctactctaaggctctcggtatccttggccggagcgaaagcgtggtgtcgggcctggactctccagctaagacaagtagtatggaaaagaaactgctgattaagagtaaagaactgcaggacagccaagataagtgccataagatggagcaggagatgacacgcctacacagaagggtgtcagaggtggaggccgtactatcacaaaaagaagttgagcttaaggcaagtgagacgcagcgtagcctcctagagcaggacctagccacatacatcactgagtgtagctcgctgaagaggagtctggaacaggcgcggatggaagtctcacaggaggatgacaaggcactccagctacttcacgacataagagaacagtctaggaagctgcaggaaattaaggaacaggagtatcaggcccaggtggaggagatgcggctgatgatgaatcagctggaggaggatctggtttctgcccgacgacgttctgatctttatgagagcgagctgcgtgagtcccggcttgcagcagaggagtttaagcggaaagcgactgaatgccagcacaagcttctgaaagcgaaagatcaagggaaacctgaggtcggtgagtacgctaaattggaaaaaattaacgctgagcagcaactcaagatccaagaactccaggaaaaactggagaaggccgtgaaggccagtactgaggccacagagctactgcagaatatcagacaggcgaaggaaagagccgaaagggagctggagaaactgcagaacagagaggactcttctgagggcatccgcaaaaaactggtagaggctgaggagttggaagagaagcaccgggaggctcaggtgagcgctcagcacctcgaagttcatctgaagcagaaggagcaacattacgaggaaaaaattaaggtgctggataatcagatcaaaaaagacttagcagacaaggagactctggagaatatgatgcagagacatgaggaggaagcccacgaaaaagggaagatcctgtccgaacagaaggcaatgattaacgcaatggattctaagatcagatctctagaacagagaatcgtcgaactttccgaggcgaataagctggctgctaactcttctctcttcacccagagaaatatgaaagcccaggaggaaatgatttccgagcttcggcagcaaaagttctatctagaaacccaggctggcaaactcgaagcccagaaccgcaagctagaggagcagttagagaagattagccaccaagaccacagtgataagaataggcttctagagttagagacacgcttgagggaggtgtcactggagcacgaggagcagaagttagagctaaaacggcagctgacggagcttcagctgtctctccaggaaagggagagccagttgaccgctctgcaggccgctcgcgcagctctggaaagccaattgcgacaagccaagacagaactggaggaaaccactgccgaggccgaggaggagattcaggccctgacagcccacagagatgagatacagcgaaagtttgatgctcttcggaactcatgcaccgtaataacagatctggaagagcaactcaaccagctgacagaggataacgcagagttgaacaaccagaatttctatctatccaagcaactggatgaagcctcgggtgcgaacgacgagatcgtccagcttaggtccgaggtggatcatctcagacgggaaattacggagagggagatgcagttgacctctcagaagcagacaatggaggctctgaagacgacctgcacgatgctggaggagcaggtgatggacttggaagcactgaacgatgaactgctggaaaaggaaaggcagtgggaagcatggcgcagtgtactgggcgacgaaaaatcccagttcgagtgccgggttcgagagcttcagaggatgctggatacagagaaacagagcagggcaagagctgaccaacgtataacggagagccgtcaggtagtcgagctcgctgtcaaggaacataaagcggaaatactcgcactgcaacaggccctgaaggagcaaaaactgaaagctgagtccttgagcgataaattgaatgacctggagaaaaaacacgcaatgctggaaatgaatgctagatccctgcagcaaaagctcgagactgaaagagagctaaaacagcggctgctggaggaacaagctaaactgcagcagcagatggacctgcagaaaaatcacatttttaggttgacacaggggcttcaggaagcgctggatagagccgatctgttgaaaaccgaacggagtgacctggaatatcagctcgaaaatattcaggtgctgtatagccatgagaaagtcaaaatggagggtacaatatcccagcagactaagctgattgattttctccaagctaaaatggaccaaccagcgaagaaaaaaaaggggcttttctcgaggcgaaaggaagatccagcgttgccgacccaggttccgctgcagtataacgagctgaaacttgctctcgaaaaggagaaagccagatgcgccgaactggaagaagcgttgcagaagacacgcatagaactgcgttcggcgagggaagaggctgcccatcggaaagcgacggatcatcctcacccgagcaccccagcaactgccaggcagcaaatagccatgagcgcaattgtgcggagtcctgaacatcagccgtctgccatgtctctactggctccaccatcaagccgtagaaaagagtcaagtacgcctgaagagttttcacgccgtctcaaagagcgaatgcaccacaacatcccccatagatttaatgtgggcctcaatatgagggcaacaaagtgcgccgtctgcctggacacagtccactttggacgtcaggcgagcaagtgcctggaatgccaggtgatgtgccatcccaaatgtagcacctgcctgcccgctacttgcgggcttccggcagagtacgcgactcatttcaccgaggcattttgcagagacaagatgaatagccctggattgcagaccaaagaaccttcttcgtctttacacttagagggctggatgaaggttccacgcaacaataaacgcggacagcaggggtgggatagaaagtacattgtgttggaggggtctaaagtgctaatctatgataatgaagcgcgcgaggcgggacaacgacctgtggaagaatttgagctgtgcctgccagacggcgatgtgtccatacacggcgccgtgggagcttctgagctagccaacacagctaaggctgatgtgccctatattcttaagatggagtctcatcctcacacaacctgctggccaggcaggaccctctatttactggctccctcctttccagataaacagagatgggttacagcccttgagtccgtcgtcgccggtgggcgggtttctcgtgaaaaagctgaggctgatgctaaactactaggcaacagtttgctgaaattagagggggacgatcgcctcgacatgaattgcactctgcctttcagcgaccaagtcgtactcgtgggcaccgaagaggggttgtacgcactgaacgtcctgaagaatagtctcacccacgtgcccggtattggcgccgtgttccagatttatatcatcaaagacctcgagaaattgctcatgatcgccggagaggaacgagcactgtgcctggtagatgtgaagaaagtaaaacagtccctcgctcagtctcacctacccgcccagccagatataagccctaatatcttcgaggcagtaaagggctgtcacctgttcggtgccggaaaaatcgaaaatggcctctgcatctgcgccgccatgccctcgaaagttgtgatcctccgctataacgagaacctgtccaaatactgcattaggaaggaaatcgagacatctgagccatgttcttgcatacacttcaccaattattctatactgattggcacaaacaagttctatgagatcgacatgaaacaatacacgctggaggagtttttggataagaatgatcattctctggctcccgcagttttcgccgcaagcagcaacagtttccctgtgtcaattgtccaagtgaacagcgctgggcagcgagaagagtatcttctgtgtttccacgagttcggggtctttgtcgacagttacgggcgccggtccaggacggacgatctaaaatggagccgtctacccctcgccttcgcataccgcgagccgtatttatttgttacccattttaactccttagaagtgatcgagatccaggctcggtcatcagctggtacacccgccagagcttaccttgatatcccaaatccaagatatctagggccagctatttcgagtggagcaatttaccttgctagctcctaccaggataagctccgggttatttgctgtaagggtaacctcgtcaaggagtctggtacagaacaccatcgcggtccctccacaagtaggtcctccccaaataaaagaggccctccaacgtataatgagcacatcacgaagcgagtggcttcctcacccgccccaccagaaggcccttctcacccccgtgagccctccaccccacaccggtaccgcgagggtcgcacggaactgcgccgggacaaaagccccggacggcccttggaacgggaaaaaagccccggtcgtatgctctctacaaggcgggaaagaagccccggaagactattcgaagacagcagtcgaggcagactgccagcaggcgccgtaagaacgcctttgtcccaagtgaataaagtttgggatcagtcctcagtttag

SEQ ID NO: 183185 - DNA, 6210 bp, Artificial Sequence
  Description of Artificial Sequence: Synthetic coding sequence
atgctgaagttcaagtacggcgcccggaaccccctggacgccggcgcagccgaacccatcgcctctcgggcgtcaagattgaacctgtttttccagggtaagcccccgtttatgactcagcaacagatgagcccactgagtcgcgaaggtattctagacgcactgttcgtactgttcgaggaatgttcccagccagcgctgatgaagattaagcacgtttcaaactttgtcagaaaatactccgacacgatcgctgaacttcaagaactgcagcctagtgccaaggacttcgaggtcaggtcactggtgggttgcggccactttgccgaagtgcaagtggtgagagaaaaggctacaggtgacatctacgctatgaaggtgatgaagaaaaaggctctgctggctcaagaacaggtcagctttttcgaggaggaacgaaacattctgtctagatccactagcccatggatacctcaactccaatatgcatttcaggataagaatcacctgtatctggtcatggagtatcaacctggcggcgatctgctcagccttctgaacaggtatgaagatcagctcgacgagaacctgatccagttctacctcgctgagctgattcttgcagtgcattcagtgcatctgatggggtatgttcacagagacatcaagccggaaaacattcttgtagatcggaccggacacatcaaactggtcgacttcggaagtgccgcaaagatgaactcaaacaagatggttaacgcgaaactccccattgggacgccagactatatggcccctgaagtcctgacagtaatgaatggtgacgggaaggggacatacgggctcgactgtgattggtggtccgttggcgtgattgcatacgaaatgatttatggtcgttccccatttgctgaaggcacaagcgctcggacgtttaacaacattatgaacttccaacgatttttgaagtttccagacgaccccaaggtgagctccgacttccttgacctgattcaatctctactgtgtggacagaaggaacgcctaaagttcgaaggcctgtgttgccacccattcttctccaagattgattggaataatattcggaactccccaccacctttcgtccccacactgaagtccgatgacgatacatccaacttcgacgagccagagaagaattcatgggtgtcatcatctccttgccagctatccccatccgggttcagcggcgaagaattgcccttcgtcggcttctcctacagcaaagccctggggatcctgggaaggagcgagtcggtggtgagcgggctggatagtccggctaagacttcctccatggagaaaaagctgctcataaagtccaaagagctgcaggatagccaagataagtgccacaaaatggaacaggaaatgactagactgcaccgacgagtgtccgaggtcgaagcagttctctcccagaaagaagtggagcttaaggctagtgaaacacagcgaagcctgctcgaacaggacctggccacctatatcactgaatgctcctctttgaagaggtctctggagcaggcaagaatggaagtttcccaagaagatgacaaagcgttacagcttctccatgacattagggagcagtcccggaagctccaagagatcaaggagcaggagtatcaggctcaggtggaggaaatgagacttatgatgaaccagctagaagaggacttagtgagcgcacgtagacgctcagacctctacgagagcgaactacgggaatcccggctcgctgccgaagaatttaaacgtaaagctactgagtgccagcacaagctcttgaaagcaaaagaccagggtaaacctgaagtaggtgagtacgcgaagctggaaaagatcaacgctgaacagcaactcaagatccaagagctccaggagaaactggaaaaagccgtgaaggctagcaccgaggcaacagaattactgcagaacattaggcaggccaaggaaagggctgagcgagaacttgagaaactccagaatagagaggattcatccgaaggtatacgtaagaagctggtggaagccgaagagagacggcacagtctagaaaacaaggtcaaacgcctcgagacgatggagaggcgggaaaacagactcaaggatgacatacagacgaaatcacagcagattcagcaaatggccgacaaaattcttgagctcgaggagaagcaccgagaagcccaagtcagtgctcagcacctggaagtccacctcaagcagaaagagcagcactacgaagagaaaatcaaggtccttgataatcaaattaagaaggacctcgccgataaagagacacttgaaaatatgatgcagcggcacgaggaagaagctcacgagaaaggtaagattctgtctgagcagaaagccatgattaatgccatggatagcaagatccggtctttggagcagcgaattgtggagctgtcggaagcaaataagctcgccgcaaattcttcactgttcacacagcgaaacatgaaggctcaggaggagatgatctctgaactgcgccagcagaagttctatcttgagactcaggctggaaagcttgaagcccagaataggaaacttgaagagcagttggaaaaaattagccatcaagatcattccgacaagaaccggctcctggagcttgaaactagactcagggaggtctccctagaacatgaagaacagaagcttgagctcaaacggcagctgaccgagctgcagctcagcttgcaggagcgggagagccagctgaccgctttacaggccgcacgtgcagcactggaaagtcaactccggcaagctaagacagagctggaggagaccaccgccgaagcagaggaggagattcaagccctgactgcccatcgggatgagatccagcgcaagtttgatgccctcaggaactcctgcacagtcatcaccgacctggaggagcagctaaaccagctgaccgaggataacgccgagctcaataaccagaacttctacttgtcaaagcagcttgatgaagcatccggcgccaatgatgagatcgtccaattacgaagcgaggtagaccacctgcgaagggaaataacagaacgggaaatgcagttgacgagccagaagcagacaatggaggccctgaagaccacctgtacaatgctcgaggagcaagtgatggaccttgaggccctgaatgacgagcttttagagaaagagcgacagtgggaagcctggagatcagtcctgggggacgaaaaatcgcagtttgagtgccgagtgcgagagcttcaacgtatgctcgacactgaaaagcagagtagagctcgggccgatcagcggatcactgaaagcagacaggtcgtcgaacttgctgtcaaggaacacaaggccgagattctcgcgctgcagcaggcgctgaaggaacaaaagctgaaagcagaatcgctgagtgacaaacttaacgacttagagaagaaacacgccatgctcgaaatgaacgctcggagcctccagcaaaagctggaaaccgaacgggagttaaaacagagattgctagaagaacaggccaaactgcagcagcagatggacttgcagaagaaccatatattcagactcacccagggtctgcaggaagcactggacagagccgatctgctcaaaacggagaggtccgacctggagtaccagcttgaaaatattcaggtgctctactctcacgaaaaggtgaaaatggaggggacaatatctcagcaaaccaagctgatagattttctgcaggccaagatggatcaacccgccaagaaaaagaagggcctgttcagccgacgcaaagaagatcctgccctgccgacacaggtaccattacaatataacgagctgaaactggccctggagaaagaaaaagcgcgctgtgcagagctcgaagaagcactccagaaaacgcgtatcgaactgcggtccgcacgcgaagaggccgcccaccgaaaggcgactgatcatccccacccttctacccccgccactgccagacagcagattgctatgtccgccatcgtccgatctccggagcatcagcccagcgcaatgtctcttctggccccaccttcctcccgtagaaaggagtcaagcacccctgaagaattttctaggcgtctgaaggagcggatgcaccataacatcccgcaccgattcaatgtgggtctgaacatgcgagcgaccaaatgcgctgtctgcctggataccgtgcattttgggaggcaggcttctaaatgcctcgagtgccaggtgatgtgccacccaaagtgctctacatgcttgccagccacttgtggtttgccagccgagtacgccacccatttcaccgaagccttctgcagagacaagatgaactctcctggcctgcagacgaaggagcccagttctagtctgcacctggaaggatggatgaaggtgcctaggaataacaagcgaggacagcaaggatgggatagaaagtacatcgtcctagaaggctccaaggtcttaatatacgataatgaggcacgcgaagccgggcagcgaccagtggaagagtttgaactctgcctcccagatggcgatgtgtcaattcatggcgctgtaggggcaagcgagttggctaacaccgccaaggcagacgtgccttacattctgaaaatggaatcacatcctcatactacctgctggcctggtcgtactctttacttactggccccatcctttcctgacaaacagagatgggtgaccgccctggaatccgtggtggccggcggacgggtttcaagggaaaaagcagaggccgacgcaaagttattgggcaattcattgctgaagctcgaaggggatgaccgcttggacatgaactgtactctgccattctccgatcaagtggtgctagtcggaaccgaggagggattatatgccttaaacgtattaaagaatagcctaacccatgtccctggcatcggcgccgtgtttcagatttatattatcaaggatctggaaaagcttctcatgatcgcaggtgaggagcgtgcactgtgtctggttgacgtcaaaaaagtgaaacaaagcttggcccagtcacatctgcccgcgcagcctgatatctctcctaacattttcgaagctgtgaagggttgtcatctgttcggggcaggcaaaatcgaaaatggactttgcatctgtgctgccatgcctagtaaagtggtgatcttacgctacaatgagaacctttctaaatattgcattcgcaaggagatcgaaacttcagaaccttgttcctgcatacactttactaactacagcattctcatcggcacaaataagttttacgagatagatatgaagcaatacacattggaggaattcttggacaaaaacgatcatagtctcgcacctgcagtgttcgccgcaagttctaattccttccccgtatcaattgtgcaggtcaactcggcgggccagcgggaagaatatttactgtgcttccacgaattcggagtgtttgttgatagctatggaaggaggtctagaaccgatgacctgaaatggtcaaggttacctctcgcattcgcctacagagagccttacctgtttgtcacacacttcaacagcctggaagtgattgagatccaggcccgttcaagcgccggtacccccgctagagcatacttggatataccgaaccctcgatacttaggcccagcaatttcctccggagcaatatacctggcctctagctaccaggacaagctcagggtgatttgttgcaagggaaacctcgtgaaggagtcaggaaccgagcaccaccgcggcccttctaccagtcggtccagccctaataaaagaggcccccctacatataacgagcatatcacaaagagagttgccagctctcccgcccctccagaagggccttcacatccacgggagcctagcacaccccataggtatcgcgaaggcaggactgagctgcggcgcgacaaatctccaggccgtcctctggagcgtgagaaaagccctggcagaatgctgagcactcggagagagaggagcccagggcgtttatttgaggactcttcacggggaaggttgcccgctggcgctgtccgtaccccgctgagccaggttaacaaagtctgggaccagtcaagtgtgtag

SEQ ID NO: 183186 - DNA, 696 bp, Artificial Sequence
  Description of Artificial Sequence: Synthetic coding sequence
atggaccccgagcacgccaagcccgagagcagcgaggcccccagcggcaatttaaagcagcctgagacggccgctgccctagccagctccggcagcgtcgtttcttccgtccctaaagcccagcgcaatatctctgccaagaccgccccacgaaagcaccctgccgtgagtatcaggagtgctcagtctgctgctgccgccaggcctcagggctccgaagggactgctccgtctaggaaggcaactacccgccccccacctaagcccacgttgccaccgccaactccttctgcccatactgagtccaaacttctcaatgagatggccattaaggaacgcgtcgagggaagggccaaggtgccctataagttccgcgatagcctgaagcgtttctccttttctcctactggtatgctgaagatcctgcggctttcactgattctaggagctttagcatgtttcatcataacccaggcaaacgagagcttcatcacaattaccagcctggagatctgcattgtcgtattctttatactgatatacgtgttaacactgcaccatctgctaacctatcttcattggcctttgttggacctcaccaactccatcataactgcggtgtttctctccgtggtggcaattctggcaatgcaggagaagaagcggcggcatctgctgtacgtggggggcaggtag

SEQ ID NO: 183187 - DNA, 369 bp, Artificial Sequence
  Description of Artificial Sequence: Synthetic coding sequence
atggaccccgagcacgccaagcccgagagcagcgaggcccccagcgggaacctcaaacagcccgaaacagctgcagcactggcctcttccggaagcgtcgatttgacaaactctattatcacagctgtgttcttgagtgtggtcgccatcctggccatgcaggagaaaaagcgaaggcacttgctgtatgtgggtggatcgttgtgcttaaccgccgtcattgtgtgctgtattgatgccttcgtggtgactacgaaaatgagaacaaacttgaaaagatttctgggggtcgaggtcgagcgcaaactcagcccggccaaagacgcttaccctgaaacaggacctgatgcgccccagaggcctgcctag

SEQ ID NO: 183188 - DNA, 351 bp, Artificial Sequence
  Description of Artificial Sequence: Synthetic coding sequence
atggaccccgagcacgccaagcccgagagcagcgaggcccccagcggcaacctcaagcagcctgagacagccgccgcccttgacctgacaaatagcattatcaccgccgtattcttgagtgtggtggctatcctggcaatgcaggagaaaaagcgtaggcacctgctctatgtcgggggctctctttgccttactgctgttatcgtttgttgtatcgacgcgtttgtcgtaactactaaaatgcgaactaatctgaagaggttcctaggggtcgaagtagaacgtaaactcagtccagccaaagacgcgtaccccgaaaccggacctgacgcccctcagcgccccgcctag

SEQ ID NO: 183189 - DNA, 279 bp, Artificial Sequence
  Description of Artificial Sequence: Synthetic coding sequence
atggaccccgagcacgccaagcccgagagcagcgaggcccccagcggaaacctcaaacagccggaaacggcggctgctcttgccagcagtgggagcgtcgtctcctctgtccccaaggcccagagaaatatatctgccaaaaccgccccacgcaaacatcccgctgtctcaatcagatcagcccagtcagccgccgctgcccgccctcagggctccgaagggaccgccccctctaggattctgccaacggtgtcccttcagctgtgctccttccaatag

SEQ ID NO: 183190 - DNA, 861 bp, Artificial Sequence
  Description of Artificial Sequence: Synthetic coding sequence
atggaccccgagcacgccaagcccgagagcagcgaggcccccagcggcaatctcaagcaaccggagaccgctgctgctctggctagctcaggcagtgtggtgtctagcgtgccaaaggctcagaggaacattagtgctaagaccgcccccagaaagcacccagcggtgtccattaggtcagcccagtccgcagccgccgcccgccctcagggtagtgaagggacagctccaagccgaaaggccactacaaggccaccccctaagcccacactgcccccacctacccccagcgcacatacagaatctaaattgttgaatgagatggccatcaaagagagagtcgagggcagagccaaggttccctataagttcagggattcactgaaacgcttctcttttagtccaactggcatgctcaagattcttagactcagcctgattctcggcgccttagcctgttttatcatcacccaagcaaacgagtcattcattacaattacatctctcgagatctgcatcgttgtattcttcattctcatctacgtgctcactctacaccatcttctgacttacttgcattggcccctgctggacttaacgaacagcattattacagctgtattcctcagtgttgtggctatcctagccatgcaggaaaagaagaggcgccatcttctgtacgtaggaggttccctgtgccttacggccgtcattgtttgttgtatcgatgccttcgtggtcacaacgaaaatgcggaccaacctgaaacggtttctcggtgtggaagtcgaacgaaaacttagccccgccaaggatgcctaccccgagaccggacctgatgcaccccagcgacccgcatag

SEQ ID NO: 183191 - DNA, 510 bp, Artificial Sequence
  Description of Artificial Sequence: Synthetic coding sequence
atggaccccgagcacgccaagcccgagagcagcgaggcccccagcggcaacctgaagcagcccgaaaccgcagccgccctgtccctgattctgggggcgctcgcttgcttcatcatcactcaggcaaacgagagtttcataactattacgagtcttgagatatgtatcgtggttttttttatcctgatctatgttctgacacttcatcacctgctgacctatctgcactggcccctgcttgatctcactaactctatcattaccgccgttttcctctccgtggtggctattcttgcgatgcaagagaaaaaacggcgtcatctcctgtatgttgggggtagcctatgcttgaccgccgtgatcgtctgttgcattgacgcttttgtggtgactacaaaaatgaggacaaacctgaagagattccttggtgttgaggtggagaggaagctcagtcctgctaaagatgcctaccccgagactgggcccgacgcaccccagcggcccgcctag

SEQ ID NO: 183192 - DNA, 345 bp, Artificial Sequence
  Description of Artificial Sequence: Synthetic coding sequence
atggaccccgagcacgccaagcccgagagcagcgaggcccccagcggcaatcttaagcagcccgagactgctgccgcgctgtcacttatactgggagcccttgcttgcttcatcatcactcaggcgaatgagtcattcatcacgatcaccagtcttgagatttgcattgtcgtgttttttatccttatatatgtgctgacactgcatcatcttctcacctacctccactggcccctcctcgacctgactaacagcatcatcaccgctgtctttttgtctgtggttgcaatcctggcaatgcaggagaagaaacgccgccatctgttatatgtcggggggcgctag

SEQ ID NO: 183193 - DNA, 117 bp, Artificial Sequence
  Description of Artificial Sequence: Synthetic coding sequence
atggaccccgagcacgccaagcccgagagcagcgaggcccccagcgggaatcttaaacagcccgagactgcggctgcattggaagctgacaaggcgaacatgtccaacttcaactag

SEQ ID NO: 183194 - DNA, 87 bp, Artificial Sequence
  Description of Artificial Sequence: Synthetic coding sequence
atggaccccgagcacgccaagcccgagagcagcgaggcccccagcggcaacttaaaacaacccgagaccgcagccgcgctgagatag

SEQ ID NO: 183195 - DNA, 747 bp, Artificial Sequence
  Description of Artificial Sequence: Synthetic coding sequence
atggcccccaaggccgccaagggcgccaagcccgagcccgcccccgctccgcctcctcccggggccaagcccgaggaagataagaaggacgggaaggagccttctgataaaccccagaaagcagtccaggaccacaaggagccttcagataagcctcaaaaggctgtccaaccaaagcatgaagttgggacccgtcgcgggtgcaggcgatatcgatgggaactcaaagattctaataaggagttctggctgctcgggcatgctgagattaagattcgaagcctgggatgcttaatagccgcaatgatcctcttatcctccttaaccgtgcaccctattctgcgattaataattaccatggaaatctcgttcttttcattctttatcctcctgtactctttcgcgatacaccgctacattccctttatcttgtggcctatatctgatctcttcaatgatttaatcgcctgtgcctttctagttggcgctgtggtcttcgccgtgagaagtcgaagatccatgaatctgcactacctcctggctgttatcttgatcggggccgctggggtgttcgcattcattgacgtctgcctccagagaaatcatttcagggggaaaaaggccaagaaacatatgctggtgcccccacctgggaaggagaaagggccccagcaaggtaagggcccggaacccgccaaacctcccgagccaggcaagcctcccggacctgcgaaaggaaaaaaatag

SEQ ID NO: 183196 - DNA, 588 bp, Artificial Sequence
  Description of Artificial Sequence: Synthetic coding sequence
atggcccccaaggccgccaagggcgccaagcccgagcccgcccccgccccacctcctcccggtgctaagcccgaggaggataagaaggatggcaaggaaccctcagacaaaccacagaaagcggtccaggatcacaaggagccctccgacaaacctcagaaggccgtccagcctaaacatgaggtagggacccgcagggggtgtaggaggtacaggtgggaattaaaggacagcaacaaagaattttggctcctaggtcatgcagagatcaagatacggagtctagatctattcaacgatctgatagcctgtgcttttctggtgggagcagtcgtgttcgccgtgagatctcgcagaagtatgaaccttcattatctgctggctgtcatccttattggcgctgccggcgtgttcgcgttcatagatgtatgcctccaaaggaatcactttagagggaaaaaagcaaagaagcatatgctcgttccacctcctggtaaagagaaaggtccgcagcagggaaaaggcccggaacccgctaaaccacccgagcctggcaagcccccagggcctgcgaaaggaaagaagtag

SEQ ID NO: 183197 - DNA, 180 bp, Artificial Sequence
  Description of Artificial Sequence: Synthetic coding sequence
atgtggccccccgaccccgaccccgaccccgaccccgagcccgccggtggctctcgccctgggcccgccgtgccagggctgcgcgcacttcttcccgctcgagcttttttgtgttcgcttaaaggaccagggggatttgtgtgcacatggtgcagctgcccccaccaacccctgtggtag

SEQ ID NO: 183198 - DNA, 549 bp, Artificial Sequence
  Description of Artificial Sequence: Synthetic coding sequence
atgtggccccccgaccccgaccccgaccccgaccccgagcccgccggcggcagtcggccagggcccgccgtccctggactcagagcacttctccccgccagagcttttctgtgttcccttaaggggcggctcctcctagctgaatcagggttgtcatttataacgtttatatgttacgtggcctcgtccgcctccgctttcttaacagcacctttgctcgagtttttgttggccctctattttctgtttgcagatgctatgcagttgaacgacaagtggcagggcctgtgttggccaatgatggacttcttgagatgtgttacagcggcactgatctattttgctatctccattactgcgatcgccaagtactccgatggagcgtccaaagctgccggggtttttggatttttcgcgacaattgtctttgcaacggatttctatctgatctttaacgatgtggccaaatttctgaaacaaggtgactccgcagacgagactaccgctcacaagaccgaagaggagaatagcgactctgacagcgactag

SEQ ID NO: 183199 - DNA, 549 bp, Artificial Sequence
  Description of Artificial Sequence: Synthetic coding sequence
atgtggccccccgaccccgaccccgaccccgaccccgagcccgccggcggatccagaccaggaccagcagtgccagggttgagagcactcctgccagcaagagcatttctttgttccctcaagggcagactgctcctggcggagtccgggctgtcattcattaccttcatatgctacgtagcctcctcagcctcagctttcttgactgctcctttgctggagttcctcctcgccctttacttcctctttgccgacgccatgcagctgaacgataaatggcagggactgtgttggcctatgatggacttcctccgatgtgtaaccgcagcattgatatatttcgccatctcgattacagcaatcgcaaagtactcagacggggcatccaaagccgctggagtgttcggctttttcgcaactattgttttcgctaccgacttctaccttatctttaatgatgtcgctaagttccttaagcagggagacagcgccgacgaaaccaccgctcataaaaccgaggaagagaattcagattccgacagcgactag

SEQ ID NO: 183200 - DNA, 549 bp, Artificial Sequence
  Description of Artificial Sequence: Synthetic coding sequence
atgtggccccccgaccccgaccccgaccccgaccccgagcccgccggaggcagtaggccgggaccagccgttccagggcttcgggcccttctccccgctagggccttcctctgttcgctcaaggggcgcctgctacttgcagagtctgggttgtctttcatcacttttatctgttacgtggccagttctgcctcagcgtttttgactgcccctctgcttgagttcttactcgctctgtacttcctgttcgcagacgcaatgcaacttaacgacaagtggcagggcctgtgctggcccatgatggactttctgcgatgtgtcacagcggctctgatctattttgctatatctataaccgccattgccaaatattccgatggcgcgtccaaggctgcaggggtgttcggcttcttcgccacaattgtattcgccactgacttttatctcatcttcaatgacgtggcaaaatttttgaagcagggagacagcgccgacgaaaccacagcccataagacagaagaagaaaattccgactctgattccgattag

SEQ ID NO: 183201 - DNA, 705 bp, Artificial Sequence
  Description of Artificial Sequence: Synthetic coding sequence
atgcggagcggcgaggagctggacggcttcgagggcgaggccagcagtacttccatgatctctggagccagtagcccctaccagcctactactgagcctgtatcccaacggcgcggactcgcagggctcaggtgcgacccagattacctgagaggagcattgggcagactgaaggtagcacaagtgattctggctctaatcgccttcatctgcatcgaaaccatcatggcttgtagtccctgcgaagggctctatttcttcgaatttgtttcctgtagcgcattcgtagtgaccggggtgttgctgataatgttcagtctcaatctgcacatgcgcattcctcagatcaactggaacctgaccgatctggttaatacaggattatctgcttttctgtttttcattgcttccatcgttctagccgccctcaaccaccgggctggggctgaaattgccgcggttatattcggcttcctcgctacggccgcttacgctgtgaatacctttctggccgtccagaaatggagggtatcagtgcgtcaacagtccaccaacgactacattagagcgaggaccgaatctagagacgtggacagtagacccgagattcagcgactggacacattcagttacagtaccaacgtcactgtgaggaagaaaagcccaacaaatttgttgtctctcaatcactggcagctggcttag

SEQ ID NO: 183202 - DNA, 627 bp, Artificial Sequence
  Description of Artificial Sequence: Synthetic coding sequence
atgcggagcggcgaggagctggacggcttcgagggcgaggccagctcaaccagcatgatctcaggagcatcctcgccgtaccagcctactactgagcccgtctctcaaaggagaggactagcagggctgcgctgtgacccagactatctcaggggagcccttggcaggctgaaggtggcacaggttatccttgctctaattgccttcatatgtattgagacaatcatggcctgcagtccctgcgaaggcctctactttttcgaatttgtgtcctgctctgcatttgttgtgacaggcgtgcttcttataatgttcagccttaatctacatatgaggattccgcagatcaactggaacctaacagacctggtgaacaccggactgagtgcttttctgttctttattgcctctatagtgcttgctgcattaaaccaccgggccggggccgaaatcgccgcagtgatttttggtttcctggcaaccgctgcctatgccgtcaacacattcctggccgtgcagaagtggcgagtgtcggttagacagcagtccactaatgactacattagagcacggaccgagagtcgcgacgtcgattcacgccctgaaatccagagactggacacttag

SEQ ID NO: 183203 - DNA, 672 bp, Artificial Sequence
  Description of Artificial Sequence: Synthetic coding sequence
atgctgagcgcccgggaccggcgggaccggcaccccgaggagggcgtggtggcggagctacagggatttgctgtagacaaagcatttctaacctcacacaaaggcatcctgctagagacagaacttgctctgaccctgataatcttcatttgtttcacagcttccatttcagcttacatggctgcagctctgcttgagttttttattacccttgcatttctttttctgtatgcaacccagtactatcaaaggttcgaccgcatcaactggccttgtctgctccagggccacgggcagagcggcggcccacaccccctcgatctactgagtcactcagcgaaggtccaaccgcagccatggccaggattgacgccccctgggtggcacacaccagcggccgtgccatgggtgccagcacccgcccccggcttctggtcatggctgttgtggtttatctgcttccattccctgggaagttccgactttctgaggtgcgtgagtgccattatcattttcttggtggtttccttcgctgccgtgacaagcagagatggcgcagctatcgcagccttcgtctttggcatcatcctcgtgagcattttcgcttacgatgcgttcaagatatacagaacagagatggctcctggggcctcacagggagaccagcagtag

SEQ ID NO: 183204 - DNA, 225 bp, Artificial Sequence
  Description of Artificial Sequence: Synthetic coding sequence
atgctgagcgcccgggaccggcgggaccggcaccccgaggagggcgtagtagccgagctccaggggtttgcagtggacaaggcatttcttacttcccataagggcatactcctcgagactgagcttgtgtttggtattatccttgtatcgattttcgcatatgacgcctttaaaatatatcgcacagaaatggcccccggcgcttcgcagggtgaccagcagtag

SEQ ID NO: 183205 - DNA, 471 bp, Artificial Sequence
  Description of Artificial Sequence: Synthetic coding sequence
atgctgagcgcccgggaccggcgggaccggcaccccgaggagggcgtagtggctgagctacaagggttcgcagttgacaaagctttcttaacctctcataaaggaatccttctagaaaccgaattagccttgacactcataatttttatctgtttcacagcttctattagcgcatacatggcagcggccctgctggagttctttatcacactggccttcctgtttctgtacgccacccaatattatcagcgtttcgataggattaactggccgtgtctggatttcctgcggtgtgtgtctgcgattattattttcttagttgtaagtttcgcggcagttacttcaagggacggagccgcaattgctgcatttgtgttcggcatcattttggtctccatctttgcgtatgatgccttcaaaatctaccgcacagagatggcccccggggcttctcaaggcgatcagcagtag

SEQ ID NO: 183206 - DNA, 378 bp, Artificial Sequence
  Description of Artificial Sequence: Synthetic coding sequence
atgctgagcgcccgggaccggcgggaccggcaccccgaggagggcgtcgtagccgagctgcagggtttcgctgttgacaaggccttcctcacttctcataaggggatcctgttagagacagagctggcactgacccttatcatctttatatgttttactgcgtctatctctgcttacatggcagctgccctgctggagtttttcattactttggccttcctattcctctatgcaacccagtattatcagcgctttgacagaattaattggccctgcctcgtgtttgggatcattttggtcagcatttttgcctacgatgctttcaaaatttaccggaccgaaatggcacccggtgcatctcagggggatcaacagtag

SEQ ID NO: 183207 - DNA, 318 bp, Artificial Sequence
  Description of Artificial Sequence: Synthetic coding sequence
atgctgagcgcccgggaccggcgggaccggcaccccgaggagggcgtggtggccgagctccaaggttttgccgtcgacaaagcttttctcacttcccataagggtatcctactggagaccgagctggacttcctgaggtgtgtttctgccattattatatttctggtggtgagtttcgccgctgtcacttcacgcgacggagccgcaattgctgcctttgtgttcggtatcatcctggtaagcatctttgcctacgacgctttcaaaatatatcggaccgaaatggccccaggcgctagccagggtgaccagcagtag

SEQ ID NO: 183208 - DNA, 1326 bp, Artificial Sequence
  Description of Artificial Sequence: Synthetic coding sequence
cccagccccgccatcggcctgttcgccagcatggccgccgtgctgttggggggcgcgagagctagtagattgctattccagcgtctcctctgggatgtagtgagatccccaataagttttttcgagagaacccccatcgggcatctgctaaaccgcttttctaaagagacagacacagtggatgttgacattccagacaagttgaggtctctgctgatgtacgcatttggactcctggaggtctctctcgtcgtcgccgttgctacacctcttcccctctggccgtcctgccactgtttctctagcacactgggttttcggtggctggcagccaatgtcgaacttctgggaaacggcctggtttttgcagccgccacttgtgccgtgctctccaaagcacacctgagcgccggtctagttggattctccgtgtcagcggcactgcaggtgactcaaacgctccagtgggtggtcagaaactggaccgacctcgaaaattctattgtatcagtggagcgaatgcaggattacgcctggacgcccaaggaggctccgtggagactccctacttgtgcagcccagccgccttggcctcagggtggtcagatcgaattccgagattttggcctgcggtatagacccgagctgcccttagcagtccagggtgtcagcttcaagatacacgccggcgagaaagtcgggattgtggggcgtactggagccggcaaatcctccctggccagcgggcttctacgtttgcaagaggccgccgagggcggcatctggatcgacggggtgcccattgcgcatgttggcctgcacactctcaggtcaagaatcagtatcatcccacaggaccccattttgttcccaggatccttaaggatgaatttggatttgctgcaggaacatagcgatgaggctatctgggcagctctggagacagtgcaattaaaggccctcgtggcaagcttaccggggcagcttcagtacaaatgtgccgatcgaggggaggacctaagtgtaggccaaaaacagctgctttgtctagcccgggcccttctgcgcaagacccagattctgatactcgacgaggccactgctgcggtagatccgggaacagaactgcagatgcaggccatgctggggagctggttcgcacaatgtacagttctgctgatcgcccataggctgcggtcagtcatggactgcgcacgtgtgctggtcatggacaagggacaggttgctgaatccggatctcccgcacaacttcttgcgcagaagggtctgttttacaggctcgctcaggaaagtggtctagtatag

SEQ ID NO: 183209 - DNA, 528 bp, Artificial Sequence
  Description of Artificial Sequence: Synthetic coding sequence
atgagccacggcgccggcctggtgcggaccacctgcagcagcggctctgcattagggcctggcgccggagccgcccagccttcggcgtctccacttgaagggctgttggatctgtcgtaccccagaacccacgcggcactgttgaaagtcgcccagatggtaactcttctgatagcattcatttgcgtgcggtcaagtctctggacgaactacagtgcctacagttatttcgaagtcgtgaccatatgcgacctgataatgatcctggccttctacctggtgcatctgtttcgcttttatcgtgtacttacatgtatctcatggcctctctctgagctcttgcattacttgatcgggaccctcttactgctgatagcctccattgttgccgcatcaaagtcttacaatcagagcggcttggtggccggcgccatttttggctttatggcaacattcctgtgtatggcctcaatatggctgtcatacaagatttcatgcgtcacccagtctactgatgctgccgtgtag

SEQ ID NO: 183210 - DNA, 429 bp, Artificial Sequence
  Description of Artificial Sequence: Synthetic coding sequence
atgagccacggcgccggcctggtgcggaccacctgcagcagcggctctgcattaggcccaggagccggagctgctcagcccagtgcttcacctttggaaggactactggacctctcatacccccggacgcacgcagctcttctaaaggtagcgcagatggtcaccctactgatcgcattcatctgcgtcaggtctagcctgtggacaaactactccgcctattcctattttgaggtcgtcacaatatgcgaccttatcatgatcttagccttctatctggtgcatctgttcagattctatagggtgctaacgtgcatctcttggcccctttctatcttcggctttatggccacctttctgtgtatggctagtatatggctttcctataagatcagttgcgtgacccaatccacggacgctgctgtctag

SEQ ID NO: 183211 - DNA, 522 bp, Artificial Sequence
  Description of Artificial Sequence: Synthetic coding sequence
atggaggagccccagcgggcccggagccacaccgtgaccaccaccgcctccagcttcgctgaaaactttagtacatcttctagctctttcgcatacgaccgggaatttctacggaccttacccggatttctgatagtagccgaaattgttctggggctcttggtatggacgttgatcgccggaaccgaatactttcgtgtccccgccttcggatgggtaatgttcgtggccgttttttactgggtcctcacagtgttttttcttatcatctacatcacaatgacctatacacgcatcccccaagttccgtggacgactgtaggtctctgtttcaatggctccgctttcgtgctgtatctttccgctgctgtggtggacgcgtcttcagtctctccagagagggactcccacaatttcaatagttgggcagcttcatcattcttcgccttcctcgtgacgatatgctatgcaggcaatacatacttttcatttatcgcttggcggtcccgaacaatacagtag

SEQ ID NO: 183212 - DNA, 363 bp, Artificial Sequence
  Description of Artificial Sequence: Synthetic coding sequence
atgcaggccctgcagcagcagcccgtgttccccgacctgctgaaggccattcctgtaagtatccacgttaacgtcatactctttagtgcaatcttaattgttttgaccatggtggggacagcctttttcatgtacaacgcattcggcaagcctttcgagactcttcatggacctctaggactatatttgctgtcttttatcagtggatcctgcggctgcctagttatgattttgttcgccagcgaagtgaagatccaccatctctctgagaagatcgccaattacaaagagggaacttacgtgtacaagacacagtcagaaaaatataccacgtcattttggctaactaaaggccattcctag

SEQ ID NO: 183213 - DNA, 699 bp, Artificial Sequence
  Description of Artificial Sequence: Synthetic coding sequence
atgcccagccagcagaagaagatcatcttctgcatggccggcgtgttctccttcgcctgtgcacttggggtggtcacagcgctcggcacacctctctggatcaaggccacagtcctgtgcaagaccggtgccttgctcgtcaacgcttctgggcaggaactggataagtttatgggtgagatgcagtacggacttttccatggagagggcgtaagacaatgcgggctgggagcacggcccttcagattttctttcttcccagacttgctcaaggccatccctgtgagcatacatgtaaacgtgatcctctttagtgctatattaatcgtgctcactatggtcgggactgcttttttcatgtacaatgccttcggtaaaccatttgagaccctgcatggtcctctcggtttgtatctcctctccttcatatcaggctcctgcggatgcctggtcatgatactgtttgcttccgaggttaaaattcaccacctgtccgagaaaatagccaattataaggagggcacatatgtctacaagacgcagtccgagaagtacaccaccagcttttgggtaatcttcttctgcttcttcgtgcatttcctgaatggactgttgattagactggcaggcttccaattcccttttgcgaaatcaaaagacgccgaaaccacaaacgtggctgccgaccttatgtactag

SEQ ID NO: 183214 - DNA, 738 bp, Artificial Sequence
  Description of Artificial Sequence: Synthetic coding sequence
atgcccagccagcagaagaagatcatcttctgcatggccggcgtgttctctttcgcatgtgctctcggcgtggttacagccctcggcactcccctgtggattaaagcaacagtcctctgcaaaaccggagccttgctagttaacgccagtggtcaggagttagacaaattcatgggtgaaatgcagtatggcctctttcacggcgaaggggtccgccagtgcggtctaggagcacgccctttcaggttttccttctttcccgacttgttaaaggcaattcctgtgagtattcacgttaatgttattttgttcagcgcaatcctgattgtcctgacaatggtgggcaccgcattcttcatgtataatgcctttgggaaacccttcgagaccctgcacgggcccctcgggctgtatctcctttctttcatatccgttgcactttggctgccggccacacgccaccaggcccagggatcatgtggatgtctcgtcatgattctcttcgcaagcgaagtgaagattcatcacctgagcgagaaaatcgctaattataaggagggaacttacgtctataagacccagagcgagaaatacaccacctcgttttgggtgatctttttttgtttctttgttcactttcttaatgggctcctgattcgcctcgccggatttcagtttccattcgctaagtccaaggatgccgaaacaacaaatgtggcggctgatctgatgtactag

SEQ ID NO: 183215 - DNA, 348 bp, Artificial Sequence
  Description of Artificial Sequence: Synthetic coding sequence
atgcaggccctgcagcagcagcccgtgttccccgacctgctgaaggcaatccctgtgagtatacacgttaacgtgattctgttttcagctatcctcatcgtccttacaatggtggggactgcgttcttcatgtataatgccttcggcaagcctttcgaaactttgcatggcccgcttggtctgtacctgctcagtttcatatcaggcagctgtggctgtctggtgatgatcttattcgcaagcgaggtgaaaatccaccacctgtctgagaaaattgcaaactataaggaaggtacttacgtgtataaaacccaaagcgagaaatataccacctcattctgggtttag

SEQ ID NO: 183216 - DNA, 1878 bp, Artificial Sequence
  Description of Artificial Sequence: Synthetic coding sequence
atgaactacagcgagatcgagagcaaggtgcgggaggccaccaacgatgacccttggggtccgtccggccaactgatgggtgagatcgctaaggccacattcatgtatgagcagtttcctgaactaatgaacatgttgtggtccaggatgctcaaggataacaaaaagaattggcgaagggtatataagagcctcctgcttctcgcttatctgatccgtaatggctcggaacgagtcgtgacttcagccagagagcacatctatgatctgcgctccttggagaactatcatttcgtagatgagcacggaaaggaccagggtataaatatcaggcagaaggtcaaggaactggtggagtttgcccaagacgatgacaggttgcgagaagagcggaaaaaagcaaaaaagaacaaggacaagtatgtgggcgtgtctagtgattcagtcggtggattccgttattcagaaaggtacgacccggaacccaagtcgaagtgggacgaagagtgggataagaataagagcgccttccctttcagtgacaaactgggggaactgtccgataaaattggcagtaccattgatgatacgatttctaaattccggagaaaggatcgagaggacagccctgagcggtgctcagattcggacgaggagaaaaaagccaggcgtggccggagccctaagggcgaattcaaagatgaagaggagactgtcacgaccaagcacattcatattacacaggcgaccgagacgactacgacccggcacaaacggacagccaaccctagtaaaacaattgatcttggcgccgcggcccactacaccggcgacaaggctagtccggaccaaaacgccagcactcatactccccaatccagtgtgaaaacttccgtgccgtcttccaaaagctctggagatctggtggatttgttcgacggcaccagccagtctaccggcggcagtgccgatctcttcggtgggttcgctgattttggctctgcagctgctagcggaagcttcccaagccaggtaactgccactagcgggaatggagactttggggactggagtgcttttaaccaggccccttcaggtcctgtggcttcctctggcgagttctttggcagcgcttcccagccggcagttgagctggtatccggatctcagtcggccctgggacccccgcccgctgcatcaaactcctcagacttatttgacctcatgggatctagccaggctaccatgaccagctcacagagcatgaacttctctatgatgtccactaacactgtcgggttgggcttaccgatgagcagaagccagcctttgcaaaacgtctcaactgtgttgcaaaagccaaacccgctgtataaccagaataccgacatggtgcagaagagtgtgtcaaaaactctgccaagcacttggagtgatccgtcggtcaatattagcctcgacaacctgttgcccgggatgcaaccctcaaaaccccagcaaccaagcctcaacacaatgatccagcaacaaaatatgcagcagcctatgaatgtaatgacacagtctttcggcgctgtaaatttgtcctcaccatctaacatgttgcctgtgagaccccagaccaatgcgttaataggcgggccaatgcccatgtctatgcccaatgtcatgacagggactatgggaatggcccccctggggaatacgccaatgatgaatcagagcatgatggggatgaacatgaatatcggaatgagtgccgctgggatggggctaacaggcacaatgggaatgggcatgccaaatattgccatgacaagcgggactgtccaaccgaagcaggacgctttcgctaatttcgccaacttctcgaaatag

SEQ ID NO: 183217 - DNA, 1878 bp, Artificial Sequence
  Description of Artificial Sequence: Synthetic coding sequence
atgctgaacatgtggaaggtgcgggagctggtggacaaggccaccaacgtggtcatgaattatagtgaaattgagtccaaggtgagagaagcaacaaatgatgacccctggggaccaagcgggcagcttatgggggagatcgctaaggcaacctttatgtatgagcagttcccagagctcatgaatatgttatggtctagaatgttgaaggacaataagaagaattggaggagggtctataagtccctgctgctactagcctatctcatccgcaatggcagcgaaagggtcgtgacctcagcccgcgagcacatctacgacctccggtctctggagaactaccacttcgtggacgaacacgggaaagatcagggaatcaacattcgtcagaaagtgaaggagcttgtcgaatttgcacaggatgatgaccgcctaagagaagaacgcaagaaagccaaaaaaaataaagacaagtacgtaggcgtctcatctgactccgtgggtgggtttcgctattccgaacgttatgatcccgaacccaaaagcaagtgggacgaggagtgggataaaaataagagcgcctttcctttctccgacaaacttggggaattgtcagacaagattggcagtacgattgatgatactatcagcaagtttcgccgaaaagacagggaagattctcctgagagatgttcggatagtgacgaggaaaagaaggcaagacgcggacgcagcccgaaaggtgaattcaaggacgaggaggagacggtgacgactaagcatatacatataacgcaggcaaccgaaaccaccacgactcgccataagcgaacagccaacccttcaaagacaattgacctcggcgccgctgcacattatacaggagacaaggcaagtcccgatcaaaatgcctcaacccacacgccccagtcaagtgtgaagacgagcgttccttctagcaagtcttccggggacctggtcgaccttttcgacggcacgagccagtccacaggcggctccgcagacctgttcggtggattcgcagatttcggttctgctgcagcatctgggagctttcccagccaagtgaccgctacaagtggtaatggcgatttcggtgactggtccgcctttaaccaggctccctcggggcctgttgccagcagcggcgagtttttcggttctgctagccagccagcagttgagctggtgtctgggtctcaaagcgccttgggacccccaccggccgcatccaattccagcgatttgttcgacttgatggggtcatcccaggcgaccatgacatcctctcaatccatgaactttagcatgatgtccacaaacactgttggcctcggcctgcctatgtcccgaagtcaaaacacagacatggtccagaaatccgtcagcaaaactctgccatctacttggtccgacccctctgtgaatatctccctcgataacctcctgcctggcatgcagccaagcaaaccgcaacagccaagcctgaataccatgatacagcaacagaacatgcagcagccaatgaatgtcatgactcagtcatttggtgcagtaaacctgagttccccatctaatatgctcccagtcaggccacagacgaacgcgctaatcggcgggccaatgccaatgagcatgcctaatgtaatgaccggaaccatgggaatggcacccctagggaatacgcccatgatgaatcaaagtatgatgggcatgaatatgaatatcggtatgtctgccgccggaatgggtctgacaggtacgatgggcatgggaatgcctaacattgccatgaccagcggcacggtgcaaccgaagcaggacgcttttgccaacttcgcgaatttttcgaaatag

SEQ ID NO: 183218 - DNA, 1878 bp, Artificial Sequence
  Description of Artificial Sequence: Synthetic coding sequence
atgaactacagcgagatcgagagcaaggtgcgggaggccaccaacgatgacccatgggggccgtcaggacagctgatgggggagatcgcaaaggccacattcatgtacgagcagttccccgaactcatgaatatgctgtggtcgcgcatgctgaaagacaataagaaaaactggcggagagtatataagagcctactgctgctcgcctacttgattcggaatgggtccgagcgggttgtaacttcggcccgagaacacatctacgatctgaggtccctggaaaactatcatttcgtcgatgaacacggcaaagatcaggggataaatatcaggcaaaaagtcaaagagctcgtggaattcgcccaggacgatgaccggcttagggaggagaggaaaaaggccaaaaaaaacaaggacaaatatgttggcgtgtcttcagactcggttggaggattccgatatagcgagcgttatgaccctgaaccgaagtccaagtgggacgaagaatgggataagaacaagagcgcctttccattttcagataagcttggcgaactgtctgacaaaattggatccacaatcgacgatacgattagcaagtttcggagaaaggacagagaagactcccccgaaaggtgtagcgatagtgatgaagaaaagaaggctcgccgcggtagatcccctaaaggtgagttcaaagacgaagaagaaaccgtcaccaccaagcacatccatatcactcaggcgacagaaacaactacaacgcggcataagcgtaccgcaaatccttctaaaacgatcgatctgggtgccgctgcccactacaccggtgacaaggcctcacccgaccagaacgcaagtacacatacaccacagagcagcgttaaaacatcagtgcctagcagtaagagtagcggggacctggttgatctgttcgatggtacttcccagtctaccgggggcagcgccgatttattcggtgggttcgctgacttcggctccgccgcagcctcagggtcgtttccaagccaggtgaccgctacatcaggtaacggtgacttcggtgactggtctgccttcaatcaggccccaagcgggcccgttgcgagttccggcgagttttttggtagcgcttcgcagcccgctgtcgagctggttagcggctcccagagtgcactggggcccccccccgctgcaagtaatagttccgacctctttgacctcatgggctcctcacaggctacaatgacttcctcccagtcaatgaatttcagcatgatgtctactaatactgtggggctgggacttccaatgtccagaagccagccgttgcaaaacgtgtctactgtgctccagaaaccaaatcccctgtacaatcagaacacggatatggtgcaaaagagcgtatctaagacactgccgtccacatggtctgatccttcggttaatatcagcctcgataatctgctgcccggtatgcagccttctaaacctcagcagcccagcctgaataccatgattcagcaacaaaacatgcaacaaccgatgaatgtcatgacacagtcttttggggcggtgaacctgtcctctccatccaacatgctacccgttcgaccccagaccaacgcactgatagggggccccatgcccatgagcatgcccaatgtgatgacagggacgatgggcatggcccctttgggcaatacaccaatgatgaaccaaagtatgatgggaatgaacatgaacattggcatgagcgctgccggtatgggcctgacaggcacaatggggatgggcatgcccaacattgccatgactagtggaactgtccagcctaaacaggacgctttcgccaactttgctaatttctctaagtag

SEQ ID NO: 183219 - DNA, 1878 bp, Artificial Sequence
  Description of Artificial Sequence: Synthetic coding sequence
atgaactacagcgagatcgagagcaaggtgcgggaggccaccaacgatgacccctgggggccctccggacagctgatgggcgagatcgccaaggccacttttatgtacgagcaatttccagagttgatgaacatgctctggtccaggatgcttaaagacaataaaaagaattggcggagggtctacaaatctctgcttttactggcttatctgatccgcaacggctctgagagagtggtgacctccgcgagggaacacatttacgatctcagatctttggaaaactaccatttcgtcgacgaacatggcaaagaccaagggattaatataagacagaaggtgaaggagctggtggagttcgcccaagatgatgatcgactgcgggaggaacgaaagaaggcaaaaaaaaataaagataagtacgtgggcgtgagctctgactcagttgggggatttcgctattccgagcgctacgatccggagcctaaaagcaaatgggacgaggagtgggataagaacaaaagcgccttcccctttagcgataagctgggcgaattatccgataagatcggctctacaatcgacgacacaatttctaaattccgacgcaaagatagggaggactctcccgaaagatgtagtgattccgatgaggagaaaaaggctcgacgggggcgaagcccgaagggcgagttcaaagacgaggaggagactgtcacgacgaagcacattcatattacgcaggctacagaaaccacaacaaccagacacaaacgcacagccaaccccagcaagacaattgatcttggggctgcggctcattacactggggacaaggcaagcccagaccagaacgcatctacccacactcctcagtcttccgtgaagacaagcgttccgtcttccaagtcatcaggagatctggttgaccttttcgacggaacgtcacagagcacagggggatcagccgacttgttcggcggctttgctgactttggctctgctgccgcatcaggttctttccctagccaggtgacggcgacctctgggaatggcgacttcggcgattggagcgccttcaaccaggccccaagtgggccggtagctagttccggagagttcttcgggtctgcatcccagccggctgtcgagctggtcagcggctcacaatctgctctgggaccccctcctgccgccagcaacagctcagatctgttcgatctgatgggcagctctcaggcaacaatgacctcaagtcagtctatgaatttctcgatgatgtccacgaatacagtcggcctggggctccctatgtctcggtctcagcccctgcaaaacgtttctacagtactccagaagccaaatcccctgtataaccagaacacggacatggtacagaaatccgtgagtaaaacgctgcctagcacctggtctgatccttctgttaacatttccctggacaatctcttaccaggcatgcagcccagtaaacctcagcagcctagtctcaataccatgatccagcagcagaatatgcagcaaccaatgaacgttatgacccaatcatttggggctgtgaacttgagctctccatccaacatgctccccgtgagacctcagaccaacgcgctcatcggtggtcccatgcctatgagcatgccaaacgtgatgactgggactatggggatggcacctctgggcaacacacctatgatgaatcaatcaatgatgggaatgaatatgaacatcgggatgtcagccgctggcatgggtcttactggcacaatgggcatggggatgccgaatattgctatgacatcagggactgtgcagcccaaacaggatgcctttgcaaactttgctaatttctccaagtag

SEQ ID NO: 183220 - DNA, 1932 bp, Artificial Sequence
  Description of Artificial Sequence: Synthetic coding sequence
atgctgaacatgtggaaggtgcgggagctggtggacaaggccaccaatgtggtgatgaattattcagagatcgaatccaaggtccgggaggccaccaatgatgacccctggggcccatccggacaattgatgggagagattgccaaggcaaccttcatgtacgaacagttcccagaactcatgaatatgctttggagcaggatgttgaaagataacaagaagaattggaggagggtgtataagtctctactcctactcgcttatctaatcaggaatggatccgagcgcgtagtgacctcggcacgagagcacatttacgacttaaggagtctggaaaattatcatttcgtggacgaacacggcaaagaccagggaatcaacattcggcagaaggtgaaggagcttgtggagtttgctcaggacgacgacaggttgcgcgaagaacgcaagaaggccaaaaaaaacaaagacaaatatgtaggggtcagttcggactccgtaggaggattcagatactccgagcgctacgatcccgaaccgaagagcaagtgggatgaagaatgggataagaacaaatctgccttccccttctccgacaaactcggcgagctgtcggacaagattgggagcaccatagacgacacaatttctaagtttagaagaaaagatcgcgaggactctcctgagcgttgtagcgactcggacgaagagaagaaggcgcggcggggccgcagccctaaaggggaattcaaggatgaggaggagacagtcaccaccaagcacatccacatcacccaggctactgaaaccaccactaccaggcacaaaaggacggctaacccctccaagaccattgacttgggcgcagccgctcactacacgggcgacaaagcttcacccgaccagaatgcctccacacacacgccccagtctagtgtgaaaacgagtgttcccagtagtaagagcagtggagacctcgtggacctgtttgatggcacttctcaaagtacgggaggatctgctgacctgttcgggggatttgcggacttcgggagcgcagcagcctcaggaagttttccctctcaggtgaccgccactagtggcaatggcgatttcggcgactggagtgcatttaaccaggctccatctggcccagtcgcttcttcaggcgagtttttcggatccgccagccaaccagcggttgaactggtctcagggtctcagagtgctctgggccctcccccagcagcttccaactctagcgatctgttcgacttgatggggtctagccaggcaacaatgactagctcgcagtccatgaacttctcgatgatgtctaccaacacggtaggcctcggacttcccatgtcacgatctcagcctttacaaaacgtgtctaccgtccttcaaaagcctaaccctctttataaccaaaacacggatatggttcaaaaaagcgtgtcaaaaacattgccctccacctggtctgacccttccgtcaacatatccctcgataatttactccccggtatgcagccatctaaaccccagcaaccctcacttaacacaatgattcagcagcagaatatgcagcaaccaatgaatgtcatgacgcagtctttcggagcggtgaatctgtccagccctagtaacatgctgccggtccgtcctcagacgaatgcgctgatagggggccctatgccaatgtccatgcccaacgtgatgacggggacaatggggatggctccactgggcaacacccctatgatgaatcagagtatgatgggaatgaacatgaacatcggtatgtcagctgccggtatgggactgactggaaccatgggcatgggaatgcctaatatcgcaatgacctccggcaccgtccagcccaaacaggacgccttcgcaaattttgcaaatttctcgaaatag

SEQ ID NO: 183221 - DNA, 5028 bp, Artificial Sequence
  Description of Artificial Sequence: Synthetic coding sequence
atggcccagatcctgcccatccggttccaggagcacctgcagctgcagaatttgggcattaatcctgcaaacattggcttctctacactcactatggaatctgacaagttcatctgcattcgggagaaggtcggcgaacaggcccaagtcgtgattatcgacatgaacgaccccagtaatcccattcgcagaccaatatcagctgacagtgctatcatgaatccagcctccaaagtgatcgccttgaaagccgggaagaccctgcaaatttttaacattgagatgaaatcaaagatgaaagcacacactatgactgacgacgtgaccttttggaagtggatctcattaaacacagtcgcactcgtgacagataatgccgtctatcactggtctatggagggcgaaagtcagcctgtgaagatgttcgacaggcatagctcactcgcagggtgtcagattatcaattatagaactgacgccaaacagaagtggttgctgctgacaggcatctcagcgcagcagaatcgtgtggtgggagccatgcaactttatagtgtggatcgcaaagtttctcagccaatcgaaggccacgccgctagtttcgcacagttcaagatggaaggcaatgctgaagagtccactctattctgcttcgccgttagggggcaggcgggcggcaagctccacatcatcgaagtggggaccccacctacagggaatcaacccttccccaaaaaggccgtggatgtgttcttccctccagaagcacaaaatgacttccctgtggctatgcagatttccgaaaagcacgatgtagtgttcttgataaccaagtatgggtacattcatctctacgacctggaaaccggtacgtgtatctatatgaatagaatctcaggggaaaccatctttgtgactgctccacacgaagccaccgccggaatcattggggtcaacagaaaggggcaggtactgtccgtttgcgtggaggaagaaaacattattccatatattacaaatgtgttgcagaatcccgatcttgccctgcgaatggccgtgaggaataatctagccggggcagaggagttattcgccagaaagttcaatgccctcttcgcccaaggcaattacagcgaagctgccaaagttgccgccaatgcacccaagggtatcttgaggacccccgataccatcaggcgcttccaatcggtccccgcacagcccggtcaaacatctcccctcctgcagtattttggaatactgctagaccaaggacagctgaacaagtacgaatctctcgaattgtgtcgaccagtcctgcaacaaggaaggaagcaactccttgaaaagtggctgaaggaagacaagttggagtgctccgaagaactcggggatctcgtcaaaagcgtcgatccaacgttggccctttctgtgtatctaagagcgaatgtccctaataaagtgatccagtgttttgccgaaaccggccaggtccagaagatagtgctctatgcaaaaaaggtgggatacactcctgattggatattcctgctccgcaacgtaatgcgcatcagtccagaccagggtcagcaattcgcgcaaatgttggtgcaggatgaggaaccactcgccgatattacacagatcgtggacgtcttcatggagtacaacttaatccagcagtgcaccgcttttctcctggacgcccttaagaataataggccaagtgagggtcctttacagacacgtcttttagagatgaatctcatgcacgcaccccaggtggctgatgccatccttggtaaccaaatgttcactcattacgatcgagcccacattgcccagctttgtgaaaaggccggcctgctgcagcgcgccctcgagcattttaccgatctgtatgacataaagcgcgctgttgtacacacacacctgctcaatcctgagtggctggtgaactacttcgggtcactttctgtggaagatagtcttgaatgcttgcgcgcgatgctcagcgctaatattaggcaaaacctccaaatttgcgttcaagtggctagtaaatatcacgaacagctgtctacccagtcactgatcgaactgtttgagtcgtttaagtcattcgaagggctgttctactttctgggatctattgtaaattttagccaggacccagacgttcacttcaaatatatccaggccgcgtgtaagactggccagatcaaagaggttgagcgaatttgtcgcgaaagcaattgctatgatccagaaagggttaagaatttcctgaaagaggcaaagctcacagatcaattgcccctcattatcgtgtgtgataggtttgattttgttcatgacctggtgctgtacttgtacagaaataacctgcagaaatatatcgaaatttacgtgcagaaagtcaaccctagccggctgcccgtggtcatcgggggcctgttggatgtagattgcagcgaagatgttataaaaaacctgattctagtcgtgaggggacagtttagtacggacgagttggtggccgaagtagagaaacggaacagattgaaactcttactgccttggctcgaagcccggattcacgaagggtgcgaagaacctgctacccataacgcccttgcaaaaatatacattgacagcaacaataacccagagcgattcttaagagaaaatccttattatgatagcagagtggtgggcaagtactgcgaaaagcgagacccacatctggcctgtgttgcctacgaaagggggcaatgcgatctggagctgatcaatgtgtgcaatgagaacagcttattcaaatccctgtccagatatttggtgcgaagaaaggacccagaactttgggggagcgtactgctcgagagcaatccttacagaaggcctttaattgatcaagtcgttcaaactgcgctgagcgagacacaggaccctgaggaagtgagtgtcactgtgaaggccttcatgactgcggacctccctaacgagttgatagagcttctggagaagatcgtcctagataacagcgtcttcagtgaacaccggaatctgcaaaacttgctgattttgacagccattaaagccgaccgaacaagggtgatggagtacatcaataggcttgataattatgatgccccagatatcgccaacatagccatctcaaatgaattgttcgaggaagcatttgccatctttcggaagtttgacgtcaacacaagtgccgtacaggtccttattgagcacatcgggaatttggaccgtgcttacgaattcgcagaacggtgcaacgaacctgccgtatggtcccagctcgccaaagcccagttgcagaagggcatggttaaggaagcgattgactcttacataaaagcagacgacccctcgagttatatggaagttgtgcaggccgccaacacttccggaaactgggaggagctcgtcaagtatttgcaaatggccagaaagaaggccagggagagctacgtggagacagagctcatctttgctcttgcaaaaaccaataggctcgcagaattggaggagtttataaatggccccaataatgcccacatacagcaggtgggggacaggtgttatgatgagaagatgtacgatgcagccaagttactgtacaacaacgtctcaaatttcgggaggttagctagcacattggttcatttgggagagtaccaggccgccgttgatggggctcgtaaggccaattctacacgaacgtggaaagaggtgtgttttgcgtgtgtggatggcaaagagtttagattagctcagatgtgcggcttgcatatagttgtacacgctgacgagttggaggagttaattaattactaccaggaccgaggatacttcgaagagctgataacaatgctggaggctgcgctgggactcgagcgtgcacacatgggcatgttcaccgaactggctatcctctattcaaagttcaagccacagaagatgcgagaacacctggagctgttctggtcgcgcgtgaatatccccaaggtgttgagggcggccgaacaggctcatctgtgggctgaattggtattcttatatgacaagtacgaggaatacgataatgcaataataaccatgatgaaccatcccaccgatgcttggaaagaggggcagttcaaggatattattacaaaggtggcgaacgtggaactatattaccgcgcaattcagttctatctcgagtttaaacctctgttgctcaacgacctgctgatggttttgtcacccaggctagaccatactcgcgccgtgaattacttcagcaaagtgaaacagttgcctctagtgaagccctacctccgatccgtgcagaatcacaacaacaagagcgtgaacgagagtttgaacaatctttttatcacagaggaggattaccaggcgctgaggacctcaatcgacgcatatgacaatttcgataatatcagcttggcccagagactcgaaaaacatgagctgattgagtttcgacgcattgctgcctacctgtttaaagggaacaacagatggaagcagagcgtggagctatgcaaaaaagactctctctacaaagacgcgatgcagtatgcctccgaatccaaggataccgaactagccgaagaactgctgcagtggttcttgcaggaagagaagcgggaatgcttcggcgcttgtctatttacatgctacgacctgctgagacctgacgtcgtgctggaaacagcatggcgccacaatatcatggactttgccatgccatacttcatccaggttatgaaagagtacttaactaaagtcgataaactagatgcctcggagtccttacggaaggaagaagaacaggcgacggagactcagcccatcgtatatggccagccccagctgatgctcaccgcaggaccctctgttgctgtgccaccccaagctccctttggatatggatataccgcacctccttatggtcagccacagcccggatttggatactcaatgtag

SEQ ID NO: 183222 - DNA, 4923 bp, Artificial Sequence
  Description of Artificial Sequence: Synthetic coding sequence
atggcccagatcctgcccgtgcggttccaggagcacttccagctgcagaatctaggcattaatcccgccaacatcggatttagcacactgacaatggaatcagacaaatttatttgtatccgggagaaggtaggcgaacaggcccaagttactattatagacatgagtgatcccatggcaccaatccgaagaccgatcagtgcagaatcagcaatcatgaatcccgcttctaaagtgattgcacttaaggccggcaagaccctccagatcttcaacatcgaaatgaaatctaaaatgaaagcgcatacaatggccgaggaggtcattttctggaaatgggtgtccgtcaacacagtggctcttgtgacagaaactgcagtgtaccactggtccatggagggcgactcccagccaatgaaaatgtttgatagacacacttccttagtaggctgccaggtcatccattaccggactgatgagtaccagaaatggctactcttagtcggaatctctgctcagcagaatagggtcgtgggagcaatgcagttatacagcgtggatagaaaggtgtcccagccaattgagggccatgctgccgctttcgccgagtttaaaatggaaggcaacgcaaagcctgctaccttattctgtttcgctgtcagaaatcctaccggcggaaagctgcatatcatcgaggtcggccagcctgccgcaggaaatcagcctttcgtcaagaaagctgtggatgtcttcttcccacctgaagcacagaacgacttcccagtcgccatgcaaatcggagccaaacatggagtgatataccttattacaaagtatgggtacctgcatttatatgatctcgagagcggagtttgcatttgcatgaacaggatttctgccgatactattttcgttaccgccccacataaaccaacgtctggaataatcggggtcaataaaaaaggccaggtgctgtcagtgtgcgtcgaggaggacaacatagtgaattatgctactaacgtgctccagaatccggacctgggcctccgacttgccgttcgctctaacttggcaggcgctgagaagttgttcgtgcgcaaattcaacacactgtttgcccagggatcctatgccgaagcggcaaaggttgcagcgagtgccccaaaaggaattctaaggacccgagagacagtccagaagtttcagtctattcccgcacaaagcggacaagcatccccattactgcaatactttggcatcttgctggaccagggccagcttaacaaactggaaagtctggagctgtgccaccttgtgctgcaacagggtcgaaaacagctgttggaaaaatggctgaaagaggacaagctcgagtgctcagaggaactgggtgacttagtgaagaccacagatcccatgctggccctttctgtctacctgcgcgcaaacgtgcccagcaaagttatccagtgcttcgccgagactggacagtttcagaaaatcgtgctgtacgccaagaaagtgggctacacccccgattggatttttcttctaaggggagtgatgaagatctccccagagcaggggctccagttttcacggatgctcgttcaggacgaagaaccattggccaatattagtcagattgtagacatctttatggagaatagcttaattcagcagtgcacatcctttttgctggacgcccttaagaacaacaggcctgctgagggccttctgcagacatggctgctagagatgaatctggtgcacgccccgcaggtcgccgatgccattttgggaaataagatgtttactcactacgatcgcgcacatattgctcagctctgcgagaaggccggcctgctgcagcaagctctcgagcactacacagacttatatgatatcaagagggccgtggtgcacactcatctcctcaacccagagtggcttgtcaatttctttgggtccctgtctgtggaggactccgtggagtgtctgcatgcaatgctttccgccaatataagacagaatttgcagctgtgcgtgcaggtggcgagtaagtatcacgaacagctcggcacacaggccctagtggaactgtttgagtcattcaaaagttataaaggtctcttctacttcctcgggtcaatcgtgaacttttctcaagatcctgatgtgcacctaaaatatatacaggcggcttgtaaaaccggccaaatcaaagaagtggagaggatttgcagggaatcttcttgctacaatcctgagcgggtgaagaatttccttaaagaggctaaactgactgaccagctgccactcattattgtatgtgacagattcggctttgtgcatgatctcgtcctctacctgtaccggaacaacttgcagagatatatcgagatttacgtgcagaaggtgaacccttccagaacccctgctgtgatcgggggactactcgatgtggactgttccgaggaagtgattaaacatctgattatggccgtgcgcggccaattttctaccgatgaactggttgcagaggtagaaaaacgcaaccgcctgaaactgctgctgccctggctcgagagtcagatccaggagggctgcgaggagccagctacccacaatgccctggcgaagatctacattgactctaacaattctcctgagtgtttcctgcgcgagaatgcctactatgatagctctgttgtgggaaggtactgtgaaaagcgggacccccatctggcttgcgttgcctacgaaaggggccagtgtgacctcgagttgattaaagtctgtaacgagaattccctttttaagagcgaggcccggtacctcgtatgccgcaaggatcccgagctctgggctcatgtgctagaggaaacaaacccttctcgacgccagctgatagatcaggttgtgcagactgccttatctgagaccagggaccccgaagagatctcagtgactgtcaaggcattcatgacagcagacttgcccaacgagctgattgagttgttggaaaagattgtgctcgataacagtgtcttctcagaacatcgcaatctccagaacctcttgattttaactgccattaaggcagaccggacgcgggtaatggagtacatctctcgccttgataactacgatgccctggacattgctagtatcgctgtaagcagtgccctctatgaggaagcattcacagtcttccataaattcgatatgaacgcctctgctatccaggtgttaattgaacatattggaaatctggaccgcgcatatgagttcgcagagagatgcaatgaaccagcagtgtggtctcagctcgctcaagcacagctgcagaaggacctggtcaaggaggccatcaactcctacatccgaggggatgatccctcctcctatttagaggtcgtacagtctgcgtctaggagcaacaattgggaggatctcgtcaaattcctccaaatggccagaaaaaagggccgagagtcctacatcgaaacggaattgatcttcgcattggcaaaaacctctcgagtgtccgagcttgaggactttatcaatgggccaaataacgcacatattcagcaagtgggagatcgctgttatgaggagggcatgtacgaagccgcaaaacttttgtacagcaacgtgtctaattttgcacgcctggctagtacactggtgcatctcggcgagtaccaggccgctgtagataacagtaggaaagcttccagcacaagaacctggaaagaggtgtgctttgcatgtatggatggtcaagaattcagatttgcacaactgtgcggcctgcatatcgtgatacacgccgacgaactggaagagcttatgtgctattaccaggatcgaggctattttgaggagctgatcttactcctagaagctgcccttgggcttgaacgggcccacatggggatgttcaccgagctagcaattctgtattccaaatttaaacctcagaagatgctcgaacacttggaactgttctggtctagagttaacattcctaaggtgctgagagcggccgagcaggcacatctgtgggctgagctggtcttcctgtacgacaagtacgaggaatacgacaacgctgtcctcaccatgatgagtcaccctaccgaagcatggaaagagggccagttcaaagatataatcaccaaggttgcaaacgttgagctatgttaccgggcgctccagttctacctagactacaaacccctgttaattaatgatttactcttggtactgagccctcggctcgaccacacttggaccgtcagctttttctctaaagctggacagttacccctggttaagccgtacttacgcagtgtgcaaagccacaataacaaatctgttaatgaagctttaaaccatctattgacggaggaggaggactaccagggtttgcgagcctctatcgatgcttacgataactttgataatatctccctggctcagcagctggagaaacaccagttgatggaatttcgatgcatagccgcctatctgtacaaggggaacaattggtgggctcagtctgtcgagctctgtaagaaagaccacctctacaaggacgcgatgcaacatgccgccgaaagtcgggacgcggaactggcccagaagctgctacagtggttcttggaagaagggaagagggaatgttttgctgcctgtctgtttacgtgctatgacctgttgcggcctgacatggttctcgagttagcctggaggcataacctagtggatttggccatgccctactttatacaggtgatgcgtgagtacctgagtaaagtcgacaaattggacgccttggagtctctgagaaaacaggaggagcacgtgaccgaacccgcaccactggtattcgacttcgacggccatgagtag

SEQ ID NO: 183223 - DNA, 4752 bp, Artificial Sequence
  Description of Artificial Sequence: Synthetic coding sequence
atggcccagatcctgcccgtgcggttccaggagcacttccagctgcagaacttggggatcaatccagctaacattggtttcagcacactgaccatggagtcggataaattcatttgtattcgggagaaggtcggtgaacaagcccaggttactatcattgacatgtcagaccctatggctcccatccggagacctataagtgctgagagtgctataatgaaccccgcctccaaggtgatagcattaaaagccgggaaaacactgcagattttcaacattgaaatgaaaagtaaaatgaaagcccatacaatggctgaagaagtcatcttctggaaatgggttagcgtgaacaccgtggccttggtaacggagactgctgtctaccactggtccatggagggcgatagccagcccatgaagatgtttgacaggcacacaagcctggtgggctgtcaagtcatacattataggacagacgaataccagaagtggctgttactggttggtatttcggctcaacaaaatcgggtggtgggggctatgcagctctattccgtggacagaaaagtttcgcagcccattgagggccatgctgccgctttcgccgagtttaaaatggaggggaatgccaagcccgctactctgttctgcttcgcagtgcgaaatccaacaggcgggaagctccacataattgaggttggccaacccgccgcaggtaatcaaccttttgtaaaaaaagccgtagatgtgtttttcccaccagaagctcagaatgattttcctgtcgccatgcagattggagcaaagcatggtgtgatctacctcattacaaagtacgggtatctccatttgtacgacctggagtccggggtgtgtatctgtatgaatcgcatctcggccgatacgatcttcgtcacggcgccccacaagcctacctctggcataataggagtgaacaaaaagggtcaggtactgagcgtctgcgtcgaagaggacaatatcgtcaattacgccacgaacgtccttcaaaatcccgaccttggcctccggcttgctgtacgctctaatctggctggcgccgagaagctttttgtcagaaagtttaatacactctttgcccaggggagctacgccgaggctgctaaggtggctgcatctgcccctaagggaatcttaaggacacgcgaaacagtgcagaagtttcagtctatacctgctcagtctggacaggcctcgccattactccagtacttcgggatcctgctcgaccagggccaattgaataagctcgaaagccttgaactttgtcatttagtgctgcagcaaggaaggaaacaactgctggagaagtggctgaaggaggataaattagagtgcagtgaggaacttggagacctcgtgaaaactacagacccaatgcttgctctctctgtataccttagggccaacgtcccaagtaaagtcatacaatgcttcgcagagaccggtcagttccaaaagatcgtgctctacgctaaaaaagttgggtatactcccgattggatattcttactccggggggtgatgaagatatcacccgaacagggcctacagttttcgaggatgctggtccaggatgaagaacctttggccaatatctcccagatcgtagatatctttatggagaattctttaattcagcagtgcaccagttttctgctggatgccctgaagaataacaggcccgcggaggggttgctgcagacctggctgcttgaaatgaatctggtccacgctcctcaagtcgctgacgctattctcggcaacaagatgttcactcactatgatcgcgcacatatcgctcaactgtgcgagaaggccgggctgctccagcaggccctggagcactataccgacctctacgacatcaaacgagccgtagtgcacacgcacctcttaaatccagaatggcttgtgaatttttttgggagcctgtccgtggaggattcagttgagtgcctccatgccatgttaagcgcaaatattcgccagaacttgcaactctgcgtacaggtcgccagcaaataccacgaacagcttggaacccaggccttggtggagctgtttgaatcttttaaaagctataaaggcttattttactttttgggatctatcgttaacttttcccaggatcccgacgtccatctcaaatacatccaggcggcatgcaaaacaggacagattaaagaagtggagaggatctgcagagaaagtagctgctacaaccccgagcgagtcaagaacttcctgaaggaggccaagcttacggatcagctgccgttgataatcgtgtgtgacaggttcggctttgtacacgacttagtgttgtatttataccggaataacctgcagcgctatatcgagatatatgtgcagaaggtaaacccatcacggacacccgcagtgatcggaggcctattggatgtggactgctctgaggaggtcattaagcacctcatcatggctgttcgcggccagttcagtaccgacgagcttgttgccgaagtggaaaagcgtaaccggctgaagttactgctcccctggctggaatcacagattcaggagggatgcgaggaacccgccacacacaacgcgttggccaagatatacatcgattctaacaacagccctgagtgcttcctgagagagaatgcatattacgatagcagcgtcgtcgggcggtactgtgagaaaagggatccccatttggcttgtgttgcctacgagagaggtcagtgtgacttggagttaattaaagtgtgcaatgaaaatagtctgttcaaaagtgaggccagatatctcgtctgcaggaaagatcctgagctgtgggcgcatgttctagaagaaactaatcctagtcgaagacaactaattgaccaggtggtccagacagccctttcagaaactagggacccggaggaaatttcggtgacagtgaaggcttttatgactgccgatctgcctaacgagctgatcgaactactcgaaaagatcgtgttggacaatagcgttttcagcgaacaccggaatcttcagaatttactcattctgacagcaatcaaggccgataggactcgtgtgatggagtatatctcgcgtctggacaactacgatgcgttggacatcgcctctattgcagttagcagcgcgttatacgaagaggccttcactgttttccataagtttgacatgaatgcctctgctattcaagtgctgatcgaacatattggaaacctggatagggcctacgagtttgccgagaggtgtaacgagcccgctgtgtggtctcaactggcacaggcccagctacagaaggacctcgttaaggaagccataaactcatatatccggggtgacgatccatcctcttatctggaagtggttcagagtgcaagtcggagtaacaactgggaggacctggttaaattcctgcagatggcacgtaagaagggccgtgagtcgtacatagaaacggaactgatctttgccctcgcaaaaacttctcgggtaagtgaactagaggacttcatcaatggacccaataacgctcacatccaacaagtgggggacagatgttatgaggaaggtatgtatgaggcagctaaactgttgtactctaatgtctccaatttcgcacgccttgcaagcaccctggtgcacctgggcgagtaccaggcagctgtagataacagtcgaaaggcatcttctaccagaacctggaaggaggtttgttttgcttgtatggacgggcaggaattcagatttgctcagctctgcggcctacacattgtaatccacgccgacgagctggaggagctcatgtgctactaccaggacagaggatactttgaagagcttatattactcctggaagcggccctcggactcgaacgcgcacacatgggcatgttcaccgagctggccatactttatagtaagttcaagccccaaaagatgctcgagcatttggagctgttctggagccgcgtgaacatccctaaggtactccgggctgctgaacaggcccacttatgggccgaactagtatttctgtacgacaagtacgaggaatatgataatgccgtcctgactatgatgagccaccccaccgaggcctggaaagagggacagttcaaagacatcattacaaaagttgcaaatgtcgagctttgttacagagccctgcagttttacctagattataaacccctgctgatcaatgatctgctgctggtcttatccccccggctcgaccatacctggaccgtgagcttcttcagcaaggcaggccagctgccactggtgaagccatatctgaggtcagtacagtcccacaacaacaagagcgttaatgaggccctgaaccatctgttaaccgaggaggaagattaccaggatgccatgcagcacgctgcagaatcccgcgacgctgagctggctcaaaaactattacaatggtttctcgaagaaggcaaaagggaatgtttcgcagcatgtctgttcacgtgctatgatctgctgcgcccggatatggtcctggagttggcctggcgacacaacctcgtcgatctcgcgatgccttacttcattcaggtgatgagagaatatctgagtaaggtggacaagctcgacgcactggaaagcctcagaaagcaagaggaacatgtaaccgagcccgcacctctggtcttcgattttgatggccacgaatag

SEQ ID NO: 183224 - DNA, 4923 bp, Artificial Sequence
  Description of Artificial Sequence: Synthetic coding sequence
atggcccagatcctgcccgtgcggttccaggagcacttccagctgcagaatcttggaatcaaccctgcgaacataggattctccaccctgaccatggagtcagacaagtttatttgcattagagagaaggtgggtgaacaggcccaggtgaccatcatcgacatgtctgatccaatggcccccatccggcgcccaatttccgcagagtccgcaattatgaatcctgcatccaaggtcatcgccttgaaagccggcaagaccctacagattttcaatatcgaaatgaagtctaagatgaaagctcacaccatggccgaagaggtcatcttttggaaatgggttagcgtaaacactgtcgctttagtaacagagactgccgtgtatcactggtctatggaaggtgactctcagcctatgaaaatgttcgatcgtcacacctcactcgtggggtgtcaggtcattcactaccgaacagatgaatatcagaaatggcttcttctggtaggcatatccgcacagcagaatagagtcgtcggcgccatgcaactctatagcgttgatagaaaggtgtcccagcctattgagggacacgccgccgcttttgcagaatttaaaatggaagggaacgccaagccagccacactgttttgttttgcagtgcggaatcctaccggagggaagttgcatattattgaagtaggtcaaccagctgctggcaaccaaccttttgtgaaaaaggccgtggatgttttcttccctcctgaggctcagaacgacttccccgtggccatgcagattggggccaaacacggggtaatatacctcattacaaagtacgggtatttgcatctgtacgatctggagagcggggtctgtatttgtatgaacaggattagtgcggacaccatcttcgtgacagccccacacaaacccacaagcggtatcatcggcgtgaataagaaaggacaggttctgtcggtgtgcgtcgaggaggacaatatcgttaactacgctacaaacgtgctgcagaacccagacttgggcttgaggctggccgtcagatcaaatctcgcgggcgccgaaaaactgttcgtgaggaagttcaacactttgtttgcccagggatcctacgcagaggctgccaaagtagctgcatctgcccccaaaggcattctgcgtacacgcgagactgtgcagaaatttcaatccatccccgcgcaaagtggccaagccagcccccttctgcagtatttcgggatactcctggatcagggtcagttaaataagcttgagagtctggaactctgccatctcgtgctgcagcagggtcgcaaacagctccttgagaaatggcttaaggaagataaactggagtgctccgaggagttgggcgatctggttaagactactgatcccatgctggctttgagcgtttacctgcgcgctaatgttccatcgaaggtcatacaatgttttgcagagactggacagtttcaaaagatcgtactttatgctaagaaagtgggatacacccccgattggatttttctgttaagaggggtgatgaaaatcagccccgagcagggcctacaattctccagaatgttagtgcaggacgaagagcctctggcaaatatctcacagattgtggacatttttatggagaactccctgattcagcaatgtacaagctttctcctggacgctctgaaaaataaccgacccgcagaggggcttttgcaaacgtggctgctcgaaatgaatctggtgcacgcaccccaggtggctgacgccatactcgggaacaaaatgtttactcactatgatcgcgcccacatcgcacagttgtgtgaaaaagctggcctcctccaacaggcactggagcactacactgatctttatgatatcaagagagccgtcgtacacacccacctcctcaatccggagtggctcgttaactttttcggatctctaagtgttgaagattctgtggagtgcttgcacgccatgctttccgccaatatccgacagaacctgcagctatgtgtgcaggtggctagtaagtaccatgagcagcttggaacacaggccctggtggaactatttgaatcttttaagagttataagggcctgttctactttctgggatccatagtgaactttagccaggaccccgatgttcacctgaagtacattcaagccgcctgtaaaaccggacaaataaaggaagtagagcggatatgcagagaatcatcctgttataatcccgagagagtgaagaacttcttgaaagaagcaaagctgacggaccaactgccgctgattatcgtttgtgacagatttggtttcgtgcacgaccttgtgctctatttatataggaacaatcttcagcggtacatcgaaatctatgttcagaaggtgaacccgtctagaacaccagcagtgattggggggctactagatgtggattgtagcgaggaggtcatcaagcatctcattatggcagtcagagggcagttcagcactgacgaattggttgccgaagtcgaaaagagaaataggctcaaattgctgctgccctggcttgagtcccagatccaggaaggatgcgaagagccagcaacccacaatgctttggccaaaatttatatcgattcaaataactcacccgaatgtttcctgagggagaacgcctactatgattcttctgtggttggaaggtattgcgaaaagcgggatccccacctggcctgtgtggcttacgagagagggcaatgtgatttggagcttataaaggtttgtaatgagaattcactttttaagagtgaagcacgctacctggtgtgcagaaaggacccagagctttgggcgcatgtacttgaagagacaaatccttctaggcgtcagttgattgaccaggtggtgcagacagcactttccgaaacccgtgatcccgaagagatttcggtcaccgtaaaggcctttatgactgctgatttgcctaacgaactgatcgagctcctggaaaagatcgtcctcgacaacagcgttttttctgaacaccgtaatctgcagaaccttctcatcctgactgcaataaaagcagataggacaagggtgatggagtacatttcccgccttgacaattatgacgcacttgatatcgcgagtatcgctgtgtccagcgctctttatgaggaagcattcacagtcttccacaagttcgacatgaacgcttccgcaatccaggtactcatcgaacacattggcaatctggatcgagcctacgagtttgctgaacggtgcaatgaaccggcggtctggtcacagctcgcacaggctcagttgcagaaagacctagttaaagaggcaattaattcatacatccgaggggatgacccttcttcctacttggaggtggttcaatccgcatctaggtctaacaattgggaggacctggtcaagttcttgcagatggcccgcaagaaaggacgcgagtcatacatcgagaccgaactcatttttgccctggccaagacatcccgggtttcggagctggaggacttcatcaacgggccaaataacgctcatattcagcaagtcggcgaccggtgttacgaagagggaatgtacgaggctgccaaactgttatacagtaacgtgagtaacttcgcccgcctcgcctctactctcgtgcatttgggtgaatatcaagcagccgtcgacaactctagaaaggcctcaagcacaagaacctggaaggaggtctgtttcgcctgcatggatggacaggagttccgctttgcccagctttgcggtctgcatattgtaatccatgccgatgagctggaggaactgatgtgctattatcaggatcgcgggtatttcgaagagctaattctgctcctggaggccgccctcggcctcgaaagggcccacatgggaatgtttacggaattagcaattctctacagcaaatttaaaccccagaaaatgctcgagcatctggagctgttctggagcagagttaacatacctaaggtcctccgagccgccgagcaggcccacctttgggctgaactggtcttcctgtatgacaagtacgaggagtatgataacgctgtgctgactatgatgtcacatcctacagaggcgtggaaggagggccagttcaaggacatcattactaaagtggccaacgtggaactgtgttaccgggcgctgcagttttatcttgattacaagcccttactgataaacgatttgctcttggtcctctcgccgcgtctggatcacacctggacagtcagctttttctcgaaggctggacagctgccgctggtaaagccctacttgcgctctgtgcagagtcacaacaacaagtctgtcaatgaagcattgaaccatctgcttacggaagaggaggactatcagggactcagagctagtattgacgcctatgataattttgacaatatctccttagcacagcaactcgaaaaacatcagcttatggagtttaggtgtattgccgcgtatctgtacaaaggcaataattggtgggcccagtctgtggaactgtgcaaaaaggatcacctctataaggacgccatgcagcatgctgctgagtcccgcgacgcggagctcgcccagaaactgctccagtggttcctagaagagggcaagcgggagtgttttgccgcctgcctgtttacctgttatgatctccttaggccggacatggtacttgaactggcctggcgtcacaatctggtggatctcgctatgccatattttattcaagttatgcgcgagtatctgtctaaggtcgataaactggacgcgcttgaatccttaagaaagcaggaggaacacgtgaccgaacctgcccccttggtcttcgactttgacggccacgagtag

SEQ ID NO: 183225 - DNA, 747 bp, Artificial Sequence
  Description of Artificial Sequence: Synthetic coding sequence
atggccgagctggaccccttcggcgcccccgccggcgcccccggcggtccggccttgggtaacggagtggcaggtgcaggcgaagaggacccagccgcggccttcttagcccagcaggaatccgaaatagcaggcatagagaacgacgaagcctttgccatcctggatggcggggcaccagggcctcaaccacatggagaaccacctggtgggcccgatgctgttgacggggtgatgaacggggagtactaccaggagtccaatggtcccactgattcctatgcagccatctcccaggtcgaccgcttgcaatcagagcctgaaagcattcggaaatggcgcgaagagcagatggagagactggaggctctcgacgccaacagtaggaagcaggaagccgaatggaaagaaaaagcaattaaggagcttgaggaatggtacgctagacaggacgaacagctacagaaaacaaaggcgaataaccgcgtcgccgacgaggcgttctataagcaacctttcgctgacgtgatcggctacgtgaccaatatcaaccacccctgttattctctcgaacaggcggccgaggaagcatttgtgaacgatattgatgaatcttctcctggtaccgagtgggaacgagtggccaggctgtgcgatttcaatcctaagtcaagtaaacaggctaaggacgtgagccggatgagatctgtattaatttcactgaaacaggccccattggtgcactag

SEQ ID NO: 183226 - DNA, 657 bp, Artificial Sequence
  Description of Artificial Sequence: Synthetic coding sequence
atggccgagctggaccccttcggcgcccccgccggcgcccccggcggtcccgcacttgggaatggggtcgccggtgctggggaagaggatccagcagcagcttttctggcacaacaggaatcggaaattgctggaattgagaatgatgaggcgttcgctatccttgacggtggagcacccgggccccagccacatggggagccgcccggcgggccggacgctgttgacggagtgatgaatggtgagtattatcaggaatctaatggcccaaccgatagttacgccgctatttctcaggttgatagactccagagcgaacccgagtctattaggaagtggagggaggaacagatggagagactggaggctttagacgctaatagtagaaagcaagaggcagaatggaaagagaaggcgattaaagaactagaagaatggtatgctcgccaggatgagcaactgcagaagaccaaggccaacaatagggccgctgaagaggccttcgttaatgacattgacgagtctagccctggaaccgaatgggaaagagtggcccggttatgcgatttcaaccccaagagttccaaacaggctaaggacgtgagccgaatgaggagtgtcctaatctcactgaaacaggcaccactggtgcactag

SEQ ID NO: 183227 - DNA, 711 bp, Artificial Sequence
  Description of Artificial Sequence: Synthetic coding sequence
atggccgagctggaccccttcggcgcccccgccggcgcccccggcgggcccgcgctgggcaatggagtcgcaggagccggcgaggaggacccagctgcggcctttctggcccagcaagaaagcgagatcgcggggattgagaacgatgaggccttcgccattttggacggaggagccccgggtccacaacctcacggagagcctcccgggggacctgacgccgtagatggagtgatgaacggggagtactaccaggagtccaatggtccgacagattcatatgctgcaataagtcaagtcgatcggcttcagtccgagcctgaatcaattaggaagtggcgcgaagagcagatggagcggctcgaggcgcttgatgcgaacagcagaaaacaagaagccgagtggaaggaaaaagccataaaggagttggaggagtggtacgccagacaggacgaacagttgcagaagaccaaggcaaacaacagagttgcagatgaagccttctacaaacaaccctttgcagatgttattgggtacgtcgccgcagaggaggccttcgtgaacgatattgatgaatcttcacccggtactgaatgggagagagtggcccggctatgcgactttaatccaaagtcttcaaagcaggcaaaggacgtgtcgcgcatgcgtagtgtgttgattagtctgaagcaagcccctctggtgcactag

SEQ ID NO: 183228 - DNA, 747 bp, Artificial Sequence
  Description of Artificial Sequence: Synthetic coding sequence
atggccgagctggaccccttcggcgcccccgccggcgcccccggcggccctgccctgggaaacggagttgctggggccggagaagaagatcctgctgctgccttcctcgcccagcaggaatccgagatagcaggaattgagaacgacgaggcttttgccatcctcgatggtggtgcgcccggaccacaaccccacggcgaaccaccaggagggccagatgcagtggacggtgttatgaacggagagtattaccaggaatctaacggccccaccgactcctatgccgctatcagccaagtggatagattgcaatcggaaccggagagtatcaggaagtggcgggaggagcaaatggagcgtctcgaggccctcgatgcaaattccaggaaacaggaagctgagtggaaggagaaggcaatcaaggagctcgaggaatggtatgctaggcaagacgagcagctccagaaaaccaaggcaaacaacagagtggctgatgaagcgttttacaagcagcctttcgccgacgtgatcgggtacgtgactaatattaatcacccctgctactcattagaacaagcggcagaggaggcattcgtgaatgatattgacgaaagttcaccagggactgagtgggaaagggttgctcggttgtgtgacttcaatcccaagagtagcaaacaggccaaggatgttagtaggatgaggtctgtccttatcagcctgaaacaggccccccttgttcactag

SEQ ID NO: 183229 - DNA, 693 bp, Artificial Sequence
  Description of Artificial Sequence: Synthetic coding sequence
atggccgagctggaccccttcggcgcccccgccggcgcccccggcggcccggctcttggcaatggtgttgccggtgctggcgaggaagacccagccgccgcctttctcgcccagcaggagtccgaaatcgctggcatcgaaaacgatgaggcgttcgccatacttgacgggggcgcccccgggcctcagcctcacggagaaccccccgggggcccagacgccgtcgatggtgtcatgaatggtgaatattaccaggagtccaacggacccactgattcctatgccgcaattagccaggtcgaccgactacagtcggagcctgagtccatcaggaaatggcgggaggagcagatggaacggttagaagccctggacgcaaattctcgaaaacaggaagcagagtggaaagagaaggctattaaagagctggaggaatggtatgctcgccaggacgagcaactccaaaagacaaaggctaataattccactaatatcaatcacccttgttattccctcgagcaggcagccgaagaggcattcgttaatgatattgatgaaagcagcccaggcaccgaatgggaaagagtggctcggctttgtgatttcaaccctaagtcatccaagcaggcgaaggacgtatcaagaatgaggtccgttctcatttcactcaaacaagcacctctagttcattag

SEQ ID NO: 183230 - DNA, 693 bp, Artificial Sequence
  Description of Artificial Sequence: Synthetic coding sequence
atggccgagctggaccccttcggcgcccccgccggcgcccccggcgggcccgcacttggcaatggcgttgctggtgcaggcgaggaggacccagccgccgccttcttggcccagcaggagtctgagattgctggaatcgagaatgacgaggcctttgcgatcctcgatgggggagctccaggccctcagccccacggcgagccccctggagggccggatgctgtggacggcgtaatgaatggggagtactatcaggagagcaacggtcccaccgactcctacgccgcaatctctcaagtggacaggctgcaatccgaacctgaaagcattaggaagtggcgtgaggagcagatggaaaggttggaggccctcgatgctaactcaaggaagcaggaggcagaatggaaagaaaaagccatcaaggagctggaggagtggtatgctcgccaggatgaacagctgcagaaaaccaaagccaataactcgactaacatcaatcatccttgctatagcctcgaacaagccgcagaggaggcttttgtcaatgacattgacgagagctcgcctggtacagaatgggagagagtggccaggctctgcgacttcaatccgaaaagcagtaaacaggcaaaggacgtgtctagaatgaggtctgttttgataagcctgaagcaggcccctctggtccattag

SEQ ID NO: 183231 - DNA, 501 bp, Artificial Sequence
  Description of Artificial Sequence: Synthetic coding sequence
atggccgagctggaccccttcggcgcccccgccggcgcccccggcgggccagcactcgggaatggagttgccggggccggggaagaggacccagcagccgctttcttggcccagcaggaaagcgagattgcaggcatagagaacgacgaggccttcgccatcctggacggcggagctccaggacctcagccgcacggagagcctcctggaggacctgatgcgaattccagaaagcaggaggctgagtggaaggaaaaagcgatcaaagaactggaggaatggtatgcgcggcaggatgaacagttacaaaagacaaaagctaataaccgcgccgctgaagaggcttttgtgaatgatattgacgagtcatctcctggaactgaatgggaacgcgtagctagattatgtgattttaaccctaagagttcaaaacaggctaaggatgtttcccggatgaggagcgtactgatttcgctcaaacaggcaccgctcgtgcactag

SEQ ID NO: 183232 - DNA, 690 bp, Artificial Sequence
  Description of Artificial Sequence: Synthetic coding sequence
atggccgacgacttcggcttcttcagcagcagcgagagcggcgccccggaagccgctgaggaggaccctgccgctgccttccttgcacagcaggagagtgaaattgctgggattgagaatgatgaggggtttggagcacctgcaggaagccatgctgctccggcacaacctggccctacgtcgggagctggcagtgaggatatgggcactactgtgaacggagacgttttccaagaggccaatggccccgctgatggctatgctgccatcgctcaagccgatagactgactcaggaacctgagagtatcagaaagtggagggaggaacaaagaaagcgcctccaggagctggacgccgcttccaaggtgaccgaacaggagtggagagagaaagccaagaaggacctcgaggaatggaatcaacggcagtctgagcaggtcgaaaaaaataaaatcaacaatcggattgcggacaaagctttctaccagcaacctgatgctgatataatagggtatgtggccagcgaggaagctttcgtgaaggagtcaaaagaggaaacacctgggacagaatgggaaaaggttgcccagctctgcgatttcaaccctaagagctctaagcagtgtaaggacgtaagcagactgcgctccgtactgatgtcactcaaacagacacccctgagccgatag

SEQ ID NO: 183233 - DNA, 636 bp, Artificial Sequence
  Description of Artificial Sequence: Synthetic coding sequence
atggccgacgacttcggcttcttcagcagcagcgagagcggcgcccccgaagcagcggaagaggatccggccgccgcattcctcgcacaacaggagagcgagatagcggggatcgagaacgacgagggctttggagctcccgccggatcacatgctgcaccggctcaacctgggccaaccagcggcgccggttcagaggacatgggcacaaccgtaaacggcgacgtgttccaagaggctaatggaccggcagacggatatgctgctattgcccaggcagaccgcctgacccaagagcccgaaagcattagaaagtggcgcgaagagcagcggaaacgcctgcaggaattggatgccgcctccaaggtgacagagcaggagtggagagaaaaggcaaaaaaagacctggaggagtggaatcagcggcagagtgagcaggtcgaaaaaaataaaatcaataaccgggcctctgaggaagcctttgtgaaggagagcaaggaagaaacgcctggcacagagtgggaaaaggtggcgcagctttgtgactttaacccaaaatctagcaagcagtgcaaagacgtgtctcgactgcgaagcgtcctcatgtccttgaagcagacaccactctcaaggtag

SEQ ID NO: 183234 - DNA, 405 bp, Artificial Sequence
  Description of Artificial Sequence: Synthetic coding sequence
atggccgacgacttcggcttcttcagcagcagcgagagcggcgcccctgaagctgccgaggaagatccggcggcagcttttcttgctcagcaagagagtgagattgctgggatcgaaaacgatgagggcttcggggcgcctgccggcagtcatgcagccccggcacaacccgggcccacctctggtgccggatcagaggacatgggaaccacagtgaacggggacgtgttccagccagtgcatcatcagcgagtccaactgcagacccagcttccaattcagcccaaagatgaacccgcccacaattactcaagcagtatatggcattcacaaggccaaggacagaaagggcccgcaggtctccgtcttcccacttccgcccaaattctctccccctttccctag

SEQ ID NO: 183235 - DNA, 636 bp, Artificial Sequence
  Description of Artificial Sequence: Synthetic coding sequence
atggccaacgccggcctgcagctgctgggcttcatcctggccttcttgggatggattggggctatagtttcgaccgcccttccgcagtggaggatctattcttatgccggcgacaacattgtaactgcacaggcaatgtacgagggtttgtggatgtcctgtgtgagtcagtccaccgggcaaatccagtgtaaagtgtttgacagcctcctcaacctcagcagtacactgcaggcaactagagctctcatggttgtcggcattctgctgggggtgattgccattttcgtggccactgtgggcatgaagtgcatgaaatgtctggaggatgatgaagtgcaaaaaatgcggatggccgtaatcgggggcgccatcttcctactagcagggttggcaatattggtcgcaaccgcctggtatggaaacagaatcgtccaggaattctacgatccaatgacccctgtgaacgcccgctacgagtttggtcaagccttgtttactgggtgggccgcagctagcctgtgtctgctcggcggtgctcttctgtgctgttcttgcccccggaagactacgtcctatccaacgcctcgaccataccctaaacccgcgccttctagcggcaaggactatgtttag

SEQ ID NO: 183236 - DNA, 501 bp, Artificial Sequence
  Description of Artificial Sequence: Synthetic coding sequence
atgtacgagggcctgtggatgagctgcgtgagccagagcaccggccaaatacaatgcaaggtgttcgactcactgctaaacctttcgtctaccctgcaagccactcgggcactgatggtcgtgggaatcctgcttggcgtcattgccatcttcgttgctacagtcggaatgaaatgtatgaagtgtctggaagacgatgaggtgcagaagatgcgaatggccgtaattggcggcgctatctttctgctggccggactcgctatcctcgttgcgactgcctggtacggaaaccgcattgtacaagagttctatgatcctatgacacccgtgaatgccaggtacgaattcggacaggcgttattcaccgggtgggcagccgcttccctctgtctgctcgggggggctctgctttgctgctcttgtccccgaaaaactacatcttaccccactccgcgcccctacccgaagcctgcaccgtcctctggcaaagactatgtgtag

SEQ ID NO: 183237 - DNA, 624 bp, Artificial Sequence
  Description of Artificial Sequence: Synthetic coding sequence
atggtggccacctgcctgcaggtggtgggcttcgtgaccagcttcgtggggtggattggagttatcgtgaccacttccaccaatgactgggtagtgacctgcggctataccatcccaacctgtcgcaagctggatgagttgggaagcaagggactatgggctgactgcgtaatggccacagggctttatcactgtaagcccctggtggacattctgatccttcctggatacgtccaagcatgcagggccttaatgatcgcagcttcagtgctggggctgcccgccatcctgttgctgcttacagtactcccctgcatcaggatgggacaggagcccggggtcgccaaatatcgaagagcccaactggccggagtgctcctgattctgttagcattgtgcgctctggtggcaacgatttggtttccggtttgcgcccaccgggagaccaccatcgttagcttcggatacagcctgtatgcaggatggatcggagccgttctttgcctggtaggtggctgtgttatcttatgttgcgccggtgatgcacaagccttcggtgaaaacagattttattacacagccggttcctcttcacctacacatgctaaaagtgcccacgtgtag

SEQ ID NO: 183238 - DNA, 498 bp, Artificial Sequence
  Description of Artificial Sequence: Synthetic coding sequence
atggtggccacctgcctgcaggtggtgggcttcgtgaccagcttcgttggctggatcggcgtcattgtgacaactagcacaaacgactgggtcgttacttgcggttacactatccccacttgccggaagctggatgaactaggctccaaaggactgtgggccgactgtgtgatggccacaggattgtaccattgtaagcccctggtcgacatacttatcttacccggctacgtccaagcctgtagggcattgatgatagcagccagcgtcctcggcctacctgcaattctgttacttttaaccgtccttccgtgtatccggatgggccaggaaccaggagtcgctaagtaccgcagagcccagctagcaggtgtacttctaatcctcctgggctgtcagctgctgtgggcgaaaactgagagctccctgcatagccagcacctcgtacagttcaaacagaagtatcttgaagattttagttatctgcagggagattag

SEQ ID NO: 183239 - DNA, 498 bp, Artificial Sequence
  Description of Artificial Sequence: Synthetic coding sequence
atggtggccacctgcctgcaggtggtgggcttcgtgaccagcttcgtcggctggatcggcgtgattgtgaccaccagcaccaatgattgggtggttacatgcggatataccattcctacgtgccgcaaactggacgagttaggctccaagggactctgggccgattgcgtgatggcaaccgggctgtaccactgcaagcctcttgttgatattttgatcttgcccggatatgtgcaggcctgccgcgccctgatgatagcagcgtctgtcttgggactgcctgctattctgctgcttttaactgtgctgccttgtattagaatgggacaagaacctggggtggcgaagtaccgccgcgcacagttggcgggcgttctgcttatcctcctaggctgtcagctgttgtgggcaaaaaccgaatccagtctgcattctcagcaccttgtgcagttcaagcagaagtacctcgaggattttagctacctccagggcgattag

SEQ ID NO: 183240 - DNA, 720 bp, Artificial Sequence
  Description of Artificial Sequence: Synthetic coding sequence
atggccagcaccgccgtgcagctgctgggcttcctgctgagcttcttgggaatggtcggaacactcatcaccaccattctccctcactggcgaagaacagcccacgttggcactaatattcttacagcggtgtcctatctgaagggattatggatggagtgcgtgtggcactccacgggaatctaccagtgccagatttacaggtcactgctggctctcccacaggaccttcaagccgccagagcactgatggttatctcctgtctgctgtctggcatcgcttgtgcctgcgccgtcattggcatgaaatgtaccaggtgcgccaaggggacacctgcaaagacaacattcgccattctgggcggcacactgtttattctggcggggctcctttgtatggtggcagtgtcctggacaaccaacgacgttgtgcaaaacttttataacccactactgccctcgggaatgaagtttgaaatcgggcaggcactttacctgggattcatttccagctcacttagtctgattgggggcacacttctttgtctgagttgtcaagatgaggctccatatcgcccttatcaggcaccccctcgcgccacaaccactacggcgaatactgcacctgcttaccagcccccggcagcctacaaagataaccgtgcaccctctgtcacctcagcgacccactctggttaccgactcaatgattatgtttag

SEQ ID NO: 183241 - DNA, 720 bp, Artificial Sequence
  Description of Artificial Sequence: Synthetic coding sequence
atggccagcaccgccgtgcagctgctgggcttcctgctgagcttcttgggaatggttggaacactcataaccactatactgccccattggagacgtactgctcacgtgggcactaacattctgaccgctgtaagctatctgaaaggcctttggatggagtgtgtatggcacagtaccgggatctaccagtgccagatctacagaagccttctggccttgccacaggatcttcaggcggcccgcgccctgatggtcatctcttgtcttctgagcggcatagcctgtgcttgtgctgtgatcgggatgaaatgcaccagatgcgccaaaggaacgccagccaaaacaaccttcgctattcttggaggcaccttgttcattttggcgggcctgctgtgcatggtcgcggtttcatggactacaaacgacgttgttcagaatttttataatccactgctgccttcgggaatgaagttcgaaataggtcaagcactgtatctgggtttcataagctcctctctttccttaattggcggaactctcctctgtctcagctgccaggacgaggccccctacaggccgtaccaggcccctccaagagctaccaccacgaccgccaacaccgctcctgcataccagccaccagccgcatacaaagacaatcgtgctccatcagtaacctctgccactcactctggctaccgattgaacgattatgtttag

SEQ ID NO: 183242 - DNA, 720 bp, Artificial Sequence
  Description of Artificial Sequence: Synthetic coding sequence
atggccagcaccgccgtgcagctgctgggcttcctgctgagcttcctgggcatggtgggcacattgatcaccacaattcttccacactggcgcaggacagcacacgtgggcacaaatatcctgaccgcggtgagttatctgaaaggactgtggatggagtgtgtgtggcacagcaccggcatctaccagtgccagatctacaggagtctgttggcactgccccaagacttacaggcggccagggccttgatggtgatcagttgcctgttgtcaggaattgcgtgcgcatgtgccgttattggcatgaaatgtacacgctgtgccaaaggcacccctgcaaagaccacttttgccatccttggtggcactctctttattttagccggattactttgcatggtcgccgtgagttggaccacgaacgatgtggtccaaaacttctacaaccctttgctgccctccggcatgaagtttgagatcggccaggcattatatctaggattcatatcctcctcgctgtccctcattgggggcacactgctgtgcctctcgtgccaggacgaagccccatacaggccctaccaggctcctcctcgcgcgacgaccactacagcaaacaccgccccagcctaccagccccctgccgcctacaaagacaatcgagccccctccgtcactagcgctacgcatagtggatacaggctgaacgattacgtgtag

SEQ ID NO: 183243 - DNA, 720 bp, Artificial Sequence
  Description of Artificial Sequence: Synthetic coding sequence
atggccagcaccgccgtgcagctgctgggcttcctgctgagcttcctgggcatggtggggactttgattaccactattctgccacattggagacgaaccgcccacgtaggcacaaacattctgacggccgtgagttatctcaaaggactgtggatggaatgcgtttggcatagtaccgggatctaccagtgtcagatttatcgatccctgctggccttaccccaagatctacaggccgcacgcgccctcatggtgatctcatgtctcctctccggtatcgcttgtgcttgtgccgtcattggtatgaaatgcactcgctgcgccaaaggtacgcccgcaaagaccacctttgccatcctgggcggtaccctcttcattctggccgggttgctgtgcatggttgcagtgtcatggacaacgaacgatgtggttcagaatttttataaccctctgctacccagcggcatgaagttcgaaatcgggcaggccctgtacctgggcttcatctcatcctctctctcattgataggtggaacactgctttgtctcagctgtcaggacgaggcaccctatcgcccttatcaggcgccccctagggccacaaccacaacggcgaacacggcccccgcctaccagcctcccgcggcctataaggataaccgagccccctccgtgacgtccgcaacccatagcggatatagattaaatgactacgtgtag

SEQ ID NO: 183244 - DNA, 720 bp, Artificial Sequence
  Description of Artificial Sequence: Synthetic coding sequence
atggccagcaccgccgtgcagctgctgggcttcctgctgagcttcttaggcatggtgggcaccctaatcaccacaattttgccccactggagacgaactgcccatgtgggaactaacattctgacagcagtttcgtatctgaaaggcctgtggatggaatgcgtgtggcactcgacaggcatataccagtgtcagatctaccggtccttgctggctctgcctcaggatctgcaggccgctagagctcttatggtgattagttgtctgctttctggaatcgcatgcgcctgcgctgtcatcggaatgaaatgcactcgttgtgccaaaggcactccagctaagactacctttgccatccttggaggaaccctgttcatccttgcagggctcctgtgtatggtggccgtcagttggacaaccaacgacgtggtacagaacttctataatccactcctgcccagcgggatgaagttcgagattgggcaggccttatatttgggattcatcagtagtagtttgtcactgattggcggcacactgctgtgtctgagctgccaagatgaagcaccctatcggccttaccaggcacccccccgcgccaccactaccacagcaaacacagcgcctgcctaccagccccctgcagcatacaaggataaccgggcacccagcgtgacctctgccactcacagcggctatcgtttgaatgactacgtatag

SEQ ID NO: 183245 - DNA, 918 bp, Artificial Sequence
  Description of Artificial Sequence: Synthetic coding sequence
atgaccagccggacccccctgctggtgaccgcctgcctgtactactcatattgcaattctcgacatctacaacagggagtgcggaaatccaagaggccggtcttttctcactgccaggtgcctgaaacgcaaaagactgatactcgacatctcagcggcgctcgcgccggtgtttgcccctgctgccacccagatggtctgctggctaccatgcgggatttgttacagtacatcgcctgtttttttgctttcttttcagccgggtttctcattgttgccacctggaccgactgctggatggttaacgccgacgacagtctagaggtgtcgactaagtgtaggggcctttggtgggagtgtgttaccaacgcttttgacggaatccggacatgcgacgaatacgattcaatcctagctgaacatccactgaagctcgtggtgacccgcgcactcatgatcacggccgatattttggcagggtttgggttcttgacacttctgctgggcctcgactgtgtgaaatttctccctgacgaaccgtacattaaagttcggatctgcttcgtcgccggcgccacacttctgattgccgggaccccaggtattatagggagcgtctggtacgcggtggatgtatacgtggaacgctcaacgcttgtgcttcataacatcttcctgggcattcaatacaaattcgggtggagctgctggctgggcatggctgggagcctgggctgtttccttgcaggggccgtgctcacttgttgcttgtatctgttcaaggacgtgggacctgaaagaaactacccttatagtctcagaaaagcgtactccgctgctggggtttcaatggccaaaagttactcggctccacggaccgagaccgccaagatgtacgccgtcgacactcgagtatag

SEQ ID NO: 183246 - DNA, 360 bp, Artificial Sequence
  Description of Artificial Sequence: Synthetic coding sequence
atgaccagccggacccccctgctggtgaccgcctgcctgtactactcttactgcaatagtcggcatctgcaacagggtgtgagaaaatcaaaacggccagtgttcagtcattgccaagtgcctgaaacccaaaagacagacacaaggcatctgagcggcgcccgcgcaggcgtatgtccttgttgtcatccagatgggttgctcgccaccatgcgcgaccttctccaatacatcgcgtgcttttttgctttctttagcgctgggttcctgattgtagccacttggacagattgttggatggtcaatgccgatgactccctggagatgctcgacctgagagaaacaatcttaatcccctag

SEQ ID NO: 183247 - DNA, 675 bp, Artificial Sequence
  Description of Artificial Sequence: Synthetic coding sequence
atggccaacagcggcctgcagctgctgggctacttcctggccctgggaggatgggttgggattatcgcctcaactgccctaccgcagtggaaacagagtagttatgccggtgatgctattatcactgccgttggcctgtacgaaggcttgtggatgtcctgtgcttcacagtcaacaggacaggtgcagtgtaagctatacgactctctgctcgccttagatggtcacattcagtcggcccgcgcactgatggttgtcgcagtgctgctgggctttgtagccatggtgctgtccgtggtcggaatgaagtgcactagagttggggactcaaatcccattgctaagggcagagttgcaatcgcaggaggggctcttttcatcttggcaggactgtgcacgctgactgctgtgtcttggtatgcaactctggttacacaagaattctttaatccatccacccccgttaacgccagatatgagtttggccccgctctgttcgtaggttgggcaagcgccggacttgcagtcctcggaggcagtttcttgtgctgcacgtgcccagaaccagagaggcctaattcttcacctcagccctaccgccccggtccttctgccgcagccagggagcccgtggtcaaactgcccgcgagtgccaagggcccgctcggggtctag

SEQ ID NO: 183248 - DNA, 636 bp, Artificial Sequence
  Description of Artificial Sequence: Synthetic coding sequence
atggccaacagcggcctgcagctgctgggctacttcctggccctgggaggctgggtgggcataattgcaagcaccgctttgccacaatggaagcagtcttcgtacgccggggatgccataatcaccgccgttggactatatgagggcctgtggatgtcttgtgcttctcagtccaccggccaggtccagtgtaagctgtacgatagcttacttgcactggacggtcacatccagagtgcccgggcacttatggtggttgcggtgctgcttgggttcgtggcaatggtgctgtctgtggtgggaatgaagtgcacgcgggttggggattcgaatcctattgccaaaggacgggtcgctatagctggtggggccctgttcatacttgctgggttgtgcaccctgacagctgtgtcttggtacgctacactggtgacccaagaattcttcaatccttctactcctgtgaacgcgaggtatgaattcggcccagctttgtttgttggatgggccagtgccggattagcagtgctgggaggttcgtttctctgttgcacatgtccagaaccagagcgacccaatagttctccccagccgtacaggccgggcccctccgccgcagccagggaatatgtgtag

SEQ ID NO: 183249 - DNA, 657 bp, Artificial Sequence
  Description of Artificial Sequence: Synthetic coding sequence
atggccaacagcggcctgcagctgctgggctacttcctggccctgggtggatgggtggggatcattgcgagcactgcactcccccagtggaaacagtcctcttatgccggcgatgccattattacagcagtgggactgtatgaagggctgtggatgagttgtgcaagccagtccactgggcaggttcaatgcaagctgtatgatagtctcctggccctcgacggccatatacagtccgcccgggcgcttatggtcgtggcggttctgctcggttttgttgctatggtgctgagcgtggttggaatgaagtgcacaagggtgggggacagtaaccccattgcgaaaggccgtgtggctatagccggcggtgccctgtttatccttgccggcatgaacctcgcacagccatgcagttgggcagggccccaattagcctggccctgctgggccgccccctcatccgcggcccatgcaaggtcacagcgggatcctaccgccgctcactcccctatcggcctcgatccgcttttgctgcctgagtccacatcggagctcaggctgccttggccggcacctcatccagtcgcccctttgccctccatccagccggcttcccagcatcccggccagggccactggggcatcgggtgggcctag

SEQ ID NO: 183250 - DNA, 663 bp, Artificial Sequence
  Description of Artificial Sequence: Synthetic coding sequence
atgagcatgggcctggagatcaccggcaccgccctggccgtgctgggctggttggggaccattgtttgttgtgccttaccgatgtggagggtctcagcgtttattggaagtaacattattaccagccaaaacatttgggagggactgtggatgaattgcgtggtccagtccacaggtcagatgcagtgcaaagtctacgattctctgcttgcccttccacaggacctacaggcggcacgtgctctaatcgtggtggcgatacttctggctgcatttggtctgcttgtggccctggttggtgctcagtgcacaaattgcgtgcaggacgacaccgcgaaggccaaaattaccatcgttgctggtgtgctttttctcctagccgcattgctgactttggtccccgtatcttggagtgcaaatacaatcattagggacttctataaccctgttgtgccagaagcccaaaagagagaaatgggggccggactctacgtgggctgggcggcagcagccctacagctgctgggaggggccctcctttgttgttcctgtccaccccgggagaaaaagtatacggccacgaaagtagtgtatagcgcccctaggtcgacaggacctggagccagcttgggcactggttacgataggaaagattacgtatag

SEQ ID NO: 183251 - DNA, 630 bp, Artificial Sequence
  Description of Artificial Sequence: Synthetic coding sequence
atggccagcatgggcctgcaggtgatgggcatcgccctggccgtgctcggatggcttgcagtaatgctttgctgtgcgctccccatgtggcgcgtgaccgcatttataggttctaatatagtcacgtcccagaccatctgggaaggattgtggatgaactgtgtggttcagtccactgggcagatgcaatgcaaggtttatgacagtctgttagccctgcctcaggacctgcaggcagctagggccctagttatcatttccattatcgtagctgccctgggagtgcttctcagcgtggtgggcggaaagtgcacaaattgtctcgaagatgagtcagctaaggcaaagaccatgatcgttgctggagtggtcttcctcttagccggactgatggtgatcgtccccgtaagctggactgcacataacattatacaagacttctataatccgctcgtggcgtctgggcagaagcgggaaatgggggcttcgctgtatgtgggctgggccgcatcaggcctactgctgctcggaggcgggctgctgtgctgcaactgccctccacgcactgacaagccctactctgccaaatactctgctgctcgctccgcagctgcaagcaactatgtgtag

SEQ ID NO: 183252 - DNA, 630 bp, Artificial Sequence
  Description of Artificial Sequence: Synthetic coding sequence
atggccagcatgggcctgcaggtgatgggcatcgccctggccgtgctgggctggctagctgtgatgctctgctgcgccctcccaatgtggcgggttacagcctttatcggctccaacattgtcaccagccagactatatgggaaggcctctggatgaattgtgtggtgcaatccaccggacaaatgcagtgcaaagtgtatgacagcctgttagccttgccccaggacctgcaggccgcccgggccctcgtcataatcagcatcatagtagctgcgctcggtgtgctgctctctgtagtaggcggcaagtgtaccaactgcctggaagatgagtccgccaaagcgaaaactatgatcgtggcgggcgtggtgttcctgctggccggcctgatggttatagtgcccgtgtcctggactgcccacaatattattcaggatttctacaatcccttagtggccagtggtcaaaaaagggaaatgggagccagtctttacgtcggctgggccgccagtggcttgctcctgctgggtggaggactgctctgctgcaattgcccccccaggaccgacaagccatattcagctaaatattcagccgcacggtcagccgccgcgagtaattacgtttag

SEQ ID NO: 183253 - DNA, 630 bp, Artificial Sequence
  Description of Artificial Sequence: Synthetic coding sequence
atggccagcatgggcctgcaggtgatgggcatcgccctggccgtgctcggctggttagctgttatgctgtgttgtgcactgcccatgtggcgcgtgaccgcgtttatagggtccaacatagtgacatctcagaccatctgggagggactgtggatgaactgtgtggtccagagcactggtcagatgcagtgcaaagtgtatgattctttactggccctgccacaagatttgcaggcagctcgcgcccttgttattattagcataatcgtcgccgcattgggagttctactgtccgtcgtggggggtaaatgcaccaactgtctggaggatgaaagcgccaaagctaagaccatgattgttgccggagtagtctttttactagcaggactcatggttattgtcccggtgagttggaccgcacataatattatacaagacttttacaatccactagttgcaagcggacagaagagagaaatgggggccagcctctatgttgggtgggcagcatctggactgcttctgcttggaggaggactgctctgctgcaattgccctccgagaaccgacaaaccgtatagcgccaagtattcggcggcacggtctgcggccgcttcgaactacgtctag

SEQ ID NO: 183254 - DNA, 591 bp, Artificial Sequence
  Description of Artificial Sequence: Synthetic coding sequence
atggccagcatgggcctgcaggtgatgggcatcgccctggccgtgttgggatggctggctgttatgctatgctgcgccctccccatgtggagagttactgccttcattgggtccaatatcgtgacttctcaaagcactggacagatgcagtgcaaagtttacgacagcctgctagcccttcctcaagacctgcaagctgccagggctctagtgatcatcagtattatagtggctgctctgggagtgttactctccgtggtgggcggtaaatgcactaactgcctggaagacgagtcagcaaaagcaaagacaatgatcgttgccggcgtagtgtttctgctggccgggttaatggtcatcgttcctgtaagttggaccgcccataacattattcaagatttctataacccgctcgtagcatctggacagaaacgggagatgggggcttccctctatgtaggttgggccgcttcagggcttctcctgctgggaggaggcttgctttgttgtaactgcccacctcggaccgacaagccgtactcagctaaatacagtgccgcaaggagcgccgcggcttccaactacgtgtag

SEQ ID NO: 183255 - DNA, 912 bp, Artificial Sequence
  Description of Artificial Sequence: Synthetic coding sequence
atgacccgggcccggatcggctgcttcggccccggcggccgggcccgcgggacggaatcagctccggagccctctaagagggtgccacccggcagatcctggcagactcaggaggttcggcagacccggggcgccaacggactcggtcctagagctggctctgccggggctaaggcaccagggccagcccaaggcgctgcccagcatgggctgggcgggtccgctggcctgcgtgtccgcgtgtccccattagcaatgggttccgccgctctggagatcctggggttggtgctctgtttggtcgggtggggcggtcttatcctggcctgcggattgcccatgtggcaagtgacggcgtttctcgatcataatatagtcacggcacagactacttggaaaggtctgtggatgtcctgcgtggtgcagagcaccggacacatgcagtgcaaagtgtacgatagtgtcctcgctttgtctacagaggtgcaggctgctcgcgccctgacagtttccgctgtcttgctagcctttgtggccctgttcgtgaccctcgctggcgcacagtgcaccacatgcgtggcccctgggccagctaaagctagggttgcacttactggtggggtcctttacctgttctgtgggcttctggcactcgtaccgctgtgctggtttgccaatatcgtggttagggagttttatgacccctccgtgcctgtcagccagaagtatgaattaggtgccgccctgtatattggatgggccgccactgcgctcctgatggtcggcgggtgcctactctgctgtggcgcctgggtttgtacagggcgacccgacctttcgtttccggttaagtatagtgcgccacgacggccaaccgccacgggagattatgacaaaaagaactacgtgtag

SEQ ID NO: 183256 - DNA, 912 bp, Artificial Sequence
  Description of Artificial Sequence: Synthetic coding sequence
atgacccgggcccggatcggctgcttcggccccggcggccgggccaggggcaccgaatcggctccggaaccttcaaaaagagtccctccaggcagatcatggcagacacaggaggttaggcaaacacgcggcgctaacggccttggacccagagccggctccgccggcgctaaggctcctggacccgctcagggcgctgcgcagcacggtttggggggttcggccggactgcgggtccgcgtgagcccgctggcaatggggtccgccgctcttgagatattggggttagttctatgcctcgttggatgggggggacttattctagcctgtggcctcccgatgtggcaggtgactgccttcctggatcataatatcgtaaccgctcagacaacctggaaaggcttatggatgtcttgcgtggtgcagtctacaggccatatgcagtgcaaagtgtatgatagcgtgcttgctctaagcactgaggtgcaggccgcccgggcattaacagtgtctgcggttctgctggctttcgtcgccttattcgtgaccttagctggggcccaatgtaccacatgcgtggctccggggcctgccaaagctagggttgcactaacgggcggggtcctgtatctattctgcggactgctcgcactggtgccgctttgttggttcgctaatatagtcgttcgcgaattttacgacccgtctgttcccgtcagccaaaagtacgagctgggcgcagccttgtatattggatgggccgctacagcccttctgatggtgggtgggtgcttactgtgctgtggcgcatgggtgtgtacagggagaccagatctcagttttccagtcaagtactcagcccccaggcggcccaccgcgacaggcgattatgacaagaaaaattacgtctag

SEQ ID NO: 183257 - DNA, 912 bp, Artificial Sequence
  Description of Artificial Sequence: Synthetic coding sequence
atgacccgggcccggatcggctgcttcggccccggcggccgggcccgcgggaccgaaagcgcacctgagccttctaagagagtaccgcccgggagatcctggcagacgcaggaggtgcgtcagacccggggcgccaatgggctgggtccaagggcaggatctgctggtgccaaggcccccggtcccgctcagggggctgctcaacatgggctaggcggatcagcgggactaagggtccgggtttctccgctggcaatgggctctgccgcactggaaatcctgggactcgtactgtgcctggtcggatggggtggccttatcctggcgtgtggtctgccaatgtggcaggttacggcttttcttgaccataatatagtgaccgctcaaactacatggaagggactgtggatgtcgtgcgtggtgcaaagcaccggccatatgcagtgcaaagtgtatgatagtgtgttggctttgagcaccgaagtgcaggccgccagagccctcactgtgtctgctgtcctgcttgcattcgtggcgctcttcgttacattggccggggcccagtgtactacttgtgtcgccccgggaccggccaaagccagagtggccctcactggcggcgtgttgtacttgttttgtggtctgctggctctagtgcctctctgctggtttgccaatatcgtcgtgcgcgagttctatgaccccagtgtgcccgtcagccagaaatacgagctgggagctgcactctacattgggtgggcggctaccgctctcctgatggtagggggatgtcttttgtgctgcggggcctgggtctgtactggaaggcccgatctgtccttccccgtgaagtacagcgccccaaggaggccgaccgccaccggcgattacgataaaaaaaactacgtctag

SEQ ID NO: 183258 - DNA, 1086 bp, Artificial Sequence
  Description of Artificial Sequence: Synthetic coding sequence
atgggcgaggaggccaacgacgacaagaagcccaccaccaagttcgagcttgagagagagacagagctaaggttcgaggtggaggcgtctcagtctgtgcaactggagttgcttaccggcatggccgagatcttcggtacagaactgacaagaaataagaaatttaccttcgatgcaggagccaaagtcgcagtcttcacatggcacgggtgtagcgtccaactgagtggtagaacagaggtggcttatgttagcaaagacacgcctatgctactgtatctgaacacacatacagcccttgaacagatgaggcgccaggccgagaaagaggaagagcgggggccccgtgtgatggtagtcggccctaccgacgtggggaagagcactgtttgcaggctgctcttaaattatgccattacttcccgcctggcagatgtgttcaaccaaagatgcgaggttaaccggcgcgccagcgtgtccgggtgcgtcataaacacctgcggttgggtcaagggcagcgggtaccaggccctggtccacgccgcctccgccttcgaggtcgacgtggtagtggtactggaccaagaaagactctacaacgagctgaaaagagatctgccccacttcgtgagaacagtcctgttacccaagtctggaggcgtcgtggaacggagcaaggacttcagacgcgaatgccgagacgaaaggatacgcgaatatttctacggttttagggggtgcttttacccccacgcatttaatgtaaaatttagcgatgttaagatatataaagtgggggcacctaccatccccgactcttgtctccccctggggatgagccaagaggacaatcagctgaagctggtaccagtgacccctggacgcgatatggtgcatcacctgctctcagtaagcacggccgaggggacagaggagaaccttagtgaaacctccgtcgccggattcatcgtcgtgactagcgtagatctcgagcaccaagtctttactgtgctgagtcccgcaccgagaccactcccaaaaaactttctcctcataatggatattaggtttatggacttaaaatag

SEQ ID NO: 183259 - DNA, 810 bp, Artificial Sequence
  Description of Artificial Sequence: Synthetic coding sequence
atgcaggagatcatcgccagcgtggaccacatcaagttcgacctggaaatcgcagttgagcagcagctgggggcgcagccacttcccttccccggcatggacaaatctggggccgccgtgtgtgaattctttctaaaggccgcctgcgggaaaggaggaatgtgcccatttcgccatatttctggtgagaagactgtagtatgcaaacattggctccggggcttgtgcaagaagggagatcagtgcgagtttctgcatgagtatgacatgaccaagatgcctgagtgttacttctatagcaaatttggggaatgctccaacaaagaatgcccctttttgcacatagacccagagtcaaaaattaaagactgcccctggtatgatcgggggttctgtaaacacggaccactatgcagacatcgacacaccaggagggtcatctgcgtgaattatttggttggcttctgtcccgagggtccctcctgcaagtttatgcatcccagatttgagttgcccatgggtacgaccgaacagcccccattgccacagcagacgcagcctccagctaagcagagcaataacccgcccctgcagcgctcttcttcgctgattcaattgaccagccagaacagcagccccaatcaacagaggacacctcaagtgattggggtgatgcagtctcagaattcttccgcaggtaatagggggccaaggccccttgagcaggtaacctgctataaatgtggtgagaagggacattatgccaaccggtgtacgaaaggccatctggcctttttgagcggacagtag

SEQ ID NO: 183260 - DNA, 735 bp, Artificial Sequence
  Description of Artificial Sequence: Synthetic coding sequence
atgcaggagatcatcgccagcgtggaccacatcaagttcgacctggagattgctgtcgaacaacagttaggcgctcagccactgccattcccgggtatggataagtccggggccgctgtctgtgaattttttctcaaggccgcctgtgggaagggcgggatgtgccctttcaggcacatcagtggcgaaaagaccgtggtctgcaaacattggttgcggggcctgtgcaagaaaggcgatcaatgtgaattcctgcatgaatacgacatgacaaagatgcccgagtgctacttttatagtaaattcggggaatgctctaacaaagagtgcccctttctccacatcgaccccgaatccaaaataaaggactgcccgtggtatgaccgagggttctgcaagcatggacccctgtgccggcatcgccacactcgcagagtgatatgtgtcaactacctggtcggcttctgccctgaggggcccagctgtaagtttatgcaccctcgctttgagcttccaatgggcacaactgagcaaccccctttaccccagcagacgcaacctcccgcaaaacaacgaacaccacaggttatcggagtgatgcaatcccagaactcgtctgcgggtaatcggggtccccgccccctggaacaggtgacttgctataagtgtggggagaagggccattacgcaaaccgctgcaccaaggggcacttggcttttctgtcgggacagtag

SEQ ID NO: 183261 - DNA, 636 bp, Artificial Sequence
  Description of Artificial Sequence: Synthetic coding sequence
atgcaggagatcatcgccagcgtggaccacatcaagttcgacctggagattgctgttgaacagcaacttggcgcacaaccactcccattccctggcatggataagagtggagctgccgtgtgcgaattcttcctgaaagccgcatgtggcaaggggggaatgtgtccatttagacatatttccggagagaagaccgtggtgtgtaagcactggttacggggtttgtgcaaaaaaggggaccagtgtgagttcctccatgagtatgatatgaccaaaatgcctgagtgctatttctacagcaaattcgggcccttgtgccgccacagacacactcgccgcgttatttgcgtgaactacctcgtcgggttctgccctgagggcccctcgtgcaagttcatgcacccccggttcgagcttccaatggggactaccgaacaaccaccactgccgcaacagacccagccccctgccaaacggaccccgcaggtgatcggggtcatgcaaagtcaaaatagtagtgccggcaaccgtggaccccggcccttggaacaggtgacctgctacaaatgtggtgagaaaggccactacgcaaacaggtgtacaaaaggtcatctggccttcctgagcggacagtag

SEQ ID NO: 183262 - DNA, 1767 bp, Artificial Sequence
  Description of Artificial Sequence: Synthetic coding sequence
atggccgacggcgtggaccacatcgacatctacgccgacgtgggcgaagaatttaaccaagaagctgaatatgggggccatgatcagatcgatctatacgatgatgtgatctcccccagtgccaacaatggtgatgcaccggaagaccgtgactatatggataccctccctcctaccgtgggagacgacgttggcaagggggccgcgcctaacgttgtctacacctataccggcaaacggattgctctgtacatcggtaacttaacatggtggaccaccgatgaggacctcacagaggcggtgcactccctcggagtcaacgacatcctggagatcaagttttttgaaaacagggccaacggccagtcaaaagggtttgctctggtaggtgttggctccgaagccagctccaaaaaactgatggatcttctacctaagcgagagctgcatgggcaaaacccggtcgtgaccccttgcaacaagcaattcctaagtcagtttgagatgcaatcacggaaaacgacacagagcggtcaaatgtccggcgaggggaaagcaggccccccgggcggcagttctagagctgcatttcctcagggagggagaggcagaggtagattccccggagcggttcccggaggagataggttcccgggccccgctggacccggaggccctcctcccccctttccgggaaatctgattaaacatctggtgaaaggcacaagacctctgtttctggagaccagaatcccttggcacatgggccacagtattgaggaaatcccaatctttggcctcaaggccggtcagacgccccccagaccaccgttggggccgcctggcccgcctggcccgcccggtccgccaccacctgggcaggtgctccccccgcccctggctggcccgccaaaccggggtgacaggccccccccaccagtgctcttccctgggcaaccttttggccagcccccgttgggtcctctgccgccagggcctccccctcctgtcccagggtatggtcctccaccagggcccccgccgccacagcagggccctccaccacctcccggccccttccctccccggccaccgggtcctctcggccctcctctgacactggctcctcctccccatctgccaggtccccccccaggcgcaccccctccagctccacacgtgaatcccgcctttttccctcctccaactaacagcgggatgcctaccagcgattccagagggccacctcctaccgatccttatgggcgacctccaccgtacgacaggggcgattatggcccgcctggacgcgagatggacaccgcgcggacgcccctgtccgaggcggagttcgaggaaatcatgaataggaatcgcgctatctcatcatctgccataagccgggctgtctctgacgcatctgcaggggattacggctccgccatcgagaccctcgtcacagctatatctttgatcaaacagtccaaggttagtgcagatgaccgttgtaaggttttgatttcgtccctacaggactgcctgcatggcatcgagtccaaatcgtacggatctggaagtcggcgcgagcgttcacgagaacgcgaccactcccgtagccgggaaaagtccagacggcacaaaagccgaagtcgggatcgacacgatgactattacagagagaggagcagggagcgtgagcggcaccgcgatagagaccgcgaccgtgatagagagcgagaccgagagagagagtaccgccaccgttag

SEQ ID NO: 183263 - DNA, 1656 bp, Artificial Sequence
  Description of Artificial Sequence: Synthetic coding sequence
atggccgacggcgtggaccacatcgacatctacgccgacgtgggcgaggagtttaatcaggaagctgaatatggtgggcacgatcaaatcgacctgtacgatgacgtgatctcaccttctgctaataatggtgacgcacccgaggacagggattatatggataccttgcctcccactgttggagatgacgtgggaaaaggggcagcccctaatgtggtctacacgtacactggaaagagaatagccctctatattgggaacctcacatggtggaccacagacgaggaccttaccgaggccgttcactccctgggagtgaatgatatacttgagattaagtttttcgaaaaccgggccaatggacaaagcaagggctttgctcttgtgggtgtcggatccgaggcatccagtaaaaaacttatggacctgctgcctaagcgcgaacttcacggccaaaacccggtagtgacaccttgcaacaagcagttcctatctcagtttgagatgcagtcccgcaaaacaacacagagtggccaaatgagcggggagggtaaggcgggaccccccggaggatctagtcgagctgcctttccgcaggggggtaggggccgcggcagattcccaggagcagtccccgggggcgaccggtttccaggcccagctggtccaggtggccccccaccaccctttcccgccgggcagacccctcccaggccccctctgggaccgccaggcccccccggcccccctggccctcctcctccgggccaagtcctccccccaccacttgcaggacctccaaacagaggagatcggcctcccccacctgtcctgtttccaggtcagccttttggacaaccccccctcggaccccttcctcctggcccgccgcccccggtgcccggctacggccccccccccggtcccccccctcctcaacagggccctccccctcccccgggaccttttcctcctagacctccaggcccccttgggccgcccctgacattggctcctccaccacaccttcccggtccaccacccggggctcccccacccgcgccccatgtaaacccggcctttttccccccacccactaactctggaatgcctacttcagattctcggggcccacctcccactgatccttacgggcgcccacctccatatgatcgcggagattatggtccccctgggcgagagatggacacggcccgcactccactatcagaggctgaattcgaggaaattatgaatagaaacagagcaatatcaagtagcgccatcagtcgtgccgtgtccgatgcttctgccggtgattacgggagcgctattgagacattggttaccgcaatatccctgattaagcaatctaaagtatccgccgatgatcgctgcaaggtacttatttcatctctgcaggactgtctgcatggaattgagtcaaaaagttacggaagtggctcccggagagagcgttctcgtgaaagggatcattcccgaagtcgtgagaagagccgccggcataaaagccgttcacgcgatcgccacgatgactattacagggagaggagccgcgaaagagagcgacaccgtgatcgtgacagggaccgagatagagaacgcgaccgcgagcgggagtaccgacaccgctag

SEQ ID NO: 183264 - DNA, 1437 bp, Artificial Sequence
  Description of Artificial Sequence: Synthetic coding sequence
atggccgacggcgtggaccacatcgacatctacgccgacgtgggcgaagaattcaatcaagaggccgagtatggggggcacgaccagatcgacctgtatgatgatgttattagcccaagcgctaacaatggcgacgcgcccgaagatcgcgattacatggacaccctgccacctaccgttggcgatgatgttggcaaaggcgcggcacccaacgttgtctacacctataccgggaagagaattgctctttatatcgggaatctgacatggtggacgactgatgaggacctaaccgaagccgtacacagtctaggtgtcaatgatatacttgagattaaattcttcgagaatagggcaaacggccagtctaagggcttcgccctcgtcggcgtcggctcagaagcctccagcaagaaactgatggacttactgcccaaacgtgagctgcacggccagaaccctgtggtgactccgtgcaataaacaattcctgagtcagtttgagatgcagagtaggaagactacgcagtcgggacagatgagtggggaaggcaaagcagggccccctggagccggccctccaaatcggggggataggccacccccccccgtgctgttccctggccagcccttcggacagccacccctgggccctttaccaccagggcctcctccaccggtgcccggttacgggcctccgccaggcccccccccaccacagcaggggcctccacctccgcccggtccattcccacccagacctccggggcccctgggccctcctctcacacttgcaccaccgccccacttgccaggcccaccacccggagccccgccccccgcgccacacgttaatccagcattctttccgccacccacaaatagcggaatgcccacatcagactcgcgtggcccacctcccactgacccttatggtcgacccccaccctacgatcggggggactacgggccgcccggccgagaaatggacaccgctcgcacaccactgtccgaagccgaatttgaggaaataatgaatcgcaaccgcgccatcagctcaagtgcgattagcagggcagtctccgatgcaagcgcaggggattatggatctgcgattgagaccctggtcactgccatttctctcataaagcagtctaaagtttctgcagacgatcggtgtaaggtcctgatttcgagccttcaggactgtcttcatggcatagagtcgaaatcctacgggtctggttctaggcgagagcgttccagggagcgtgaccattcaaggagccgcgaaaaaagcaggagacacaaatcccgaagccgcgatcgacacgacgattactatcgggagagatcacgcgagagagaaagacatagagatcgtgaccgcgatcgtgacagagaaagagatcgggagcgagagtaccggcatcgttag

SEQ ID NO: 183265 - DNA, 1851 bp, Artificial Sequence
  Description of Artificial Sequence: Synthetic coding sequence
atgagcagcctggccgtgcgggaccccgccatggaccggagcctgagatccgtgtttgtgggaaatatcccttacgaagcaactgaggaacagctaaaagacatattcagtgaggtgggttctgtggttagcttcagattagtctatgatagggagaccggcaagcccaagggctacggattttgcgagtaccaggaccaggagaccgccttgtctgctatgcgaaatctaaatggccgggagttctccggaagagccttgagggtggacaacgctgcctctgagaagaataaagaagagctcaagtcacttggccccgccgcacctattattgactctccatatggcgaccctatcgaccctgaagacgcacctgaatccattacccgggccgttgccagtttgcctcctgagcagatgttcgaattaatgaagcagatgaaactatgtgtgcagaattctcaccaggaggcgcgcaacatgcttctgcagaaccctcagctggcctacgctctgctccaggctcaggtagtaatgagaattatggatcccgaaattgcactgaaaattttacaccgtaagatccacgttacaccactaatcccggggaagtctcagtctgtctccgtctctggccctggaccgggccccggtcctggactatgtccagggccgaacgtacttctgaatcaacagaatccacccgctccccaaccccagcatttagcacgccggcccgtgaaggatatcccgccactgatgcaaacccctatccaaggggggattccagccccgggccccataccagcagccgtacctggtgctggccctgggtccctgaccccaggaggcgctatgcaaccccaactgggaatgccaggagttgggcccgttcccctggaacgcggccaggtgcagatgtcagacccaagggcacctattcctcgggggccagtgacaccagggggcctgcccccaaggggtctgttgggagacgccccaaacgatccacgcggaggtacactgttgagcgtgacgggagaggtcgagccccgcggctatctcggcccgccccatcaaggaccaccaatgcaccacgcctctgggcacgatactcgtggaccaagttctcatgagatgagggggggacccctgggggacccacggcttctgatcggggagccgcgaggtcctatgattgatcagagagggcttccgatggacggtcggggcgggagggatagccgagccatggaaacaagggctatggagacagaagtcctcgagactagagtgatggaacgacgcggcatggagacatgcgcaatggaaacccgggggatggaggcccgcggcatggatgcgcgaggtctggagatgcgtggacccgtcccctcctcaaggggccccatgactgggggtatccagggaccagggcccatcaacataggggccggcggtcccccgcagggcccccgccaagtccccggcatttctggagttgggaatcctggcgctggaatgcagggtacaggaatccaagggaccgggatgcagggcgcaggaatccaaggcggcggaatgcagggcgcgggcattcagggggtgagcattcaaggcggcgggattcaaggaggcggcattcagggtgccagcaagcaaggcggttcccagcccagtagcttttctcccggacagagccaggtgacccctcaagaccaggagaaggccgccttgataatgcaggtccttcaattgactgctgaccaaatcgcaatgctgccgcctgaacagcggcagtccatactcattctgaaggaacaaattcagaaatctactggtgcttcttag

SEQ ID NO: 183266 - DNA, 2541 bp, Artificial Sequence
  Description of Artificial Sequence: Synthetic coding sequence
atgctgttcaccgtgagctgcagcaagatgagcagcatcgtggaccgtgacgactcctccatctttgacgggctggtggaagaagacgacaaggataaagctaagagagtcagcagaaacaaatccgagaaaaaacgcagagaccagttcaacgtgttaataaaggaacttggctctatgctccccggcaatgcccgcaagatggacaagagcactgtcttgcagaagtccatcgactttcttaggaagcacaaagagatcactgctcagtcagacgcatccgagattagacaggattggaagcccacatttctgagcaacgaagagttcacgcagcttatgctggaggccctggacggattctttctcgccatcatgactgatggcagcatcatatacgtctctgaatcagtcacctccctgctagaacatctacctagtgatcttgtggatcagagcatattcaattttattccagagggcgaacattccgaagtttataagattctgtcaacacacttgctggaatctgactctctgactcccgaatatcttaagagcaagaatcagctggagttctgctgtcacatgctgcgaggaactatcgaccccaaggagcccagcacatatgagtatgttaagtttatcggaaactttaaatccctgaactcggtgtccagctccgcacacaatgggtttgagggaacaattcagcgaacgcacaggccaagttacgaggaccgggtctgcttcgtggctactgtgcgtctggccacaccacagtttatcaaagagatgtgcacagtggaagagcccaacgaagaattcacaagccgacactctctggaatggaagttccttttcttggaccaccgagctccccctataattgggtatctccctttcgaggttctgggcacaagtggatacgactattaccacgtagacgacctcgaaaatctggcgaaatgccacgagcatttaatgcagtatgggaagggtaagtcctgttattatcgcttccttacgaaaggccagcagtggatctggctccagacccattattacataacttaccatcaatggaattctcggcccgaatttatagtctgtacccacaccgtggtgtcttatgcagaagtgcgggccgagaggagacgggagctgggcatcgaggagtccctacccgagacagccgcagataagagccaggactccggctccgataaccgcattaacacagtgtctctcaaggaggcactggaacgctttgatcacagccctacaccatccgcatcttctcgatccagtcgcaagtcctctcacacagccgtgtcagatcccagctcgacccccaccaagatccctacagatacatctaccccaccaaggcaacatctccccgcccacgagaaaatggtgcagcggcgctcctctttcagttcccagtccatcaatagccagtccgtcggcagttctctgacccagcccgttatgtcgcaggcgacgaacctccctatcccacaggggatgtcacaatttcagttcagtgcccagcttggcgccatgcagcacctcaaggatcagcttgagcagcgaacgaggatgattgaggctaatattcacaggcagcaggaggagctgagaaaaatccaagagcagctccagatggttcatggacagggcctgcagatgttcctgcaacaaagcaatcctgggctgaattttggctctgtgcaattgtcctctgggaattcttccaatattcagcaactggccccaatcaacatgcaggggcaagtggttccaaccaatcaaattcaatctggcatgaataccggacatatcgggacaactcagcacatgatacagcagcaaactctgcaaagcacctccactcagtcacaacaaaatgttctgagcggccactcacagcagacatcactgcctagtcagacacagtcgacgctaaccgcccccctgtataacactatggtcatctcacagcccgccgccggatccatggttcagatcccgtcctcaatgcctcagaacagcactcagtcagccgccgtgactacgttcacacaggataggcaaataaggttcagccagggccagcaattggtaaccaagctggttacggcacctgtcgcctgtggagcagttatggtgcccagcaccatgctgatgggccaggttgtaactgcatatcccacttttgccactcagcagcaacagagccaaactctttcggtgacccagcaacagcagcaacagtccagccaggaacaacagttgacctcagtacaacagcctagccaagcgcagctcactcaacccccccagcaattcctccagacaagcaggctgctgcacggcaatccttctactcagctgattctgtccgcagccttccccctacagcagtctacattcccccagtcccatcaccaacagcatcagagccagcagcaacagcaactgtcccgccacagaactgattcactccccgacccctccaaagtccagccccagtag

SEQ ID NO: 183267 - DNA, 1278 bp, Artificial Sequence
  Description of Artificial Sequence: Synthetic coding sequence
atgggcgaggaggccaacgacgacaagaagcccaccaccaagttcgaacttgaacgcgagacggagctccggtttgaggttgaggcttcacagagcgtgcagttagagctgttgaccggcatggccgagatctttggcaccgagctgacaaggaataagaaattcacgttcgatgccggcgctaaggtagccgtttttacatggcacggttgctcagtgcagctttctggccgaactgaagtggcatatgtctctaaggataccccgatgctcctatatctgaacacccataccgctctggaacagatgcggcgtcaggccgaaaaggaggaagagaggggaccccgcgtgatggtggtgggccccaccgatgtgggaaagtcgacggtgtgcaggctcctgttgaactacgcagtgcgcctcggaaggcgacctacttatgtggagttagatgttgggcagggctcagtgagtataccaggaacgatgggtgccctttatatcgagcgcccagccgacgtcgaggaagggttctctatccaggcgcccctggtttaccactttggtagcaccacacccggaaccaatataaaattgtataacaaaataaccagccggctcgctgatgtgttcaaccagcggtgcgaggtgaataggagagcctccgtatccggatgtgtgatcaatacatgtggatgggtgaaggggagtggataccaggcacttgtccacgcggcaagcgcatttgaggttgacgtggtcgtggtactcgatcaagagagattgtataatgagttgaagcgcgatctgccccattttgtcagaacagttttgctgcctaaatccgggggagtggttgaaaggtcaaaagactttcgccgcgagtgccgcgatgagcgcatcagggaatacttttacggctttcgcggatgcttctacccccacgcctttaatgtgaaattctctgacgtgaaaatttacaaggtcggcgccccaaccatcccagactcctgcttacctcttggcatgtcccaggaagataatcaacttaagctagtcccggttacgcctgggagggacatggtgcatcacttactgtcagtcagcaccgccgagggcaccgaggagaatctgagcgagacctctgtcgccggttttatcgtcgtaacttctgtggacctcgagcaccaggtttttacagtgctctctcctgcacctcgaccactccccaagaatttccttctgatcatggatattagatttatggatcttaaatag

SEQ ID NO: 183268 - DNA, 1311 bp, Artificial Sequence
  Description of Artificial Sequence: Synthetic coding sequence
atgaccgacctgcacagcagctacaccgaggagatgggcgaggaggctaatgacgacaagaaaccaaccacgaagttcgagctggagcgagaaactgagttacgttttgaagttgaagcctcccaatcagtacagcttgaactcctgacaggaatggctgaaatttttggaactgagttaacccgcaataaaaaattcaccttcgacgcaggagccaaggttgctgtattcacctggcacggctgctctgtgcagctgtcaggccggaccgaagtggcttatgtgagcaaagatacacctatgctgttgtatctgaacacgcataccgccctagagcagatgcgtcggcaggctgagaaagaggaggaacgtggaccaagggtgatggtggtaggcccaaccgacgtcggtaaatctacggtgtgcagactcttactgaactatgccgtcagactgggacggcgacccacttatgtggagttagatgttggccaagggtcagtgtctatcccagggacgatgggggcgttgtacatcgagcgcccagctgatgtggaagaaggcttctcgatccaggccccgctggtgtaccatttcggatctacaacaccgggaactaatatcaaactctacaacaagatcactagccgactggccgacgtgttcaatcaaagatgcgaggttaatagacgtgcctctgtctcaggctgtgtgatcaacacctgtgggtgggttaaggggtcaggttaccaggccctagtccacgccgcatctgcttttgaggttgatgtcgtggtcgtgctggatcaggaacgcctatacaacgaacttaaaagggacctgccacattttgtgagaaccgtgctcctaccgaagagcggaggagtcgtggaacgctccaaggactttagacgggagtgcagagatgaaagaatcagggagtacttctacggcttccgtgggtgcttctacccccacgcattcaatgttaagttcagtgacgtgaagatctacaaggtgggcgccccgaccatcccagacagttgtctccccctgggaatgtcacaggaggataaccaactgaagctcgtgcccgtaacaccaggcagggacatggtccaccacctgctgtccgtcagcactgcagagggtaccgaagagaacttatctgagacctctgtggccgggtttatcgtggtcacatctgtggatctcgagcaccaggtgttcaccgtgttatcccccgcccctagaccactgccaaagaatttcctcctaatcatggacatcaggtttatggacctgaaatag

SEQ ID NO: 183269 - DNA, 279 bp, Artificial Sequence
  Description of Artificial Sequence: Synthetic coding sequence
atgggcgaggaggccaacgacgacaagaagcccaccaccaagttcgagctggagcgggaaaccgagctgcgcttcgaggtggaagcatcccaatcagtacagctcgagctgctcacaggtatggcagaaatcttcggcactgagctaacccgtaacaagaagtttacatttgacgccggagcaaaagttgcagtgtttacatggcacggatgctcagttcaactgtccggcaggactgaggttgcctacgtcagtaaagacacacccatgttgctttag

SEQ ID NO: 183270 - DNA, 1278 bp, Artificial Sequence
  Description of Artificial Sequence: Synthetic coding sequence
atgggcgaggaggccaacgacgacaagaagcccaccaccaagttcgagctcgagagagaaacagaactgcgctttgaggtggaagcatctcaaagtgtgcagctggaactgctgacaggcatggcagagatcttcggcacagagctcactcggaacaagaaattcacttttgatgctggggcgaaagtcgctgtgtttacctggcatggctgttccgtgcaactctccggccgtaccgaggtcgcctacgtgtcaaaggacacaccgatgctcctgtatctcaatacacatacggcactggagcagatgaggagacaggcggagaaagaagaggagcggggaccacgggttatggttgtgggcccaacggatgtcggcaagagtactgtctgccgactcctactgaactatgcggtgcgcctgggacggcggccgacctatgttgagctggacgtggggcaggggtctgtgtccatccccgggaccatgggcgcactgtatattgagagaccagccgacgtcgaggagggattctctatccaagccccgttagtgtaccactttggctctacaactcccgggaccaatattaagctgtataacaagattacctccagattggcggatgtttttaatcagagatgtgaagtcaaccgcagggcaagcgtttccgggtgcgtgattaatacctgcggctgggtgaaaggctctggctaccaggctctcgtgcacgccgcttccgccttcgaggtggatgtggtggtagtgttggaccaagaacgattatacaacgagctcaagcgagatctgccacacttcgttaggaccgtcttgctgcccaagagcgggggggtcgtcgagcgcagcaaagattttcgtcgggagtgtcgcgacgaaagaattcgcgagtacttctacggcttccgggggtgtttttacccccatgccttcaacgttaaattttctgatgtgaaaatctacaaggtcggcgcccccactatccctgacagttgcctcccactcggaatgtcgcaagaggacaatcagctaaaactggttccagttacaccaggcagggacatggtgcaccacctgctgagtgtatctacagccgagggtaccgaggagaatctgagcgaaacatccgtggctggttttatcgttgtcacaagcgtggatctggagcatcaggtgttcacagtccttagccctgccccgagacccctgcccaaaaacttcctgctgatcatggatataaggttcatggacctgaaatag

SEQ ID NO: 183271 - DNA, 399 bp, Artificial Sequence
  Description of Artificial Sequence: Synthetic coding sequence
atgggcgaggaggccaacgacgacaagaagcccaccaccaagttcgagctggagagagaaaccgaattgcgattcgaggttgaagccagccaaagcgttcagcttgaactgctgaccggaatggcggagatcttcggaacagagctgaccagaaacaagaagtttacattcgacgccggggccaaggtggctgttttcacttggcacgggtgtagtgttcaactgtcggggcggaccgaagttgcttacgtctcaaaggatacaccaatgttgctctatttgaacacacacacagctctggagcaaatgcgaagacaagccgagaaggaagaagaaagaggtccgcgagtgatggtggtaggtcctaccgatgtgggcaaatctacagtgtgccggtag

SEQ ID NO: 183272 - DNA, 834 bp, Artificial Sequence
  Description of Artificial Sequence: Synthetic coding sequence
atgtggcccggcatcctggtgggcggcgcccgggtggccagctgccgatatcctgcactgggacctaggctcgccgcacactttcccgcccagcggcctccgcagcggacactacaaaacggtttggctcttcagcgctgcctgcacgctaccgcaactagagcacttcccctcatccctatagttgtggagcagactggtcggggtgaacgggcatatgacatatacagtaggctgttacgggaacggatagtgtgtgtaatggggcctatcgacgactcagtggctagcttggtgatcgctcaactactgttcttacagtccgaatctaacaagaaacccattcacatgtacatcaactctccggggggcgtggtgacggccgggttggcaatttacgacaccatgcaatacatactgaatcccatttgcacctggtgcgtgggacaagccgcctcaatgggctccctgctcctcgcagctggtacccccggcatgcggcattcactgcctaactcccgtatcatgatccatcagccatccggaggggccagaggacaggccaccgacatcgccatccaggccgaagaaataatgaagttgaaaaagcagctgtacaacatctatgcgaaacatacgaagcaaagcctccaagttatagaatcagctatggagcgtgaccgatatatgagccccatggaggctcaggagtttggcatccttgacaaggtgctcgtccatccaccgcaagatggagaggacgagccaacgctcgtgcagaaggaacctgtggaggctgctccagctgcagagcccgtgcctgcctcgacctag

SEQ ID NO: 183273 - DNA, 1617 bp, Artificial Sequence
  Description of Artificial Sequence: Synthetic coding sequence
atgtggagcggccggagcagcttcaccagcctggtggtgggcgtgtttgtggtgtacgtggtgcacacgtgttgggtgatgtacggtattgtgtacacccggccgtgtagcggcgatgcaaactgtattcaaccctatctggcacgtaggcctaagctgcagctctccgtgtatacgactacccgtagtcacttaggagccgaaaacaacatagacctggtgctgaatgtggaggacttcgacgtggaatctaagtttgaacggaccgtcaacgttagcgtgccaaagaaaacccgcaataatggaactctttacgcctacatattcctacatcatgccggggtcttgccgtggcatgatggcaaacaggtgcacctggtgagccctttaaccacgtatatggtcccgaaacctgaggaaattaatctccttacaggtgagtctgacactcagcaaattgaggcagaaaagaagcccacaagcgcactggatgagcccgtgtctcattggaggccgcggttggccctgaacgtgatggctgacaactttgtattcgacggaagcagtctccctgcagacgttcaccgatacatgaaaatgattcagttaggcaagacagtgcactatctgccaatcctgttcattgatcagttgtctaaccgtgtgaaagacctgatggtgatcaatcggtcaaccaccgagctcccactgacggtgtcctacgataaggtatctctaggcagactgaggttctggatccacatgcaggacgccgtttactcactccagcagttcggattcagcgaaaaggacgctgacgaggttaagggtatttttgttgacacaaatctgtacttcttagccttgacatttttcgttgccgcctttcacctgctgtttgactttctcgcatttaagaacgacatatcattctggaaaaagaagaagtctatgatcggcatgagcaccaaggcagtgttgtggaggtgctttagcactgttgtgatttttttatttctactggatgagcagacctctttgctggtgctcgtgccagcgggcgtcggtgccgctatcgagctatggaaggtcaagaaggcactgaagatgacaatcttctggaggggccttatgccagagtttcaattcggcacctattccgaatccgagaggaagaccgaagagtatgatacacaggccatgaagtacctatcctacctgctttacccactgtgtgtaggcggcgccgtttacagtctcctgaacataaagtacaaatcctggtacagttggttgatcaacagcttcgtgaatggtgtctatgctttcggcttcctctttatgctgccccagttatttgtcaattacaaactcaagtccgtggcccacttgccctggaaggcttttacctacaaggccttcaacactttcatagacgatgtgtttgcgttcattatcaccatgccgacaagccatagactggcgtgcttccgcgatgatgtggtattcctggtgtacctctatcagcgatggttgtatcccgttgacaagcggagggtcaatgaatttggggagtcctacgaagagaaggcaactcgggcaccacacaccgattag

SEQ ID NO: 183274 - DNA, 1509 bp, Artificial Sequence
  Description of Artificial Sequence: Synthetic coding sequence
atgtggagcggccggagcagcttcaccagcctggtggtgggcgtgttcgtggtgtacgtggtgcacacttgttgggtgatgtacggaattgtctatacgagaccgtgtagcggcgacgccaactgtatccagccttacctcgcgcggaggcctaagctacagctaagtgtctacactaccacacgttctcatttgggagctgagaacaatattgacttggtgctgaatgtggaagatttcgatgtggaatctaagttcgaaaggaccgtaaacgtgtcggttccaaagaaaacaaggaataatgggaccctgtacgcctatatctttctgcaccatgctggcgtactgccatggcacgatggtaagcaggtccatctagtgagccctctcaccacgtacatggttccaaaaccagaggaaatcaatctgctcacaggtgaatcagacactcagcaaattgaggccgagaaaaaacctacaagcgcacttgacgagcccgtgagtcactggcggccccgattagctctgaatgtcatggcagataactttgtttttgatggtagcagcttacccgctgatgtgcaccgatacatgaaaatgatccagttgggaaagaccgttcactacctgcccatcctctttatcgaccagcttagtaatagggtgaaagacttgatggtgattaataggtcaaccaccgagctcccactgaccgtgagctacgacaaagtgtctctggggaggctccggttttggattcacatgcaggacgcagtctatagcctccaacaattcggcttctctgaaaaggatgctgatgaagtgaagggaattttcgtggatactaatctatactttcttgctctgacattcttcgtcgccgcgtttcacttactcttcgattttctggctttcaaaaacgacatcagcttctggaagaagaaaaagtctatgatcgggatgtcaacgaaactttggaaggtgaagaaagctctgaaaatgaccatcttttggcgaggacttatgccggaatttcagttcggtacatactccgaaagcgaacggaagacagaagagtatgatacgcaagctatgaaatacctcagttatcttttatatccattgtgcgttggaggtgccgtgtactctctccttaatataaagtataagtcctggtactcatggcttatcaactcattcgtgaacggggtgtatgcttttgggttcctctttatgctgccccaattatttgtgaactacaaactgaagagtgttgcccatctgccttggaaggcctttacctataaagccttcaatacctttatcgatgacgtctttgcgtttattatcactatgcctaccagtcacaggctcgcctgtttccgggacgatgtcgtattcctggtatacctctatcagaggtggctgtaccctgtagataagcgacgggtgaatgagtttggcgaaagttacgaagaaaaagccactagagcgccacacactgattag

SEQ ID NO: 183275 - DNA, 1350 bp, Artificial Sequence
  Description of Artificial Sequence: Synthetic coding sequence
atgatgaagaccctgctgctgttcgtgggcctgctgctgacctgggagagcggccaagtgctgggggaccaaaccgttagtgataatgaactgcaagaaatgagtaaccagggctccaagtatgttaacaaagagattcaaaatgctgtgaacggtgtcaaacagatcaagaccctgattgagaaaactaatgaagagcgcaagactctcttaagcaatctcgaggaggcaaaaaagaagaaggaagatgctctgaacgaaacccgtgagagcgagaccaagctcaaggagttacccggcgtgtgcaatgaaactatgatggccttatgggaggaatgcaagccttgtttaaagcagacatgtatgaagttctatgcgcgggtctgcagatcagggtctggacttgtcggaaggcaattggaagagttcctgaaccagagtagccccttttacttttggatgaatggagaccggatcgacagtctcctggagaacgacagacagcagactcatatgcttgacgttatgcaggatcacttctcacgcgcctcctcaattatagacgagctcttccaggatagattttttacgcgtgagcctcaggacacttatcattacctcccattctctctgccccaccgaagaccacacttcttcttccctaagagccgtatcgttcggagtctcatgccattcagtccctacgagccactcaatttccacgccatgtttcaaccattcctcgagatgatccatgaggcacaacaggctatggatatccattttcacagccctgcctttcagcatccgcccacagaatttattcgcgaaggggacgacgatcgcacagtatgcagagagatcaggcacaacagcactggctgtctgcgcatgaaagatcagtgtgacaagtgtcgcgaaattttaagtgtggactgcagtacaaataacccaagtcaggccaaattgagacgggaacttgacgaatccctgcaagtcgccgaacggctaacgcggaagtacaatgaactgctcaagtcttatcagtggaaaatgctgaatacctcctctctcctggaacagctgaatgagcagttcaactgggtctcacggttggcgaatcttacacagggcgaggatcagtactatctcagagtcacaaccgtagcctcgcacacctcggattccgatgtgccctctggcgtgactgaggtggttgtcaaattgtttgattcggaccccattaccgtgaccgtcccggtggaggtatctagaaagaaccctaaattcatggaaacggtcgccgagaaagctttgcaagagtatcgcaagaaacatcgcgaggagtag

SEQ ID NO: 183276 - DNA, 825 bp, Artificial Sequence
  Description of Artificial Sequence: Synthetic coding sequence
atgcaggaccacttcagccgggccagcagcatcatcgacgagctgttccaagaccgtttcttcacaagggagcctcaggacacttatcactacttacccttcagtctgccccaccgtagacctcactttttcttcccgaagagccgcatcgtgcgtagcctgatgcccttcagcccatacgagccgcttaacttccacgcaatgttccagcccttcctggaaatgattcacgaagcacaacaggccatggacatccatttccattcaccggcatttcagcatcctccaaccgagtttataagagaaggggatgacgacagaacagtgtgtcgagagatcagacataactcaacgggctgccttaggatgaaggatcaatgtgacaagtgccgtgagatcctgagtgtcgattgcagcacaaataatcctagtcaggcaaaactccggagggaattggatgagtcactgcaggtcgcagaaaggctgaccagaaagtataacgagctgttgaagagttaccaatggaagatgctcaacacctcctcactactcgagcaactgaatgagcaattcaactgggtgtcgaggctggcaaatcttactcagggcgaggaccaatattaccttcgagtaaccaccgtagcatcccacacgagtgatagcgacgtgccaagtggagtgaccgaagttgtagtgaaattgtttgatagcgatcccataacggtgacggtcccagtcgaagtttcaagaaaaaatccgaaattcatggaaactgtcgctgagaaagctctccaggagtaccgcaagaagcacagagaggaatag

SEQ ID NO: 183277 - DNA, 1350 bp, Artificial Sequence
  Description of Artificial Sequence: Synthetic coding sequence
atgatgaagaccctgctgctgttcgtgggcctgctgctgacctgggagagcggtcaggttttaggcgaccaaactgtttccgataacgaactccaagaaatgtctaatcagggatcgaagtacgtgaataaagagatacagaacgccgtaaatggcgtaaaacagattaaaaccctcatcgaaaagacgaacgaagaacggaaaacactgctatcaaatctagaagaggcaaaaaagaagaaggaagacgccctgaatgaaacacgcgagtcagaaacaaaattgaaagaactcccaggggtttgtaatgaaactatgatggcactttgggaggaatgcaagccctgcctcaaacagacttgtatgaaattctacgcaagggtgtgcaggtccggctcagggttggtgggaagacagctggaggagtttctcaaccaatctagtccattttatttttggatgaatggcgaccgcattgacagccttctagagaatgacaggcagcaaacccatatgttggatgtaatgcaggaccattttagccgcgcatcttcaatcatcgacgaactcttccaggaccgtttttttacccgggaaccccaggatacgtaccattatctccccttttcattaccccaccgccggccacatttttttttcccaaagtcccggattgtcaggtcattgatgccgttttccccatacgagccgctcaattttcacgccatgttccagcccttcctggagatgattcacgaggcacagcaggctatggacattcacttccacagtccggcatttcaacatcccccgactgaatttatacgggagggggacgacgaccggactgtttgccgagaaattcgtcataatagcactggatgcctcaggatgaaggatcagtgcgataaatgtcgcgagatcttaagtgtggactgttctacaaacaatcctagccaagctaagctcagacgtgagcttgatgaatctctgcaggttgctgagcgccttacaaggaagtataacgagctcctcaagagttatcagtggaaaatgcttaacacctcatccctgctggaacagctgaacgaacagttcaactgggtgtccagactggctaacctgactcaaggcgaggaccaatactatctcagagtgaccaccgtggccagtcacacttctgattccgatgtgccctcgggggtgacggaggtggttgtgaagctgtttgactcagatcccataacagtgaccgtgcccgtcgaagtgagcagaaaaaacccaaagttcatggaaacagtagccgaaaaggccctccaggagtatagaaaaaagcatcgggaagagtag

SEQ ID NO: 183278 - DNA, 615 bp, Artificial Sequence
  Description of Artificial Sequence: Synthetic coding sequence
atgatgaagaccctgctgctgttcgtgggcctgctgctgacctgggaatcggggcaggttctgggtgaccaaactgtgtccgacaacgagctccaggaaatgtccaaccagggttctaaatatgtcaacaaagaaatccagaacgccgttaacggtgtgaagcaaataaagaccctgattgaaaagaccaacgaagaacggaaaactttgctgagcaatctcgaagaagcgaagaaaaaaaaggaagatgcacttaacgagacccgagagtccgagacgaagctcaaagagctgccaggagtgtgcaatgagacgatgatggcgctctgggaagaatgcaaaccatgcctaaagcaaacatgtatgaagttttacgcccgggtctgcaggtctggctcagggctggtagggagacagttagaggagtttctcaaccaatcctcaccgttttacttctggatgaatggtgatagaattgattcattgcttgagaacgaccgtcagcagacccacatgcttgatgtcatgcaggatcacttcagtcgagcttccagcattatagatgagttgtttcaggacaggttcttcactagagaaccccaggacacatactag

SEQ ID NO: 183279 - DNA, 1350 bp, Artificial Sequence
  Description of Artificial Sequence: Synthetic coding sequence
atgatgaagaccctgctgctgttcgtgggcctgctgctgacctgggaaagcggtcaggtcctaggagaccagactgtgtcagataatgagctacaggagatgagcaatcagggttcgaagtatgttaataaggagatccagaatgccgtcaacggtgttaaacaaatcaaaactctgattgagaagacaaatgaggagcgaaagacattgctctcaaatcttgaggaagcaaagaagaaaaaagaggacgcactcaatgagactcgagagtctgaaacaaaactgaaggaattgcccggtgtatgcaatgaaacgatgatggcattgtgggaggaatgcaagccatgtctcaagcaaacgtgtatgaaattttacgcccgtgtttgccggagtgggtctggcctggtgggcagacagctcgaagaattccttaatcaatcgtctcctttctacttttggatgaacggggatcggatcgacagtctgctggaaaacgacaggcagcaaacacatatgctagacgttatgcaggatcacttttcgcgtgcatctagtatcattgacgagctcttccaggacaggttcttcacccgggagccgcaggacacctatcactatctgccttttagcctgcctcatcgtcgcccacactttttctttcccaagtccaggattgtgcggtctctgatgcccttctctccatacgaacccctgaatttccatgctatgtttcagccttttttggaaatgattcatgaggctcagcaggccatggatatccacttccactccccagcatttcagcatccacccactgaatttattagagagggggacgacgaccgcaccgtctgccgggaaatcagacataattcaactgggtgtctgcggatgaaagatcaatgcgacaagtgccgtgaaatcctctctgtcgactgcagcacaaacaaccccagccaggctaagctgaggagggagctggatgagagccttcaggtggccgagcgcctgactcgcaaatataacgagttactgaagtcttaccagtggaagatgctgaatacgagctctttgctggaacagcttaatgaacagtttaactgggtctcccgcctggcaaatcttactcaaggggaggatcagtattacttaagagtgaccactgtggcaagccacacaagtgactctgatgtaccttcaggcgtgactgaggtagtggtcaaactgttcgattccgaccctatcacagtgacagtcccagtggaggtctctaggaagaatcccaaattcatggaaaccgtggcagagaaagcactgcaggaataccgcaagaagcacagggaagagtag

SEQ ID NO: 183280 - DNA, 816 bp, Artificial Sequence
  Description of Artificial Sequence: Synthetic coding sequence
atgatgaagaccctgctgctgttcgtgggcctgctgctgacctgggaaagcggtcaggtgctgggcgatcagaccgtgagtgataacgagctgcaagaaatgagtaatcagggaagtaagtacgtgaacaaagagattcagaatgccgttaacggggtcaaacagataaaaaccctcatcgaaaaaactaatgaggagcgtaaaacactattgagtaatttggaggaggcaaagaaaaagaaggaagacgctctgaatgagactcgggaatccgagaccaagctgaaggaactgccaggggtatgcaacgaaactatgatggccttatgggaggaatgcaaaccatgtctaaagcagacatgcatgaaattttacgcccgggtatgtcgctccggcagcggcctagtggggagacagcttgaagagtttctgaatcagtcttcaccgttttacttctggatgaacggagatcgtatcgattccctgcttgagaacgataggcaacagacccacatgctggatgtgatgcaggaccactttagtcgagcgtctagtattatcgacgagctgttccaagactccctcatgcctttctctccatacgagccactgaatttccacgccatgttccagccattccttgagatgatccatgaagctcaacaggcaatggatatccacttccacagtcccgcgttccagcatccaccaaccgagtttatacgcgagggagatgacgatcggaccgtttgtcgggagataagacataattctaccgggtgcctgcggatgaaggatcaatgtgacaaatgctag

SEQ ID NO: 183281 - DNA, 1383 bp, Artificial Sequence
  Description of Artificial Sequence: Synthetic coding sequence
atggaggcctgcaaggacagccggatcggcggcatgatgaagaccctattactctttgtgggtttgctgctaacctgggagagtggtcaggtccttggagaccagacagtgtccgataacgagctacaagagatgtctaatcagggaagcaaatatgtcaacaaggaaattcagaatgcagttaatggagtcaaacagatcaaaactctgatcgagaaaactaacgaggagaggaagaccctgctctctaaccttgaggaagccaaaaaaaagaaagaggatgccctgaacgaaacaagggaatccgagaccaagctgaaggagctgccaggggtgtgtaatgaaacgatgatggccctttgggaggagtgcaaaccctgtttaaagcagacatgcatgaagttctatgcacgagtgtgtcggtctgggagcggcttggttgggaggcagctggaagaatttctgaaccaatcctccccattttacttttggatgaatggtgataggatcgatagtttgcttgagaatgaccgtcagcaaacgcatatgctggacgtgatgcaagatcatttttctcgggcctctagcatcatcgacgaactgtttcaagatagattcttcaccagagagccacaggacacctatcactacctgcctttcagtttgccgcatagacgtccccacttttttttccccaagtcccgaattgtaaggtcccttatgccattttccccgtacgaacctctaaactttcacgcaatgttccagccttttctggaaatgattcatgaagcccagcaggccatggatattcatttccatagtcctgcctttcaacatccgcccacagagttcattagagaaggagatgacgacaggaccgtctgtcgggaaatccgccacaactccacaggatgcctgcgtatgaaggatcagtgcgataaatgccgggaaatcctgtccgtggactgctccaccaataaccccagccaagccaagctgaggcgagagctggatgagtcgctgcaggtggcagagcgcctcactcgcaaatataacgagctcctcaagtcctatcagtggaaaatgctgaacacctctagcctcttagagcagcttaacgagcagtttaactgggtgtctaggctggccaaccttacccagggggaagaccagtactatctccgggtgaccacagttgcatcgcacacatccgacagcgacgtaccttccggagtgacggaggtggtcgtgaaactattcgatagcgacccaatcacagtcaccgtgcctgtggaggtaagccggaaaaatcccaaattcatggaaactgttgcagaaaaggccctgcaagaatatagaaagaagcatagggaggaatag

SEQ ID NO: 183282 - DNA, 1506 bp, Artificial Sequence
  Description of Artificial Sequence: Synthetic coding sequence
atgcaggtgtgcagccagccccagcggggctgcgtgcgggagcagtccgccattaatacggcgcccccctctgctcataacgctgcttcgccaggaggcgcccgcgggcatcgagttcccttgactgaagcatgcaaggatagccggatcggtgggatgatgaagacactcttgctttttgtgggtctgctgctgacatgggagtccgggcaggttttgggggatcagacagtatctgacaacgagttacaggaaatgagtaaccaggggagcaagtacgtgaataaagagatccagaacgccgttaacggggtgaaacagataaaaactctgatcgagaaaaccaacgaagaacgcaaaacactgctcagtaatcttgaggaagccaagaagaagaaagaggatgctcttaatgagacccgagagtcagagacaaaactcaaggagctgcctggagtgtgcaatgaaacgatgatggcactgtgggaagaatgtaagccttgcctcaaacaaacttgcatgaagttctacgctagagtttgcagatctgggtcgggcctggtaggccgtcaactcgaggagtttctgaatcagtcttctcctttctatttttggatgaacggcgaccgcattgactccttgctggagaacgaccgtcaacagacacacatgctggacgtgatgcaggaccacttctctcgcgcgagctctatcattgacgagttgttccaagaccgcttctttaccagggagccccaggatacatatcactatcttcctttctcacttccccataggagaccccattttttcttcccaaaatcccgcattgtgagatcgttaatgcccttttcaccctacgagcctctcaactttcatgcaatgttccagccctttctggaaatgatccacgaagcacagcaagctatggacattcactttcatagtcccgcctttcagcatccgccgaccgagttcatacgagagggtgacgacgacagaaccgtgtgccgggagatcagacataattctacaggctgcctgaggatgaaggaccaatgcgacaaatgccgagagatcctgtccgtcgactgttcaaccaacaacccttcacaggccaagctgagacgggagctggacgaaagtctgcaagtggctgagcgattaacccgaaagtacaatgagttactgaaatcctaccaatggaaaatgctcaacacctctagtctgctggagcagctgaatgagcagtttaattgggtgtcccggcttgccaaccttacccagggcgaagatcagtactacttgcgcgtcacaacagtcgcaagtcatacgagtgactccgatgtgccttcaggggtcaccgaggtagtggtgaaactgttcgattcagatcccataacagtaacggttcctgtggaggtgtcccgcaagaaccctaaattcatggaaaccgtcgcagagaaggcgttacaggagtaccgcaagaagcaccgggaggagtag

SEQ ID NO: 183283 - DNA, 894 bp, Artificial Sequence
  Description of Artificial Sequence: Synthetic coding sequence
atggaggcctgcaaggacagccggatcggcggcatgatgaagaccctgctgttgtttgtcggtctccttcttacctgggagtcaggacaagtgctcggcgatcaaacagtcagtgacaacgagctgcaggagatgagcaatcagggctctaagtatgtgaacaaagaaattcagaacgccgtgaatggcgttaagcagattaagaccctgattgaaaagaccaacgaggagagaaagacattgctgtctaacttagaagaagccaagaagaagaaggaagacgcgctgaacgagacacgggagtccgagactaagttgaaggaattaccgggggtatgcaatgagactatgatggcactttgggaagaatgtaagccatgtctgaaacagacctgcatgaaattttacgcaagagtctgcaggagtggctcaggtctcgtgggacggcagctggaggaattcctcaaccagtccagccctttttatttctggatgaatggtgacaggattgatagcctccttgagaacgatcggcagcagacgcatatgcttgacgttatgcaggaccacttttcacgtgcttcatcgatcatcgacgaattgttccaggacagattttttacccgcgaaccccaggatacatatcactacttgcctttttccctcccacacagacgtccacatttttttttccccaaaagtagaattgttaggtccctgatgcctttttctccatatgagcctttgaacttccatgctatgtttcaacctttcttggagatgattcacgaagcgcaacaggccatggacatccactttcactcccccgcatttcagcaccccccaactgagtttattcgggaaggtgatgatgaccgaacggtgtgccgctag

SEQ ID NO: 183284 - DNA, 2040 bp, Artificial Sequence
  Description of Artificial Sequence: Synthetic coding sequence
ctgggccagttcgagcagcccaccggctacatggagaacagcgtgagttattccgccatcgaggatgtacaactcctgtcttgggaaaacgcaccaaaatattgtctgcagcttactattcccggaggtacagtgctgctacaggccgctaatagctacctgcgggaccaatggtttcattcactgcagtggaagaaaaagatatataagtacaagaaagtgctgtctaacccaagcaggtgggaagtggtcctgaaggaaatccgtacactcgtggatatggctttaacatcgcctctccaagatgacagcatcaaccaagccccgttggaaatcgtgagcaagctgctgtctgaaaacacaaacttgacaacgcaagaacatgaaaacattattgtggctatcgcgcccttactcgagaataaccatcccccacctgatctttgcgagtttttctgcaaacactgtcgtgagagaccacgttccatggtcgttatcgaagtcttcactccggtagtgcagcggattctgaagcacaacatggattttggtaagtgtcccagactccggctgttcacccaggagtacatattggccctgaatgaactgaatgccggcatggaagtggttaaaaagttcatccagtcgatgcatggacccactggtcactgtcctcaccctcgggtactccccaaccttgtggctgtctgtctcgcagcaatatactcctgttatgaggagttcatcaacagtcgggataactctccatccctcaaggaaattcgaaacggatgtcaacaaccatgtgaccgcaaacctacgctcccactcaggctcctgcaccccagccctgacctcgtgagtcaggaggcaacgctcagtgaagccagacttaaaagcgtcgtagtggcatctagcgagatccatgtcgaggtggagagaaccagtaccgccaagccggccctgactgcctccgccggcaatgactcggaacctaacctgatagactgcttgatggtttcccccgcgtgttctacaatgtcaatcgagttagggccgcaggcagacagaacattgggttgttacgtggagatcctcaaactgttatctgattatgacgattggaggccgtctttggctagtctgcttcagccaatcccatttcccaaggaggccctcgcacatgaaaagtttactaaggaactgaaatacgtaattcagcggttcgctgaggacccccggcaagaggtgcatagctgtctgctaagtgtgagagcaggcaaagacgggtggttccaattatattccccaggcggcgtggcatgcgatgacgacggggagctgtttgcctctatggtgcatatcctgatgggaagctgctataagactaaaaagttcctgctgtctttggctgagaataagctggggccctgtatgttactggcactgcggggtaatcaaaccatggtggaaatcctgtgtctgatgttggaatataacataatcgataacaacgatacacaactgcagatcatatcaacgctggaaagcactgacgtgggcaagagaatgtatgagcagctgtgtgatcgacaacgcgaattaaaggagctgcaaagaaaaggcggacctacacgcctgacacttcccagcaagtcaaccgatgcagacttagcgcgcttgttgtcttcgggatcatttggtaaccttgaaaatctttctcttgctttcactaatgtgactagcgcgtgcgctgagcatctgatcaaactgccaagcctgaaacagttaaatctgtggtctacacagtttggggatgcgggcctaagattacttagtgaacatctaaccatgcttcaggtactcaatctttgcgaaacccctgttactgatgctggactcctggccctttccagcatgaaaagcctgtgctccttgaacatgaacagtaccaaactctcagccgacacgtacgaggatcttaaggctaagttgccaaaccttaaggaggtagatgtccgctacacggaagcatggtag

SEQ ID NO: 183285 - DNA, 2322 bp, Artificial Sequence
  Description of Artificial Sequence: Synthetic coding sequence
atggacgtgaccagcagcagcggcggcggcggcgacccccggcagattgaagaaacgaaaccactactggggggggacgtgagtgcgccagaagggacaaaaatgggtgccgtgccatgccgccgagccctgctcctgtgcaacggaatgcgttacaagctgcttcaggaaggagatatccaggtgtgcgtcatccggcacccacggacatttctgagtaaaatcctcacatccaaattcctgagaagatgggaaccgcatcacctgacactggccgataatagcttagcctcagcaactcccaccgggtatatggagaactccgtctcatatagcgctattgaggacgtccaactcctatcatgggaaaacgcccccaaatactgcttacaactaacaatacccggggggactgtcctgctccaggctgccaactcttatcttagggatcagtggttccactcactgcaatggaaaaagaaaatctacaagtataagaaggtgctgtccaacccttccaggtgggaggtggtactgaaagagatccgaacactggttgacatggcacttacatctcccctccaggacgactcaatcaaccaggcccccctcgagattgtgtctaagctgctatctgaaaatactaacctcaccacacaggaacacgaaaacattatcgtggccattgcgccattactggagaacaaccacccccctcccgatctgtgcgaatttttctgcaaacactgtagagagcgtcccaggagtatggtggtgattgaggtgtttacgccggtagtgcagcggatccttaagcataacatggactttggcaagtgccctaggctaaggcttttcacacaggagtatattttggcactaaatgagctcaatgctgggatggaggtggttaagaagttcatccagtctatgcatggaccaaccggccactgtccgcatccccgcgtcttacccaatctggtggcagtctgtcttgccgcgatttactcttgctacgaggagtttataaatagccgagacaactctcccagcttaaaggagattcgcaacggatgtcagcagccctgtgaccgtaagcctactctgcctctgaggctgctgcacccctctcccgacctcgttagccaggaggccacgctgagtgaggcccggttgaagtctgtcgtggtggcctcctccgaaatccacgtggaagttgaaagaacaagcactgcaaaaccggctctgactgcttccgctggcaatgactcagagcccaatctgatcgattgtcttatggtgagtcctgcatgttctactatgtctatagagctggggccccaggcagatcgaacacttgggtgttacgtagaaatccttaaactgctttctgactatgacgattggcggccctcgcttgcctctctcctgcagcccatcccctttcccaaagaggcattagcccacgagaagttcactaaggagcttaagtacgtgattcagaggtttgccgaagatcccagacaggaggttcacagttgtcttctgagcgtgagagctggcaaggacggttggttccagctgtacagccccggcggggtcgcgtgtgatgatgacggggaattgtttgcatccatggtccatatacttatgggttcatgctacaagactaagaagttccttttgagtcttgccgagaataaattgggcccctgtatgctgctggctctccggggcaatcagacaatggtcgagatactttgtctgatgctggaatataacattatagataataatgacacccagctccagatcatcagcactctcgaaagcacagacgtgggcaaaaggatgtatgaacagctctgtgacaggcagcgcgagctgaaggagcttcagcggaagggaggacctaccaggctaaccctgccctccaaatccactgatgcggatctggccagattattgagctctgggtcttttggtaacctcgagaatctctcgctggcctttactaacgtcacttcagcttgcgccgagcacttaattaagctaccatccctgaagcagttgaacctctggtctacgcagttcggcgacgccgggcttcgattgctcagtgagcacctaaccatgttgcaggtgctgaatctgtgtgaaaccccagttacagacgcaggactgttagcactaagttctatgaaatctttgtgttccctgaacatgaatagcaccaaactgtcagccgacacttacgaagatctgaaggcaaagctccctaatctcaaggaggttgacgttaggtataccgaggcttggtag

SEQ ID NO: 183286 - DNA, 2040 bp, Artificial Sequence
  Description of Artificial Sequence: Synthetic coding sequence
atgggccaggccgccgagcccaccggctacatggagaacagcgtgtcatatagtgcaattgaagacgtccagttactctcttgggagaatgctcctaaatattgccttcagcttactatcccaggagggaccgtgctgttacaggccgccaactcttacctgagggatcagtggttccactcattacagtggaaaaaaaaaatctacaaatataaaaaggttctctctaacccttcccgctgggaagtggtgttaaaggaaatcaggaccctggtagacatggctcttaccagcccacttcaggatgattctattaaccaggctcccctagaaatagtttccaagcttctctccgaaaacaccaatctcactacccaggaacacgagaatattatcgttgctatcgcccccctgctggagaataaccatccgcctcccgacttgtgcgagtttttctgtaaacattgccgtgaaaggccccgttcgatggtagtgatagaggtgttcaccccggtggtgcagcggatcctcaaacataacatggacttcggcaaatgtccaagactgcgacttttcacccaggagtatattctcgccctcaatgagttgaacgccggcatggaggtagtcaagaagttcatccagtccatgcacggccccactgggcattgtccgcacccacgtgttttgccgaacctagtcgccgtctgcttggcggctatctactcatgctacgaggagtttatcaatagtagggacaattctcccagcctgaaggagatccgtaatggatgccagcagccttgcgacaggaaacccactctccccttacgccttctccatcctagccccgacctggttagccaagaggctactctctctgaggctcgccttaagagtgttgtggtggcaagcagtgagatccacgtggaggtggagagaacatcaaccgccaagccagctctgaccgcctcagctggaaacgatagtgagcccaacctgatcgactgtctgatggtatccccagcatgctctacaatgagcatcgaactgggaccccaggccgaccgcacgctaggatgttacgtggagatcctgaaattgctgagcgactacgatgactggaggccgtctctcgcctcgctccttcaaccaatcccgtttccaaaggaggctctggcccatgagaagttcactaaagagctcaagtatgtcattcagcggtttgccgaggatcctagacaggaggtgcactcatgcctcctctccgtgcgcgcaggcaaggatggttggttccagctctactcccctggtggagtcgcttgtgacgacgacggcgagctgttcgcttctatggttcacatcctaatgggtagctgctacaaaaccaagaaattcttactgtctcttgctgaaaataagcttggtccctgcatgctgttggctttacgaggaaaccaaacaatggtcgagatcttatgtttgatgctggaatataacattatcgataacaatgacacgcagttacagataatttcaactctggagtctacggatgtcggcaagagaatgtatgagcaattgtgtgacaggcagagagagttgaaggagctgcagaggaaagggggtcccactcggcttaccctgccctctaaatctaccgatgccgaccttgctagactccttagtagcgggtccttcgggaacctcgagaacttgtcattggcctttacaaacgtgacatccgcgtgtgccgaacacttaattaaactcccctctctcaaacaactcaacctgtggtcaacacagtttggagatgctgggctgcggttgttgtctgagcacttaacaatgctgcaggtgctgaatctgtgtgaaacccctgtaacggatgccggcttactagcactcagttcgatgaaaagtttgtgctcgctgaatatgaactctaccaagcttagcgcagacacctacgaggacttaaaagccaagttacctaacctgaaggaagtggacgtccgctataccgaagcttggtag

SEQ ID NO: 183287 - DNA, 1761 bp, Artificial Sequence
  Description of Artificial Sequence: Synthetic coding sequence
atggccctgaccagccccctgcaggacgacagcatcaaccaggccccgctggaaatcgtttctaaattgctgtctgagaataccaatctcaccactcaggagcacgaaaacattatcgttgctatagcccctctgctggagaataatcatcctccacctgacctgtgtgaatttttttgtaaacactgccgggagcgccctcggtctatggtggtgatcgaggtgtttaccccagttgttcagcgaattctaaaacacaacatggactttggtaagtgcccccgattacgcctgtttacccaggagtatatcctcgccctcaatgagctgaatgccgggatggaagtagttaagaagtttatccagtctatgcatgggcctaccggacattgtccccatccaagagtgctgcccaatttggtggcagtctgcctagccgccatctactcctgctatgaagaattcatcaattctcgcgataacagcccttccctgaaagagatcaggaacggctgccagcagccctgcgaccgtaaaccaacgcttcctctaagattgctgcatcctagcccggacctagtcagccaggaggcaaccctgagcgaggcaaggttgaagagtgttgtggtagcttcatccgagatccatgtggaggtggagagaacctcaaccgcaaagcctgcactgaccgccagcgctggtaacgacagcgagcccaacttgatcgactgtttgatggtcagccctgcctgtagcaccatgtccattgaactgggaccccaggctgaccggacactgggctgttacgtcgaaattctgaaactgctgtccgactatgacgattggcgcccatctctggcttcactccttcagcccattccctttcccaaggaagcactggcacatgagaaatttaccaaggaactcaagtatgtaattcagaggtttgcagaggacccaagacaagaggtgcatagctgcttactgagtgtgcgggccgggaaggatgggtggtttcagttgtacagcccaggaggggttgcctgcgatgatgacggcgagctgtttgcgtctatggtgcacatcttgatgggctcctgctacaagactaaaaaatttcttctctcccttgcggagaataagttaggaccctgtatgctactggctcttcgggggaaccaaacaatggtggagatcttgtgtttgatgctagaatataacataatcgataacaacgacacccagttgcagattatctcaacactggagtctacagacgtggggaaacgtatgtacgaacagttgtgtgatagacagagagagctgaaagagttacagcgaaaggggggaccgacccggcttacactgccctccaaatctacggatgccgatctggcccggttgctatcttcagggtcctttggcaatctagagaatctgtcactcgctttcacaaacgtgacgtcggcgtgtgctgaacatttaattaaattaccaagtctgaaacagcttaacctgtggtcaacccagtttggcgatgcgggcctgcggcttctgtcagaacacctgacgatgctacaggtgctcaatttgtgcgagactccagtcacagacgcgggattgcttgcactgtcttccatgaagtccctgtgttcactgaatatgaatagcactaaactgtcagccgatacgtacgaggacctgaaggcaaagctgccaaacctgaaggaggtagatgtacgctatacagaagcttggtag

SEQ ID NO: 183288 - DNA, 312 bp, Artificial Sequence
  Description of Artificial Sequence: Synthetic coding sequence
atggcccactacaaggccgccgacagcaagcgggagcagttccggcgttacctcgagaagtcaggagtgctggatactctcactaaggtcctggtggcactctacgaggagccggagaagcccaatagtgcattggatttcctgaagcatcaccttggcgcagccaccccagaaaaccccgagattgaactgctgagacttgagctggcagaaatgaaggaaaagtatgaagccatcgtggaggaaaacaaaaagctgaaagcaaagctcgctcagtatgagcccccccaggaagagaagcgcgcggagtag

SEQ ID NO: 183289 - DNA, 1695 bp, Artificial Sequence
  Description of Artificial Sequence: Synthetic coding sequence
atggccgtgttccggagcggcctgctggtgctgaccacccccctggcttccctagccccacgccttgcctctattctgacctcagcagccaggctggtgaaccacaccttgtatgtgcacttgcagcccggcatgtctctagagggccctgctcaaccccagagcagtcctgtgcaggccacattcgaggttcttgactttattacacatctgtacgcaggagcagatgttcatcggcatctggacgtccgcattctcctcacgaatattaggaccaaatccacattcttgcctcccctgcccaccagcgtacagaacttggcacatccaccggaggtagtcctgaccgattttcagaccctggacggctcgcagtataatccagtaaagcaacaattggtacggtacgctacctcctgctattcatgctgcccccgactcgcttctgttctgctgtatagtgactacggaataggagaggtgccagtcgagccgctcgacgtgccgcttccaagcacaatccgacctgcttcccctgtagccggctccccaaaacagcccgtccggggatactacagaggcgccgtgggaggaacctttgacaggctgcataacgcacacaaggtcctgctgagcgtcgcatgtatactggcgcaggaacagctggttgtcggcgtcgcagacaaggatctgttgaagagtaagttgctgcctgagctgttacaaccttacaccgaacgagtcgaacatttgtctgaattcctggtggacatcaagccctccctgacttttgatgtcatccctcttttggacccttacggaccagctggatcagacccctcgctggaatttttggtggtgagtgaggaaacctatcgtggtggaatggccatcaatcgattccgccttgaaaatgacttggaggagctggcattgtaccagatacagttattaaaagacctgcggcacacagaaaatgaagaagataaggtttcttcttccagtttccgacaaaggatgctgggaaacctattgagacccccgtatgagagaccagagctccccacatgtctctacgtgatcggcctcacagggatctccggatcaggaaagtccagcatagcacagcggctcaagggtctcggagcattcgtgatagattctgaccacttgggacacagggcctatgccccaggtggtccggcttatcagccagtagtcgaggccttcggtacggacattctgcataaggacggtataattaatcgcaaagtgcttggcagcagggtgtttggaaacaagaaacagctgaaaattctcaccgacatcatgtggccaatcattgccaagctagcgagagaggaaatggatagggcagtggccgagggcaaaagggtgtgcgtgatcgacgccgcagtcctgctcgaggcgggatggcagaatctcgtccatgaagtgtggactgccgtgatacctgagacggaggcagtaagacggatcgtggaaagagacggcttgtccgaggccgccgcgcaaagccgcctgcagagtcaaatgtccggtcagcagctagtcgaacagtcccacgtggttctaagcaccctctgggagccacatataacacagcgacaggtggagaaagcatgggccctgctccagaagagaatacccaagactcatcaagcactggactag

SEQ ID NO: 183290 - DNA, 1695 bp, Artificial Sequence
  Description of Artificial Sequence: Synthetic coding sequence
atggccgtgttccggagcggcctgctggtgctgaccacccccctggcctcactcgccccaaggttggctagcatcctgacctcggccgcgaggctggtgaatcacacgctgtacgttcatctccaaccaggtatgtctcttgagggccctgcacagccccagtcatctccagtgcaggccacattcgaggtgctcgacttcatcacgcatctctatgccggtgctgacgttcatcggcatctcgatgttcggattcttctgactaatattaggaccaagagtacctttcttcctccactgccgacctctgtacagaacctcgcacaccctcccgaggtggtgctgaccgatttccaaactttggatggaagccaatacaatccagtaaagcagcaactggtccgctacgccacctcttgttactcctgttgtccacgcctcgccagtgtcctgctgtatagcgattatggaataggagaggtgcctgttgaacctctcgatgtgcctctcccatccactattagaccagcttctccagtggctggctctccgaagcagcccgtgagaggctactacaggggagctgtagggggaactttcgatcgcctccataatgcacacaaagtgctactgtctgtcgcatgtattctggcacaggagcagcttgtcgttggtgtggccgataaagatcttctgaaatccaagttgttacccgaactgttacaaccttatactgagcgcgtggaacacctttcagagttcctagtcgatattaagcccagcctcaccttcgacgttatcccgctgctggatccctacggacccgccggaagtgacccttctctcgaatttctggtggtttccgaggaaacttatagagggggcatggctattaacagatttagactggagaacgacttagaggagttggctttgtaccaaatccagttactcaaagatttacgacatactgagaacgaagaggacaaggtgtcatcatcttcctttcgtcagcgtatgcttggcaacctactcaggcccccttacgaaagacccgagctacccacgtgtttgtacgtgattggactgactggtattagcggatctggaaagagttctattgcacagaggctgaaagggttaggggcctttgtgatagactcagaccacttaggccacagagcttacgcaccaggcgggcccgcgtaccagccagtcgtggaggcatttggaactgacatactgcacaaggatggcattattaacagaaaagtgctgggctcccgagtgttcgggaacaaaaaacagctcaagatcctgaccgatattatgtggcccattatagccaagttggcaagagaggagatggacagggctgtcgctgaaggtaaaagggtgtgcgttatcgatgctgctgtccttctggaggccggatggcagaacctcgtccatgaggtttggacagctgtcatcccagagaccgaagcagtgcgcaggatcgtggagagggacgggctaagcgaagctgcagcccaatctagactgcagagccagatgagcggccagcagctggtggaacagagccacgttgtcctatcgacactctgggagcctcatataactcagagacaggtggagaaggcttgggccctcctccaaaaacggatccctaaaacacaccaggcactggattag

SEQ ID NO: 183291 - DNA, 1782 bp, Artificial Sequence
  Description of Artificial Sequence: Synthetic coding sequence
atgcggaccccccggctgcgggcccagccccggggcgccgtgtaccaagctcccagccctccgcctgcacctgtgggcctgggctccatggccgtattcaggtcaggattgctcgtacttaccaccccactggcgagcctagccccgcgtttagcttcaattttgacgtcggcagctcggctggtgaatcacaccttatacgtacacttacagcctggaatgagcctcgaaggacccgcacagccacagagctcccctgtgcaggctaccttcgaggtccttgacttcatcacccatctgtacgccggggccgatgtgcataggcacttggatgtgcgcatcttgcttacaaatattcgcacaaagagtacattcctgcctcccctacccacatctgtccagaacttagcccatcctcccgaagtcgtactgaccgatttccaaactttagatgggtcacagtacaatccagtgaaacagcagctcgttcgatacgcaacaagctgttattcttgctgtcctagactcgctagtgtgctgctctacagcgattatgggatcggcgaggtgcctgtggaacctcttgacgtcccactccccagcaccatacggccagcttcacctgtcgccgggtcgcccaaacagcctgtaagggggtactaccggggggcagtcggtgggacgttcgaccgtctccataacgcccataaggttctcttgtctgtggcttgtatcttagcccaggagcagctagtggtgggcgtagccgacaaggacctgctgaaatccaagcttctgccggaactccttcaaccctacaccgagagggtggagcacttgtctgaatttcttgtggacattaagccttcactgaccttcgacgtgattcctctactggatccatatgggcccgctggctctgatccctctctggagttcctggtggtttctgaggagacttaccgcgggggaatggcaatcaacaggttccggctcgaaaacgatttagaagagttggctctgtaccagattcagcttctcaaagacctgaggcataccgagaacgaggaggataaagtgagcagctcttccttccggcagcgtatgctcggcaacttgctccgccctccctacgaacggccggaacttcctacttgtctatatgtcatcggcctgaccggcatctccggttctggaaagtcttcaatcgcccagagactaaagggtctcggggcctttgttatcgatagcgatcatctgggacatcgggcctatgctccagggggtccagcgtaccagcctgtggtcgaggctttcggcactgatatcttacacaaagatggcataatcaaccgtaaagtgctgggaagtagagtgttcgggaacaaaaagcagcttaagatactgactgacatcatgtggccgatcatcgccaagctggctagggaagagatggatcgtgctgttgccgaaggaaaaagagtttgcgtgattgatgctgccgtgctactggaagcagggtggcagaatctggtgcacgaggtgtggaccgctgttattccagagaccgaagcagtgcgacggattgtggagcgggacggtctgagcgaagcggccgcccagagccgcttacagagccagatgtcaggacagcagctggtcgagcagtctcacgtggtattgagtacgctctgggagcctcacatcacgcaaaggcaagtcgagaaggcatgggccctgttgcagaagagaatacctaaaacccaccaagccttggactag

SEQ ID NO: 183292 - DNA, 528 bp, Artificial Sequence
  Description of Artificial Sequence: Synthetic coding sequence
atggccgtgttccggagcggcctgctggtgctgaccacccccctggcatcactggcgccccgcttagcaagcatactgacatccgcagctagactcgtgaatcatactctctatgtgcatttgcagccaggcatgtcactggagggaccagcccagcctcagtcctcccctgtacaggccacctttgaagtcctggactttattacccatctttccccctcgccagctcacctgtctcccgagagtcgacctcccgcccgatcgcgggtggaccggttccccgacccgggctggaagcctgtgcagcccggacagaccgctgccagcgctctcagacatcaactgctgcaactgcttagcgcgaccggactgggcgcagccattttgaggttatgggatcgaaggtcagctcgaggggccccagggtgtcctctgactctccatgatcaggcttccttccctaggggcagagtctctaaagcggcaggtgcttggcttttgccttggcgctgtaggtggcacgtgtag

SEQ ID NO: 183293 - DNA, 810 bp, Artificial Sequence
  Description of Artificial Sequence: Synthetic coding sequence
atggccatcaaccggttccggctggagaacgacctggaggagctggctctataccagattcagttgctgaaggatcttcgacacaccgaaaacgaagaggacaaggtgtctagtagctctttcaggcagagaatgctcggcaatctgctccggcccccatatgaaagacccgaattgcctacgtgcctctacgtgatcggcctgactggaatttcgggctccggtaagtcatcaatagcccagcggctcaagggattgggtgcgttcgtcattgactcggatcatctcggccaccgtgcatacgcgccggggggccccgcttaccagccagttgtggaggcctttggaactgatattctccacaaggacggaattattaatcgcaaagtactcgggagccgagtgtttggcaataagaagcagctcaagattctcaccgacatcatgtggcccattatcgccaaactggctcgcgaagaaatggatagagctgtggccgaaggaaaacgtgtgtgcgtcattgatgcggctgtcctactcgaggctggttggcaaaacttagttcacgaggtttggaccgcggtcattcccgaaaccgaagctgtcaggcggatcgtcgagcgagatggcctgagtgaggccgcagcacaatcaagactccagagccagatgtctggccagcagctcgtcgagcagagtcacgtggtgctttctacgctttgggagccacacatcactcagcgccaggtggaaaaggcgtgggccttactacaaaagagaatccccaaaacacatcaggctctggactag

SEQ ID NO: 183294 - DNA, 1782 bp, Artificial Sequence
  Description of Artificial Sequence: Synthetic coding sequence
atgcggaccccccggctgcgggcccagccccggggcgccgtgtaccaagctcctagcccacctcccgcacccgtgggcttaggaagcatggccgttttccggagtggcctgctcgtgctgacgacacccttggcttctttggctccgagactagcctctattttaacctccgccgcacgactggttaatcatacgctgtacgtacacctgcagccggggatgtcattggaaggcccagcccaaccccagtcctctcccgtgcaggccaccttcgaagtcctcgacttcatcacccacttgtacgctggtgcggacgttcatcgacacttggatgtgcggattcttctgaccaacatccgcacaaaatccacttttttaccacctctgcctacaagcgtccagaatctcgcacatcccccagaggtggtgttaacggattttcagactcttgacggttcacagtataaccccgttaaacaacagttagtgcggtatgccactagctgttacagttgctgtccacgccttgccagtgtgttgctttacagtgattatggaatcggtgaagtcccagtggagccattagacgtcccactgccttctactattcgaccagcctcccccgttgcgggttcccccaaacagcccgttcgaggttattaccgcggtgctgtgggcgggacattcgatcgcctgcataatgcacataaagtactgttgagcgtggcctgtatactcgcacaggagcagcttgtggtgggggtcgcagacaaggatttgctgaagagtaagcttctaccggagctcctgcaaccctatactgagagagtggaacacctgtccgagtttctcgtcgacatcaagccctccctgactttcgatgtcataccgttgctagatccgtacgggcctgcaggctctgacccctccctcgagttcttagtggtttctgaggagacttatcgcggcggaatggccataaaccgtttcaggctcgagaacgatttggaggagctggccctttaccagattcagctattgaaggacctcagacacacggaaaatgaggaggacaaggtgagctccagtagtttccggcaacgcatgctgggcaatcttctgcgccccccttacgagagaccagaactcccaacctgtctttatgtcatcggcctgaccggcatctcaggatccggaaagagttcaatagcacagcggttgaaaggactcggtgccttcgttattgacagtgatcacctgggccaccgcgcgtatgcccccggaggccccgcgtaccagccggtggtggaggcatttggcacagacatcctgcataaagacggtatcataaatagaaaggtactcggcagtagggtattcggtaacaagaagcagctaaagatcctcaccgatatcatgtggcccatcattgccaagctggcacgagaggaaatggacagggctgtcgccgaaggcaaaagggtgtgtgttatcgatgcagctgtcctgctcgaagccgggtggcagaatttggtgcatgaggtgtggacagctgtcatccccgagaccgaggcagtgcggcgtatcgtggaaagagacggcttatccgaggccgccgcccagtccagactccagtcgcagatgtctggacagcaactggtcgaacagtcacatgtggttctgagtacgctgtgggagcctcacatcacgcagaggcaggtggagaaagcttgggccttactgcagaagagaatccctaagacccatcaggccctcgattag

SEQ ID NO: 183295 - DNA, 429 bp, Artificial Sequence
  Description of Artificial Sequence: Synthetic coding sequence
atggccaccaagatcgacaaggaggcctgccgggccgcctacaacctcgtgcgagacgatggcagtgcagtaatatgggttactttcaaatatgacggtagcacaatagttccgggcgagcaaggtgcagagtatcaacattttatccagcagtgtaccgatgatgtaagactgtttgcattcgtcagattcactacgggggatgcaatgagcaagagaagcaaatttgcattgattacttggatcggggaaaatgtgtcggggctgcagagagccaaaaccggcaccgataaaaccttagttaaagaggtagtgcagaatttcgctaaggaatttgttatcagtgataggaaagaattggaagaagatttcattaagagcgagcttaagaaagctggaggtgcaaactatgacgcccagactgagtag

SEQ ID NO: 183296 - DNA, 1731 bp, Artificial Sequence
  Description of Artificial Sequence: Synthetic coding sequence
atgcggggccccaacagcggcaccgagaagggccggctggtgatcccggaaaagcagggtttcgatttcttgtgtatgccagtgtttcacccacggtttaaacgtgagtttatacaggagcctgccaaaaatcgcccaggaccccagactcgatccgatttgctacttagcgggcgcgcgttcttgctccctctcaatcaggaagacaacaccaatctggcacgtgtgctgacgaaccacatccacactgggcatcactcctctatgttttggatgagggtgcctctggtggcaccagaggatctccgcgacgacattatagagaacgcccctaccacacacaccgaggagtatagtggggaggaaaagacttggatgtggtggcacaatttccgcacactttgtgactactcgaagcggatcgcggtggcactggagatcggtgccgatctgccctccaaccatgtcatagaccgctggctgggcgagccaataaaagccgccatcctgccgacaagtattttcctgactaacaagaaagggtttcctgtgctgtccaagatgcaccagcgcttgatcttccgactccttaagctcgaggtgcagttcataatcacaggtacaaaccatcattcagagaaggaattctgttcgtatctgcagtaccttgaatacctgtcccaaaaccgtccacctcccaatgcatatgaactcttcgccaagggctacgaagactacctccagtcacccttacagccattaatggataatctagagagccagacttatgaagtgttcgaaaaagaccccattaagtatagtcagtatcagcaggctatctacaagtgtttactggacagagtcccggaggaggaaaaagacacaaatgtccaagtgctaatggtgctcggtgccgggagaggtccgctggtaaacgcttctctgagagccgccaaacaggccgatagacggatcaagctctatgccgtcgagaagaacccgaacgctgtcgtaaccttggagaactggcagttcgaggagtgggggtctcaggtgaccgtggtgagcagtgacatgcgcgagtgggtcgcacccgaaaaagcagacattatcgtgtccgagctgcttggttcattcgccgacaacgaattgtcgccagagtgtctggacggtgcccagcacttcctgaaggatgatggtgtttctatacctggggagtacacaagctttctggcacctatttccagttcaaagctctacaacgaagtgcgcgcttgccgtgagaaagatcgcgatcccgaggcccagttcgagatgccctacgtggtgcgcctgcacaactttcaccagctaagcgcccctcagccttgtttcaccttctcacatccaaatagggacccaatgatcgacaataataggtactgcaccctcgaattcccggtggaggtcaataccgtgctccatggcttcgcaggctatttcgagaccgtgctctatcaggacattacgctgagtataagacccgagacacacagcccgggtatgttctcatggtttcccattctcttcccgatcaagcagccaattaccgttcgcgagggacaaactatatgcgtgaggttctggaggtgcagcaattctaagaaggtgtggtatgagtgggctgtgaccgcccccgtatgtagtgctatccataatcctaccgggagaagctacacaattggcctatag

SEQ ID NO: 183297 - DNA, 1206 bp, Artificial Sequence
  Description of Artificial Sequence: Synthetic coding sequence
atgctgggcatcggcaccgagggcccccacgtgggcctggtgcaggcttccgaacaccccaaaatcgagttttatctgaaaaattttacatccgccaaagatgtactcttcgccataaaggaggtgggcttccgtgggggaaactccaataccgatatcacgctggagaagtatctgtttgtgatgcttaaacggagcgaaaaccagcagacatacctcatgaatgccgatgtggcggagagaatgagttccacaactgtcgatagtgaagagcgcctcctacggggaaaagcactgaagcacaccgcacagaagtttttcaccgtcgatgccggcgttaggaaggggattcctaaggtggtggtcgtgttcatcgatggctggccatctgatgatatcgaagaagccggaatcgtcgcacgagaatttggggtaaacgtctttatcgtttcagttgctaaacccatcccggaagagctcggaatggtccaagatgtcacatttgttgataaagccgtgtgtcggaacaatggttttttttcctaccatatgcccaattggtttggaaccactaaatacgttaagcccctagtgcagaagctctgtacacacgagcagatgatgtgttctaaaacatgctataattccgtgaacatcgcattcttaattgatggctcctcgtcagttggtgactcaaattttcggcttatgctggagttcgttagtaatattgctaaaactttcgagatctctgacattggtgccaagattgccgcagtgcaattcacatacgaccagcggaccgagttttctttcacagattactctaccaaggagaacgtcctggccgtaatcagaaacatcagatatatgtcaggcgggaccgccactggcgacgctattagttttaccgtgcggaacgtgtttggacctataagggagagcccaaataagaacttcctggtgatagtgaccgatggacaatcctatgatgacgtccagggcccagctgcagccgctcacgacgcagggataaccattttttctgtcggagtcgcatgggccccactggacgacttaaaagatatggctagcaaacccaaggaatcccatgcatttttcacacgggaattcaccggattagagccaattgtctccgatgtgattagaggcatctgccgtgacttcctggagtcccagcagtag

SEQ ID NO: 183298 - DNA, 1653 bp, Artificial Sequence
  Description of Artificial Sequence: Synthetic coding sequence
atgagcgccgcctggatccccgccctgggcctgggcgtgtgcctgcttcttctgcccggccctgctggaagcgagggtgccgctccaatcgccataacctgcttcactagaggcttggacatacggaaggagaaggcagacgtgctgtgcccagggggttgcccactggaagaattttcggtatacgggaatatcgtgtatgcctccgtgagcagcatctgcggtgccgccgtgcacaggggggtgattagtaactcaggtggcccagtgcgggtgtacagccttcctggtagagagaactattcaagcgtcgacgccaatggtatccagagtcagatgctgagccgctggagtgcctcattcactgtgacaaaaggtaaaagcagtacccaggaggctactgggcaggcagtgtccacggctcacccgcctactggcaagaggcttaaaaaaacgccagagaaaaagaccggcaataaggattgcaaggcggacattgcctttttaatcgatggctcattcaatataggtcagcggcgcttcaacctgcagaaaaacttcgtgggcaaagtcgctcttatgcttggtataggcaccgaggggccccatgttggcctcgtgcaggcctctgaacatcccaagatcgagttctatctaaaaaatttcacctcagctaaggatgtgctgttcgctattaaggaggtcgggtttagaggcgggaattccaacactggcaaagcactgaagcacacagcgcaaaaattctttacggtcgacgccggtgtgcgcaaaggaattcccaaagtcgtagtggtgttcattgatggctggccctccgatgatattgaggaggccgggatagtcgcacgggagttcggggtcaacgtgtttatcgtgtctgtggctaaaccaatccccgaggaactcggtatggtacaagacgtgacattcgttgataaggcagtgtgtcgaaacaatgggttcttcagctaccacatgccaaactggttcgggaccacaaaatatgtcaaacccctagtgcagaaactgtgcacccacgaacaaatgatgtgttctaagacttgctacaacagtgtaaacatagcctttcttatcgacggttcctcctccgtaggagacagtaattttcgactaatgctggagttcgtgagtaatatcgcgaaaacttttgagatctctgacattggggcgaaaatcgcagccgtgcaattcacctacgaccagcggaccgaatttagctttacagattactccacgaaagaaaatgtcctcgcagtcataaggaacatccgttatatgtctggcggaaccgctaccggcgatgctatttcattcactgttagaaatgtgtttggtcccatccgtgagtcgccgaataaaaactttctagtgatcgtcacagatggacagtcatacgacgacgtgcagggtcctgcagccgccgcccatgacgccggtatcacaatatttagcgtaggtgtggcatgggccccactggacgatctgaaggacatggcctctaaacccaaggagtcacatgctttctttactagggaattcacaggattagagccaattgtgtctgatgtcatcagagggatttgtcgcgacttcctggagtcccaacagtag

SEQ ID NO: 183299 - DNA, 732 bp, Artificial Sequence
  Description of Artificial Sequence: Synthetic coding sequence
atgctgagccggtggagcgccagcttcaccgtgaccaagggcaagagttccacccaggaggcgactggacaagctgtctctacagcccatccgccaacggggaaaaggctgaaaaagacacccgagaaaaagactggcaacaaagactgcaaggcagacatcgcatttctgatcgacggctcgtttaatatagggcagagacgatttaatctgcagaaaaactttgtagggaaggttgccctgatgctggggattggcacagaaggcccccacgttggacttgtgcaagcctcagagcatcccaagatagagttttacctaaaaaacttcacctctgcgaaggatgtgctgtttgccattaaggaggttggtttccggggaggtaactcaaacaccggaaaggccctgaaacacacagcacagaagttttttaccgtggacgcgggagttcgcaaaggaatccctaaagtggtggttgtgtttatcgacggctggccttctgacgatatcgaggaagccggcatcgttgccagggagttcggggtcaacgtgttcatcgtgagcgtagccaaacctataccagaggagcttggaatggtgcaagacgtgacatttgtcgataaagcagtgtgtaggaacaatggcttcttttcttatcacatgccaaattggtttgggactaccaagtatgtcagcttatggtatcggagttgcgccctcatgaataaatag

SEQ ID NO: 183300 - DNA, 1278 bp, Artificial Sequence
  Description of Artificial Sequence: Synthetic coding sequence
atgggcccccggcggctgctgctggtggccgcctgcttcagcctgtgtggacccttgctgtcggcaaggacacgcgccaggaggcctgaaagcaaggcaaccaatgctacactcgatccacgatccttcctgctcagaaatccaaacgataaatatgaacctttttgggaggacgaagagaagaacgaaagtgggctgaccgaatataggttagtttcaataaacaaatcctctccactgcaaaagcagctgcctgcttttatctccgaagatgcttcaggctacctgacatcatcatggctgacccttttcgttccatctgtttatactggagtttttgtagtatccttgcccctcaatattatggccatcgtggtgttcatcctgaaaatgaaagtaaaaaagcctgctgttgtgtatatgctgcatctggctacagcagacgtcctgttcgtctctgtgctgccatttaagattagctactatttctcaggctccgactggcagttcggctccgagctgtgtcgattcgtcacggccgcattctactgcaacatgtatgcgagtatattgctgatgaccgtcatttcgatcgacaggttcttggctgtggtatatccaatgcagagtctgtcttggcggacattaggccgcgctagttttacgtgtcttgccatctgggccctggccattgctggcgtggtgcctcttttgctcaaagagcagaccatccaggttccagggctgaacatcaccacatgccacgacgtgctaaacgagaccctgctggaaggctactatgcatattatttctctgcgttcagcgccgtgttcttttttgtgcctctgatcatttcgacggtttgctatgtgagtatcattcgctgtctgagcagcagtgcagtggcaaacagaagtaaaaagtctagggcactcttccttagcgcagccgtgttctgcatctttatcatttgtttcggaccgaccaatgttctgctgatcgcacattacagcttcctgtcacacactagtactactgaagcagcatacttcgcctacctactgtgcgtgtgcgtcagttctatttcatgttgtattgacccccttatttactactatgccagttccgaatgtcagaggtacgtgtactccatcctgtgttgcaaagaaagcagcgatccttcttcttacaattcatcaggtcagctaatggcttccaagatggacacctgtagttctaacctgaacaacagtatctacaagaagctgctgacttag

SEQ ID NO: 183301 - DNA, 1194 bp, Artificial Sequence
  Description of Artificial Sequence: Synthetic coding sequence
atgcggagccccagcgccgcctggctgctgggcgccgccatcctgctcgccgcctctctttcctgttcaggcaccatccagggaacgagccgcagttctaaaggaagatctttaatcggcaaagtggatgggacgtctcacgtcacaggaaaaggcgtcactgttgaaaccgtgttctcagtcgatgagttcagcgcgagcgtgctcaccgggaagcttactacggtgttccttcctatcgtctatactatagttttcgttgtcggactgcctagcaacggtatggctctttgggtgtttctttttaggaccaagaagaagcaccccgctgtgatctatatggcgaacctggcacttgccgacttgctcagtgtgatatggtttcccctcaagatcgcctatcacattcacggtaacaattggatttatggggaggccctatgcaatgttctcattgggtttttttacggtaacatgtactgctcaatactgtttatgacttgcctctctgtccagcgatattgggtgatcgtcaaccctatgggtcacagtcggaagaaagccaatattgcaattgggatttccctggccatctggctccttatcttgctggtcacgatcccactgtatgtggtcaaacagaccatttttattcctgccctcaacatcacaacctgccatgatgtgttgcctgaacagctgctggtgggtgacatgttcaactacttcctcagtctcgcaattggtgtgttcctttttccagcctttctgaccgcctcggcctacgtattgatgattagaatgctgcgctcctctgccatggatgagaatagtgagaaaaagcgcaagcgggcgattaagctgatcgtgacagtgctcgctatgtaccttatttgtttcacaccctcaaatctgcttctggtggtccactatttcctaataaagagccaggggcaaagtcacgtgtacgcattatacattgttgccctttgtctatctaccctgaactcttgtattgatccatttgtgtactattttgtgagccatgacttccgggatcatgcaaaaaatgccctcctctgcaggtctgtgaggactgtgaaacagatgcaggtgtctcttacaagcaagaagcactctaggaagtcatcatcttacagttcctcttctaccacagtgaaaacaagttattag

SEQ ID NO: 183302 - DNA, 1125 bp, Artificial Sequence
  Description of Artificial Sequence: Synthetic coding sequence
atgaaggccctgatcttcgccgccgccggcctgctgctgctgctgcctaccttttgtcagagtggaatggagaacgataccaacaaccttgccaaacctaccctgcccatcaaaacctttagaggcgctcctcccaacagcttcgaagagtttccctttagcgccctcgagggctggactggcgcaaccatcaccgtgaaaataaagtgccccgaggagagcgcctctcatctgcacgtaaaaaatgccactatgggctacctcacctccagcctgtctacaaaattgatacccgctatttaccttctcgtttttgtggttggtgtgccggccaacgccgtgacactctggatgctgttcttccgaacgcgatctatatgtaccaccgtcttttacaccaatctggctattgccgactttcttttttgcgttactttgccttttaaaatagcctaccatctgaatgggaataactgggtgttcggagaggtgctttgtcgggcaactacagtgattttctatgggaatatgtactgttccatcttgctgctcgcatgcatttctatcaataggtacctggctattgtccatcccttcacctaccggggcctgcccaagcatacctatgcgctcgttacgtgtgggcttgtgtgggcaactgtgttcctctacatgctgcctttcttcatccttaagcaggagtactatctagtgcagccggacataactacatgccatgatgtgcacaacacttgcgagtcatcctcgccgttccagttatattactttatcagcctagccttttttggcttcctgatcccattcgtactcattatctactgttatgccgccataatacggactctgaacgcctacgatcacaggtggttgtggtacgtgaaagcatcccttcttatcttagttatcttcactatctgtttcgcaccatctaacattattctcataatccatcatgctaattactactataacaacacggatggtctgtactttatctacctaatcgcactttgcctgggaagcctgaacagctgtctggatccttttctttacttcctgatgagtaagacacggaaccacagcactgcctacctgaccaagtag

SEQ ID NO: 183303 - DNA, 1059 bp, Artificial Sequence
  Description of Artificial Sequence: Synthetic coding sequence
atggagaacgacaccaacaacctggccaagcccaccctgcccatcaagacttttaggggggccccgccaaatagctttgaggagtttcccttcagtgctctagaaggctggaccggtgctacaattacagtgaaaataaaatgccctgaggaatccgcaagccatcttcatgtaaaaaatgctacgatgggttacttgacctcctccctttcaacgaaacttataccagctatttacctgctggtttttgtcgtgggggttcctgccaacgctgttacactgtggatgttgttcttccgcactcgatccatctgcaccactgtgttctacaccaacctcgccatcgctgactttctgttttgcgttacactgccattcaaaattgcctatcacctaaacggtaacaactgggtttttggtgaggttctgtgccgcgctaccacagtcatcttctatggcaatatgtactgctccatcctcctcctggcctgtattagcattaaccgttacctggcgatcgtgcacccattcacctatagagggttgccaaagcacacatatgccctcgtgacgtgtggcctcgtctgggctaccgtgtttctgtacatgcttccatttttcattttaaagcaggaatactatctggtgcagcccgacatcacaacatgtcacgacgtgcacaatacgtgtgagagcagttcacctttccagctgtactactttattagtctggctttcttcggattcctgataccattcgtgctgataatctattgctacgcagctattatacggacactgaatgcatacgaccatcgctggctgtggtacgtaaaagcatcactccttatccttgtcattttcacgatttgctttgctccctcaaatataatactgattattcaccacgcaaattattactacaataacacagacggcttgtacttcatctacctcattgctctgtgcctgggaagcctgaacagctgtttggatccattcttgtactttctgatgtccaagacacgtaaccactcaactgcctatcttacaaagtag

SEQ ID NO: 183304 - DNA, 1158 bp, Artificial Sequence
  Description of Artificial Sequence: Synthetic coding sequence
atgtggggccggctgctgctgtggcccctggtgctgggcttcagcctctcaggcggaacacagacaccgtccgtatatgatgagagcgggtctactggcgggggggacgactcaactccctcaatattgcccgcccccagggggtatcccgggcaagtgtgtgcaaatgacagtgacacgttagaattgccagactccagtcgcgccctgctcttgggttgggtgcccaccaggctcgtacccgccctctacggcctagtgttggtagtcggactgcccgcaaacggtctcgcgctgtgggtccttgctacacaggcacctcgtctcccctcaactatgctgctgatgaaccttgctgccgctgacctgttgctggcattggcactgcctccaaggatagcctaccacctcagaggccagagatggccctttggagaggctgcatgtaggctcgcaactgcggcattatacggccatatgtacgggtccgtcctattactcgccgccgtgtcccttgaccgatatcttgctttagtacacccattgagggcccgcgcactgcgagggaggcgtttagctctgggattatgtatggcggcttggctgatggccgcagccttagcgctacccctcaccctccaaaggcagacattcagacttgctaggtcagaccgggtactgtgtcacgatgccctgcccctggacgcacaggcgagtcactggcagccagccttcacttgtctggctttgctgggttgcttcctgccactattggccatgctcttgtgttacggagccaccttgcacaccctcgctgcctccggacgcagatatggccatgcactgaggttgacagccgttgtgctcgcatccgctgtcgcttttttcgtcccaagtaacttgctactgttactgcactattctgacccaagcccatcagcatggggcaacctatatggcgcttatgtccctagtctggccctctccacgctcaatagctgcgtcgatccattcatctactattacgtgtcggctgaattcagggataaggtgcgggcgggattgtttcagcggtctcccggcgacacagtggctagtaaggccagtgccgaaggaggttcaagggggatgggaacacacagcagcctactgcagtag

SEQ ID NO: 183305 - DNA, 1848 bp, Artificial Sequence
  Description of Artificial Sequence: Synthetic coding sequence
atgcgggccctgctgctgctgggcttcctgctggtgagcctggagagtaccttgagcatacccccctgggaagcaccgaaagagcacaaatacaaggccgaggagcatacagtagtactaaccgtgacgggcgagccttgccactttccatttcaataccatcggcaactttatcacaagtgtacacataagggcaggccagggcctcagccctggtgcgccactacccccaactttgatcaggaccaaagatgggggtactgtttggagccgaaaaaagtgaaggaccactgtagcaaacacagtccctgccagaagggcggaacgtgtgtgaacatgccaagcggaccacattgcctgtgtcctcaacacctgacaggcaaccactgccagaaggagaagtgcttcgagccgcagctactgagattttttcataaaaacgagatctggtacagaaccgaacaagcggccgtggcacggtgccaatgtaagggaccagacgctcattgtcagaggcttgcctcacaggcatgcaggaccaacccctgcttgcatggagggagatgcctggaggtggaaggtcaccggttatgtcactgcccagtgggttataccggagccttttgcgacgtggacactaaggcaagttgctacgatggcagagggctcagctatcgcggtttggcaagaacaaccttgtctggcgcgccttgccagccttgggcttccgaggccacttataggaatgtaactgcggagcaggctcggaattggggtctcggtggtcacgccttttgccgcaatccagataacgatatcagaccctggtgttttgtgttaaatcgagatcgcctctcttgggagtactgcgacctcgcacagtgtcaaacaccaacacaagctgctccaccgacccccgttagcccccgactgcacgtgccgttgatgcccgctcagcctgctccacctaaaccccagcctaccacacgcacgccaccccagagccagacccccggcgctctgcccgctaaacgcgaacagcccccatctttgacgagaaacgggcctctgtcttgcggacagaggctccggaaatccttgagtagcatgacccgggttgtgggcggcctggtggctctccgcggtgcccacccgtacatagcagccctatattgggggcatagtttctgcgcagggagcctgattgctccctgttgggtgttaaccgcagcgcactgtctccaggatcgccccgcaccggaggatctcacggtggtgctgggccaggagaggaggaaccatagctgcgagccatgtcagaccctggccgttagatcctatagattgcacgaagccttctctcctgtttcttaccagcacgacctcgccctgctccgactgcaggaggacgccgacggaagttgtgctcttctctcgccctacgtccagcctgtttgtttacctagcggtgccgccaggcccagcgaaacaactctgtgccaagtcgctggctggggacaccaattcgagggagctgaggaatatgcatccttcctgcaagaagcccaggtcccattcctgtcacttgagcgttgctccgcaccggatgtacatggaagcagcatactgcccggcatgttgtgtgctggctttctcgaaggggggacggatgcctgtcagggcgattccggcggcccgctggtgtgtgaagaccaagcggctgagcggcgcctgacactgcaggggatcatcagctggggttctggctgcggggaccggaataagccaggtgtctatactgacgtggcttattacctcgcttggattagggagcatacagtttcctag

SEQ ID NO: 183306 - DNA, 1986 bp, Artificial Sequence
  Description of Artificial Sequence: Synthetic coding sequence
atgcggctgaagaacctgaccttcatcatcatcctgatcatcagcggcgaactttatgcagaggagaagccatgtgggttcccccacgtcgagaacggccggatcgctcaatactactatactttcaagagtttctacttcccaatgtcaatagacaaaaaactctctttcttttgtctcgccggctacaccacagaaagcggcagacaggaggaacagaccacatgtaccaccgagggatggtcccccgagccaagatgctttaaaaagtgcaccaaacccgaccttagtaatgggtatattagtgatgtcaaactgttgtacaagattcaggagaatatgagatacggttgtgcatccggatacaaaacaacagggggaaaagacgaggaagtcgtacagtgcctaagcgacggctggtcctcccagcctacctgtcgcaaagaacatgagacttgtctcgcccccgagctttacaatggtaattacagcacaacacaaaagacattcaaagtgaaagacaaggtacagtatgaatgcgcgacgggctactacacggcaggaggcaagaaaaccgaggaggtggagtgtcttacttacggctggagcctgacacccaagtgcactaagctgaaatgttccagcctcagactaattgagaacggttatttccatccagtgaaacaaacttacgaagaaggtgacgtagtacagttcttttgtcatgagaattattatctgagcggatcagatctaatacagtgctacaattttggctggtacccagagagtcccgtttgcgagggaaggagaaaccgctgcccacccccccccctgccaatcaattcaaagattcagactcacagtacgacttaccgccatggggagatagttcatattgagtgtgaactgaattttgaaattcatggtagcgcagaaattaggtgcgaagatggaaaatggacagagccccctaagtgcatcgaagggcaggaaaaggtcgcctgtgaagagccaccttttattgagaatggcgccgccaatttgcactcaaagatctattacaacggcgataaagtaacatacgcctgcaaatctggctatcttctgcacggaagtaacgaaatcacctgcaacaggggtaagtggacactgccccccgagtgcgtcgaaaataatgagaattgtaaacacccccctgtcgtgatgaatggtgcggttgccgatggcatcctggcgtcctacgctacaggtagtagtgtggaatacagatgtaatgaatattatcttctcaggggcagcaagatctcccgctgtgagcaggggaagtggtctagcccaccggtgtgtctggagccatgcacagtgaacgtggactatatgaacagaaacaacatcgagatgaaatggaagtacgaaggcaaggtgcttcacggggacctaatcgatttcgtgtgcaaacaggggtatgaccttagccctctgactcccctatctgagctaagcgtgcaatgtaatcgcggggaggtgaagtatcccctctgcacacggaaagagtcaaaagggatgtgtacctcaccgcctcttattaaacatggggtgataatatcctcgacagtggacacatacgaaaacggaagcagcgtcgagtatcggtgtttcgatcatcacttcttggaaggtagtcgggaggcatactgtctcgatggcatgtggaccacaccgccactttgcctggagccatgcactctgagctttacagagatggaaaagaataacctgctgctgaagtgggatttcgacaaccgtccacacatcctacatggggaatacattgagttcatatgtaggggggatacttatcccgcagagctatacataactgggtccatcctgcgaatgcagtgcgatcgggggcaattaaaataccccagatgtattcctcgccagtctaccctgtcataccaagagccacttagaacctag

SEQ ID NO: 183307 - DNA, 3675 bp, Artificial Sequence
  Description of Artificial Sequence: Synthetic coding sequence
atgctgaccaagttcgagaccaagagcgcccgggtgaagggcctgagtttccatccaaagaggccttggattttaacatccttgcataacggcgtgattcagctgtgggactacagaatgtgcactcttatagataagtttgacgaacacgacgggccagtgagggggatcgacttccataagcaacaaccgttgttcgtatcaggaggggacgattacaaaattaaggtctggaattataaacttaggagatgcctctttactttactcgggcacctggactacatccgcactacattcttccaccacgaatacccatggatcttatccgccagtgacgaccaaaccattcgggtgtggaactggcagtccagaacttgcgtatgcgtgctgaccgggcacaatcactatgtgatgtgcgcacaatttcaccctactgaagacctggtggtctccgcctcacttgaccagacagtaagggtgtgggacatctctggcctgagaaagaagaatctaagtcccggggccgtcgagagtgacgtcagaggaatcacaggggtggaccttttcggtaccacagacgctgtggtgaaacacgtcctggagggccatgacaggggagtcaactgggcagcatttcatcccaccatgcctcttattgtgagtggcgctgatgatcgtcaagtcaaaatatggaggatgaacgagagcaaagcctgggaagtggatacttgtaggggacattataataatgtcagctgcgcggtgttccacccacgacaggagctgatcctgagcaactcagaggacaagtccatcagagtctgggatatgagcaagcgcacaggggttcagacctttcgaagggaccatgatcggttttgggtcctcgcagcccacccgaatttaaacctgtttgccgctggacatgatggaggaatgattgtttttaagctagagcgcgagcgccctgcctatgccgtccacggcaatatgctacactatgtgaaggatcgcttccttcgtcagctggatttcaatagttccaaggatgtagctgtgatgcaacttagatcaggttccaaatttcccgtgttcaacatgagttacaatcccgccgaaaatgcggttctgctctgcacacgcgccagcaatctggaaaatagtacatacgacttgtacactatcccaaaggacgccgattctcagaatcccgacgctcctgaggggaagcgcagtagcgggctcacggcagtgtgggttgccaggaatcgcttcgcagtgctggaccgaatgcactccctgctgatcaagaacttgaagaatgaaattaccaagaaagtccaggtacccaattgcgacgagattttctatgcgggtactggtaacctgcttttaagggatgcagactccattacactattcgacgtgcagcagaaaaggaccctcgcctctgtgaagatcagtaaagtgaaatacgtaatctggtcagcagatatgtcacatgttgccctgctggctaagcacgccatcgttatctgtaatcgtaagctggatgcattatgcaacatccatgagaatatcagagtcaaatccggcgcttgggatgagtctggcgttttcatatataccacatctaaccatattaagtatgcagtaaccacaggcgaccacggcattatccgcacactggatttgccaatttacgttacccgggtcaagggaaataatgtttactgcctagaccgcgaatgtcgaccgcgtgtgctgacgatcgacccgacggagtttaaatttaagctggccttgatcaaccggaagtacgatgaagtcctacatatggttcgcaacgctaaactggtgggacaatctattattgcctacctacagaaaaaaggataccctgaagtggccttgcatttcgttaaggatgagaagacgcggttctcactggcgctggagtgcggcaacatcgaaatagccctcgaggctgcaaaagccctagacgataaaaattgttgggagaagctgggggaagtagcactgcttcagggaaatcaccaaatcgttgagatgtgttaccagaggacaaaaaatttcgacaagctttctttcctgtacctaatcactggcaacctggaaaagctgcgaaaaatgatgaagatagcggagattagaaaggacatgtccgggcactatcagaacgccctttatcttggcgatgtctccgagagagtgaggatcctgaagaattgtgggcagaagagcctcgcctatctgacagctgccacgcacggcctagatgaagaggctgaatcactcaaagagaccttcgatcctgaaaaggagactattccggatattgatcccaacgctaagcttttgcagcccccagcaccgattatgcctctcgataccaactggccactgctaaccgtcagtaagggtttttttgagggcactattgccagcaagggaaaggggggtgcactggcggcagacatcgacattgatacggtcgggaccgaaggatggggggaggacgcagagctccagctggatgaagacggatttgtggaggctacagagggtctcggtgacgacgccctcggcaagggccaagaagagggtggtggttgggacgttgaggaggacctggagttaccccctgaattggatattagtcccggtgccgctgggggcgcagaagacgggttttttgtacctccaaccaagggtacaagtccaactcaaatatggtgtaacaatagccagctgcccgtggaccatatcctcgctggctctttcgaaactgcaatgcgtctgctccacgatcaggttggggtgattcagttcgggccctacaaacagttgttcttgcagacatacgcccggggtcgtacgacataccaagctttgccctgcctgccctccatgtacggatatcccaatcgcaattggaaggatgcaggcctcaaaaacggagtcccagcggttggtctgaaactgaatgatctgatccagcggcttcagctgtgctaccagctaaccaccgtgggtaagtttgaagaggccgtggagaaattcaggtctattctgctgtctgtcccactgttggtggtggacaataagcaggagattgcggaggcccagcaattgattacaatctgccgcgaatatattgtgggactgagcgtggagaccgaacgtaaaaagcttccaaaggagaccctcgaacaacagaagcgaatctgcgaaatggctgcgtacttcacgcattctaatctccagccggtccatatgattttagtacttcggacagccctgaacttgttctttaaactgaagaatttcaagactgcggccacctttgcacgccggttgttagagctggggcccaaacccgaggttgcacagcagacaagaaagatcttaagcgcatgtgaaaagaacccaacagacgcataccagttaaattatgacatgcacaatccttttgatatttgcgccgcatcttaccgcccgatctatcgcggaaaaccagtggaaaagtgcccactatccggagcctgctattctccagagttcaagggacagatttgtagagtcactaccgtcaccgagatagggaaggatgtaatcgggctacgtattagcccactgcagtttaggtag

SEQ ID NO: 183308 - DNA, 3702 bp, Artificial Sequence
  Description of Artificial Sequence: Synthetic coding sequence
atgctgaccaagttcgagaccaagagcgcccgggtgaagggcctgtcctttcaccccaagcggccatggatcctcacctcattgcacaacggcgtgattcagctgtgggactaccgtatgtgtacactgatcgacaaatttgatgagcatgatggtcctgttcgcgggattgattttcacaaacagcaacccctgttcgtgtccggcggagacgattacaagatcaaagtgtggaattataagttgcgtaggtgtcttttcactctcctggggcacctcgactacataagaacaacgtttttccaccatgaatatccttggatactgagcgcttccgatgatcaaaccatcagggtgtggaactggcagtcccgtacttgtgtgtgtgtgctgacaggacacaatcactacgtgatgtgtgctcagttccaccccaccgaggacttggtggtaagcgctagccttgaccagaccgtcagagtgtgggatatttcaggattgaggaagaaaaatctgtctccaggagcggtagagagtgacgtgcgcggaattacaggggtcgacctcttcggtactactgacgcggtggtgaaacatgtattggaaggccacgacagaggagttaactgggctgcatttcatcccaccatgcctttaatcgtgagtggggctgatgatcggcaggtcaagatctggaggatgaacgagtccaaggcatgggaagttgacacttgcagagggcattacaacaacgtatcctgcgcagtattccacccgcgacaggagttgattctgtccaacagcgaggataaaagcattcgcgtatgggatatgtcaaaaaggactggtgtacagacctttcgcagagatcacgatcgtttctgggttctggcagcccaccctaaccttaatctttttgccgcagggcatgatggagggatgatagtctttaagcttgagagggaacggccagcttatgccgtgcatggaaatatgctccattacgtgaaggatagatttctccggcagctggacttcaactcctcgaaagacgtggccgtgatgcagttgcggtcaggatccaaatttcccgtgttcaatatgagctacaaccctgcggagaatgccgtgctcctgtgtacccgggcatctaatctggagaacagtacctatgatttgtacaccatccccaaggacgcagactctcagaacccagatgcaccggagggtaaaaggtcaagcggcttgactgccgtttgggttgcgagaaatcgattcgctgttttggataggatgcacagcctgctgattaagaaccttaaaaacgagatcactaagaaagtgcaggtccctaattgcgacgagatcttctatgccgggaccggcaatcttcttctgcgtgatgccgacagcattaccctgtttgatgttcagcagaaacgcaccctggcttccgtgaagatctcaaaggttaagtatgttatctggtcggctgatatgtcccacgtggcactgctcgcgaaacacgaacatagttgcccgttacccttgacagccatagttatctgcaatcggaagcttgatgccctgtgtaacattcatgagaacatacgcgtgaagtctggggcctgggatgagtctggcgttttcatttacaccacctccaatcatataaagtatgccgtgaccactggggatcatgggatcatccggaccctcgacctgcccatttacgtgactagagttaaggggaacaacgtatactgtctggatagagaatgccgtcccagagtgctgaccatcgatcctaccgagtttaaattcaagctggctcttatcaatcgaaaatacgatgaggtcctgcacatggttcggaacgcgaagctggtcggacagagcatcattgcctacctccagaagaaaggctaccccgaggtcgctttacattttgttaaggatgaaaagacgagattctccctggccttagaatgtggcaatattgagattgcactggaggctgctaaggcactggatgataaaaattgttgggaaaagctgggagaggtggccctgttgcagggcaatcaccaaatagtggagatgtgctatcagcggaccaagaacttcgacaaactgtcattcctctatttaattacagggaatttagagaagcttagaaagatgatgaaaattgccgagattcggaaggacatgagtggacactaccagaacgccctgtacctcggggacgtgtccgaacgtgtacggatcttaaagaactgtggtcagaagtctctggcatacctcacagcggccacccatggcttggatgaggaagcagagtctctcaaagagacttttgaccccgagaaagagacaattcccgacatagaccctaacgccaagctgctgcagcctccggcgccaattatgccgttagataccaactggcccttgttgaccgtaagtaagggtttttttgaaggaaccatagcaagtaagggcaaaggaggagctctggctgctgatatcgatatcgacactgtggggacagagggatggggagaggatgctgagcttcaactagatgaagacggattcgtcgaggccaccgaaggactgggtgatgatgccctggggaaaggacaggaggaaggcggaggctgggacgttgaagaggatctcgaactgccccctgagctcgatatctctcccggggcagctgggggtgcagaggacggctttttcgtgccccccactaaaggcactagccccactcaaatctggtgcaataacagccaattaccggtcgaccatattctcgctgggtcatttgagaccgccatgcgcctgttacatgaccaggtgggtgttatacagttcggcccctacaagcaactcttcttacagacctacgcacgggggcgtacaacataccaggctcttccttgcctgcccagcatgtacggttaccccaaccgaaattggaaagacgcgggtctgaaaaatggtgtcccggcagttggcctgaaattaaacgatctgattcagcgcctgcaactttgttatcagctcaccactgtgggaaaattcgaggaggctgtagagaaattccggagcatcctgttatcagtcccactcctggtcgtcgacaacaaacaggaaattgccgaggcacagcagttaatcacaatctgcagagagtacatcgtaggcctttccgtggagactgagcgaaaaaaattgccaaaggaaaccctagaacaacaaaagcggatctgtgagatggccgcttactttacacacagcaacctgcagcccgtgcatatgatcctggtcttacgcacagcactcaatctcttctttaagctgaagaatttcaaaacagccgctacgttcgctcgcaggttgcttgaattgggacctaaacctgaggtggctcagcagaccagaaaaatcctcagcgcatgtgaaaaaaacccgactgacgcctaccagctgaattatgacatgcataacccctttgacatttgcgccgctagctatagacccatttaccggggcaagccagtggaaaaatgtcctcttagcggtgcctgctattcacccgagtttaagggccagatctgtcgtgtcaccactgtgacagagataggaaaggacgttataggactgaggatcagtccactgcaatttcgctag

SEQ ID NO: 183309 - DNA, 2862 bp, Artificial Sequence
  Description of Artificial Sequence: Synthetic coding sequence
atgaccgccgccgagaacgtgtgctacaccctgatcaacgtgcccatggattccgaacccccaagcgaaatctcgcttaaaaatgatctcgaaaaaggagacgtcaaatcaaagaccgaagccttaaaaaaggttatcattatgatcctgaatggcgaaaaactccctggactgttgatgactattattagatttgtcctgccgttacaggatcacacaatcaaaaagttgctcttagtgttttgggagatagtgccgaagaccacccccgacggcagactgctgcatgaaatgatcttggtctgcgatgcttatagaaaggatttgcaacatcctaacgaattcattaggggttctacactacgttttctgtgcaaactgaaagaagcggaattactggagccattaatgccagcgattagggcctgtttagagcaccggcacagctatgtgagaaggaatgctgtgctggctatttacacaatctacagaaatttcgaacatctgattcccgatgccccggaattaatccacgatttcctcgtcaacgaaaaagacgcttcttgtaaacgcaacgccttcatgatgcttatacacgccgaccaggacagagctctggattatctgtcaacctgtattgatcaggtgcagaccttcggagatattttacagctggtgattgtggagttaatctataaagtctgccacgctaacccttcagagagagcccggtttatcagatgtatctataacctgctgcaatcgtcatctccagccgtcaaatacgaggccgctggcaccctggttaccctgagctccgcacctacagcaatcaaggctgcagcgcagtgttacatcgacttgatcatcaaagaatcagataacaatgtgaagttaatcgtgctcgacagattaattgaattgaaagaacaccccgctcacgagcgggtgttacaagacttagttatggatatcctgagagtgctttctactcctgacctggaagtgaggaagaagaccctgcaactcgctcttgatttagtgagctctaggaatgttgaggaactagtgatcgtcttgaagaaagaggttatcaagacaaataatgtctcggagcatgaggacactgacaaatatcgccagctgctggtacggacgctacatagctgctctgttcgcttccccgacatggccgctaatgtcattcctgtgctgatggagttcctcagtgataacaacgaggcagccgccgcggacgtgcttgaattcgtgcgggaagcaatacagcgtttcgacaatctgcggatgctgattgttgagaagatgctcgaggtttttcacgctattaaatccgtaaaaatttacagaggcgctctctggatcctgggcgagtattgtagtacaaaagaagacatacaaagtgtgatgacagagataagacggtcgctcggagaaattcccatcgtggagagcgaaataaagaaagaagccggcgaactaaagcccgaagaggaaatcacagtgggtcccgtgcagaaactagtaacggagatgggaacctacgctacccaaagcgccctgagcagctcacgtcctaccaaaaaagaagaggacaggccacctctacgcggctttctcctggacggggatttctttgtggcagccagtctcgccactacccttaccaagattgccctccggtacgtggctctagtgcaggaaaagaaaaaacagaactcgttcgtcgctgaggcgatgctcctgatggccactattttgcacctgggaaagagcagcttgcccaagaaaccaatcactgatgacgatgttgaccgtatcagcctctgccttaaggtgctgtctgaatgttcccccctcatgaatgatatttttaataaggagtgtaggcagtccctatctcatatgctaagtgcaaagcttgaagaggaaaagctttcccaaaaaaaagagtcagaaaagcggaatgtaaccgtacaaccagacgatcctattagttttatgcagctgactgctaaaaatgagatgaactgcaaagaggaccagtttcagctcagtctcctggccgccatgggcaacactcaacggaaagaagccgctgatccgctcgcaagcaagctaaataaggtcacccagctgaccggcttctccgacccagtatatgctgaagcttatgttcatgtgaaccagtacgatatagtcctagatgtactcgtagtgaaccagacctcagatacgctgcaaaattgcaccctcgaactggctacactgggtgatctgaaactggttgaaaagccgagcccactgaccctggcaccacacgactttgctaacatcaaggccaatgttaaggtggctagcacggaaaacggtatcatctttggcaatattgtgtacgatgtatcaggagcggccagcgaccggaactgtgtggtgctctcagatatccatattgacatcatggattatattcaacccgctacttgcactgacgccgagtttcgtcagatgtgggccgagttcgagtgggagaacaaggtgaccgtcaacactaatatggtggacctgaacgactatctccagcacatcctcaaaagcactaacatgaagtgtctgacccccgaaaaggcgctgagcggctactgcggattcatggccgctaatctctatgcccgaagtatctttggtgaagacgcgctagcaaatgtttccatcgagaagcctattcatcaaggccccgacgccgcagtcactgggcacatccggatcagagcaaagtctcagggaatggctctgtcactaggcgataagattaacctgtcacaaaaaaagacaagcatttag

SEQ ID NO: 183310 - DNA, 2862 bp, Artificial Sequence
  Description of Artificial Sequence: Synthetic coding sequence
atgaccgccgccgagaacgtgtgctacaccctgatcaacgtgcccatggacagtgaacccccctccgaaatttccctgaagaatgatctggaaaaaggcgatgttaaaagtaaaactgaagcacttaaaaaggtcataatcatgatcctcaacggagagaaactcccagggcttctgatgaccattattaggttcgtgcttcccttacaggatcataccataaaaaaacttctcttggtcttttgggagatcgtgccgaagacaacccctgatggcagattgttgcacgagatgattttggtgtgcgatgcttaccgcaaggacctccagcaccctaatgagttcattagaggtagcacactaaggttcctttgcaaactgaaggaggctgaactgctggagccactcatgccagcgataagggcctgtctcgaacatcgtcactcctacgtgagaaggaacgcagtattagcaatatatactatctatcgcaactttgagcatctgattcctgacgcccctgagttaattcacgactttctggtgaatgaaaaggatgcatcatgtaagcggaatgccttcatgatgctcatacatgccgaccaggacagggcgcttgactatctcagcacttgcatagatcaggtgcaaacattcggggatattctgcaactggtgatcgtggagcttatctataaggtctgccacgcgaatcccagcgaaagggctcgctttattcgatgtatttacaacctgttgcagagcagctcccccgcagtcaaatacgaggcagctggcactctcgtaactctctccagcgctccgacagctattaaagcagccgcccagtgttacatcgacctcatcattaaagaatcagataataacgtcaaacttatcgtgctggacaggctcatcgaactaaaagaacaccctgcccacgagcgtgtgttgcaggacttagtcatggacatcctgagggttctgagtacaccagacctggaagtgcgaaagaagactttacagctggctctggacctggtgtcctctcgcaatgtggaggaactcgtcattgtgcttaagaaagaggtgatcaaaaccaacaatgtctcagaacacgaggatacagataagtatagacagctgctggttcggacattacacagctgcagcgtgcgttttcctgatatggctgccaacgtaatccctgtcctgatggagttcctgtctgacaacaatgaagccgctgccgcagatgtactggagttcgtgagagaagcaatccagcggttcgataatctacgcatgcttatcgtggaaaagatgctggaagtgttccacgcaattaagtccgttaaaatctaccgcggcgctctctggatcctcggagaatactgctccacaaaggaggacatccagagcgtgatgacagagatccgccggagcttaggtgaaattcctattgtcgaatcagaaattaaaaaggaagctggcgagctgaagccggaagaagagattaccgtcggtcctgtgcagaagcttgtgacagaaatgggaacctacgccacacagtctgccctatccagtagccgacctaccaagaaggaagaggataggccccccctccgtggcttcctgcttgatggggattttttcgtcgctgcctccttggcgaccaccctgacaaagattgcacttcgctatgtggcactggtccaggaaaagaaaaaacagaacagcttcgtcgcagaggccatgttgttgatggctacaatcctccatttgggaaaatccagcctgcccaagaagcccataaccgatgatgacgtcgatcgcatcagtctgtgtttaaaggtcctctccgaatgtagccctctgatgaatgatatctttaacaaagagtgtcggcagagcttgagccacatgctgtcagcaaaactggaagaagagaagcttagccaaaaaaaggagtcagaaaagcgcaatgtgacagtccagcctgacgaccctatatcgttcatgcaactcaccgccaaaaacgagatgaattgtaaagaagaccagttccagctctctctgctggccgcaatggggaacacgcaacggaaggaggctgcagaccccctggcgtcaaaactgaataaggtgacgcaactaaccggtttttcagatccagtctatgcggaagcatatgtccacgttaaccagtacgacatagtcctggacgtacttgtggtgaaccagacaagcgacacactccagaactgcacactggagctcgccactctcggagacctcaagttggtcgagaagccgtccccgctgacactggcgcctcacgatttcgctaatattaaggccaacgtgaaggtggcctcaactgaaaacggtatcattttcggcaacattgtgtacgacgtctccggggccgcctcagacaggaactgtgtggtgctatcagacattcacatcgatataatggattacattcaacctgcaacctgtaccgacgctgaattccggcagatgtgggccgagtttgagtgggaaaataaagtgactgtgaacactaacatggtggatctgaatgattacctgcagcatatcttaaagagcacaaatatgaaatgccttacccccgaaaaagccctctccggctactgcggatttatggccgcaaatctgtacgcccgtagcatctttggcgaggacgccttggctaatgtctccatcgagaagcccatccatcagggtcctgacgccgccgtgaccggccacattagaattagggctaagtcccagggaatggcccttagcctgggcgacaagatcaacctaagtcagaaaaagacctctatttag

SEQ ID NO: 183311 - DNA, 2721 bp, Artificial Sequence
  Description of Artificial Sequence: Synthetic coding sequence
atgcccctgcggctggacatcaagcggaagctgaccgcccggagcgaccgggttaagagtgttgatctacatcctaccgagccttggatgctcgcctctctttataatggatccgtgtgcgtctggaatcacgaaactcagactctggtgaagaccttcgaggtgtgtgacctgccagtgcgcgctgccaagttcgtggctaggaagaactgggtggtcacgggggcggacgacatgcagatccgggtgttcaactataacacactggaacgagtgcatatgttcgaagcccacagcgattatattaggtgtatcgctgtgcatcccacacagcctttcatactcacctcgtcggacgatatgctgatcaagctgtgggattgggacaaaaagtggtcctgtagtcaggtgtttgagggacacactcattacgtgatgcagatagtcatcaatcccaaggataacaatcaattcgcatctgccagcctcgaccgaaccatcaaggtgtggcaattggggagctcttcaccaaattttacattggagggtcatgagaagggagtgaactgcatagactattactccggaggagacaaaccatatctcatctccggtgcagatgacaggctggtaaaaatttgggactaccagaataagacctgtgtccagacgctggaagggcacgcccagaacgtgagctgcgcatccttccacccagagcttccaatcatcatcactggttccgaagacggcacagtccggatatggcatagcagcacctatcggcttgagtctaccctcaattatgggatggagcgtgtgtggtgcgtggcaagcctaagagggagcaacaacgtggctctgggctatgatgagggctccatcattgtgaaacttggcagagaagaacccgcaatgagtatggacgccaatgggaagattatttgggccaagcactccgaggtccagcaggcaaatttgaaagccatgggagacgcggagatcaaagacggtgagaggctacctctggccgtgaaagatatgggaagttgtgaaatatacccacaaacaatccagcacaatcctaacggtcggttcgtagtcgtgtgcggggacggagaatacatcatctataccgccatggcactaaggaataagtctttcggatcggcccaagagtttgcttgggcacacgactcatcggagtacgctattagagagtctaacagcattgtgaagatcttcaaaaacttcaaagagaagaaatcattcaagcctgactttggagccgaaagcatatatggtgggtttttgttaggagttaggtcagtgaatggcctcgccttctatgattgggacaatacagaactcattcgtcgcatcgaaattcagcccaaacacatcttctggtctgactctggtgagctcgtatgcatagcgactgaagagagttttttcattcttaaatatctctctgaaaaagtgttagccgcccaagagacgcatgagggtgttactgaagacgggatcgaagatgcctttgaggttcttggagagatccaggaaatcgtgaaaactggtctttgggttggggactgttttatatacacttccagtgtgaacaggctcaattattacgtcggaggtgagatcgtgaccatagcccatcttgacagaacaatgtatctgctgggatacataccaaaagacaatagactttatctgggcgataaagaactgaacatcatttcttatagtctcctggtatccgttctggagtaccagactgctgtgatgcgtcgtgatttttcaatggccgacaaggtcctgccaacaataccgaaagaacaacgaacccgggtggctcatttccttgaaaagcagggctttaaacagcaggctctgaccgtctccacagatccggagcacagatttgaactcgctttacagctgggggagctgaagatagcttatcagttggccgtggaggccgagagcgagcagaagtggaaacaactggccgagctcgctatctccaagtgccagtttggcctcgcccaagagtgcttacatcacgcccaggactacggtggcttgctactgctggctacagcgtcaggcaatgctaatatggtgaacaaactggcggagggcgcagagcgagatgggaagaacaatgttgcattcatgagctattttcttcaagggaaggtcgacgcctgtctggagctcctgattcgaactgggcgcctgccagaggccgcctttttggccagaacctacctgcctagccaggtcagccgcgtagtcaaactctggagagaaaacttatctaaagtgaatcagaaggccgctgaatcactcgccgatcccacagagtatgagaacctcttccccgggcttaaggaggcctttgttgttgaggaatgggtcaaagagactcacgccgatctgtggcccgccaagcagtacccactggttacacccaacgaagaacgcaacgtcatggaggagggcaaagactttcaaccatcccgtagcaccgcccaacaagaactcgatgggaagcccgcctcacccaccccggtgatagtcgcttctcacactgctaacaaggaagaaaagtcgcttttggaattagaggtggacctggacaacctggagctggaggatatcgataccaccgacattaacttggacgaggatatcttggatgactag

SEQ ID NO: 183312 - DNA, 2634 bp, Artificial Sequence
  Description of Artificial Sequence: Synthetic coding sequence
atgctggccagcctgtacaacggcagcgtgtgcgtgtggaaccacgaaacccagacactggtcaagacctttgaagtctgcgatctgcctgtaagggcggctaagttcgtcgctagaaagaactgggtggtgacaggagctgacgatatgcagattcgggtgtttaactacaacactctagaacgagtgcatatgttcgaagcccactccgactacatccggtgtatagccgtccacccaacccaaccctttattcttacatcctccgacgacatgctgattaagttgtgggattgggacaagaaatggagttgtagccaggttttcgaagggcatacacactatgtgatgcagatcgttattaacccgaaagataataaccagtttgcatctgccagtctggacaggactatcaaagtatggcagttgggctcttcatcacccaatttcactctagaagggcatgagaaaggcgtcaactgtatagattattatagtggcggcgataagccttatttgatatccggagctgacgacagactggtcaagatctgggactatcaaaacaagacgtgcgtgcaaaccctggaaggccatgcccaaaacgtgagctgcgcctcatttcaccccgaattacccatcatcatcactggatctgaagatgggactgtgcggatctggcattcatccacttatcggctggaatccaccctaaattacggtatggaacgtgtatggtgcgtcgcttcactgagaggaagcaataacgtggctctgggctatgacgaaggatccatcatcgtaaagctgggccgggaagaaccagccatgtccatggatgctaatggcaaaatcatttgggctaagcattccgaagtccagcaggctaatctcaaagccatgggggacgccgaaatcaaggacggggagcgcctgcctctggccgttaaagacatgggttcctgcgaaatctacccacagaccatacagcacaatcccaacggccggttcgtggtggtttgtggagacggtgaatacatcatctacaccgcaatggctctgaggaataaaagcttcggatctgcacaggagtttgcatgggcccacgatagctctgagtacgccattagggaaagtaattccatcgtcaaaattttcaagaactttaaagagaagaagagcttcaaacccgattttggtgccgaatcaatctacgggggctttctgctgggcgtgcgatcagtgaatggcttagccttttacgattgggataacacagaactgattaggcgaatagaaattcagccaaaacatatcttttggagtgatagtggcgagctggtgtgtatagctaccgaagaatcatttttcatcttgaagtatctgagcgaaaaagtgctggccgcccaggaaacacacgagggcgtcaccgaggacggaatagaggacgccttcgaagtcttaggagagatccaggaaatcgtgaaaactggactgtgggttggggattgcttcatctatacttctagtgtcaataggcttaactactatgtgggtggggagatcgtgacgatcgcccacttggaccggactatgtacctgttaggatatatccccaaggacaaccgcttatacctgggagacaaggaactcaatatcatctcttactccctgttggttagcgtgctagaataccagacagccgtaatgcggcgggacttctccatggcggataaagttctgcccactatccccaaagagcaacgaacccgggtcgcccatttcctggagaagcagggcttcaagcagcaggccctgacggtgtctactgaccctgaacatagatttgagttggccctgcagctgggtgaattgaagattgcctaccagcttgctgtggaggcagaatcagagcagaaatggaaacagctggcagagctagccattagcaaatgccaatttgggttagcacaggagtgcttgcaccatgctcaagattacggcgggcttcttctacttgccactgccagtggtaatgcgaatatggtgaataagcttgctgaaggcgctgagagggatggcaaaaataacgttgcattcatgagctacttcttgcaaggaaaggtggatgcatgtctcgaactcctgattcgcaccggccgcttgccggaggctgcctttctcgctcgcacctatctacccagtcaggtgagccgcgtggtgaagctatggcgagagaacctctcaaaggtcaaccaaaaagcggccgaatcacttgccgaccccaccgaatatgagaacctgttccctgggttaaaagaagcatttgtggtggaagagtgggtgaaggagacccacgctgacctctggcctgccaagcagtatcccctggtcacaccaaacgaagaacgaaacgtgatggaggaaggcaaggactttcaaccctcacgctccaccgcccaacaggagctggatggcaagccagccagccccacccctgtcatagtggcatctcatacagccaataaagaggaaaaatccctgcttgagcttgaggtcgatctcgacaacctcgagctggaagatattgacactacagatatcaacctggacgaagacattctagacgattag

SEQ ID NO: 183313 - DNA, 927 bp, Artificial Sequence
  Description of Artificial Sequence: Synthetic coding sequence
atggccccccccgcccccggccccgccagcggcggcagcggcgaggttgacgaattatttgatgtgaagaacgcgttttatattggttcgtaccagcaatgtattaacgaggcccagagagtcaagttgtcctcccccgagcgggacgtcgaacgtgacgtcttcctgtatagggcctatctcgctcagagaaaatttggggtagtgctggatgaaatcaagccttcatctgcaccagagctgcaggccgtgaggatgtttgcagattacctggcccacgagtcacggagagactccatcgtagcagagcttgatcgcgagatgtctagaagtgttgacgtcaccaatactacctttttgctgatggctgcttcgatttacctccatgaccagaaccccgatgccgcactgagggcacttcaccagggagattcattagagtgcaccgctatgaccgtccaaattttgttaaagctggatcggctggatctagcccgaaaagaactcaagcgcatgcaggatctggatgaggatgcgacacttacacagctagccaccgcatgggtgagtctggctacaggaggagagaagttgcaagatgcctattatattttccaagaaatggccgataagtgttcgcccacgcttctcctgctgaacggccaggctgcctgccacatggcacagggacggtgggaagctgcagaaggtttgctgcaggaggccctcgacaaagactcaggataccctgagacacttgtgaatctgattgtgctttcccaacatctggggaaaccacccgaggtcacaaaccggtacttatcgcagttaaaagacgcccatcgtagccaccccttcattaaagaatatcaggctaaagagaacgattttgatcggctagtactgcagtacgcccccagtgcctag

SEQ ID NO: 183314 - DNA, 771 bp, Artificial Sequence
  Description of Artificial Sequence: Synthetic coding sequence
atggccccccccgcccccggccccgccagcggcggcagcggcgaggtcgatgagctgttcgatgtgaaaaacgcattctatatcggttcatatcagcagtgtattaatgaggcacagcgcgttaagctctctagtcctgagcgcgacgttgagcgcgacgtctttctttacagagcttacttggcccagcggaaatttggcgtggtgctagacgaaatcaaaccgagctcagctcctgaactccaggcagtgcggatgtttgccgactatcttgcccacgagagtcgccgagactcaattgtggctgagctagacagggagatgtcccgcagcgtggatgtgaccaacacaacattcctgctcatggctgcatccatatacttgcacgaccagaaccctgatgccgccctcagggcccttcatcaaggcgacagcctggagtgcactgcaatgacagtgcagattttgctgaagttagataggcttgacctagcccgtaaagagctcaagagaatgcaggatttggacgaagatgctactctcacacagctggcaaccgcttgggtgtcactcgccaccgactctgggtatcctgagaccctcgtcaacctgatcgttctctcccagcatctgggtaaaccccctgaggttactaaccgctatctgagccagctgaaggatgctcacagatcccacccttttatcaaagagtatcaggctaaagaaaatgacttcgaccggctagtcttgcaatacgccccttctgcctag

SEQ ID NO: 183315 - DNA, 774 bp, Artificial Sequence
  Description of Artificial Sequence: Synthetic coding sequence
atggccccccccgcccccggccccgccagcggcggcagcggcgaggtcgatgaactgtttgacgtgaagaacgcgttctacatcgggtcttaccagcagtgcataaacgaggcacagagggttaagttgtcttcacccgagcgcgacgttgagagagatgtgtttctatatcgggcttacctcgcacaacggaagttcggcgtggtgctcgatgagatcaaaccaagctccgccccggagcttcaggccgttaggatgtttgccgactacttggcacatgagtccaggtccacggccatgactgttcagattctgctgaagctggacagactcgaccttgctcgaaaagagctcaagcgcatgcaagatttggatgaagacgctaccctgacgcagctcgcaaccgcctgggtgtcactcgcaaccggcggggagaagcttcaggacgcctactacatctttcaggagatggcagataagtgttcccccactctcttactgctcaacgggcaagctgcttgccatatggcccagggacggtgggaagccgccgagggtcttctccaagaggcactagacaaggactcaggctaccccgaaaccctggtgaacctgatcgttctgagtcagcatctggggaagcctccagaggtaaccaacagatatctgtctcagctgaaagacgcacacagaagtcacccttttatcaaagagtaccaggctaaagaaaacgatttcgaccggctggtcttgcagtacgcaccttcagcttag

SEQ ID NO: 183316 - DNA, 924 bp, Artificial Sequence
  Description of Artificial Sequence: Synthetic coding sequence
atggccccccccgcccccgccggcctgcggggcagcggcgaggtggatgaattattcgacgtgaaaaatgccttctacattggctcctaccagcagtgcatcaacgaagctcagcgggtcaaactcagtagccctgagcgagacgtggaacgagatgtgtttttgtacagagcctacctggcccagcgaaagttcggcgtggtgctggatgaaattaaaccatcttctgccccagagctgcaggctgtgcggatgttcgcggactacctcgcccatgaatcaaggcgagactcaatcgttgctgaactcgaccgcgagatgagcagatccgtcgacgtgaccaacactaccttcttgctgatggcagcctctatttacttacatgatcagaaccctgatgccgccctcagggccttgcaccagggcgatagtctggaatgcaccgccatgacagtccaaatcttattgaaacttgacaggcttgacctggctaggaaagagcttaagaggatgcaggaccttgatgaggacgccactttgacccaacttgcgaccgcttgggtctctctggcgacggggggagaaaagcttcaggatgcttattatatattccaggaaatggcagacaaatgctcgcctacactcttgctgttaaacgggcaggccgcctgccacatggcacaaggacgctgggaggccgcagagggtctcctccaggaggccctggacaaggatagtggctatcctgagactctggtgaacttgatcgtgctgagtcagcacctaggcaaacccccggaagtgacaaatagatatctttcccagctgaaagacgctcatcgctcccatcctttcataaaggaataccaggccaaggagaatgacttcgaccgcttggtgctgcagtacgctccaagtgcctag

SEQ ID NO: 183317 - DNA, 741 bp, Artificial Sequence
  Description of Artificial Sequence: Synthetic coding sequence
atgatcaagaagttcgacaagaaggacgaggagagcggcagcggctccaacccttttcagcacctcgagaaatccgccgtgctgcaggaggcgaggatatttaacgaaacacctatcaacccacgaagatgtctacatattctgactaagatcctatatctgcttaatcaaggggagcatttcggcaccacagaggcgactgaggctttcttcgcaatgaccagattgttccagagcaatgatcagacactgagacgcatgtgctatttgacgatcaaagagatggcaacaataagcgaagacgtaattatcgtaactagcagtctgacaaaggatatgactggtaaggaggatgtgtataggggcccagctattagggccctgtgcaggattaccgacgggacaatgcttcaggccatcgagcgttacatgaagcaggctatcgtggacaaggtgtcctctgtgtcctctagcgccctagtctctagcctccatatgatgaagatctcttacgatgtagttaaacggtggataaacgaagcccaggaggccgcctcctccgacaacattatggtccagtatcacgcgctgggggtcctgtaccatctaaggaaaaatgatcgtctggcagtgtcaaaaatgctgaacaagtttactaaatccggacttaagtcccagtttgcatattgtatgttgatcagaatcgctagcaggttgctcaaggagactgaggacgggtag

SEQ ID NO: 183318 - DNA, 468 bp, Artificial Sequence
  Description of Artificial Sequence: Synthetic coding sequence
tgagccggcagcttcagctgcaccatgaagttcaccgtgcgggactgcgatccaaatacgggggtgccggacgaggatggatatgacgatgagtacgtactcgaggatctggaagtgacagtcagcgatcatatccagaaggtgttaaagcccaactttgctgctgcatgggaggaagtgggtgatacctttgaaaaggaggagacatttgcactgagttcaaccaagacactggaggaagctgttaataacatcataactttccttgggatgcagccgtgtgagcgctcggacaaggttcccgaaaataagaattcccattctttgtatttggcaggcatctttcgcggcggatacgacctgttggtacgttctcggctcgcccttgcagatggagtgacaatgcaggtcacggtaaggtctaaagaacgtactcccgtcgacgtgattctcgcgagcgtcggatag

SEQ ID NO: 183319 - DNA, 741 bp, Artificial Sequence
  Description of Artificial Sequence: Synthetic coding sequence
atgatcaagaagttcgacaagaaggacgaggagagcggcagcggctcaaatccattccagcatctggagaagagcgccgtgcttcaggaggcccgaatcttcaatgaaacaccaatcaatcccagacgttgtctgcatattttgaccaagatcctgtatttacttaatcaaggcgaacatttcggaacaacggaggctaccgaagctttctttgccatgacgaggttgttccaatctaacgaccagaccctcaggaggatgtgctatcttaccataaaagaaatggccaccatttccgaggatgtcatcatcgtgaccagtagtctgactaaagatatgactggtaaggaagacgtttataggggccctgctattagagctttatgtcgaattactgacgggacaatgcttcaggcaattgaacgatacatgaaacaagccatcgtggacaaagtgagcagcgtctctagttcggccctggtaagcagcttgcacatgatgaaaatctcttacgacgtggtgaaaaggtggattaacgaagcccaagaagccgcttcctccgacaacatcatggtgcagtaccacgcgctgggagttttgtaccatttgcgaaagaatgacaggttggccgtgtcaaaaatgcttaacaaatttactaaaagcgggctgaagtcacagtttgcttactgcatgctgatcagaattgccagccgactacttaaagagacggaagatggatag

SEQ ID NO: 183320 - DNA, 1080 bp, Artificial Sequence
  Description of Artificial Sequence: Synthetic coding sequence
atgtacttcaagcgggccgcccgggccttccccgtgctgctgaccggcgccggtaagacgactctgctaaattacatcctcaccgagcagcatagcaagcgcgtggcagtaatactaaatgagtttggagaagggtccgcccttgagaagtccttagccgtgtctcaggggggcgagctgtacgaagaatggctagaactacgtaacgggtgtttgtgttgcagcgtgaaggactccggcctcagagcaatcgagaacttaatgcaaaagaaggggaaatttgattatatattgcttgagacaacaggattggcagaccccggggctgttgcgtccatgttctgggtggatgccgagttgggaagcgatatatacttagatgggattataaccatcgtggactccaaatatggtctgaaacatctcaccgaggaaaagccggatggcctcattaatgaagctacacggcaggtggcattggctgatgctatattaatcaacaagaccgatctggtgcctgaggaggatgttaagaagctgcggacaactatcagaagcatcaatgggcttggtcagattttagagacacaaagaagcagagtcgatctgagcaacgtcctggaccttcacgccttcgattccctgagtggtatttctctgcagaagaaattacagcatgtacccggtacacagccacatctagatcagtctatcgtgacaattacatttgaggttccaggaaatgctaaggaggagcacctcaacatgtttattcagaacctgctgtgggagaaaaacgttcgtaataaagataatcattgcatggaagtaattagattaaaaggcctcgtctcaatcaaggacaagtcccagcaggtcattgtacagggagtgcacgagctgtatgatctcgaggagacaccggtgtcctggaaagatgacacagagcggacgaataggcttgtgctcctcgggagaaatcttgacaaagacattctgaagcagttgtttattgctaccgtgaccgagacagagaaacagtggaccacacgcttccaggaggaccaggtttgcacttag

SEQ ID NO: 183321 - DNA, 1188 bp, Artificial Sequence
  Description of Artificial Sequence: Synthetic coding sequence
atgctgcccgccgtgggcagcgccgacgaggaggaggaccccgccgaagaggattgcccagagctcgtgcccatagaaaccacccaatctgaggaagaggagaagagtggcctgggtgccaaaattcccgtgaccatcatcactggatatctgggagcaggaaaaacaacactgctgaactacattctcaccgagcagcattccaagcgcgttgcagtgatccttaacgaatttggggaggggtccgcactcgaaaagagcctcgccgtatcccagggaggagaactgtatgaggagtggctggaactgagaaacgggtgcctatgttgtagtgtcaaagactcaggtctgagggcgattgaaaacctaatgcaaaaaaaaggaaaatttgactacatcctcctagaaactactggcttggctgaccccggggctgtggcctctatgttttgggtagatgccgagcttggctccgatatctacctcgacggaattatcaccatcgtcgacagtaaatatgggctcaagcacttaaccgaggaaaaaccggatggcttgattaacgaagcgacaaggcaggtggccctggcggacgccatcctaattaacaaaaccgatctagttcccgaagaggacgtgaagaagctccggactaccatcaggagcatcaatggcttggggcagattctggagacccagcgcagtcgtgtggacctgagcaacgtgctcgatcttcacgcatttgactcactaagtggtatttctcttcaaaagaaactgcagcatgtccccggcacacagcctcatttggaccaatcgattgtgacgatcaccttcgaggttccaggcaacgctaaagaagagcatctcaatatgtttattcagaatttactttgggagaaaaatgtaaggaacaaggacaatcactgtatggaggtgattaggttgaaaggacttgtttctatcaaagataagagtcagcaagtcattgtgcaaggcgtgcacgaactgtacgatctagaggagactccggtgtcctggaaggatgacaccgaaaggaccaatcgactggtgcttctgggacgaaatttggacaaggacatattgaaacagctcttcatagcaacggtgacggagactgagaagcagtggaccacccggttccaggaggaccaggtctgtacatag

SEQ ID NO: 183322 - DNA, 543 bp, Artificial Sequence
  Description of Artificial Sequence: Synthetic coding sequence
atgctgcccgccgtgggcagcgccgacgaggaggaggaccccgccgaagaggattgtccagagctggttccgattgagacaacccagagtgaggaagaagagaagagcggccttggagccaaaatccctgttacgatcatcacaggatacctcggcgcaggcaagaccacgttgttgaactatatattaaccgaacagcattctaaacgtgtggccgtgattctaaacgagtttggcgaaggaagtgctcttgagaagtcactggcagtctcccaagggggagagctgtacgaggagtggttggaactaaggaacgggtgcttgtgctgttcggtgaaagactctggcctcagagctattgagaacctaatgcagaaaaaaggtaaatttgactatatcctgttagaaacgacgggactagccgatcccggagctgttgcttctatgttctgggtggacgccgagctggggtccgatatttatctagacggaatcatcacaattgtggactccaagtacggactcaaggttaagtatcattag

SEQ ID NO: 183323 - DNA, 1044 bp, Artificial Sequence
  Description of Artificial Sequence: Synthetic coding sequence
atgctgcccgccgtgggcagcgccgacgaggaggaggaccccgccgaggaggactgccctgagcttgttccaatcgagaccactcaatccgaagaggaagagaagtccgggctgggagctaaaattccagttacaataatcaccgggtacctgggcgccggaaagacgacattactcaactacatcctgacagaacagcacagtaagcgcgttgccgtgattctgaacgaattcggtgaggggtccgcactggaaaagtccttggcagtgtcacagggaggtgaactgtatgaagagtggctcgaactccggaatgggtgcctttgttgttctgtgaaagacagtggattgagagcaatcgagaatctgatgcagaaaaaaggcaaatttgattatatcctgttggagaccacagggctcgccgacccgggggctgttgcctcaatgttttgggtcgatgctgagctgggctccgatatttatcttgatggcatcatcaccattgtagatagcaagtacggtctgaagcatctgaccgaagagaaacccgatggtctgattaatgaagctactcggtctataaatggcttagggcagattctcgagacccagaggagtagtcttcagaaaaaattgcagcacgttcctggcacgcagccccatctggaccagagcattgtcacgattacattcgaggttccaggcaacgcaaaggaggagcaccttaacatgtttatccagaacctgctgtgggagaaaaacgtcaggaataaagacaaccattgcatggaagttattcgtctgaagggattggtaagtattaaggataaaagtcagcaagtaatagttcaaggtgtgcacgagctctatgaccttgaagagacaccggtatcctggaaagatgataccgagaggacgaatcggctggtgctactagggcgaaatttagacaaagatatcttaaagcagctgtttatagccaccgtcaccgagacagagaaacaatggactacacggttccaggaagaccaggtctgtacatag

SEQ ID NO: 183324 - DNA, 753 bp, Artificial Sequence
  Description of Artificial Sequence: Synthetic coding sequence
atgctgcccgccgtgggcagcgccgacgaggaggaggaccccgccgaagaggattgtccggagttagtacctattgaaactacgcagtctgaggaggaagagaagtctggcctcggggccaaaatccctgttaccattattacggggtatctcggtgccggaaaaacaaccctgctcaattatatcctgacagaacagcactcaaagagggtcgctgttatcctaaatgagttcggggaaggcagcgccctcgagaaaagtctggctgtgtctcagggcggtgaattatatgaagaatggctggaactacggaacgggtgtctgtgttgtagcgtgaaggattcggggctccgcgcaatcgagaatttgatgcagaaaaagggtaagttcgactacatcctattagaaacaactggtctggctgatccgggcgcggtagcctcaatgttctgggttgatgctgaactgggttctgacatctacctggatggaatcattaccatagtggattctaaatacggtttgaagcatcttacagaggaaaaacccgatggccttatcaatgaagccactagacaggtcgctctggcagatgctatactgattaataagaccgatctggtcccagaggaggacgttaaaaaactgcgtaccacgatccggtacgagatgatctcagtgctttcagcctacagatctatgctctatactcaaaatattttctacagtgactgctgtcccgtcgagacctag

SEQ ID NO: 183325 - DNA, 234 bp, Artificial Sequence
  Description of Artificial Sequence: Synthetic coding sequence
atgtacttcaagcgggccgcccgggccttccccgtgctgctgaccggtgccggaaaaacaacattgttgaactacatcctcactgaacaacattcgaagagggtcgcagtgatcctgaacgaatttggagagggaagtgcattagagaagtcgctggccgtcagtcaaggcggcgaactgtatgaggaatggctggagctgaggaacggctgtctgtgttgtagcgtgaaatag

SEQ ID NO: 183326 - DNA, 342 bp, Artificial Sequence
  Description of Artificial Sequence: Synthetic coding sequence
atgctgcccgccgtgggcagcgccgacgaggaggaggaccccgccgaggaggattgtcccgagcttgtgcctattgagactacccaaagcgaggaagaggagaaaagtggccttggggccaagattccggtgaccatcataacagggtatctgggcgcaggtaagacaacactcctcaattacattctgactgagcagcacagcaagcgcgtcgcggtgatactgaacgagtttggggaaggttcagcccttgaaaaaagtttggccgtttcgcagggcggcgagctgtacgaagagtggctggagctccgcaacggatgcctgtgttgttctgtgaagtag

SEQ ID NO: 183327 - DNA, 1131 bp, Artificial Sequence
  Description of Artificial Sequence: Synthetic coding sequence
atgctgcccgccgtgggcagcgccgacgaggaggaggaccccgccgaagaagattgccccgaattggtgcccatcgagacaacccagagtgaggaggaggagaagtcgggcctgggggcaaagatccccgtgaccattatcacaggttatctgggagctggcaagacaacactgctgaattatatccttaccgagcagcacagtaagagggtggcagtgattttaaatgaattcggggaagggtctgcattagagaagtctctggccgtctcgcagggcggcgagctctacgaggaatggctagaactaaggaatggatgcctatgttgtagtgtgaaggattccgggctgcgggcaatcgaaaacctgatgcaaaagaagggcaagttcgactacattctgcttgagactacgggactcgccgaccctggcgctgtggcctctatgttctgggtcgacgcggaactaggttcagatatctatctggatgggattattacgattgtggatagcaagtatggcttgaagcacctgacagaagaaaagccggacggacttataaacgaggctaccaggcaagtcgcactagctgatgcgatcttgatcaacaaaaccgacctcgtacccgaagaagatgtgaaaaaactcagaaccaccatccgatcaattaacggacttgggcagatcctcgagactcagaggtcttctctccagaagaaactgcagcacgttcctggcacacagccccatctggatcagagtatcgtcaccatcacgttcgaagtgccgggaaacgcaaaggaagagcacttgaacatgtttatccaaaatctactgtgggagaaaaatgtgcgcaacaaggacaaccattgtatggaggtgatcagattgaaagggttggttagcatcaaggacaaatcccagcaggtgatcgtccagggcgtccacgaattgtacgacctggaggagacgcccgtgtcttggaaagacgatactgagaggaccaataggctggtgctgctggggcgcaacctggacaaagatattctcaaacagttgtttatcgcgacagtgactgagactgaaaagcagtggaccactcggtttcaggaagaccaggtgtgcacctag

SEQ ID NO: 183328 - DNA, 483 bp, Artificial Sequence
  Description of Artificial Sequence: Synthetic coding sequence
atgctgcccgccgtgggcagcgccgacgaggaggaggaccccgccgaggaggattgccctgagctggttcccatagaaactacccagagcgaggaagaggagaaatccggcctgggcgccaaaatacctgtgaccataatcaccggctacctgggtgcaggaaagacaacattgctcaactacatcctcacagagcagcacagtaaaagagtggccgtgatcctgaatgagtttggagaaggttccgcactcgaaaaaagcctggccgtttctcagggcggcgagctctacgaggagtggctggaactcagaaacggttgcttatgttgttccgtaaaagactcagggctccgtgctatcgaaaacttaatgcaaaagaaggggaagttcgactatatacttctggaaactactggattagctgatccaggtattatcaccatcgtggactccaagtacgggcttaaggtgaagtaccactag

SEQ ID NO: 183329 - DNA, 441 bp, Artificial Sequence
  Description of Artificial Sequence: Synthetic coding sequence
atgtacttcaagcgggccgcccgggccttccccgtgctgctgaccggggccggaaagaccactttattgaattatatcctgaccgagcagcactccaagcgcgtcgccgtcatcctcaacgaattcggagagggcagtgctctcgagaagagcctggcggtgtctcaagggggcgaactgtatgaagaatggttggagctccggaatggctgcctgtgctgttctgtaaaggactccggactgcgcgccattgagaacttaatgcagaaaaagggcaagtttgattacattctgttggaaacgaccggattggcagatcctggcgccgtggcttcaatgttctgggttgatgcagaattgggctctgacatttatttggacggaattattaccatcgtggattccaaatacggtctgaaagctaagaattggacgacttag

SEQ ID NO: 183330 - DNA, 1188 bp, Artificial Sequence
  Description of Artificial Sequence: Synthetic coding sequence
atgctgcccgccgtgggcagcgccgacgaggaggaggaccccgccgaggaagattgccccgaactagtccctatggaaactacacagagtgaggaagaagaaaagagcggcttaggggccaagatcccagtaacaataatcacgggttacctgggcgcaggaaaaacaacactcctgaattacatcctcaccgagcagcacagcaaaagagtcgcagtaattctgaacgagttcggagaaggtagcgctttggaaaagagtttagccgtttctcaggggggggagctatacgaggaatggctggagctaagaaacggctgcctgtgttgtagtgtgaaggataacggactgagagcgatcgagaacctgatgcaaaagaaggggaaattcgattatattctcctggagacaaccgggcttgcagatccaggcgccgtcgcctctatgttttgggttgacgcagaattgggtagtgatatttacctggacgggataatcaccattgtggattcgaagtacggcctgaagcacctcgcagaggagaaacctgatggcctaattaacgaagcaaccaggcaggtggcactcgccgacgccatcctgatcaataaaactgaccttgtgcccgaagaggatgttaagaagttgcgggccacgattcgaagtattaacggattaggacagatccttgaaacgcagagatctagggtggacctatccaatgtccttgaccttcatgcatttgattctctgagtggtatcagtctgcagaaaaaactgcagcacgtgccaggtactcaaccccatctagatcagtcaatcgtgacgatcacgtttgaagtcccaggaaatgctaaagaggagcaccttaatatgttcatacagaacctgctctgggaaaagaacgtgcggaataaggacaatcactgcatggaagttatcaggttaaagggactggtctcaatcaaggataagtcacagcaagttatcgtgcagggggtgcatgagctctatgacctggaagaaacaccagtttcatggaaagacgatactgaacggacaaatcgtctggtgctgctcgggcgcaatctggataaagacatcctcaaacagttgttcatcgctacagtgaccgagaccgagaaacagtggacgacacacttcaaggaggaccaggtttgcacatag

SEQ ID NO: 183331 - DNA, 543 bp, Artificial Sequence
  Description of Artificial Sequence: Synthetic coding sequence
atgctgcccgccgtgggcagcgccgacgaggaggaggaccccgccgaggaagattgccccgagttagtgcctatggaaacaacacagtctgaagaggaagagaaatcaggactgggggccaagattcccgtcaccattatcaccgggtacttaggcgccggcaaaacaacgctcctcaactacatcctgacagagcagcactccaagcgtgtggccgtcatactgaacgagttcggggagggatcagccttggagaaatcgctggcggtctctcagggcggcgagctgtacgaggaatggctggagcttcggaacggatgcctgtgttgttctgtgaaagacaatggattaagagctatcgagaacctcatgcagaagaaaggtaagtttgactatattctacttgaaaccaccgggttggccgacccaggtgccgtggcttcgatgttctgggtggatgccgagctggggtctgatatctacttagatggcattattaccattgttgatagcaagtatggtctgaaagtcaagtaccattag

SEQ ID NO: 183332 - DNA, 1131 bp, Artificial Sequence
  Description of Artificial Sequence: Synthetic coding sequence
atgctgcccgccgtgggcagcgccgacgaggaggaggaccccgccgaggaagattgcccagagctggttcccatggaaaccactcaatctgaagaggaggagaagagtgggttgggggcaaagatcccagtcacgattatcacaggctacctcggagcagggaaaaccaccctgctgaattatatactgacagaacaacacagcaaacgagtagccgtgatactgaatgagttcggcgaagggtccgctttagagaaaagtctggctgtgtctcagggcggcgagctgtacgaagaatggctggagctgagaaacgggtgtctgtgttgcagcgtcaaggataatggcctcagagccatagaaaaccttatgcagaagaaaggcaaatttgactacattcttttagagaccaccggactcgctgatccaggagccgtggccagtatgttttgggtagatgctgaactgggctccgatatctatctggacggtatcattaccatcgttgactccaagtatggactgaagcatctggctgaggaaaaacccgatggtctcatcaacgaggcgacgcgccaggtggccctggctgacgccatcctgatcaacaaaactgacttagtaccagaggaggacgttaaaaagctgcgtgctaccattcgtagcatcaatggattgggacagatccttgaaacccagaggtcttccctgcagaagaagctgcagcatgtacctgggacgcaaccacacctggaccagtctatagtgacaataactttcgaggtgccgggaaacgccaaggaggagcacttaaacatgttcatccaaaatctattgtgggagaagaatgtcaggaacaaagacaaccactgcatggaagtgattcggctgaaaggactggtgtccattaaggacaaaagccagcaggtaatcgtccaaggtgtacatgagctttatgacctagaagagacccccgtgtcttggaaggatgatacggagagaaccaatcgtctcgtccttctgggacgaaatttagataaggatatcctgaagcaactgtttatcgctactgtgacggagacagaaaagcagtggacaactcatttcaaagaagatcaagtgtgtacatag

SEQ ID NO: 183333 - DNA, 1080 bp, Artificial Sequence
  Description of Artificial Sequence: Synthetic coding sequence
atgtacttcaagcgggccgcccgggccttccccgtgctgctgaccggggctggaaaaacaactctcttgaactacatccttaccgaacaacattcgaaaagggttgcagttatcctgaatgagtttggagagggctcagcccttgagaagagcttagcggtctcgcagggcggggagctttatgaggaatggttggaactgaggaatgggtgtctctgttgctctgttaaggacaacggcctgagggcaattgagaatctcatgcagaagaaaggcaaatttgactacattctcctggagactacgggccttgcagaccccggagcagtggccagcatgttttgggtcgacgcagaactggggtcagacatctatttggacgggataattaccatcgtggattccaaatacggcctgaagcacctggctgaggagaaacctgacgggctgattaatgaagctacccgacaggtggcacttgccgacgctatcctgattaataagacagatttagtgccagaagaggatgtcaagaagttgcgcgccactattcggtctatcaatgggctgggccaaatattggagactcagagaagtcgcgtcgacctgtcaaacgtgctggatctgcacgcctttgactcactgagcggaatctcactgcagaagaaactgcagcacgtaccaggcactcagccccatctcgaccagtccatcgtcactataacattcgaggttcccggtaatgccaaggaggagcacctaaacatgtttatccagaatctgctgtgggagaagaatgtgaggaacaaggacaaccactgcatggaggtgatcagactgaagggactcgtgtctatcaaagataaatctcagcaagttatagtccagggcgtccacgagctgtatgacctcgaggaaacacccgtttcctggaaggacgatactgaacgaaccaaccgactggtgcttttgggccgcaacttagacaaagatatcctgaaacagctgtttattgccaccgtaaccgagacggaaaagcagtggactacgcatttcaaggaggaccaagtctgtacgtag

SEQ ID NO: 183334 - DNA, 483 bp, Artificial Sequence
  Description of Artificial Sequence: Synthetic coding sequence
atgctgcccgccgtgggcagcgccgacgaggaggaggaccccgccgaggaagattgccccgaactggtgccgatggagactactcagagcgaggaggaggaaaagtccggactcggggcaaagattcctgtgactatcataacaggttacttaggggccgggaaaacaaccttactcaattacatcctgacggaacagcacagcaagagggtggcagtaattctgaacgaattcggtgaagggtccgccctggagaagtctctggcagtcagtcagggcggtgagctgtatgaggagtggcttgaactgaggaatgggtgcctttgctgctctgtcaaggataacggcctgcgcgccatcgaaaatctcatgcaaaagaaaggtaaattcgattacattttgctggagacgaccggccttgccgatccagggataattaccattgttgattctaaatacgggctgaaagttaagtaccactag

SEQ ID NO: 183335 - DNA, 1188 bp, Artificial Sequence
  Description of Artificial Sequence: Synthetic coding sequence
atgctgcccgccgtgggcagcgtggacgaggaggaggaccccgccgaagaggactgccctgaacttgtccctattgagacaacacaaagtgaagaggaagagaagtctggactgggggctaaaattccagtcaccatcatcactgggtaccttggcgcgggaaagactacccttttgaattatatcctgacagagcagcactcaaagcgggtagctgtgattttgaatgagtctggagagggttcagccttagaaaagtctctggctgtgagtcagggaggcgaactgtatgaagagtggctcgaactccgcaacggatgtctctgctgtagcgtcaaagataacggactgcgggcaatcgaaaacctcatgcagaaaaaaggtaagtttgatgacatactactggaaacaacagggctcgccgaccctggagcggtcgcctccatgttttgggtggatgcagaactcggttcagacatttacctggatggcatcatcacaattgtggattcaaagtatggactgaaacacttgacagaagagaagcctgatggcctgatcaatgaggccacacgtcaggttgcgttagctgatattatccttataaataagacggacctggtgccggaggaggatgtgaagaaacttcgaaccaccattaggtccattaacggcctcgggcagatacttgaaacgcagcgttcacgggtagatttatccaatgtgctggacctgcacgccttcgatagcctgtcaggtattagtctgcagaaaaaactacaacacgttcccgggacacaaccacacctggatcagagcatcgtgacaataacatttgaagtgccggggaatgctaaagaagagcacctcaatatgttcatccagaatctgctgtgggagaagaacgtgcgcaacaaagacaatcactgtatggaagtgattcgactgaagggactggtgtccatcaaggacaagtctcagcaggtcatcgtgcagggggtgcatgagttgtatgacctggaagagacacccgtctcatggaaagatgataccgaaagaaccaatagactcgtcttaataggtcgcaatttagataaagatatcctgaagcagttatttattgccaccgtgaccgagacagaaaagcagtggacgacccacttcaaagaggaccaggtttgcacctag

SEQ ID NO: 183336 - DNA, 258 bp, Artificial Sequence
  Description of Artificial Sequence: Synthetic coding sequence
atggaggtgatccggctgaagggcctggtgagcatcaaggacaagagtcagcaggttatcgtgcaaggggtgcatgagctgtacgatctggaggagacacctgtttcttggaaagatgatacggagcggactaacaggctggtgttaatcggccggaacctggataaagacattctaaagcaattattcatagcaaccgtgactgaaaccgaaaaacagtggaccactcattttaaggaggaccaggtttgcacctag

SEQ ID NO: 183337 - DNA, 258 bp, Artificial Sequence
  Description of Artificial Sequence: Synthetic coding sequence
atggaggtgatccggctgaagggcctggtgagcatcaaggacaagtcgcagcaagttatcgtccagggagtgcacgaattgtacgatttggaggagacaccagtgagctggaaagacgacacagagaggacaaaccgtctggttctaatcggccgtaatctcgacaaagacattctgaaacagttatttatagcaaccgtcaccgaaaccgagaagcagtggaccacccacttcaaggaagatcaggtgtgtacatag

SEQ ID NO: 183338 - DNA, 132 bp, Artificial Sequence
  Description of Artificial Sequence: Synthetic coding sequence
atgttcatccagaacctgctgtgggagaagaacgtgcggaacaaggacaaccattgcatggaggtgatccgcctaaaagtgcagtttacagttgctgatttctggaccaagtcctttagctggttgctctag

SEQ ID NO: 183339 - DNA, 1128 bp, Artificial Sequence
  Description of Artificial Sequence: Synthetic coding sequence
atgctgcccgccgtgggcagcgtggacgaggaggaggaccccgccgaggaggactgccctgagctagtgccaatagagaccacccagagcgaggaggaggagaagagcgggctgggggcaaaaattccagttacaataatcacgggatatctgggagcagggaaaactaccctgttaaactatatccttacggagcaacactcgaaaagggtggctgttattttgaacgagagcggtgaaggctcggcactggagaagtccctggctgtatctcagggcggagaattgtacgaagagtggctcgagctgcggaacgggtgcctatgctgttccgtcaaggataatgggctgcgcgccatagagaatctcatgcagaaaaagggaaagtttgatgacatcttgttggagacaaccggcctggccgatcccggcatcattacaattgttgacagtaaatacggtctgaaacatttgaccgaggagaagcccgatgggctgatcaatgaagctactcgccaggttgcactagccgatattatcttaatcaataagactgatctggtgcccgaagaagacgttaagaaactcaggactaccattcgctccatcaatgggctgggccagatcctggaaactcagagaagtcgcgtggatctgagtaacgttctagacttacatgcctttgatagcctctcaggaattagtcttcaaaaaaaactgcagcacgtgcccggaacccaacctcacctggaccagtctattgttactattactttcgaggtacccggaaatgctaaggaggaacacctaaacatgtttatacaaaatctgctgtgggagaaaaacgtgcggaacaaggacaatcattgcatggaagttattcggctcaaagggcttgtctctatcaaagataagagccagcaggtgattgttcagggagtacatgagctgtacgatctggaggagacacccgtctcgtggaaggatgatactgaaagaaccaatcggctcgtccttatcggaaggaatctggataaagatattctgaagcaattgttcattgccaccgtaactgagacagagaaacaatggacaacacacttcaaggaggaccaggtctgtacgtag

SEQ ID NO: 183340 - DNA, 1080 bp, Artificial Sequence
  Description of Artificial Sequence: Synthetic coding sequence
atgtacttcaagcgggccccccgggccttccccgtgctgctgaccggcgctggcaaaaccaccctcttgaactatattctcaccgagcagcacagcaaacgggtagcggtaatattgaatgagtccggggaaggctctgccctagagaagtctctggcagtgtcccagggcggggaactgtatgaggaatggctggagctcagaaacggttgtctctgctgctctgtcaaggacaacgggttgcgcgctatcgaaaacctgatgcagaagaaaggcaagttcgatgatattctccttgagactacagggctagctgacccgggcgcggtggcatccatgttttgggtcgatgctgagttgggcagcgatatctacctcgacggtatcattaccatcgtggatagcaaatatgggctcaagcatctaaccgaggagaagccggatggcctaattaacgaggccacaagacaggtggctttggcggatatcattttgattaacaaaaccgatttggtcccagaagaggatgtaaagaaactcaggactaccattagatcaatcaacggtctcgggcagatcttggagacccagagaagccgggtcgaccttagtaacgttctggacctgcacgcctttgattctctgtccggcatttccctacagaaaaaactccaacatgtccctggcacgcaacctcacttagaccagtccattgtgactatcacatttgaagttcccgggaacgccaaggaagaacatctaaacatgttcatccagaacctcctatgggagaagaacgtgagaaataaggataaccactgtatggaagttataaggctcaaggggctggtctccatcaaagataagagtcagcaggtcattgtacagggggtccatgaactgtacgacctggaagagacccccgtatcatggaaagacgatacagaaaggacaaaccggttagtcctgatcggtagaaatcttgacaaagacattctgaaacaactgtttattgctaccgtgacagagacagaaaaacaatggacaacacatttcaaagaggaccaggtttgcacttag

SEQ ID NO: 183341 - DNA, 234 bp, Artificial Sequence
  Description of Artificial Sequence: Synthetic coding sequence
atgtacttcaagcgggccccccgggccttccccgtgctgctgaccggagccggcaaaacaacactactcaactatatcctgaccgaacagcactcaaagcgcgttgccgtcattctcaacgagagtggggaggggtccgcccttgagaagtcattggccgtgagccaaggaggcgagctgtatgaggagtggcttgagctgcggaacggatgcctgtgttgttcagtgaagtag

SEQ ID NO: 183342 - DNA, 1131 bp, Artificial Sequence
  Description of Artificial Sequence: Synthetic coding sequence
atgctgcccgccgtgggcagcgtggacgaggaggaggaccccgccgaggaagattgccctgaactcgtcccaattgagaccactcaaagcgaagaggaagaaaagagcggcctaggcgctaagatccccgttacaattatcacaggctacctcggggctggcaagactaccctcctaaactatattttgaccgaacagcattcaaagagagtggctgtgattctgaatgagagcggcgaagggtctgccctcgaaaagtccctggctgtgagccaagggggggagttgtatgaggaatggctggagttgagaaatgggtgtctgtgttgctcagtgaaggacaatggactcagagccatcgaaaatctaatgcagaagaagggcaagtttgacgatatcctcctagagacaacgggattggctgacccaggcgccgttgcctctatgttctgggtcgacgccgaacttgggtccgatatctacctcgacggtatcatcaccatcgttgactctaagtatggcctaaagcatctcacggaggagaaaccagatggcctcattaatgaggccaccaggcaggtcgccttagcagatatcattctcataaacaagaccgacctggtacccgaggaggacgtgaaaaaattgaggacaaccattagatctatcaatgggctgggccagattcttgaaacgcagagatcctccctgcagaagaagcttcaacacgtgcccggaacacaaccccatctggaccaatctatcgtgaccattacatttgaagtgcccgggaatgctaaggaagaacacctgaacatgtttatacagaatctactctgggaaaagaatgtcaggaataaagataaccactgcatggaggtgattaggcttaagggacttgttagcataaaggacaagtcacaacaagtgatcgtgcagggcgtacacgagctctatgatttggaggaaacacccgtgagctggaaggatgacactgaacggaccaatcggctggtcctaatcggacggaacctcgacaaagacatccttaagcaattgttcatagccactgtgactgagacggaaaaacagtggaccacccacttcaaggaggaccaggtgtgtacttag

SEQ ID NO: 183343 - DNA, 225 bp, Artificial Sequence
  Description of Artificial Sequence: Synthetic coding sequence
atgtacttcaagcgggccccccgggccttccccgtgctgctgaccggggcggggaaaactaccctgttaaattatatcttaaccgaacagcatagcaaacgagtggcagtgattctgaacgaaagcggcgagggctccgcactggagaagtctctggcagtgagccagggaggcgaactctacgaggaatggctcgagctgcgcaacggatgcctttgctgctag

SEQ ID NO: 183344 - DNA, 543 bp, Artificial Sequence
  Description of Artificial Sequence: Synthetic coding sequence
atgctgcccgccgtgggcagcgtggacgaggaggaggaccccgccgaggaggattgccctgagctggtgcccatcgagaccacgcagtctgaggaagaggaaaaaagcggtttgggcgcgaagattccagtgacaattataacaggatacctgggagcgggaaagactaccctgctcaactacatcctgacagaacagcactctaagcgggttgcagttattctgaacgagtcgggtgagggcagtgccctcgagaaaagcctagcggtctcgcaaggaggagaactctacgaagaatggctagagctgcggaatggatgtctgtgttgttcagttaaggacaatgggcttcgggctattgaaaacctaatgcagaagaagggcaagtttgacgatattctactagaaaccactggcttggcggacccaggggccgttgcctccatgttctgggttgatgccgaattgggctcggatatttacctggacggaattattacaatcgtggactctaaatacggacttaaagttaaataccactag

SEQ ID NO: 183345 - DNA, 1044 bp, Artificial Sequence
  Description of Artificial Sequence: Synthetic coding sequence
atgctgcccgccgtgggcagcgtggacgaggaggaggaccccgccgaggaggattgccccgaacttgtgcctatcgaaactactcagtccgaagaggaagaaaaatcaggcctcggcgctaagatacccgtgactatcattaccggctacctcggagccggcaagaccacgctgctcaattacattctgacagaacagcactccaaaagagttgccgtcatccttaacgaatctggggagggctctgccttggagaagtctcttgccgtgagccaaggcggggaattatatgaagaatggttggaattgagaaatggatgtctctgttgtagtgtaaaggataacggtttaagggcaattgaaaacttgatgcagaaaaaaggcaaattcgatgatattctcctcgagacgaccggtttggcagatcctggggcagtagcctccatgttctgggtggatgccgagttaggatcggatatttatctcgatggtataatcacaatcgtggattccaaatacgggctgaaacacctgacggaggagaagcctgatgggttaattaacgaggctacgaggtccattaatggcctcggccagattttagaaacgcaacgcagctcgctgcagaaaaaactgcagcatgtgcctggtacacagccccacctggaccagagtatcgttacaattacattcgaagtaccagggaatgccaaggaggaacacctgaacatgttcatacagaacctcctgtgggaaaagaatgtgcgtaataaagataaccactgcatggaagtgattcgcttgaagggtctggtctctattaaagataaaagccaacaggtcattgtacaaggtgtacacgagctttacgacttggaggaaaccccagtgtcttggaaagacgatacagaaagaacgaatagactagtattgatcggccgcaacttagacaaagacattctgaaacaactattcatagccacggtgacagagaccgagaaacagtggacaacgcacttcaaagaggatcaagtttgtacttag

SEQ ID NO: 183346 - DNA, 987 bp, Artificial Sequence
  Description of Artificial Sequence: Synthetic coding sequence
atgctgggcagccgggccgccggcttcgcccggggcctgcgggccgtcgccttggcctggcttccaggatggcgaggcaggtcattcgcccttgcacgcgcagctggggcaccccacggtggggatctccaaccgcctgcgtgccccgagcctagaggccggcagctgtcactctccgcagcagccgtggtcgactccgctcctcgccctctccagccttacttgcgcctgatgaggctcgacaagcccatcggaacctggcttctgtacttaccctgtacatggtcgattggattggcagctgaacccggatgctttccagactggtacatgctgtcactctttgggactggtgcaatcttaatgcgaggcgcagggtgcactatcaacgatatgtgggatcaagattacgacaagaaagtcaccagaacagctaaccgtcccatagccgctggcgacatatctacttttcagagttttgtattccttgggggacagttgactcttgctctgggggtcctcctgtgcttgaattactatagcattgccctgggcgccggcagcttactcttggtaattacctaccctctgatgaaacggatttcctattggccccagctggctctggggctgactttcaactggggagcactcctggggtggtccgctatcaaagggagttgcgaccctagtgtttgcctccccctgtactttagtggcgtaatgtggacactgatctacgatacaatttacgctcatcaggacaagagggatgacgtcctgatcggcttgaagtccacagctctgagattcggtgagaatactaagccgtggctctcaggctttagcgtagccatgttgggtgccctgagcctcgtgggcgttaacagcgggcagacggcgccctattatgcggctcttggagctgtgggcgctcacctcactcaccagaaatggggcctggagatcctgcctaggctcgtttag

SEQ ID NO: 183347 - DNA, 1266 bp, Artificial Sequence
  Description of Artificial Sequence: Synthetic coding sequence
atgacccccatcagccaggtgcggatgcggaagggcagcgcccacacagccgcacagccagggagactgggactgcatcctgccggggcgactgctcacgcctgccggggcatgacaagcatacgagctcggcctgggctcacatctgccatgctcggttctagagccgccggctttgcaagaggcctgcgcgccgttgcattggcatggctccctgggtggagaggccgttcgttcgcgctagcaagggctgcgggcgcaccgcacggtggcgacctccaaccccctgcttgcccagagcctagaggcaggcagctctcattgagtgctgccgccgtggtggacagcgcgccaaggcccttgcagccgtaccttcgccttatgcgcttggacaagcccattggtacatggctgttatatttgccatgcacttggtctattggcctagccgcagagccagggtgttttcccgactggtatatgctgagtttgtttggcaccggggcgatcctcatgagaggcgccgggtgcactatcaatgatatgtgggatcaggactatgataagaaggtgacaaggaccgcaaatagaccaatagccgccggcgacatctctacattccagtcattcgtgtttctcgggggccaactgactctagctttgggggttctgctgtgtctgaattattattcaattgctctgggcgccgggtcactactgttggtcatcacatatccgttgatgaagaggatttcctattggcctcagttagctctgggcctcacttttaactggggggcactgctgggctggagtgccatcaaagggtcttgcgatccctctgtgtgcttgcctttgtacttcagtggtgtaatgtggactctgatctacgacaccatttacgcccatcaggacaaaagagacgacgtattgatcgggctaaaaagtacagccttaagattcggagagaacacaaagccctggttgtccggttttagtgtcgcaatgctgggtgctctatctcttgttggcgtgaacagcggtcaaaccgccccctactatgccgcgcttggggccgtgggtgcccacttgacacatcagatttacaccctggatatccacagacctgaggattgctggaataaatttataagtaacagaacactcggtttaatcgtcttcctagggatagtgctgggcaatctttggaaggaaaagaagacagataagaccaaaaagggaattgaaaacaagatcgaaaattag

SEQ ID NO: 183348 - DNA, 1155 bp, Artificial Sequence
  Description of Artificial Sequence: Synthetic coding sequence
atgaccagcatccgggcccggcccggcctgaccagcgccatgctgggcagccgagccgccggctttgctagggggctgagggccgtggcgctcgcgtggttgcccggttggagaggccgcagcttcgctcttgcccgagccgcaggcgctccccacgggggtgatcttcagcctccggcctgtccagagccacggggcagacagcttagtcttagcgctgctgctgtagtggacagcgccccacgcccattacaaccctacttgcgcctaatgaggctggacaagccaattggtacgtggctactgtacctgccctgcacatggtctattgggctggctgcagagccaggttgttttccagattggtatatgctctccctgttcggcacaggcgctatcttaatgcgcggggccgggtgcacaatcaacgacatgtgggaccaagattatgacaaaaaagtcacacgtaccgctaatcgtcccatagccgcaggggacatctctacctttcaatccttcgtttttctcggcggacagttgaccctggcattgggggttctgttatgtctgaattattacagcatagcacttggcgccggcagtctgctgctggtcatcacctaccccctgatgaagagaatctcctactggccacaactggcacttggcctgacttttaattggggtgcactgctggggtggtctgctattaaagggtcatgtgatcccagcgtttgtttgcctttgtactttagcggcgtcatgtggacgttgatctatgacaccatctatgcacatcaagacaagcgagatgacgtgctaattggtttaaagagcactgctctgagattcggcgaaaacacgaagccctggctctccggtttttccgtggccatgctgggagctctttctctggtcggggtgaatagtggccaaactgctccctattacgcagcattgggtgcggttggagcgcatctgactcaccagatttacacccttgacatccacagacccgaggattgctggaataaattcatttccaaccgtactctgggccttatcgttttcctcggtattgtgctgggtaatctgtggaaagagaaaaaaacggacaaaactaaaaaggggatcgagaataaaatcgagaattag

SEQ ID NO: 183349 - DNA, 798 bp, Artificial Sequence
  Description of Artificial Sequence: Synthetic coding sequence
atggccaccctgctgcggcccgtgctgcggcggctgtgcggcctgccaggtctgcaacgcccggcagcagaaatgcccctgagggctcggtctgacggagccgggccactgtattcccaccacttgcccacctcccccctgcagaagggacttcttgccgcaggatccgccgctatggcactatacaacccatatcgccatgacatggtggcagtcctcggcgagacaaccgggcacaggacgctaaaagttctgcgcgaccaaatgcggcgagacccagagggggcacaaattctgcaagaacggccaagaatttcaaccagcaccctggacctgggcaagctgcaatcactgcctgaggggagtttgggacgggagtacctgagattcctcgacgtgaacagagtgtcacctgacactcgggccccaactaggtttgtcgacgatgaggagctggcttatgtgatacagcggtatagggaggtgcacgatatgctgcatacgctgcttggaatgcccactaatattttgggagaaatcgtagtgaaatggttcgaagccgtgcagacaggattgcctatgtgtatactgggagccttcttcggacctattcgcttgggtgctcagagtctgcaggtgctcgtgagcgaactcatcccctgggccgtgcaaaatgggaggcgcgccccctgtgtactgaatctgtattatgaacgcaggtgggaacagtcattgcgcgccctccgcgaagagctcggcatcacagcccctccaatgcacgtacagggactcgcctag

SEQ ID NO: 183350 - DNA, 456 bp, Artificial Sequence
  Description of Artificial Sequence: Synthetic coding sequence
atggccaccctgctgcggcccgtgctgcggcggctgtgcggcctgcccgggctgcagcgtccagcagccgagatgcccctcagggctcgcagcgacggggctggcccgctgtactcccaccatctccccacctcacctcttcagaaggggctgctggcggcgggtagcgcagctatggctctgtataatccttacaggcatgatatggtcgccgtgctgggcgagacaactgggcaccgcactttaaaggtgttacgtgaccagatgcgacgcgaccctgagggcgctcagatcctccaggaacggccccgcatatcaacgagcacactcgatttagggaaattgcagtctttgccagaagggtcactcggtcgggagtatcttcgattcctggatgtaaacgtctcgtttcagttgctctgtatttggcaatctcctgatagaacagaagagtag

SEQ ID NO: 183351 - DNA, 654 bp, Artificial Sequence
  Description of Artificial Sequence: Synthetic coding sequence
atgagctgcgccggcgccgccgccgccccccggctgtggcggctgaggcctggtgcccgccgatctctttccgcctatggacggaggaccagtgtcagatttcgatctagcggcatgaccctcgataatattagccgagcagccgtcgatagaattatccgcgtggaccatgcaggggaatatggcgctaaccgaatttatgcaggccagatggccgtgctgggtcgtaccagtgtgggccctgtcattcaaaaaatgtgggaccaggaaaaagatcatcttaaaaagttcaatgaactgatggtaactttccgggtgcgccccactgtccttatgcccctctggaacgtcctgggttttgccttaggggcgggaaccgcccttctgggaaaggagggcgccatggcttgcaccgtggctgttgaagagtccatagctcaccattataacaaccagatacgaactctcatggaggaggaccccgagaaatacgaagaactccttcagcttatcaagaagttcagagatgaagagcttgaacatcatgatataggattagatcatgacgccgagctcgcaccggcatatgccgtccttaaatccatcatccaggccggatgcagagtcgctatatatctgtctgagagactgtag

SEQ ID NO: 183352 - DNA, 540 bp, Artificial Sequence
  Description of Artificial Sequence: Synthetic coding sequence
atgaccctggacaacatcagccgggccgccgtggaccggatcatcagagtggatcacgcgggtgaatatggcgctaatcggatctatgcgggtcagatggcggtgcttggccgcacaagcgtgggtcctgtaattcagaagatgtgggaccaggaaaaggatcatttgaaaaaattcaatgagctgatggttacctttcgggtgcgcccaaccgtgctgatgcctctgtggaatgttctcggcttcgccctgggcgccggcacggcgttgctagggaaggaaggtgccatggcctgcacggtcgccgtagaggaatccattgcccatcattacaacaatcaaatccgaacactgatggaagaagatcctgagaaatacgaagaactccttcagctaatcaagaagtttcgagatgaagaactagaacatcatgatataggactagatcacgacgccgagctcgcccctgcttacgcggtgctgaagtcaattatccaggcaggatgtagggtcgccatttatctcagcgaaaggctgtag

SEQ ID NO: 183353 - DNA, 957 bp, Artificial Sequence
  Description of Artificial Sequence: Synthetic coding sequence
atggccgccgccgccgtgagcggcgccctgggccgggccggctggcggctgctgcaattgcgatgtctgcccgtggcgcgctgtcgacaggctctggtaccacgcgccttccacgccagtgccgtgggactgagatccagtgacgaacagaagcagcaaccccctaacagctttagccaacagcactccgagacgcagggcgccgagaaacctgatcctgaatcctcgcactccccgccccgatacacagatcagggcggagaggaggaagaggattatgaatctgaggagcagctgcagcatagaatcctgaccgcggccttggagtttgtgcccgctcatgggtggaccgcggaagcgatcgcggagggcgcccaatccctgggcctgtccagtgccgcagctagtatgttcgggaaggatggatcagagcttattctccacttcgttacgcaatgtaataccagacttactagagtactggaggaagaacagaagttagtgcagttagggcaggctgaaaagcgaaagacagatcagtttctgagagatgccgtggagacgcgccttaggatgctcatcccctacatcgagcactggccccgtgcgctctccatcttgatgcttcctcacaacatcccatcaagtctgtctttgctgacgtctatggtggatgacatgtggcactatgctggcgaccaatccactgatttcaattggtatactcgccgcgctatgctagctgccatttataatactaccgaacttgtgatgatgcaggactcgtctccggattttgaggacacatggcgttttttggaaaatcgcgttaacgacgccatgaacatgggacatacagctaaacaggttaaaagtacaggcgaagctctcgtccaggggctaatgggggccgcagtcaccttgaagaatctgaccggcctgaaccagcgacgctag

SEQ ID NO: 183354 - DNA, 1743 bp, Artificial Sequence
  Description of Artificial Sequence: Synthetic coding sequence
atgttcgccggcctgcaggacctgggcgtggccaacggcgaggacctcaaggagactttaacgaattgcacagagcccttaaaagctatcgaacagtttcagaccgaaaatggcgtgctgctgccaagtctccagagtgcactgccgtttctggatctccacggtacccccaggctagagtttcaccagagcgtcttcgacgaacttagagacaaattgctggaaagggtaagtgccatcgcaagtgaggggaaagccgaagagagatataaaaagctggaagatctgcttgagaaatctttcagcctagtcaagatgcccagtttgcaaccggttgtaatgtgcgtcatgaagcacctgcctaaggttccagaaaaaaaattaaagctggtgatggcagacaaggaactataccgggcttgtgcggtggaggtgaaacggcagatttggcaggataaccaagccctgtttggagacgaagtgagccccctactcaagcaatatatcttggaaaaagagtctgctctcttcagcacagagctatctgttttgcacaattttttcagcccgtctcctaagacacgacgtcagggagaggtggtccagaggctgaccaggatggttggtaagaatgttaaactgtatgacatggttctccagtttttgcggacgttgtttctgcggactagaaacgtgcactattgcactctgcgggcggagctgctcatgtccctccacgacctggacgtcggcgaaatatgcacggtagacccatgtcacaaattcacctggtgcctggatgcttgcattagagagcggtttgtcgattctaagcgggctcgagaattacaggggttcctggatggggtcaagaaggggcaggagcaggtgctgggagacctgtctatgattctatgtgatccgtttgctattaacacactagctcttagtactgtcaggcatcttcaagagttggtgggacaggaaacccttcccagagactcgcctgatctgctgttgctgctgagactgcttgcattggggcagggggcttgggacatgattgatagccaggtcttcaaggagcccaagatggaagtggagctcatcactagatttctgccgatgctaatgagcttcttggtcgacgactatacattcaacgtcgatcagaagcttcccgccgaagagaaggccccagtgtcctaccctaacaccctgcccgagtcttttaccaagtttctccaggagcagcggatggcgtgcgaggttgggctgtattacgtgctacacattacgaagcagcggaacaagaacgccctgctgaggttgctccctgggctggtggaaacatttggcgacctggcatttggtgatatttttttacacctgctcaccgggaacctggctctgttagctgacgaatttgcactggaggacttctgctcatcactgttcgatgggtttttcctaacagcctccccccgcaaagagaatgtacaccggcatgctttgagactgctgatccatttacaccctcgcgtggcaccatcaaaactggaggccctgcagaaagctctagaaccaaccggccagagcggcgaggcagtgaaggaactgtattctcagctcggtgaaaaacttgaacaactagaccaccgtaagccatccccagcgcaggccgcggagactcctgcgctagaacttcccttgccgagtgttccagcccctgccccactttag

SEQ ID NO: 183355 - DNA, 501 bp, Artificial Sequence
  Description of Artificial Sequence: Synthetic coding sequence
atggccagcggcgtgaccgtgaacgacgaggtgatcaaggtgttcaacgatatgaaggtgcgcaagagtagtacacaagaggagatcaaaaagcgtaaaaaagctgtcctgttctgcctatctgacgataaacgccagattatagtcgaggaagccaagcagatcttagttggagacatcggagacactgttgaagacccttataccagcttcgtcaagctgctcccgctcaatgattgtcggtacgcactgtacgatgctacctacgaaaccaaggaatccaaaaaagaggatctcgtgttcatcttttgggctcctgagtctgctccactgaaatccaaaatgatctacgcatcttccaaggatgcaattaagaaaaaatttacgggcattaagcacgaatggcaggtaaacggactagatgacatcaaggacagatctacgctcggcgaaaaactgggggggaacgtcgtggtgtcattggaaggaaaacctctctag

SEQ ID NO: 183356 - DNA, 501 bp, Artificial Sequence
  Description of Artificial Sequence: Synthetic coding sequence
atggccagcggcgtgaccgtgaacgacgaggtgatcaaggtgttcaatgatatgaaggtgaggaaatctagtacccaagaagagattaaaaagcgcaaaaaagccgtactcttctgtctgtcggacgacaagagacaaatcattgtggaggaagcaaaacagattctggtcggagacataggagacaccgtggaggatccgtacacaagtttcgtaaagctcctgccacttaatgattgtaggtatgctctctacgatgccacctatgagactaaggagagtaaaaaggaagacctcgtgtttatcttttgggccccagagtctgctccccttaaaagtaaaatgatctatgcaagctcaaaggacgcgatcaagaaaaagttcactgggataaagcacgagtggcaggtgaacggcctcgacgacataaaggacaggtcaactttaggggagaaactggggggaaacgtcgtggtttctctggaaggaaagcccctctag

SEQ ID NO: 183357 - DNA, 1722 bp, Artificial Sequence
  Description of Artificial Sequence: Synthetic coding sequence
atgcggcggtacgaccggggcctgaagaccctggagaacctgctggcatctatacgaaagggtaacgctatcgacgaagccgacatccctcctcccgtggccattggcaagggacctgccagtacccctacctactcacctgcgcccacacagccagccccacggatcgcttccgctcctgaacctagggtgacacttgaagggccatctgccaccgctcccgcctcatcccccgggctcgccaaaccccagatgcctcccggcccctgctctccgggtcccctcgcgcagctgcagtctagacagcgggactataagctcgccgcactccatgctaaacagcagcagctggcctttctcgaggggaggaaaaagcagcttcttcaagccgccttacgcgccaaacaaaagaatgatgtggagggggcgaagatgcacctgcggcaagccaaaggtctagagccaatgctggaagcttctaggaatggcctgcctgtagacatcacaaaggtgccacccgcccctgtgaataaggatgactttgccctcgtccaaagacctgggcctggattgtcccaggaggccgctagaaggtacggcgaactgaccaagcttattaggcaacagcatgaaatgtgtctgaaccattctaaccagtttactcagctcggaaacatcaccgagacgacaaaatttgagaaactggccgaagactgcaagaggtcaatggacatcttgaaacaggctttcgtgagaggattgccaacacctactgcacgtttcgagcagagaacctttagcgttatcaagatttttcccgatctcagctccaacgatatgctgctgtttattgttaagggcattaaccttcctacgcctcccggactatcccctggcgacttggatgtgttcgttaggttcgattttccttatcctaatgtcgaggaggctcaaaaggacaagacaagcgtgattaagaacactgacagccctgagttcaaagagcaattcaaactctgtatcaataggtcacacaggggtttcaggcgtgcgatccagacaaaaggcattaaatttgaggttgtgcacaagggggggttgttcaaaacagacagggtcctcggcaccgcccagctcaagctggacgcactggagatcgcatgcgaggttcgcgagatcctggaagttttagacggtcgacgaccaaccggcgggcggctcgaggtcatggttcgcattcgggaaccacttacggcacagcaattagagacaacaacagaacggtggctggttatcgaccctgtgcccgctgctgtcccaactgtagccggcccaaagggaaaggcccctccagtgcctgcccccgcccgggaaagcggaaacagatcagcccggcccttacactccctcagtgtcctggcattcgatcaggaaaggctggagcgcaaaatactcgcactgagacaggctcggcggcctgtgccccccgaggtcgctcagcagtaccaggatataatgcagagatcgcaatggcaacgcgcccagctcgagcagggcggggtggggatccggcgcgagtacgcagcccaactggagcgccagctccagttctatacagaagccgcgcgccgccttggcaacgacggatcccgcgacgcagccaaggaggcgttgtatagacgcaatctggtggagtctgagctgcaacgcctccgccgctag

SEQ ID NO: 183358 - DNA, 2856 bp, Artificial Sequence
  Description of Artificial Sequence: Synthetic coding sequence
atgcacaagcggaagggcccccccggcccccccggccggggcgccgccgccgccagacagttaggactcctcgtggatctctcccctgatggcttaatgattcccgaggacggtgccaatgacgaggagctggaggcagagtttcttgcactggttggcgggcaaccacccgccctcgaaaagctgaaagggaaggggccgttgcccatggaggcgatcgagaaaatggcatcactctgcatgcgggaccccgatgaagatgaggaggagggcacagacgaagatgaccttgaagcagatgatgatctactcgccgaactgaatgaggtgttgggcgaagagcaaaaggcctccgagaccccgccgcctgtggcccagcctaagcccgaagctcctcacccagggctcgagactactctccaggaaaggcttgcgctgtatcagactgctatcgaatcagcgcggcaagccggtgattctgccaagatgcgaagatatgaccgagggctgaaaacactggagaacttactggcgagcatcagaaaagggaatgccattgacgaagctgatatcccaccccctgtcgccatcgggaagggcccagccagtacacccacgtattctccagcgcccacacagcccgcaccacgtatcgcgagtgctcccgagcctagagtgaccctggaagggccctcagccaccgcaccagcctcgtctccagggcttgccaagccccagatgcccccaggtccctgttcgcccgggccgctagcacaacttcaaagccgccagcgcgattacaagctcgcagccctgcatgctaaacagcagggtgacaccacagctgccgcccgtcactttcgggtggcaaaatctttcgatgccgtgctcgaagcactctctaggggtgaaccagtagatctgtcttgtctcccaccacctcctgaccagcttcccccagatcctccgagtcccccttcccagcctccgacaccagcaactgcgccctctacaacagaggtaccaccccctcctcgaaccctcctcgaagcactagagcagcggatggaaaggtatcaggtggcagctgcacaggcgaagtcaaaaggagatcagagaaaagcacgaatgcacgagcgtatcgtgaaacagtatcaggatgctatccgggctcataaggccggtagagccgtggatgttgccgaactaccggtgcctccgggttttccccccattcagggcttggaggccaccaagcctacccagcagtctctggtgggagtgctggaaaccgcgatgaaactggccaaccaggatgaggggcctgaggacgaggaagacgaagtcccgaaaaagcagaacagccctgttgccccaaccgcacagccaaaagctccaccatcaaggacacctcagagcggatcagcacctacagccaaggctccccccaaggctacttccacgagagcccagcaacagttggccttcctcgaggggcgcaaaaagcagctgctccaggccgctctgcgggcgaagcagaaaaatgatgttgaaggggcaaaaatgcacctccggcaggcaaagggcctcgaacctatgctggaagctagtcggaatggactgcctgttgatattaccaaggtgcccccagcgccagtcaacaaagatgatttcgccctcgttcagagacccggaccaggtttatctcaagaagcagcccgccgttatggagaactaactaagctgatccgacagcagcatgagatgtgcctgaatcacagtaatcagtttacacaactcggaaacatcactgagactaccaagttcgagaaactggcagaagattgcaagaggtctatggatatcttgaaacaagcattcgttagggggttgcctaccccaaccgccaggttcgaacaacggaccttcagtgtgataaagatctttccagacctgagctccaatgacatgttgttatttatagtgaaagggatcaacctgcccacgccacccggactgtctccaggcgacctcgatgtttttgtgcgttttgattttccctacccaaacgtcgaagaggctcaaaaagacaaaacatctgttattaaaaataccgattcccccgaattcaaggaacagtttaagctgtgcatcaaccggagccatcggggttttaggcgagcgatccagacaaagggtatcaaatttgaggtggtgcataaaggagggctcttcaaaaccgatagggtgctgggcaccgcccaactgaaactggacgctctcgagattgcctgcgaggtcagggaaattttggaggtgttggatgggaggagaccgacaggggggcgactggaggtgatggtccggatccgggaaccgctcacagctcagcagctggagactaccactgagcggtggcttgtgatcgatcccgtgcctgctgctgtcccaacccaagttgctgggccgaagggtaaggcaccaccggttccagccccagctagagaaagcgggaatcgcagcgcaagacctttacatagtctatcggtgctcgccttcgatcaggagcggctggagagaaagatcctcgcgctcaggcaagccaggagacctgtcccgcccgaagttgcgcagcagtatcaggacatcatgcaacgatcgcaatggcaacgggcacaactggagcaaggaggcgtgggtattcgccgcgaatatgcggcccagcttgaaagacaacttcaattctatacagaagccgcccgccgcctcggaaacgacgggagcagagacgcagccaaagaagctctttatcgccggaacctggtggaaagcgagctgcagaggcttagacgctag

SEQ ID NO: 183359 - DNA, 711 bp, Artificial Sequence
  Description of Artificial Sequence: Synthetic coding sequence
tggcacagccccgacggcctgatgatccccgaggacggcgccaacgatgaagaactggaagccgagtttttggccctggtgggaggccaaccgcccgcgctggagaaactgaaaggcaagggacctctccctatggaggcgatcgagaagatggcctccctttgcatgcgcgaccccgacgaagatgaagaagagggtacagacgaggacgatctcgaggcagatgacgaccttctcgcagaactgaatgaggtactcggtgaagagcagaaggccagtgagacccccccaccggtggctcagccgaagcctgaggcccctcaccctggactggagaccactctgcaagagcgcctggccctgtaccagacagccatagaatcggcccgccaggctggcgattccgctaagatgagacggtatgataggggtctaaagacattggagaaccttctagccagtattcggaaggggaatgcaatagatgaggcagacatacctccacccgtggctatcggaaagggtcccgcgtcaacccctacatatagtcccgcccctactcagcctgcgccccgcattgcctcagcccccgaaccaagggtcacgctcgaagggccctcagcaactgcccccgctagctccccgggccttgctaaacctcaaatgccacccggcccatgttctcccggcccgctcgcccagctgcagtag

SEQ ID NO: 183360 - DNA, 1116 bp, Artificial Sequence
  Description of Artificial Sequence: Synthetic coding sequence
atgccccccggcccctgcagccccggccccctggcccagctgcagtctaggcaaagagactacaaattggcagccctgcatgcgaagcagcaaggcgatacaaccgccgccgccaggcattttagagtggctaagagcttcgacgcagtcctggaggccctcagtagaggggagccggtggatctgagttgtcttcccccgccccctgatcaacttcctcccgacccacccagccccccatctcagcctcccacaccggcgacggccccatcaaccacagaggtaccaccgcccccccgcacacttctggaagctctcgagcaacggatggagaggtaccaggtagccgccgcgcaggcgaaatctaaaggggaccagcgaaaggcccggatgcatgagcgtatcgtgaaacagtatcaagatgccatccgggcccataaagctgggagggcagtcgacgtggctgagctgccagtccccccgggtttcccacctatccagggacttgaggcaaccaaaccaacccaacagagccttgtcggcgttctggaaaccgcaatgaagctggccaaccaagacgagggcccggaagacgaggaagatgaagttccgaaaaagcagaattccccagtggcccccactgcccagccgaaggcacccccaagccggactccgcagtctggcagtgcgccaacagctaaagcccctcccaaagctactagcacccgggctcagcagcaactggcctttcttgagggccggaagaagcagcttctgcaggcagccttgcgtgccaagcagaagaacgacgtggagggtgccaagatgcatctgagacaggccaagggactggaacctatgttggaggcctctagaaacggcttacctgtggacatcacaaaagttcctcctgcgccagtgaataaggacgacttcgccctggtgcagagacctggccctgggctctctcaggaagccgccaggaggtacggtgagcttaccaagctgatccgccagcagcacgagatgtgcctgaaccattctaaccagttcacgcagctgggcaatatcacggaaaccaccaaggccaatatggtaaaaccatgtttctattag

SEQ ID NO: 183361 - DNA, 4539 bp, Artificial Sequence
  Description of Artificial Sequence: Synthetic coding sequence
atggtgagcgagaagagccacctgggcaacccccaggagcccgtgcaggaggaacctaagactcggctgctgtctatgaccgtccgccgaggccctaggagcctgcctccgatcccatcaacatccagaacgggattcgctgagttctccatgcggggtcggatgagggaaaagttacaggcggcccgctcgaaggccgagtcagcgctgctgcaggagatccccaccccgagaccacgaaggctgcggtccccttccaagaaggagctggagaccgaattcgggacagagccaggcaaagaagtcgagagaacccagcaggaagttgactctcagtcatatagcagggtgaagttccatgacagcgccagaaagattaagcccaaaccccaggtacctccagggtttcccagtgccgaggaggcctataatttcttcactttcaacttcgaccccgagcctgaggggtccgaggaaaagcctaaagcccggcatagggccgggacgaatcaggaggaagaagaaggggaagaggaggagcccccggcccagggcggggggaaagagatggatgaagaggagctcctaaacggcgatgacgctgaagacttcctgctgggtttagatcacgtggccgacgattttgtggccgtgcggccagccgattatgagagtattcatgaccggcttcagatggaaagagaaatgctttttattccctcacgacaaaccgtacctacttataaaaaattgcccgaaaatgtccaacctcggttcctggaggacgaaggcctttacaccggtgtgcggccggaagtggcccgcactaaccaaaacattatggagaaccgactcctcatgcaagatcccgaacgtcgttggtttggcgatgatgggcgaatacttgctcttcccaaccctataaaaccctttccctcacgcccacctgtcttaactcaggaacagagtatcaaagccgaactggaaactctgtacaagaaggcagtgaaatacgtgcattccagccaacacgtgatcagatcaggcgatccccctggaaactttcaactggacatcgatatttctgggctcatctttacacatcatccctgcttctctcgtgaacacgtgttagccgccaagctggctcaactttacgatcagtatctcgcccgccaccagagaaacaaagccaagttcctaaccgacaaactgcaagcactgaggaacgccgtccaaaccgggctagatccggagaagccccaccagagtctggataccatccaaaagactatcaatgaatacaagtctgagattagacagacacggaagttcagagatgctgaacaggagaaggacagaactctgctgaaaactatcatcaaagtctggaaagagatgaagagcctgcgcgagttccagagatttaccaatactccactcaagttggtgctgaggaaggaaaaggccgaccagaaggccgatgaggaggcttacgaggccgaaatacaggccgagatctccgagctgttggaggagcatacggaagagtatgctcagaaaatggaagaatatcgcacatctttacagcagtggaaggcatggcggaaagtccagcgcgccaagaaaaaaaagcgaaagcaggccgcagaagagcaccctggcgatgagatagcagaaccgtatcccgaggaagatttggtaaagcctagccctccagaacccacagatagggcagtcattgaacaggaagtacgcgaacgggccgcccagagcagacgtcgaccatgggaacctacgctggtacctgagctgtcccttgcgggaagcgttactccaaatgaccagtgcccacgggctgaagtgagtcgccgcgaagatgttaaaaagaggagcgtatatctcaaggtcttgttcaataataaggaggtgtctagaacagtgagcaggcccctgggggcagacttcagagttcattttggccagatatttaacctgcagatcgtcaattggcctgaaagcctgactctgcaggtttacgagaccgtgggccacagtagccccacactcctggcagaagtgttcctgcccattcctgagactacagtcgtcacaggcagagctccaaccgaggaggtcgagtttagcagcaaccaacacgtgaccttggatcacgaaggggtgggctcaggcgttccattttcattcgaagccgacggctctaaccaactgacccttatgacatccggcaaagtgtcccacagcgtagcctgggctatcggagaaaacgggattcccttgattcctcctttaagccagcagaacattggcttccgctcagctttgaagaaagccgacgcgatttcttcgatcggcacaagcggcctgacggacatgaagaagttggctaagtgggcagccgaatcaaagttggaccctaatgatcctaataatgctcctctgatgcagttaatttcagtggccacgtctggcgagtcctatgtgcctgattttttccggctggagcaattgcagcaagagttcaattttgtgagcgaccaggagctgaacaggagcaagcggttccgtcttctccacttgagatcccaggaggtgcccgaattccggaactacaagcaggtgcctgtgtatgatcgggaaattatggagaaggtttttcaggactatgaaaaacgtctccgcgatcggaacgtaattgaaacaaaagagcatattgacacacatagagccatcgtggcaaagtaccttcagcaggtgcgagagagcgtaatcaaccggttcctgattgccaagcagtacttccttctggccgatatgatagttgaagaagaggtgccgaatatttccatcctcggcctgtctctattcaagctggcagagcagaagcggcccctgcgtccacgccgcaaaggacggaaaaaggtcacagcgcagaacttgtccgacggggacatcaaactactggtcaacatcgtgcgcgcctacgatattccagttcgaaaacccgctgtgtccaaattccagcagcctagtagatctagcagaatgttttccgagaagcacgctgcatctccttctacctattcccccacccataatgccgattaccccctgggacaggtgttggtgcgccccttcgtggaggtgagctttcagcgaactgtgtgccacaccaccaccgctgagggccccaacccctcatggaacgaggagttggagcttcccttccgtgcccccaatggagactactccacggcttctctgcagtccgtcaaggacgtggtctttatcaatattttcgatgaggtactccacgatgttctagaggacgatagggagagaggttccggcatccacacacgcatagagcggcactggctgggatgcgtgaaaatgcccttcagcacaatttatttccaggctcggtttgagtctcaagaggacgaaaagctcctccaggcaacagaaaagttccaagcggagtgtgctctcaaattccccaatagacagtgtttgaccaccgtgatcgacatttccggaaaaacagtatttatcacacggtatctgaaacctttgaaccctcctcaagagctgctgaacgtgtacccgaacaaccttcaagctacagccgagcttgtcgcgcgctacgttagcctaattccatttctccctgataccgtctcatttgggggtatctgtgacctatggtcaaccagcgaccagtttctggacctcttggcaggtgacgaggaggaacacgctgtgctgctttgtaattacttcctctcactgggcaaaaaggcttggctacttatgggcaatgctattccagaaggccctacagcctacgtactgacctgggagcaaggacggtatctaatttggaacccatgctctggccacttctacggacaatttgacaccttctgccccctgaaaaatgtgggatgtctgattggccccgataacatttggtttaacatccagaggtacgagtccccgctgaggatcaatttcgacgtgacaaggcctaaactctggaagtccttcttctctcgcagcttgccataccccgggctgtcgagcgttcaacccgaggaattgatttaccaacgatcagataaggctgctgccgcagagctccaagatcggatcgaaaagattctcaaagagaagattatggactggaggccaaggcacctcacccgatggaaccgttactgtaccagtactctcaggcattttttacccctgctggagaaatcacagggcgaagatgtggaggacgaccaccgtgccgagttgttaaaacaactgggagattatcgttttagcggcttccctctccacatgccgtacagcgaggttaaacccctcatagatgctgtttattctacaggcgtccacaacattgatgtgccaaatgttgagttcgcattggcagtttacattcatccctatcccaaaaatgtgctcagtgtgtggatctacgttgcctctctcatacggaacaggtag

SEQ ID NO: 183362 - DNA, 4863 bp, Artificial Sequence
  Description of Artificial Sequence: Synthetic coding sequence
atgaacccccgggaggagaaggtgaagatcatcaccgaggagttcatcgaaaacgacgaagacgctgatatgggtcgccaaaataaaaacagtaaggtgcggcgacaacctagaaagaagcaacctcctactgccgttccgaaggaaatggtctcagagaaaagtcacttgggtaacccccaagagcccgttcaagaagagcccaagacccggctgctatcgatgaccgtgcgaagaggtccacgttccttaccccctatcccatcgacttccagaaccggattcgccgaattctcgatgcgcgggcgaatgagggaaaaactccaggccgctcgaagcaaggctgaaagcgcacttctgcaagagatcccaacaccgcggccgagaagattacgcagcccatccaagaaggaactggagaccgagtttgggactgaacccggaaaagaagtagagaggacccagcaggaggtggattcacaatcctatagccgagtgaagtttcatgattctgctcggaaaattaagcccaaaccacaggtcccacctggcttccccagcgccgaagaagcctataatttcttcacttttaactttgaccccgaaccggaaggctcagaggaaaaacctaaagctcgccaccgggccgggaccaatcaagaggaggaggagggcgaggaggaggaacccccagcccaggggggggggaaagagatggacgaggaggaacttttgaatggtgatgatgccgaggatttccttctagggttggatcacgtagctgatgacttcgtagcagtgcgccccgctgattatgaaagcattcacgaccggctgcaaatggaacgagagatgctgttcatcccatcgaggcagactgtgcccacttacaagaagcttcccgaaaatgtgcagccccgtttcctggaggatgaaggtctctacactggggttcgacccgaggtggctcggacaaaccagaacattatggagaatcggctgctgatgcaggatcctgagcgccggtggttcggcgatgacgggcgtattcttgccttgccaaatcctatcaagccatttccttcacgacccccagtgctgacacaggagcagtcgatcaaggcagaattggaaactctgtacaaaaaggcggtgaagtacgtacacagtagccagcacgtaattaggtccggcgacccacccgggaattttcagctggatattgatatcagtggcctcatcttcacacaccatccttgtttcagtagggagcacgtcctcgccgcaaaactggcacagctctacgaccaatacttagcacgacaccagcggaataaggcaaagtttttgactgacaaactacaggccctgcgcaacgctgtccaaactggactggatccggagaaaccccaccagtcactggatactatacaaaaaaccatcaatgagtataagtctgagattcgccagactaggaaattcagggacgcagaacaagaaaaagataggacgctactgaagacaatcatcaaggtttggaaagagatgaaaagtcttcgagaattccaaagattcacgaatacccccctgaaactcgtgctcagaaaggagaaggcggaccaaaaagccgacgaggaagcatatgaggcagaaatccaagcggagatctcggaacttttggaggaacatacagaagaatatgcccaaaagatggaggagtatagaacaagcctgcagcagtggaaggcgtggcggaaagtccaacgagctaagaagaagaagcgaaagcaggccgccgaagagcatccgggagacgaaatcgcagaaccataccccgaggaggatctcgtgaaacctagccccccagagcctacagacagagctgtaatcgagcaggaggtgcgagagagagccgcccaaagtcggagacggccctgggagccaacgctggtgccagaactgtcactggcaggatcagttactcccaatgaccagtgtccccgtgccgaggtgagccggagggaagatgtcaagaagagatccgtgtacttgaaggtactgtttaacaataaggaagtgtccagaacggtttcacggccactgggcgccgatttccgagttcactttggccagattttcaatctccagattgtgaactggccggagtcacttaccctgcaggtctatgaaaccgtcgggcacagctctcctactctgttagccgaagtgtttctcccgatccctgaaaccaccgtcgtgacagggagggctccaacagaagaggtggaattttcctccaatcaacacgtgaccctcgaccacgagggtgtcggaagcggagttccatttagcttcgaggctgatggtagcaatcagctaactctgatgacatctggcaaggtgagtcactccgttgcctgggccattggagaaaacgggattcctttaattccaccattaagccaacaaaatataggctttcgtagcgccctgaagaaggcggatgctattagttctattggtacatctgggctaaccgatatgaagaagctggccaagtgggccgcagagagtaagcttgatccaaatgatccaaacaatgcccccttgatgcaacttatttcagtggccacttccggtgagtcatatgtgcctgatttcttccgcctggaacagctgcagcaagaattcaattttgtgtctgatcaggaattgaaccgaagcaaacgcttcaggctgttgcacttacggtcccaagaagtcccagagttcaggaattataaacaggttcctgtctatgacagggagattatggaaaaggtgtttcaggactatgagaagcggcttcgtgatcgcaatgtgatcgagaccaaagaacatatcgacacccaccgagccatcgtagccaaatacctccagcaggttcgggagtccgttatcaatcggttcttaattgctaaacagtattttctgctcgccgacatgatagtggaggaggaagtgcctaacatttctatcctaggactctcattgtttaagctggcagagcagaagaggccgctaaggcctagaagaaagggcagaaaaaaggtaacagcccaaaatctgtcagacggcgacataaagctgctggtgaatatcgtgagggcatacgacatccctgtgagaaaacccgccgtgagtaagtttcaacagccgagcaggtcatcccgtatgttctcagagaagcacgccgctagtcctagcacatactcgcccacccacaatgccgactatcctctggggcaggtgctcgtgagaccgttcgtggaggtatcctttcagcggaccgtttgtcataccacaacagcagagggccccaatccttcgtggaatgaagaacttgaactgcctttcagagcgccaaatggcgattacagcacggcatcattacagtctgtgaaagacgtagtgtttattaatatttttgatgaggtgctgcacgatgtcctggaggatgacagggagaggggttccggcatccacactcgcatcgaacggcactggctcggttgcgtaaagatgcccttctccacaatctatttccaggcacgcatcgatggtacgttcaagatcgatattcccccagtgctcctgggatattccaaggagaggaacatgattttagagaggggatttgatagcgtgcggagcttgagcgagggctcctacataaccctctttatcacaattgagccacagttagtacccggcgagtcaatacgcgaaaaattcgagtcccaggaagatgaaaagcttctacaagctaccgagaagttccaagcagagtgtgccctgaagtttcccaacagacagtgtctgactaccgtaatcgatatttccggcaaaacagtcttcattacaagatacctgaaacccctcaaccccccccaggaactcctgaacgtatatccaaacaatttgcaggcaacggccgagttagtcgcgagatatgttagtctgattccattcttacctgataccgtgtcctttggcggtatatgtgatctgtggtctaccagcgaccaatttctcgacctacttgctggcgatgaggaagagcacgccgtcttgttatgtaactacttcctgtccctcggcaagaaagcgtggctcttgatgggaaatgccatccctgagggtcctaccgcatatgtgcttacctgggagcagggccggtatctcatctggaatccttgtagcggacatttttatggtcagttcgatactttttgcccattgaagaacgtcgggtgcttaattgggcccgataacatctggtttaacatccaacgatacgagtcaccacttcgcatcaactttgacgtgaccaggccaaaattatggaagtcgttcttttcccgtagcctgccctatcctgggctgtccagtgtgcaaccagaggagctgatctaccaacggtctgacaaggcggcggccgcagagctgcaagatcgcattgagaaaatcctgaaggaaaagatcatggactggaggccccggcatctgacgcggtggaatcggtattgtaccagcacactcagacatttcttgccccttttggagaaatcccaaggcgaggacgtggaggacgaccacagagctgaattgttaaagcagcttggcgattacagatttagtggctttcctctgcacatgccgtatagtgaagtgaagccactcatcgacgctgtgtattccactggcgttcataatattgacgttcccaatgtcgagtttgccctggccgtgtatatccacccgtatcccaaaaacgtactctcagtctggatttatgttgcgtctctgatccggaatcgttag

SEQ ID NO: 183363 - DNA, 4863 bp, Artificial Sequence
  Description of Artificial Sequence: Synthetic coding sequence
atgaacccccgggaggagaaggtgaagatcatcaccgaggagttcatcgagaatgacgaagatgctgatatgggtaggcaaaacaagaacagtaaggtacgcagacagcctaggaagaaacagccaccaaccgccgtgcccaaggagatggtgtctgagaagagtcacctcgggaacccgcaggaacccgtgcaggaggaaccaaaaactaggctgttatcgatgacggtgagacgtggcccgcgctctttaccgcctattccatctactagcagaacgggctttgctgagttctcaatgcgagggcgaatgagagaaaagctgcaggcagctcgctccaaagcggagtctgcgttacttcaagaaatccccactccacgaccgagacggctcaggtccccttccaagaaagaactcgagaccgagttcggcactgagccgggcaaagaggttgagagaacccagcaggaagtcgactcacaatcttatagtcgggtcaagtttcacgactctgcccggaagattaagcccaagcctcaggtcccgccagggttccccagcgcggaagaagcatacaacttttttacattcaacttcgacccagagccagaagggtcagaggaaaagccaaaggcacgacaccgcgccggaacaaatcaggaagaagaagaaggagaggaagaggagcctccggctcagggtggcggcaaggaaatggatgaagaggagctcctgaatggggatgacgctgaggatttcctgttaggattagaccatgtggcagatgacttcgtagccgtgcggccagccgactacgaatcgattcacgaccggctacagatggagagagaaatgctattcatcccttctcgacagacagtccccacatacaagaagctgcccgaaaatgtgcaaccacggtttctagaagatgagggtctgtataccggagtacggcctgaggtggccaggaccaatcagaacatcatggaaaacagactcctgatgcaggaccctgaacggcgctggttcggagacgatggtagaattcttgcactgcctaaccctattaagccgtttcccagcaggccgccagttcttacccaagaacagtcaatcaaagccgaactggaaacattgtacaaaaaggcggtgaagtacgtacattcttcccaacacgtaattcgcagtggcgatccccccgggaatttccagctggatatagacatctccggtttgatctttacccaccacccctgcttttctagagagcacgtgctggcagctaagctggcacagctgtatgaccagtacttggctcgacaccagcgaaataaagcaaagtttctaactgacaagctgcaagctcttcggaacgccgtgcaaacagggctggatcccgagaaaccccatcagtctttggacacaattcagaaaacaataaatgaatataaatccgaaatccggcagacacggaaattccgagatgcagagcaggagaaggacaggacgctcctaaaaactatcattaaggtctggaaagaaatgaagagcttgagggagtttcagcgtttcaccaacacacctctaaagctggtgttgcggaaagaaaaggccgaccagaaggccgacgaggaggcttacgaagcagaaatccaggcagagatctcggagctcttagaggaacacacggaggaatatgctcaaaagatggaggagtaccggacgagccttcaacaatggaaggcctggcggaaagtgcagcgggccaagaagaagaagaggaaacaagccgccgaggaacatcctggtgacgaaatcgccgaaccttatcccgaagaggatctggtcaagccctcacctcccgagcccaccgatcgtgctgtgattgaacaggaggtgcgggagagagccgcccagtctaggcggagaccctgggagcctacactcgtccccgagctctctttagctggctctgttacgcccaatgatcaatgccctagagccgaagtgtctcgaagggaggatgtgaagaaacgctcggtgtacctgaaagtgcttttcaataacaaggaggtgtcaagaactgtgtcacggccactcggcgctgactttcgtgttcattttggccagatcttcaacctgcagattgtgaattggcctgagtccctgacgttgcaggtgtacgagactgtcggccattcaagcccgacgctcctggccgaagtgtttttgcccattccggaaaccactgtagtgaccggaagagcacctactgaagaggtggagtttagcagtaaccagcacgtgacgctggaccacgaaggggttggctctggggtaccgttctccttcgaagcagacggatcgaatcaacttactctgatgacatcaggcaaagtcagtcactccgttgcttgggccattggggagaatggtatcccccttatccccccactgagtcagcagaatattgggtttagaagcgccctgaagaaagcggacgccatctcctccatcggcacctccggtttaacagatatgaaaaagcttgccaagtgggccgcagaatccaaactcgacccaaatgaccccaataacgcccctctcatgcagctgatcagcgtcgctactagcggagaatcctatgtgccagattttttccgcttggaacaactgcagcaggagtttaacttcgtcagcgaccaagaattgaatcgcagtaaaagattcaggctgttacacctgaggtctcaggaagtgcctgaattccgcaactacaagcaggtacctgtgtacgatcgagagattatggagaaggtgttccaagactacgagaagagactcagggatcgcaacgttattgaaactaaagagcatattgatacccatcgggctattgtggccaagtacctgcaacaggtcagggagtccgttattaaccgatttcttatcgcgaagcagtatttcctgcttgcggatatgattgtggaggaggaagttccaaacatcagtatactgggcctgtccttgttcaaactcgccgaacagaagagacctctgcgccctcgacggaagggccggaagaaagtgacagcacagaatttgtcggacggggacatcaagctgctggtgaatatcgtacgcgcttacgacatccccgtgcgcaagccagctgtctccaagtttcagcagccatctagatctagccgcatgttctccgagaagcatgcggcttcgcccagcacctactcacctacccacaatgctgactacccactgggacaggttcttgttcggccctttgtggaggtaagctttcagagaacagtttgtcataccaccaccgccgagggaccaaacccaagctggaacgaagagttagagcttcctttcagggcgcctaacggcgactacagtaccgccagcttacaaagcgtgaaagacgtggtgttcatcaatatatttgatgaagtgctgcacgatgtccttgaggatgacagggagcgggggtccgggattcacacgcggatcgaaaggcactggttgggctgcgtcaagatgcccttttccactatttacttccaggctagaatcgatggtactttcaagatcgatattcctccagtgttgttgggttactcaaaggaaaggaacatgattctagagcgcggcttcgatagcgtgcgttctctgtctgagggctcttatattaccctctttattacaatcgaaccccagctggtccccggagaatctattcgcgaaaagttcgagagccaggaggatgagaaactgctgcaggccacggagaaattccaggccgaatgtgctctgaagttcccaaatagacagtgtctgactaccgtcattgatatcagcggaaagacagtctttattaccagatatttaaagcccctgaacccgccgcaggagttgctcaacgtttatccaaataatctgcaagctaccgcagaactggtcgcgcggtacgtctctctgattccattcttaccagatacagtgagttttggcggcatatgtgacctctggagcacaagcgatcagtttctagacttgttggcgggcgatgaagaggaacatgctgtcttactgtgcaactactttctgagcttgggcaaaaaagcctggttgctgatgggaaacgctattcccgaggggccaacagcctacgttctgacttgggagcaggggagatatctgatttggaacccttgcagtggccacttttacggacagtttgataccttctgtcccctgaagaatgttggttgccttatcggcccagacaacatctggttcaatatccagaggtacgaatctccgcttaggataaactttgacgtgacccggccaaagctgtggaagagcttcttctctcgttctttaccctacccagggttatcatccgtgcagcctgaggagctcatttaccagcgcagcgataaggctgctgctgctgagttacaagacagaatcgaaaagattctcaaggagaagattatggattggcgcccacgccacctgactcgctggaacagatattgcacatcaacactgcggcatttcctgcctttgctggagaagtcacagggcgaggacgtcgaggatgatcatcgggcggagctgctgaagcagctaggagactaccggttttccggcttcccgttacatatgccctatagtgaggttaagcctctcatcgacgcggtatattccaccggcgtccacaacatcgatgtcccaaacgtggagttcgcattagctgtctatatccatccctaccctaaaaacgtcctcagcgtttggatctatgtcgcttccctgattcggaaccgatag

SEQ ID NO: 183364 - DNA, 4539 bp, Artificial Sequence
  Description of Artificial Sequence: Synthetic coding sequence
atggtgagcgagaagagccacctgggcaacccccaggagcccgtgcaggaggaacctaaaacacggttgctctctatgacagtgagacggggcccacgctccctccctccaatcccgtccacttccagaaccggatttgccgaattttcgatgcggggaaggatgcgcgagaagcttcaggccgctaggtctaaggcagagagcgcgttactacaggagattcccaccccaaggcctaggcggctccgctcacctagtaaaaaagaactggaaactgagttcggcaccgagccaggtaaggaagtagagaggacccaacaggaagtcgattctcaatcgtatagtagagtcaagttccacgatagtgcccgcaagataaagcccaagccacaggtgcctccgggctttccctcagcggaagaggcttataatttcttcactttcaacttcgacccagaacccgaagggtcggaggaaaagccaaaggcacggcaccgtgcaggaaccaatcaggaggaggaggagggggaagaggaagaacctcccgcccagggcggcggaaaggaaatggacgaggaggaattgcttaacggggacgacgccgaggacttcctcttgggactcgatcatgtcgccgatgactttgttgccgtcagacctgctgattacgagtcgatccacgaccgtcttcagatggagcgtgagatgctcttcattcccagccggcagacagtgcctacttataaaaagctaccagaaaatgtgcagcccaggtttctggaagacgaaggactgtatactggggttcgaccagaggtggccaggaccaaccaaaatatcatggaaaaccggctactgatgcaggatcccgagcggaggtggtttggtgatgacggacggatcctcgccctacccaatccaattaagccatttccatccagacctcctgtgcttacacaggagcaaagtattaaggctgagctggaaaccttgtataagaaagcagttaagtatgtgcattcatcccagcacgtgatcagatccggcgaccctcctggcaacttccagctggatatcgacatcagcgggcttatcttcacccatcatccatgttttagtcgagagcacgttctcgcagcaaaattggcccagctgtatgaccagtatctggctagacaccagcggaataaggccaaattcctgaccgataagctgcaggccctgcgtaatgccgtccaaaccggcttggatcccgagaaacctcatcagtctttagacaccattcaaaaaaccatcaatgaatacaagagtgaaattagacaaacgaggaagttccgggatgccgaacaggaaaaagaccgcacactgctgaaaactatcatcaaggtatggaaagaaatgaagtcactaagagagtttcagcgctttactaatactcctcttaagctggtgttgcggaaggagaaagccgaccagaaggccgatgaagaggcctatgaagctgagatccaagcagagataagtgagctgctggaagagcacaccgaagagtacgcgcaaaagatggaagagtacaggacctccctgcaacaatggaaggcatggcgcaaggtgcaacgggcgaaaaaaaagaaaagaaagcaagctgccgaggagcacccaggcgacgaaatcgcggaaccatatcccgaagaagatttagtgaagcctagccctcctgagcctacggaccgggccgttattgagcaggaggtcagggaacgtgcagcccagtctaggcgccggccttgggagccaacactcgtccctgagctgtctctggccggctctgtgacacccaacgaccagtgcccgagagccgaagttagtagaagagaggatgtaaagaaacgctccgtctacctcaaagtactgttcaacaacaaagaagtcagcagaactgtctcaagacccctgggcgcagactttcgggtacattttggccaaatctttaacctccagatcgttaactggcctgaatccctaacactccaagtgtatgagacggtcggacattctagccctacgctccttgccgaagttttcttgccgatccctgaaactacggtggtgacaggacgcgcacctacagaggaggtcgaattcagctctaaccaacatgtcaccctcgatcatgagggcgtcgggtccggcgttccatttagcttcgaagctgacgggagtaatcagctgacccttatgacatccggtaaagtgtctcacagtgtagcgtgggctattggagagaacggaatccctttgatacctccacttagccaacagaatatcggatttcggtctgctttaaagaaggcagacgctatctctagtatcggcacctctgggttaaccgacatgaagaaattggctaagtgggccgccgaatcaaaactagaccccaacgacccgaataatgctccactgatgcagctcatctctgtcgcgaccagcggggaatcttacgtgcctgacttttttcggctggagcagcttcaacaggagtttaacttcgtaagtgaccaagagctaaatcgcagcaagaggtttagactgctacatttacgcagtcaggaggtgccagaatttaggaactacaagcaggttccagtgtacgaccgagaaattatggaaaaagtttttcaggactatgagaaacgattacgggaccggaacgtgatcgagaccaaggaacacattgacacgcacagggcgattgtagcaaaatatctacagcaggtgcgtgaaagtgtgattaacagattcctcatagccaaacagtacttcttgctcgcggatatgatcgtcgaagaagaggtgccaaacatttcaatactggggctgagcttgttcaaattggcggaacaaaagagacctttacggcctcgccgcaaggggcggaaaaaagttaccgcccagaacctgtcagatggtgacatcaagctgctcgtgaacatcgttagggcctacgacattccggtccgtaaacccgctgtgtctaagtttcaacagcctagtcgctccagtcgcatgttttcagaaaaacacgcggctagcccctcgacttactcccccactcataatgctgattatcccttaggacaggtgctggttcgaccatttgttgaagtgtccttccaaagaactgtgtgccatacgacaacagccgaggggccgaatcctagctggaacgaagaactggagctccctttcagagccccaaatggggactattctacagcctctcttcagtctgttaaggacgtcgtcttcattaacatctttgatgaagtgttgcacgacgttctggaagatgacagggagagagggtccgggattcacaccagaatcgaacgccactggttaggctgtgttaaaatgcccttctctactatctacttccaggccagattcgagagccaggaggacgaaaagctgctgcaggcaacagaaaagttccaggccgagtgtgccctgaaatttcctaatcggcagtgccttacaaccgtgatcgatattagcggtaaaaccgttttcataacacgctacctgaagccgttaaatccgccgcaagagctgctaaacgtataccctaataacctacaggccaccgctgagctggtggcaaggtacgtcagcctgatcccattcttgcccgacactgtgagctttggcgggatttgtgacctctggagcaccagtgatcaatttctcgacttgctggccggagatgaggaggagcacgcagtgctgctgtgcaattactttctgtctctgggaaaaaaagcttggcttctgatgggtaatgccatccctgagggcccaactgcctacgtgcttacctgggagcaggggcgatatctgatctggaatccatgttctgggcacttttacggacagtttgacaccttttgcccgctgaaaaacgttggctgtcttatcggaccggataacatatggttcaacattcagcgctatgagtcccccctacgaatcaatttcgacgtgactcggcccaaactgtggaagtcctttttctcacgatcgctgccataccctgggctgagctctgtccagcccgaagagctcatttaccaacgttctgacaaagccgctgctgctgagctgcaggacagaatcgagaaaattctgaaggaaaaaatcatggattggagaccccgtcacctcacacgttggaacagatactgcactagcacactgagacattttctcccgctgctggagaagtcccagggtgaagacgtggaagacgatcaccgtgccgagcttttaaagcagctaggagattaccgcttttccggctttcccctacacatgccatacagcgaagtcaagccgctgattgatgctgtgtactctacaggagtacataatatcgacgtgccaaatgtggaatttgccctggccgtctatattcatccatatccaaagaatgtgctgtccgtttggatctacgttgcgtcccttatcagaaatcgctag

SEQ ID NO: 183365 - DNA, 369 bp, Artificial Sequence
  Description of Artificial Sequence: Synthetic coding sequence
atgaacccccgggaggagaaggtgaagatcatcaccgaggagttcatcgaaaacgatgaagatgcagatatgggaagacaaaacaaaaatagcaaggtccgtcgccaaccacggaagaagcagaagcccacaccgttttctagagcctgttggcagatcttacctcatctgtcagcaggagtgcccctgctgggatgggaacacccggtgcagggaaagtccttccaagcaactaactgttgtcctcagggcaatggagtcaggaagattcccccctggcagcctccaggagcatgtgctggcggggcacaggaccccccccccgagtacgacagtccagagcggcccaccgaacgagccgggtgctag

SEQ ID NO: 183366 - DNA, 4863 bp, Artificial Sequence
  Description of Artificial Sequence: Synthetic coding sequence
atgaacccccgggaggagaaggtgaagatcatcaccgaggagttcatcgaaaatgatgaggacgcggatatgggtagacagaataagaactctaaagtcaggagacaaccccggaagaagcagcctcctacggccgtacccaaggagatggtgagcgaaaagagtcacctcggcaacccccaggagcccgttcaggaggaacctaaaactagactgctcagtatgaccgttagaaggggacctaggtctctgccgcccattccttccacttcaagaacagggtttgctgaatttagcatgcgggggaggatgcgcgagaagcttcaggcggcgaggagcaaggccgaaagcgccctattacaggagattccaacaccccgacctcgaaggctgcggtctccaagcaagaaagagctcgagacagagtttggaaccgaacccggcaaggaggtggaacgcacacagcaagaggttgactcgcagagctattcacgagtcaagtttcatgattcagcccgcaagatcaagcccaagccgcaggtcccacccggcttcccctctgcagaagaggcatataatttttttaccttcaacttcgaccctgaaccagagggatcagaggagaaacccaaggctaggcatcgggccggtacaaaccaggaagaggaggaaggggaagaagaagaaccccccgcgcaaggcggtgggaaagagatggacgaggaggagctgctgaacggcgacgatgcagaagatttcttactcgggttggaccatgtcgccgacgatttcgtcgctgtccggcccgctgactacgaatccatccacgacaggcttcagatggagcgggagatgcttttcatacctagtcgtcagacagttccaacctacaagaagctgcccgagaatgtccagccgagattcctcgaggacgaggggctctataccggcgtgcgacccgaggtggcgcggactaatcaaaatattatggagaaccggctgttgatgcaggaccccgagcggcgctggttcggtgatgatggacgcatactggccttgcctaacccaattaaaccgtttccctcgaggccccccgtgctgacacaagagcagtccatcaaggctgaacttgaaactctatacaaaaaagccgttaaatatgtgcattcctcacagcatgtaattcgatcaggcgatcctccagggaattttcagcttgacattgatatctctggactgatttttacacaccatccttgcttctctcgggagcacgtgttggcagctaaattagcccaactttatgaccagtacctagcaagacatcagcgaaacaaagcaaaattcttgacggacaaattgcaggctctgcgcaatgcagtgcagacgggtctggaccccgagaagccccatcagtccttggatacaatccaaaagaccattaatgaatataagtcggaaattcgccagactcggaagtttcgggacgccgaacaagagaaggatagaactttgcttaaaaccattatcaaggtgtggaaagagatgaagagtcttcgggaattccaaagattcactaacacccccctgaagctggtcctaagaaaggagaaggctgaccagaaggcagatgaggaagcctatgaagccgaaatccaagcagaaattagtgagttgctggaagaacataccgaagagtacgcacagaaaatggaagagtacaggacaagcttacagcagtggaaagcctggcggaaagtccagagggccaaaaagaagaaaaggaagcaggctgcagaggagcaccccggcgatgaaattgccgaaccctacccagaggaggacctggttaaaccttctcctccagagccaacagatagagccgtcattgagcaggaggtacgggaaagggccgcgcaatctcgcagaaggccatgggaaccaactttggtccctgaactttctctggccggatccgtcactccaaacgaccagtgcccaagagccgaggtgtctcgccgcgaagacgttaagaagcgtagcgtttaccttaaggtcctcttcaacaataaagaggtgtcccgcactgtttctcgcccacttggcgccgacttccgagttcattttggccagatcttcaatctgcaaatcgtcaactggcctgagagtcttacgctccaggtgtacgaaacagtcggccacagcagtcccaccctcttggccgaggtgtttttgcccatccccgagaccaccgtggttaccggtagagctccaaccgaggaggtcgagttttcctccaatcagcacgttacgttagatcacgaaggcgtcggatccggagtccccttttcttttgaagctgacggaagtaaccagctaacgctcatgacctcggggaaagtgtctcactccgtcgcctgggccatcggcgagaatgggatccccttgattcctcctctgtctcaacagaacatcggatttagaagcgccctgaagaaggcagatgctatcagcagcattgggactagtggcttaactgatatgaagaagctggcgaaatgggccgccgagtcaaagctggatcccaacgacccaaacaacgccccactgatgcagctcatctcagtagccactagcggcgagtcatacgtacccgatttctttaggttagagcagcttcaacaggagtttaatttcgtcagtgatcaagaactgaatcggtccaaaaggttcaggctgctacacctgcggtctcaggaggtacccgaatttcggaattacaagcaggtcccagtgtacgacagagagatcatggagaaggtgtttcaggactacgagaagaggctgcgagatagaaatgtgattgagacaaaggagcatatcgacacacaccgtgccatagtggccaaatatttgcaacaagtgagagaatctgtgattaaccgttttctcatagctaagcagtacttcctgctggccgacatgatagtggaggaggaggtccctaacatcagcatactcggactcagcctttttaagttggccgagcagaaacgccctcttcgccccagacggaaggggagaaaaaaggttacagctcagaacctgagtgacggcgacatcaagctcttagtaaatatcgtccgggcctacgatattcccgtccggaagcccgccgtgtcaaaatttcaacagccatcaagatcaagccgaatgttttccgagaagcatgccgctagcccaagcacttacagcccaacacacaacgcagactatcctctggggcaggtgctggtgcgcccattcgtcgaagtgtcctttcagcgcacagtttgccacactacgacagccgagggcccaaatcccagttggaacgaggaactagagctgccgttccgcgctccaaatggggactattccaccgccagcctacagagtgtgaaggacgtagtattcatcaacatatttgacgaagttcttcacgacgtgctcgaggacgatagggaaagaggttcaggaatacatactcgaatagagcgtcattggttagggtgtgtcaaaatgccattcagtaccatctactttcaggccagaatcgatggcaccttcaagattgatatccccccagtgttgctaggctatagcaaggagcgcaacatgatcctggagaggggatttgactctgtgaggtctctaagcgagggatcctacattacactcttcatcaccatcgaacctcagctggtgcctggcgagtctatcagggaaaaatttgagtcccaggaggatgagaagctactgcaagctactgagaagtttcaagctgagtgtgccctgaaattccccaatcgacagtgcttaacaactgtgatcgacatttccggaaaaaccgtctttattacccggtatctgaagcccctaaatcctccacaggagctgttgaacgtatatcctaacaacttacaggctaccgccgagctggtggccagatatgtcagccttataccatttctgcccgacacggtctcattcggcggcatttgtgacctgtggagcacgtctgaccaatttctggatctgctggccggcgacgaagaagaacacgcagtgttactctgcaattatttcctgtccctcggaaaaaaggcctggttgctgatgggaaacgctatccctgaagggcccaccgcttatgttctgacgtgggagcaggggcgttatctgatctggaacccctgctctggccatttttatggccagtttgatacgttctgcccccttaaaaatgtagggtgcttgataggtccagacaacatctggtttaatatccaacgatacgagagccctttacgaataaacttcgatgtgacccggccgaagctctggaagtcttttttctcacgttctttaccctaccccggtctctcaagcgttcaacctgaggagctgatctatcagagatctgacaaagccgctgcagctgagctgcaggatcgcatcgaaaaaattctgaaagagaaaataatggattggaggcccaggcatctgaccagatggaaccggtactgtactagcaccctgcgccacttcttgcccttgcttgagaagtcacagggagaagacgtcgaagacgaccaccgggccgagctgctgaagcagctaggggactatagattttctgggtttccccttcacatgccttattcagaggtgaaaccacttatagatgcagtctactccaccggagttcacaatatcgatgtacctaacgtcgagttcgctctcgctgtgtatatccacccttaccccaagaatgtgttgtccgtctggatctatgtggctagcttaatccggaaccgttag

SEQ ID NO: 183367 - DNA, 369 bp, Artificial Sequence
  Description of Artificial Sequence: Synthetic coding sequence
atgaacccccgggaggagaaggtgaagatcatcaccgaggagttcatcgaaaacgacgaggacgccgacatgggtcggcaaaacaaaaatagcaaagtgcggcggcaaccacgcaagaagcagaaacccactccattttctagggcatgctggcagatcctgccgcacctgagcgccggtgtaccgctactggggtgggaacacccagtgcagggcaaaagcttccaagccacgaattgttgtccccagggtaacggcgtccgcaaaatccccccctggcaaccgcctggggcttgcgccggcggagcccaagatcccccacctgagtacgactcccctgaacggcccaccgagagagccggctgctag

SEQ ID NO: 183368 - DNA, 4539 bp, Artificial Sequence
  Description of Artificial Sequence: Synthetic coding sequence
atggtgagcgagaagagccacctgggcaacccccaggagcccgtgcaggaagaaccaaaaacgcgcctcctaagtatgactgtaaggaggggaccaagatccttgccccctattccctcaacaagccgaacgggattcgccgagttcagcatgcggggccggatgagggagaagctacaggccgcccgctccaaggcggaaagtgccctgctgcaagagataccaaccccacgtccacgacggctacgcagtcccagcaagaaggaactggagaccgagttcgggacagagccaggaaaagaagttgagaggacacaacaggaagtcgactcccagagttactcccgtgtaaagtttcacgatagtgcccgtaaaattaaacccaagccacaggtccctccaggattcccttcagccgaagaggcttacaacttttttacttttaacttcgatcctgaacctgaaggcagcgaggagaagcctaaggcaagacacagggctggcacaaaccaagaggaagaggagggggaagaggaggaacctcctgcccaaggcggcggaaaggaaatggatgaggaagagcttctgaatggggacgatgcagaggacttcctgctaggcctggaccatgttgctgatgatttcgtggcagtgcgccccgcagactatgaatccattcacgaccgcttgcagatggaacgtgagatgctctttatcccgtcccggcagaccgttccaacctataaaaagcttccagagaatgtgcagccccgcttcctcgaagatgagggcctgtatacaggtgtgcggccagaagtggccaggacaaatcaaaacatcatggaaaatcgcctgttgatgcaggaccccgagcgacgatggtttggagacgatggtaggatcctagcacttcccaaccccatcaagccgttccccagtagacctcccgtcttgacacaggagcagagtatcaaggctgaactcgaaaccctctataaaaaggccgtgaagtacgtgcactccagtcagcacgtcatacgctccggggaccctcccggaaatttccagttggatatcgacatatccggcctgattttcacacatcacccctgctttagcagggaacacgtcctggccgcaaagttggctcagctctacgaccaatatttagcacggcaccagcgtaataaggcaaagttcctgactgataaactccaggccctgaggaatgctgttcagacaggactcgatcccgaaaaaccacatcagagcctggacactatccagaagaccatcaacgagtacaagtccgagattcggcagacccgtaagtttagagatgccgagcaagagaaagatcgtacactgctgaaaacaattattaaggtgtggaaagaaatgaagtcgctgagggagttccagcgctttacaaatacacctttgaagctggttttaagaaaagaaaaagccgaccaaaaagcggatgaagaggcttacgaagccgagatccaagctgagatcagcgagctgttggaggagcatactgaggaatacgcccagaaaatggaggaatatcggactagtttacagcagtggaaggcctggcgaaaggtgcaacgggccaagaagaagaaacgcaaacaagccgctgaggaacacccaggagatgaaattgctgaaccttacccagaggaagacctggttaagccttctcctccagagcccactgacagggcagtgatcgaacaggaggtgcgggagagggccgctcagtcccgccgccgcccttgggaaccgaccctagtacccgagctaagcctggccggtagtgttaccccaaatgatcagtgcccgcgcgctgaggtttctcggcgcgaggacgtcaaaaagcggagtgtttatcttaaagtcctttttaacaataaagaggttagtcgcactgtaagtcgcccattgggggctgacttcagagtccattttggccagatcttcaacctccagattgttaattggccggagtctctgacattacaagtatacgaaactgtgggccactcatctccaacactgctggccgaggtgttcctgccgatcccagagactacagttgttaccggtagagctccgacagaggaggtggagttttcgtctaaccagcacgtgacattggaccacgagggggtgggttcaggcgtcccttttagttttgaagctgatggcagcaatcagttaaccctcatgacttctggcaaagtatctcactcagtagcctgggctattggcgagaacgggatccctctgatccctcctctaagccagcagaacatcggcttccgatccgctcttaaaaaagcagatgctatttcatccatcggaactagcgggttgaccgacatgaaaaaactcgcaaagtgggcagccgagtccaaattagaccctaatgaccccaacaatgctccgctgatgcaactgatctccgttgccacctccggagagtcatacgtgccggacttctttcgactcgagcagctccagcaggagttcaattttgtaagtgatcaagagctgaaccggtctaagcgttttaggttgctccacctccgctcacaagaggtgcccgagttccggaattacaaacaggtgcctgtgtacgaccgtgaaatcatggaaaaagttttccaagattacgaaaaaaggctgagggacagaaatgtgatcgagacgaaggaacatatcgatacgcaccgcgcgatcgtggccaagtacctgcagcaggttcgtgagagcgtgattaaccggtttctgatagctaaacagtatttcctgttggccgatatgattgtggaggaggaggtccctaatattagtatcctgggcctgtccctatttaaactagctgagcagaaacgccctctacggccaagacggaaaggccggaagaaggttactgcgcaaaatctgtcggatggggacatcaagcttctcgtcaacatcgttcgtgcttacgacatacctgtgaggaagccagccgtgagtaaattccagcaacctagccggagctcccgcatgtttagcgagaaacacgcggcctctccgagcacctatagcccgactcacaatgccgattatcccttgggacaggtcctagtgagacctttcgttgaagtctccttccagcggactgtatgtcatactactaccgctgagggccccaatccaagttggaacgaagagctagagctgccattccgcgcgcctaatggggactattcgactgcgtctctgcagagcgttaaagacgtcgtcttcatcaatattttcgatgaggtgctgcatgatgtgcttgaggacgaccgagagaggggttctggtattcatacacggattgaaaggcattggctgggatgcgtgaaaatgccattttctactatctactttcaggcaaggttcgagtctcaggaagacgagaagctgctgcaggccaccgaaaaatttcaggcagagtgcgcactcaagtttccgaacaggcagtgcctaactaccgtaattgacattagcggaaagacagtctttatcacccggtacttgaagccattgaatccgccccaggagctcttgaacgtctatcctaataacctgcaagctaccgctgaactggttgcccgctatgtctcactgattccctttctgccagacactgtttcttttggcggaatctgtgacttgtggtcgacgtcggaccagtttcttgatttactggccggcgatgaggaggaacacgcagttctgctgtgcaattatttcctgagcctcggcaagaaggcctggctgttgatgggcaacgcaattccagagggtcctaccgcctacgtactgacatgggagcagggacgatatcttatttggaatccatgctccggccatttctacggacagttcgatacattctgtcctctgaaaaatgtgggctgcctcattggccccgataacatctggtttaatattcagcgatacgagtctcctttgcgcattaacttcgacgtgacccgacccaagctttggaagtcgttcttctctaggtcacttccctatcctggtctgagctccgttcagccagaagaactcatataccaacgcagtgacaaggcagctgcagcagaactccaagaccggattgaaaagatcctgaaagagaagatcatggactggcgaccccgccacctaactaggtggaacagatactgcacctccacacttcggcactttcttcctttactcgagaaaagccagggagaggatgttgaggacgatcaccgcgcggaactcctgaaacagctgggcgattatcggtttagcggattccccctccacatgccgtattctgaagtcaaacctctgatcgatgctgtctactctaccggcgtacacaacattgatgtccctaatgtcgagttcgcactagcggtgtatatacacccatatcccaagaacgttctgtcagtctggatctatgttgcttccctcataaggaaccgatag

SEQ ID NO: 183369 - DNA, 369 bp, Artificial Sequence
  Description of Artificial Sequence: Synthetic coding sequence
atgaacccccgggaggagaaggtgaagatcatcaccgaggagttcattgagaatgatgaggatgccgacatgggtcgtcagaataaaaatagcaaggtgagaaggcagcctcgaaaaaaacagaagcccacccccttttctagagcatgttggcagattcttccacaccttagcgccggcgttccactgctcgggtgggagcatcctgttcaaggcaagtcctttcaggcaactaactgctgccctcagggaaacggtgtccgtaaaatccctccttggcaacccccgggggcttgtgcaggaggcgcccaggatccacccccagaatatgatagccccgagaggcccacagaacgagctggctgctag

SEQ ID NO: 183370 - DNA, 1767 bp, Artificial Sequence
  Description of Artificial Sequence: Synthetic coding sequence
atgaacccccgggaggagaaggtgaagatcatcaccgaggagttcatcgaaaatgacgaggacgcagacatggggcggcaaaacaagaactctaaggtgcgccggcaaccccgcaagaaacaaccgccgactgccgtgcctaaagagatggtgtcagagaaatcacacctgggcaatccacaggagccagttcaggaagaaccgaagacacgcttgttgagtatgactgtgaggagaggacctcggtcattacccccgattccatccactagtaggaccggtttcgcggagtttagcatgagggggcggatgcgagagaagctccaagcagcccgatcaaaagccgaaagcgccctgttgcaggagattcctaccccaaggcctagacgactccggagtcctagcaagaaagagcttgagaccgaatttggcaccgagcctggcaaagaggtggaacggacccaacaagaggtcgattctcagtcatattctcgggtgaagttccacgattccgctcggaaaatcaagccaaagccgcaggttccacctggtttccccagcgcggaggaggcctacaactttttcacattcaactttgaccctgagcccgaggggagcgaagaaaagccgaaggctagacatcgggctggaaccaaccaggaagaagaggagggagaagaggaagagcctcctgcccaggggggggggaaagagatggatgaggaagagctgctcaatggcgatgacgcagaagattttctcttaggcttggatcacgtagctgacgacttcgtagccgtacggcccgcagactacgaaagtatccacgatcgcttgcagatggaaagggagatgctgttcatcccttctcgacagactgttcccacctataaaaaacttcccgagaacgtccaaccacggtttctggaggacgagggcctctatactggcgtccgtcctgaggttgcccgaacaaaccagaacatcatggagaataggttgctgatgcaggaccctgagagacgttggtttggagacgacggccggattctggccttgcccaaccctattaagccctttccttcacggcctcccgtcctgacccaagaacagagcatcaaggctgagctggaaactctttataagaaagccgttaagtatgtccattcatcacaacacgtgatccgaagtggggaccccccaggtaactttcagctggatatagacattagcgggttgatattcacacatcatccttgttttagccgcgaacatgtgctggccgctaaacttgcacagctctatgaccaatatctcgcccgccaccagcggaacaaggccaagttcctgaccgacaaattgcaggcgctccgcaatgccgtgcaaactggtttggatcctgagaaaccccatcagtcactcgacacaatacagaagacaatcaacgagtacaaatctgagatacggcagacccgtaagttcagagacgccgagcaagagaaggaccgaaccctcctcaagaccattatcaaggtgtggaaggagatgaaatccttaagggaatttcaacggtttactaatactccacttaaattagtgcttcgcaaggagaaggccgaccaaaaagctgacgaggaggcctatgaagctgagattcaagcggaaatttctgagctgcttgaggaacatacagaggagtatgcgcagaaaatggaggagtaccgcacaagtttacagcagtggaaggcttggaggaaggtgcagtag

SEQ ID NO: 183371 - DNA, 336 bp, Artificial Sequence
  Description of Artificial Sequence: Synthetic coding sequence
atgaacccccgggaggagaaggtgaagatcatcaccgaggagttcatagaaaacgacgaggatgctgacatggggcggcagaataaaaattccaaggtccggcggcagccaagaaagaaacagccccccaccgctgtcccaaaggagatggtgtctgaaaaatcacacctggggaaccctcaagaaccagtccaggaggagccaaaaacacgtctcttatctatgaccgtccggaggggtccacgacgcgaactggtggtgaaaaagtcactggggcgcccgggcactgtcacccacgtctgtaatccaagcacactggaaggccgagggggttag

SEQ ID NO: 183372 - DNA, 882 bp, Artificial Sequence
  Description of Artificial Sequence: Synthetic coding sequence
atggccctggtgagcgccgacagccggatcgccgagctgctgaccgaattacaccaacttatcaaacaaacgcaggaggaaaggtctagaagcgagcacaatctagtaaacatccaaaagactcacgaacgtatgcagaccgaaaataagatttcgccatactacaggacaaagctcagaggtctgtatacaaccgctaaggccgatgcagaggccgagtgcaacattttaagaaaagccctcgacaaaatcgcagaaataaaaagcttgctagaggagcgtaggatcgcagccaaaattgccgggctctataacgactctgagcccccacgtaaaacgatgaggaggggcgtcttaatgacacttctccaacagagcgctatgacccttcccctctggatagggaaacctggtgataagccaccccctctctgcggtgctatccctgcttctggcgattacgtggcgcgccctggggacaaagtggctgccagggttaaggcggtggacggagatgagcagtggattctggcagaagtcgtctcctacagccatgccacaaataagtacgaggtcgatgatattgacgaagaaggcaaggagagacatacattgagccggaggagagtgataccccttccacagtggaaagccaatccggaaaccgaccctgaggcattatttcagaaggaacagctggtcctcgcactctatcctcagacaacatgtttctaccgggctttgatccacgcacctccacaacggcctcaggatgattatagcgtgctgttcgaggatacttcatacgccgacggctactccccccccctcaatgtcgctcagcgctacgtcgttgcttgcaaggaacctaagaaaaagtag

SEQ ID NO: 183373 - DNA, 843 bp, Artificial Sequence
  Description of Artificial Sequence: Synthetic coding sequence
atgaacgaccggagcagccggcggcggaccatgaaggacgacgagacattcgagatctccatcccctttgacgaagcaccacatctcgatccgcagatcttctattctctgagccccagtcgcagaaacttcgaagagcctcccgaggccgcaagtagcgccctggccctcatgaatagtgtcaaaacccagctgcacatggcgctggaacggaattcttggctgcagaagcggattgaagatctggaggaggagagagatttccttcgatgccagctggacaagttcatatccagtgcgcgcatggaggcagaggaccactgcaggatgaagcctggacctaggagaatggagggagacagtcgaggtggcgcgggtggcgaggcatctgatccagaatctgccgcctcctcgctaagcggcgctagtgaggaagggtccgcatccgaaagacggcgacagaaacagaaggggggcgcctcacgcagaagattcggaaaacccaaagcaagggagcgccaacgtgtcaaagacgcagacggcgtactttgcaggtataagaagatacttggaacctttcagaagttgaagagcatgagccgggcatttgagcatcatagagtggaccggaatactgtggctttaaccacacctatcgccgagctcctcattgtggctcccgaaaaactggccgaggtcggggagtttgacccatcaaaagaacgtctcctcgaatatagcaggcggtgcttcctagccctcgatgacgagacgttgaagaaagtccaagcactgaagaagtccaaactgcttctgcctatcacctacaggtttaagagatag

SEQ ID NO: 183374 - DNA, 495 bp, Artificial Sequence
  Description of Artificial Sequence: Synthetic coding sequence
atgatgctgacccaggcccccagcagcgtggtgcggagccggaacagtcggaatcatacagtgaactccggcgggtcctgcttgagcgcaagtaccgtagccatccccgctatcaatgactctagcgccgctatgagtgcatgcagcaccatctcggcacagcctgcatcttctatggacacccaaatgcactccccgaaaaaacaagagcgagtgaacaagcgtgttatatgggggattgaggtggcggaagaactacactggaaaggatgggagctcggaaaagaaacgactcgcaacttggtgctcaagaacaggagtctcaaattgcagaagatgaaatataggtatcagtacaagggcagtaggacgcagtgtcattccctagaaccccgcaaacaggctttgttcaagaccaagcagaataagcagaaaaaaccattgacttgccacatcaaagcctccgaatgcctgaagtacgtgcagtatgaatag

SEQ ID NO: 183375 - DNA, 495 bp, Artificial Sequence
  Description of Artificial Sequence: Synthetic coding sequence
atgatgctgacccaggcccccagcagcgtggtgcggagccggaactctcgcaatcacacagtcaattccgggggatcctgcctctcagcctctactgttgcaataccggccatcaacgacagctctgccgcaatgtctgcctgttctaccatttctgcccagccagcctcatcgatggacacccaaatgcacagtcctaaaaaacaggagagggtgaataagcgcgtgatctggggcatcgaagtggccgaggagctccattggaagggatgggagctagggaaggaaacaactcgcaatctggtgttgaagaaccggtccctgaaactacagaagatgaagtacaggtaccaatacaaaggctccagaacacaatgccactccctggaaccgcgaaagcaggccttgtttaagacaaaacaaaacaagcagaagaagcctttgacttgccatatcaaggccagtgagtgtctcaagtatgtgcagtacgagtag

SEQ ID NO: 183376 - DNA, 5778 bp, Artificial Sequence
  Description of Artificial Sequence: Synthetic coding sequence
atgttcaccctgaccggctgccggctggtggagaagacccagaaggtcgagaacccctcagtctcattcgcttctagctttcccttgattccactcctcttaagaggcaaatccgtacagaaaaaacaggcagagtctaagtctcagattaaactccatacacagagtgccccgttcggcctatgtccaaaggacatgatgctgactcaggccccaagctcagttgtgcgttctcgaaatagtagaaatcatacagtcaattcggggggaagttgcctatctgcgtccacagttgcgatccccgctataaacgactcttcagcagctatgagcgcatgtagcacgatatcagcccaacccgcctccagcatggacactcagatgcattctccaaagaagcaggagcgtgttaacaaacgagttatttggggcatcgaggtggccgaggagctgcattggaaagggtgggagctgggaaaggaaacaacgcggaaccttgtcttgaagaatcgctccctgaaactgcaaaagatgaagtatcgtcctccgaagactaaatttttctttacagtcatcccccagcccattttcctgtcacctggaattacgctcacactgcctatagtgttcaggcccttggaagccaaggagtacatggaccagttgtggttcgaaaaggctgaggggatgttttgtgttggcctcagggcaaccctcccatgccaccgcctcatttgtcgacctccatccttacagctccccatgtgcgccgtaggggacaccaccgaagcctttttctgcctagataatgtaggagatttgcctaccttcttcacatgggagttctcgagtcccttccaaatgctgccagccaccgggttgctcgagcccgggcaagcctcccaaatcaaagtcacgttccaaccactgactgcggtgatttatgaggtgcaagccacgtgctggtacggagcaggtagcagacagcggagcagcatccagttacaggctgtcgcaaagtgtgctcagttactggtttccattaaacacaaatgtcccgaagatcaagatgccgagggctttcagaagctgttgtattttggttctgtggccgtcgggtgtacatctgaaaggcagattagacttcacaatccaagcgcagttaatgcaccgtttaggattgagatctcccccgacgaacttgccgaagatcaggccttctcctgccccaccgcccacggaattgtgctccccggcgagaaaaaatgtgtgagcgtgtttttccaccctaagacactggacacaaggacagtggactactgtagcattatgccatcaggctgcgcaagcaagacgctgctcaaagtggtgggattctgccgggggcctgctgtttcccttcagcactactgcgtaaactttagctgggtgaatctcggagaaagatcggagcagcccctgtggatcgaaaatcagagtgattgtacagcgcacttccagtttgctatagactgtctggagagcgtgttcactatccgtcccgcttttggcacactcgtggggaaagcacggatgactctgcattgtgcgtttcagcccacgcacccaattatttgctttaggagggtcgcatgccttattcaccaccaggatcctttgttcctggatctgatggggacgtgccactccgactcgactaaaccagctatactaaagcctcagcatctgacatggtacaggactcatcttgcaagaggactgaccctctacccacccgatatcctcgacgccatgttgaaggagaaaaagctcgcacaggaccagaacggggccttaatgatccctatccaggatctggaggacatgcccgctcctcagtacccctatatccccccaatgacagaatttttttttgatgggactagtgatattactatcttcccaccaccaataagcgtcgaacctgttgaggtggactttggtgcttgccccggccccgaggctcctaatcccgtgcccctttgcctcatgaaccacacaaagggcaaaattatggtggtctggactagacggagcgattgccccttctgggttacccctgaatcctgcgacgttccccccttgaagtccatggcaatgaggctgcacttccagccacctcatcccaactgcctgtacactgtggaactcgaggctttcgctatatataaagtcctgcagagttactctaatatcgaggaggattgcactatgtgtcccagttggtgcctcaccgtgagggcaagaggccatagctactttgcaggtttcgagcatcacatcccccaatatagccttgacgtcccaaagctcttccccgctgtcagctcgggggagcccacttacaggtcactactgctggtgaacaaagactgcaagctattgacattcagcctggctccccagcggggttctgatgtgatcctacggccaacctccggcctggtcgcacccggggcgcaccagatcattctcatttgtacctatcccgagggaagctcctggaagcagcacacgttctatctgcaatgtaatgcaagcccccagtacctcaaagaagtaagtatgtactccagggaggaacccctccagctgaaactggacactcataagtcactttatttcaagccgacatgggtgggctgtagcagcacttcaccttttacctttaggaatccgagtcgactccccctacagtttgaatggcgggttagcgaacaacaccgtaaactgttggccgtacagccatcacgcggtctgattcagccaaatgaacggctgactttgacctggactttctcacctctggaagagactaaatacctgtttcaggttggtatgtgggtttgggaagctggactttctcctaatgccaatcccgccgccaccacccattatatgctgcgactggtcggcgttggcctgacaagctctctgagcgccaaggaaaaggaactcgccttcggaaacgtacttgtaaatagcaagcagtccaggttcctggtcctactgaacgatggaaattgcacactctattaccgcctgtatctggaacaagggagccccgaggcagtggacaatcatccgctggcattacaacttgataggactgagggatcaatgcccccacgcagccaggacaccatctgcctgacagcttgccctaagcaaagatcccaatactcatggacgatcacctactcgctgctcagccaccgggataacaaggcaggggagaaacaagaactgtgttgtgtaagcctagtcgctgtgtatcctttattgtctattctggatgtgtcgagtatgggttctgccgaggggatcacacgtaagcacctctggagactcttctcccttgatttgctaaacagctatttggaacgcgatccaacaccatgcgaattgacatacaaggtccccacacgccacagcatgtcccagattcctcccgtgctgaccccactgagactggacttcaactttggggcagcaccgttcaaggccccccccagtgttgtgttcttggctttgaaaaactccggcgtggtgagcctggattgggcttttcttctccccagcgatcagaggatcgacgtagagctgtgggccgagcaagcggagctaaattctacagagttgcaccagatgagggtacaagacaactgcctgttctcaatcagcccaaaggccggatctttaagccctgggcaggagcagatggtcgagttgaagtactctcacttattcataggaaccgatcatctgccagtgctgtttaaagtgtctcacggacgggaaattctcttgaactttatcggcgtgaccgtgaagccggagcaaaagtacgtgcactttacctctacaacgcaccagttcatacctataccaatcggcgacacactccctcctagacaaatatatgaactttataacggtggcagcgttcctgtgacatatgaggtacagacggatgtgctctcccaggtgcaggaaaagaatttcgaccaccccatcttttgttgtttgaatcctaagggggagattcagcctggttctaccgcccgagtgttatggatcttctcccctatagaagccaagacgtatactgtggatgtccctatacacatcttaggctggaactctgccctcatacatttccaaggagtaggatacaacccccatatgatgggcgatacggccccctttcataacattagctcttgggataacagctccatccattctcgtttggtggttccagggcagaatgtctttctctctcaaagccacatctctctggggaacattccagtgcagtctaagtgctcccggctcctattcctcaataatataagtaagaatgaagagatcgccttcagttggcagccctctcctttagacttcggagaagtgagcgtgagcccgatgatcggcgtggtggccccggaggagacagtgccattcgttgtcactctgcgggctagcgtccacgctagcttctattctgctgatctggtgtgcaagctgtactcccaacaactcatgcgccaataccacaaggagttacaggagtggaaagatgaaaaagtccgtcaggaagtggagtttacgattacggatatgaaggttaaaaagcgaacttgttgcaccgcctgcgagccagccaggaaatataaaactctgccacccataaaaaaccaacagagtgtgtcgcgccctgcaagttggaaacttcagacccctaaagaagaggtctcctggccctgcccccaaccaccttctccaggcatgttgtgcctggggctcacagctcgcgcacacgccaccgactacttcctggcaaatttcttcagcgagtttccatgccatttcctgcatagagagctgcccaagcgcaaggctcctagggaggagtccgaaactagcgaagagaagagccccaacaaatgggggccagtgtcaaagcaaaaaaagcagctgctggttgacatactaacaactatcatcaggggactcttagaggacaaaaactttcacgaggccgtggaccagtctctggtggagcaagtgccttacttccgtcaattctggaatgagcaaagtacgaagttcatggaccagaagaattcattgtacctaatgcccattctgcctgtgccatccagctcgtgggaggatggaaaaggtaagcagcccaaggaagatagacccgaacactacccaggcttaggcaagaaggaggaaggggaggaggaaaagggggaggaggaagaggaggagctggaagaagaggaagaagaagaagaggagacagaagaagaggagctgggaaaagaagagatcgaagaaaaggaggaggagcgtgatgaaaaggaggagaaggtctcctgggcagggatcggcccaacacctcaaccggaaagtcaagaatccatgcagtggcagtggcaacagcaactcaacgtgatggttaaggaagaacaggaacaggacgagaaggaggccatacgccgactgcccgcgttcgccaacctgcaggaagcactcttagaaaacatgatccagaatatcctggtggaagcatcgcgaggtgaagtggtgctcacctcacgtcctcgcgttatcgctctaccacccttttgcgtaccaagaagtctgactcctgatactcttctgcctacccagcaagctgaggtattgcacccggtcgtgccgctgcccaccgatctcccatag

SEQ ID NO: 183377 - DNA, 2190 bp, Artificial Sequence
  Description of Artificial Sequence: Synthetic coding sequence
atgctgacccaggcccccagcagcgtggtgcggagccggaacagcaggaaccacactgtcaactcaggagggtcttgtctctcagcatctacagtggcaatcccagcgatcaacgactccagtgccgccatgagcgcctgctccacaatctcggctcaacctgcctctagtatggacacacagatgcattctcccaagaaacaggagcgagtgaacaaacgagtgatctggggcatcgaggtggccgaggagcttcactggaagggatgggaattgggaaaagagacgacgcgcaatctcgtgttgaaaaatcgcagtctaaagctacagaagatgaaatatcgcccccctaaaactaagtttttttttactgtcattcctcagcccatcttcctcagtccaggtattacacttactctcccgattgtgtttcgcccgcttgaggctaaggaatacatggatcagttgtggttcgagaaggccgaggggatgttctgtgtgggcttacgagccacactgccttgtcatcgtctgatatgcaggcctccctctctgcagctccctatgtgcgccgtaggcgacacgaccgaggcctttttctgtctggacaacgtaggagacctgcctaccttctttacctgggagttcagctcacccttccagatgttgcctgcgacagggctgctcgaaccagggcaggcatcacagatcaaggtaaccttccagccactgacagcggtaatatatgaagttcaggctacatgttggtatggcgctgggtcaagacagcggagctcgatccagctccaggctgtcgccaagtgtgcacagttgctggtatcaattaaacataagtgccctgaagatcaggatgctgaggggtttcagaaattgctgtacttcgggtctgtagccgttggatgcacaagcgaacgtcagattcgattgcacaacccctctgctgtgaacgcacccttccgtatcgaaatctcgccagacgagctcgcagaggatcaggctttttcctgccccaccgcccacgggatcgttctcccaggggagaagaagtgtgtgtctgtgttcttccatccgaagaccctggacacacggaccgttgattactgcagtattatgccgtctggatgtgcgagcaaaacattacttaaagtggtgggattctgcaggggccctgccgtgtctcttcaacactactgcgtgaattttagttgggttaacctgggagagcgaagcgagcagccactatggatcgagaaccagtccgactgcacagcccactttcagtttgctattgactgcttagagtcggtgttcaccatcaggcccgcatttggcactttggtggggaaggctcgcatgacgttacattgtgccttccagccgacccacccaatcatctgtttccgccgtgttgcctgtctcattcatcaccaggatcccctttttttagacctcatgggtacctgccattctgactccaccaagcccgccatcctgaagccacagcatctgacttggtatcgaactcacttggctcgcggcctgacgctttacccacccgacatcctggatgctatgctcaaagagaaaaaactcgcgcaagaccagaatggcgccctcatgattcccattcaggacttggaagatatgcctgccccgcaatacccatacatcccccccatgacggagttctttttcgatgggacatccgacatcaccatttttcccccacccataagcgtggaacctgtggaggtagacttcggtgcatgccccggtcccgaagccccgaacccagtgccgttgtgtctgatgaatcacacaaaggggaagattatggttgtttggacgcgacggagtgattgccccttctgggtaacacccgaaagctgtgatgttcctcccctgaagtcaatggcaatgcgacttcattttcagcctcctcatcctaattgcctctatactgtggaactggaggcttttgctatatacaaggtctgtgctcggaatgagcgtgaagaatgtggagtcagcgcccgctcacttagcgggcttgtcggatggcaagaggtcacagaggggtctttccgtctgcatccgctgcgcgcgcgactgtcattggggtggactgttacccctatgtccctgagtcctcccaaattattagcatag

SEQ ID NO: 183378 - DNA, 5778 bp, Artificial Sequence
  Description of Artificial Sequence: Synthetic coding sequence
atgttcaccctgaccggctgccggctggtggagaagacccagaaggtggaaaatccatctgtctctttcgcgtccagtttccccctaattccattactgctgcggggcaagtcagtgcagaaaaagcaggcggagtctaaatctcagatcaaactgcacacacagtctgctccattcggcctctgtcctaaggacatgatgttaacccaagcaccctcatccgtggttagaagtaggaatagccggaaccatacagtgaattctggcgggtcctgtctgagcgctagtaccgtagccatccctgcaatcaacgattcgtctgcagctatgtcagcctgctccaccatctctgcacaacctgcttcgtcaatggacacgcagatgcatagccctaagaagcaggaaagggtgaacaaacgcgtgatctggggtatcgaggttgcggaagagcttcactggaaaggctgggaactgggaaaggagacaactcggaatctggttcttaagaaccgcagtcttaaactgcagaagatgaaataccggcctcccaaaaccaaattttttttcacagtaatcccccagcccatctttttgagtcccgggatcaccctgacactgccaatagtgtttcggcctttagaggcgaaggagtatatggaccagctttggttcgaaaaggccgaaggaatgttctgcgtgggactacgggctacactaccatgtcaccgactgatttgtcggccgccatctctgcagctgcccatgtgtgctgtcggtgacacaacagaggcctttttctgtttggacaacgtaggggacctcccaactttctttacttgggagttttcttcccctttccagatgctgccggccaccggattgcttgagcctggacaggcatctcagataaaagtcactttccagccgttaactgccgtaatctacgaagtccaggctacatgttggtacggcgctggatcccgtcagagaagctccattcagctgcaagccgtcgcaaaatgtgcacagctattggtgagcattaagcacaagtgcccagaggatcaggacgcagaggggtttcagaagcttctgtacttcggatcagtggccgtgggatgcacctcagagagacagatccgtctgcataacccatccgccgttaatgcacctttccggatcgagatctctccggatgagctggctgaggaccaagcgttttcttgccctacagctcatggaatagtgctgcctggtgagaagaagtgtgtgtctgttttctttcatccaaagacacttgatacgcgcacagtggactactgttcgatcatgcctagtggatgtgcaagtaagaccctcctgaaagttgttgggttctgccgaggtccagccgtcagcctccaacactactgcgtcaattttagctgggtgaacctgggcgaaagatctgagcagcctctctggatagagaaccagagcgactgtacagcacatttccaattcgccatcgattgcctggagtcagtttttacgatccgacctgcattcggcacactggtggggaaagctaggatgacactgcactgtgctttccaaccgacccaccctatcatatgtttccggcgggtggcttgtttaattcatcaccaggatccactttttctagacctcatgggtacttgccatagcgactctaccaaaccggcgatcttaaaaccacaacaccttacatggtaccgcacacacctggcgcgcggcctgacactgtatcctcctgatattctggatgccatgctgaaagaaaaaaaactggctcaggatcaaaatggggccctgatgatccccatccaagatcttgaggacatgccggcaccacagtacccctatatcccgcctatgaccgagttctttttcgatgggacaagcgatattacaattttcccccctcccatcagcgtcgagccagtagaagtcgatttcggagcatgtcccggacccgaggcccctaaccccgtcccattgtgtctgatgaatcacaccaaggggaaaattatggtagtatggacaaggagaagcgattgtcctttctgggttaccccagaaagttgcgatgtgccgcctctaaagagcatggctatgaggctgcattttcaacccccacatccgaattgtctctataccgttgaacttgaggccttcgctatatataaggtgttgcaaagctatagcaatatcgaagaagactgcactatgtgcccatcctggtgcttgactgtcagggcccgcggacatagttactttgccgggttcgagcaccacatcccacaatacagcttagacgtgccgaagttgttcccggccgtcagttccggggaacctacatataggtcattactgttggtaaataaagattgtaagctattgaccttttcactagcgccccagcgcggatccgatgtgatattacggcctacgtctggcctcgtcgcccctggggcgcatcagatcatactaatatgtacttacccagagggctcctcgtggaagcagcatacattctacttgcagtgcaacgcatccccccaatatctgaaggaggtgagtatgtactcacgagaagagccactgcaactgaagctggacacacataagtcattatactttaagcccacatgggtgggttgttcatctacctccccttttaccttcaggaacccgagcaggctacccttacagttcgaatggagggtgagcgagcaacatcgcaagctcctcgccgtccagccctcacggggcctgatacagcccaatgaacggctgaccttaacttggacattctctcccctggaagaaactaaataccttttccaggtggggatgtgggtctgggaggccggcctcagcccaaatgctaatcccgcggccaccacccattacatgctcagattggtgggagtcggattgacatcgtccctgtctgccaaggaaaaagagctcgcctttggcaacgtcctcgtcaacagcaagcaatcccgttttctcgtattattaaatgatggcaattgcacactctactacaggctttacttagagcagggctccccagaagctgttgataaccatcctttggccttgcagctggatcgcactgagggaagcatgccacctcgaagtcaggacacaatatgtctaaccgcctgccctaaacagaggtcgcagtacagctggaccataacatacagcctgctaagccacagggataacaaagctggcgagaagcaggaactgtgctgcgtgagtcttgtagccgtttaccctctactcagcattttggatgtctctagcatggggtccgctgaagggattactcggaaacacttatggagattgttctccctcgatctgttgaactcgtaccttgaacgtgatccaaccccctgcgagctgacttacaaggtgccaactcgccacagcatgtcccagattccccctgttttgacaccactgcgcttagactttaattttggggccgctcccttcaaagcccccccaagtgtcgtctttctggctctcaagaactccggcgtcgtaagtctggactgggcatttctcctgccctctgatcagcgcattgatgtggaactttgggctgagcaagctgagctcaactccacagaacttcaccaaatgagagtccaagataattgcctgtttagtattagtccgaaggccgggtccctatcccctggtcaggagcagatggtcgaacttaagtactcccatctgttcatcggtacagaccacctgccagtgctgttcaaagtgtcccatggtagagagatcttactcaacttcattggggtaaccgtaaagccggagcagaagtacgtccacttcacatctacaacccatcagttcatacctatccccattggggacacactgccccccaggcaaatctatgaactctataacgggggctctgtaccagtaacatatgaagttcagacagatgtgctttcccaggtgcaggagaaaaattttgaccaccctattttttgttgtctcaaccccaagggtgaaatccaacctggaagcaccgcgcgagtcctgtggattttcagtcctattgaagctaagacatatacggtggatgtgcctatccacatcctgggctggaacagcgccctgattcatttccagggcgtgggatacaaccctcacatgatgggcgacacggcaccattccacaatatctccagttgggacaattcatccatccactcgagactcgtcgtgccggggcagaatgtcttcctttcacaatcacacatctccctcgggaatatacccgtgcagagcaagtgcagtcggttgctattcctgaataatatcagcaagaacgaggaaatcgcctttagttggcagcctagcccactcgactttggcgaggtgtccgttagcccgatgataggagtcgtggcacctgaggaaaccgtacctttcgttgtaacactgagggcaagtgtacatgcctccttttactccgcagatttggtgtgcaagttgtactcacagcagctgatgagacagtaccataaggagctgcaggagtggaaggacgagaaagtgcgacaagaagtagaatttacaatcacagatatgaaggtgaaaaagcgaacatgttgtacagcctgtgagcccgcccgcaagtacaagacgctccctcccatcaaaaaccagcagagtgtttctcgccctgcttcgtggaagctgcaaacacccaaggaggaagtgtcttggccgtgcccccaacctcctagccctggcatgctgtgtctcggcctgactgcccgagcacacgccactgattatttcctggctaacttcttttcagagttcccttgtcattttctccacagggaactgccaaagaggaaagcaccgagggaggagagtgagacaagtgaagaaaaaagccccaacaaatggggacccgtgagcaagcagaaaaagcagctgctggtggatatcctgaccaccatcattagaggtttgttggaggataagaattttcatgaggcagttgaccagtcccttgtggaacaggtgccttattttcgccagttctggaacgaacagagtaccaaatttatggaccagaaaaattccctgtacctgatgcccatcctgcctgtgccatcatcatcctgggaggatgggaaggggaaacaacctaaggaggataggccggagcactaccccggactgggtaagaaggaagagggggaggaagagaagggggaagaggaagaagaggagctggaggaagaagaggaggaggaagaggagaccgaggaggaagaacttggcaaggaagagattgaagagaaagaagaagaaagagacgaaaaagaagaaaaggtatcatgggcgggaattggacctactccacagccagagagtcaggagtcaatgcagtggcagtggcaacagcaactcaatgtgatggttaaagaagaacaagagcaagacgagaaagaggcgattcgtaggctccctgcgttcgcaaaccttcaggaggccctgctggagaatatgatccagaacattctggtggaggcttcccggggtgaagtcgtcctcacctcacgccccagagttatagccttgcccccattctgtgtgcctagaagcctgacgcccgacactctcttacctacacaacaggctgaagtcctgcacccggtggttcctctgcctaccgatctcccatag

SEQ ID NO: 183379 - DNA, 5778 bp, Artificial Sequence
  Description of Artificial Sequence: Synthetic coding sequence
atgttcaccctgaccggctgccggctggtggagaagacccagaaggttgaaaatccttcagtatcatttgcgagctccttccctctgatccctttgctgctcagaggcaagtctgtccagaagaagcaggctgagagcaagtcccagatcaagcttcacactcagtctgccccattcgggctctgccctaaagacatgatgctcacacaagccccctcctctgtggtgagaagtcggaatagtaggaaccatacggtcaattcagggggcagttgtctgtcagcatcgactgtcgcaattcccgcgataaacgacagctcagcggccatgtctgcatgtagcactatcagcgcacagcccgcctccagcatggatacccagatgcactcaccaaagaagcaggagagagtcaataaaagagtcatttggggcatagaagtggcagaggagcttcattggaaggggtgggaactcgggaaagagaccacaaggaacctggtcttgaagaacaggtcactgaaactgcaaaagatgaaataccgccctccaaaaacgaagttttttttcactgtcatccctcaacccatcttccttagccctggcattaccctgacgctcccaatagtattcagacctttagaggccaaagagtacatggatcagctgtggttcgaaaaggctgagggaatgttctgtgtgggtctcagagcgacccttccctgccatcggctcatctgtaggccgccgtccctgcaacttccaatgtgcgccgtcggggacaccaccgaggcctttttctgcctagacaatgtgggagatctcccgaccttcttcacttgggaattttcatcccccttccaaatgctccccgccactggcctgctggaacccggacaagcgtctcagattaaggtaaccttccaaccactgaccgctgtgatctacgaagtgcaagccacctgttggtatggggccggcagccggcaacgctccagcatccaactgcaggcggtggcaaagtgcgcccagctattagtgagcataaaacacaagtgccccgaagatcaagatgctgaggggtttcagaaactgttgtatttcggctccgtggcagttgggtgcacgtccgaaagacagatccgactgcacaaccctagcgcagtgaacgctccattcagaatcgaaatcagtcccgatgaactggccgaagatcaggcattctcatgccccactgcgcatggtatcgtgctgcccggtgagaaaaaatgcgtttctgtcttctttcacccgaaaacactggatacaaggaccgtggattactgttcaataatgccctccgggtgtgcttcaaagacgcttctgaaagtggtgggcttttgtagaggccccgctgtgtcgcttcagcattactgcgtgaatttttcttgggttaacctgggggagaggtccgagcaacctttgtggatagaaaatcaatcagactgtacagcccactttcaattcgcaattgactgcctagaatcggtgtttaccattagaccagcgtttggcaccctagtaggcaaagcgagaatgacgctgcactgtgcctttcaaccaacccatccgatcatctgctttcgaagagttgcctgtctaatccatcaccaagatcccctgttcctagacttgatggggacctgccattctgactctaccaaacccgctattctcaagcctcagcatctcacatggtaccgcacacacctggcacgcggcctgacactgtatccgcccgatattttggatgccatgctaaaagagaaaaagctggcccaggaccagaacggcgccctcatgattccaatccaggatctggaggacatgcccgctccgcagtatccgtacattccgccaatgacagaattttttttcgacggcaccagtgacattactatttttccaccccccatctctgtcgaacccgtcgaggtggattttggcgcttgccccgggcccgaagcaccaaacccagtgcccctctgccttatgaatcacaccaaaggcaagattatggtcgtgtggacccgccgctcggactgtccattctgggttacccccgaatcctgcgacgtgcctccactgaagtctatggcgatgcggctgcactttcagcccccacaccccaattgtttgtacacagtggaattggaggcattcgccatttataaagtcctgcagtcttacagtaacattgaagaagattgtaccatgtgcccgagttggtgtctgacggtcagggctcgcggccacagttactttgccggctttgaacatcacatccctcaatatagtttggacgtgcctaaactgttccccgccgtaagctcaggtgagccaacctacaggtcattgctccttgtgaacaaggactgtaaattgctgactttcagcttagcaccacagcggggcagcgatgtcattttgaggcctaccagtggactggtggcacctggtgcccatcagataatcctcatctgtacctaccccgaagggagctcctggaagcaacatacattctacctgcagtgcaacgcgtctccacagtatctcaaagaagtgagcatgtactctagggaagagccacttcagctgaagcttgacacacacaaatctttatactttaagccaacatgggtggggtgttcctcaacttctccttttacttttcggaatccaagtcgcctccccctgcagtttgaatggagggtgtctgagcagcatcgcaaactcctggccgtccagccttcgcgcgggttaatccaaccaaatgaacgtctgactttaacctggaccttctctcccctcgaggaaacgaagtacttgtttcaggtagggatgtgggtctgggaagctggcctgagtcccaatgccaacccggcagcgaccacccactacatgttacgtttggtgggcgttgggctgactagcagtctctctgcaaaggagaaagagttggcgttcgggaatgtgttggtcaacagcaaacagagcagatttttggtgttgctgaatgacggtaactgcacgctatactatagattatacctggagcaaggctcacctgaagccgtggacaatcaccccctggccctccagttagacagaactgaaggatcaatgccgccgaggtcacaggacaccatttgccttactgcctgccctaagcagagatcccagtacagttggaccatcacttattcactgctctcccacagggacaataaggccggggaaaagcaagagctgtgttgtgttagcctcgtcgccgtctacccactgcttagtatcctggacgtctcttccatgggctcggccgagggtattacaaggaaacatctgtggagactgttcagcctggatcttctgaatagctatctcgaacgagatcccaccccttgcgaactcacatacaaggttccaacccgccattctatgagccagattccaccagtccttaccccactcaggctggactttaatttcggcgctgctcctttcaaggctcccccttccgtcgtgttcctggcgctcaaaaattccggtgtggtgtccctggactgggcttttctccttccctccgaccaacggatcgatgttgagctgtgggcagaacaggctgagctcaatagtaccgagctgcaccagatgcgggtgcaggataattgtttgttcagcatcagcccaaaggctggctctctgagccctgggcaggagcagatggtggagctcaagtatagtcatctgtttattgggactgaccatcttccagtgcttttcaaagtatcccacgggcgcgaaatcctcctcaatttcatcggtgtaaccgtcaagcctgagcagaagtacgttcatttcacaagtacaactcatcaatttatacccattccgatcggagatactctccctcccaggcagatatatgagctttataacggcgggtctgtgccagtgacctacgaggtacaaaccgacgtgcttagtcaggtgcaggaaaagaacttcgatcatcccatcttctgctgtctcaatcctaagggggagattcagcctggtagtacagcgcgggtcctttggattttctcgcccatcgaagcaaagacatacaccgtggatgtccctatccacatactgggctggaactctgccttgattcatttccagggagtgggttacaatccgcacatgatgggcgatactgccccgttccataacatttctagctgggacaatagtagtatccactctagactggtggtgccaggacagaacgtctttctatcacagtctcatatctctctcggtaatattccggttcagtcaaaatgttcccggctgctctttctcaataacatctcaaaaaatgaggagatcgccttctcctggcagcccagcccacttgattttggggaggtctctgtgagccctatgatcggcgtagtggcaccggaggagacagtcccattcgtcgtgaccttacgggcgagcgtgcacgccagcttctattcagccgatctggtctgcaaactgtactcccagcagctgatgaggcaataccacaaagaactgcaggagtggaaggacgaaaaggtgcgccaagaggtggaattcacaatcaccgatatgaaagtaaagaagcggacatgctgtaccgcatgcgagcccgccaggaagtataaaaccctaccgccgatcaagaatcaacaatcggtctcgaggccagcctcctggaaactgcaaacgcccaaggaagaagtgagctggccttgccctcagcctccctcccctggtatgctgtgtctgggccttactgccagggcccatgcaactgattatttcctggctaactttttttctgaattcccttgtcacttcctacatagggaacttcccaaacgcaaagccccccgggaagagtccgagacttctgaggagaaaagtcctaacaagtgggggcctgtgtctaaacaaaagaaacagctgctcgtggacattcttacgacaattatcaggggcctactagaggacaaaaactttcacgaggctgttgaccagtcactggtggaacaggtgccgtatttcagacagttttggaacgaacagagcacaaaatttatggaccagaagaactctctgtatctgatgcctatcctcccagttccatcttcctcttgggaagacggaaagggaaagcagcctaaagaagacaggcctgagcattaccctggacttggcaagaaggaggagggggaagaggaaaagggagaggaggaagaagaggagttggaggaggaagaagaagaagaggaagaaaccgaagaggaggaactcgggaaagaagagattgaagaaaaggaagaggagagagatgaaaaagaagagaaagtctcatgggctggcatcggccccaccccccaacctgagtctcaagagagcatgcagtggcaatggcagcagcagctgaatgtcatggtgaaagaggaacaggaacaagatgagaaagaggccattcgcagactacctgcatttgccaatctccaagaagctctgttagagaacatgattcagaatatactagttgaggccagccgtggggaagtagtgctgacgagccgcccacgagttatagctctcccccccttctgcgttccccgcagtctgactcctgacactctactcccaacccagcaagccgaggtcctgcaccctgtagtccctctgccaacagacctcccctag

SEQ ID NO: 183380 - DNA, 816 bp, Artificial Sequence
  Description of Artificial Sequence: Synthetic coding sequence
atgaccctgcactgcgccttccagcccacccaccccatcatctgcttcaggagagtggcctgcttgatccaccaccaggatcccctctttttggacctcatgggaacctgtcatagcgatagcacgaagcctgccattctgaagccgcagcacttaacgtggtaccggacccacttggctcgggggctaactctgtacccccccgatatattggatgccatgctgaaggagaagaaactagcccaggatcagaacggtgccctaatgattcccattcaggacctagaggacatgcctgcaccccaatatccatacattcccccgatgacggaattctttttcgatgggactagtgatattacaatattccccccgccaatctccgttgagcctgtcgaggtcgatttcggagcctgtccgggcccagaagccccgaatcctgtgcccctgtgcctgatgaaccacactaaggggaaaataatggtggtctggacccgtcgcagcgactgtcccttttgggtcactcctgagtcctgtgacgtcccaccgctgaagtccatggccatgagactccacttccaaccaccccatcccaactgcttatacaccgtggagcttgaagcgtttgccatctacaaggtgtgcgctaggaatgagagagaagaatgcggcgtaagtgcacgcagtctgagcggactggttggatggcaagaagtgactgaggggagtttccggctgcaccccctgcgggcacgcctctccctggggtggacggttacacccatgtcccttagccccccaaagttgctcgcctag

SEQ ID NO: 183381 - DNA, 543 bp, Artificial Sequence
  Description of Artificial Sequence: Synthetic coding sequence
atggccgccctggacctgcgggccgagctggacagcctggtgctgcaactgctgggtgacctggaagagctggaaggaaaaaggacagtgctgaatgcccgcgtggaggaaggctggctgtccttagcaaaggctcggtatgccatgggagcaaagtctgttggaccacttcagtatgcctcacatatggaaccacaggtttgtttacatgcgagcgaagcccaggaaggactccagaagttcaaagtagtacgcgccggcgtacacgcgcccgaagaggtaggaccccgggaagcgggactgaggcgcagaaaagggcctactaaaactcccgagccagaatcgtccgaggcacctcaggaccccctgaattggttcggcatactcgtaccacacagcctgcgtcaggcccaggcatcctttagagacggcttgcagctggcggctgacattgccagtcttcagaacaggatagactggggcaggagccagctgagaggtctccaggagaaactcaagcagttagagccaggggcagcatag

SEQ ID NO: 183382 - DNA, 567 bp, Artificial Sequence
  Description of Artificial Sequence: Synthetic coding sequence
atgggcacccccctggacggcggcagccgggtgcccatcggctgcccagccaagctgcggcgcgtgacaagaaagaaggtcgctccggatctcgaaggttggctgagcttggctaaagcccgctacgctatgggggctaagtccgtggggcctctgcagtatgcaagtcacatggaaccacaggtgtgtcttcacgccagcgaggctcaggaaggattgcagaagtttaaggtggttcgcgcaggtgtgcatgcccccgaggaagtgggcccacgggaggctggattaaggagacgcaaaggcccgacaaagactcccgagcctgagtcctccgaagctccacaggatcccctcaactggtttggtatcctggtaccccatagcctgagacaggcacaggccagtttccgggacggagtcctggaggctaagaagcgaaaatgctttcttgagagggtgatccaatgcgtggttagtcccgccgcggagcaggaggccgaggatgagtcatgtccagaggattgggcagctgccgtacctgcggagacgtccgccaaggcaatttag

SEQ ID NO: 183383 - DNA, 855 bp, Artificial Sequence
  Description of Artificial Sequence: Synthetic coding sequence
atgagcgacaacaaggagcggaagagccagggcttccccaaggaggacaaccaagacacaagctctctggccgatgctgtggagaaagttgccaaacagcagcagagccaagcgtctgaaattgagaaaaataagaaggtcttgttcaacctgaaaaatgaactgcacgagttagagaaagagatcgcggctatatctgccgagactaaagagactgagcggcaaatctaccaacaggattctgctattgagaacacgaaactccactgtgatagcttggaaacacagattaaaagtctgcattccgagaatgtcaaactcaagttcgatatagagacggcccaggaagactttgaggagcatatgattaaatacaatgcctattatgcaaagataaaggcacacaagaactcactaggagaagtcgaatccaaatggagttttatgactgagcttcacgagaagcgcgatttcgtgaaaaagctgaagacaatgaaagaagagttgatgcaagaccttcagaacccaggcggaaacaggataacacaggtgcaagaggacattaccaacctaaaggacaaaatcatcacggtgaaggagagtatcattgagaaaacctgttttctggaggaggaaaaaaaaacacatgagaaactgaggaaggagatcgagagtctggcaccaagcccacggctggaatgtagttccgccatttctgctcattgtaagctttgtctcccaggctcaaggcacagcccggccagtgccagcggtgttgccggaacaaccggagcatgtcaccatacacaacttatcttctgtattttcagtcgggatggtgtcagcccttgttag

SEQ ID NO: 183384 - DNA, 822 bp, Artificial Sequence
  Description of Artificial Sequence: Synthetic coding sequence
atgagcgacaacaaggagcggaagagccagggcttccccaaggaggataatcaggacacttcttctctagctgacgcggtggaaaaggttgccaagcagcagcagtctcaggccagtgaaattgaaaaaaacaagaaagttttgttcaacttgaaaaacgaactgcacgaactggagaaagagattgcggcgatctccgccgagaccaaagagaccgaacggcagatttatcaacaggactcagccattgagaatactaaattgcactgcgactccttggagactcagatcaaatcactgcactccgagaacgtgaagctaaagttcgatatcgagaccgctcaggaagatttcgaggagcatatgattaagtacaatgcttactacgcaaagatcaaagctcacaagaactccttgggagaagtggaatctaagtggtctttcatgacagagctccacgagaagcgtgactttgtcaagaagctcaagaccatgaaagaagagttgatgcaagacttacaaaaccctggcggtaatcggatcacacaagtgcaggaggacatcacaaatttgaaagacaagataattaccgtgaaggaatccatcattgagaaaacctgttttttggaggaagagaagaaaacgcatgagaagctccggaaagaaatagaggtgcagcacaaaaggtatgatgccatcttgaagcgcctgcattgtcaggtgaacaaattacagtcgaataggagacagtggcagtggaatattcagcagctcgagaaaaccgctgcagagcttcgcaaatgcataggaatgcaggagtag

SEQ ID NO: 183385 - DNA, 1536 bp, Artificial Sequence
  Description of Artificial Sequence: Synthetic coding sequence
atgagcaaggtggcccggagcagcagcgagagcgacgtgcagctgtgggaaactgaggaagacgatatgactgaaggagacctgggctatggcctgggccgtaagcccggcgggatctacgaaattgagttctcacacagatccagaaaaaggtcagacggaaaaaatttctcgcctccgccatttcctaggaagggagaggaaaggaacgaagcctcttttcaatacagcaagcataaatcacagcaggataccttcccccaggtgtctcgcatcagcaattacagacggcagtcttcaacagtggattctaacagtgagttgtctaacgaggagctgaggcagtgtctgaacgagactttggaggaggttgagatgttgaagaccgagttggaagcctctcagcggcagctcagaggaaaggaagaagccctcaagatactgcagtccatggccatcctaggcaaggccacctcccatacacaggccgtgcttcagaaaaccatggagcagaatcgctccctggagaaagagatcaacgcccttcagtgggaaattgaattcgatcataataggtttaagaacatagaagagtcctggatccagaaatatgatagacttaactgtgaaaatgccgtgttaaaggagaacttaaaagtgaagaccgaagagatcaagatgctgaagtccgataacgccgtcctgaatcagcggtacctggaggctctggcgatgctcgatatcaaacaacagaagatggctcaagagaacatgtgctgtgacaagtccggcttcgctgaggcatcagggttggagctggcagtgctcggcgcatgcttgtgtcatgggccaggtgggaatccctgctcctgtgccaggatggcagccagcacaagaaaactcctgctccaacttaagcaagagctggagattcttcagaagtcaaaggaagaggcctatgtgatggcagacgcgtttcgcatagccttcgagcagcagttgatgcggaagaatgatcaggcactccagttaactcagatggacaagatgcataagaaggctacaaaatggatgaactggaaacacctcaaagaagacggcttcccttctcctagatccaaaaaaacgtttggtcagcggttgctgggtatgctgccatccgagaactcctcaaagcgcatggaagaccaggacagcccccaggaggttctgaagatgctcatcgaccttctcaatgataaggaagaagcactggcacatcagcgtaaggtgtcttatatgctcgcccgggcattagaagataaagacacagcctctaacgaaaataaagagaaaaatccaattaaagaaaacttcccctttaacaacccctggagaaaaacatccgaattcagcgtcctgggggatcccatacacagcagcgtctgcatactgaactcggtgggttgcatctgctccatacagcactcgcagatcgaccccaactatcgcacgctaaagaggtcacattcactgccatccagcataattttttag

SEQ ID NO: 183386 - DNA, 1536 bp, Artificial Sequence
  Description of Artificial Sequence: Synthetic coding sequence
atgagcaaggtggcccggagcagcagcgagagcgacgtgcagctgtgggagacagaagaagacgatatgactgagggcgacctggggtatgggctgggtcgaaaacctggcggtatatatgagatagaattttctcacagatccaggaagcgtagcgacggcaaaaacttcagtccaccacctttccctcgtaaaggcgaggaacgtaatgaagcttcctttcagtattccaagcataagtctcaacaggatacctttccgcaggtttctagaatcagcaactatcgccggcagagctctacggtagattcaaattcagaactatcaaacgaagaactgagacagtgcctgaatgagaccttggaggaggtcgaaatgctgaagactgagctggaggccagtcagcgccaacttcgtggcaaggaggaagccctgaagatcctgcaaagcatggcgattctgggcaaagcaacatcacacacgcaggcggtactgcagaagactatggagcagaaccgctctctggaaaaagagattaacgctttgcagtgggaaatcgagtttgaccacaatagatttaagaacattgaagaatcctggatccaaaagtacgaccgactcaattgtgagaatgctgtgctgaaagagaatcttaaggtcaagaccgaagaaataaaaatgctgaagagcgataacgccgtgctgaatcaaagatatcttgaagccttggcaatgcttgacattaaacagcagaagatggcccaggagaatatgtgttgtgacaaatcaggattcgcagaagcctccggcctggaactggcagttcttggagcctgtttatgccatgggcctggcgggaatccatgtagctgcgctcggatggccgccagcacacgcaaactgctgctgcagctcaagcaggaactggaaattctgcagaaatctaaggaggaggcatacgtaatggcagatgcattccgaatcgcgtttgagcagcagctgatgcgaaagaatgaccaagccctccagctgacccaaatggacaaaatgcataaaaaggctaccaagtggatgaattggaaacacctcaaggaagatggtttcccatcgccccgctctaaaaagacattcgggcagcgtttgctcggcatgcttccttccgagaactctagtaagagaatggaggaccaggactcaccgcaggaggtgctgaaaatgcttattgatctgcttaacgataaggaggaagcgttggcccaccagaggaaggtgagctatatgctagcacgcgctttagaagacaaagacactgccagtaacgagaacaaggagaagaatcccatcaaagaaaattttccctttaataatccctggaggaagacctctgaattttcagtgctgggagatccgatccattcctcggtttgtatcctgaattctgttggctgcatttgctctattcagcactctcagattgatcccaattaccggacactgaaaaggagccatagcttacccagctccataattttttag

SEQ ID NO: 183387 - DNA, 1161 bp, Artificial Sequence
  Description of Artificial Sequence: Synthetic coding sequence
atgctgaagaccgagctggaggccagccagcggcagctgcggggcaaggaggaagccctgaagattctacagtctatggctattctcggcaaggccacctcccatacacaggcggtgctgcagaaaactatggaacagaatcggtcgctcgagaaagagataaatgccctgcaatgggaaatcgagtttgaccataatagatttaaaaacatcgaagaatcatggatccagaagtacgaccggcttaattgtgagaatgctgttctaaaggagaatctgaaggtgaaaaccgaggaaataaagatgcttaagtctgacaatgccgtcttaaaccagcgttacctggaggccctggccatgctggatatcaaacagcaaaagatggcccaggaaaatatgtgctgcgacaagagcggcttcgcagaggccagcggtctcgagctggctgtcctgggggcctgtctttgccacggtccaggaggcaatccctgtagttgcgcccgtatggcggcttctacccggaagctgctgctgcagctaaaacaggaattggagattctgcagaaatccaaagaggaagcttatgtcatggctgacgccttcagaatagcctttgaacagcagctcatgaggaagaacgaccaagctctgcagttgacccagatggacaaaatgcataagaaagccactaaatggatgaattggaagcacctcaaggaagatggctttccatccccacgctccaagaagaccttcggccagcgcttactaggaatgctaccatcagagaattcttccaagaggatggaggaccaggatagccctcaagaggttcttaaaatgctcatcgacttattgaacgacaaggaggaagctctggcccaccaacgtaaagtaagttatatgctggctcgcgccttggaggataaagacactgctagtaacgagaataaagaaaaaaaccccatcaaagagaatttcccattcaataatccatggcggaagacaagtgagttttctgtgctaggagacccgattcactcctcagtttgtatactgaatagtgttggatgcatctgcagcattcagcactcacagattgatcctaattatcgaactctgaagcgttcacattctctaccatcaagcattatcttttag

SEQ ID NO: 183388 - DNA, 3465 bp, Artificial Sequence
  Description of Artificial Sequence: Synthetic coding sequence
atgcaggccatggagggcgaggtgctgctgcccgccctgtacgaggaagaagaagaagaggaggaagaggaagaggaagttgaagaagaggaggaacaagtgcagaaggggggctcagttggttcgctgtccgtgaacaagcataggggactgtcgttaaccgaaaccgagttggaagagcttagggcccaggtattacagctggtagcagagctggaagagactagagaacttgctggccaacacgaggacgattctctagagctgcaaggcttgttagaggatgagaggctggcgtccgcccaacaagccgaggtgtttacaaaacagatccagcaacttcagggcgaactgagaagcctgagagaagaaatttccctgttagaacacgaaaaagaatctgaattaaaggaaattgaacaagagctgcacctggcccaggcagaaatccaatctttacggcaggcagctgaggactcagccaccgaacatgagtccgacatcgcttccctgcaggaagacctgtgtcggatgcagaatgaactggaggatatggagagaatcagaggcgattatgagatggaaatcgcaagcctccgagccgaaatggagatgaagagtagcgagcccagcggaagcctgggcctgagtgattattccgggttacaggaagaactgcaggagctgcgtgaacgctatcatttcctcaatgaggaataccgggcgttgcaggagtctaactcaagtttaaccgggcagttagccgacctcgagtccgagaggacccagagagcaaccgagcggtggctgcaatctcagactctgtctatgacctcggctgagtcccagacatctgagatggattttctcgagccagatcccgaaatgcagctactgcggcagcagctgcgagacgctgaagaacagatgcatggcatgaagaataagtgccaagagctgtgttgtgaacttgaggagcttcaacatcaccggcaagtatctgaagaagaacagcggcggcttcagcgggagctgaaatgcgcccaaaacgaggttctacggttccaaacatcccactccgtcacgcagaacgaagagttaaaatcaaggttgtgcacattgcagaagaagtacgatacctctcaggatgaacagaatgagcttttgaagatgcagctgcagttgcagaccgagctgagacagctgaaggttatgaagagtactcttgtggagaaccaatccgagaaagagctcctctgtcgtctgcaaaagctgcacctccagcaccagaatgtgacatgcgagaaggagaaactactagagcgacagcagcagctgcaggaggaattacaatgtcacgaagctgaactacaacacctgagggacaccgtggcctctttcaaagaatccaacgaaaaggataccgagacccacgctcagctgcaagaaatgaaacagttatatcaggcttccaaggacgagctggagagacaaaagcacatgtacgaccagttggagcaagacctgctcctctgccagctcgagctcaaggagctgaaggcttcccatcctatccccgaggataaagggaagtgtgcaaataaatgcgacactctgctgagccggttgactgaactgcaggagaagtacaaagcatcacagaaggagatgggacagctgcagatggaacaatgcgaactcctggaggaccagaggaggatgcaggaggagcagggccagctgcaggaagagctgcatcgcctgacactgcccctcccaaagtccggcctgttgttaaagagccaggaattactgacaaagctcgaggatctctgcgagctgcagctgctgtaccagggcatgcaagaggagcagaagaaattgattcaaaaccaggattgtgttttgaaggaacaactggaaatccacgaagagctccgacggttcaaagagtcacattttcaagaggtgctggaaaatccagacgacagcaagctggcaaaatcttccaagtgcaaccgaaacaaacaaagtaagctgctgatggaacagatgcaggcattgcaggtgatgtacgatgccggccaagccaagcaggagctgttgcaacaggagcaaggtagactcttagaggaacggaagcgccttcaggctgatctgcaactctgtttagaggaaatgcaattgctgcaggtgcagtcccctagcattaagatgtcccttgagagttacggaaagagttatggcagtatggtcccctccaacgagaattgtagaaaaacctacgatacaaccgttgatgataacgagagctactacaagtcctacacgagcacccagacctcatctaagagcttcctgaagagctatgattctagcacctctgcttccgaggcctatggaaaatcctactgcactaccagtaatagttctatcacttacaaaaagagttacggtagtacatcctcttctgatacctgtcagaagtctttcgtcagctcatgtacagatgaagaaccagccgaaccagaggatatggaaaggttcgaggagatggtagtcaaggtgctgatcaagctgcaggcagtccaggcaatgtatcagatcagtcaggaggagcatagtcagttacaagagcagatggaaaaactgctggcgaagcagaaggatttgaaggaagagcttgacgcttgtgagcgtgaattcaaggaatgcatggaatgtctggaaaaaccaatggccccccagaatgataagaatgagatcaaggaactccagaccaaacttagggagctgcagctccagtaccaggcttccatggacgagcagggtcgattactggtggtccaagaacagctggagggtcagttgcagtgctgtcaggaggaactaagacagctccgggaaaagagaccttcagtcgtcaaagaggcaagaggaaagaatgcaaataagaatatgaacaagaatgctaatggagtgaagatgaagaaggtcaccaaaccctgttctgatacctccgagtctgacctagagacgaggaagtccctggaagttgtattgtactacaaggcaagccagcggaagctggatggtctggctaaggaggaggaaaaaaaagaggaaatggaagaagagaagaagcaggtgaaggaagaagcaaaagagcaatgcggggacgagttagtggctgagcctgcggaccctgaggaagcgaaatctacagaagaccaggaagaaaatgaagaagacaaagaggaggaggagaaggaggaagattccgaagaagaagaggacgatgccgactcatctttggagagcccagaggagaacaatcctttaaggctttccgagtcgaaaaagagctcccccactccaaacccacccatattctccctgcctctggtgggacttgtggtcatatctgccctgttgtggtgttggtgggccgaaaccagcagctag

SEQ ID NO: 183389 - DNA, 2874 bp, Artificial Sequence
  Description of Artificial Sequence: Synthetic coding sequence
ctgcgggccctggagggcgaggtgctgctgcccgccctgtacgaggaggaggaagaggaagaggaggaagaagaggaggtggaagaagaggaggagcaggtccaaaagggcggatccgttggcagcctgtctgttaacaagcatcggggcctttccctcaccgagacagagctagaggagctgagagcgcaggtgctgcagcttgtagccgaactagaggagacacgcgagctggctggccagcacgaggacgattcattagagctccaggggttgctcgaggacgagcgccttgcaagcgcccaacaggcggaggtgtttactaagcaaatacaacagctgcagggcgaactgcgttcactcagggaggaaatctctctactggaacatgagaaagaaagcgaattgaaagagatcgagcaggagctgcaccttgcgcaagctgagatccagtccctgcggcaagcggctgaggacagcgccaccgagcatgaatccgatattgcgagtttgcaagaggacctttgtagaatgcagaatgagctggaggatatggagaggatcagaggagactacgagatggagattgccagcctgcgggccgagatggaaatgaaaagcagtgagccttcgggtagcctggggctgagcgattactcaggcttgcaggaggagctgcaggaactgagggaacggtaccacttcctgaatgaagaataccgggccctgcaggaaagcaattccagtctgactgggcagcttgccgacctggagagcgaaaggacccagagagctacagagcggtggttgcagagccagacactgtcaatgaccagcgctgagtcacagacttccgagatggacttcttggaaccggacccagaaatgcagctgttgaggcagcaactccgtgatgccgaagaacaaatgcacggtatgaaaaataaatgccaggagttatgctgtgagctggaggagctgcaacatcatcgtcaggttagtgaagaagaacaacgacggctccaacgcgaattgaaatgtgcccagaacgaggtgcttagattccaaacatcccactcagtcactcagaatgaggagctaaagtcccgactctgcaccctccagaaaaaatatgacaccagccaagacgaacagaacgagctgctgaagatgcagctgcaactgcagactgaactgagacagctaaaggtgatgaagagtactcttgtcgaaaaccagtccgaaaaagaactcttgtgccggttgcagaaattacatttgcagcaccaaaatgtgacgtgcgagaaggaaaagctcctggagagacagcagcaactgcaagaagaacttcaatgtcatgaagccgaacttcagcacctgagggatactgtggcgtcttttaaagagtctaacgaaaaagacacagaaactcacgcacaattgcaggagatgaaacaattgtatcaggcaagcaaagacgaactcgagcgacaaaaacacatgtatgatcaactggagcaggacctgctgctctgtcaactggagttaaaggaattaaaagcttcacatcctatacccgaggacaaaggaaagtgtgccaacaaatgcgacacgctgctatctaggctgactgaactgcaggagaaatataaggcttcacagaaggaaatggggcaactgcaaatggaacagtgcgagctcctggaggaccagcgtagaatgcaggaggagcaagggcagctgcaggaggagctacatcgcctcacactgccactgccaaaaagtggtcttctcctgaagagccaggagctgctcaccaaacttgaggatttgtgcgaactgcagctcctctatcagggtatgcaagaggaacagaaaaaactgatacagaaccaggattgcgtcctgaaagagcagttagagatccacgaggaactgaggaggttcaaggagagtcactttcaggaagtattggaaaaccccgacgacagcaagcttgcaaagtcctccaagtgcaatagaaacaaacaaagtaaactcctgatggaacaaatgcaggcgctccaggttatgtatgatgcggggcaggctaaacaggagctgctgcaacaggaacagggccggctgctggaggagagaaagcgccttcaagctgacttacagttgtgtttagaagaaatgcagctgctgcaggttcaatcaccctctattaaaatgtcgcttgagtcatatgggaaatcctatggcagtatggtgccatcaaacgagaactgtcgcaaaacatacgatactactgttgacgataatgagtcatactacaaatcatacacatccacccagacttcctctaaaagcttcctgaaatcttatgactcctcaacatcagcatctgaggcttacggtaagtcttactgtacaacgagcaattcatctatcacctacaagaaaagctatggatcaaccagcagtagcgatacgtgccagaaaagcttcgtttcatcctgcacagacgaagagcccgctgaacctgaggatatggaaagattcgaggaaatggttgttaaggtgcttattaaactgcaagcagtgcaggctatgtatcaaatctctcaggaggaacacagccagttacaggaacagatggaaaagttacttgcgaaacagaaggatctcaaggaggagcttgacgcctgtgaaagggagttcaaggagtgcatggagtgtctggagaagcccatggctcctcagaatgacaagaatgaaaacatgttcgggttgtggaagcccatggtgttcttggccatcgctgccgtggctctgtatgtgttgccgaatatgcgccaacaggagtcagaattttgcctaatggagtag

SEQ ID NO: 183390 - DNA, 1305 bp, Artificial Sequence
  Description of Artificial Sequence: Synthetic coding sequence
atggaggccggcgccggcgccggcgccggcgccgccggctggagctgtcccggccctggccccactgtcactacactggggagttatgaagcatcagaagggtgcgagaggaagaaagggcagcgttggggttccttggagcgcaggggtatgcaggccatggagggcgaggtactgctccccgctctatacgaggaagaggaagaggaggaggaagaggaagaggaggtcgaagaggaagaggagcaagtccaaaagggcggctccgtcggctcactctcagtgaataagcaccggggattgtcactgacagaaaccgaactagaagagcttagagcccaggtcctgcagcttgtggctgaactggaggaaactcgagaactcgccgggcaacatgaggacgactctctggagttacagggcctcctcgaggatgagcgccttgctagtgcacaacaggcagaggtgttcacaaagcagatccagcagctccagggcgagctccgcagtctgagagaggagattagtctgctggaacacgagaaggaaagcgaactcaaagagattgagcaggaattgcacctggcgcaggcggaaatacagagcttgcgacaagcagcagaggacagcgccacagagcatgagtccgatattgccagcttgcaagaagatctgtgccggatgcagaatgaactggaggatatggagcgcatccgaggagactacgaaatggaaatcgcttcactgcgagccgagatggagatgaaatcgtctgagccatctgaggagctacaagaattacgggaacgataccatttcctcaacgaggagtacagggcacttcaagaatctaactcatctctcacaggtcaactggccgatctggagtccgaaaggacacaacgcgccacagagaggtggttgcagtcacagacactctccatgacctcagctgagagtcagacctccgagatggattttttggaacctgatcctgaaatgcagctactacggcagcaacttcgggatgcagaggagcaaatgcacggtatgaagaataagtgccaggaactctgttgcgaactggaagagctgcagcaccatagacaggtctcggaggaagagcaacggcgcctacagagagaactcaagtgcgcccaaaacgaggtgctgcgctttcagactagccactctgtgacccaatcatcgcctacacctaatccccccatcttttccctcccactggtgggcctggtggtcatcagtgctcttctctggtgttggtgggcagagacctccagctag

SEQ ID NO: 183391 - DNA, 3474 bp, Artificial Sequence
  Description of Artificial Sequence: Synthetic coding sequence
ctgcgggccctggagggcgaggtgctgctgcccgccctgtacgaggaagaggaggaagaggaagaggaggaagaagaggtcgaagaggaagaagagcaggtgcagaagggagggtccgttggctccctgtctgtcaataaacatcgtgggctctctcttaccgaaacagaactggaggagctgagagcacaggtgctccagcttgtagcagaattggaggagacacgtgaattggctggccaacacgaagacgattcactcgagctgcaaggcttactagaggatgaaagactggcctcagcacagcaggcagaggttttcactaaacagattcagcagttgcagggcgaactgcggagcctccgtgaggaaatatcactcctggagcacgaaaaagaaagcgaattgaaagaaattgaacaggaacttcatttagcacaggccgaaatccaaagtctccggcaggcggccgaggacagcgcaaccgagcacgaatctgacatcgcatccctgcaggaggacctctgtcggatgcaaaacgagctcgaagatatggagcgaatcaggggggactacgagatggaaatcgcctcattacgcgcggaaatggagatgaagtctagtgagccctccgggagtctgggcctgagcgactactcaggcctccaggaggagctgcaggagttgcgagaacgctaccacttcctgaatgaggagtatagggccttacaggagtcaaattcttcactcacagggcaactggctgacctggaatcggagcgtactcagcgagctaccgaacggtggctccagtcccaaaccctatcaatgacatcggctgaaagccagaccagcgaaatggatttcctggagccagatcccgagatgcagctactgcgccagcagcttagagacgccgaggaacagatgcatggcatgaaaaacaaatgccaggaactgtgctgcgagcttgaagaacttcagcaccatcgccaggtcagcgaagaagaacagagaagactacagcgagagctcaaatgcgctcagaacgaggtcctgagattccagacctctcattctgtgacccagaacgaggagctgaaaagcaggctgtgtaccctacagaagaagtatgatacgagccaggatgagcagaacgagctccttaagatgcagctccagctgcaaaccgaactccgtcagctgaaagtcatgaaatcaacacttgtggaaaatcagagcgagaaggagctgctgtgcaggttgcagaagctccacctccagcatcaaaacgttacctgcgaaaaggagaaactgctggaacgccagcagcagcttcaagaagagctgcagtgccatgaggcggaacttcagcacctgcgagatactgtggcatccttcaaagaaagtaatgagaaggataccgagacccacgcccagctccaagagatgaaacaactgtaccaagctagcaaagacgagctcgaaagacagaagcacatgtacgatcagctcgaacaagacctgttgctttgccaactagagcttaaagagttgaaagcatctcaccctatccctgaagataagggtaaatgcgcaaataaatgtgacacacttctgagccgcttgactgagctgcaggagaaatacaaggcatcacagaaagagatggggcaattgcagatggaacagtgtgaacttctggaagatcaaagaagaatgcaagaggaacagggacagctgcaggaggaacttcatagattgactttgcctcttcctaaaagcggcttgctgcttaaaagccaggaactccttaccaaactagaagatttatgtgaactgcagctgctgtaccagggaatgcaggaggagcagaaaaagctaatccaaaaccaggactgcgtgttaaaggaacagctggaaattcatgaagaactacggcgctttaaagaaagccattttcaggaagtgcttgagaatccagatgactccaagctggcaaagtctagtaagtgcaaccgcaacaagcagtccaaacttttaatggagcagatgcaggctctgcaggtcatgtatgatgccggacaggccaagcaagaacttctgcagcaggaacaaggccgattattggaggaacgaaagcgcctgcaggccgatcttcagctttgtctggaggaaatgcagctgctccaagtgcagtctccttccatcaaaatgtctctggaaagttatggcaagtcctatggctccatggtcccgtccaacgagaactgtcgaaagacatatgacacaactgtggatgataacgagtcctactacaaatcctatacaagcacgcaaacgagcagcaagagcttcctaaaatcctatgattcttcaactagcgcctccgaggcctatggcaagagctactgtacgacgtctaattcctcaatcacatataaaaagtcttacggctccacctcatcttctgatacgtgccagaagtcctttgtgtctagctgcactgacgaagaaccagccgagcccgaggatatggaaagattcgaagaaatggtggtcaaagttctcataaagctccaggctgtgcaggcaatgtaccagatttcccaagaagaacattcccagctgcaggagcagatggaaaaacttctggccaaacagaaagacctgaaagaagagctggatgcttgtgaaagagaatttaaagaatgtatggagtgcctcgaaaaaccgatggcaccgcagaacgacaagaatgagataaaggaacttcaaaccaagttgcgcgagctacagctgcaatatcaggcctctatggacgagcagggccgcctgttggtagtccaggagcagctggaagggcaattgcaatgttgtcaagaagaattgcgccaattgagagaaaagcggccaagcgtggtcaaggaggcaaggggcaaaaacgcgaacaaaaatatgaacaagaacgccaatggagtaaagatgaagaaggtgaccaaaccttgctccgataccagtgaatctgatcttgagacaaggaagagccttgaagtggtgttgtattataaggcttcacagcgtaagttggacgggctggccaaagaagaggaaaagaaagaggagatggaggaagagaaaaagcaagttaaggaggaggccaaggagcaatgtggcgacgaactggtggccgagcctgctgatcctgaggaagcgaagtccactgaagatcaagaggagaacgaggaagataaagaggaggaagaaaaggaagaggatagcgaagaggaggaggatgatgccgacagctccctggaatctcccgaagagaataatccactgaggcttagtgagtcaaagaagaatatgttcggtctgtggaagcccatggtgtttctagccattgccgccgtagctctttacgtgttgccaaatatgagacaacaggagtcggagttttgtctcatggagtag

SEQ ID NO: 183392 - DNA, 309 bp, Artificial Sequence
  Description of Artificial Sequence: Synthetic coding sequence
atgcaggccatggagggcgaggtgctgctgcccgccctgtacgaggaagaagaagaggaagaagaagaggaagaagaggttgaggaggaagaagagcaggtccagaaaggaggatccgttggctcattatccgtcaataaacaccgagggttgtcactgaccgagacagaactggaagagcttagggctcaagtcctccaactggttgctgaactggaagagacccgcgagttagcaggccagcacgaggacgattccttggaactccagggtctgctggaagatgagcgtttggcttccgcccagtag

SEQ ID NO: 183393 - DNA, 1341 bp, Artificial Sequence
  Description of Artificial Sequence: Synthetic coding sequence
atggaggccggcgccggcgccggcgccggcgccgccggctggagctgtcctggccctggccccaccgtcaccaccctcggaagctacgaggccagcgaggggtgtgagcgaaagaagggccaacgatgggggagtctggaacggagggggatgcaagctatggaaggcgaagtcttgcttcctgccctgtatgaagaagaggaggaagaggaagaagaagaggaagaggtcgaagaggaagaagaacaggtccaaaagggaggttcagtcggctccttatccgttaacaaacacagagggctgtccctgacggaaactgaactggaagaactgcgggcccaagtgttgcagctcgtcgccgaactcgaggagacgcgcgaactggcaggacagcatgaagacgactcactagaactgcagggtttgcttgaggacgagcggctagccagcgctcagcaggcagaggtatttaccaaacagatacagcagcttcagggcgagttaaggtctctccgcgaggagatctccttgcttgaacacgaaaaggaaagcgagttgaaagagatcgaacaggagctccatctggcacaggctgaaatccagtctctgcgtcaggctgccgaggattctgcaacagagcatgaatccgacattgcctctctgcaggaggacctgtgtaggatgcaaaacgagctggaagatatggagagaatcaggggcgactacgagatggaaatcgcatccttacgggctgagatggaaatgaaatctagcgaaccttctggttctctagggctctccgattactctggattgcaggaggagctgcaggagctcagggaacgctatcattttttaaacgaagagtacagggcacttcaggagtccaatagcagcttgacagggcagctcgccgatctggagagcgagcggacacaaagagcaaccgagcggtggttacagagccaaacactctctatgacttccgccgagtcccagacttccgaaatggatttcctggagcccgatcccgagatgcagctcctgaggcagcagctgcgcgatgccgaggaacagatgcacggaatgaaaaataagtgtcaggagttatgttgcgagctggaggagctgcagcaccatagacaagttagtgaagaagagcaacggcggctgcagagagaattaaagtgcgctcagaatgaagtactccgattccagaccagccactcagtaactcagagttcacccacccccaaccctccgatctttagcctgcccttggtggggctggtggttatctccgcacttctgtggtgctggtgggcagaaacatctagttag

SEQ ID NO: 183394 - DNA, 21 bp, Artificial Sequence
  Description of Artificial Sequence: Synthetic coding sequence
atgcaggccatggagggctag

SEQ ID NO: 183395 - DNA, 414 bp, Artificial Sequence
  Description of Artificial Sequence: Synthetic coding sequence
atgcaggccatggagggcgaggtgctgctgcccgccctgtacgaggaagaggaagaggaagaggaggaagaggaggaagttgaagaggaggaagagcaggtccagaagggtgggagcgtgggctccctgtcggtgaataaacaccgcggactcagcctgacagagaccgagctggaggaactccgggctcaggttctacaactggttgcggaactggaagagacaagggagctggctggccagcatgaagatgactcgcttgagctgcaggggctcttggaagatgaaagactggcaagcgcccagcaggccgaggtgttcacaaaacagattcagcaactgcagggcgagttgcgaagcctgcgggaagagatcagcctgctcgagcacgagaaggagagcgaactgaagtag

SEQ ID NO: 183396 - DNA, 192 bp, Artificial Sequence
  Description of Artificial Sequence: Synthetic coding sequence
atgcaggccatggagggcgaggtgctgctgcccgccctgtacgaggaagaagaagaagaggaggaagaggaagaggaggtcgaagaagaggaggaacaggtgcaaaagggaggctctgtgggatccctgagcgtcaataaacatcggggactatccctaaccgagacagagctcgaggaactccgagcctag

SEQ ID NO: 183397 - DNA, 870 bp, Artificial Sequence
  Description of Artificial Sequence: Synthetic coding sequence
atggccggcgccggccggggcgccgccgtgagccgggtgcaggccggccctggttctccccgcagggcaagggggagacaacaagtacagcccctcggaaagcagagacccgccccttggcctgggcttcgaagtaaggaaaagaagaaagtcaactgcaagcctaagaatcaagacgaacaggagatcccattccgcctacgcgagataatgagaagtaggcaggagatgaaaaatccaatcagtaataagaaacgcaaaaaagctgctcaagtcaccttccgaaaaaccttagagaaagaagcgaagggcgaggagcccgatatagccgttccaaagttcaagcaaagaaaaggtgagtccgacggagcctatattcatagaatgcagcaagaagcccagcatgtgctttttttgagtaagaaccaggccatcagacagcccgaagtgcaggctgctccaaaggagaagtccgaacagaagaaagctaaaaaggcctttcaaaagcgaagactggacaaggtgcggagaaagaaggaggagaaggcagctgatcggcttgaacaggagctgcttagggatacagtcaagtttggggaggttgtgctgcaacctcccgaactaacggcacgaccacagaggtccgtgagcaaagaccagcccggccgaagaagccagatgctccggatgctactgagcccgggtggcgtgtcacagcctctcactgccagtcttgcgcggcagagaattgtggaggaagagcgggagcgcgccgtgcaggcttacagagcactcaaacaacgccagcagcagcttcatggggagcgaccgcacctgacatctagaaagaaacccgaaccccagctctag

SEQ ID NO: 183398 - DNA, 1656 bp, Artificial Sequence
  Description of Artificial Sequence: Synthetic coding sequence
atgcccctgagcaccgccggcatcctgagcagcagcagcgccgcctcaaacagatctagaaataaggcccgctaccgcaccaaagccgttagcagtgaggtggacgagtcactctttggtgacatcaagtcacccgcccagggccaatctgattctccaattgtgttgctgcgtgacaagcacactttacagaaaacactgaccgcactcggcctggatcgcaaaccggaaaccattcaacttatcaccagggatatggtgagagaacttatagtgccaactgaagacccttccggggaaagcctgattatcagtccggaagaattcgaaagaatcaaatgggcttctcacgtactgactagagaagaactggaagcaagagaccaggccttcaagaaggaaaaagaagcaactatggacgccgtaatgactcgaaaaaaaatcatgaagcagaaggaaatggtgtggaataacaacaagaagctgagtgatctggaggaagtcgccaaggaaagagctcagaatctgcttcagcgcgctaataagcttcgaatggaacaggaggaggaactaaaagacatgtccaaaattatcttgaatgcaaaatgccatgccataagagatgcacagatcctcgaaaaacaacagattcaaaaggagctggacacagaggagaaacgtctggaccagatgatggaggttgaaaggcagaaatctattcagcgacaggaggagttagagaggaagcggagagaggaacgtatccgcgggcgaagacagatagttgagcagatggaaaagaatcaggaggagaggtctctactagcagagcagagagagcaggagaaggagcagatgctcgagtatatggagcagctgcaggaggaagacctcaaggacatggaaaggagacaacaacagaaactaaaaatgcaggccgaaattaaacgcattaatgacgagaaccaaaagcagaaggccgagcttctggcccaagagaagctcgccgaccaaatggtaatggagttcaccaagaagaaaatggcccgcgaggctgaattcgaagccgaacaagagcgaattagaagagaaaaggagaaggagattgctagactgcgagctatgcaggagaaggcacaggactatcaggccgagcaggacgcactacgtgctaaacgcaatcaggaggtagcggatcgcgaatggcgtcgcaaagagaaggagaacgctagaaagaagatggaaaccgaggcggaattgagaaagagccggctcgaacaggttgcatttaaagaacacgccctggccgtccaggtacagcgggaccgcgacgagttcgagcgcatccttcgggcccagcgagaacagattgagaaggagcggctggaggaggagaagaaagccacaggacgcctccaacacgcaaacgaactcagaagacaggttagagagaatcagcagaaggaggtccaaaacaggatagctacttttgaggaagggcgcaggctcaaggaggaagcccagaaaaggagggagagaattgacgagattaagaggaaaaagctggaggagctgcgtgcaacaggcctccccgaaaaatactgtatagaagcagaaagaaaagccaacatcttacccgccactagcgtaaactag

SEQ ID NO: 183399 - DNA, 1401 bp, Artificial Sequence
  Description of Artificial Sequence: Synthetic coding sequence
atggtgcgggagctgatcgtgcccaccgaggaccccagcggcgagtcccttattatttctcctgaggagtttgagcgcatcaagtgggcaagccatgtattaactagagaagaactggaggccagggaccaagccttcaagaaggagaaggaagccacaatggatgccgttatgactcggaaaaaaataatgaagcagaaagagatggtctggaacaataataagaagttatcagatctggaggaagtagccaaagagagagcccagaatctgttgcagcgagccaataagctgagaatggagcaggaggaggaactgaaagacatgtccaaaataatactcaatgctaagtgtcacgcaatcagagatgctcaaatccttgagaagcagcagattcaaaaggagttggacactgaagaaaagcgtttagaccagatgatggaggtggaaaggcagaaatcaatacaaaggcaggaggagctggagagaaaacgcagggaagagcggataagaggacggcggcaaattgtggaacagatggagaagaaccaagaagagcggtctttattagctgagcagcgcgagcaagaaaaggagcaaatgctcgagtacatggaacaattgcaggaagaggatcttaaagacatggagcgcaggcagcagcagaaactgaaaatgcaggctgagatcaaacggatcaatgacgagaatcagaagcagaaagcagaactgctggcgcaggagaaattagccgaccaaatggtgatggagtttacaaagaagaagatggctcgggaggcggagtttgaagccgagcaggaacggatcaggcgtgaaaaggagaaagagatagcccgtctacgcgctatgcaggagaaggcccaggattatcaggctgagcaagatgcccttagggccaaacggaatcaggaggttgctgatagggagtggagaaggaaagagaaagagaatgctcggaaaaaaatggagactgaagcggaactgaggaaatccaggctggaacaagttgcttttaaggaacatgcactggccgtgcaggtccaaagagatcgggatgagttcgaaagaatcctccgcgcacagagagagcagatagagaaagaacggttggaggaagagaaaaaagcaaccggcagattgcagcacgcaaacgagctgaggcgccaggtccgggagaatcaacagaaagaggtgcagaatcggatagccactttcgaagaagggagaaggttgaaagaggaagcccagaagagacgggaacggatagatgaaataaaaagaaagaaactggaagaactccgtgccaccgggcttccggaaaaatactgcatcgaggcagaaagaaaagcaaacatactgccggccacaagtgtgaattag

SEQ ID NO: 183400 - DNA, 1884 bp, Artificial Sequence
  Description of Artificial Sequence: Synthetic coding sequence
atggaggaggccgaccggatcctgatccacagcctgcggcaggccggcaccgcagttcctcccgatgtccagacccttcgggccttcacaaccgagctggtagtcgaggcagtggtaagatgccttagggttatcaacccagccgtcggctccggactgagtccactgctgcccctcgccatgtcagctagattccgcctagcgatgtccctggcccaagcgtgtatggatttggggtatcccctcgagctgggctatcaaaattttctgtatccctccgaaccggatttgcgcgacctgctacttttcctggccgaacgactgccaacagatgccagtgaggacgccgatcagcctgccggggatagcgcaatccttcttcgtgctattggctctcaaatcagagatcagctggctctcccctgggtgccaccgcacctacggacccccaaactccagcatctacagggtagcgcgttacaaaaaccttttcacgccagccgcctcgtggtgcctgagctgtctagtagaggtgaacccagggaatttcaggccagcccactgctgctccctgtgccaacacaggtaccacagcccgtcgggcgggtggcttcccttttggaacatcacgctctacaactctgccaacagaccgggcgagatcggcccggcgatgaagattgggtgcatcgcacctcacgcttgccgccccaggaagacacccgggcacaacggcaacggctgcagaagcagttaaccgagcacttacgccaaagttgggggctgttgggcgctcccatacaagctcgtgacctcggggagctactgcaggcctggggggctggcgcgaagacgggtgctcccaagggtagtcgcttcacccactccgaaaagttcacatttcacctagagcctcaggcacaggccacacaagtgagcgatgtgccagcaacctctcgccggcccgagcaggtcacctgggcagcacaagagcaggaattggagtcgcttcgcgaacagttagagggtgtcaatcgatccatcgaagaggtcgaggccgatatgaaaacgctgggcgtgagctttgtacaggctgagtccgaatgccggcactctaaactttcaacagccgaacgcgaacaagcacttcgactgaaaagccgagccgttgaacttcttccagacggaacagctaatctggccaagttgcaattggtggtggagaacagtgcccaacgggtgatccatctggcagggcagtgggagaagcaccgggtccctctgttggcggaatacagacaccttcgcaagttgcaggattgtagggaattggaatcatcacgccgtctggctgagatccaggagcttcaccagtcagtgagggctgcggctgaagaggcaaggcggaaggaagaggtctacaaacagttgatgtccgagttagaaaccctccccagggatgtgtcgcgtctcgcttacacccagcggattctggaaattgtgggtaatattcgaaagcagaaagaagagataaccaaaatcctgtctgataccaaagagctgcagaaggaaattaattcactgagtggaaagctggatcgtaccttcgcagtgactgacgaactcgtgtttaaggacgctaaaaaggatgacgctgttagaaaggcttacaaatatctggctgcccttcatgagaattgttcacagctgatccagactatcgaagacactggtacgatcatgcgggaagttagggatctggaagagcaaatcgaaactgaactggggaagaagactctgtctaacttggagaaaatccgcgaggattaccgagcactgaggcaggagaacgccggcctcctgggacgcgtgagagaggcttag

SEQ ID NO: 183401 - DNA, 1743 bp, Artificial Sequence
  Description of Artificial Sequence: Synthetic coding sequence
atggaggaggccgaccggatcctgatccacagcctgcggcaggccgggacagctgtgcctccggacgtacagacactgcgcgcctttacaaccgaactggtggtggaggcagtcgtcagatgcttgagggtcatcaaccccgcggtcggcagtggtctgagccccttgctgccgctggcgatgtcagccagatttagactggcaatgtctctggctcaggcatgtatggatcttggctaccccctggaactgggctaccagaattttctatacccatcagagcccgatctgcgagacctgctgctgttcctggccgagaggctgcctacagacgcatctgaagatgcagaccagccagcgggcgacagtgcaatcctgctgagagccattgggtcccagatccgagaccagcttgcccttccctgggttccgccgcacctccgcactcccaaacttcaacatctgcagggaagtgccctgcagaagccatttcatgcctctcgactggttgtccccgagctttcctcacgcggcgagccacgggaatttcaggccagccccctcctgttgcccgtgccgacccaggtccctcagcccgtgggtagagtggccagtctgctcgaacaccatgccctgcagctttgtcagcagactggtcgtgatcggccgggcgacgaagactgggtccaccggacctcgcggctacctccccaggaagataccagggcacagcgccagagactgcagaaacagctgacggagcacctgcggcagtcctggggattgttgggagcaccaatacaggcaagggatcttggcgagcttctccaagcttggggcgccggcgccaaaactggcgccccaaagggaagcaggttcacccactccgaaaagtttacgtttcaccttgagcctcaggctcaggccacacaggtctccgatgtgcctgcaacgagtagaagacctgaacaagtcacgtgggcagcccaggagcaggagctggagagcctgcgggagcaactcgaaggcgtgaaccgttccatcgaggaggtcgaggccgatatgaagactctcggggtcagcttcgtccaagctgagtcagagtgccgccatagcaagctgagtactgctgaacgggaacaggccctgcgtctcaaatcccgcgccgttgaattactccccgatgggacggccaacttggccaaactgcaattggttgtggaaaacagcgctcagcgcgttatccacctggccgggcagtgggagaagcaccgcgtgccactgctcgccgaatacaggcatctgcgaaaactgcaggactgccgggagctcgagtcctcccgacgcttggctgagatacaggagctccaccaaagtgtcagggcggccgccgaagaggctcgccgcaaggaggaggtctacaagcaacttatgagcgaattggaaacactgcctcgcgatgtgagccgcctggcctacacacagcgcatcctggagattgtcggcaatatcaggaagcagaaggaagaaataaccaaaatcctttctgacacaaaggaactacaaaaggagataaatagcctgtctggaaagctcgaccgaaccttcgcggtaacagacgaactcgtgtttaaggacgccaaaaaagatgacgccgtacgtaaagcatataaatacctggctgcactgcacttcatcggagacggaacagtgggatgggggccatggatacccaataagtag

SEQ ID NO: 183402 - DNA, 603 bp, Artificial Sequence
  Description of Artificial Sequence: Synthetic coding sequence
atggacgacaagaagaagaagcggagccccaagccctgcctggcccaacctgcccaggcacctggaacgcttcgcagagtgcccgtacccacatcccactccggcagcctggccctgggtttgccacacctgccttctcccaaacagcgcgcaaagttcaagcgggtcggcaaagaaaagtgccgcccagtcctcgccgggggcggatcgggctccgctgggacccctctccagcatagctttctaacagaggtgactgacgtctatgagatggagggcggtttgttaaacctcctgaacgacttccatagcggacgcttgcaggccttcgggaaagaatgcagctttgagcagctcgagcacgtcagggaaatgcaggaaaagttggcccgcctccacttttctctcgatgtttgcggggaagaggaggacgacgaggaggaggaagatggcgtcaccgagggactgcccgaggaacaaaaaaagacaatggctgatcggaaccttgaccagctgctgtccaatctcgaggacttatctaacagcatccagaaactgcacctcgcggaaaacgcagagcccgaagaacagagtgctgcctag

SEQ ID NO: 183403 - DNA, 690 bp, Artificial Sequence
  Description of Artificial Sequence: Synthetic coding sequence
atgtgggccgccggccggtggggccccaccttccccagcagctacgcaggtttttcggccgattgtaggcctcgtagccgaccttctagcgattcatgtagtgtccctatgaccggcgcaaggggacaggggctggaggtggtgaggtcaccatctcctcccctgccgctgagttgttccaattcaacgcgctcactactgtcacccttgggccatcaaagtttccagtttgatgaggatgacggagatggggaggacgaagaagatgtagacgatgaggaagatgtggacgaagatgctcacgattcagaagccaaggtggcttctcttcgcggaatggagctgcaaggctgtgcttcgacacaggtggaaagcgaaaataatcaagaggagcaaaaacaagttaggcttccagagagcagactgaccccgtgggaggtgtggtttattggtaaagagaaagaggagagggatcggctgcagctgaaggccctcgaggaactcaatcagcagctcgaaaagcgaaaggagatggaagagagagaaaaacggaagatcatagccgaggagaagcacaaggaatgggtccagaagaaaaatgagcaggtgagacgcggaaagtggatccatacactgacctccctgcttcagaatatctcatcatactatacgtccctgcctaggttttag

SEQ ID NO: 183404 - DNA, 1122 bp, Artificial Sequence
  Description of Artificial Sequence: Synthetic coding sequence
atgtgggccgccggccggtggggccccaccttccccagcagctacgcgggtttctccgccgattgtcgcccccgctcaagaccatcctcagattcttgcagcgtgcctatgacaggcgctaggggccagggccttgaggttgttagatcgccatccccacccttgccactgagctgctccaactcaacacgatcactcttatcacctctgggacaccaaagtttccaatttgacgaagatgacggagacggggaggacgaggaggatgtggacgacgaagaagatgtagatgaggacgcccatgattccgaggccaaggtcgcatcgctgaggggcatggaactccaaggctgcgcgtccacgcaggtggaatccgagaataatcaagaagagcagaagcaggtgcgcctccctgagagtagactcacaccttgggaagtgtggtttatcggaaaggaaaaagaagaaagggatcggctccagctgaaggccttggaggaacttaaccagcagctggaaaaacgaaaggagatggaggaaagagaaaagaggaagataattgccgaagaaaagcacaaagaatgggtccagaagaaaaacgagcagaagcgaaaagagagagaacagaaaattaataaagaaatggaggagaaggctgcaaaggaattagagaaggagtacttgcaggagaaagcaaaggagaaatatcaggagtggcttaagaagaaaaatgcagaggagtgcgaacgcaagaagaaggagaaagaaaaagagaagcaacagcaggccgagatccaggaaaagaaagagatagcagagaagaaattccaggaatggcttgaaaatgctaagcacaaaccaagaccggcggccaaatcctatgggtacgccaatgggaaactgaccggattctattcaggtaactcctatcctgaacccgccttttataaccccattccttggaagccgattcatatgcccccacccaaggaagctaaagacctgtctggtcgcaagtctaagcgacctgtgatctcacagccccataagtccagctccttagtcatccacaaagccagatccaacctttgcttaggaacactttgcaggatacaacgttag

SEQ ID NO: 183405 - DNA, 2268 bp, Artificial Sequence
  Description of Artificial Sequence: Synthetic coding sequence
atggagtacatcttccccaacaccggcgtgctgtggagctggctgatcaacatcctatgtaaccgccgcatagtgtggttcacaagttcccagctgcccagaggtccaccagcttccagtgggggtcacagctttcatacactgagagaaaggtccgagagtcgcctgtttgtggagtcctatgccgctgcatggcagccgcctggtacttcaggcggtgctagctgctgcagtagcctgagtgctcaggttatgagcagtgaattcctcgcagagctgcattgggaggacggctttgccattccagtggctaatgaggaaaacaaactccttgaggaccagctgtccaagcttaaggatgagcgcgcatccctacaggacgagctgcgagaatacgaggagagaattaattccatgaccagccattttaagaacgtgaagcaggagttgtcaatcacccagagcctgtgcaaagctagggaaagggagaccgaatccgaagaacatttcaaggctatcgcccagcgggaactcggacgtgtgaaggacgagatccagagacttgaaaatgaaatggctagtatcctcgagaaaaagagcgacaaggagaacggtatctttaaggcgacacagaaactggatggcttgaaatgtcagatgaattgggatcagcaggccctcgaagcatggctggaggagtctgcccataaagacagcgatgcactcaccctccagaaatacgcccagcaggacgacaacaaaattcgggcactgacactgcaattggagaggctaacgctcgaatgtaaccaaaagcgtaaaatcctggacaatgaactcaccgaaaccatctcggcccagctggaacttgataaagcagctcaagatttccgcaaaatccacaacgaaaggcaggaacttatcaagcagtgggaaaataccattgaacagatgcaaaagcgcgatggggacatagataattgtgccctggagctcgctaggatcaaacaggaaacgagggagaaagaaaatctagttaaggagaaaattaagttcctggaatctgagataggtaataacacagaatttgagaagcgcatttctgtggcagatcgcaagctgctgaagtgccggacggcctatcaggaccatgagacctcaagaatacagctgaagggcgaactggactcacttaaggctacagtaaacaggacttcctctgatcttgaggctttgagaaagaatataagcaaaattaaaaaagatatccacgaagagacagcacgattgcaaaaaaccaaaaaccataacgagattattcaaaccaaactgaaggagatcacagaaaaaacaatgtccgtggaggaaaaggcaactaatctcgaagacatgctcaaggaagaggagaaggacgtcaaagaggtggacgtccagctcaacctcattaagggtgtcctttttaaaaaggcccaggagttacagactgagaccatgaaggagaaggctgtgctgagtgagatcgaagggacgcggtcgagccttaagcatttgaaccaccagcttcagaagttagatttcgagactctgaagcaacaggaaatcatgtacagtcaggattttcacattcaacaggttgagcgcagaatgtcacggctgaaaggggaaatcaactccgaagagaaacaggctctggaagcaaagattgtcgaattgaggaagtctctggaggagaaaaagagcacatgtggactgctggagacccagattaaaaagttgcacaacgacctttattttatcaaaaaagctcactccaaaaattctgacgaaaagcagtctttaatgactaagatcaacgaactgaacctgttcattgacaggtcagaaaaggaactggacaaggccaagggcttcaagcaagatctgatgatcgaggataatctgttaaaattggaagttaaacgaacccgcgaaatgcttcactcaaaggctgaggaggtgctaagtctggaaaagaggaaacagcagctttacacggcgatggaagagaggaccgaggagatcaaggtgcataaaaccatgctcgccagccagataagatatgtagatcaagagagagaaaacatttcaactgagttcagagagaggctgtcgaaaatcgaaaaattgaaaaaccgctacgaaattttaacagtggtgatgttgccccctgaaggcgaagaggaaaaaactcaggcttactatgtaatcaaagtcatgagcatgagctag

SEQ ID NO: 183406 - DNA, 2826 bp, Artificial Sequence
  Description of Artificial Sequence: Synthetic coding sequence
atgagcagcgagttcctggccgagctgcactgggaggacggcttcgcaattcccgtggctaatgaggaaaacaagctgcttgaggaccagctgtctaagttgaaggatgaacgcgcttccctgcaggatgagctgcgcgaatatgaggagaggatcaattccatgacgagtcatttcaagaacgtgaagcaagagctgtctataacccagtctctgtgtaaggcacgagagagggaaacagaatccgaagaacacttcaaggccatagctcagcgcgaactggggagagtgaaggatgaaattcaacggctcgaaaacgagatggctagcatcttggaaaagaagtcagataaagaaaacggcatcttcaaggccacacagaagctcgatgggcttaagtgtcagatgaactgggaccagcaagccctggaagcatggcttgaagaatctgcccataaggactctgacgccctgactctgcagaagtacgcgcagcaggacgacaataagatccgagctttaacactccagctggagaggcttactctcgaatgcaatcaaaaacgaaagatactggataacgaactaaccgagaccataagcgcacaactggagttggacaaggcggcccaagactttcggaaaattcacaacgagcgccaggaacttatcaagcagtgggagaatactatcgagcaaatgcagaagcgagatggcgacatcgacaactgcgccctggaactggcgaggatcaagcaggagactagggagaaggagaacctggtgaaggaaaaaatcaaattcctagaatcggaaatcggtaataatacagaattcgaaaagcggatttcagtggcggaccgcaagctgctgaagtgcagaaccgcataccaagatcacgaaacatcacgcattcaactcaagggggaacttgactccctgaaggcgacggtcaaccggacctcctctgacctagaggccctgcgtaaaaacatttcaaaaataaagaaggacatacacgaggagacagcacggctccagaaaactaaaaatcataatgaaatcattcaaaccaagctgaaggaaattacagaaaagacaatgtctgtcgaggagaaggctaccaacctggaggatatgctgaaggaggaggagaaggacgtgaaggaagtggacgtgcaacttaatttgataaaaggcgtgctttttaaaaaagcccaggagctgcagactgagactatgaaggaaaaagcggtgctttctgagatcgagggcactcggagttctctgaaacacctgaaccaccagctgcaaaaactggacttcgagacgctgaagcaacaggagattatgtatagtcaggacttccacatacagcaggtcgagcggagaatgtcacggttaaagggcgaaatcaatagcgaagagaaacaggcccttgaagctaagattgtcgagctaaggaaatccttagaggaaaaaaagtctacttgtggcctcctggaaactcagattaaaaagctgcataatgacttgtactttatcaaaaaggcccacagcaagaattcagacgaaaagcaatccctgatgactaagattaatgagctaaatctgttcattgaccggtcagaaaaagagttagacaaagctaaggggttcaaacaggatctgatgatcgaggacaacctgctgaaacttgaggtgaaacggactcgcgaaatgctgcatagcaaagctgaggaagtgctgtccttggagaagcgaaaacagcagctctataccgccatggaagagcgaactgaggaaataaaggtccacaagacgatgctcgcttcacagatccgttacgtcgatcaggagcgggagaacatctcaaccgaatttagagaaaggctgtccaaaatcgagaagctgaagaacaggtacgaaatcttgacagttgtgatgcttcccccagaaggggaggaagagaagacacaggcttattacgtcattaaagccgcacaggagaaagaagaacttcagcgggagggagattgcctcgacgctaaaattaataaggcagagaaggaaatctatgccctggaaaatacacttcaggtactgaatagttgcaacaacaactataaacagtcattcaagaaggtaacgccctcgagcgatgagtacgagttgaagatccagttagaagagcagaagagagccgttgacgagaagtatagatataaacaaaggcagatcagagaactgcaggaagacatccaaagcatggaaaatacccttgacgtcattgagcacttagcgaacaacgtcaaggagaaactgagtgagaaacaggcctacagcttccagctctcaaaggagactgaagaacagaagcccaagcttgaaagagtcaccaaacagtgcgccaagttgacgaaggagattcggttgctgaaggataccaaagacgaaaccatggaagaacaagacatcaagctccgtgagatgaagcaatttcacaaagttatcgatgagatgctggtcgacattatagaagagaatacagaaattcgaatcatcttgcagacgtactttcaacagtcaggactggagttacctaccgccagcactaaaggaagtcgccaaagctcccgctctcctagccatacatccctcagtgccaggtcttcaagaagtaccagcacctccacctcacagtccagtataaaagttctggaactgaagttccctgcaagtagctcactcgtgggatcccccagccgcccatcctcagcatcctcgtcgagctcaaatgtgaagtctaagaagtcgagtaagtag

SEQ ID NO: 183407 - DNA, 1740 bp, Artificial Sequence
  Description of Artificial Sequence: Synthetic coding sequence
atggccgagcccggcggcgccgccggccggagccaccccgaggacgggagcgctagcgaaggcgagaaggagggcaacaacgaaagccacatggtgtcacctccggagaaggacgatgggcagaaaggggaagaggccgtgggctcaactgaacaccctgaagaggtcacaacccaggctgaagcggctattgaggagggagaggtcgaaaccgaaggcgaagccgccgtagaaggggaagaggaggctgtcagctatggcgacgcggaatcagaagaggaatactactataccgagaccagctcacccgaggggcagattagcgctgcagacacgacatacccctatttctcgccgccccaggagctccctggagaggaggcttacgatagcgtgtccggtgaggcaggcctgcagggattccagcaggaggccaccgggccccccgagtcaagggaaagaagggtgacttccccagagcccagccatggagttctgggcccctcagagcagatggggcaggtgacctctggacctgcggtgggccgtctgaccggaagcactgaggaaccccaaggacaggttctccctatgggtgtgcagcaccggttccgcctctcccacgggtccgacattgagtctagcgatttagaggagtttgtttctcaggagcccgtgatcccccccggtgtacctgatgcacaccctagagaaggcgatcttccagtgtttcaggaccagatacagcaacctagcacggaagaaggcgctatggctgaaagggtggagagcgaagggtccgacgaggaggctgaggatgaaggcagccagttggttgtcttagacccagaccaccctcttatggtcagatttcaagcggcactgaaaaattatctgaaccggcagatcgaaaagttaaagctggacttgcaggagttggtcgtggctacaaaacaaagccgtgctcaaaggcaggagctgggcgtgaatctgtacgaggtccagcaacatttggtgcacctccagaagctacttgaaaaaagccatgatagacacgcaatggcgagctctgaacgtcgacagaaagaagaagaactgcaggccgctagagccttatacacgaagacatgcgctgccgcaaacgaagagaggaaaaaactggcggctctgcagactgaaatggagaacctggctttgcatctcttctatatgcagaacatcgatcaggatatgagggacgacattagggtgatgacacaggtggtcaaaaaggcagaaaccgagagaattagggcagagattgagaaaaaaaaacaggatctttatgtggaccaactcaccactcgcgcgcagcagctggaagaagacatagcgctcttcgaggcacagtatctggcccaggccgaggacacaaggatcctccgaaaagctgtttctgaagcctgcaccgaaatcgatgccatcagcgtcgagaaacggaggattatgcagcagtgggccagtagtcttgtcggaatgaaacacagggacgaggcccaccgcgcagtccttgaagccctgagtgtttctttagaaagatttcccagtcagaacattaataccgcaaggagccggctgtctacaacatggcacagcgccggaatcctcctgagagggtcgtttctgccaggcgccagcagggccttcgcttcagtttgctacggcggcgctgctgtggataatagaattcgggagtgttag

SEQ ID NO: 183408 - DNA, 1437 bp, Artificial Sequence
  Description of Artificial Sequence: Synthetic coding sequence
atggccgagcccggcggcgccgccggccggagccaccccgaggacggctccgcctcagagggggagaaggagggcaacaacgagtcccacatggtgtctccacccgaaaaggacgacggccagaagggagaagaagctgtaggttccaccgagcaccctgaagaggttacaacccaggctgaggctgccattgaggagggcgaggttgagacggagggagaggccgccgttgaaggggaagaagaggccgtgagctatggagacgccgagtcggaggaggagtattactacaccgaaacttcaagccctgaagggcagatcagcgcggccgacacaacctatccttacttctcccctccacaagagctacctggagaggaggcttatgacagcgtgtccggcgaggctggactccaggggttccaacaagaggctacaggtcctccagaatctcgggagagacgtgttacctcccctgagccctcacatggggttctgggacccagcgagcagatgggtcaagtgacctcaggacctgccgtcgggaggctgaccgggtcaacagaggagccgcaggggcaggtgctgcccatgggtgtacagcacaggttccgtctctctcatggcagcgatatcgagagtagcgatctggaagaattcgtctctcaagagcctgtcatcccaccgggagtcccagatgcccacccgagagaaggtgatctaccggtttttcaggaccagattcagcagccgagtaccgaagaaggcgccatggccgagagggtagaatccgaggggtcagatgaagaagccgaggacgaaggctcacagctggtggtgctggaccccgaccacccgctgatggtgaggttccaggcagccctgaagaattacctgaacaggcagattgaaaaactgaagttagacttgcaagagctggtggttgctactaaacagagccgcgctcaacgccaggagttgggcgtgaacttgtatgaagtgcaacagcacttagtgcacttgcaaaaactattggagaaatcccacgacagacatgccatggctagctccgaacgcagacagaaagaggaagagcttcaagccgctcgggcgttatatacaaagacctgcgcagcggccaacgaggaaagaaaaaagcttgccgcacttcagacagagatggaaaacctggcgctccaccttttctatatgcaaaatattgatcaggacatgcgagatgatatcagagtcatgacacaagtggtgaagaaggctgagactgagcgcatacgtgctgagatcgaaaaaaagaagcagggagttggggacactggcgcggccttcattccgaagaccacgcaaggcgatcaggtttccggccgcgggaagaagaagcccgggactgtcgtggcccgggtatcccccgccgaactatag

SEQ ID NO: 183409 - DNA, 3093 bp, Artificial Sequence
  Description of Artificial Sequence: Synthetic coding sequence
atggccgagcccggcggcgccgccggccggagccaccccgaggacgggagcgcctcagagggagaaaaggaaggcaacaatgagtcccacatggtcagcccacccgagaaggacgatggccaaaaaggggaggaagcggtgggaagcaccgagcatcctgaggaagtgacaacccaagctgaggctgcgatcgaggagggtgaagtcgaaacagagggtgaagccgctgtggaaggagaggaagaggcagtgagctatggagacgccgagtcggaggaagagtactattatactgagacatctagccctgaaggtcagatatcagctgctgatacgacctacccatacttcagccctcctcaagagctgcccggcgaggaagcctacgactctgttagtggggaggctggactccaggggtttcagcaggaagctacgggaccaccagagagccgcgaaaggagggttacttcccccgagccaagccatggagttttgggcccttcagaacagatgggacaggtgacaagtggaccagccgttggccgcttgaccggctcaaccgaagaaccgcagggacaggtgcttcccatgggggttcagcatagattcagactgagccatggcagcgacattgagtcatccgacctcgaggagttcgtttctcaggagcctgtaatacctcccggggttcctgacgcacatcctcgcgagggcgaccttccggtgtttcaggatcagattcagcagccatccacagaagaaggcgccatggccgagcgagtggaaagcgagggctccgatgaggaggcagaggacgagggaagccagctcgtcgtgctggaccccgaccatcccctgatggttcgctttcaggccgcactgaagaactatttgaatcggcagatcgaaaaattgaagctcgacttgcaggaactggtggtggccactaagcagagtcgggcccagcgacaggaattgggagttaatctgtacgaagtgcaacagcacctcgtgcacctacaaaagctgctggagaagagccacgaccgccatgctatggcctctagcgaacggaggcaaaaggaagaggagcttcaggccgcgcgggcgctctacaccaagacatgcgcagccgcgaatgaagagcgcaagaaactcgcagctctccaaactgagatggagaatctggcactgcatctcttctatatgcagaatatcgaccaggacatgagggatgacatccgggtcatgacacaggttgtgaagaaggctgaaaccgaacggatacgcgcagaaattgaaaagaagaagcaggatctctacgtcgatcagcttaccactcgggcccagcagttggaggaggacatagcgctgttcgaggctcaatatctcgcccaagcagaagatactagaattcttcgcaaggctgtatcagaagcctgcactgaaatcgatgccatctcggtggaaaagagaaggataatgcagcagtgggcttcaagtctggtgggaatgaagcaccgcgatgaggctcatcgcgccgtcctggaggccctacgggggtgccagcaccaagctaagtcaacagatggcgagatcgaggcttacaagaaatccataatgaaggaggaagaaaaaaatgagaaactggcgagcatcctcaatcgcacagagaccgaggccaccctcctgcagaaactgaccacacagtgtttgaccaaacaggtggcactgcagtctcaattcaatacctaccggcttaccctgcaggacacagaagatgctctttcgcaggaccagctggagcagatgattctgacagaggaactgcaagcaatcagacaggcaattcagggtgagttggaactacgccgcaagactgacgctgccatccgtgagaaactccaagagcacatgacaagtaataagacaacaaagtattttaaccagctgatcctgcgcctgcagaaagagaaaaccaacatgatgacccatctttctaaaatcaatggagacatcgcacaaactacactagatattacgcacactagttcacgcctagatgcacatcagaaaaccctcgtggagctcgaccaggacgtgaaaaaggtgaatgaacttatcaccaattcgcagtctgaaataagccgccgcacaattctaattgagagaaagcaaggtctaataaattttttgaataaacaactcgagcgaatggtcagcgaactggggggcgaggaagtggggcccctcgaactggagattaagcgactatcaaagctgattgacgagcatgatggaaaggccgtacaggctcaggtcacctggctgagactgcaacaagaaatggtaaaagtgacgcaagagcaggaggagcaactagccagcttagatgccagtaagaaagagttgcatatcatggaacagaagaaacttcgcgtggagagtaagatagaacaggagaagaaggagcagaaggaaatagagcaccacatgaaagacctcgacaacgaccttaagaaactcaacatgctgatgaataagaatcgctgctcatccgaggagctagagcagaacaatcgagtgacagagaacgagtttgtacgcagtctaaaagcctctgagcgggagacgatcaagatgcaggataagctgaatcagctgtcggaagagaaggcaactttgctgaatcagcttgtcgaggctgagcatcagatcatgctgtgggagaaaaaaatacaactggcaaaagaaatgcgaagcagtgtggactccgagatcgggcagaccgaaatcagggccatgaaaggggagatacatcggatgaagaaatattgtcgaaccacacaggatgctcatcgccacgtgcacgagcagcatggaacacacgcaggcacatgtaccaagaatactgggcgggctcaagctagggccaggaccaccagagatgcccggggccacgtgcatgaacagcacggcacgcgggccggtacttgcaccaacaacacagggcgcgcccaggcccgcgctcgaacacgtgatgccaggaggcatgtccatgagcaccggacccacactgctcgggcctag

SEQ ID NO: 183410 - DNA, 3429 bp, Artificial Sequence
  Description of Artificial Sequence: Synthetic coding sequence
atggccgagcccggcggcgccgccggccggagccaccccgaggacggcagcgccagcgagggggagaaggaaggaaacaatgaaagtcatatggtaagtcctcccgagaaggacgacggccagaagggggaggaggcagtgggctctaccgagcacccagaggaggtcactacgcaggccgaagccgccattgaagaaggcgaagtggagactgagggcgaggcagcggtggagggcgaagaagaagccgtgagttatggcgacgctgagagcgaagaagagtactactatactgaaacatcctctcctgagggccagatcagcgcagccgacacaacttacccttatttctctccacctcaggagctccccggtgaagaggcttatgattcagtgagcggtgaggccggattgcagggttttcagcaagaggccaccggtccgcccgagtctagggaaagaagagttacaagtccagagccatcccatggtgtgctgggacccagcgaacaaatgggacaggtgacaagcggacccgcggtgggccggctcactggctcaaccgaagaacctcaggggcaggtcttgccaatgggagttcagcatagatttaggctctcgcacggttctgatatcgagagtagtgaccttgaagagttcgtatcgcaggaacctgtgatcccccctggcgtgccagacgcacacccccgcgaaggggacctccccgtctttcaggatcagatccagcagcccagtaccgaagaaggcgcgatggccgagcgagttgagtcagagggcagtgatgaagaagccgaagacgaggggtcgcaactggtcgtactggatccagaccacccactcatggtgcgtttccaggccgcattgaagaattacctcaatcgacagatcgagaaactgaagttggacctgcaagaactcgtcgtggccacaaaacagtcacgggctcaacggcaggagttgggcgtaaatctttacgaagtacagcagcatctagtccatctacagaagctccttgaaaaaagccacgaccgtcacgccatggccagcagtgaaaggcgtcagaaggaagaggaattacaagccgctagggcactgtacaccaagacatgtgctgcagccaacgaggagcgcaaaaagctggctgccctgcaaaccgagatggagaacttggcactgcatcttttctatatgcaaaacatcgaccaagacatgcgggacgacatacgcgtgatgacccaggtcgtcaaaaaggctgaaacggaacgaatccgcgcggaaatcgagaagaaaaaacaggacctgtacgttgaccaactcaccacccgtgcccagcagctggaggaagatattgcattattcgaagctcagtatctcgcacaagccgaggatacgagaatattaaggaaagcagtcagcgaggcatgcacagagatagacgcaatctctgtcgaaaaaagacgaattatgcagcagtgggctagctcactcgtcggtatgaagcaccgtgacgaggcacaccgggctgtcctcgaggcccttcgtggctgccagcatcaggccaagagtaccgacggtgagattgaagcctataaaaaatctattatgaaagaagaggaaaagaacgagaagctcgccagtattctgaacagaacagagaccgaagccacccttctgcaaaagttgacaacacagtgcctcactaagcaggtggccctgcagagtcagttcaacacctaccggttgactctgcaggatactgaggatgccctgtcacaggatcaactcgagcaaatgatactaactgaggaactgcaggctatacgccaggctattcaaggcgagcttgagctgagaagaaaaacagacgctgccatcagagagaaattgcaggagcacatgacctctaacaagacaaccaaatacttcaaccagcttattctgcgcctgcagaaggagaagaccaacatgatgactcaccttagtaagatcaatggtgatatcgcccaaacgactctggacataacacatacctcgtcacgtcttgacgcccaccaaaagacactggtagagctggaccaagacgtcaaaaaagtgaatgaactcattaccaattcgcagtccgagatttctagacgcacaatcctgattgagagaaagcagggactgattaactttctgaacaagcagctggaacgtatggtgtccgagctgggcggagaggaagttggtccactcgaactggaaatcaaaagattgagcaaactgatcgacgaacacgacggtaaagctgtacaagctcaggtaacttggctgaggctgcagcaggagatggttaaagtgacgcaggaacaagaagagcagctcgctagtctggatgcatctaagaaggagctccatattatggagcagaaaaaactgcgcgtggagagcaagattgagcaggagaaaaaggaacagaaggaaattgaacaccatatgaaagatcttgacaatgacctgaaaaaattaaatatgctcatgaataagaaccgatgctcttccgaagagctcgagcagaacaaccgtgtgacggaaaatgagttcgtcaggagtcttaaggcgtccgaaagagagactataaaaatgcaggacaaattaaaccaactttcagaggaaaaagcaaccctgttgaatcagctggtcgaagcggaacaccaaatcatgctctgggaaaaaaagatccaactagcaaaggaaatgagatcctcggtcgatagcgaaatcggacagactgagattagagccatgaaaggagaaatacaccgcatgaaggttcgcctggggcaactgctaaagcagcaggagaagatgatccgagccatggagctagctgtcgccagacgggaaaccgtgactacccaggccgaagggcagagaaaaatggatagaaaggctctgacacgcaccgatttccaccacaagcagctagagctgcggcggaaaattcgcgatgtacggaaggcgaccgatgaatgcaccaagaccgtactcgagttggaggaaacacagagaaacgtgagctcttcgctgttagaaaagcaggagaaactctccgtgatccaagcagatttcgacactctggaagccgatctgacacgcctgggggccctgaaacgacagaacctctctgagatcgttgccctccagacacgattgaaacacttacaggcagtgaaggaggggagatacgtatttcttttcagaagcaagcaatcccttgtgctcgaaaggcagcgccttgataagagactagccctgatcgctacaatcctggatagagttagagatgaatatccgcaattccaggaagcacttcataaagtgtcccagatgattgcgaacaagctggaatcgcctggtccatcatag

SEQ ID NO: 183411 - DNA, 921 bp, Artificial Sequence
  Description of Artificial Sequence: Synthetic coding sequence
atggccgaggtgagcatcgaccagagcaagctgcccggcgtgaaggaggtctgtagagatttcgcagttctcgaagatcacaccctcgcccactccctgcaggagcaggaaatagagcaccacttagcgagtaacgtgcagcggaacagacttgttcaacacgacctccaggtggctaagcagcttcaggaggaagatctgaaggcgcaggctcagctccagaagcgttacaaagatctcgagcagcaagactgtgagatcgcacaggagatccaggagaagctggctatcgaagcagaaaggaggcggatacaggaaaagaaagacgaagatattgctcggctgctgcaggagaaggaactccaggaggagaagaaaagaaaaaaacactttcccgagtttcctgctactcgcgcctatgccgactcctactattatgaagatggcgggatgaaaccacgagttatgaaggaggctgtatccaccccaagcagaatggcacaccgcgatcaggaatggtatgatgccgaaatcgccagaaagttacaggaggaagaactcctagccacccaggtggatatgcgcgctgcccaagtggcccaggacgaggagattgccaggttactcatggctgaggaaaagaaggcatataagaaggccaaggaacgcgaaaagtctagccttgacaagcgaaaacaggaccccgaatggaaaccaaagacagccaaggctgcaaacagcaagtcaaaagagtccgacgagccacaccattctaaaaacgagcgaccagccagacctccaccaccaatcatgaccgacggggaggacgccgactacacccactttactaaccaacagtcttccacacggcacttttctaaaagcgaaagctcacataagggctttcactataaacactag

SEQ ID NO: 183412 - DNA, 1449 bp, Artificial Sequence
  Description of Artificial Sequence: Synthetic coding sequence
atggccgaggtgagcatcgaccagagcaagctgcccggcgtgaaggaggtctgcagagacttcgcggtccttgaagatcacaccctcgctcattccctgcaagaacaagagattgaacatcacttagcttccaacgttcagcgcaaccggctggtccagcacgatctccaggtggccaagcagctgcaggaggaggatctgaaggcacaggcccagctgcagaaacgctataaagacctggagcagcaggactgtgagatcgcccaggagattcaggagaaacttgccattgaggccgagaggcgccgaatccaggaaaaaaaggacgaggatatcgcaagactgctgcaagaaaaagagctccaggaggaaaagaagcggaagaagcatttcccagaattccccgccactcgcgcgtatgcggattcttactattacgaggacggggaccagccaggaagtcgcagagccagggagctgggatcggggttcagcagaccctgtagactgcagcgggacggtaaaaccgtgaaacacaaaaaggagaagcccgaacacccattggaaaatcttgaagaacccgaacagcattgctcttcaaagcgaagtctctcgtcttcaagttctggaaagggccgagacaatccgcatattaacaacgaacagcacgagcggaaacggagcacccaggaacgtcccaggcgcccgcttctccctacaatatccggcgaggtgtttctttcgacagaatgtgatgactgggaaaccaaaatcaaccaccagacccgaaactgggagaaacaatccagacatcaggataggctgtcaccgaagagctctcagaaggcgggccttcactgcaaggaagtggtctatggtagagaccacggacagggcgagcaccgcaaacgcagacacaggccgagaacgcctccattctccgagtcagaagagcagttgcacctgcatgacgcagggatgaaaccacgggtcatgaaggaagctgtttccacaccctcaagaatggctcacagagaccaggagtggtacgacgcagaaattgcaaggaaattacaggaagaggaactgctagccacgcaggtcgatatgcgcgctgcgcaggtcgcgcaggacgaagaaattgctaggctgcttatggctgaagaaaaaaaggcctacaagaaggctaaggagcgagaaaagagttccctcgacaaacggaagcaagatccggagtggaaaccaaaaacggcgaaggctgctaattctaaaagtaaagagtccgatgagccccaccattcaaaaaatgaacgcccagcccgtccccctcctcctattatgacagacggagaggatgcagactacacgcactttaccaatcagcagagctcgactaggcacttcagtaaatccgaatcatcacacaaagggtttcattacaagcattag

SEQ ID NO: 183413 - DNA, 1425 bp, Artificial Sequence
  Description of Artificial Sequence: Synthetic coding sequence
atggccgacagcgccagcgagagcgacaccgacggcgccggcggcaacagctcctcttctgccgccatgcagtcgtcatgtagttcaacaagtggaggcggaggaggagggggaggaggggggggaggtggtaaaagcgggggcatagtgatctctccctttcgcctagaggaactcactaaccgactagcgagcctgcagcaagagaacaaagtcctcaaaatcgaactagaaacctataaattgaagtgtaaagcccttcaagaggagaatcgcgatttgcggaaggccagtgtgaccatccaagcgagagcggagcaagaggaagaattcattagcaataccctgtttaagaagatccaagcactgcagaaagaaaaagagactctcgccgtcaactatgagaaagaagaggaattcttaacaaacgagctgtccaggaagttgatgcagctgcagcacgaaaaggctgagctggaacagcatctcgagcaggagcaagagtttcaggtcaataagcttatgaagaaaattaagaaactcgaaaatgacacaatcagtaagcaacttaccctcgaacaattgcgaagagagaagattgatttggaaaacaccctggaacaagagcaggaggctctggtgaaccgtctgtggaagcgaatggacaagcttgaagctgagaaaaggattttgcaagaaaagttggaccaaccagtgtcggctcctccatcccctcgggacataagtatggaaattgattcacctgagaatatgatgagacacatcagattcctcaaaaatgaagtggaaaggctgaaaaagcagctccgagctgctcagttacagcattctgagaagatggcccagtatttggaggaggagaggcatatgcgagaagagaacctgcggctgcagcgcaaacttcagcgcgaaatggagagaagggaggctctgtgccgccagctcagcgaaagcgaaagcagcctggagatggacgatgaaagatatttcaacgagatgtctgcccaggggctgcggcccagaacagtttcgtcccccatcccttatacaccatcgccaagtagctccagaccaatttctcccggtctgtcttacgcaagtcatacggtgggattcacaccacctacttctctgacacgggcaggaatgtcctactataacagccctgggctccacgttcagcatatggggacctcccacgggatcacacgcccctctccccgcaggtccaacagcccagacaagttcaagcgacctacccctcctccatctccgaacacccagaccccagtgcagcctccaccacctccacccccgcctccaatgcagcccaccgtgccttctgcggcaaccagtcagcccaccccatcccagcatagtgctcacccttcgtctcaaccttag

SEQ ID NO: 183414 - DNA, 2055 bp, Artificial Sequence
  Description of Artificial Sequence: Synthetic coding sequence
atgaacccccccgccgccttcctggccggccggcagaacatcggcagtgaggtcgagatatcaactattgagaaacagaggaaagaactgcagctactgatcggtgaattaaaagatcgcgataaagagttgaatgatatggtggcagtccatcagcagcaattgttgtcctgggaggaggacaggcaaaaagtactcaccttggaagagagatgcagcaaacttgaaggggaattgcacaaacgaacagagatcataagatccctaaccaagaaggttaaggctctggagtccaatcagatggagtgccagactgcactgcagaagacccaattgcaattgcaggagatggctcagaaggccacccattcaagtttgctttccgaggatctcgaagcccgaaatgagacgctgtctaataccttggtggagttgtcagctcaggtcgggcaactgcaggctcgggagcaggccctgaccaccatgatcaaactcaaagataaagacatcattgaagcagtgaaccacattgctgattgtagtggcaagtttaaaatgttggagcacgcccttagagatgctaaaatggctgagacttgtatcgtaaaggagaagcaggactacaaacagaaactgaaggccctgaagattgaagttaataaactcaaagaagacctaaatgagaaaaccacagagaataatgaacagagagaggaaattatacgattgaagcaggaaaagtcatgcttgcacgacgagctcttatttaccgtggagcgcgagaagcgaaaagacgagctgttgaacattgccaagtctaagcaggaacgaactaacagcgagctccataacttgcgacaaatctatgttaagcagcagtcagatctacaatttctgaatttcaacgtggagaactctcaagagctcatccaaatgtatgacagcaaaatggaagagtctaaagccctcgatagctcccgcgacatgtgcctttcggacctcgaaaacaatcaccctaaggtagacattaagagggaaaaaaaccagaaatctttgttcaaagaccagaagttcgaggcaatgctggtccagcagaaccgttctgataaaagttcctgtgatgaatgtaaagagaagaagcagcagattgataccgtgttcggcgagaaaagcgttattactctgtcgagtatcttcacgaaagatctggtggagaagcacaatctgccttggtctcttggcggaaaaacgcaaattgaaccagaaaacaagattactctgtgcaagatccatactaaatctcccaaatgccatggaacgggagtgcaaaacgagggtaagcagccatccgagaccccaaccctcagcgacgagaaacagtggcatgatgtttcagtgtacttaggcctgactaattgtccttcttccaagcatccagagaagttagatgttgagtgccaggaccagatggagagaagcgaaatttcgtgttgccaaaaaaacgaggcttgcctgggcgaatctgggatgtgtgacagtaagtgctgccacccatctaactttatcatcgaggcccccggccacatgagcgacgtcgagtggatgagtatctttaaacccagtaaaatgcaacgaatcgtaagactcaaaagtgggtgtacgtgctccgaatctatatgcggtacacaacacgacagtcccgcatccgaacttatcgccattcaggactctcacagtcttggttcctctaagtccgcactgcgggaggatgaaactgaatcaagcagcaacaagaaaaactctccaacatcactgcttatctacaaggatgctcccgcctttaacgagaaagccagcatcgtgctgccaagccaggatgattttagtcctactagcaaacttcagagattgttggctgaatcacgacaaatggttactgacttagagctgtccacccttctcccgatcagtcacgagaacctgaccggtagtgccacaaacaagtccgaagtgcccgaggagagcgcgcagaaaaatacgttcgtttcttactag

SEQ ID NO: 183415 - DNA, 1338 bp, Artificial Sequence
  Description of Artificial Sequence: Synthetic coding sequence
atgcccaacagcagccccaaggaccccaccaccgccagcggcaacgggtccaaggttgagcgtgagaaaagaaaggatgaactgctgaacattgccaagtcaaagcaggaacgaactaattccgagctacacaaccttcggcagatctacgttaagcaacaatccgaccttcagttcttgaactttaatgtggaaaacagtcaggagctaatccagatgtatgactctaaaatggaagagtccaaggcgctcgatagttcccgagatatgtgccttagtgacctagaaaataaccaccccaaagtggatatcaagcgggagaagaaccagaaatcattgttcaaggaccagaaatttgaggccatgctcgtgcagcaaaacagatccgacaagtcctcatgcgacgaatgtaaggaaaaaaagcagcaaatcgacacagtgttcggagaaaaatcagtgattaccctgagctcaatttttacgaaagatttggtggagaagcataacctgccttggtcccttggtgggaagacgcagatcgagcctgaaaataaaattaccttgtgcaagatacatacaaaaagtcctaaatgccacggaacaggagtgcaaaacgaggggaaacagccatccgagacacccacccttagtgatgaaaaacaatggcatgatgtctcagtgtatctgggactcacaaattgcccttcatcaaagcaccctgaaaagcttgacgtcgagtgccaggatcaaatggagagatcggaaatatcatgctgccagaaaaacgaggcttgcttaggtgaatcaggcatgtgtgattctaagtgctgtcacccatcaaattttattatcgaggcccccgggcacatgtccgacgtcgagtggatgagtatttttaagcccagtaagatgcagagaattgtgcgactgaaaagcgggtgtacttgtagcgagagcatatgtggaacccagcatgatagcccggcctccgaacttatcgctatccaggattcccatagtctgggatcaagtaaaagtgctctgcgagaggacgaaaccgagtcttctagcaacaaaaagaactctcccacctcgctgcttatctataaggacgctcccgcattcaatgaaaaggccagcattgtgcttccgagtcaggacgacttctctcctacaagtaagttgcagaggctgctggcggagtccaggcagatggtcacagaccttgaactgtccacactgctgccgatatcccacgagaacctgactgggagtgctactaataagagcgaggtgccagaggagtcggcccagaagaacacattcgtgtcatattag

SEQ ID NO: 183416 - DNA, 2049 bp, Artificial Sequence
  Description of Artificial Sequence: Synthetic coding sequence
atgaacccccccgccgccttcctggccggccggcagaacatcggctctgaggtggagatctcgactatcgaaaagcagagaaaagagttgcagctcctcatcggagagctcaaggatagggacaaggagctaaacgacatggttgccgttcaccagcagcagttactctcttgggaggaagaccgccagaaggtgctgacattagaggagagatgttcaaagctggagggagaacttcataagcggaccgagattattcgctcattgactaagaaggtgaaggcactggagtccaatcaaatggagtgtcaaacagccctgcaaaagactcagcttcagctccaagagatggcgcagaaggccacccacagcagcctgctatccgaagacttggaggctcggaacgagacattgtcgaatactttagttgaactttctgcgcaggtcggtcagctccaggctagagagcaggcgttgactactatgatcaagttgaaagataaggatatcatagaagctgtgaatcatatcgccgactgctccggaaagttcaagatgttagagcacgctctgagggatgcgaaaatggctgaaacatgtatcgtgaaggagaagcaggattataaacagaagctgaaggccctgaagatcgaggtgaataagcttaaggaagatcttaatgaaaagaccacagaaaataacgaacaacgcgaggaaatcatcagactgaaacaggaaaagagttgtctgcacgatgaacttctgttcacagtggaaagagagaagcggaaggatgagttactgaatatcgccaaatccaaacaggagagaactaatagtgaactgcacaatctgaggcaaatctacgtgaagcagcagtccgacctgcagttcctaaactttaacgtggagaattcacaggagctcattcagatgtacgattccaagatggaagaatcgaaagcactggactcctcccgcgacatgtgccttagtgatctcgagaacaatcaccctaaagtggacatcaaaagagagaagaaccagaagtcactcttcaaggaccagaagttcgaggcgatgcttgtccagcagaatagaagcgacaagagttcctgcgacgagtgtaaggaaaaaaagcagcagattgacacagttttcggcgagaagagcgtcataactttgtcgtcaatctttaccaaagatctcgttgaaaaacataacttgccctggtccctgggaggtaagacacagatcgaacctgagaataaaattacactgtgcaaaatacacaccaagagccctaaatgtcacggcacaggagtacagaatgaaggaaaacagccgagtgaaacaccaaccctgtccgatgagaagcagtggcatgacgtgagcgtctatctgggcctcactaattgtccgtcaagcaagcaccccgagaaacttgacgtggagtgccaggatcaaatggagcggagcgaaatctcctgctgccagaaaaatgaggcgtgcctgggagagtccggtatgtgtgattcgaagtgctgccaccccagtaactttattatagaagccccaggccacatgagtgatgtggaatggatgtcaattttcaagcccagtaagatgcagcggattgtgagactgaagtcagggtgcacatgctctgaaagtatctgcggaactcaacatgactcccctgcctcggagcttatcgccatccaggactctcactctctgggctcgtcaaagagcgcactccgagaggatgagacagagtcgtcctctaataaaaaaaactctcccaccagtttgttgatatacaaggatgcgccagcctttaatgagaaggcttctatcgtcttgccctctcaggacgacttttcccctacaagtaagcttcagcgtttgctagctgagagcagacagatggttaccgatttggaattgtcaactctcctgccaatatctcacgaaaatctcacgggctctgctaccaacatttctcatctttgcgggcgccagaaggccgatactaacactgagtag

SEQ ID NO: 183417 - DNA, 1494 bp, Artificial Sequence
  Description of Artificial Sequence: Synthetic coding sequence
atgcccaagaaggagaagatggccaagacccccctgagcgacgagaagcagcttctgcttttccagcagaagttgctggccgaggaggaaatggcaaaaaagaaagagcgtttgctgtcccagtttctgaaggacaagctggctaaggaagagcacaactcggccttgaacctcaacaagatcaacacccagtggcgcaccgtgctgcgagaagtgaagactagagaattgcacaaggacatcgaaatactgtctcagacttttgaaagggttgttgactgcaaggataatgttatcaagtcacttgcgaaggacctatccgaggccgaagaacagtacgcacatgctctgcgatcgcacctgcacaatgtcgaccagcttctggccttgcagcggcaccgtctgtcattgctggaggagagctacaacatggagctcgaggccctaacaaaggagtttgagacggagcgcaagaccattattgatcagcatgagaaagaaattcattatctccaagacatattcatggccatggagcagaattatatcgatagcgaatacgagtccaagttggaattccagtcaatgtggaacgatctgaagaatatgaacctcgaagagaagcattttctgcgcctccacctggagaatcgagtggaagatttatggcggaaatttcaggatgtcttaaagaattacacagacgcaaccgaagaccggaaagccgcctttgagaccctacaggtgaaagatgagaagtctagtaaagaaattgaggttcagatgaagaagatccaaaagctgcaggacgcgatcacaatctccaaaggcaagattatgattcactcccgcgagtctgaggacgagaacagatatatcaggaacgacaaggagctcgtgttggtgcagctgaggaagctgaaggcccagcggacacaggcccgagcagcgtcccaaaagaacctggtgcgcctgactctggaatccaatgccacacttaaggccctccgcaaaatagtggataagggggagaagatcctgaaattggccgagatatgtcggaaattcgagacggaggaagagaaagtcctacccttctatagtagcgtactgactcctaaagagcaggaagggatccagaaaaataacctggaggaactgaccgaggaactgacgaaagtgatggtagattacataggcatggagaacttctggaagagatataataaggtgaagctggagcagttatccctgcaacatcggagggctcaacttctcgacattaacggtaaactgcgagaaatgttgaagcaatatctggatggcatcagcgtaagcgacgaggtgctgtctcagctgaaccctctgttcatcgtcaactatcagagcaatttgttgcagccactcagtatacggatcgcccatcctggcagcacctccccttctgctccctggagggatcagagacgctcctttttcctcggctcctcatag

SEQ ID NO: 183418 - DNA, 1455 bp, Artificial Sequence
  Description of Artificial Sequence: Synthetic coding sequence
atgcccaagaaggagaagatggccaagacccccctgagcgacgagaagcagctgctcctgttccagcagaaactattagccgaggaggagatggccaagaaaaaagagcgtcttctgagtcagttcttgaaagacaagctggctaaagaggaacacaactccgccctgaatctcaataaaatcaatacacagtggaggacagtgctgagggaggtcaagacacgggagttgcataaagacatcgagattctcagccagaccttcgagagagttgtggattgtaaggacaacgtgattaaatccctagcgaaggacttgtcagaggcagaggagcagtacgctcacgcgctgaggtcccatctgcataatgtcgaccaacttctggcccttcagaggcacaggctgagcctcctcgaggagtcttacaatatggaattggaggccctgactaaggagtttgaaacagagcggaaaacaataatcgatcagcacgaaaaggagattcattacctgcaggatatatttatggctatggaacagaactacattgactctgagtacgagagcaagcttgagtttcaaagtatgtggaacgatctcaagaacatgaatctcgaagaaaaacacttcctgcgccttcacttagagaaccgcgtggaggatttgtggagaaagttccaggacgtcctgaagaactatactgatgccaccgaggatagaaaggcagcgtttgaaacactgcaggttaaggacgagaaatccagcaaggaaatagaagtccaaatgaaaaaaatacagaagctgcaggatgccatcaccatcagcaaaggaaagattatgatccattcccgggaatcggaagacgaaaatcgttatatcaggaacgacaaagagctggtgctggtgcagctccgcaagcttaaagcccagcgcacccaagcccgcgctgcctcgcaaaagaatctagttcgcctcaccttagagtccaacgcaacactgaaggcattacgcaagatcgtagacaagggggagaagatactgaaactggccgaaatatgtcgtaaattcgagaccgaagaggagaaagtgttacccttttatagttctgtcctgacacccaaggaacaggaggggattcagaaaaataatctcgaagaacttaccgaagagcttactaaggtgatggtggattatatcggcatggagaacttttggaagcgctacaataaagttaagttagaacagttgagtttacagcaccgaagggcccagttactagacatcaacggaaaactgcgagaaatgctgaagcaatacctggatgggatcagcgtctcagatgaagtgttaagccagctcaaccccctatttattgtcaattatcagtctaacctgcttcagcccctgtccatcagaatagcacaccccggagacaagcaacacccaacaacttag

SEQ ID NO: 183419 - DNA, 3240 bp, Artificial Sequence
  Description of Artificial Sequence: Synthetic coding sequence
atggagagcaacttcaacaccgagagcagcagcaccttcaccctgcaatcaagttccgagactttgtttagtattcagctccttgactttaaaacctcattgctagaggccttggaagagttacgcatgcgtagggaagctgaaatacattacgaggagcaaatcggaaagatcatagtcgagacccaggaattgaagtggcagaaagaaaccctgcagaatcagaaagaaaccctggctgagcagcataaggaggccatggctgtgtttaagaaacaactccagatgaaaatgtgcgcgctggaagaagaaaagggaaaatatcagctggccaccgaaatcaaggagaaggaaattgagggattgaaggaaacactgaaggccttacaagtgtccaagtacagcttacagaaaaaggtgtcagagatggagcagaaggtgcagctccatttgctcgctaaagaagattaccacaagcagttatccgagattgaaaagtattatgcaactatcacagggcagtttggactggtgaaagagaatcatgagaagctggaacaaaacgtcagagaggccatccagtccaataagcgcctaagtgccttaaacaagaaacaggaggccgaaatctgctcattgaagaaggaacttaaaaaggcagcatccgacctgatcaagtctaaggtgacatgccagtataagatgggcgaagaaaacattaacctgactatcaaggagcagaaattccaagagttacaagagcggctgaatatggaattagagctgaatgaaaaaataaatgaggaaatcacccatatccaggaggagaagcaagacatcattatcagttttcagcatatgcagcagctgcttaggcaacagatccaggcaaatacagaaatggaggctgagttgaaggtgctaaaagaaaacaatcagacgcttgagagggataacgagctgcagagagagaaggtaaaagagaatgaggagaaatttctcaacctccagaacgagcatgagaaagctctgggaacttggaaacgccatgctgaggagctcaatggagaaatcaacaagataaagaatgagctgagctccttaaaggaaacccacatcaaattgcaagagcactacaacaagctgtgcaaccagaaaacattcgaagaggacaaaaaatttcaaaacgttcccgaggtgaataatgaaaattctgaaatgagcaccgagaagtctgagaacactatcattcagaaatataacactgaacaggagattcgtgaggaaaacatggagaatttctgttcagacactgaatatcgagaaaaagaggagaagaaggaaggctcattcattgaggaaataatcatcgacgatctacaactttttgagaagtcctttaagaacgaaattgacaccgtcgtgagccaagacgagaaccagagcgagattagcctaagcaagaccctttctttggataaagaagtgatatctcagggccagacgtccaacgtaactgataaccggaagtctgtgaccaccgaaattaaggataaaatctgcctcgaaaaggataacgggtgtacagagtttaaatctcctaacaaccatttcgttgtactcgacacagctattgaaacagagaaaattcacctggaacggacgcgcggcttggatgtgcaccataccgacgtgaatctggaggtggaaaacaacaaaacctccttcaatagcattctcaacgagaccgctcataacacataccataacaacaacaaagatgtgagcgaaaatgaaccatttaaacaattccggcttctgccaggtacccgcgagcacgcactcgaaaaggaaattaccaatagcgaccagaccaaggctgatcttgatagcagcttagacatcaagaagaatccagtcccctgtcagaagtacagcctccgcaactccagtaatgtgatgctcgacgacaagcaatgcaaaattaagcagatccagctcctgaccaagaagtcagagtgttccattctcctctccaagcagacaagcgactttctccaggtttgcaatgacacattagagaagagcgagttaactgtgccgtgcgacatcgtgattgatcatcacgtgtcttacgccgcattcagcgcaaattctaagttgctgctgaagaatagtgacaaaaatgtgcactccatgtccatgttagtgaagcccaatagctcacccggaggaaagacaatgtgtaagaacatgagcgacatgcagaattcccagtttaataactgcctgggatatctggagaatactaatgtgaatatttcccacttacacctgaacaatgaaaattcccacgctagccaggccaaggacgtgaaaacagctgtccacatgaagacctgtaccgagactgaattcagtaataagaagaatcaaattgacgaaaatcaggtgaccgaggctactaaaaacgacttgttcctttttgtgagtattaacgagagacaacatactttgctgaataatacagagaaaactgagtccctgaatgacatagtgtctggaaaaatgttttcagaggggcagttggaggagagccattctttccacattgaaccttccggggacttggttaatcggtctggccgctccacatttgatctgtccacttctgataagaaaaccgagaagacccccgtatacatgaatttctccgatcccggcccttggagcaaagttaaccatattgagagtcaaactgcctcatccagcactccttgtattagtcttctgttaaaagaacgtcccctcgacccttccgagaataaaaagattatttcaatggccctgtgcaaaaacattggtgtcgacgatgtcgggaaggacatcggaccagatacaacgagcatcaaccgggtggccgacacactaaacaactggtccattcatccagaccctaaaggggagccgagtgaggaaaagaatgccatggcgaagacattctacgattcaagcttccctaccgagcatgtcaagaccaagcctctaatctctacgcctttgcaatcgcacctccaggcaatcaagacaactaagaatactagcggagatgacgattggcagagcctgatcaccaatcagctgaataagtccgagaatctgctgtcactcgagaatgataatcagcccaaaaaaaggaaagcagaagaaaccctggagaagaacaatcgcctcaaatag

SEQ ID NO: 183420 - DNA, 1617 bp, Artificial Sequence
  Description of Artificial Sequence: Synthetic coding sequence
atgctgcagatcggcgaggacgtggactacctgctgatcccccgggaggtccggctggctggaggtgtgtggagggtcatttccaaacctgcaaccaaggaggccgagttccgggaacggctgacacagttcctggaagaagaaggccgcaccctcgaggatgttgcccgcatcatggagaagtcgactccccatccaccgcagccacctaaaaaaccgaaagaaccacgtgtgaggcgtcgggtgcaacagatggtgacacctccccctcgcctcgttgttggtacatacgacagttctaacgcctccgactccgagttctcggattttgagaccagcagggacaaatccaggcaaggacctaggagagggaaaaaagtaagaaagatgccagtgtcctatttgggttctaagttccttggttctgatttagagagcgaggatgacgaagaactcgtcgaagcctttctgcggcgccaggagaagcagccctctgctccgcccgcgcggaggagagtgaaccttccagtgcccatgtttgaagataacctggggccacaactgtccaaggcggacaggtggcgggagtacgtctcccaggtctcttggggtaagctaaaacggcgtgtgaaagggtgggccccgcgcgctgggccaggagtgggcgaggcaagactcgcatcaactgctgtcgagagcgccggcgtgtcaagtgcccccgagggaacaagccctggggataggctggggaacgctggcgacgtatgtgtcccgcaggcctcccctcgccgttggagacctaaaattaactgggcatcctttcgtaggcgtcggaaagagcagacggcaccaactggacagggagctgacatagaggcagaccagggcggcgaagccgccgacagccagcgggaggaggcgatcgctgaccaacgagaaggcgctgcaggcaaccagcgcgcgggcgcccccgccgaccagggagctgaggcagcagataaccagagagaggaggcagccgataatcaacgcgcgggtgccccagccgaggagggtgctgaggcagccgataatcagcgtgaagaggcggcagataatcagagagccgaggcacctgctgatcagcggagccaaggcacagataatcatagggaagaagccgctgataatcagcgcgcagaggctcctgccgatcaggggagcgaggttacagacaatcagcgcgaagaggcggtccatgatcagcgcgaaagagccccagcagtgcaaggcgccgacaaccaaagggcccaggcccgagcggggcagagagccgaggccgcgcataaccagcgagctggagcacctgggattcaggaagccgaggtgagcgcagcccaaggaacgacgggtaccgcccctggcgcgcgagcccgcaagcaggtaaagaccgtgaggttccaaacgccaggacgattttcatggttctgtaagcgccgtcgagctttctggcacacgccaaggctccctacgctccctaagagggtccctcgcgccggcgaagcccgcaatcttcgggttctgagagcggaggcccgcgcagaggccgagcagggggagcaggaggaccagctgtag

SEQ ID NO: 183421 - DNA, 975 bp, Artificial Sequence
  Description of Artificial Sequence: Synthetic coding sequence
atgctgcagatcggcgaggacgtggactacctgctgatcccccgggaagtgcgcctggccggcggagtgtggcgcgtcatcagcaagcctgcgaccaaggaggcagaattcagagagagactgacccaatttctggaggaagagggtcgcaccctcgaggatgttgcaagaataatggagaaatcgactcctcatcccccccagccacctaaaaaacccaaggaacctcgagtgcgaaggcgagttcagcaaatggtgacacccccgccgaggcttgtcgttggcacctatgatagctcgaacgcttcagatagcgagttttcagacttcgagactagcagggataaaagtcggcagggaccccgtagaggcaagaaagtgagaaagatgcctgtaagctatctaggttctaaattcctcggttccgatcttgagtccgaggacgacgaggagctcgtagaagctttcttgcgccggcagggcctccaagtcatcagagggcaaggacctcagctaaccagggggcagagactgcagattatcagagggaagcgcctacagatcatccgggggcagggtccccagctgcggagaggccagaggctccaaatcacgaggggaaagcgcctccagatcatcagaggccagcgccctcaactgactaggggccacagggcccaaatcactaccggaaagcgcctgcaaattatcaggggacggcgccctcagcttactcgggggcagcgacttcagattataaagggcaagagaccctatatgactagagggaagggaccccagttgtccagggtgcaaattatccgcgggcaccgccctggactcgctagaggccagagactgcatatcatccggggccagggccctcaggtatctcgaaagctcaagagtcaactccccaaggggccacaggaacaactgcaggagccgggccctgggaataggagtagacagtag

SEQ ID NO: 183422 - DNA, 5532 bp, Artificial Sequence
  Description of Artificial Sequence: Synthetic coding sequence
atggagaacgagatcttcacccccctgctggagcagttcatgacctcgcccctcgtcacgtgggtcaaaaccttcggacctcttgccgccgggaacgggacaaatctggatgaatacgtggccttggtcgatggagtgtttctgaaccaggtgatgttgcagattaaccccaagctggaatctcaaagggtgaacaaaaaagtgaacaacgatgcatctctgcgcatgcataatctgagcatcttagttcgccagatcaagttctactaccaggaaacactgcagcagctgatcatgatgtccctgccaaacgtcctcatcatcggtaagaacccatttagcgagcagggtaccgaggaagttaagaaactactgctccttctcttaggttgcgcggtccagtgccagaagaaagaggagtttatcgagcgtattcaaggcctggacttcgacaccaaagccgctgtggctgctcacattcaagaggtcacacacaaccaggagaatgtcttcgacctgcagtggatggaggtgactgacatgagtcaggaagacattgaaccgctcctgaagaatatggcactccatctgaaaaggctgatcgatgagagggatgagcattctgagacaatcatagagctctccgaggagcgcgacggtttgcatttccttcctcacgcttcttcatctgcccagtctccttgtggtagtccgggaatgaaacgaaccgagtcccgacagcatctgtcagtggagctcgcagacgccaaagcaaaaattcggagactgagacaggaattggaggagaaaacagagcagctcctggactgcaaacaggagctcgaacagatggagatcgagctgaagagactgcagcaggagaacatgaacctcctgtctgacgcccgatctgcccggatgtacagggacgagcttgatgctctccgcgaaaaggccgtgagggtagataagctggaatccgaagtgtcaaggtacaaggaaagacttcacgacatcgagttctacaaggccagagtggaagagctcaaggaagataaccaagtcctgctagagactaagaccatgctggaagaccagctggagggcactagggctaggtccgacaagttgcatgagttggagaaggagaatttgcagcttaaggctaagttgcatgatatggaaatggaaagggatatggaccggaagaaaatcgaggaactgatggaagagaatatgaccctggagatggcccagaaacaatctatggatgagtcattacacctcgggtgggaactcgagcagatctctcgcacctccgagctgtccgaggccccccagaaatccctcgggcacgaagtcaacgagttgacctcttcccgcctcctgaaacttgagatggaaaatcagtccctgaccaagactgtagaagagcttcggacaaccgtggattcggtcgaagggaatgccagtaaaatcttgaagatggaaaaggaaaatcagcggctatctaagaaggtggagatcctggaaaacgagatcgtacaggaaaagcagtctcttcagaattgccagaatctgagcaaagatctgatgaaagagaaggcccaactggagaaaaccatcgaaaccctgagagaaaactctgaacggcagataaagattctggaacaggagaacgagcatcttaaccaaactgtatcaagcctccgacaaaggtctcagattagcgctgaagcccgggtcaaggatatagaaaaagaaaacaaaatcctgcatgagtctatcaaggaaacgtcctctaagctcagcaaaattgaatttgaaaaaaggcagatcaaaaaagaattagagcactacaaggagaagggcgaaagggccgaggaactcgaaaatgaactgcaccaccttgaaaaggagaatgagctgcttcaaaagaaaatcacgaaccttaagattacatgtgaaaaaatcgaagctttggagcaagagaattcagaacttgaacgcgaaaaccgcaaattgaagaagacactggactcttttaaaaatctgacctttcagctcgagtcgctcgaaaaggaaaatagccagttagatgaggagaaccttgagctgagacggaacgttgaatcactgaaatgtgcttcaatgaagatggctcagctccagctcgagaataaagagctggaaagcgaaaaggaacagctgaaaaagggcctcgaactcctgaaggcttcatttaaaaaaactgaacggctggaggtgtcataccagggcctggacattgaaaatcagcggctccagaaaacgctggaaaacagtaacaagaagattcaacaacttgagtcagaactccaggatcttgagatggagaaccagacactgcagaagaacctcgaggaactaaaaatcagtagcaagcgactggaacagctggagaaggagaataaatcccttgagcaagagacttctcagcttgagaaagacaagaagcagctggagaaagagaataaacgcctcagacagcaggctgaaattaaagatacaaccctggaagaaaacaacgtcaaaatcgggaatctggagaaggagaacaagacactgtctaaagagatcggaatctacaaggagtcctgtgtacggcttaaggagcttgagaaggagaacaaggagctcgtgaaacgtgctaccattgacatcaaaaccctcgtcacactgcgcgaagaccttgtcagtgagaaactgaagacccagcagatgaataacgacttggagaaattgactcacgagctggagaagatagggcttaataaggagaggcttctgcatgatgagcagtctactgatgacagtagatataagctgctagagtccaagctggagagcaccctgaaaaaatccctcgagataaaggaggagaagattgcagctctggaggcccgcttagaggagtccactaactacaaccagcaacttcgtcaggaactgaagacagttaaaaagaattatgaggccctgaagcaaagacaggatgaggagcggatggtgcaatccagcccgcccatcagcggtgaggataacaagtgggaaagggagagtcaggaaaccacaagagagcttctgaaggtgaaagaccggctgatcgaggtggaaagaaacaatgccactctgcaggctgagaagcaagctcttaagacacagcttaaacaactagaaacgcaaaataataacctgcaggcccagattctggccttacagcgccagacggtctctttgcaagaacagaatactaccttgcagacccaaaacgctaagctgcaggtcgaaaattccaccctgaacagtcaaagcacctccctcatgaaccagaacgctcagcttctaatccagcagagctcactggaaaatgaaaatgaaagtgtgatcaaagaaagggaagacttgaaatccttatatgacagtttgatcaaggatcatgaaaaattagagttattacatgagaggcaggcctcagagtatgagagcctgatctcaaaacacgggactttaaaatcagcccacaagaatctggaggttgagcaccgcgacctcgaggacaggtataatcagctacttaaacagaagggtcagctggaggaccttgaaaaaatgctgaaggttgagcaggaaaaaatgttgttggaaaataagaatcacgagaccgttgccgcggagtataaaaaactatgcggagagaatgatcgccttaatcacacatactctcagctactgaaggagaccgaagtgttgcagaccgatcataaaaacctgaagtcacttctgaataactcgaaacttgaacaaacgaggcttgaagcagagttcagtaaactgaaagaacagtaccagcagctggacattaccagcaccaagctgaacaatcagtgtgagctgctcagtcagctcaagggtaatcttgaagaagaaaacagacacctcttggatcagattcaaaccctgatgctccagaatcggaccttactggagcaaaacatggaatctaaagacctctttcatgtggagcagcgccagtatattgataaattgaacgagttgagaaggcagaaagagaaactcgaggagaagatcatggaccagtataagttctacgatccctcgccaccacgacgtcgtggcaattggattacattaaagatgcgtaaattgattaagagcaaaaaggacatcaacagagagagacagaagtcactgacgcttactcccacacggtccgattctagtgagggctttctccagctgccacatcaggacagccaggactctagttcagtggggtcgaattccctggaagacgggcagacgctcggtaccaagaagagttccacgatgaacgatctagtccaatctatggtcttggcagggcagtggactggctctacagagaatctggaagttcctgatgacatttccactggcaaaaggcggaaagagctgggagcaatggcctttagcacaactgcaattaacttcagtacagtcaactctagcgctggattccgttccaagcagctcgtcaataacaaagacaccacatcatttgaggacatttccccacagggagtgtctgacgatagttcaactgggtctcgcgtccatgcctctcgtcctgcctccctagattccggccgtacgagcacctctaatagcaacaacaatgcatccctgcatgaggtaaaggcgggcgccgtgaataatcaatctaggcctcagtcccacagctcaggcgagttttccctgttgcacgatcatgaggcctggtcgtcaagcgggtcctctcccatccaatacttaaagcggcagaccaggagctctcctgtgctccaacataagatttcggaaaccctagaaagccgccaccacaagataaagacaggttcccccggatccgaggttgtcaccttgcagcagtttcttgaggagtccaacaagctgaccagtgtgcagataaagagcagctctcaggaaaacttgctggacgaagtaatgaaatccctgtctgtgtcctccgacttcctaggaaaggataagcccgtgtcgtgcgggctcgccaggagcgtgtctggaaaaactcccggagacttctatgacagacgcacaacgaaaccagagtttttgagaccagggccacggaaaaccgaggacacctactttatttccagtgccgggaagcctactcctggtacccaggggaagatcaaactggttaaagaatctagtctctcccgccaatctaaggatagtaatccatacgcaacgctcccaagagcatcaagtgtcataagcaccgcagaagggacgaccagacgtacctctattcatgactttttaactaaggacagccggcttcccatctctgtggactctccccctgccgccgctgattcaaatacgactgccgctagcaacgtggacaaagtccaggagtccaggaacagcaagtcaaggagccgggagcaacagtcctcatag

SEQ ID NO: 183423 - DNA, 5613 bp, Artificial Sequence
  Description of Artificial Sequence: Synthetic coding sequence
atggagaacgagatcttcacccccctgctggagcagttcatgaccagtcctctcgtaacgtgggtgaagaccttcggcccgcttgctgccggaaacggaactaacctggatgaatacgtggcccttgttgacggcgtcttcctgaaccaggtgatgctccagatcaaccccaagcttgagtcccagcgagtgaataagaaagtgaacaacgatgcatcgttgcgcatgcataacttgagcatcctcgtgagacagattaaattctactaccaagagacgctgcagcagctcatcatgatgagccttcccaacgtgctgatcatcggcaaaaacccctttagtgaacaaggaaccgaggaggtaaagaagctgctgctcctgctgttgggatgcgctgtgcagtgtcagaaaaaagaggagttcatcgagagaattcagggtctggattttgacacaaaagcagccgtggcagcccacatccaggaggttacccacaaccaggaaaacgtcttcgacctgcagtggatggaagtcacagacatgtcacaggaggatattgagccgttactcaaaaatatggcactgcacctcaagagacttattgacgagcgagatgagcattccgagacaatcatcgagctatctgaagagcgagacggactgcactttctgcctcatgcgtcctccagtgcccagagcccatgcgggtctccgggcatgaaacgcaccgaaagccgccaacatctgtctgtcgagcttgcggatgcgaaggccaaaatcagacgactgcgccaggaactcgaagagaagaccgagcaacttcttgattgcaagcaggaactggagcagatggaaatagagctgaagcgccttcaacaagagaacatgaacttgctatcagatgctcggtccgcccgcatgtacagggatgaactggatgctctgagagagaaagcagtgcgggtggacaagctggagtcagaggtgtctagatacaaagaacggcttcatgatatcgagttttacaaagctcgggtcgaggaactgaaggaagacaatcaggtgctgcttgagaccaagacgatgctcgaggaccagctggaaggcaccagagcccgttctgacaaacttcacgaactggaaaaggaaaatcttcagcttaaagccaagctgcatgacatggaaatggagcgcgacatggacagaaagaaaattgaggaactcatggaggagaacatgactctcgagatggcccagaagcagagcatggatgagagcctccatctgggatgggagctggagcaaatctcccggactagtgagttatctgaggcaccgcagaaatccctggggcacgaggttaacgagctgacgagctctcgactgctcaaactggaaatggagaatcagagcctgactaagacagttgaagagctcagaacgactgttgatagtgttgaagggaatgcatccaagattttaaaaatggagaaggagaaccaacggttgtcgaagaaggttgagatcctggagaatgagattgtccaggagaagcagagcctccaaaactgccagaatctatcaaaggacctgatgaaggagaaggcacagttggaaaaaacaattgagactctgcgggagaacagcgagcggcaaattaaaatcctggaacaggaaaacgagcatctgaatcagactgtttcgagtttgcgccaaaggagtcagatctcggcggaggcacgagtcaaagatatcgagaaagagaacaagatcctgcacgaaagtatcaaagaaacatcctcaaagctttctaagattgagttcgagaagcgacagatcaagaaagaattagaacactataaagagaaaggggagcgtgccgaagaattggaaaacgagttgcaccatctggaaaaggaaaatgagctcctgcagaaaaagattaccaatcttaagattacctgcgagaagattgaagcccttgagcaggaaaattccgagctggaaagggaaaaccggaaacttaagaagaccttggactctttcaagaacctcacatttcagctggagagcttggagaaagagaactcacagctggatgaggaaaatctggagcttagacgaaatgtggagtccctgaaatgcgcctcaatgaaaatggctcagctccaactcgagaataaggagctggagagtgaaaaagagcagctcaagaagggcctggaactgctgaaagcttcgttcaaaaagacagaaagactagaggtgagctaccagggcttggatatcgaaaaccagaggctgcagaaaacactcgaaaatagtaacaagaaaatccaacagctggaaagcgaactgcaggacctagaaatggagaaccagacactccaaaaaaatctggaggaactaaaaattagtagcaaacggctggagcaactcgaaaaagaaaataagtccctggagcaggaaacatctcaactagaaaaggataaaaagcagctggagaaggaaaataagcgcttacggcagcaggctgaaataaaggatacgaccttggaggagaataacgtgaaaataggcaacttagaaaaggagaataaaacgctctccaaggaaattgggatctataaggaatcatgcgtccggcttaaagagctcgaaaaggagaataaggagctcgtgaaacgcgccactatcgacatcaagaccttggtgaccctccgcgaggatctggtgtctgagaaactgaaaacccagcagatgaataatgacctggagaagctgacacatgaactggagaaaattggtctcaacaaagagcgcctgctccatgacgaacagtctacagacgacaggtacaaactcctggagtccaagttggaaagtactctcaaaaagtcattggagattaaggaggaaaagattgcggcactggaagctcgactggaggaaagcactaattacaatcagcagctgcgccaagagcttaaaactgtgaaaaaaaactatgaagctctgaagcagaggcaagacgaagaaagaatggtgcagagttctccccccatttctggcgaagacaacaagtgggaaagagagtcccaggagacaacccgtgaattgctgaaggtgaaagacagactcatcgaagttgaacgcaataatgcaaccctccaggcggaaaaacaggcattaaagactcagctgaaacagctcgaaacccaaaataacaatttgcaggcccagatcctggccttgcagcggcagacagtttctctgcaggagcaaaatacaaccttgcaaacccagaacgccaagctgcaggtggaaaacagcaccctcaacagccagtcaacaagtttgatgaaccagaatgcccaactgcttattcaacagtcaagcctagaaaacgaaaatgagagcgtgataaaagaacgagaggacctgaagtcattgtacgactcactcataaaagatcatgagaagctagagctcctgcatgagagacaggcctccgaatacgagtccttgatctctaagcatggcaccttgaaaagtgcacacaagaatcttgaagtggagcatagagacctcgaagatagatataaccaattgttaaagcagaagggccaactggaggacctcgaaaaaatgctgaaggtggaacaagagaagatgctcctggaaaacaaaaaccacgagacagtggcagccgagtacaagaaactctgcggggagaacgataggttgaatcatacttattctcagctgctcaaggagacggaggtgttgcaaaccgatcataagaacttgaagagccttctgaacaattctaaactagaacagacacgactggaagccgaattttcaaagctcaaggagcagtatcagcagctcgatattacctctaccaaattaaacaaccagtgcgagctactgtctcagctgaaagggaaccttgaagaagagaataggcacctgttggatcagattcagaccttgatgttacagaatcgcaccctgctggagcaaaatatggagagcaaagacctcttccacgtagagcaacggcagtatattgataagttaaacgaacttcgccggcaaaaggagaaattggaggagaagatcatggatcaatataagttttatgacccttcaccgccacgtcgacgcggtaactggattactctgaagatgcggaaacttattaagtcaaaaaaagatattaaccgggagcgccagaagagcctgaccctcacccccactaggtcagacagttccgagggctttctccagctgccccaccaggattcccaggactcgagtagtgttggctcaaattcactggaggatggtcagaccctgggaactaaaaaaagcagtatggttgctctgaaacgcctgccctttcttcgtaaccggcctaaggacaaggataaaatgaaagcatgttacagacgtagtatgtcgatgaatgatctggtgcaaagcatggtccttgcgggccaatggaccgggagtaccgagaacctggaggtgcctgacgacattagcaccggcaagaggcgtaaagagctcggggccatggcctttagcacgactgccatcaacttttccacagttaactcttccgccggcttcaggtccaaacagctcgtgaacaacaaggacacgaccagttttgaagacatctctccacaaggcgttagtgatgattcctccaccggatctcgagttcacgcctcccgccctgcctcactggactctgggcggacaagcacctccaacagtaacaataacgcttccctccacgaggttaaggcaggcgcggtgaataaccaaagtagaccccagtcgcacagcagcggtgagttcagtttgctccatgatcatgaggcttggtcatcctccggatcttccccaattcagtacttgaagcggcagaccagatctagccccgtcctccagcataaaatctctgaaacactcgaatcccggcaccacaagataaaaaccgggagtccaggatccgaggtggtaacgctgcagcagttcctcgaggagtcaaataagttgacttctgtgcagataaaatcttcttcccaggaaaatctgctggatgaagtcatgaaaagcctctctgtgtccagcgatttcctcggtaaggacaagccggtttcttgcggcctggcacgctccgtgagtggcaaaacacctggagatttctacgatcggaggaccaccaaaccagagtttcttagacccgggcctagaaagaccgaggacacttattttatcagcagcgccggaaaacctacccccggaacacaggggaaaatcaagctagtgaaggaatccagccttagcaggcaaagcaaggactcgaacccttacgcgaccttgccacgcgccagcagtgtcattagcactgccgaggggactactcggcgaacatcaattcatgattttttgacaaaagatagccggttgcccatatcagttgactccccgccagccgctgcagattccaacactaccgctgccagcaatgtagacaaagtgcaagagagcaggaacagcaagagcagaagccgggagcaacagtcttcttag

SEQ ID NO: 183424 - DNA, 2667 bp, Artificial Sequence
  Description of Artificial Sequence: Synthetic coding sequence
ctgctggagagcaagctggagagcaccctgaagaagagcctggagataaaggaggagaaaatcgccgccctggaagcccggctggaggagtcaacaaattacaaccagcaacttcgtcaggaactgaagacggtgaaaaaaaactacgaggccctcaagcagcggcaagacgaagaacgtatggtacaaagctctcctccaatctcaggggaggacaacaagtgggaaagggagtcgcaagagaccacccgagagctgctcaaagtgaaggaccgactcatcgaggtggaaaggaataacgctacactccaggcagagaagcaggccttgaagacacagctgaagcaattggaaactcagaacaacaacttgcaggcacaaattcttgcactgcagcgacagacagtatcactccaggaacagaataccaccctgcagacacagaatgcgaagctccaagtggaaaattctacgctaaattcgcagtctacttctctgatgaaccagaatgcccagctgttgattcagcagagctcgttggagaacgaaaacgagtccgttataaaggaaagggaagacttaaaatccttgtacgattcgctgattaaggaccatgagaagttagagctactacacgagagacaagcctccgaatacgagtctctgatttccaagcacgggaccctgaaatctgctcacaagaatctggaagttgaacatcgagacttagaagatcggtacaatcagctcctaaaacagaagggacaactcgaagatctggagaaaatgctgaaagtggagcaggaaaagatgttgctggagaataaaaatcatgagaccgttgccgccgaatataaaaagttgtgcggtgagaacgaccgtcttaatcatacgtacagccagttactgaaagaaactgaggtgctccagacagatcacaagaacctgaaatcattactcaataattccaaactcgagcagacccggctggaggccgaattctcaaagctaaaagaacaatatcagcagctggatatcaccagcacgaaactgaataaccagtgcgagctgctgtcccagttaaaaggaaaccttgaggaagagaaccggcacctgctggaccagattcagaccctcatgctgcagaatcggacacttctcgaacaaaatatggaatccaaggacctgttccatgtggaacagcgccaatatatcgataaactcaacgagctgcgcaggcagaaagagaagctggaagaaaaaatcatggaccaatataagttttacgacccttccccaccaaggaggcgcgggaattggattaccctgaagatgagaaagttgatcaagagcaagaaggacatcaatcgagagcgacaaaaatctttaaccctcactccaacgcgctccgactccagcgagggcttcctgcagttaccgcaccaggacagccaggattcctcctcagtggggagcaacagtctggaggatggtcagactctgggaacgaagaagagcagcaccatgaatgaccttgtgcaaagcatggtgctggccggccaatggacgggctctacagaaaacttagaggtacctgacgatatcagcacagggaaaaggcgaaaagaactgggggcaatggctttctccactaccgccatcaacttctcaacagtcaattcatctgccgggttccgaagtaagcaactggttaacaataaggataccactagcttcgaagatatatcccctcaaggcgtcagtgacgattcctccactggcagtcgcgttcatgcatcacgccctgccagtttggattcagggaggacaagtacaagcaatagtaataataacgcctctctgcacgaggtgaaagcaggcgctgtaaataaccaaagtcggccgcagtcacactcttccggtgaattctcattgcttcatgaccacgaagcatggtctagttctggctcatctccaatccaatatctaaagagacagacaagaagttccccggttctgcagcacaaaattagtgagacgctagaatcacgccaccataagattaaaaccggctctccaggtagtgaggtggtgacactgcagcagttcttagaggaatcaaacaaactcacatcagtgcagataaagtcttccagtcaggagaatctgctcgatgaggtcatgaagtcattgtctgtgtcctctgactttctgggaaaggataagccagtatcatgcggcctggcgcgctcggtcagtggcaagacccctggcgatttctacgatcgacggaccacaaaaccagaattcttaaggcctggccctagaaaaaccgaggacacatatttcatctccagcgccggtaaacctacccccggtacacaaggaaagatcaagcttgtcaaggaatcaagcctcagtcgccaatctaaggactcgaatccttatgcaaccttgcctagggcgtcatccgttatctcaactgctgaggggacgactaggcgcacatccatccacgattttttaacgaaagactcaaggctcccgatctcagttgatagcccacccgcagcggcagacagtaataccacggccgccagtaacgtagataaggtgcaggagagccggaactcaaagagcagaagcagagaacagcagtcctcttag

SEQ ID NO: 183425 - DNA, 5391 bp, Artificial Sequence
  Description of Artificial Sequence: Synthetic coding sequence
atggagaacgagatcttcacccccctgctggagcagttcatgaccagtccgctagtcacctgggtcaagaccttcgggcccctagctgctggcaacggtaccaacctcgatgagtatgtggcccttgtagacggcgtattcttaaatcaggtcatgctgcagatcaacccgaagttggagtcccaacgcgtcaacaagaaggtcaacaatgatgctagtctaagaatgcacaaccttagcatcctcgtccgccaaataaagttctattaccaggagaccctgcagcagctcatcatgatgagcctgcctaacgtcctcataataggcaagaaccctttctctgaacagggcacagaagaggtgaagaagttgttattgcttttgctgggttgtgctgtacaatgtcaaaaaaaagaggaatttattgagcgcattcagggcttagatttcgacactaaagctgcggtcgccgcccacattcaggaggtaacgcacaaccaggagaatgtttttgatctgcagtggatggaggtgacagatatgagccaagaagacattgaacccctcctcaaaaacatggctctgcacctgaagcgcttgattgacgaacgcgatgaacatagcgaaaccattattgaactctccgaagaaagggatggacttcactttctgccccacgcctctagcagtgcacagagcccatgcggaagccccgggatgaaaagaacggaaagcagacagcacctgtccgttgagctggccgacgccaaggccaagattaggcgcctccgtcaggagttggaagagaaaacggagcagcttctggactgcaagcaggaactggagcaaatggaaatcgagctgaagagactacaacaagaaaatatgaatctcttgtctgacgccaggtcggcgagaatgtaccgcgacgagctggacgcactgagggagaaagctgtgcgggtcgataagctcgagtcggaggtgagtcgatataaggagcggctccacgacatcgagttttacaaggccagagtcgaagagctgaaagaggacaatcaagttcttctcgagactaagacaatgctcgaagaccagctggaggggacaagagccaggtccgacaaattacatgagcttgagaaagagaatctgcagctgaaggccaagttacacgatatggagatggaacgtgacatggaccgtaaaaaaatagaggaactcatggaggagaatatgacattggagatggcacaaaagcagagcatggacgaatctcttcacctgggttgggagctggagcagatatccaggacttcagaactgtcggaagctccacagaagtctctgggccacgaagtcaatgaactgaccagctcccgcctcctaaaactagaaatggagaatcagtccttgaccaagaccgtggaagagctcagaacaaccgttgactcagtagagggaaatgcttctaagatccttaaaatggagaaagaaaatcagcgactgagcaagaaggtggagatattggagaatgagatcgtgcaggagaaacagagtctccagaattgccagaatttgtcgaaagacctgatgaaagaaaaggctcaacttgaaaaaacaattgaaacccttcgagaaaactctgaacggcagattaagattctcgaacaggaaaacgagcacctgaaccaaaccgtgtcatctctgagacagcgctcccagatcagcgcagaagcacgcgtaaaagatattgagaaagaaaacaagatactgcatgaatcaattaaagagacttcttccaagcttagcaagatcgaatttgaaaaacgacagatcaaaaaagaattagagcactataaagaaaaaggtgaacgagccgaagaacttgagaacgagctgcatcacctagaaaaagaaaatgaactgctgcagaaaaagatcaccaatcttaagataacttgcgaaaagatcgaggcccttgagcaggaaaactccgagttggagcgggagaacagaaagctcaagaaaaccctcgattccttcaaaaacctcactttccagttggaatccttggagaaagaaaatagccaactggacgaggagaatctcgaactcagaaggaatgttgagtccctgaagtgtgccagcatgaagatggcccagcttcaactggaaaacaaggaactcgaatccgaaaaggagcagttaaaaaaaggtctcgagctcttgaaggcgtcctttaaaaaaactgagaggcttgaagtgtcataccagggacttgatatagaaaatcaaagactgcagaagacgctggaaaactccaataaaaaaattcagcagctggaaagcgagctacaggatctggagatggaaaaccagacacttcagaaaaatctcgaggaacttaaaatttcctctaaacgtttggaacagcttgagaaggagaacaaatctttggagcaggaaacgagccagctagagaaggataagaaacaattggagaaggaaaataaacgtttacgccagcaagcggaaatcaaagacactactctcgaggaaaacaatgtgaagattggcaatctggagaaagaaaacaagacattgtcaaaagaaatcggaatatacaaggagagttgcgtacggctgaaagagttggaaaaggaaaataaggagttagtgaagcgagcaacgatcgacattaaaaccctggtgactttaagggaggatctggtctccgagaagttgaagacccaacaaatgaacaatgacctcgagaagctcacacacgaactcgagaagatcgggcttaacaaggagagactcctccatgatgaacaatctacagatgataggtacaagctgctcgaaagcaaactcgagagtaccctgaaaaagagtttggagataaaggaggaaaagatcgctgccttggaagctaggctcgaagaatcgaccaactacaatcaacagctccgacaggagctcaaaacagtcaagaaaaactacgaagcgctgaaacagcgccaagacgaagaacgcatggtacaatcgagccctcctattagtggcgaagacaataagtgggagcgtgagagccaggaaactacgcgagaactcctgaaggtcaaggatcgcctgatcgaagtcgagaggaataacgctacgttgcaagccgagaaacaggctttgaagactcagcttaagcagcttgagacgcagaataacaacctgcaggctcagatcctcgctctgcagcggcagacagtatccttacaggaacagaacaccacattgcaaacccagaatgcaaagctgcaggtcgagaactccaccctgaacagtcagagcacatccctcatgaaccagaatgcacagctgttgattcaacaatcctcattagaaaacgagaatgagagcgtgatcaaagagagggaggaccttaaatcactgtacgacagccttattaaagatcatgagaagctggaactccttcacgaacggcaagcctcggagtatgagagtctgatttctaagcatggcacgcttaagagcgcccacaaaaatctggaggtcgagcacagagatctcgaagataggtataaccagcttctgaaacagaaggggcagttggaagacctggaaaagatgttgaaggtagagcaagaaaagatgctcctagagaacaagaatcatgagacggtcgccgccgagtacaagaagctgtgtggcgagaatgatagattaaatcatacatattcacaactgttaaaggagactgaagtgctgcagaccgatcacaagaatctgaaatctctgttgaacaatagcaaactggagcagacacgcctggaagcagagttttctaagctcaaagagcagtaccaacaactggacatcacgtctaccaaactcaataaccagtgcgagttgctgtcccagcttaagggaaacctggaggaagagaatcggcacctgcttgaccagatacagactctgatgctgcaaaataggaccctactggaacaaaacatggaatctaaagacctcttccacgtggagcaacggcaatatatcgacaaactgaacgaattacgaaggcagaaggagaaattggaagagaagatcatggatcaatataagttttacgatcctagccccccccggcggcgcggaaattggattactctgaaaatgagaaagctcattaaatcaaagaaggacataaacagggagcggcagaagtccctgactctgaccccaacaagaagcgactcaagcgaaggattcctccagttgccccaccaggattcccaggactcatccagtgtggggtctaattccctagaagatggccaaacactgggaacaaagaaaagttccatggttgctctgaaaaggctgccattcctgcggaaccgtccgaaagataaggataagatgaaggcatgttatcgccgcagcatgagcatgaatgatctcgtgcaatctatggtgctcgccggtcaatggaccggctctacagagaacttagaggtgcctgatgatatctccaccggtaaaaggagaaaagagctcggcgccatggctttttccacaaccgcgatcaacttttccactgtcaatagttcagcaggattccgatcaaaacagctcgttaataacaaagacactacttccttcgaggatatatccccacagggggtctcagatgacagctctactggcagtcgggttcatgcatcacgtcccgcttcgcttgattcaggccggacctctacatctaacagcaataacaatgcctctctgcacgaggtgaaggctggtgcagtcaacaaccagagccggccccagagccattctagtggcgaattctccctcctccacgatcacgaggcatggtcaagtagcggatctagcccgatccagtatctgaagaggcaaactcgatcgtcccccgtcctgcagcataagataagcgagacattggagagccggcatcataagatcaagactggcagtcctggtagcgaggtggtgacattgcagcagttcttagaagagagtaacaagctgacctccgtgcagattaagagcagtagtcaggagaatctccttgacgaagtcatgaagtccttgagcgtcagctctgactttctcgggaaagacaagccagtaagctgcgggttagcatctgtcatttctaccgctgaaggcacaaccaggcggacctcaatacatgacttcctcacaaaggactcacgcctgcctatcagtgtagacagtccccccgcagccgctgattcaaatacaaccgcagcctctaatgtggataaggtgcaggagtccaggaatagtaagagccggagccgtgagcagcaaagctcatag

SEQ ID NO: 183426 - DNA, 1119 bp, Artificial Sequence
  Description of Artificial Sequence: Synthetic coding sequence
atggaccagtacaagttctacgaccccagccccccccggcggcggggaaactggatcacattgaagatgaggaagctcatcaagtcaaaaaaggacattaatagggagcggcaaaaaagccttactttaaccccgacacggtccgattcttctgaagggttcctccagctccctcatcaggattcccaggacagttcctctgtgggcagtaacagcctcgaggacgggcagacactcggcacgaagaagtcctcaaataccacctcatttgaggatatcagcccgcagggggtgagcgacgattcttccaccgggagtcgtgtgcatgctggcgccgtcaacaatcagagccgccctcagagtcactcttcgggcgagttttccctgctccacgaccacgaagcctggtcctcctctggcagttctccaatacagtacttaaagcgccagacccggtcgagcccagtgctccaacacaaaatttcggaaacgctcgagtcccgacatcacaaaattaagactgggtccccgggcagcgaggtcgtgactttgcaacagtttctcgaggagtccaataagctcacttccgtgcaaatcaagtcttcttctcaggagaacttacttgacgaggttatgaagtctctctctgtgagttccgatttcctcggaaaagataagccggtatcctgcgggcttgccagatcagtgagtggaaaaacacctggcgacttttacgatcgccgtacaaccaaacccgagtttttacgccctggcccgcgaaagacagaagacacatacttcatatcctctgccggtaagccaaccccagggacacagggcaagatcaagctggtgaaggaatcttccttgtcacggcaatccaaggatagtaacccctacgcaacactgccaagagcttctagtgtgatcagcaccgctgagggaacaacacgccgcacctcgatccatgacttccttactaaagattctagactcccgatcagtgtggacagcccgcccgccgcagcagattctaataccaccgccgcctccaatgtagacaaggtgcaggagagcaggaactccaaaagccggtcccgtgagcagcaatcatcctag

SEQ ID NO: 183427 - DNA, 5616 bp, Artificial Sequence
  Description of Artificial Sequence: Synthetic coding sequence
atggagaacgagatcttcacccccctgctggagcagttcatgacctcccctctagtgacttgggttaagacgtttggaccactggctgccggaaatggcactaatctggacgagtatgttgcactggtggacggcgtttttcttaatcaggtgatgttgcaaatcaaccccaaacttgagagccagcgagttaataagaaggtcaacaatgacgcttccttgagaatgcataacctgtccatcctggttagacagatcaagttctactatcaagagaccttgcagcagctgattatgatgagcctgcccaatgtgctgatcatcgggaagaatccttttagcgagcagggcactgaagaggttaaaaagttgcttctgctcctcctgggctgtgccgttcagtgccagaaaaaagaagaattcatcgaacggatccagggattggatttcgacactaaagccgctgtggcagcacacattcaggaagtcacacacaaccaggagaatgtgtttgacctgcagtggatggaagttactgatatgtctcaggaagatattgaaccgctcctcaagaacatggccttgcacctgaaacggctaatagatgaacgggatgagcattccgagacaatcatcgagttgtccgaggaacgggacgggttacatttcctgccccacgcaagctccagcgctcagtcaccatgcggctcacccgggatgaagcgaacagagtctaggcagcacctttccgttgaactcgctgacgccaaggcaaagatcaggagactgcggcaagagttggaagaaaagacagagcagctgttagattgcaaacaggagttggaacagatggagatcgaattaaaaaggctccagcaagagaatatgaatctgctttccgatgcgaggtccgctaggatgtaccgggacgaactggatgccctgagggaaaaggcagtgagagtagacaaacttgaatccgaggttagcagatacaaagagcgcctgcacgatatcgaattttataaagctagagtcgaggaattgaaggaggataatcaggtgctgctcgagactaaaacgatgctggaggatcagctggagggtacccgtgctcgcagcgataagttgcacgaactggagaaagagaatctgcaattaaaagccaagctgcatgatatggagatggaacgagacatggatagaaagaagattgaagagctaatggaagaaaacatgacactggaaatggctcaaaaacagtctatggacgaaagcctacacttgggctgggagcttgaacagatctcgcgcacaagtgagctctcagaggcccctcagaaaagtcttggccacgaagttaacgaactgacttcttcaaggctgctgaaactggaaatggagaatcaaagcctcacaaaaacagtcgaggagctcagaaccaccgttgattccgttgaaggtaatgcttctaaaatactcaaaatggaaaaagaaaaccagaggctgtcaaagaaggtggagattctcgaaaatgagattgtacaggagaagcaatcactccagaactgccagaaccttagcaaggacctgatgaaagagaaggcgcagctcgagaaaaccatcgaaaccctccgcgaaaacagtgaacgtcagataaagatcttggagcaagaaaacgagcacctgaatcagactgtttcatccttgagacagaggtcacagatttccgcggaggctagggtgaaagatatcgaaaaagaaaataaaattctgcacgagtccattaaggagacttcatctaaactgtctaagatcgagttcgagaagagacagataaaaaaggagttagaacattataaggagaaaggcgagcgagctgaggaactagagaacgagctgcatcacctggaaaaagaaaacgagctgttacagaaaaaaataactaacctgaagatcacatgtgaaaagatagaggctctggagcaggagaactccgagctcgagagggaaaatcgtaagctcaagaaaactctggatagcttcaagaacctgacctttcagctggaaagtctcgagaaagagaacagtcagctggatgaagaaaatcttgagttgcggcgcaatgtcgaaagcctgaagtgcgccagcatgaagatggcccagctgcaactcgaaaacaaagagctagaatcggaaaaggaacagttaaagaagggtctggaactgctcaaggctagcttcaagaagacggaacggttggaggtgtcgtaccagggcttggacatcgaaaatcagaggctccagaagaccctagaaaatagcaataaaaaaattcagcaactggaatccgagctccaggacctggagatggaaaaccaaacccttcagaagaatctggaagaacttaagatcagctcgaagagactggaacagctggagaaggagaacaagagccttgagcaagagacttctcagctcgagaaagataagaagcagctggagaaagagaataagaggctgaggcagcaggcagaaattaaagatacaactctggaagagaataatgttaaaattggaaatcttgaaaaagaaaataaaaccctctctaaggagattggtatatacaaagagtcatgcgttcgactcaaagaactggagaaggagaataaggagctggtgaaaagagccactattgacatcaaaacgttggttacacttcgagaggatctggtgtccgaaaaacttaagacccagcagatgaacaatgatctcgagaagttaacacacgaacttgagaagataggcctaaataaagaacgcctcctgcacgacgaacagtcaaccgacgactccaggtataagttgctggaatcaaagttggaaagtaccctgaagaagtccttggaaattaaagaggagaaaatagcagccttggaggcccgcctcgaagaaagtaccaattacaaccagcagctgcgtcaagagctaaagactgtgaaaaagaactatgaagccttgaaacaaagacaagacgaggaacgaatggtccagtcctcgcctcctattagtggtgaggataataagtgggagcgggagtcacaagaaaccactagggagttacttaaagttaaggaccgcctgattgaagtggagaggaataacgctacactgcaggctgaaaaacaggcactcaaaacacagcttaaacagttggagacgcagaataacaatctacaggctcagatccttgcactccaacggcagacagtgtccttacaggagcagaataccacactgcagacccagaatgctaaactgcaggtggaaaacagcaccctgaactcccaaagcacctccctgatgaatcaaaatgcccagctgctgattcaacaatccagtcttgagaacgaaaacgagagtgtcataaaggagcgcgaggaccttaagtcactttatgattcattgatcaaggatcacgaaaaattggagctgctccacgaacgccaggcctctgagtatgaaagcctaataagcaagcacggcacacttaaatcggcccacaaaaatctggaggtagaacaccgggacctagaagatcggtataatcagctgttaaaacagaaagggcagctggaggaccttgaaaaaatgttaaaggtggaacaggaaaagatgctcttggaaaacaagaatcacgaaacggttgccgctgaatataagaagctctgcggtgagaacgacaggctcaaccacacctattctcagctgcttaaggagacggaggtactgcaaacggatcataagaaccttaaatccctgctgaataattccaagctggaacagacccggttagaggcggagtttagtaagctgaaggaacagtatcagcagttggatataacatcaactaagctgaataaccagtgtgaacttctatcccagcttaagggaaacctcgaagaagagaaccggcatttgcttgaccagattcagaccctgatgcttcagaatcggacactactagagcagaatatggagtcaaaagacttatttcatgtggaacagcgacaatacatagataaactgaacgaactgaggaggcagaaagaaaagttggaagagaaaatcatggaccaatacaaattctatgatcctagcccccccagaaggagaggtaactggataactctgaaaatgcgcaaactcattaagagcaagaaggatatcaatcgcgagcgacagaaatccctgacccttacacccactagatcagattcatctgaggggtttttacagctgccgcatcaagacagccaggactcatccagcgtgggatcaaattctcttgaagatggccagaccctgggaacaaagaaatcttccatggtggcactgaagagactgcccttcctgagaaatagaccaaaggacaaggataagatgaaggcctgctatagaagatctatgagtatgaacgacctcgtccaatccatggtgttagctggacagtggaccgggagtacggagaatctggaagtgccagacgatattagcactgggaaacgtcgcaaggagctgggcgcaatggccttttctaccacagcgatcaatttcagtacagtgaatagttccgcaggatttaggagtaagcagctcgtgaacaacaaagacactacttctttcgaggatatttccccccaaggggtgtctgacgacagcagcacgggatctagagtccacgcctctcggcccgctagtctcgatagtggtaggacatccacttctaattccaacaataatgcatccttgcacgaggtcaaagctggcgccgttaacaaccagagccgtccacagtcccactcatcgggagagttcagcctgttacacgatcacgaagcctggagttcatccggcagttccccgatacagtacctgaaaagacagaccaggagctcacctgtactgcagcataagatttccgagacgctggagtcccgccatcataagatcaaaacaggatcccctggcagcgaggtcgtaaccttgcagcagttcttggaggaaagcaacaagctgacctccgtgcagattaaatctagctcacaggaaaacctcctggacgaggttatgaaatcattgagcgtctcctctgacttccttggcaaagacaagcccgtatcttgtgggttggcgagaagtgtaagcgggaaaacccctggggatttctatgacaggagaaccactaagcccgaattcttgaggcccggccccagaaagacagaagacacctactttatcagcagcgcagggaaaccaactcctgggacccagggcaaaatcaaactggtaaaggagtcatctctgtcgcggcagtcgaaagacagcaatccgtacgccacactgccccgcgcctcgtctgtgatatccaccgccgagggaacaactaggcggacctctattcacgatttcctcaccaaagatagcagacttcctatttcagtcgattctcctcccgccgctgctgacagtaatacaaccgctgcttctaatgtagataaggtgcaagagtcacgcaattctaagtccaggtccagggaacaacagtcgagctag

SEQ ID NO: 183428 - DNA, 420 bp, Artificial Sequence
  Description of Artificial Sequence: Synthetic coding sequence
atgccctgcgccgcccggagccggagcagctggcggcggagctggacaaatactgcatgttggtccctttgtccatgcccggggccacgttccccttcccctgccccaatgcggcgggctcaatcctcgctgtgcctgagggatgagaccttagccggagggcagagacgcaagctttctagtcgctttcccgtggggcgcagctccgaatccttctctccaggtgataccccccgccagcgtttccggcaacggcaccccggcccactgggtgctcctgtgtctcacagcaaaggccccggggtggggtgggaaaacagtgcggagacattacaggaacatgagacagatgccaatcgagagggccccgaggtgcaagaaccagaaaagagaccactcacaccatccctatcccagtag

SEQ ID NO: 183429 - DNA, 4431 bp, Artificial Sequence
  Description of Artificial Sequence: Synthetic coding sequence
atggagggcggcaagggcccccggctgcgggacttcctgagcggctccctggctacctgggccttgggtcttgcgggcttagttggggaagcagaggattctgagggtgaggaagaagaagaggaagaagagccaccgctttggcttgagaagagatttctgagactctctgatggggcgctgctcctgcgggtattagggatcatcgctccatcaagccgtgggggccctagaatgctcagagggctagacggtcccgccgcatggcgggtatggaacctaaaccacctatggggacgactacgcgatttctatcaagaggaacttcaactgttgattttgtccccaccccctgatctgcagacgctaggtttcgaccctctatcagaagaagctgtggaacagctggagggagtgctccggctgttgttaggcgctagcgttcaatgcgaacatagagagttatttatccgacatatccaggggctgtctcttgaggtccagagtgaactggcagccgccatccaggaggttactcagccgggcgctggtgttgttctggccctgtccgggcccgatccgggcgagctggcacccgcggagctcgaaatgcttagccgcagcctaatgggcaccctctctaaactggcgcgagaaagggatctgggtgcccagcggcttgccgagctcttactggagcgggagcccctttgtctgaggcctgaagctcccagtcgagcccccgcagaggggccatcacatcacctggcacttcagcttgctaatgctaaggcgcaactccggagattaagacaagaacttgaggaaaaggccgaattgctgctggactcacaggcagaagttcagggcctggaggctgagatccggcgcttgcggcaggaggctcaggccctgagtggccaagctaagagagctgaactgtaccgagaagaagccgaagcactccgagaacgcgcgggtaggctgccacgtctccaggaagaactgcggagatgcagggagcgtctgcaggccgcagaagcctacaaatcacagctggaagaagaaagggtgttgagtggcgtgttagaagcctctaaggcactgttggaagaacagctcgaggccgcaagagaaaggtgcgcacgcctgcacgagacccaacgagagaacctcctgctccgcaccagactaggcgaagcacacgccgaattggacagtctgagacaccaggtagatcaactggccgaagagaatgtggagcttgaattagaactccagagatcactcgaacccccacccgggtcacccggcgaagcacccttagcaggggccgcaccctcactgcaggatgaagtgagagaagctgaggccggccgccttcggaccctagagagagagaaccgtgagcttcgcggactgttgcaggttctgcaaggccagccgggtggacagcaccccttgctagaagccccaagagaagatccagtcctgcctgtgctggaagaagcaccccaaacccctgtggctttcgaccattctccccagggtttggtgcagaaggctcgcgacggaggcccgcaagcattagacctggcgccgccggccctcgacagtgtcctggaggcaagtgccgagtgtccacaggcgcctgatagtgatccacaggaagccgagagtccactgcaggccgccgccatggacccccaggcaagcgactggtctccccaagagtcaggttcccctgttgagacccaagaatcacctgagaaagctggacgacgaagctctcttcagtcccccgcaagcgtggccccaccccaaggcccaggtactaagatccaggcgccacagctgctagggggcgagaccgaggggagggaggcacctcagggagaactggtgccagaagcatggggactgagacaggagggtccagagcacaaaccagggccttccgagccatcttccgtgcagctcgaagagcaggagggcccaaaccagggtcttgatttggcaaccggccaggccgaagcacgagaacacgatcagaggctggagggcactgtacgggacccagcttggcagaagccacagcagaagagcgaaggagccctggaggtacaagtttgggagggacccatacccggtgagagcctggcctcaggagtggcggagcaggaggcgttgagggaggaggtcgctcagctgagacgtaaggcggaggcactcggtgacgagctcgaggcccaggcaagaaaactagaagcccagaacacagaagcagcccggctgtcgaaggaattggcccaggctcggcgggccgaggcagaggcccaccgtgaagccgaggcccaggcttgggaacaagctcggttgagagaggccgttgaagccgctggccaggaattggaatccgccagccaggaaagagaggccctggtagaggctctcgctgctgcggggagggaaagacgacagtgggagcgagagggttccaggttacgagctcagtccgaggccgctgaagagaggatgcaagtcctggaatctgaaggaaggcagcatctggaggaagcagagcgcgaaagaagggagaaagaggccctacaagccgagctggaaaaggccgtggtgagggggaaggagctgggggataggctggagcacctgcagagagagctggaacaggctgccctggaaaggcaggaattcttgcgcgaaaaggagtcacagcatcagcgctatcagggactggagcaaagattagaagccgaactgcaagccgctgccacaagcaaggaagaggcgcttatggagctgaagacacgagctctccagctcgaggaagagctatttcaactccggcaggggcctgccgggctggggcccaagaaaagagctgagccccagttggtggagacacaaaacgtcagactgatcgaagtggagagaagtaatgccatgttggtggctgagaaagccgctttgcagggccagctgcagcatcttgaagggcaactaggttctctgcagggccgagcccaggagctgctgctgcaaagccagcgcgcccaagaacatagcagccgcctccaggcagaaaagagtgtgctggaaattcagggtcaggaactccaccggaagttagaggtgctggaggaggaagtccgcgccgccagacaaagtcaagaagagacaaggggccagcagcaggcactgctgcgggatcacaaggccctcgctcagcttcagcggcggcaggaggcggagcttgaaggattactagttcgtcaccgtgacctaaaggccaacatgcgagctctagagttagctcaccgagaactgcaaggaaggcacgagcagctgcaggctcagcgggcatctgttgaagcccaggaggtagcactcctggcggagagagaacgcctgatgcaggatggtcacagacaacggggcctcgaagaggagctccggcggttgcagagcgagcacgaccgggctcagatgctgcttgctgaactgtcccgagagcgcggtgaacttcagggtgagcggggagagctgaggggtcgcctggccaggctggagctggagcgtgcccagctggagatgcagagtcagcagttacgggagtccaaccagcagctcgatctgagcgcctgcaggttgactactcagtgtgagctgctgactcaactccgctccgcccaggaagaggaaaataggcagctcctggccgaagtccaagccctcagtcgagagaatagagagctgctagaaagatccctggagtctcgggaccatcttcaccgggagcagagggagtacctggaccagctgaatgccctgagacgggaaaaacagaaacttgtagaaaagattatggatcaatatcgggtcttggaacctgtccccctgccacgcaccaagaaaggatcttggttagccgataaggtgaagaggctgatgcgacccaggcgagaaggcggccctcctggaggcctgcgcctaggggccgacggagctggctccaccgagtcattgggcggaccccctgaaactgagttgccagaggggcgagaggctgacgggaccggaagcccttcccccgccccaatgcgcagggcccagagcagcttgtgtcttagggacgaaaccctggccggtggtcaaaggagaaagctgagctctcggttccctgtcggcagatcgtccgaaagctttagtcccggcgatacaccccgccagcgttttcgccagaggcatcccgggcctctgggagcacccgtttctcattccaagggacctggcgtgggttgggaaaatagcgcggagaccctgcaggagcacgaaaccgatgcaaatcgggagggccccgaagtacaggaaccagagaagagacctttaaccccaagcctgagccagtag

SEQ ID NO: 183430 - DNA, 2139 bp, Artificial Sequence
  Description of Artificial Sequence: Synthetic coding sequence
atggccggcgtggccgcccaccgggcccacccccccttcaccgcccacatgaaaaaccgggggctgagggaggaactggaaaaagccgtggtgcgagggaaagagctgggcgatagactggagcatctgcagcgagagctggaacaagctgccctggaaagacaagagttcttgcgcgagaaggaatctcaacaccagcgttatcagggccttgagcagaggcttgaggctgagctccaagcggctgctaccagtaaagaggaggccttgatggagctgaaaacgcgagctctacagctcgaggaggaactcttccagcttcgccaggggccggccggactgggccctaagaaaagagctgaaccgcagctcgtggagacccaaaatgtacgcctcatcgaggtggagcgatccaacgctatgttggtggctgagaaggccgcactccaaggccagctgcagcatctggagggccaattgggctcattacaagggcgcgctcaagagctgctgctccagtctcagcgggctcaggaacacagcagcagactgcaggccgaaaaatcagtacttgagattcagggccaggagctgcaccgaaagctggaagttcttgaggaagaggtccgggcagccaggcaaagtcaggaagagacaagaggacagcagcaggccctgctgcgggatcataaagctctggctcagctgcagaggcggcaggaagcagagctcgaaggcttactggtgcgccaccgggatctaaaggctaatatgagagcccttgagctggcccacagggaattgcagggcagacacgaacagttacaagcccaaagagcatcagtggaggcgcaggaagtcgcccttctggcagagcgggagagactgatgcaagacggccacagacagcgagggctggaggaggagcttagacggctccagtccgagcatgatagggctcagatgctgctcgcagaactatcccgtgagcggggagagttgcagggggagcgaggcgaactgcgcgggaggctagcaaggcttgaactcgagcgcgctcaactcgaaatgcagtcccagcagctacgtgaatctaatcagcagttagatttaagcgcctgtcgcctcactactcagtgtgaacttctaacccagctcagaagcgcacaggaagaagagaatagacaactgcttgccgaagtccaggccctgtcacgggagaacagggagctactggagagatcactggaatcccgagaccacctgcaccgtgagcagcgtgagtaccttgaccagctcaatgccctgcggcgggagaagcagaagctagttgaaaagattatggatcaataccgcgtgttggaaccagtgcccttaccgcgtactaaaaagggcagctggctcgctgacaaggggcccttgccacgccacccatgtgccggccctcgggctccctctgcatgcggaatgcgcccatggcaggctgggtctggaggtaactccgcccaaggatcccgatggggagaagctctgtcacatagcgctctgggtaccccgttaggcaatgattcagattccgcgatccaggctccttgggggcgcccctctcctaccgccaaggatctggtgtgggatgggcggacaccactgcggccctgtcggaacacaaagcagatgccgacagaacgagccctgcgctatagaaatcgtcggaatgtcccctcgccgcatcccagtgcttccgataccgttgggacagccggactaggcgtccagccttcacgccactggtctgtctccggaggaccgcgtcagcctaagtccagtggcagccaggggccccagggcgagtccctcgacaaagaggcttgggctttgaggtcgtccactgtcagcgcaggtgctcgaaggtggtcgtgggatgaatgcgtcgaccgcggagacggatggccgcctcgcgccgcaccaggttggtcatccgggagcagccggtggctgccactacgtcagcgtagcctgggcgaccctcctgccgaggggggatggcaggaactggcccgagagccaccagccctctcacggtgggaagctgaatcacaatgctgggggaccgttgcctgggctgatctcgagccctag

SEQ ID NO: 183431 - DNA, 4077 bp, Artificial Sequence
  Description of Artificial Sequence: Synthetic coding sequence
atggagggcggcaagggcccccggctgcgggacttcctgagcggcagcctggctacgtgggcccttggactcgctggcttggtgggcgaagcggaggatagtgagggagaggaagaggaagaggaagaagaacctcccctgtggctggagaaacgcttcctgaggcttagcgacggagcactactattgagggtgctcggaatcatcgcaccaagctctagaggtggtccccggatgctaaggggtctcgacggcccagctgcttggagggtatggaaccttaaccacctatggggccgcctgagagatttctatcaggaagaactgcaactcttaattttatcccctcccccggatctccagactctcggcttcgaccccctgagtgaggaagctgttgagcagctagaaggcgtgttgcgactcctgttgggggctagcgtgcagtgcgagcatcgagaactgtttattcgccatatacaagggctttctctggaagttcagagcgaactggccgctgccattcaggaagtaacgcagcccggtgccggcgttgtgttagcactcagcggccctgacccaggtgagctggccccagctgaactagaaatgctaagccgctcacttatggggactctttctaagctggcccgcgagcgagatttgggcgcgcagcgacttgccgagctgctactagagcgagaaccgctgtgtctcaggccagaggcgccaagccgggcccccgctgagggacctagtcatcacctggcccttcagcttgctaacgccaaggcgcagctcagacgccttagacaggagttggaagaaaaggcggagctgctgctggattcccaagccgaggttcaagggctggaagccgagataagacggttgcggcaagaagcacaggctttgtctgggcaagccaagcgggctgagctctatagagaggaagccgaagctcttagagagagagcagggcggctccctcggcttcaggaggaactcaggagatgtcgggaacggctccaagccgcagaggcctataagagccagttagaggaagagcgcgtcctgagcggcgtgctcgaagcgagcaaagcactgctagaggagcaacttgaggccgccagggaacgctgcgcgagactccacgaaactcaaagagagaacctgcttttacgtactaggctgggggaggcccatgctgagctggatagcctcagacatcaggtggaccagttggcagaggaaaacgttgagctggagttagagcttcagaggtcgctggaacccccaccgggctctcctggagaggcaccacttgccggagctgctccttctttgcaggacgaagtgagagaggccgaggcaggccgactgagaacactggagagggaaaatcgggagctgcgcgggctgctgcaggtgctgcagggccaacccggggggcagcacccgctgctcgaggccccccgtgaggatccagtcctgcctgttcttgaagaagcgccccaaactcctgtggcttttgatcattcaccccaggggttggtccaaaaagctagggacggcggtccacaagcactcgatttggcgccaccggccctggacagtgttcttgaagcatctgccgaatgccctcaggcccccgacagcgaccctcaggaggctgagtcccccctgcaggctgccgccatggacccacaggcctccgactggagccctcaggagtccggctctcctgtggagacccaagagagcccagagaaggctggacgccgctccagcctccagagccctgccagcgtggcccccccacagggacctggaacgaagattcaagctcctcagctgctcgggggtgagaccgagggcagagaggcaccccaaggcgaattggtgcccgaagcctgggggttacggcaagaggggccagagcacaagccagggccatccgaaccctccagcgtgcagctggaggaacaggaggggcccaaccaaggcctggacctggccacgggacaggcggaggctagggaacatgaccagcgccttgaggggaccgtgcgggaccctgcatggcagaaaccccagcagaaaagcgaaggagcactggaagttcaggtctgggaaggccccatacccggcgaaagtctggccagcggtgtagcagaacaagaagctttgagagaggaagtagcccagctgcggagaaaagcggaagccctgggcgacgaacttgaggcccaggcccgcaaactcgaggcgcagaatacggaggcagcccggcttagtaaggagctggcacaggcgcgtcgagcggaagcagaagcccatcgggaggccgaggcacaggcctgggagcaggctaggctgcgcgaggccgtggaggccgcaggacaagagctcgagtccgcctctcaggagcgcgaggccctcgtggaagccctggctgcggccggcagggagcgccgacagtgggagagagagggctccagactccgcgcgcagtccgaggctgcggaggaacgaatgcaggtgctcgagtccgagggtagacaacatttggaggaggcagaaagagagagaagagagaaggaggccctgcaggctgagctggagaaggcagtggtgagaggcaaagagctcggtgatcggctggaacaccttcagcgcgagctggagcaggccgcgttagagcgacaagagttcctgagagagaaagagagtcagcaccagaggtaccaaggactcgagcagcggctagaggccgagctgcaggctgcggctacctccaaggaggaggctctcatggagctgaagactcgagccttgcaactggaggaagagttgttccaactccggcagggccccgcaggtctcggaccgaaaaaaagggctgagccacaactcgtcgaaacgcagaacgtgcggctgattgaggtggaaaggtctaacgcgatgcttgttgctgagaaggcggccctgcaggggcagttgcaacacttggaaggtcaacttggcagcctccagggaagagcacaggaattgttgctcgccgaaagggagcgcctgatgcaggatggtcaccggcagagggggctcgaagaagagctgcgccggctgcaaagtgaacatgacagggcccagatgctgttggcggagctgtcacgtgaacgcggtgagttgcaaggcgagagaggcgagcttcgcggacggctcgcccggttggaattagaacgggcccaattagagatgcagtctcaacagctcagggaaagcaaccagcaactcgaccttagcgcttgccggctgaccactcaatgtgaacttttaacgcagctcagatcagctcaggaggaagagaataggcagctcttggcagaggtccaagcacttagtagagaaaacagggaacttcttgagagatcactggagtctcgggatcacctgcaccgtgaacaacgcgagtacctcgatcaactgaatgctctgagacgggagaagcagaagctcgtagagaaaattatggaccagtatcgggtgcttgagcctgtcccgttgcctcgtacaaaaaaaggctcatggctggccgacaaggtgaagcggcttatgagaccaaggcgggaaggcggaccccccggggggctgcggctgggggctgatggagctggctccactgaaagcttgggggggcctccggagacagagcttcctgagggtagggaggccgacggaaccgggtctccttcccctgccccaatgaggcgagcacagagcagtctgtgtctgcgggatgagactctggcgggcggacaacgtcggaagctgtccagtagattccctgttgggcgcagctctgaatctttcagtcctggcgatactcctaggcaacgatttcgccaaagacacccagggccgctgggtgcccccgtctcacactctaagggtcccggtgtgggctgggaaaactccgctgaaacccttcaggagcatgaaaccgacgccaaccgtgagggtcccgaggtccaggagcccgaaaagaggcctcttacaccctcacttagccagtag

SEQ ID NO: 183432 - DNA, 684 bp, Artificial Sequence
  Description of Artificial Sequence: Synthetic coding sequence
atgggcggcaccaccagcacccggcgggtgaccttcgaggccgacgagaacgagaacattacggtggtcaagggaatccgcctctctgaaaacgtgattgacagaatgaaagagagtagcccttcaggcagcaagagccagcgatacagcggggcatacggggcatcagtgagcgacgaagagcttaagcgtcgggtggctgaggaactggctttagaacaggctaaaaaagaatctgaagaccagaagcgcctcaagcaggctaaagagctcgacagagagagagctgctgccaacgagcaactgacgcgggctatccttagggagcgcatttgttcggaagaggaacgagccaaggcaaagcacctcgctcgtcagttagaggaaaaggatagagtgctgaaaaagcaggacgcattttacaaagagcagctcgcccgcttagaagaacgcagttctgaattttatagggtcaccaccgagcagtatcagaaggcggctgaggaagtggaagccaaatttaaacgttatgagtcacatccagtctgcgccgatctgcaggctaagatcctgcagtgttatcgcgagaatactcatcagactctgaagtgttcggcactggccacccagtacatgcactgcgtgaaccatgccaagcaatccatgcttgagaagggcggttag

SEQ ID NO: 183433 - DNA, 417 bp, Artificial Sequence
  Description of Artificial Sequence: Synthetic coding sequence
atgggcggcaccaccagcacccggcgggtgaccttcgaggccgacgaaaatgaaaacatcactgtcgttaaaggcattaggttgagcgagaatgtgatagatcgcatgaaggagagcagtccaagtggatctaagtctcagcgatacagcggcgcatacggggccagcgtgtccgatgaagaactcaaacgcagggtcgctgaggagctagccctggaacaggctaaaaaagaaagtgaggatcagaaaaggctgaagcaggctaaggagctcgacagggaacgtgcagccgcaaatgagcagctgacccgcgccatcctgagggagcggatctgcagcgaggaggagagggccaaagctaagcacctgatcaaggtcgagctgctttgggtcaaacccggcgtgctcactgcatag

SEQ ID NO: 183434 - DNA, 333 bp, Artificial Sequence
  Description of Artificial Sequence: Synthetic coding sequence
atgaagtgcgaggagacccacgcccccaacagcaactgggtgtacgtgatgctcccatccaagaaaacagtgcgaatgccgagtgtgactcagcggctgcgggatcctgacattaacccttgcttgagtgagtctgatgcctctactaggtgccttgatgaaaacaactatgacagggagaggtgctctacttactttctgaggtacaagaattgcagacggttttggaattccatcgtgatgcagaggaggaaaaacggcgtgaagccattcatgccgacagccgccgagcgagatgagatcctcagggcagtcgggaatatgccctattag

SEQ ID NO: 183435 - DNA, 258 bp, Artificial Sequence
  Description of Artificial Sequence: Synthetic coding sequence
atgcccagcgtgacccagcggctgcgggaccccgacatcaacccctgcctgagtgaatctgatgctagcactaggtgcctggatgagaataactacgaccgtgagcgatgcagtacatatttcctccgttacaaaaattgccgacggttctggaatagtatcgtaatgcaaaggaggaagaacggagtcaaaccgttcatgcccacagcagcagaaagagacgagattttacgcgcagtcggtaacatgccctattag

SEQ ID NO: 183436 - DNA, 285 bp, Artificial Sequence
  Description of Artificial Sequence: Synthetic coding sequence
atgctgcccagcaagaagaccgtgcggatgcccagcgtgacccagaggctgagggaccctgatattaatccttgtctatcagaatccgacgcttctaccagatgtctggatgagaataattacgaccgggagagatgtagtacgtattttcttaggtacaagaattgccgcaggttttggaatagtatagtgatgcagcgcagaaaaaatggagttaagccatttatgccaaccgctgctgagcgggatgaaatcctgagggctgtaggcaatatgccttactag

SEQ ID NO: 183437 - DNA, 135 bp, Artificial Sequence
  Description of Artificial Sequence: Synthetic coding sequence
atgcccagcgtgacccagcggctgcgggaccccgacatcaacccctgtctgtccgaatcagatgcgagcaccagatgtctcgatgagaacaattacgatcgcgagagatgctcgacatattttctgcgatattag

SEQ ID NO: 183438 - DNA, 294 bp, Artificial Sequence
  Description of Artificial Sequence: Synthetic coding sequence
atgcaccagacccggaccggcaagaagaccgtgcggatgcccagcgtcacacagaggttgcgcgaccctgatattaatccatgtctctctgagagcgatgcgagcactagatgtcttgacgagaacaactacgatcgtgaacgatgtagtacttattttctgcggtataaaaactgcagacgtttctggaattcaattgtcatgcagcgaagaaaaaacggcgtgaagcctttcatgccaacagcagcagagcgcgatgagatcttgagagccgtcggtaatatgccctattag

SEQ ID NO: 183439 - DNA, 207 bp, Artificial Sequence
  Description of Artificial Sequence: Synthetic coding sequence
atgcaccagacccggaccggcaagaagaccgtgcggatgcccagcgttactcagaggctgcgggatccagatatcaatccatgcctctcaatcctgttctacctgctgaacgacgcgagccttatcagcgttcggaatctcatgctgcccccagacgtttggatgaagatcaccatgaccgggaaaggcgtccctttaacttcttag

SEQ ID NO: 183440 - DNA, 264 bp, Artificial Sequence
  Description of Artificial Sequence: Synthetic coding sequence
atgagcaccagcgtgccccagggccacacctggacccagcgggtgaagaaagatgacgaagaggaggatcccctcgaccagctcatctcccggagcggctgtgcagcatcacacttcgccgtccaggaatgcatggcgcagcaccaagactggaggcagtgccagccccaagtgcaggcttttaaggactgtatgtctgaacagcaggctaggaggcaggaggagctacaacgccgccaggagcaggcaggtgcgcaccattag

SEQ ID NO: 183441 - DNA, 264 bp, Artificial Sequence
  Description of Artificial Sequence: Synthetic coding sequence
atgagcaccagcgtgccccagggccacacctggacccagcgggtgaaaaaggacgatgaggaagaggatccattggaccagctaatcagcagatcaggctgcgctgcctctcactttgcggtgcaggagtgtatggctcaacaccaggactggaggcagtgtcagccacaggtgcaggcatttaaggactgtatgtctgagcagcaggcaaggaggcaggaggaactgcaacggcggcaagagcaagccggtgcccaccactag

SEQ ID NO: 183442 - DNA, 291 bp, Artificial Sequence
  Description of Artificial Sequence: Synthetic coding sequence
atgttctaccggctgcccatcccccggatgagcaccagcgtgccccagggacacacttggacccaacgggtaaagaaggatgatgaagaagaggaccccctggaccagctgataagtagaagcggctgcgccgcatcacattttgcggttcaagaatgtatggcacagcaccaagattggcgccaatgtcagccccaggtgcaagccttcaaggactgcatgagcgagcagcaagctaggaggcaggaagagttgcagcgacgacaagagcaggccggggctcaccattag

SEQ ID NO: 183443 - DNA, 264 bp, Artificial Sequence
  Description of Artificial Sequence: Synthetic coding sequence
atgagcaccagcgtgccccagggccacacctggacccagcgggtgaagaaagacgatgaggaagaggatcctctggatcagctgatttcgcgctcggggtgcgcagcttctcatttcgcagtacaggagtgtatggctcagcatcaagactggcgacagtgtcagcctcaggttcaagccttcaaggattgtatgtctgagcagcaggcacgacggcaggaagagcttcaacggagacaggagcaagcgggggcccaccactag

SEQ ID NO: 183444 - DNA, 1731 bp, Artificial Sequence
  Description of Artificial Sequence: Synthetic coding sequence
atggccgccagcgagaccgtgcggctgcggctgcagttcgactacccacccccagcaacaccccactgcactgcgttttggctgctggtagatctgaaccggtgtagagtagtgactgatctgatcagtttgattcgccagcgtttcggattttccagtggcgccttcttgggactgtacctggagggaggcctgctgccgcccgcagaaagcgcaaggctggtaagagacaatgactgcctacgggtgaagctcgaggagagaggcgttgctgagaacagcgtggtgatcagtaatggcgatattaacctatctctgcggaaagctaaaaaaagggcctttcagctagaggagggagaagagaccgagcctgattgcaaatactctaaaaagcactggaaatcaagagagaataataataacaacgagaaggtgctggatctggaacctaaggcggttacggatcagactgtctccaaaaagaataaacgaaagaataaagctacttgcggtaccgtgggtgacgacaatgaggaggccaagaggaagagcccgaaaaagaaggagaaatgtgaatacaaaaagaaggccaagaaccctaaatccccgaaggtgcaggcagttaaagattgggccaatcaacgctgttcttctccaaaagggtccgcccgcaactccctcgtaaaggcgaagcgaaaagggagcgtgtctgtgtgtagcaaggagtctccgtctagctcttctgagtctgagtcttgcgatgagtctataagtgacgggccctcgaaggttacattggaagcgagaaattcgagcgaaaagctgcccaccgagctctctaaagaagagcccagcacaaagaataccaccgctgacaagctggcaattaaattgggatttagcctgacaccaagcaaaggtaaaaccagcggcactacctcttctagtagcgactccagtgctgaatcagacgatcagtgtcttatgtcatcctcgacacccgaatgcgcagcgggattcctgaagaccgtggggttgttcgctggccgcggccgtcccgggccaggcttgagctcccaaaccgccggtgccgcaggctggcgcagatctggttccaatggcggtggacaagcccccggagcttccccttctgtcagcctgcccgcctctctcggccggggctgggggcgcgaagaaaacctcttctcctggaagggggcaaaagggcggggaatgcgcgggcggggacggggaaggggtcaccctgtatcttgtgtggtgaaccggtctaccgataatcagagacaacaacagttgaacgacgtggtcaaaaactcctccaccattatccaaaacccagtggagacccccaagaaagattactccctcctgcccttgctcgcagccgcccctcaggtgggagagaagatcgccttcaaactcctcgaacttacttccagctatagccccgacgtcagcgattacaaggagggacggatcctttcccataaccccgagacccaacaggtggatattgagattctctctagtttgccggcccttagagagccaggcaagtttgatctcgtttatcacaatgagaacggagccgaggtggtggagtacgcagtgactcaagaaagcaaaattacggtgttttggaaggagcttattgaccctagactgattatcgagtctccatccaacacatccagcacagagccagcctag

SEQ ID NO: 183445 - DNA, 519 bp, Artificial Sequence
  Description of Artificial Sequence: Synthetic coding sequence
atggccagcgacgagggcaagctgttcgtgggcggcctgagcttcgacacgaacgagcagagtctcgagcaggtctttagcaagtacggccagattagcgaggtcgtagtggtgaaagaccgggaaacgcaaaggagtcgggggttcgggtttgtgaccttcgaaaacattgatgacgccaaagatgctatgatggccatgaacgggaaaagtgtggacgggagacaaattcgcgtggaccaagctggaaaaagttcagacaaccggagtcgaggctaccgcggaggaagcgctgggggtcgaggcttttttagaggagggcgaggccgcggccgcggcttcagccgcggggggggcgaccgaggttatggagggaaccggtttgagtctcgctctggtggatacggcggatccagggattattattcctctagatcgcagagcggaggctacagcgaccggtcatcaggcggatcgtatagggattcatacgatagttacgctacacacaatgagtag

SEQ ID NO: 183446 - DNA, 792 bp, Artificial Sequence
  Description of Artificial Sequence: Synthetic coding sequence
atggccagcgacgagggcaagctgttcgtgggcggcctgagcttcgacactaatgaacagtctttggagcaggtgttttctaaatacggtcagatctctgaggtggtagtggtgaaggaccgtgagactcagcgatccagaggtttcgggtttgtgacatttgagaatatcgacgacgctaaagacgccatgatggccatgaacggcaaatccgtggacggccggcagatacgtgtggaccaggccggaggtggcgatcgaggctacgggggaaataggttcgagagcagatcaggcgggtacggcgggtctcgagactattattcttcccgttcccagagtggcggctacagtgacagatcgtcaggcggatcatacagagatagctacgacagttacggcaagtctcactcagaaggcgccaccctactgtggccggccgtcggggccagattcaccctcgttccctctccatcaacactgggctggaccctccgtccttgtcactgtgcatgtccagaggaagcccatctatcttcgcagagccatttttatagacgaacgcaaaaacctaatgagacagaccagaagggcaagggcgagcgagggccggctggtcaaagcgcgagatgcatgtgcgggcggcggccggcatctctgggttgcggaggctggctgcttcccggacgacgccctcgtccggggctcgcatctggtgtaaagctgcccctggtggcttctgtacctttgcattgcgcgtgttttctgagcagcgcaactcataacgagtag

SEQ ID NO: 183447 - DNA, 735 bp, Artificial Sequence
  Description of Artificial Sequence: Synthetic coding sequence
atgagcagccggtggagccggagcagccagagcaccgaccggagcctgaagtctgtcgatggacgacagatccgagtggaccaagccggcaaatcatctgataatcgaagtcgtggataccgaggaggatcagctggcggaaggggcttcttcagagggggtcgcggaagggggcgtgggtttagccgcgggggtggcgaccggggctacggaggcaacaggttcgagtcacggtctggcggatatggtggaagcagggactattatagctctcgctcccaatccggtggctactccgatcgctctagcgggggatcttatcgagattcttacgatagctatggcaagtctcattctgaaggcgccacactgttgtggccagctgtaggtgctcgctttacactcgtcccgagccccagcacactggggtggacccttagaccatgtcactgtgcttgccctgaggaagcgcatctatcctcacagtcacacttctatcggcgcactcagaagcctaacgagactgaccagaagggcaagggagagcgtggccccgcagggcagtctgctcgctgtatgtgcggacgtagaccagcgagtctgggctgtgggggatggttattgcccgggcgtcgcccacggcccggcctggcctcaggggtcaaactccccctggtcgcatccgttcccctgcactgtgcctgctttctttccagcgctactcacaatgaatag

SEQ ID NO: 183448 - DNA, 519 bp, Artificial Sequence
  Description of Artificial Sequence: Synthetic coding sequence
atggccagcgacgagggcaagctgttcgtgggcggcctgagcttcgacacaaacgagcagtctttggagcaggttttctcaaaatatggccaaatttccgaagttgttgtggtgaaggacagagagacacagcgctctcggggttttgggttcgtaacttttgaaaatatcgatgacgcaaaagacgcaatgatggcgatgaatggaaaatccgtcgatggtcgtcaaatacgtgttgatcaggcagggaaaagcagtgacaaccgcagcaggggctaccgggggggaagcgcaggcgggcggggttttttccgaggagggaggggtcggggtcggggattctcacgggggggcggggatcgcgggtatgggggcaatcgtttcgaatctcggtctggagggtacggcgggtccagagattattatagtagccgctcccagagcggaggctattcggacaggagcagcggagggagctaccgcgacagctatgatagctacgcaacacacaatgagtag

SEQ ID NO: 183449 - DNA, 2304 bp, Artificial Sequence
  Description of Artificial Sequence: Synthetic coding sequence
atgagcttcgaccccaacctgctgcacaacaacggccacaacggctaccctaatggcacgagtgctgctttgagggagacaggtgtgatagagaaacttttgacctcttatggctttattcagtgttcagagcggcaggcgaggctattttttcattgctcgcagtataatggaaacttgcaggatctaaaggttggtgatgacgtggaatttgaggtgtcatcggataggagaacaggcaaaccaattgcggtgaagcttgtaaagattaagcaggaaattctgccggaggaacggatgaacggacaagaagttttttacctgacttatacgcctgaggacgtagaaggcaatgtccagctcgaaaccggagacaagattaatttcgtcattgataacaacaaacacaccggggcagtgagcgctcgaaatattatgctcctcaagaagaagcaagctcgctgccaaggtgtggtgtgcgcaatgaaagaggccttcggctttatagagcgcggggacgtggtcaaagagatattctttcactactcggaattcaagggggatttggagactctgcagccaggagacgacgtggaattcaccattaaagaccgcaacggaaaagaggtggctacagacgtgcgcctgctgcctcagggaacggtgatcttcgaagacatttcaatagaacactttgaggggaccgtaaccaaggtgattccaaaagtgccctctaaaaaccagaacgaccccttgccaggaaggatcaaggtggattttgtgattccgaaggagcttccatttggtgacaaagatacaaaaagcaaagtgacactattagaaggcgaccatgtgaggttcaacatttccactgataggcgagataagctggagcgggcaaccaatatcgaagtcctgagtaacactttccagttcacaaatgaagccagagagatgggagttatcgccgcaatgcgggatggattcggatttattaagtgcgttgacagggacgtgcggatgttctttcacttttctgagattctggacggcaaccagcttcacatcgccgacgaggtcgagttcaccgtagtccctgatatgctaagcgcccagcggaaccacgctattaggatcaaaaaactcccaaagggcaccgtttcctttcactcacatagtgaccatagatttctcggaaccgtggaaaaagaagcgactttctccaatcccaagacgaccagccccaataaaggtaaggagaaggaggccgaagacgggataattgcctatgatgactgtggggtgaagctgaccatcgccttccaagccaaggacgtcgaaggttccacatccccccagatcggcgacaaagttgagttttccatctccgacaaacagagacccgggcagcaggtggctacctgtgtccgcctgctgggcaggaatagcaacagcaagcgcctcctggggtacgtggcgactctgaaagacaactttgggttcatagagaccgctaatcatgacaaggagatctttttccattactctgagttctcgggggacgtggacagcctcgagttgggggatatggtggaatacagcttgtctaaaggtaagggcaataaggtttccgccgagaaagtgaacaagacacactcagtgaatgggatcactgaggaagcagacccaacaatctattccggcaaggtgatccgcccgctgagaagcgtggaccccactcaaacagaataccagggcatgattgaaatagtggaggagggtgacatgaaaggcgaggtgtacccatttggaattgtggggatggctaacaagggtgattgcctccaaaaaggtgaatccgtgaagttccaattatgcgtcttggggcagaatgcacaaacgatggcctacaatattaccccacttcggcgggcgaccgttgagtgcgtcaaagaccaattcggcttcattaactacgaggtcggtgatagcaagaagctgttcttccacgtaaaggaagtgcaagacggcatcgagcttcaagctggcgacgaagtagagtttagcgtgattttgaaccagcggacagggaagtgctccgcttgcaatgtgtggcgggtgtgtgagggcccgaaggcagtcgccgcacctcggcccgacagactggtcaacagactaaaaaacattacactcgatgacgctagcgccccccggctcatggtcctgagacagccacgcggtccagataatagcatgggctttggtgctgagaggaaaatcaggcaggctggagtcattgactag

SEQ ID NO: 183450 - DNA, 2304 bp, Artificial Sequence
  Description of Artificial Sequence: Synthetic coding sequence
atgagcttcgaccccaacctgctgcacaacaacggccacaacggctacccaaatggcacgtccgccgctcttagggaaaccggagtgatcgaaaaactgctgacttcctacgggtttatacaatgttccgagcggcaggctcgcctgttttttcactgctcacaatacaatggtaacctgcaagatctcaaggtgggggatgatgttgaatttgaagtgtcatccgatcgaaggactgggaagcccattgcagtcaagctagttaagattaagcaggagatacttccagaagaacgcatgaacgggcaggaggtgttctacctgacatatacacctgaagacgttgagggaaatgtgcagttagagactggagataaaattaacttcgtgattgataacaacaaacataccggcgcggttagcgcccgaaatatcatgctccttaaaaagaaacaggccagatgccaaggcgtggtctgcgcaatgaaggaggcatttgggtttattgagcgtggcgacgtggttaaggagatctttttccattattctgaattcaagggggatcttgagactctgcagcctggcgacgacgttgagtttacaattaaagacaggaacggtaaagaagtggcgacagatgtccggctgttacctcagggtaccgtcatcttcgaggacatttccattgagcattttgagggaacagtcaccaaagttattcctaaagtaccctcaaagaaccagaacgatccgctcccaggaagaatcaaggttgacttcgtgattccaaaggagctgccattcggagataaggacacaaaaagcaaggtcacccttctcgagggagatcacgtgcgcttcaacatcagcaccgaccgtcgcgataaactggagcgtgccacaaacatcgaggttttaagcaacacgttccagtttaccaatgaagctcgggagatgggagtcatagcagccatgcgcgacggattcggtttcatcaagtgcgtcgatcgggacgtacgaatgttctttcatttcagcgagatccttgatggcaatcagctgcatatagcagacgaagttgaattcacagtggtccccgatatgcttagcgcccagcggaaccacgcaatcaggatcaagaaactgccaaaaggcaccgtgagtttccactcccacagcgaccaccgatttctaggcactgttgagaaggaggcaaccttttctaaccccaagaccacctcacctaacaagggaaaagaaaaagaggctgaagatgggattatcgcttacgatgattgtggagtcaagctcacgatagcttttcaggcaaaggatgtggaagggagcacctccccacagataggggataaagtcgagtttagcatttccgataagcagcggcccggacagcaagtggctacttgtgtcaggctactgggtcgaaacagcaattccaagcgccttttaggctacgttgccacgctgaaggataacttcggattcatcgagaccgccaaccatgacaaggagatttttttccactattctgaattcagtggcgacgtggatagcctcgagcttggggatatggtggaatatagcctttcaaagggcaaaggaaacaaagtctccgccgagaaagtgaacaaaacccattctgtcaacgggattaccgaagaggcggatccaaccatatactccggtaaggttatcagacctctgcggtccgtcgatccgacacagacagagtatcagggtatgatcgaaattgtcgaggagggagatatgaaaggcgaagtctacccgttcggcatcgttggtatggcaaacaaaggagattgcctccagaaaggtgaatccgtcaagttccagctctgcgtcttagggcagaacgcgcagactatggcttacaatataactccacttcgccgggctacagtcgagtgcgttaaagatcagtttggctttattaattatgaggtgggagactccaagaagctgttcttccacgtgaaagaggtgcaggatgggatcgagcttcaagctggcgacgaggttgagttttccgttatactgaatcaacggacaggaaagtgctcggcttgcaatgtttggagagtgtgcgagggccctaaagccgtggccgctcccaggcccgatcggctagtcaataggttaaaaaacattactctggatgatgcatcagcacctcgcctgatggtgctgcggcaaccacgcggccccgataactctatggggtttggagcagagaggaaaattagacaggcaggggtaattgactag

SEQ ID NO: 183451 - DNA, 2397 bp, Artificial Sequence
  Description of Artificial Sequence: Synthetic coding sequence
atgagcttcgaccccaacctgctgcacaacaacggccacaacggctaccccaatggaacaagtgctgccctccgggagacaggtgtgattgagaagctgctgacatcctacgggttcatacaatgtagcgagcgacaggcccggctattcttccattgctcacagtataacgggaatctccaggacctcaaggtgggcgatgatgtagagtttgaggtgtcttccgaccgtaggacagggaagcctatcgccgttaagctggtaaagataaagcaggaaattctgccagaggagcgaatgaatggccaggtggtctgtgcagtgccccacaacctggaatctaagtcccccgcagcacctgggcagtctcctacgggaagcgtgtgctatgaaaggaacggagaggtcttctacctgacctatactcccgaggatgtggaagggaatgttcagctcgaaaccggagacaagatcaattttgtgattgacaacaacaaacacaccggtgctgtttcggctcgcaacatcatgctgctgaaaaagaagcaggcccgctgtcagggcgtagtttgcgcaatgaaggaagctttcggatttattgagcgcggcgacgtcgttaaagaaattttcttccactatagcgagtttaagggagatcttgagacactccagccaggcgacgatgtggaattcaccataaaagacagaaacggaaaagaggtggccaccgacgtacgtttgctgccccaaggcacagtgatcttcgaggacatctcgattgagcacttcgaaggtaccgtgactaaagtgatccctaaggttccctccaaaaatcagaacgaccccctacctggtaggattaaggttgatttcgtcatccccaaggagctacctttcggggacaaagacacaaaatccaaggtgacactgctcgaaggggaccacgtgcgctttaatatctctactgatcggcgggacaaattggaaagagccacgaacattgaagtgttaagtaacacttttcaatttaccaatgaagccagggaaatgggagtgattgcagcaatgcgagacggctttggcttcataaaatgcgtggaccgagacgtgcgcatgttctttcacttcagcgaaatactcgatggcaaccaactccacatcgcagacgaggttgagttcaccgtggtgcccgacatgctgtctgcccagaggaaccacgctattcgaatcaagaaactgcccaaaggaactgtgtcttttcacagtcatagcgaccaccggtttctggggactgtcgagaaagaagcgaccttcagcaaccccaagactacatcccccaataagggcaaggagaaggaagcagaagatggcatcatcgcctatgatgactgcggcgtgaaactcacaatcgcatttcaggcgaaggacgtggaaggatctacttcgccacaaataggggataaagtggagtttagtatttccgataagcagcggccaggccagcaagttgccacttgtgttcggctcctgggccgcaactcaaattcaaagcgactgctgggctatgtcgccacactgaaagataatttcggttttattgagactgccaatcacgataaggagatcttcttccactactccgaattcagcggcgacgtggattcacttgaactgggagacatggttgaatactccctgtcaaagggaaaaggcaacaaggtttccgccgaaaaggttaataaaacgcactctgttaacggtatcaccgaagaagcagatcccactatctacagcgggaaggttatcaggcccctgagaagtgtagatcctactcagactgaataccaggggatgatcgagattgttgaagagggcgatatgaaaggagaggtttacccctttggaattgtcggcatggccaacaagggcgactgtcttcaaaaaggcgaatcagtgaaattccagctctgtgttcttgggcagaacgcgcagactatggcctacaacataacaccgctgagaagggccactgtggaatgcgtgaaggatcagttcgggtttatcaattatgaggtcggcgacagtaagaagctcttttttcatgtgaaggaagtacaggatgggatcgagctccaggcgggagacgaggtggaatttagcgtgatcctgaatcagcgtaccggcaagtgcagcgcgtgcaatgtgtggcgcgtttgtgaaggacctaaagcagtggccgcacctaggccagatagactggtgaacaggcttaaaaacatcactctcgatgacgcttctgcgcctcgcctcatggtgctccgccagcctcgtggaccagataattcaatgggcttcggagccgagcgaaagatacggcaggctggtgttatagattag

SEQ ID NO: 183452 - DNA, 2442 bp, Artificial Sequence
  Description of Artificial Sequence: Synthetic coding sequence
atggagaacgtgttcaccgtgagcagcgacccccaccccagccccgccgctccaccttccctgagtctgcccctctcatccagttccacttcgtctggaaccaagaaacagaaaagaacgcctacataccaaagatctatgtcttttgatcccaacttgctgcacaacaacggacacaacggctacccgaacggtacgtccgcagcgttgcgggagactggagtcattgaaaagttgctgacaagctatggctttatccagtgcagcgagagacaagcccggctcttctttcactgcagccagtataacgggaacttgcaggacctcaaggttggcgacgacgtggaatttgaggtcagctcggaccggcgcaccggcaaacctatcgctgtcaaactcgtcaagattaagcaggagatcctccctgaagagcgaatgaatgggcaggaggtcttctatttgacctacaccccagaggatgttgaaggaaacgtgcagttagaaaccggtgacaagattaactttgttatcgacaacaataaacatacgggcgccgtgagtgcaagaaatatcatgcttctgaagaaaaaacaggcccgatgtcagggcgtcgtatgcgcaatgaaagaggctttcggtttcattgaacgaggtgatgtcgtaaaggaaatttttttccactactctgagttcaagggagacctagagaccctccaacctggcgatgatgtagagtttacaatcaaggatcggaatggcaaagaagtggcaacagatgtccgactgctgccacaggggacagtgatatttgaggacatctccattgagcattttgaaggaactgtgaccaaagtcatcccgaaggtgccctccaagaatcagaatgaccccctgcccggacgcattaaggtggacttcgtaattcccaaggaactgccatttggagacaaagacactaaatccaaagtcacgctcctggagggagatcacgtgcgtttcaacatcagcaccgaccgccgcgataagttggaacgagccacaaatattgaggtgctgtctaacacctttcaatttacaaatgaagccagagagatgggggtgattgctgctatgagagacggcttcgggttcattaagtgtgtcgatcgcgatgtccgaatgttctttcactttagcgagatcctcgatggcaaccagcttcacatcgctgacgaggtggaatttaccgtagttcccgatatgctctccgcgcaacgaaatcatgcgattcgcataaagaagttgcccaaagggacggtctcctttcattctcatagcgatcaccgatttctgggtaccgtggaaaaggaagctaccttttccaaccccaagacgacgtccccgaacaaagggaaagagaaggaggccgaagacggaatcattgcttacgacgactgcggggtcaaactgaccatcgctttccaggcaaaggacgtggaggggtcgaccagtcctcagataggcgacaaagttgaattctccatctctgataaacagaggccaggacagcaggtggccacatgcgtccggttattagggagaaactctaatagcaagaggctgctgggttatgtggctaccttgaaagacaactttgggttcatcgagaccgcaaatcacgacaaggaaatcttctttcactatagtgagttttcaggagatgtcgacagcttggagctgggggacatggtggagtactccctaagtaagggtaagggcaataaagtttcagcagagaaagtgaataagacccactcggtgaacggaataactgaagaggccgatcctactatctacagtgggaaagtgatcaggcccctgaggtcagttgaccccacccaaactgagtatcagggtatgatcgaaattgtggaggaaggcgatatgaaaggggaggtgtacccttttggtatcgtcggaatggccaacaagggggattgcctgcagaagggggaaagcgtgaaattccaactgtgtgtgcttggtcagaacgcccaaaccatggcatacaatatcacaccactccggcgggccacggtggaatgcgtgaaagaccaattcggctttattaactacgaagtcggagattccaagaagcttttcttccacgtcaaagaggtgcaggacgggatagagctgcaggcaggggatgaggtcgaatttagcgtaattctcaaccagcgaaccggcaagtgcagcgcttgcaatgtctggagggtgtgcgagggtcctaaggcggttgcagcgcctcgccctgacaggcttgtgaacagattgaagaacatcacgctcgatgatgcaagcgctccacgcttgatggtgctgcggcagcctaggggccctgacaattccatgggcttcggggcagagcggaaaatccgacaagccggcgtgatagactag

SEQ ID NO: 183453 - DNA, 2535 bp, Artificial Sequence
  Description of Artificial Sequence: Synthetic coding sequence
atggagaacgtgttcaccgtgagcagcgacccccaccccagccccgccgcccccccttccctgagtctcccgctgagctcatccagtacttccagtgggactaagaagcagaagcggacgcctacatatcaacggtcgatgagtttcgacccaaatctccttcacaacaatggacataatggatatcctaacggcacgtccgctgcccttagggaaaccggggtaattgagaaactgctcactagctatggtttcattcagtgcagcgagagacaggcacgcctcttttttcactgctcacagtacaatggcaacttgcaggatctgaaggtgggagacgatgtcgaattcgaagtctcctcggatcgtagaaccggtaaacccattgctgtcaaacttgttaaaataaagcaggagattcttcctgaagagcggatgaacggccaggtggtctgcgccgtaccacacaatctggaatccaagtcgcccgccgcccctgggcagtcccctacaggatccgtatgttacgaacgtaacggcgaggtcttctacctcacatacacaccagaggacgtcgaaggcaatgtgcagttggaaaccggagataaaatcaatttcgttatagacaacaacaaacatacaggggcagtcagcgcacgtaatattatgctgctgaaaaagaagcaagcgcgatgccagggcgttgtatgcgcgatgaaggaggcattcggcttcatcgagagaggtgacgtggtaaaagagattttttttcattactccgaattcaagggagatctggaaacgctacagccaggggatgacgttgaattcactatcaaagaccgtaatggcaaagaggttgccaccgacgtgaggttgctgccccaaggtactgtgatattcgaggatatctccatagagcattttgaaggcacggtcacaaaagtaatccccaaagtaccaagcaagaaccaaaacgaccctttaccggggcgtatcaaggttgactttgttatcccgaaagagctgccctttggcgacaaagacacaaaatccaaggttacacttctcgaaggagatcacgtgcgttttaatatctcaacagatcgtagggataagttagaacgggctacgaacatagaagtgctcagtaacaccttccagttcaccaacgaggccagggagatgggtgtcatagcagcgatgcgggacggatttgggttcataaaatgcgtggacagggacgtcaggatgttctttcatttctctgagatactggacgggaaccagctacacatagccgacgaagtggagttcacagtcgtgccagacatgttgtcagctcaacgtaatcatgccatcaggatcaaaaaactgcccaagggcacagtgagctttcacagccactccgaccacaggttcctcggtaccgtggagaaggaagcaacgttctcaaaccccaaaaccaccagccccaacaagggtaaagaaaaagaagctgaggacggcatcatagcatatgatgactgcggggtgaagctgactatagctttccaggccaaagatgtagaaggaagcacttctccccagattggcgataaagtggagttctctataagtgacaagcagaggcctggccaacaggtggctacctgtgtgcgactcctcggccggaattctaattctaagagactgttgggctacgtggctacattgaaggacaacttcgggttcatagaaactgctaatcacgacaaggaaatcttcttccattactcagagttcagcggagatgttgatagtttagagcttggcgacatggtggagtacagtctatctaaggggaaggggaataaagtttccgccgaaaaagtgaacaagactcatagcgtgaacggtatcaccgaggaagcagaccccaccatttattctgggaaggtgatacgccccctgagatctgtcgacccgactcagaccgagtaccaggggatgatcgagatcgtcgaagaaggtgatatgaagggggaggtgtatccatttggtattgtgggaatggcaaacaagggtgactgcctgcagaagggtgagtcagtgaaatttcaactttgtgtgcttggccagaatgcccagacaatggcatacaacatcactcctcttaggagagctaccgtagagtgcgtgaaagaccagtttgggtttatcaactacgaagtcggggacagcaagaagctgttttttcatgtcaaagaggtgcaggatggcattgaactccaggccggagatgaggtggagttctcagtgatcctcaaccagcgcaccggaaagtgcagcgcctgcaatgtttggcgggtgtgcgagggccctaaagccgtggccgctcctaggcccgatcgactggtcaaccggctgaagaacatcacgttggatgatgcttcagcacctagactgatggtcttgcggcagcccagagggcctgacaatagtatgggtttcggggccgagcgcaaaattcgccaagccggtgtgatcgactag

SEQ ID NO: 183454 - DNA, 141 bp, Artificial Sequence
  Description of Artificial Sequence: Synthetic coding sequence
atgagcttcgaccccaacctgctgcacaacaacggccacaacggctacccaaatgggaccagtgccgccctccgagaaaccggagtcatagagaaactcctcacctcctacgggttcatccagtgcagcgaaaggcaatag

SEQ ID NO: 183455 - DNA, 24 bp, Artificial Sequence
  Description of Artificial Sequence: Synthetic coding sequence
atgagcttcgaccccaacctgtag

SEQ ID NO: 183456 - DNA, 2007 bp, Artificial Sequence
  Description of Artificial Sequence: Synthetic coding sequence
atgaacggccaggaggtgttctacctgacctacacccccgaggacgttgaggggaacgttcaactcgagactggcgataagataaatttcgtgattgataataataagcacacaggggccgtctctgctaggaacatcatgttgctcaagaaaaagcaggctcgttgccaaggcgtggtttgcgcaatgaaagaggctttcggcttcattgaacgaggcgatgtggtgaaagagattttctttcactacagcgaatttaagggtgacctggaaaccctgcagcccggagacgacgtggagtttaccattaaagaccgcaatggcaaggaagtcgccacagacgtgcgcctgctgccgcagggcactgtcattttcgaggatatcagcatagaacacttcgaagggactgtgacaaaggtgattcctaaggttccctcaaagaaccaaaacgatccactgcctgggcggattaaggtcgacttcgtgattccaaaggaactgccgtttggtgacaaagatacaaagagcaaagtaacattgctggaaggggaccatgtccgatttaacatctcgacggaccggcgcgataaactagagagggccaccaatatcgaagtccttagcaacaccttccagttcactaatgaagcacgcgagatgggggtcatcgccgcgatgcgggatgggttcgggttcattaaatgcgtcgacagggacgtgaggatgttctttcacttcagtgagatattggatgggaaccagctacatatagctgacgaggtcgagttcacagtggttcctgacatgctcagtgcacagagaaatcacgccattcgaatcaaaaagctacctaagggtaccgtatccttccattcccacagcgaccaccgcttcctcgggacagtggagaaagaagctaccttcagtaatccgaagactacctcacccaataagggaaaagagaaggaagctgaggatggaattatagcctacgacgactgcggggtcaagctgacaattgcatttcaggcgaaagatgtggaaggctccacatccccacagatcggcgacaaagtagaattctctatctccgacaaacagcggcctggacagcaggttgccacctgtgtccgtctcctcggtcgcaacagtaactccaaacgcctccttggttatgtggctaccctgaaggacaattttgggtttatcgagaccgctaatcatgataaagagatattctttcactacagcgagttctccggagacgtggatagcctggagctcggagacatggtggagtattccctgtccaagggaaaaggaaacaaggtcagtgccgagaaggtcaataagacccactctgtaaacggaattacagaggaggcagaccccacgatctactctgggaaggtaattaggcccctcaggtcggtggatcccacacagaccgagtatcagggaatgatagagattgttgaagaaggcgatatgaagggggaagtttacccatttggtatcgtgggcatggcaaacaagggggactgcctgcaaaagggggaatccgtgaagttccagttatgtgttctcggccaaaatgctcagactatggcgtacaatatcacaccacttagacgggcgacggttgaatgtgttaaggatcaatttggatttattaactacgaggtcggagatagcaagaaattgttctttcacgtgaaggaagtgcaggacggcattgaactccaagctggggatgaagtggagttttctgtgatactgaatcaacgaactggcaaatgttcggcatgtaacgtgtggagagtctgcgagggacccaaggctgttgccgcccctcggccggaccggttggtgaacagactaaagaatattaccctcgatgacgcctcagctcctaggcttatggttctgcggcagcccagaggccctgacaatagcatgggatttggcgcggaaaggaagattaggcaggccggggtgatagattag

SEQ ID NO: 183457 - DNA, 288 bp, Artificial Sequence
  Description of Artificial Sequence: Synthetic coding sequence
atgagcttcgaccccaacctgctgcacaacaacggccacaacggctatcccaacggaacctctgccgcgcttcgtgagaccggtgtgattgagaaactcttgacatcttatggctttatccagtgctcagaacggcaggcacgccttttttttcactgcagtcagtataacggaaatctgcaggacctaaaggtcggcgacgatgtggagtttgaggtttcgagcgacagacggaccggaaagccaattgcagtgaagcttgtcaagatcaaacaggaaatactgtag

SEQ ID NO: 183458 - DNA, 2397 bp, Artificial Sequence
  Description of Artificial Sequence: Synthetic coding sequence
atgagcttcgaccccaacctgctgcacaacaacggccacaacggctatcccaatggaacgtctgccgctttgagggaaacaggcgttattgagaagcttttgacatcctatggttttatccagtgcagcgagcgccaggcaagactgttcttccattgctctcagtacaacggcaatttacaagatcttaaagtgggtgatgacgtagagttcgaagttagttcagacaggcggacaggtaagcctattgctgtgaagctggttaagattaagcaggagatcctgccagaggagaggatgaacggtcaagtcgtctgcgccgtgccacacaatcttgaaagcaagagccctgcggcgcccggtcaaagccctaccggaagtgtctgttatgaacggaatggggaagtgttttatctgacgtatacacccgaagacgtggagggcaacgtgcaactcgaaacaggggacaagatcaactttgtgatcgacaataacaagcacactggtgctgtcagtgcaagaaacatcatgcttttaaagaaaaaacaggcccggtgccagggggtggtttgtgcaatgaaagaagccttcggatttatcgagaggggagatgttgttaaggagatattctttcactattccgagttcaaaggtgatctggaaaccctacagcccggcgacgatgtcgaattcacaattaaagacagaaatggcaaagaagtcgctactgatgtgcggttactcccacagggtaccgtcatctttgaagatatttccatcgagcactttgaaggtacagtcaccaaggttatacctaaggtgccttctaaaaatcagaatgatcctcttcctggccgcatcaaagtggacttcgtaatcccgaaggaactgcctttcggcgataaggatacaaagtccaaagtaacactactcgagggcgatcacgtgagatttaatatcagcaccgacaggcgggacaagctggagcgcgctacgaatattgaagttctgtccaatacatttcagtttaccaacgaagcccgtgagatgggggttatcgctgcaatgagagatggatttggcttcattaaatgcgtggatcgggacgtccgcatgttcttccacttcagcgagatcctggatgggaatcaactacatatcgcagatgaggtggaattcaccgtggtgccagacatgctctccgcccagagaaatcacgctattagaattaaaaaactccccaaggggaccgtctccttccactctcactccgaccaccgctttctcggtactgtggagaaagaagccactttctctaatcctaaaaccacctcacccaataaaggaaaggagaaggaagccgaggatggtatcatcgcatatgacgactgtggtgttaagctcaccattgccttccaggctaaggacgtcgagggttctacctctccccagatcggggataaggtagagttctcaatatctgataaacaacgtcccgggcagcaagtcgccacatgtgttagattgctaggacgaaattcaaattctaagcgactgctaggttacgtagccaccttgaaggataactttgggttcattgagactgcgaatcatgataaagagatatttttccactacagtgaattttccggggatgtcgatagcctggaactgggagatatggtagagtactccctgtccaagggcaaaggtaacaaagtttccgctgaaaaagtcaacaagacacacagcgtgaacggcatcacggaggaggctgatcctaccatttacagcggaaaggtaatacggcctctccgatccgtagacccaacccagactgagtaccagggcatgatcgagatcgtagaagagggagatatgaagggtgaagtgtatccatttggaatcgttggcatggccaacaagggagattgtcttcagaagggtgagagtgtgaagtttcagttgtgtgtgcttggacagaatgctcaaaccatggcatacaacattaccccactcagaagagctaccgtcgaatgcgtgaaagaccagttcggcttcataaattacgaagtgggcgacagtaagaagctgttttttcatgttaaggaggtgcaggacggaatcgagctgcaggccggggacgaagtggagttcagcgtgatactgaaccaacgaacaggtaaatgttcggcttgcaatgtctggagggtctgtgaggggcccaaagccgtggctgctccaagacccgatagactggtgaatcggcttaagaatatcactctggatgatgcctctgccccgcggttgatggtgctgcggcagccccggggacctgacaactctatgggattcggggccgagcgcaagatccgccaggccggagtcatcgactag

SEQ ID NO: 183459 - DNA, 1329 bp, Artificial Sequence
  Description of Artificial Sequence: Synthetic coding sequence
atggaggccagccggtgccggctgagccccagcggcgacagcgtgtttcacgaggagatgatgaaaatgcgtcaggcaaagctggactaccaacgcctactcctggagaagcgccagcgcaaaaagcgtctcgagcctttcatggtccagcctaatccagaggccaggcttcgccgggctaaaccaagagcttctgacgagcagacacctttggtgaattgtcatactcctcatagcaatgtgatactacatggcattgatgggcctgccgccgttttgaaacccgatgaggttcatgctcccagcgtaagcagctcagtagttgaggaggatgccgagaacactgttgatacggcgtcaaagcccggcttgcaggagcggctacagaaacacgacatctcagaatccgtgaattttgacgaagaaaccgacggaatctctcagagtgcctgcctcgagagaccaaatagtgcttccagtcagaactcaaccgatacgggtactagcggctctgctaccgctgcccagcccgcagacaaccttttgggggacattgacgacttagaggactttgtctattcccctgctccccagggggtgaccgtccggtgtagaatcatccgggataagagagggatggatcggggtctgttcccaacttactatatgtaccttgaaaaagaagaaaaccagaagatctttttactggcagcacggaaaaggaagaagtctaagaccgctaactatctcattagcatcgacccagttgatttgagcagggagggtgagagttatgttggaaagttgcgtagcaatcttatggggaccaaatttacggtgtacgaccgaggaatctgccctatgaaagggcgtggactggtaggtgcggcccataccagacaagagttggccgcaatctcatatgagactaacgtccttggcttcaagggcccacgcaagatgtctgtcattatcccgggtatgacgctcaatcacaagcagatcccatatcagccacagaacaaccacgatagccttctgtcccggtggcagaatcggacaatggaaaatctggttgaacttcacaacaaggctcctgtatggaattcagacacccaatcctatgtgcttaactttaggggccgcgtgacccaggccagcgttaagaacttccagattgttcataagaacgacccagactacatcgtgatgcagttcggcagagtcgctgatgacgtttttacgctggattacaactaccccctgtgtgccgttcaggcttttggcattggacttagttcgttcgattccaagctggcctgcgagtag

SEQ ID NO: 183460 - DNA, 912 bp, Artificial Sequence
  Description of Artificial Sequence: Synthetic coding sequence
atgagcgaggccggcgaggccaccaccaccaccaccaccaccctgccccaggcaccaacagaggccgcagcagctgcaccacaggaccccgcccctaagtcccctgtcggttccggcgcaccgcaggcagctgctcccgcccccgccgcgcatgttgctggcaaccctggcggcgatgccgctccagcggccactggaactgccgcagccgcctctttggcgacagccgcggggagcgaggacgcagagaaaaaagtattagctacaaaggtcttaggaaccgtgaaatggtttaacgttcggaatgggtacggttttattaaccgcaacgataccaaagaggatgtgtttgtgcaccagaccgcaattaagaagaacaaccctagaaagtatctcagatccgtaggggatggcgagaccgttgaattcgatgtcgtagagggggaaaagggcgcagaagctgctaatgttactgggccagatggagtgcccgtcgaagggagtcgctatgcagcagacaggcgcaggtacaggcggggatattacggccgcaggcgaggccccccccggaacgcgggcgaaatcggtgagatgaaagatggggtacctgagggcgcccagctgcaagggcccgtccacagaaatcctacctatcgcccccgctataggagtcggggtccgcctcgccccagaccggctcccgcagtgggcgaggctgaggataaagagaaccagcaagctaccagtggacctaaccagcctagcgtgcgccggggatataggagaccttacaactacagaagaaggccccgccctcccaacgccccctcccaggatgggaaggaggccaaggccggtgaagcacctaccgagaacccggcccccccaactcagcagagcagcgctgagtag

SEQ ID NO: 183461 - DNA, 339 bp, Artificial Sequence
  Description of Artificial Sequence: Synthetic coding sequence
atggagaagatcctgatcctgctgctggtggccctgagcgtggcctacgcggcccccgggcccagaggaatcatcatcaacctggaaaacggagaactgtgcatgaatagcgctcagtgcaagtctaattgctgccaacactcatccgctcttggtctggcccgctgtactagtatggcgtcagagaacagcgagtgtagcgtgaagaccctttacggcatctattacaaatgcccatgtgagcgagggctcacgtgcgaaggggacaagacaatcgtcggtagtatcacgaatactaacttcggcatctgccacgatgccggaagaagcaagcaatag

SEQ ID NO: 183462 - DNA, 216 bp, Artificial Sequence
  Description of Artificial Sequence: Synthetic coding sequence
atggagaagatcctgatcctgctgctggtggccctgagcgtggcctacgccgctcccggtccacgaggcatcatcatcaacctgaccctgtacggaatttactataagtgtccgtgtgagcgcggcctgacttgcgagggagacaaaactattgtgggcagtatcaccaacacaaatttcggtatatgccacgacgcagggagatcaaaacagtag

SEQ ID NO: 183463 - DNA, 408 bp, Artificial Sequence
  Description of Artificial Sequence: Synthetic coding sequence
atgcagctgacctgggccagcatcagcctggtgacccggtgctggccccaaacaccaacctttcaggacctgctagcctgtctaggtgcacgggcgctgccaggacctccaggtgcacctgggcgcgatgggagcaagggcgaaaggggagcccctggacctagaggaagtccaggaccgccagggtcattcgattttcttcttcttatgctggccgatatacgcaacgatatcactgagctccaggaaaaggtgttcggccaccgaactcacagtagcgccgaagaatttccacttccccaggagttcccatcctaccctgaggcaatggatctgggaagcggcgatgaccaccctaggcgcacagaaaccagagacctgagggctccacgagacttctacccctag

SEQ ID NO: 183464 - DNA, 1221 bp, Artificial Sequence
  Description of Artificial Sequence: Synthetic coding sequence
atggtgccccccccccccagccggggcggcgccgcccggggccagctcgggcgctctctcggaccgctgctcctgctcttggccttaggacacacgtggacttacagggaggaacccgaggatggggatcgcgagatctgcagcgagtctaagattgccaccactaaatatccatgcttaaaatctagcggggagctcactacatgttaccggaaaaagtgctgcaagggatacaaattcgtactcggtcagtgcatccccgaggactacgatgtttgcgccgaagccccttgcgaacagcagtgcaccgacaactttggtagagtactttgcacgtgctatccaggctataggtatgatcgagagcgccatagaaagagagaaaagccctactgccttgacattgacgagtgcgctagcagtaatggaaccctatgcgcccacatctgcataaacacactcggtagctacagatgcgagtgtcgtgagggctatattcgggaagatgacggaaaaacttgtaccagaggtgacaaatatcccaacgatacagggcatgaaaagagcgaaaacatggtaaaagcgggtacctgttgtgccacctgcaaggaattttatcagatgaagcaaactgtgcttcaactcaagcagaaaatcgcccttctgcccaataacgctgccgatctgggtaagtacatcactggcgacaaggttctcgcatccaacacatatctcccagggcctcccggtcttcctgggggacagggaccccctgggagcccggggccaaaggggtcacccggatttccaggcatgcccggccccccaggccagccaggccctcgcggtagcatgggacccatgggcccttcacctgacctgtctcacataaaacaggggcggagaggtcccgtgggcccacccggagcacccggcagggatggaagtaagggggaaaggggggctccaggcccaagggggagcccaggcccccctggtagctttgactttctgttgctcatgttggccgacattagaaatgacataacggagcttcaggaaaaagtgttcggccataggactcactctagcgctgaggaatttccactgccgcaggagtttcctagttatccagaggccatggatctgggatccggcgatgaccaccctcgcaggactgagacccgagacttgcgcgccccccgggacttctacccgtag

SEQ ID NO: 183465 - DNA, 699 bp, Artificial Sequence
  Description of Artificial Sequence: Synthetic coding sequence
atgtggccccccggccggagcatcaccgtgaagctgcgggagaagacagtgtcccgaaagctggagatgaatggtccaagcgcgtttcaggggctaatctgtggcaagtataacggcatgtgtctgcaagggccagcaggagtacccgggcgtgatggcagtcccggggctaacgggattcccgggaccccgggcatcccaggcagagatggtttcaagggcgaaaaaggtgaatgtctgcgagagtcatttgaagaatcctggactcctaattacaaacagtgcagctggagctccctgaattatgggattgatctcggcaaaatagccgagtgtacctttacgaagatgcggtccaattctgctctgagggtattattttctgggtcactccgcttaaaatgtcggaacgcttgttgccagcggtggtactttacctttaatggtgcagaatgctcgggtcctctcccaatcgaagccattatctacttagaccagggttccccggagatgaactcaactatcaacattcatcgtacctcaagtgtagaggggctttgcgaaggcataggagcgggacttgtggacgtcgcgatatgggtcggaacatgctccgattatccaaagggagacgcctctacaggctggaatagtgtgagtaggatcataattgaggagcttcctaactatctgttctag

SEQ ID NO: 183466 - DNA, 732 bp, Artificial Sequence
  Description of Artificial Sequence: Synthetic coding sequence
atgcggccccagggccccgccgccagcccccagcggctgcggggcttgctgctgctgctcctgttgcagctgcccgctccttcctccgcttccgagattcccaaaggcaaacagaaagcccagcttagacaacgcgaggtggtcgatttgtacaacggcatgtgcctgcagggtccagcaggagttccaggccgagacgggtctcccggcgccaacggtatccctgggacacccggaattccagggcgtgatggctttaagggagaaaaaggtgaatgcctccgcgagagcttcgaggagtcttggacacccaattataaacaatgctcatggagctctctgaactacggcatcgacctcggaaaaattgctgaatgtacttttacaaaaatgaggtcgaactcggcattgcgagtgctgttttcagggagcttgcggcttaaatgccggaatgcttgctgtcagaggtggtacttcacctttaacggagctgaatgtagcggtcccctgcctattgaggcaattatttacctggaccagggatctccagagatgaactccacgattaacatacacagaacttcatcagtggagggactctgcgaggggatcggagccgggctggttgacgtggcaatatgggttggcacgtgctcggactaccctaagggagacgcctcaaccggctggaatagcgtgtccaggataatcattgaggagctgcccaagtag

SEQ ID NO: 183467 - DNA, 690 bp, Artificial Sequence
  Description of Artificial Sequence: Synthetic coding sequence
atgtggccccccggccggagcatcaccgtgaagctgcgggagaagacagtctctaggaagctggagatgaatgggcccagcgctttccagggccttatctgcggcaaatacaatggtatgtgtctgcagggacctgcaggcgtgcctgggcgggacggatctccaggagctaacggcatcccagggaccccaggcatccctggcagggatgggtttaagggagagaagggcgaatgtctccgcgagtcctttgaggagtcttggaccccgaactacaaacagtgctcctggtctagcctgaactacggcatcgacctgggcaagatcgcagagtgcacatttactaagatgcgcagcaacagtgctctgagggtcctgttcagcgggagcctgcgcctgaaatgccgcaacgcctgttgccagagatggtactttacattcaatggcgccgagtgctccggacctcttccaattgaggcaattatctatcttgatcaggggtcaccagagatgaacagcaccataaatatacatcgcaccagctccgtcgagggcttatgcgagggcatcggcgctggcctggttgacgtagccatctgggtcggcacatgctccgactaccctaaaggcgacgctagtacagggtggaattcggtctctcgcatcattatcgaggagctccccaaatag

SEQ ID NO: 183468 - DNA, 5037 bp, Artificial Sequence
  Description of Artificial Sequence: Synthetic coding sequence
atgcaccccggcctgtggctgctgctggtgaccctgtgcctgaccgaggagctggctgctgctggggagaaatcttacggcaaaccctgcggcggtcaggattgcagtggttcttgccaatgctttccggaaaagggagctcgaggacggccaggacctattggcatccaaggcccaacgggaccacagggctttacagggtctaccggtttatcagggcttaaaggcgagaggggcttccccgggcttctgggtccctatggtcctaaaggtgacaagggtcccatgggagtccctggtttcttggggatcaacggtattcccggccatcccggtcaacccggccccagaggcccacccggattggacgggtgtaatggtacccagggcgcagttggctttcctggccccgacggctatccaggtctgcttggcccacctggactgcccggccagaaaggttccaagggcgatcccgtgttggctcccggatcctttaagggaatgaagggagatcccggcctgcctggcctggacggcatcaccggaccccagggagcccctgggttccccggcgccgtgggaccagctggccctccggggctccagggacctcctggccccccgggcccactggggcctgatgggaatatgggccttggttttcagggcgagaagggggtgaagggcgatgtaggactccccgggcctgcgggccccccccctagcaccggggaattggagttcatgggatttcctaaagggaaaaaagggagcaagggcgagcctggccccaaaggattcccgggaatctcgggcccaccaggcttccctggactcggcacaaccggagagaaaggcgaaaaaggggagaaagggatccccggattacccggcccccgggggccaatgggttcggaaggtgttcagggccctccaggccagcagggtaagaaagggacacttgggttcccaggattgaacggctttcaaggaattgagggtcaaaaaggtgacattggtctccccggtcccgatgtgtttatcgatattgatggggcagtgatctccggtaatccaggtgatcccggtgtgccaggccttccgggactcaagggcgatgagggaatccaaggcctccgggggccctctggtgtgcctggacttccggccctgagcggagtgcccggagccttaggaccacaagggtttccaggacttaaaggagatcagggcaaccctggcagaaccacaatcggagctgcaggactccccgggagggacggcctgcctggcccacccgggcctcccgggccaccctctcctgaattcgaaaccgagactcttcataataaggaatctggctttcctggactcagaggtgaacaggggcccaagggaaacttgggtctgaaaggaattaagggggatagtgggttctgtgcgtgtgacggcggagttcctaataccggtccccccggcgagccaggcccaccaggtccctgggggcttattggcctgcctggcctcaaaggcgcaagaggggaccgcgggagtggaggggctcagggcccagcgggggcacctggtttggtcggaccacttgggcctagcggccctaaaggcaaaaaaggtgaacccatactgagcaccatacaaggaatgccaggagatcgcggcgattctggcagtcaaggcttcaggggggttattggagagcctggaaaagacggggtccccgggcttcctgggctgccaggcttgcccggagacggtggacaaggatttcccggggaaaagggcttacccggactgcccggtgaaaagggccatcctgggccccctggcctgcctgggaatggcctccccggcctgcccggacccagaggcctgcccggcgacaaagggaaagatgggctccccgggcagcagggactgccaggttccaagggcatcactctgccttgcattatcccaggatcctacgggccaagcggattccctgggaccccagggtttccaggaccaaaagggtcacgggggctccccgggacgccaggacagcccggcagcagcgggtctaaaggggagcctggctccccaggcctggtacacctgccagaattgccaggtttcccgggaccacgcggggagaaaggacttcctggattccccggcctcccaggtaaggacggattaccaggcatgatcgggtcaccagggttgccagggagtaagggcgcaactggggacattttcggtgcagagaacggtgccccaggggagcaaggactccagggccttactggccataaaggattcctgggcgactctggcctgccaggcttgaaaggagtgcacggaaagcccgggctgctgggacctaagggtgagagggggagccccgggaccccaggccaggtcggccaaccagggaccccagggagcagcggtccatacggaatcaaaggaaaaagtggtctgcctggggctccaggattccctgggatctctggccacccagggaagaagggtaccagaggcaagaaggggccacctgggtcaatcgtgaaaaagggcctaccagggttgaaaggcctgcctggcaaccctggcttagtaggcctgaaggggtcccccggatcccccggagtcgctgggctccccgcgttgagtggtcccaaaggagagaagggcagtgtgggctttgtggggtttcccggtatccctgggctgccaggaataccgggcaccaggggtctgaagggcatccccgggagcacaggaaagatgggaccgagcgggagagctggcactccaggcgagaagggggatcgcggaaaccccggccctgtcggcatcccctctccccggagacccatgtcaaatctttggcttaaaggggacaaagggtctcaggggtccgcaggcagcaatggattccctggtccaaggggggacaaaggggaggctgggcgccctgggcccccgggactacctggtgctcccggtttacctggtattataaaaggagtctcagggaagcctggtcctccaggttttatgggcatccgcggattacctggactgaagggaagtagcggaatcaccggcttccccggcatgcccggggaatctggatcccagggcatcaggggttctcctggcctccccggtgcttctgggctgcctggcctgaaaggcgacaatggccaaactgtggaaatttctggaagccccggtcctaagggccagccgggagagagcgggttcaaggggactaagggtcgagatggtctgatcggaaacattggctttcccggcaataagggtgaggacggtaaagtcggtgtgtcaggtgacgttgggttgccaggcgctcccggattccccggtgtcgccgggatgcggggagaaccgggactccccggatcctctgggcatcagggcgcaatcgggcccctcgggagccctggtctgataggaccgaaagggttcccaggattccctggactgcacggcctcaatggactgcccggcacaaagggcacacacggtacccctggaccatccatcacaggggtgccaggcccagctggattacccggaccaaagggcgagaagggctatcctggaatcggaattggggcccctggcaaacccgggcttagggggcaaaaaggggaccgaggattccccggactgcagggtccagccgggctacccggcgccccagggattagcctcccctctctgatcgcaggccaaccgggcgatcccggtagaccaggattagatggtgagagaggccgcccaggcccggctggaccacccggcccccctgggccaagtagtaaccagggcgacacaggagatcccgggttccctggtatacctggattcagcgggcttccaggtgagctaggactgaaaggcatgagaggcgagccgggcttcatggggacccctggcaaagtcggccctcccggggatcccggcttccccggtatgaaaggcaaagcgggcccgagaggctctagtgggttgcagggagaccccggacagaccccgaccgccgaggccgtacaggtacctcccggccctctgggacttcccggcattgatggaatccctggcctaaccggagatcctggggctcaaggccctgtaggcctgcagggcagcaaaggcctccccgggattcccggaaaggatggccctagcggtctaccaggtccacccggcgcccttggggaccctggcctccccgggctgcaggggccccctggattcgagggcgcaccaggccaacaaggaccatttggcatgccaggcatgccgggccaatccatgcgagtgggctacactctggtgaagcattcacagtcagaacaggtgcctccttgtcccatcgggatgtcgcagctgtgggtggggtactccctcttgtttgtcgagggccaagaaaaggcccacaaccaagatctgggctttgccggctcttgcctacccaggttcagtaccatgccttttatctattgcaacatcaatgaggtgtgccactacgcgagaaggaatgataagtcttattggctttcaacgactgcacctattcctatgatgccagtgagtcaaactcagataccgcagtacatctcaaggtgtagtgtgtgcgaggccccctcacaagccattgcggtgcattctcaggacatcacaatcccccaatgcccactaggatggcggtccctgtggatcggatatagctttctcatgcacacggcggcaggagccgaaggaggcggccaatctttggtgagcccggggtcctgcctggaggattttcgagccacaccttttatcgagtgttccggtgcaagaggaacatgccactactttgctaacaagtattcgttttggctgacaactgttgaagagcgccaacagttcggggaactgcctgtgtctgagacactcaaagctggtcaacttcatacccgggtgtccagatgtcaggtttgcatgaaatcgctttag

SEQ ID NO: 183469 - DNA, 3087 bp, Artificial Sequence
  Description of Artificial Sequence: Synthetic coding sequence
atgcgggccgcccgggccctgctgcccctgctgctgcaggcctgctggacagctgcgcaggacgagcccgagacaccgcgggccgtggcatttcaggattgtcctgtggacctcttttttgtacttgacacgtccgaaagtgttgccttgcgactgaaaccttatggtgccctggttgacaaggtgaagagtttcaccaagcgttttatcgacaatctaagagatcgctattacaggtgtgatcggaacttagtctggaatgccggcgcgctgcattatagcgatgaggtggagattatccaaggcctgaccagaatgccgggggggcgggacgcgctgaaatctagcgttgacgccgtcaaatacttcggcaaaggcacttacacagattgtgccattaagaagggcctggaacagcttctcgttgggggtagccaccttaaggagaataaatacctgatcgtcgttaccgatgggcatccattagagggttataaggagccttgcggcggtctggaggatgcggtgaacgaggccaagcatttgggtgttaaggtttttagcgtggccatcacacctgaccacctggaaccccgcctctcaatcatcgctacagatcacacctaccgtcgaaacttcactgccgcggactggggccagtctcgggacgctgaagaggcgatcagtcagacaatcgacaccattgttgacatgataaagaataacgtggagcaggtgtgttgtagcttcgaatgccagccagcacgaggtccccccggtctccgaggtgacccagggttcgaaggcgaacgcgggaagccaggcctgccaggggaaaagggcgaagccggagatcctggcaggccaggggatttaggcccagttggctatcaggggatgaaaggagagaaggggagtaggggagagaagggatccaggggccccaaaggatacaagggtgagaagggaaagaggggcatcgatggcgtcgacggcgtcaaaggggagatgggttaccctgggctaccaggttgtaaggggtcccctgggtttgacgggattcaaggcccccctggacccaagggggacccgggtgcattcgggcttaagggggagaagggagaaccaggagccgatggcgaagctggtaggccagggtctagcgggccaagcggggatgaagggcagcccggtgagccaggcccgcccggggaaaagggcgaggccggtgacgaggggaatcctggcccagatggagcccccggagaaagaggtgggcccggcgaacgtggccctcgaggcactccaggcacaagaggtccacgcggggatccaggcgaggctggaccacagggcgaccagggacgggaaggccccgtcggggtgccaggggatccaggagaagccggtccaatagggccaaaggggtacagaggcgatgagggcccacctggaagcgaaggcgccagaggcgctcccggcccagccggccctcctggtgatccaggcctgatgggcgaaaggggagaggacgggcccgcaggcaatgggactgaggggttccctggattccccggatatcccggaaatcgcggggctcccggaatcaacgggacaaaggggtacccgggcctcaagggggacgagggcgaagcaggagaccctggggacgacaataacgatatcgccccaaggggcgtgaagggcgcaaagggctataggggtccagaaggcccacagggccctcccggccatcaggggccaccaggccccgacgaatgcgagatcctggacatcataatgaaaatgtgtagttgctgcgagtgcaaatgtggccctattgatcttctttttgtcttagacagctcagagtcaattggcctgcaaaatttcgaaattgcaaaagattttgtggttaaggtcattgaccggctgagccgcgacgaactggtgaagttcgagccggggcaatcttacgcaggcgtcgtccagtactcacatagccagatgcaggagcacgtgtcattgcgatccccgagcatcagaaacgtgcaggaattgaaagaggcaatcaaaagcctgcagtggatggcggggggcacgttcactggggaggctctccaatataccagagatcagttgttaccgccttcacctaataatcggatcgcattagtgattaccgatggacgaagcgacactcagcgagacaccactcctctgaacgttctctgtagtccaggaattcaagttgtgagtgttgggataaaggacgtgttcgacttcattcctggaagcgatcagctgaacgtcatcagctgccaaggcttagcaccaagtcagggcaggccaggcctcagccttgttaaggaaaactatgcagaactgctagaggacgcattcttgaaaaacgtaactgctcaaatatgcatcgataaaaagtgcccagactatacctgtcctataacattttcaagcccggctgatatcacgattctcctcgacggatcagcatctgttgggagtcataatttcgatacaactaagagatttgccaaacggttggcggagcggtttttgacggccggaaggacagatccagcccacgacgtccgggttgctgttgtccagtactccggcacaggccagcagcgtccggagcgagcgagcttacagttcctgcagaactatacagcattggcctctgcagtggacgccatggattttatcaacgatgcaactgacgtgaatgatgctctcggatacgtaacgaggttctacagagaagccagctccggcgctgcaaagaaaagactgctgcttttctccgatggtaatagccagggcgcaacccccgcagcaatcgagaaagcagtccaagaagcacagagagccggcattgagattttcgtagtggtggtgggccgacaggtgaatgagccacacatccgagtactcgttacgggcaaaaccgccgaatatgatgtggcatacggagaatctcatctgtttcgcgtgccctcctatcaagcactcttacggggggttttccaccagactgtttccaggaaagtagccctggggtag

SEQ ID NO: 183470 - DNA, 1770 bp, Artificial Sequence
  Description of Artificial Sequence: Synthetic coding sequence
atgcgggccgcccgggccctgctgcccctgctgctgcaggcctgctggacagcagcccaggatgagcccgagactcctagggctgtcgccttccaagattgtcccgtggatctctttttcgtgctcgatacctcggaatcagtggcacttcgtctcaagccatacggggcactggtggacaaagtcaagtcgtttacaaagaggtttattgacaacttgcgcgaccggtattacaggtgcgatagaaatctggtgtggaacgccggcgctctgcattattcagacgaagtggagattatacagggcctcacacggatgcctggcggtagggacgccctgaagagcagcgtggatgctgtaaaatatttcggtaaaggtacttataccgattgtgccattaagaaaggactcgagcaactcctagtcgggggctcccatcttaaggaaaacaagtacctgatcgtagtaactgacggacaccctctagagggctataaggagccctgcggtggtttagaggacgctgtgaacgaggctaagcacctgggcgtgaaagtatttagcgtcgctatcacccctgatcacctggagccacgactgtcaatcatcgccaccgatcatacgtatcggcgcaactttactgccgcagactgggggcaatcccgcgatgccgaggaagccatctcacagaccattgataccatagtagacatgatcaagaacaatgttgagcaggtgtgttgctctttcgagtgccagcccgcccgcggcccaccaggtctccggggagatcctgggtttgagggagagcggggcaagcccgggctgccaggcgagaaaggtgaagccggcgatccggggaggcctggggatcttggccccgtgggctatcaggggatgaagggcgagaagggctctcgcggagaaaaagggagtagaggtcccaaaggctataagggggagaagggtaaaagagggatagacggggtggatggggtcaagggtgaaatgggttaccccggtcttccaggctgtaaaggctctccggggttcgacggcattcaggggccaccaggccccaagggcgatcccggcgcatttggcctgaagggtgagaagggggaacctggcgctgatggagaggcaggtcgaccaggatcaagcgggccttctggagatgaaggccaacctggtgagccagggcctccaggtgaaaaaggggaagctggagatgaaggcaacccgggccctgatggtgccccaggggaaaggggaggcccgggagagagaggccccagaggtacacccgggacaagaggcccgaggggagaccctggggaggctggtccccagggggaccaaggtagggaagggcctgtgggagtgccgggtgatcccggcgaagccggcccgatcggcccaaaggggtaccgtggagatgagggccccccagggagcgaaggcgcaaggggggctccaggccccgcggggccgccaggagatcctggtttgatgggagaaaggggggaagacggcccagctggcaacggcacggagggcttcccaggtttccccggttatcctggaaacaggggggcccccggtatcaatgggacgaaaggttaccctggactgaagggcgacgaaggcgaggccggcgatcctggcgatgataacaacgatattgcccctaggctgctgagggtattgttggtgaccgggctcgaccttgggcctacagcactcgaagctgccgccgatcaacactag

SEQ ID NO: 183471 - DNA, 324 bp, Artificial Sequence
  Description of Artificial Sequence: Synthetic coding sequence
atgcgggccgcccgggccctgctgcccctgctgctgcaggcctgctggaccgcagctcaagatgagcctgagaccccacgagctgttgcctttcaagattgccccgtggatctcttcttcgtcctagatacatcagaaagtgtggctttgcgactcaagccgtacggcgcgttagtggataaagtcaagagtttcaccaaaagatttatcgacaatctgcgggatcgttactacagatgcgacaggaatctggtgtggaacgctggtgcattgcactactctgacgaggtcgagattattcaggggttaacccggatgccttag

SEQ ID NO: 183472 - DNA, 3060 bp, Artificial Sequence
  Description of Artificial Sequence: Synthetic coding sequence
atgctgcagggcacctgcagcgtgctgctgctgtggggcatcctgggagcaatacaagcccaacagcaggaggtgataagccctgataccaccgaacggaataacaactgtcccgagaaaacggactgtcccatccacgtgtatttcgtgctcgataccagcgaaagcgttaccatgcagtccccgaccgacattctcctcttccacatgaagcagttcgtgccccaatttatttcacagctgcagaacgaattttacctagatcaggttgctctttcatggcggtacggaggactgcatttttctgaccaagtcgaggttttcagcccacccggctccgaccgcgcttctttcatcaaaaatctgcagggaatcagcagtttccgccgcggcacctttactgattgcgctctagctaacatgactgaacagattaggcaagaccggagtaaaggcactgtccacttcgccgtagtcatcacagatggccacgtgactgggtcaccatgcggagggatcaaactgcaggccgaaagagcacgcgaggagggtatcaggctcttcgcagtggccccaaaccaaaacctgaaagaacagggtctgagagatatcgccagtaccccgcacgaactctatagaaacgattacgccaccatgctcccagacagcacggaaatcgatcaggatactataaatcggatcatcaaggtcatgaagcacgaagcctatggcgagtgttacaaggtgagctgtctggaaattcctgggcccagcggacccaagggataccgtgggcaaaagggggcaaaggggaatatgggggaaccgggcgaacccggccagaagggccggcaaggtgatccaggtatcgagggccccatcgggtttcccggccccaagggagtgcctggtttcaaaggagagaagggtgaattcggcgccgatggacgcaaaggagctcctggactcgctggtaaaaatggtaccgacggccagaagggcaagcttggcagaattggcccacccggctgtaaaggcgaccctggtaacagaggccctgacgggtacccaggcgaggcaggttcacctggtgagcggggtgatcaggggggtaaaggggacccaggcaggcccggtagacgcggtccacctggagagattggcgcaaaggggtcaaagggctaccaaggcaactctggcgccccaggtagtccaggcgtaaagggtgccaaaggcggccccgggcctagaggccccaagggtgagcccggaagacgaggagatccagggaccaagggaagccctggatctgacggacccaagggtgaaaaaggcgaccctgggcccgagggccccaggggtttggccggcgaggtgggcaacaagggggccaagggagaccggggactccctggccccaggggcccacagggcgcattgggcgaacccggtaagcaggggagccgaggggatccaggggacgccggaccccgcggggattccgggcagccaggcccgaagggggacccagggcggccaggttttagttaccctggacctaggggggcccccggcgaaaagggcgaacccggtcctagagggccagaaggggggcgcggggatttcggactgaagggggagcccggacgaaagggcgagaagggagagcctgcagatccaggaccgccaggagaaccgggaccacgcgggccccgtggggtaccaggccccgagggggagccaggacctcctggagatcccggtctgaccgaatgcgacgtgatgacatacgtgagggaaacctgtgggtgctgtgattgtgaaaagcgatgcggggctcttgatgtggtcttcgttatagattcctcagagagcattggatacaccaactttacactcgaaaaaaatttcgttatcaatgttgtcaaccgacttggagccattgccaaagaccccaagtccgaaacaggaacccgtgtaggagtagtgcagtactcacatgaaggaaccttcgaggcaattcaactagacgacgagaggatcgattctctgtcatcttttaaggaggccgtgaaaaatctagagtggatcgccggggggacctggaccccttccgcactcaagtttgcctacgaccgccttattaaagaatcgcggcgccagaaaacccgggtgtttgccgtagtgatcacagacggtagacacgaccctcgagacgatgacttgaacctgagagcgttatgtgaccgtgatgtgactgtcactgcgattgggattggagacatgtttcatgagaagcatgagagtgagaacctgtattccatcgcctgcgacaaaccacagcaggttcggaatatgacactgttcagcgatttggtggcagaaaagttcattgacgacatggaggatgttctttgccccgacccgcaaatcgtctgcccggatttaccatgccagacggagctgtccgtggctcagtgtacccagcgccccgtcgacatcgtcttcctgttagacggctcagaacgattgggagaacagaattttcacaaggcccggcgtttcgtagagcaggtggcccggcgcctaacactggctcgccgggacgacgaccctctgaacgctcgggtggctcttctgcagttcggaggacctggggaacagcaggtggccttcccactctcacacaacctcacggccatacatgaggccctagaaaccacgcaatatctgaactctttcagtcacgtcggcgccggcgtggtgcatgccatcaatgccatcgttagaagccctcgggggggcgcccgaagacacgcagagcttagcttcgtatttctgacagacggtgtgaccggtaatgacagccttcatgaatcagcccactccatgcgtaagcagaacgtcgtgcctacagtgctggccctgggatctgacgtggacatggatgtgctcactactctgagtctgggggaccgggccgcagtatttcatgagaaggactatgattctctggcccaacctggcttcttcgaccggttcatacggtggatttgttag

SEQ ID NO: 183473 - DNA, 2487 bp, Artificial Sequence
  Description of Artificial Sequence: Synthetic coding sequence
atgctgcagggcacctgcagcgtgctgctgctgtggggcatcctgggagcaatccaggcgcagcagcaagaagtaatttctccagatacgacagagcgaaataataactgccctgagaaaaccgattgcccaatccacgtttactttgtgctggatacatctgagtccgtgaccatgcagagccccactgatattctcctcttccacatgaaacaattcgtgccccagttcatcagccagctgcagaatgagttctatctagaccaggtcgctctgagttggcgatatggaggactccacttctcagaccaggttgaggtgtttagcccacctggctccgatcgggccagcttcattaaaaatctacaggggattagctcatttaggcgggggactttcactgattgcgcacttgcaaacatgaccgaacaaatacgccaggatcgctccaaaggtacagtacactttgccgtggtaatcacggatggccatgtgacgggttcgccctgtggcggcattaagttgcaggccgagcgggccagggaagaagggattaggcttttcgcggtcgcgcccaatcagaacctcaaggagcaaggcttgagggatattgcttctactccccatgaactttatagaaacgactatgctaccatgcttccagattctaccgagatcgatcaggataccatcaaccggatcattaaagtgatgaagcatgaggcatatggcgagtgctataaggtcagttgtctggaaatccccggccccagcggcccaaagggatatcgcggccaaaagggtgccaagggaaatatgggcgagccgggggagcccggccaaaagggacggcagggcgacccaggtatcgagggccctatcggctttcccggccccaagggcgtgcccggtttcaaaggggaaaagggagaatttggcgccgacggccgcaagggtgctccaggtttggccggtaaaaatggaactgacgggcaaaaggggaagttaggccgaattggcccgcctggctgcaaaggggatccaggcaatagagggcctgacggctaccccggcgaggctgggagcccaggggagcggggtgatcagggtggcaaaggagatcccgggagacctgggcggcgcggcccacccggggagattggggccaagggatcaaagggataccaaggcaactctggggccccagggtcccctggcgtgaagggagcaaagggtggaccaggccccagaggtcctaagggggaaccagggcggcgcggtgatcctggaacaaagggatccccaggatctgatggtcccaagggagaaaagggggacccaggcccagaaggaccacgcggcctcgccggcgaagttggcaacaagggtgccaaaggggaccgaggtctcccaggcccccggggcccacaaggcgcactgggggaacctggcaagcaaggatcccgaggtgatcccggcgacgccggccctaggggggactccggccaaccaggtccaaaaggggaccctggccgtcccgggttctcctatcctggacctaggggtgctcctggcgaaaaaggcgagccgggcccaaggggtccagaaggcgggcgcggcgactttggactcaagggagagccagggaggaaaggtgagaagggggagcccgccgaccccgggccaccgggtgaacccgggccccgtgggcccaggggcgtcccgggtcccgaaggtgaaccaggcccacccggcgacccaggactgacggagtgcgacgtgatgacctatgtccgcgaaacatgtggatgttgcgactgtgaaaagcggtgtggtgcgctcgatgtggttttcgttattgattcctcagaaagtattggatacactaattttactctggagaagaatttcgtaatcaatgttgtgaatagactcggcgccatcgcaaaagacccgaaaagcgagacgggcactcgggtcggcgttgtgcagtattctcatgaaggaacctttgaggccattcagctcgacgatgagagaatcgactctctgtccagctttaaagaggcggtgaagaatctggagtggatcgccgggggaacatggacaccctccgcactcaaatttgcatacgatcggcttatcaaggaaagtcgacgacagaagactagggtgttcgccgttgtgatcacagatggccgacatgacccccgcgacgacgatctcaatctgcgggcactctgtgaccgagacgtgacggtgaccgccattggcatcggcgatatgtttcatgagaagcacgagtccgaaaatctttattctatcgcatgtgacaagcctcaacaagtgcggaacatgactttgtttagtgacttggtggcggagaaattcatagatgacatggaagacgtgctctgccctgatccgcaaattgtgtgtcctgatctgccgtgccaaacgggactggatggcgccgtgttatgttag

SEQ ID NO: 183474 - DNA, 2757 bp, Artificial Sequence
  Description of Artificial Sequence: Synthetic coding sequence
atgctgcagggcacctgcagcgtgctgctgctgtggggcatcctgggggccattcaagctcaacaacaggaggttatttcacccgatactacagaacggaacaacaactgtcccgagaaaacagattgcccaattcatgtgtatttcgtcctggacacatctgagtcagtgaccatgcaatcaccgactgatattcttttgtttcatatgaagcagtttgtgccacagttcatctcccagctgcaaaacgagttttacctggatcaagtggcactctcttggcgctatggggggctgcactttagtgatcaggtggaagtcttttccccccccgggtctgaccgagcatcatttatcaaaaatttgcaggggatcagctcctttcggagaggcactttcaccgattgcgccctggcaaatatgacagaacagatccgacaggatcggagtaaagggacagtgcacttcgccgtggtcatcacagatggccacgtcaccggtagcccatgcgggggtattaaactgcaggctgagagggcgagagaggagggtatcagactctttgctgtggcacccaatcagaacctgaaggaacagggacttagagatattgctagcacccctcacgagttgtacagaaacgattacgcaacaatgcttcctgactcgacagagattgatcaggacactatcaacagaatcataaaggtgatgaaacacgaagcctacggcgagtgctataaagtgtcatgcttagaaatacctggccccagcgggccaaaaggctatagaggacaaaagggggcaaaagggaatatgggagagcctggagagccaggccagaagggtagacagggcgatccaggcattgaagggcccatcggctttcccggcccaaaaggtgtgcctggttttaaaggggaaaagggggagtttggcgcagacgggcgcaagggcgctcccggcctcgcgggcaagaacgggaccgatggccagaagggcaagttgggtcgtatcggaccgccaggctgcaaaggtgatcctggcaatcggggtcccgacggctatcctggcgaggcaggctctcccggcgagcggggcgaccagggtggaaagggggatccaggtcgtccaggccggcggggcccgccaggcgaaatcggcgcgaaagggtctaagggctatcagggaaactctggtgccccaggctcccccggagtgaagggagctaaaggggggccgggcccgcgcgggcccaagggggagcccggtaggagaggcgatcctgggactaaaggtagtccggggagcgacggtcccaagggcgaaaaaggcgacccagggcctgaaggaccaaggggtctcgccggtgaggtgggaaataaaggagctaaaggcgaccgcggcctgcccggacctaggggcccgcagggagcattaggggaacctgggaagcagggcagcaggggagaccccggtgatgcggggcctcgcggggatagcggccaacctggccccaagggagaccctggacggccaggcttcagctatccagggcctaggggcgcgcccggggaaaagggcgagccaggccccaggggcccagaaggcggaaggggcgacttcggcttaaagggcgagccaggcagaaaaggcgagaagggcgaaccggccgatcccgggccacccggtgagcccgggccacgtggacccaggggcgtcccaggccctgaaggggagcctgggccacctggggatcccgggctaacagagtgcgatgtcatgacgtatgtgagagagacttgcggatgttgcgactgtgaaaaaaggtgcggcgccctcgacgtggtgttcgtgatcgacagtagcgagtccatcggatacaccaattttaccctcgaaaagaatttcgtgatcaacgtcgtgaataggctgggagcaatcgctaaagaccccaagagcgagaccgggactagagtcggtgtcgtgcagtacagtcatgagggcacattcgaggcaattcagctggacgacgagaggattgacagtctgtcttcctttaaagaggccgtgaagaacctcgagtggatcgccgggggcacatggacccctagtgcattgaagttcgcttatgatcgactcatcaaggagtcacgtcgtcagaagaccagagtcttcgccgttgtgattacggacgggcgccacgatccacgtgacgacgacctcaacctgagggcactgtgcgatcgagacgtgaccgtgactgccataggtatcggcgacatgttccatgagaagcacgagagtgaaaatctttacagcatcgcttgtgataagcctcagcaggtgagaaatatgaccctattctctgatctggtggctgagaaattcatcgatgacatggaggatgtgctgtgcccagatccacagattgtatgcccagacttgccgtgtcagactgatgccccctggccagggggcgagccgccggtgaccttcctgagaacagaggagggaccggacgcaacgttcccccgtaccatcccgctaatccaacagctcctcaacgccacggaattgacccaggaccccgccgcatattcccagctggtcgcggttctagtctatacagctgagagagccaaatttgctacaggcgttgagaggcaagattggatggaattgtttattgacaccttcaaactggtccatagggatatagttggagaccctgaaacagccctggctttgtgctag

SEQ ID NO: 183475 - DNA, 2757 bp, Artificial Sequence
  Description of Artificial Sequence: Synthetic coding sequence
atgctgcagggcacctgcagcgtgctgctgctgtggggcatcctgggcgcaatccaagctcagcaacaggaggtgatcagcccagatactacggagcgaaataataactgtcccgaaaagacagactgcccgatccacgtctatttcgtccttgatacgagtgaatccgtgacaatgcagagccccacggatatcctccttttccacatgaagcagttcgtgccacagttcatctcccagcttcagaacgagttctatctggaccaggtcgcactatcgtggcgatacgggggtctgcatttcagtgatcaggtggaggttttttcccctccaggttctgaccgggcatcttttatcaagaacctgcagggaatcagtagcttccgacggggtacgtttacagattgtgcgctggcgaacatgaccgaacaaataaggcaagacaggagcaaaggtaccgtccactttgctgtggttatcactgacggccacgttaccggctcaccctgcggcggcatcaaactccaggctgagcgcgctcgggaagaagggattaggctgttcgcagtcgccccaaaccagaatctcaaggaacaaggactgcgagatatcgcaagtaccccacacgagctgtatagaaacgactacgcgactatgcttcccgactccacagagatcgaccaggacactattaataggatcatcaaggtgatgaagcacgaagcatacggtgagtgctataaggtttcctgtctggagatcccaggcccctcgggccccaaaggttatcgtggccagaaaggggctaaaggcaatatgggcgagcccggggaaccaggccagaaggggcgccagggcgatcccggtattgaaggacctattggattccctggccctaaaggggtgccaggattcaagggcgaaaagggagaatttggagctgatgggcgcaaaggagctcctgggcttgccggaaagaatggcacagatggacagaaaggcaagcttggccggatcgggcccccaggatgcaaaggcgaccccggcaatagagggcccgacggctaccctggagaagccgggtctccaggagagagaggggaccagggcggaaagggggatccggggaggcctggccgaagaggccccccaggagagattggggccaagggctccaagggataccagggaaatagcggggcaccggggtccccaggagttaagggcgcaaagggagggcccgggcctaggggtcccaaaggagagccaggacggagaggtgaccctgggacaaaagggagccctgggagcgatggcccaaaaggggagaaaggagaccctggacctgagggtccacgaggcctcgccggtgaggtggggaataaaggggcaaagggcgaccgaggtcttccgggacctcgtgggcctcagggcgcattaggggaaccagggaagcaaggaagcaggggcgaccctggtgacgcaggtccaaggggcgattcgggacagcccgggccaaagggcgatcccgggaggcccggtttcagttatccgggccccaggggagcccctggcgagaaaggagagcccggacccaggggaccagaggggggccgaggcgacttcgggttgaagggcgaacctggacgaaagggcgagaagggcgaaccagctgatcccggaccaccaggcgagcccggacctcggggcccccgaggcgtgccaggacccgaaggcgaaccgggccctcctggggacccaggcttaacggagtgcgacgtgatgacttacgtaagggagacatgtggatgctgcgactgtgaaaagcgctgcggagctcttgacgttgtcttcgtgattgactcctcggaatcaatcgggtatacgaattttaccttggaaaaaaacttcgtgatcaacgtggttaacagactgggcgccatcgccaaggatcccaaaagcgagacgggcacccgggtgggggttgtgcagtattcccacgagggcacctttgaggctattcagctggatgatgagcgcattgattcactgtcttcctttaaggaagctgtcaaaaatctggagtggatcgccggcggcacctggactccaagcgctcttaagtttgcgtacgatcgactaattaaagaaagccgccgtcagaagacacgggtcttcgccgttgttatcactgacgggcggcacgatccgagggacgacgatctcaatctcagagccctttgtgacagggacgtcacagtgaccgccataggaataggggacatgttccatgaaaaacacgaaagtgaaaatctctacagcattgcctgcgataaaccacagcaggtacgtaacatgacactctttagtgaccttgtggctgaaaagttcatcgacgacatggaagatgtgctttgtccagatccacagatcgtatgtccagatctcccatgccagacagacgccccctggccgggtggagagccacccgtaaccttcctcagaaccgaggaaggcccggacgccacatttccgagaacaatcccactaatccaacagttattaaatgcaacagaacttactcaggatcctgctgcgtattcgcagctcgtcgccgtccttgtgtataccgctgaaagagccaaatttgcaaccggagtcgaacggcaggactggatggagctgttcatcgatacttttaagcttgtccacagggatattgtaggggaccccgagacagccctggctttatgctag

SEQ ID NO: 183476 - DNA, 2487 bp, Artificial Sequence
  Description of Artificial Sequence: Synthetic coding sequence
atgctgcagggcacctgcagcgtgctgctgctgtggggcatcctgggcgccatccaggctcagcagcaggaagttatcagtcccgacacaactgaacgaaataacaactgtcccgagaagaccgactgtcctatccacgtctactttgttttggacacctccgagagcgtaaccatgcagtcccctacagatattctcctgttccatatgaaacagttcgtgccgcaatttataagtcaactccaaaatgagttctacctagaccaggtggcactgagctggcggtatgggggcctgcatttctccgatcaggttgaggtcttctcccccccaggttctgacagagcgtctttcattaagaatctgcaaggaattagttcatttcgcaggggcacctttaccgactgtgctcttgccaatatgactgaacaaatcaggcaggacaggtccaagggaacagtccacttcgccgtagttatcactgatggccacgtgaccgggtccccctgcgggggtatcaagcttcaagctgagcgcgctagggaggagggcattcgtctcttcgccgtggctccaaatcagaacctgaaagagcagggcttgcgggatatagcctccaccccacacgagctctatcggaacgattacgcgaccatgctccccgattccacagaaatcgaccaggatactatcaatagaatcatcaaggttatgaagcatgaagcctacggtgaatgttacaaggtgagttgcctagaaataccgggcccaagcgggccaaaggggtatcggggtcagaaaggcgctaagggcaacatgggggagcccggcgagcccggccaaaaggggcggcaaggtgaccctgggattgagggcccaatcggattccccggtccgaagggggtgccagggttcaaaggggagaagggggagttcggggcggacggcagaaagggggctcctgggctcgccggcaagaatggaactgacggccagaaaggcaagctgggcaggatcgggccacccggctgcaagggagatccaggaaaccgagggcctgacggttacccaggagaagcgggttcgcctggtgagagaggcgatcagggaggaaagggagacccaggaagacctggccggcggggtcctccaggcgagattggagccaaaggctcaaaggggtatcagggcaacagcggggccccaggatctccaggtgtcaaaggcgctaaaggcggacctggtccccgaggacccaaaggcgaaccaggcagacgaggagaccccggcaccaagggctctcccggaagcgacggtcctaaaggcgagaagggggacccaggccccgagggccctcgcggattggctggtgaggtaggtaacaagggcgccaagggcgacaggggacttccaggaccccggggaccacaaggcgctctgggcgagccagggaagcaggggtcccgaggagacccaggagacgcaggcccgagaggcgactctgggcagcccggccctaaaggggacccaggccgccccggtttctcatatccaggcccaaggggtgctccaggcgagaagggcgagcccggtcccagaggaccagaaggaggccggggagactttgggttgaagggagagccaggaaggaaaggcgagaaaggggagcccgctgatccaggacctccaggcgagcctggccctaggggcccaaggggggttcccggaccagagggcgagccaggcccccccggcgatcctggactcacagaatgcgacgtaatgacctacgtcagagaaacctgtggctgctgtgattgcgagaagagatgcggagctttggacgtggttttcgtgattgacagctccgagtccattggctacactaatttcactctggagaagaacttcgtcataaacgtggtgaacaggctgggcgccattgctaaggatccaaaatccgagacagggacccgcgtgggggtggtgcagtattcacacgagggcactttcgaggctattcagctcgacgacgaacgcattgatagcttgagctccttcaaggaggccgtgaaaaacttagagtggatcgccggcgggacctggacaccttcagcccttaaatttgcgtacgatcggctgattaaagagagtagacgtcagaaaacccgcgtgttcgccgtcgtcattacagatggtcgccacgatcctcgcgatgatgatctcaatttgcgggccttgtgcgaccgcgacgttaccgtgaccgccattgggatcggagacatgtttcacgagaaacacgagtctgagaatctgtactctattgcgtgcgataagccgcagcaagtccggaacatgactctcttctcagatttggttgcagagaaattcatcgacgatatggaggacgtcctgtgtccagacccccaaattgtctgccccgatctgccatgtcaaaccggactcgacggcgcggtgctgtgttag

SEQ ID NO: 183477 - DNA, 543 bp, Artificial Sequence
  Description of Artificial Sequence: Synthetic coding sequence
atgctgcagggcacctgcagcgtgctgctgctgtggggcatcctgggagccatccaggcgcaacaacaggaggttatttccccggatacgaccgaacggaacaataattgtccagaaaagaccgactgtccaattcacgtgtatttcgtgttggatacttcagagagcgtgacgatgcagagtcccaccgatattcttctgttccatatgaaacagtttgttcctcagtttataagccagctgcaaaacgagttctatttggaccaggtggccctgtcttggcgctacgggggtctccattttagcgatcaggtcgaggtgtttagcccacccgggagcgatcgcgcctccttcataaaaaatctgcaggggataagtagttttaggcgcggaactttcaccgattgtgccctagcaaacatgacggagcaaattcgtcaggaccggtctaagggaactgtacacttcgctgtggtcattaccgacggacatgtgactggctcaccatgtggaggcataaaattacaagcggaacgggcctag

SEQ ID NO: 183478 - DNA, 2235 bp, Artificial Sequence
  Description of Artificial Sequence: Synthetic coding sequence
atggccgtgctgcccggccccctgcagctgctgggcgtgctgctgaccattagcctgtcgtcaatccgcctgattcaggccggcgcatactatggcatcaagcccctgcctcctcagatccctccccagatgccaccccaaataccacagtatcaacccctcgggcagcaagtaccacacatgcctttagctaaggacggtcttgctatggggaaggagatgccccatctccagtacggcaaagaatacccacacctgccccagtatatgaaggaaattcagcctgcccctagaatgggaaaggaggcggtgcccaagaaaggcaaggagatccccctcgcctccctccgtggggaacagggacctaggggtgaacccgggcctcgaggccctcccgggcccccaggattacccggacatgggatccccggcatcaagggcaaaccaggtccccagggataccccggcgtcgggaaacctgggatgccaggcatgccgggaaagcccggcgctatggggatgccgggagccaagggcgaaatcgggcagaaaggcgagattggccccatggggatccccggcccacagggccctccaggaccgcatggcctgccaggaattggcaagccgggcgggcctggcctccctggtcagccagggccaaagggagatcgtgggcctaagggcctgccaggccctcagggcttacgagggcctaaaggcgacaagggctttgggatgcctggagcccctggggtgaaaggacctcccggcatgcatggcccgcccggccctgtggggctgccgggtgttggcaaaccaggggtgaccggctttcctggcccgcagggcccactcgggaagcccggtgctcctggagagcctggcccccagggaccaatcggggtgcccggcgtgcagggcccacctggtatccccggaatcggaaaacccggccaagacgggatccctggacaaccaggtttcccgggcggcaaaggggaacaaggcctgcctggtctgcccggtccccccggactgcctggcattggcaaacctggattcccaggcccaaagggcgatcgcggcatggggggtgtaccgggggctttgggaccacgcggcgaaaagggccccatcggtgcaccaggtattggcggccccccaggggaaccaggcctgcccggaatcccgggacctatgggcccacctggcgcgattggcttcccaggccccaaaggtgagggagggattgtggggccccaggggcctcctgggccaaagggcgagcccggactgcagggcttcccaggcaaacctggcttcctaggcgaagtaggccctccaggcatgagagggctgccaggacctattggtccaaagggagaggccggccagaaaggtgtccccggactcccgggggtgcccggcctgctggggcccaagggagagcccgggattccgggagaccaaggtctccagggccctccaggcattcctgggatcggcggacctagtggccccatcggaccacccggtatacctgggcccaaaggagaacccggtctaccagggcctcccggctttccagggatcggcaaaccaggtgtggctggtttgcacgggccccccggcaagccaggcgccctggggccgcagggacaaccaggcttgccagggcccccaggcccccccgggcctcctgggccaccggctgtgatgccccccacaccacccccacagggcgagtacttacccgacatgggcctaggtatagacggagttaaacccccacatgcctatggcgccaaaaagggtaaaaatgggggcccagcctacgaaatgccagccttcactgccgagttaacagcgccattcccccccgtgggtgcccctgtgaaatttaataaactcttgtacaacggcaggcagaactataaccctcagaccggaatcttcacatgcgaagtaccaggtgtgtactactttgcttaccatgtacattgtaagggaggcaacgtctgggtcgcccttttcaaaaacaacgagcctgtgatgtacacctatgacgagtataaaaaaggattcttagaccaagcatccggcagcgccgtgctcctcctccgccccggggatagagtttttctgcagatgccgtcagagcaggccgccggcctttacgctggccagtacgtgcactcaagcttctccgggtatttgctatatccaatgtag

SEQ ID NO: 183479 - DNA, 2235 bp, Artificial Sequence
  Description of Artificial Sequence: Synthetic coding sequence
atggccgtgctgcccggccccctgcagctgctgggcgtgctgctgactattagcctttctagtatcagacttatacaagctggggcgtactacggtatcaaaccgctacccccacagattcctccccagatgcccccccaaattcctcagtaccagcctttggggcagcaagtgccccatatgccgctggccaaagatggcctcgctatgggaaaggagatgcctcacctccagtatggcaaagagtatcctcatctgccacagtacatgaaagagattcagcccgcacctaggatgggaaaagaggcggttccaaagaagggaaaggagattcctctcgcatctctgcgtggcgagcagggtcctcgcggcgaacctgggccccggggcccacccggaccacctggcctgcctggtcacggcatcccaggcattaaaggtaagcctggacctcaggggtaccccggggtgggcaagcccggcatgccgggtatgcccggaaaaccgggggcaatgggcatgcctggtgctaagggtgagatcgggcagaagggagagatcgggccaatggggatccctggtccccaggggccacctggacctcacggactgcccggaatcggcaagccaggcggcccaggcctcccgggccagccaggtccaaaaggtgaccggggacccaaagggctcccagggccccaaggactacgaggaccaaaaggggataagggcttcggaatgccgggagccccaggggtcaagggcccccctggcatgcacgggccaccaggccccgtggggctgcctggggtgggtaagccgggagtcaccgggttccctggtcctcagggaccccttggcaaaccaggcgcccctggcgaaccgggaccacagggcccaatcggtgtcccaggcgtgcagggcccccccggcattcccggcattgggaagccaggccaggatggcatccccggtcagcccggcttcccaggaggcaaaggagagcagggccttcctggccttcctggacccccaggactcccaggaatcggcaagccgggcttcccaggcccaaaaggtgatcgcggcatgggaggagtaccaggcgccctggggcctcgaggcgagaagggtccaatcggggccccgggcattggtggtccacccggcgaacctgggcttcccggaatccccggaccgatgggcccgcctggagctattgggttcccgggacctaagggtgagggtggaattgtgggcccacaggggcctcccggacctaagggggaacccggcctgcagggattccccgggaaaccaggattcctcggcgaggtgggccctccaggcatgaggggacttcccggtccgatcggcccgaagggtgaggctggacaaaagggcgtacctggactgcccggagtgccaggtctgctggggcctaagggagaaccgggcattcccggcgaccaaggcctccaggggccaccaggcatccccggcataggggggccctccgggcctatcggtcctcctggcatcccgggacctaagggtgaaccggggctaccaggccctcctggctttccaggcattgggaagcctggtgttgccgggctccatgggcctcccgggaagccgggcgcgctgggcccccaaggtcagcccggactgcccggaccccctggtccccccggaccccctggtccaccggcggtgatgcccccaacccctccgcctcagggtgagtacttaccagacatgggcttgggtattgatggcgtcaagccccctcacgcctatggcgcaaaaaagggtaagaatggtgggcctgcatacgagatgccagcgtttaccgccgaactaacagcgccctttccgcctgtcggagctcccgtcaagttcaacaagttgctctacaacggaagacaaaactataatcctcagacaggaatcttcacctgcgaagtccccggtgtgtattactttgcctatcacgtgcactgtaaaggcggaaacgtctgggtcgccttattcaagaacaatgagccggtgatgtatacatatgatgagtacaagaagggtttcctggaccaggcctcaggctccgcggtccttctgctccggcccggagatagggtgttcctgcaaatgccctccgaacaggcagctgggctttatgccggacagtatgttcactctagtttctctggctatctcctgtatccaatgtag

SEQ ID NO: 183480 - DNA, 345 bp, Artificial Sequence
  Description of Artificial Sequence: Synthetic coding sequence
atggccgtgctgcccggccccctgcagctgctgggcgtgctgctgaccattagtctgagttccattagacttatccaagcgggagcgtattatgggataaagcccctgcccccgcagatacccccccagatgcctccgcagattccccagtatcaacccctagggcaacaggttcctcatatgccactggcaaaagacggccttgccatgggcaaagagatgccccacctccagtacggcaaagagtatccacatctgccacagtacatgaaagagatacagcccgccccccgaatggggaaggaggctgtaccaaagaagggaaaagagatccctctcgcctag

SEQ ID NO: 183481 - DNA, 2061 bp, Artificial Sequence
  Description of Artificial Sequence: Synthetic coding sequence
atggtggccgagcggacccacaaggccgccgccaccggcgcccgggggcccggagagctcggtgccccgggaacagtagcgctggtggctgctcgcgctgagaggggggcccgacttccttcacctgggtcctgcgggctgctgaccttggccctctgctctttggctttgagcctgttggcgcattttcgaactgcagaactgcaagctcgggttctgcgccttgaagccgagagaggggaacagcagatggaaaccgcgatcctgggacgagtcaatcagctgcttgatgagaagtggaagctgcattcacgccggcggcgtgaagctccaaaaacttctcctggatgtaactgccccccgggaccgcctggtccaacaggaagacctggcctgcccggagacaagggcgccattggcatgccaggccgcgtcgggtcgcccggcgacgcgggtctctccattatcgggccccggggccctcctggtcagcccggaactcgcgggttccccgggtttcccggacctatcgggttagacggaaagcccggccatcctggtccaaaaggcgacatgggactgacggggccgccaggacagcccggaccacagggtcagaaaggcgagaaaggccagtgcggagagtacccacatagacttttacccctacttaattccgtacgcctggctccaccccccgttatcaaaagacgaacattccagggagagcaatcacaagcctccattcagggcccacctggccctccaggccccccagggcccagcggccccctcggccaccctggactgcccggcccaatgggtcctcctggcttgccaggtcccccaggtcctaaaggcgacccaggtattcagggttaccatgggcgcaagggcgagagggggatgcccgggatgcccgggaagcatggagcaaagggagctccaggcatcgccgttgctggcatgaagggcgagcctggtattcccggtactaagggcgagaagggcgctgagggctctcctgggctgcccggcctgctggggcagaagggcgaaaaaggcgacgcaggtaatagcatcggcggcgggcgtggggaacctgggcctcccggtctcccgggcccccctggcccaaagggagaagctggcgtggacgggcaggttggccctcccgggcaacctggcgacaagggcgagaggggcgccgcaggcgaacaaggtcctgatggccctaagggttccaagggagaaccaggtaaaggagaaatggtcgactataacggaaatattaacgaggccctgcaggagataagaaccctggcactgatggggcccccggggctgccaggacagatcggccctccgggcgctcctggaatccctggacagaagggcgagatcggactccccggcccccccggacatgatggggaaaaaggccctcggggtaagccaggtgatatgggccccccgggcccacaaggcccaccaggtaaggatggaccccccggagtcaaaggtgaaaacggccatcccggcagccctggagagaaaggggaaaagggtgagacaggacaggctgggtcccccggtgagaagggcgaagcaggggagaaaggcaatcccggtgccgaagtgccagggctgcccggcccggaaggacctcccgggcccccaggtctccaaggcgtgcccggcccaaagggggaggctgggcttgatggcgcaaaaggcgagaaaggtttccagggtgagaagggggaccgtggtcccctgggcctgcctgggacacccggacccataggggtccctgggccagccggacccaaaggagaacgcggtagtaagggcgaccccggtatgaccgggcctaccggtgccgccggtcttccgggcctccatgggccccctggagacaagggtaatcgcggcgagagaggcaagaagggctccaggggaccaaaaggagataagggcgaccaaggggcgcccgggttggacgcaccttgtcccctgggcgaggacggattgcccgtgcaggggtgttggaataaatag

SEQ ID NO: 183482 - DNA, 1338 bp, Artificial Sequence
  Description of Artificial Sequence: Synthetic coding sequence
atgaccggcagcagcttcagcctggcccacctgctgatcatcagcggactcctgtgctattcggccggctgcctggcgttgcctagcctcgaccagaagaagaggggcgggcacaaagcctgctgcttgctcacacctccacctcctccccttttccccccacccttctttcggggtggccggtcccccctgctctcacccgacatgaaaaacttgatgctggagttggagacttctcagtccccttgtatgcagggctccctgggtagtccaggtcctcctggaccacagggaccacctggcttgcccggtaaaacaggtccgaagggagagaagggagagctcgggcggcccggcagaaagggccggcctgggcccccgggtgttccgggaatgcctggacccatcggctggccggggcccgaaggaccgcgtggagaaaagggggatcttggaatgatgggccttcctggcagtaggggtcctatgggctctaaagggtacccaggcagcaggggcgagaagggttctaggggcgagaagggggacctaggacctaaaggcgagaagggtttcccgggatttccagggatgttgggccagaaaggggagatggggccaaaaggggaaccagggatcgctggtcaccgaggcccaaccggccgaccagggaagcggggtaagcagggccagaagggggattctggtgtgatgggacccccaggaaaacctggaccatccggacagccaggacggccaggccctccaggacccccgcctgccggccagctcattatgggacccaaaggagaaagagggtttcccggccctccgggacgctgtctgtgtggtccaaccatgaatgtgaacaatccctcatatggagaatcagtctacggaccatcaagccctagagtgccagtgatatttgtagtgaataaccaggaagagctcgaacggttaaacacgcagaatgctattgcttttcgtcgcgaccagcggtctctttacttcaaggatagtcttgggtggcttccgattcaattgacaccattctaccctgtggattacaccgccgaccagcacggcacctgcggagatgggctgctacaaccaggggaagaatgcgatgatggtaattccgatgtaggggatgactgcattcgctgtcacagggcatattgcggcgatgggcaccgccatgaaggcgtggaagattgcgacgggtccgacttcggctacctgacttgcgaaacttatctgccagggtcttacggggacctgcagtgcacccagtactgctacattgactcgaccccctgccgctactttacttag

SEQ ID NO: 183483 - DNA, 876 bp, Artificial Sequence
  Description of Artificial Sequence: Synthetic coding sequence
atggtggtgctgaaccccatgaccctgggcatctacctgcagctgttcttcttaagcattgtatcccagcctaccttcatcaattctgtgctgcctatttccgctgctctgcccagtctcgaccaaaaaaagaggggaggacataaggcctgttgcctgctgacacccccccccccacctctattccctcctccctttttccgcggaggacggagtccactactctctcccgacatgaagaacctgatgctggagctggaaacctcccagtccccatgtatgcaggggagtctggggtcccccggaccccctggccctcaaggcccgcccggcctgccaggcaagacaggaccaaaaggcgaaaagggagaactggggcgtcccggccggaagggtcgccctggaccgccgggagtgcctggaatgccggggcccatcggatggccgggacccgaaggcccgcggggtgagaagggggacttgggtatgatgggcttgccagggagtcgaggccccatggggtccaaaggataccccggttcccgcggtgaaaagggtagtcgtggcgaaaaaggggacttgggcccaaagggcgaaaagggatttcccgggttccctggtatgctcggccaaaagggcgaaatgggcccgaagggcgaacctggaatcgcaggccacaggggtccaaccggccggcctggcaagagaggcaagcagtcatcacgcactccttgtaccttaccccggcgacctcccgtgccatgtggccaggggagcagatctccggtcactgtcgttgccgggaaggaatctcaagcttgcctgttgccgaggtttgaggaggattacattagtagcggaaccgaacgcggctag

SEQ ID NO: 183484 - DNA, 1266 bp, Artificial Sequence
  Description of Artificial Sequence: Synthetic coding sequence
atggtggtgctgaaccccatgaccctgggcatctacctgcagctgttcttcctctctatagtcagtcaacctactttcatcaactctgttctgcccattagcgccgccctgccaagtctcgaccagaagaagagagggggacacaaggcctgttgtctcctgacccccccacctccccccctgtttccgcctccattttttaggggcggaaggagtcccgggccccctggactgcccggcaagacaggtccgaagggtgagaaaggagagctgggacgccccggtcgcaaagggcggcccgggcccccaggggtgcccggcatgccaggaccaattggatggcccggtccggaaggtccacggggcgagaagggcgaccttgggatgatggggctacctggctctagggggccaatgggctccaaaggttatcccggctctcggggggaaaaggggtcccggggggagaagggcgatctgggaccaaagggggaaaaaggatttccaggctttcccggcatgctgggccagaaaggagaaatggggcccaagggtgagcctgggattgctggtcaccgcggcccaaccggccggcctggcaaaagaggtaaacaggggcagaaaggcgacagcggggtgatggggccaccggggaaacccgggccttccggacaaccaggcagaccggggccaccaggacccccacccgccggacagttgatcatgggcccaaaaggagagcgtggcttcccaggacccccaggcaggtgtctgtgtggccctaccatgaacgtgaacaacccgtcatatggggaaagcgtctacggtccttctagtccgcgcgtgcctgtaattttcgtggttaataatcaggaggagctggagaggctgaacacgcaaaacgccatcgcattccgcagagatcagaggagcctctactttaaagactctctcggttggctccccatccagctgacacctttctaccctgtcgactataccgccgaccagcacggtacctgcggtgacggtctgctgcaaccaggtgaagaatgcgatgacggcaattctgatgtgggcgatgattgcattcgctgccaccgcgcctactgcggtgacggtcataggcacgaaggggtcgaagactgcgatgggtccgacttcggctacctcacctgcgaaacatacctgccaggtagctacggcgatttgcagtgcacacaatactgctacattgactccactccgtgtcgatatttcacctag

SEQ ID NO: 183485 - DNA, 1341 bp, Artificial Sequence
  Description of Artificial Sequence: Synthetic coding sequence
atggtggtgctgaaccccatgaccctgggcatctacctgcagctgttctttctatctatagtctcccagcccacattcataaatagcgttctgccgatatctgctgccctaccttcgctggatcagaagaagcggggtggccataaggcctgttgcctgctaacaccacctcctccccccttgttcccccctccatttttccgcggaggccgatccccgctgctttcccccgacatgaagaacttaatgctggagctggagacatcccagtctccttgtatgcaaggaagtctcggttcacctggcccacccggaccacagggtcccccgggacttccagggaaaaccggacctaagggtgaaaaggggagaccgggtccgcccggtgtgcccggcatgcctggacctattgggtggccgggacccgaaggccccaggggagaaaaaggggacctggggatgatgggtcttcctggttcccgtggcccaatggggagcaaaggatacccagggtcccgtggtgagaaagggtctcgcggggagaaaggagatttaggccctaaaggggaaaaagggttccccggcttcccagggatgctgggccagaagggcgagatgggaccgaaaggagaaccaggaattgctgggcatcgcggacccaccggccggcctggcaagagaggtaagcaggggcagaaaggcgattctggggtgatgggtcctcccgggaaaccgggccccagcgggcagccagggcgccctggcccccctggcccccctcctgccggtcagctcatcatgggccccaagggtgagcggggattccctggtccgcccggcaggtgcctgtgtggaccaacaatgaatgtcaataatccttcatatggcgagagtgtctacggacccagctcaccaagagttcccgtgatttttgtggttaataatcaggaggagttggaacgccttaacacgcaaaacgcgatcgcctttcggcgggaccagcgctcactgtactttaaggactctctgggctggctgccaattcaattaaccccattctatcctgttgactacacagcagatcagcatgggacctgtggcgacggcctactccagcctggcgaagagtgcgacgatgggaactctgatgttggtgacgactgtattcgctgtcaccgggcttactgcggcgacggacatcgacatgaaggcgtggaggattgtgacggatctgacttcgggtatctgacctgtgaaacatatttgccgggcagttacggggaccttcagtgtacacaatattgttacattgacagtaccccctgtcgatacttcacatag

SEQ ID NO: 183486 - DNA, 1368 bp, Artificial Sequence
  Description of Artificial Sequence: Synthetic coding sequence
atggtggtgctgaaccccatgaccctgggcatctacctgcagctgttcttcttatccatagtatcacagcctacttttatcaacagcgtgctgccaatctccgctgctctaccatcactcgatcagaaaaagcgaggaggccataaagcctgttgccttctgactcccccgcctccccccttgttcccacctcctttctttcggggaggccgaagcccgttgctgtctcccgacatgaagaacttaatgcttgagctggaaacgtcccagtcgccctgcatgcaaggcagcctcggatcacctggccccccagggccgcagggtccacccgggctcccaggcaaaacagggccgaaaggagaaaagggcgaattagggagacccgggaggaagggcaggcctggtcccccaggggtcccagggatgccgggccccattgggtggcctgggcccgagggccctagaggggagaagggtgatctgggtatgatggggctacccggctcccgcggaccaatgggctccaagggctaccccggaagccgcggggagaaaggatctaggggcgagaagggagatctgggtccgaagggtgaaaaaggcttccctggcttcccgggcatgctgggacagaagggcgagatgggccctaagggggagcccggcattgcgggtcataggggacctaccggcagacctggaaaacgcggaaaacagggtcaaaagggcgacagtggggtcatgggacctccagggaaaccaggccctagtggccaaccaggccgccctggacccccgggccccccacctgccggacagctcattatgggtcccaaaggggagagaggattccccggacctccaggacgttgcttgtgtggccctaccatgaacgtaaacaacccttcctatggggagagcgtctatgggcccagtagtccgagagttccggtgatatttgttgtgaataatcaggaagagttagaacgccttaacacacaaaatgcaattgcctttcgtcgggaccagcggagtctttatttcaaagactcactgggctggctgccaatacaactgacaccattttaccctgtggactacaccgccgaccagcacggaacgtgcggagacggactcctgcagccaggagaggaatgcgacgacggtaactctgacgtcggcgacgactgtatcagatgccaccgtgcgtattgcggtgacggtcacaggcacgaaggagtcgaggactgcgacggttctgactttggctatcttacctgcgagacttacctacccggcagttatggcgatttacagtgcactcagtattgttacattgacagtacgccatgccgctacttcacgtag

SEQ ID NO: 183487 - DNA, 1338 bp, Artificial Sequence
  Description of Artificial Sequence: Synthetic coding sequence
atgaccggcagcagcttcagcctggcccacctgctgatcatcagcggtttgctctgttatagcgccggctgcctggctcttccctccttggatcagaagaagcgcgggggtcacaaagcctgctgcttactgacacccccaccgccccctttatttccaccaccatttttcagggggggcagaagcccgctcctcagtcccgacatgaaaaatctcatgcttgagcttgaaacctcccagtctccgtgtatgcaggggtccctcggcagtccaggaccgcctggcccccagggcccacccggtctgcccgggaagacagggccaaagggtgagaaaggtgagctgggtcgcccaggacgaaaaggcaggccaggacccccgggcgtcccagggatgccaggacccatcgggtggccaggaccagagggccccaggggcgagaagggggatctggggatgatgggcctccccggcagccgcggtcccatgggctccaaggggtatcccggcagcaggggcgaaaaggggtcccgcggcgagaaaggcgatctcgggcccaaaggcgagaagggctttcctggcttccccggcatgctgggccagaagggcgaaatgggccccaagggggagccaggcatagcgggacatcgtggccccacgggccgacctgggaaaagaggaaagcaagggcagaagggggactccggcgtaatgggaccccccggtaagcccggaccatctggtcagcccgggcgaccgggccccccaggcccacctccagcgggccagttgattatgggccctaaaggggagagggggtttcctgggccccccggacgatgcctatgcggacccaccatgaatgtgaataacccttcgtatggggagtctgtttacgggccctcttcgcctagggttcctgtgattttcgtagtgaataatcaggaggagctggaaagactcaatacgcagaacgctatcgcttttagacgagaccagaggtcactgtactttaaagactccttgggctggctgcctatccagctcacaccgttttatcctgtggactacactgctgatcaacatggaacttgtggcgatgggttactgcagcctggtgaggagtgtgacgacggcaattcagacgtcggagatgattgtatcagatgccacagagcctactgtggagatggccaccgccatgaaggggtggaggactgcgacgggtccgactttggatacttgacgtgcgagacctacctccccgggtcttacggtgatctccaatgcacccagtactgctacatcgattctacaccttgcagatatttcacctag

SEQ ID NO: 183488 - DNA, 585 bp, Artificial Sequence
  Description of Artificial Sequence: Synthetic coding sequence
atcagcggcctgctgtgctacagcgccggctgcctggccctgccctcattggaccagaagaagcgggggggccacaaagcttgttgccttttaaccccacctccccccccactttttcctccaccattcttccggggcggtagaagtcctgggcctcccggcctccccggcaagactggccctaaaggagaaaagggcgagttgggtagaccaggtagaaagggcaggcccgggcccccgggcgtgccaggaatgcccgggcctattggttggcccggccccgaaggcccacgtggagaaaagggtgacctgggaatgatgggtctgcccggcagcaggggtccgatgggctcaaaaggatacccagggtctaggggtgagaagggctccagaggagaaaaaggcgacctagggcccaaaggagaaaagggattccctggatttcccggaatgctcggacagaaaggagagatgggtccgaaaggtgaacccggaatcgcaggacaccgtggccccacaggaaggcctggtaaacgggggaagcagggccagaagggcgactcgggcgttatgggcccaccctag

SEQ ID NO: 183489 - DNA, 1338 bp, Artificial Sequence
  Description of Artificial Sequence: Synthetic coding sequence
atgaccggcagcagcttcagcctggcccacctgctgatcatcagcgggttgctgtgttactcggcgggttgcttagcgttgccaagccttgatcagaagaaacgcggcggtcataaggcttgttgtcttctcacgccaccacccccgcctctgttcccacctcctttttttagaggcgggagatccccccttctgtcccccgatatgaaaaatctcatgcttgagctcgaaactagccagagcccctgtatgcagggatccctcgggagtccaggccctccaggaccccaaggaccacccggactgccggggaaaacaggacctaaaggcgagaagggtgaactcgggcgacctggccgcaagggccggcctgggccgccaggagtacccggtatgccaggacccatcggttggccaggccctgagggaccaaggggtgagaagggggatcttgggatgatgggattaccaggaagcaggggacccatgggtagtaagggctaccctggtagcaggggggagaaaggttctagaggcgaaaagggcgacctaggtcccaaaggtgagaagtgtaacccattgctcctcttgttcccttctttccaaggtgagatgggccccaaaggggaaccgggcatcgccggacacagaggtcctacaggtagaccagggaagcggggcaaacagggtcagaaaggggacagcggtgtcatgggccctcccgggaaaccaggtccttctgggcagcccggtagacctggaccgcccggccccccacccgctggtcagttgataatgggccccaagggggaaagagggtttccaggacccccgggccgatgtctttgtggccctactatgaacgtcaataatccatcttatggagaaagtgtgtatggacctagttctccaagagtgccagtcattttcgtcgtgaacaaccaggaagagctggaacggttgaacacccaaaatgcaatagcgttcagacgtgaccagcgatccctatacttcaaagacagcctgggctggctgccaatccagctgacgcccttttatcccgttgattacactgctgaccagcacggcacatgcggcgacggcctactccagcctggggaggagtgcgacgacggtaactctgatgtcggagacgattgcatccggtgccacagggcttattgcggagatgggcataggcacgaaggcgttgaggattgtgacggatccgatttcggatatctgacctgcgaaacgtacctccccggctcctacggagacctgcagtgtacacagtattgttacatcgattcaacaccgtgcagatatttcacgtag

SEQ ID NO: 183490 - DNA, 2061 bp, Artificial Sequence
  Description of Artificial Sequence: Synthetic coding sequence
atggccgaccggcggcgggcctggaacaccgaggacgacctgcccgtctatctcgccagaccaggctcagccgctcagacccctcggcaaaagtacggaggcatgtttgctgcagtcgaaggggcctatgagaacaagaccattgacttcgacgcctactccgtgggccgtcgaggctcagcccggaccccgagaagtgcgggtagaccagacgcagtgggcctgcccgggccaggcggttctgaagacaccgcttccgacgtctccgaacctagtggctctgcggtgtcatcgcctggggagagagacgaacggcctcccaccctccgcatacggagaccagcaccccgagacctcccactgggcagagacaacgggcagtcggatcggctgttgatcaagggtggcaggatcatcaacgacgatcagtccctgtatgctgacgtctatctggaggacggactgatcaagcaaatcggagaaaatctgatcgtcccgggcggagtaaaaacgatagaggccaacgggaggatggtgatccccggaggaatagacgtgaacacttatctccagaagcccagtcagggaatgactgccgctgatgatttctttcaggggacaagagcagcactggtcggcggtacaacgatgataatagaccatgtcgttccagagcccggttccagcttactaacctcattcgaaaaatggcatgaggctgctgacactaagtcctgctgtgactacagtttgcatgtcgatattactagttggtatgacggggtgcgggaagaactggaagtcttagtccaggacaaaggagtcaactctttccaagtatatatggcctataaagacgtctatcagatgtccgattcccagctctacgaagccttcactttcctgaaggggctcggggccgtaatattagttcacgccgaaaatggggacctgatcgcccaagaacagaaaaggattctggaaatgggaataacgggccccgaggggcatgcattaagtcggcccgaggaacttgaggccgaagctgtgtttcgggcaataacaatcgccggacgcatcaactgtccagtatacatcaccaaagtgatgtcgaaaagcgcggcagatattattgccttggccaggaagaaaggaccattggtctttggggagcccattgctgcttccctcggcaccgacggcactcattattggagcaagaattgggcgaaagctgcagcattcgttacctctccacccctctcccctgatccaaccacacctgattacttaactagcctgttggcctgcggcgatttgcaggtgactgggtccggccactgtccatactcgaccgcacagaaggccgtggggaaagataactttactttaatacctgaaggcgtgaatggaatcgaggaaagaatgaccgtggtgtgggacaaagccgtggcgactggaaagatggacgaaaaccagtttgtggccgttacctcgactaatgctgccaaaatctttaacctatacccccggaagggaaggattgcggtcgggtccgacgctgatgtggtgatctgggatccggacaaactgaagaccatcacagcgaagagccataagagtgccgtcgaatacaacatctttgagggtatggagtgccatgggagcccgctcgttgtgattagtcaagggaaaattgtttttgaagacgggaatattaacgtgaataagggtatggggcggtttatcccacggaaggcctttccggagcatttatatcagagggtgaagatccggaacaaggtctttggactgcaaggcgtgtccagaggtatgtatgatggccctgtgtacgaggtgcccgccacccctaaatatgcaacccctgcccctagcgcaaaatcctccccgtccaagcatcagccacctccgatccggaacttgcaccagtcaaacttttcactgtctggagcccagatcgacgataacaacccacgaaggaccggacatcgtattgtagcccccccaggggggcggtccaatattacctcattggggtag

SEQ ID NO: 183491 - DNA, 1719 bp, Artificial Sequence
  Description of Artificial Sequence: Synthetic coding sequence
atgagctaccagggcaagaagagcatcccccacatcaccagcgacaggcttcttataaaaggcggtcgtataatcaatgatgaccaatcactttatgccgatgtgtatctcgaggacggcctaatcaaacaaattggggagaatctgatcgttcccggaggcgtcaagacgattgaggctaacggaaggatggttatccctgggggtatcgatgtgaacacctacctgcagaagccgtcacaggggatgactgctgcagatgattttttccagggaacccgggctgccctggtgggcggtacaactatgatcatcgatcacgtggtaccggagcccgggagtagcttgttaacttccttcgaaaaatggcatgaggctgccgacactaaaagctgctgcgattacagtttgcatgtggacattacatcctggtacgatggcgtgcgggaagagctggaggtgctagtgcaagacaaaggcgtgaattctttccaggtttatatggcatacaaagacgtctaccagatgagtgactctcagttgtatgaagctttcacgtttctaaaagggctgggcgccgtgatactcgttcatgcagagaatggcgatctgatcgcccaggagcagaaaagaattctggagatgggcattaccgggccagaaggtcatgcactgtcacggcctgaagaactagaggcagaggccgtgtttagggccataactatcgccgggcgcattaattgtccagtctatatcactaaggtaatgtccaaaagcgccgccgacataattgccttagctaggaagaaaggaccactcgtatttggtgaaccgattgctgctagcctgggtactgacggaacacactactggtctaagaattgggcaaaagctgccgccttcgtaacatccccacctttaagtcctgaccctacgacaccggattacctgacttctctgctggcttgtggtgacctccaggtgactggaagcggtcactgtccttatagcacggcacaaaaggccgtcggtaaggacaactttaccctcattccagaaggtgtaaacggaatcgaggaaaggatgaccgtcgtttgggataaggctgtggccacgggaaaaatggacgaaaatcagttcgtcgccgtgacgtctaccaatgccgctaagatctttaacctgtatcccagaaagggaagaattgccgtaggaagcgacgccgatgttgtcatctgggacccggacaagttgaagaccatcacagcaaagagccacaaaagtgcggtggagtacaatatcttcgaaggaatggagtgtcatgggtcacccctggtggttatcagtcagggcaaaattgtattcgaggatggtaacatcaacgttaataagggcatgggaagattcatcccacggaaggctttcccagagcacctctaccagcgggtgaaaatccgtaacaaggttttcggactgcagggggtgtctcggggcatgtacgatgggccggtgtacgaagtgccagccactcccaaatatgcaacccccgccccgagtgccaaaagctcgccctcaaagcatcagcctccccccatacggaatttgcatcagagcaacttttccttatcaggcgctcagatcgatgacaacaatccgcggaggaccggccatcgcatagttgccccccccggagggaggtccaacataacatcccttggctag

SEQ ID NO: 183492 - DNA, 1713 bp, Artificial Sequence
  Description of Artificial Sequence: Synthetic coding sequence
atgcagaagatgaacaacgaggtggtggacaagagcgaccggctgttgatcaaaggaggcaggatcattaatgatgatcaatccttgtacgccgacgtgtacctcgaagacggactgatcaaacaaattggcgaaaacctgatcgtgcctggcggtgtgaagactatcgaggccaacgggcgcatggtgattcctggcggaatcgacgtcaatacgtacctgcaaaaaccttcacagggaatgacggctgctgatgacttctttcagggcactcgcgccgccctggtaggtggtaccactatgatcatagaccacgtagtgcctgagcctggatcgtcccttctcacttcgtttgagaagtggcacgaagccgcagacaccaaatcctgctgtgattactcccttcacgtggatataacaagttggtatgatggagttagagaagaactggaagtgctcgtccaggataagggcgtcaattctttccaggtctacatggcctataaggatgtgtaccagatgagcgacagtcaactgtacgaggcctttactttcctcaaaggactgggggccgtgatcctggtgcacgccgagaatggtgatttgatagcccaggagcagaagcggatattagaaatgggtatcactggaccagaaggacacgcactgagtcgccctgaggagctcgaggcagaagcagtgtttcgcgccattactatcgctggacgcattaactgccccgtatacattaccaaagtcatgtctaaaagcgctgccgacatcatagcacttgctcgtaagaagggccctctggtttttggagaacccattgcagcgtccctgggcaccgacggtactcattattggagcaagaactgggccaaagccgccgcttttgttacttcaccccccttatcgccagatcccactacaccagactacctgacaagcctgctggcgtgtggtgacctacaggtaactggttccggccactgcccatactctaccgcacagaaagccgtgggaaaggacaatttcacgctcatacccgaaggggtcaacggcattgaagagagaatgactgtggtgtgggataaggccgtggccacgggaaagatggatgagaaccagttcgtcgccgtcaccagcactaatgctgccaagatattcaacctgtatcctcgaaaggggcggatcgccgtcggatcagacgcagatgtggtgatttgggaccccgacaaactgaagacgattacggccaagtctcataaatctgcagtggagtacaacatctttgaaggcatggagtgccatggcagccctttagtcgtgattagccagggaaagatcgtctttgaagatggtaacattaatgtgaacaagggcatgggaaggttcataccccgcaaggcattccccgaacatctgtaccagagggtgaaaatccgtaacaaggtttttggccttcagggcgttagtcgaggtatgtatgatggcccagtctacgaggtccccgctaccccaaaatacgccactccagcaccgagcgccaaatcatcaccttcaaagcaccagcccccacctatccggaatctgcaccagtccaacttcagcttgtcaggagcacagatcgacgataacaatccccgaagaactggacacaggatcgtggcaccacctggcggcagaagcaacattacttcccttggctag

SEQ ID NO: 183493 - DNA, 1719 bp, Artificial Sequence
  Description of Artificial Sequence: Synthetic coding sequence
atgagctaccagggcaagaagagcatcccccacatcaccagcgacagactgctcataaagggggggcgcataataaacgatgatcagagtctgtacgccgacgtctacctggaggacggactcataaaacagatcggagagaatttgattgtacccggcggggtgaaaacaatcgaggccaatggtcgcatggtgattcctggcggcattgatgtcaacacttacctgcaaaagccctcccagggcatgacagcagctgatgacttcttccagggtacacgggctgccctggtgggcggaacgacaatgatcattgaccatgtggtgcctgaacccgggtcttcgctgctcaccagcttcgagaagtggcacgaggccgccgacaccaagagctgctgtgactactccctccatgtggatatcacgtcgtggtatgacggtgtgcgcgaagagcttgaagtgttggtgcaggacaagggtgtcaatagctttcaagtgtatatggcatacaaagacgtctatcaaatgtctgattctcaactgtacgaggctttcacttttctcaaaggccttggggctgtgatcttggtgcacgccgagaacggggacctcatcgcccaggagcaaaagcggatactagagatgggcatcacgggcccagagggacatgccctgagcaggccagaggagctcgaggctgaagcggtcttccgggcgattacgatcgccgggcgaatcaattgtcctgtctacatcacaaaggtcatgtcaaaatccgccgccgatattatagccctggcacgaaagaaaggccccctagtttttggggaacctattgcagcctcgctggggacggatgggacccattactggtcgaaaaactgggctaaagccgctgcttttgtgacttccccacccctctcaccggatccgacgacgcccgattaccttacttctctgctcgcttgcggcgacctccaggttaccggatccggacactgcccttacagtaccgcccagaaagcagtgggcaaagataatttcactctgattccggaaggcgtgaatggaattgaggaaagaatgacggtggtatgggataaggccgttgccacaggcaagatggatgagaatcagttcgtggccgtgacctccacaaacgcagccaagattttcaatttgtatccaagaaaagggcgaatagcggtaggctcagacgctgatgtagtcatctgggacccggataagctaaaaacaattacggctaaaagccataagagcgctgtggagtataatatcttcgaggggatggaatgtcacgggagtccacttgttgtgatttcccagggcaaaattgtttttgaagatggaaatattaatgtgaacaaggggatgggccggttcataccgaggaaggcatttccagaacatttgtaccaaagggtcaaaatccggaacaaggtctttggcttgcagggcgtgtctcggggcatgtacgatggaccagtttatgaagtccctgcgacgccaaaatatgcaaccccagccccgtccgcgaagtcatcacccagcaaacatcagccccctcccatcaggaacctccaccagagtaacttttccctgtccggtgcgcagatcgatgacaacaaccctaggaggactggccatcgaatcgttgcacccccaggcggcagaagcaatataacaagcctgggctag

SEQ ID NO: 183494 - DNA, 834 bp, Artificial Sequence
  Description of Artificial Sequence: Synthetic coding sequence
atgaacggcttcgccagcctgctgcggcggaaccagttcatcctgctggttctttttctgctgcagatccagagtttagggcttgatatcgacagtagacccaccgccgaagtctgtgctacacatacaatctcacccggccctaagggcgatgacggggagaaaggagacccaggcgaggagggcaagcacgggaaggtcggtcggatgggccctaaagggataaagggggaactgggggacatgggagaccagggaaacattggcaagaccggtcccatagggaagaaaggggacaaaggggagaaaggcctcttgggcattccgggagagaaaggtaaggctggtactgtgtgcgactgcgggcgataccggaagtttgtcggccagctggacataagtatagccagactgaaaacaagcatgaagttcgtcaagaatgtgattgccggaatccgggaaaccgaggagaaattttattacatcgttcaggaggagaaaaattaccgcgagtcactgacccactgccgtattcgggggggaatgctggccatgcctaaagatgaagcagctaacactctcattgccgattatgtggctaagagcggtttctttagagtattcataggtgtgaatgatttagagcgcgaaggtcaatacatgtttactgataatacgcccctgcagaattattcaaactggaatgaaggcgagccgagcgatccgtacggccatgaggactgtgtcgaaatgttaagctctgggcggtggaatgataccgagtgtcatctgaccatgtattttgtttgcgaatttatcaagaaaaagaagtag

SEQ ID NO: 183495 - DNA, 807 bp, Artificial Sequence
  Description of Artificial Sequence: Synthetic coding sequence
atgacccccgccctgtgccggagcagcagcctggccagcaagggcatgagagagcggagggagaccaaagctcctccagacggcctggaggagtcagctccacgggaaaagaagcaatcccagcctgtcgtgacggctagtgacatttcaaaacggaagtgtacctctagtttcgtcgagatgggaagccagggcgacatgggcgataagggccagaaggggagcgttggacgccatggcaagatagggcccatcggctcaaagggggaaaagggggatagcggggacattggtccaccaggccctaacggcgaaccaggtctgccatgcgagtgtagccagcttcgcaaagcgattggtgagatggataaccaggtgagccagctgacgtcagagctgaagttcattaaaaatgcagtcgcaggagtgagggagaccgagtcgaaaatctacctgctagttaaggaggagaaaaggtacgccgatgctcagctctcctgccaggggagagggggcaccctgagcatgcctaaggacgaggccgctaatggactgatggctgcatacctcgcccaggcaggactcgccagagtgttcattggaatcaacgacctggaaaaggagggtgccttcgtttattctgaccatagtccaatgagaaccttcaacaagtggagatcaggggagccgaataatgcttatgacgaggaagattgcgtagagatggttgcgtctggtggatggaacgatgtcgcgtgccacacaacaatgtactttatgtgcgagttcgataaggagaacatgtag

SEQ ID NO: 183496 - DNA, 816 bp, Artificial Sequence
  Description of Artificial Sequence: Synthetic coding sequence
atgcggggcaacctggccctggtgggcgtgctgatcagcctggccttcttgagcctgcttccttctgggcacccccagccagctggtgatgacgcatgttccgtgcaaatcctggttccagggctcaagggcgacgctggtgagaaaggggataagggcgcgcctggccgacctggccgggtgggccccacaggcgaaaaaggcgacatgggagacaagggccaaaaggggagcgttggtagacatggaaagataggccctatcggctctaagggcgagaagggcgattctggcgatataggaccaccagggccgaatggagaaccagggctgccctgtgaatgctcccagttacgaaaagccattggcgagatggataaccaggtgagtcaattgacctccgaactcaagtttatcaagaatgctgtcgccggagtgcgcgagaccgagtcaaagatctacttgttagtgaaagaagagaagcgttacgcggacgcccaacttagctgtcaggggagaggagggacgctcagcatgcccaaggacgaagccgccaatgggttgatggcggcgtatctggcccaggcaggcttagccagagtgtttatcggtataaacgatttggaaaaggagggggcctttgtttattccgatcatagtcccatgcgaactttcaacaagtggcgatccggcgaaccaaacaacgcctacgacgaagaggattgcgttgagatggttgcctctggcggctggaacgatgtagcttgtcacaccaccatgtatttcatgtgcgaattcgataaggagaacatgtag

SEQ ID NO: 183497 - DNA, 744 bp, Artificial Sequence
  Description of Artificial Sequence: Synthetic coding sequence
atgcggggcaacctggccctggtgggcgtgctgatcagcctggcctttctttccttactgccgagcggacatcctcaaccggctggagatgacgcctgttccgttcagattctggtacctggcctcaaaggcgatgctggggaaaaaggcgataagggcgcccctggtcgcccaggaagagtgggccccactggtgagaaaggcgaaaaaggggacagcggggacatcggacctccaggccccaacggggaaccagggttgccttgtgagtgctcccagctgagaaaagctatcggtgaaatggataatcaggtgagccagttgacttccgagttgaagttcatcaaaaacgccgttgcaggcgtgagggagaccgagagtaaaatatacctgctggtgaaggaggagaagagatatgcagacgcgcaactgtcttgtcagggccgggggggcacactgagcatgcccaaggacgaggctgccaatggtttaatggccgcttacttagcccaggctggtttggccagggtcttcattggtataaatgatctggagaaggagggcgccttcgtgtacagcgatcatagcccaatgcgcaccttcaataaatggcggagcggggaacccaataacgcctacgacgaagaagattgcgttgagatggtcgcatctggaggctggaacgatgtcgcctgccataccacgatgtacttcatgtgtgagtttgacaaagagaacatgtag

SEQ ID NO: 183498 - DNA, 858 bp, Artificial Sequence
  Description of Artificial Sequence: Synthetic coding sequence
atgaagaagcagcggggcgtgggcgtgctgcccgccctgcggatgcgtgggaacctcgctttggtcggagttttaattagcctcgcgtttttgtctttacttcccagtggacaccctcaacccgccggggatgatgcctgttccgtgcagatcttggtcccaggcctgaagggcgacgccggtgagaaaggggataagggagctcccgggaggccaggaagggtggggccgactggtgaaaagggcgacatgggcgataaaggtcagaaggggagtgtcggccgtcatgggaagatcggcccaatcggttccaagggcgaaaaaggggactccggtgacattgggcctcccggcccaaatggagagccaggcttaccatgcgagtgttcacagttaaggaaggcaattggagagatggataatcaagtcagtcagctgacctctgagctcaagtttataaagaacgccgtagctggggtgcgagaaaccgagtctaagatctatctgctggtgaaagaagaaaaacggtatgccgacgctcaattatcctgccagggccggggaggaactctgtcaatgcctaaggacgaggcagcaaacggactgatggccgcctatctggcccaggcggggctggctagagtgttcatcggcattaacgacctggagaaggaaggagccttcgtgtactccgatcactctcccatgcgcacgttcaacaaatggaggagcggggagcccaataacgcctacgacgaggaggactgcgtcgagatggtggcttccgggggatggaacgatgttgcctgccatactacgatgtacttcatgtgtgagtttgataaggaaaacatgtag

SEQ ID NO: 183499 - DNA, 666 bp, Artificial Sequence
  Description of Artificial Sequence: Synthetic coding sequence
atgtggtgggtgccccccagcccctacggctgcctgccctgcgccctccccggcgatatgggcgacaaggggcaaaaaggcagtgtcggccgccacggaaagatcggccctattgggtcaaagggggaaaagggcgactcaggcgatataggcccacccggccctaacggggaacctggtctgccttgcgaatgtagccaactccggaaagctattggcgagatggacaatcaggtgtctcagcttactagcgagctaaaatttatcaaaaatgctgtggcaggagtccgggaaacagagagcaaaatctacctcctggttaaagaagagaaacgatatgcagatgctcaactttcctgtcaaggtcgtggaggcacactgagtatgccaaaagatgaggcagcaaacgggctgatggccgcatacctcgcccaggccggtttggcgcgcgtttttattggtatcaatgatctggagaaggaaggagcattcgtgtactcagatcactcgccaatgcgtacttttaacaaatggcgcagcggagagccaaacaacgcatacgacgaggaagattgcgtggagatggtggccagcggcgggtggaacgacgtggcgtgtcacactacaatgtattttatgtgcgagttcgacaaggagaatatgtag

SEQ ID NO: 183500 - DNA, 666 bp, Artificial Sequence
  Description of Artificial Sequence: Synthetic coding sequence
atgtggtgggtgccccccagcccctacggctgcctgccctgcgccttaccaggcgacgccggggagaagggtgacaagggcgcgccgggcaggccaggacgtgtcggacccaccggcgagaaaggcgagaagggtgacagcggggacattggacctcctggcccaaacggggagccagggctcccatgcgagtgctcacagctccgcaaagccattggcgaaatggataaccaggttagtcagctgacgtctgagcttaagttcatcaagaacgcggtcgctggagttagggaaacggaatcaaagatttaccttttagtgaaagaagaaaaaaggtacgccgatgcacagctttcctgtcaaggcagagggggaacactttccatgccaaaggatgaggcggctaacgggcttatggctgcgtaccttgcccaggcaggactcgcccgcgtctttatcgggatcaatgacctggaaaaagaaggagcttttgtttactctgaccattctcccatgcgtacgttcaataagtggcgcagcggagaaccaaacaatgcctatgacgaagaagattgcgtggagatggtggcctcaggcgggtggaacgatgtggcatgccatacgacaatgtatttcatgtgtgagttcgataaggaaaatatgtag

SEQ ID NO: 183501 - DNA, 594 bp, Artificial Sequence
  Description of Artificial Sequence: Synthetic coding sequence
atgtggtgggtgccccccagcccctacggctgcctgccctgcgccctccccggcgaaaaaggagatagtggtgacataggccctccaggacctaacggcgagccgggcttgccctgtgaatgtagtcagcttcgcaaagctattggagagatggacaaccaggtgtctcagctcacctccgaactcaagttcatcaagaatgccgtagccggagtgcgagaaacagagtccaagatctatcttttggtaaaagaggaaaaacggtatgccgacgctcagctgtcttgccagggccgagggggcacgctgtccatgccgaaagacgaggcagcaaacggcttgatggccgcgtacctagctcaggccggcctggcgagagtgttcatcggcatcaacgacttggaaaaggaaggagcctttgtgtatagtgatcactctcccatgcggacctttaacaaatggaggagcggagaacctaacaacgcctacgatgaggaggactgtgtcgagatggtcgcctctggcggctggaatgacgtggcatgtcacacaacaatgtacttcatgtgcgagttcgacaaggagaacatgtag

SEQ ID NO: 183502 - DNA, 2229 bp, Artificial Sequence
  Description of Artificial Sequence: Synthetic coding sequence
atgaaggacgacttcgccgaggaggaggaggtgcagagcttcggctacaagcgattcggtatccaggagggaactcagtgcaccaaatgtaaaaataactgggcgctgaagttttctatcattctgctgtacatcctgtgcgctctgctgaccatcactgtagcgatcctgggatataaggttgtcgagaagatggacaacgtgaccgggggaatggaaacctccagacagacatatgacgacaaattaacagccgttgagtccgatctcaaaaagctgggcgatcagacgggaaagaaagcaatctccactaactccgaactcagcaccttcagaagcgacattctcgacttaagacagcagctccgcgagataacagagaagacttcaaaaaataaggacactcttgagaaattacaggcatccggcgacgctctggttgaccggcagagtcagctgaaggagacattggagaacaatagcttcctgatcactactgtcaataagaccttgcaggcctataatggatatgttactaatttgcagcaagatacaagtgtgctgcaaggtaacctgcagaaccaaatgtattctcacaatgtagtgattatgaacctgaacaatctaaacctgacccaggtccagcagcgcaatctaatcacaaacttgcaacggtcagtggatgacactagtcaggctatacagcggatcaagaacgatttccagaacctccagcaagtatttttgcaggctaagaaagataccgattggcttaaggagaaggtgcagagccttcaaaccttagcagcgaataacagcgccctcgccaaggcaaataacgatactctcgaggacatgaatagccagctgaactctttcacggggcagatggagaacataaccacgattagccaggccaatgagcagaacctcaaggatctgcaggatctgcataaggatgccgagaaccggactgcaataaagtttaatcaactggaggagagatttcagctttttgagacagacatcgtcaacatcatttctaacattagctataccgcgcatcacctgcgcacactgacgtccaacctcaatgaagtccgcactacatgcacagatactctaaccaagcataccgacgacctgacatcactcaataacacactggccaacatcagactggactctgtgtccctccgaatgcagcaagaccttatgaggtcacgcctggatacagaggtggctaacctcagtgtgatcatggaggagatgaagctcgtggactcaaaacatggtcaactaatcaagaattttactatcctgcaaggccctccaggtccgcggggaccccgaggggacaggggctcacaagggccccccgggcctactgggaataaaggacagaaaggggagaaaggagaaccaggcccccctgggccagctggagagaggggcccgattggacccgccggcccgcctggcgaacgcggaggcaaagggtctaaggggtctcaaggcccaaagggatccaggggcagccctggtaaaccaggtcctcaggggtccagtggagaccccggccctcctgggcctccagggaaggaagggcttcctggaccacaggggcctcccggcttccaggggctgcagggaaccgtcggtgaacccggcgtgcccggaccaaggggtttaccaggcctccccggagttcctggaatgcccggccccaagggtcccccgggtccgccaggcccttctggagccgtggtccctttagccctgcagaacgagcctacccccgctccagaggataatgggtgtccaccgcattggaaaaacttcacagataaatgctattacttttcggtggagaaggaaatatttgaggacgcgaagctgttttgcgaagataagtcctcccaccttgtgttcatcaatacaagagaggagcagcagtggatcaaaaagcaaatggtgggcagagagtcacattggatcgggctcacggactccgaaagagagaacgaatggaagtggctagacggaacttcacccgattataagaattggaaggccgggcagccagacaactgggggcatggacatggccctggggaagactgcgcgggtttaatatacgcgggacaatggaacgattttcagtgcgaggatgtcaacaattttatctgcgagaaggatagggagactgttctctcctcagcactgtag

SEQ ID NO: 183503 - DNA, 2919 bp, Artificial Sequence
  Description of Artificial Sequence: Synthetic coding sequence
atgggccccggcgtgctgctgctgctgctggtggccaccgcctggcacggccaaggaatccccgtcattgaaccctccgttcccgagctcgtcgtgaaacccggggctaccgttacacttcgctgcgtgggaaacgggtcagtcgaatgggatggcccacccagtccccattggactttgtacagcgatgggtcctccagtattctgagcacaaacaacgctacgttccagaacaccgggacatatcggtgtaccgagccgggagaccctttggggggatcggctgcaatccatctgtacgtgaaggatcccgctagaccatggaacgtcttggcacaggaggtggttgtcttcgaggaccaggatgcattgctgccctgcctgttaacggatcccgtgttggaggcaggcgttagcttggtccgagttaggggacggcccttgatgaggcataccaattacagttttagcccatggcacggattcactattcaccgggccaagtttatacagtcgcaggattatcaatgttccgcactgatgggaggtaggaaagtgatgtcaatctctatccgattgaaagtgcagaaggtaattcccggaccacccgctctgactctggtgccggccgaactggtacgcatacgtggtgaagccgcacagatcgtatgttctgcctccagtgtggacgtgaattttgacgtgtttttgcagcataacaacactaaactagccatccctcaacaatccgattttcataacaacagatatcagaaagtgctcactctgaacttggatcaggtggattttcagcatgccggaaattattcctgcgtggcctcaaatgttcagggaaagcacagcacgtctatgttcttcagagtggtggagagtgcctaccttaacttgagctctgagcagaatctgattcaagaggttactgtaggcgaggggcttaacttgaaggttatggtggaagcttatccaggtctgcagggatttaattggacatatttaggccctttctcggatcatcaacctgagccaaaactggcaaatgccaccaccaaagatacgtacaggcacacatttactttgtctctgcctaggttgaagccttccgaggccgggcggtactcttttttggctcggaacccagggggatggcgcgctcttacgttcgagctcacactgaggtatccgcccgaagttagtgtgatttggacctttatcaatggctctggaaccctgctgtgcgcggcctctgggtatccccagccaaatgttacatggttacagtgcagtgggcacaccgatcggtgtgatgaggcccaggtgctccaggtttgggatgatccatatcctgaggttctcagccaagagccatttcacaaagtgaccgtgcagtcgctcctgacagtcgagacgctggaacataaccagacatacgagtgtagagcccataactctgtgggctccggaagttgggctttcatccctatttctgccggggcccatactcacccccctgacgagttcctcttcacccccgtcgtcgtggcatgtatgagcattatggctctcctgctgctcctgctgctgctgcttctgtataaatataagcagaagcccaagtatcaggtgaggtggaagatcattgagagctacgaaggaaacagctatactttcatcgatcccacccaactgccttacaacgaaaagtgggagtttcctcgaaataacctccagtttgggaaaacccttggggccggagcttttggtaaggtcgttgaagccacagcctttgggctggggaaagaggacgctgtgctgaaggttgccgttaaaatgctgaagtcgactgcccacgccgacgagaaggaggcgctcatgtctgaactgaaaatcatgagtcatctgggacaacacgagaatatcgtgaatctgcttggagcatgcacacatggggggccggtcctggtaattactgagtattgttgctatggcgacctcctgaacttcttacggcgaaaagcagaggccatgcttggcccgtctctcagccccggacaggacccagaaggcggcgtggattacaagaacatccacctcgaaaagaaatatgtgcgcagggactccggcttttcctctcaaggggttgatacctatgtggaaatgcgcccagtgagtacaagttccaatgattcattcagtgagcaggacctggataaagaagatggaaggccactggagttgcgggacctgctgcacttctccagccaagtggctcaggggatggcttttttggcatcaaagaattgtatccatagggatgtggcagcccgcaatgtcctcctcactaatggacatgttgcaaagatcggcgacttcggtctcgcacgggatattatgaacgattcgaattacatcgtcaagggaaatgcacgccttccagtgaagtggatggcccccgagtctattttcgattgcgtgtacacggtccaaagtgatgtgtggagctacggcatcctgctgtgggaaatcttcagtctgggactgaacccataccctgggatcctcgtaaattcaaagttctacaagctggttaaggatggttatcagatggctcagcctgcctttgccccgaagaatatttacagcatcatgcaagcttgctgggccctggagcctactcaccgtcccaccttccagcagatctgcagcttcctgcaggaacaggcccaggaagaccgccgagagcgggattacacaaaccttccatcctcctctcggagcggaggaagtggttcctcaagctcagaactggaggaagagagctcttccgaacatctaacctgctgtgagcagggagacatagcccagcccctactgcaacccaataactaccagttttgctag

SEQ ID NO: 183504 - DNA, 1506 bp, Artificial Sequence
  Description of Artificial Sequence: Synthetic coding sequence
atgcggcacaccaactacagcttcagcccctggcacggcttcaccatacatagggccaaatttattcagtcacaagactaccagtgttcagccctgatgggcggtcgaaaagtgatgagcatttctattaggctgaaagtgcagaaggtgatccccgggccccctgctctcactctcgtgcctgccgaacttgtgaggattcgtggggaggccgctcagattgtgtgttctgctagttctgtagacgttaatttcgatgtcttcctgcagcataataacacgaagctcgccatcccccaacagtctgattttcataacaatcggtatcagaaggtgctcacgctgaatttggaccaggtcgactttcagcatgcgggcaactatagctgcgtcgcctcgaacgtccagggcaagcattctactagtatgttctttcgggtggtggagtcggcgtacctgaatttaagctccgaacagaatcttatacaagaagtgactgtaggagaagggttgaaccttaaggttatggtagaggcctaccctggcttacagggatttaattggacgtacctggggcccttctcagatcaccagcctgaaccaaaattggccaatgccacaactaaggatacgtaccggcacaccttcacactttccctgccaaggctgaagcctagcgaggccgggagatactcattcttagcacggaacccgggggggtggagagccctaacatttgaactcaccttgcggtatccacctgaagtcagcgtgatttggaccttcatcaatggttctggcaccttattgtgtgccgcctcggggtatccgcaacctaacgtaacttggctccagtgctccgggcacacagatcggtgcgatgaggctcaggttctgcaggtgtgggacgatccttaccccgaggtgctgtctcaggagcccttccacaaggtgaccgtgcaaagcttgctgacagttgagaccttagagcataaccagacatatgaatgtagagctcataatagcgttggctctgggtcatgggcattcatccccatcagcgcaggtgcccacactcatcctccagacgagtttctcttcacccctgtggtggtggcctgtatgagtattatggcactgttgctgctcctcctactcctactcctttacaagtacaaacaaaaacctaagtatcaggttcggtggaaaattatcgagagttatgaagggaattcatatacatttatcgatccaacacagttgccgtacaacgagaagtgggagtttcccagaaataatctccagtttggcaaaacactcggcgccggagcttttgggaaagtggtggaagcaaccgcttttgggttaggcaaagaggacgccgtgctgaaagtcgccgtcaaaatgctgaagagtaccgcccacgcagacgaaaaggaggcctccggtctttaccagtcagcagagcagcagcagaagagatggcagcgccagcagcagcagtag

SEQ ID NO: 183505 - DNA, 2016 bp, Artificial Sequence
  Description of Artificial Sequence: Synthetic coding sequence
atgggccccggcgtgctgctgctgctgctggtggccaccgcctggcacggacagggcattcccgtcatagaaccctctgtgcccgaactggtggtgaagcctggggctacagtgacgctgagatgcgtgggcaacggcagcgtggagtgggatgggccaccctctccacactggaccctttattccgacggttcttctagcattctgtccactaataacgcgaccttccaaaacaccggcacatatcgctgtacggaaccgggcgacccactggggggaagcgcagcaattcacctctatgtgaaggaccctgctaggccatggaacgtcctggcacaggaggtggtggttttcgaagatcaggacgccctcttgccgtgtctgctcactgacccggtcctggaggcgggcgtgagcctcgtgagagtgcgaggccgtcccctgatgcgacacacaaattattccttctctccgtggcacgggtttacgattcatcgtgccaagttcatccagagccaagattaccaatgcagtgccctgatgggtgggcggaaggtgatgtccatctcaattagactaaaggtccaaaaggtgatcccaggccctcctgctctcaccttggtccctgccgaacttgttaggattcgcggcgaagccgcccagattgtgtgttctgctagttccgtggacgtaaatttcgatgtatttcttcagcataacaacaccaagctggcaatcccgcaacagtcagactttcacaataacagataccagaaggttttgactcttaatctggaccaggtggattttcagcacgctgggaattattcctgcgtcgcttcaaacgtgcaaggaaagcacagcacaagtatgtttttcagggtggtggaaagtgcatatttgaacctgagtagcgaacagaatcttattcaagaggttacggtgggcgagggactgaacctgaaggttatggtggaggcttacccaggcttacaaggatttaattggacctatctaggcccattttctgatcaccaacctgagcctaaactggcgaatgctacgactaaggatacctaccgtcacactttcactctgtccctgccgaggctcaaaccatccgaagcaggccggtactcattcctggcaagaaatcccggggggtggcgtgccttgacgtttgaacttaccctgagatacccacctgaggtatccgtcatttggacattcatcaatggatccggcacgttgctgtgtgctgccagtggatatccgcagcccaatgtcacatggctgcagtgcagcggacacactgacaggtgcgacgaggcccaagtgctgcaagtatgggacgacccgtaccctgaggtgctgtctcaggaaccctttcacaaagtcacagtgcagtcccttcttacagttgagacccttgagcacaaccagacctatgaatgtcgcgcccacaacagtgtgggcagcggatcatgggctttcattcccatctcagcaggggctcacactcacccacctgacgaatttctgtttaccccagtcgtagtagcctgcatgtccataatggcactcctgctgctcctgctgcttttactgctgtataaatacaaacagaagccaaaataccaggtgagatggaagattatcgagtcttacgaggggaacagttacacattcatcgacccaactcagctgccatataacgaaaagtgggagttcccgaggaacaacctgcagtttggtaagacactgggggcaggagcattcggcaaagttgtggaagctaccgcgttcggtctcggtaaagaggatgcggtgctgaaagtcgcagttaagatgcttaagtctaccgcacacgctgatgagaaagaggctctcatgtcagaattaaagatcatgtctcatctgggacagcatgaaaacatagtaaacttacttggtgcctgtactcacggaggaaccgtggcaagcccagcccgagtgtggacccctatgtggagatag

SEQ ID NO: 183506 - DNA, 921 bp, Artificial Sequence
  Description of Artificial Sequence: Synthetic coding sequence
atgggccccggcgtgctgctgctgctgctggtggccaccgcctggcacggccaggggatccctgtgatagaacctagcgtgccagagctggtagtgaagcctggcgcaacagttacattaagatgcgtgggcaatggctccgtggagtgggatggaccacccagcccacactggacactttattcggatgggtcgagtagcatcttatccaccaataacgccacttttcagaacacggggacctataggtgtaccgaacctggtgaccctctaggcggaagcgctgccattcatctgtatgtgaaggatccggctcgtccatggaacgtgttagcccaagaagtggtggtgttcgaggatcaggacgccctcttgccctgcctgcttaccgatccggtgcttgaagccggcgtgtctctggtgagggtgaggggacggccattgatgagacataccaattacagcttcagtccgtggcacgggtttaccattcaccgggccaagttcattcagtcacaggattaccagtgctcagccctcatggggggccgcaaggtaatgagcatttccattagactgaaggtgcagaaagttatccccggtccaccggccctgactctggtgccagcagaattggtgagaattcgcggcgaagcagcgcagatcgtgtgttcagctagctccgtggatgtgaatttcgatgtgtttctgcagcataataatactaagctcgccattccccagcagagcgatttccacaacaaccgctatcagaaagtgctgactctcaacctagaccaggtggattttcaacacgcgggaaactatagttgtgtggcatcaaacgttcagggaaagcactcaaccagcatgttttttcgggtcgtgggtacaccgtctccaagtttgtgccctgcctag

SEQ ID NO: 183507 - DNA, 1134 bp, Artificial Sequence
  Description of Artificial Sequence: Synthetic coding sequence
atgctgctgctggtgaccagcctgctgctgtgcgagctgccccacccagcttttcttttgatccccgagaagagtgacttaagaaccgtagcaccagccagcagtctgaatgtgcggtttgactccaggacgatgaacctttcttgggactgccaggaaaacactacctttagcaagtgtttccttaccgataagaaaaatagagtggtggagcctagactctcaaacaacgagtgtagctgcaccttcagggaaatttgcctgcatgagggtgtgacatttgaggttcacgtgaatacttcccaacgaggatttcagcaaaagctgttgtaccccaacagcgggagggaagggacggccgctcaaaattttagttgttttatctataacgccgaccttatgaattgcacatgggccagaggtcctactgcacccagggatgtgcagtatttcctatatatccgcaacagtaagagaaggcgtgagatcagatgtccttattacattcaggactccggcacccatgtcggctgtcacctggataacctgtctgggctgactagccgcaattacttcctggtcaacggcaccagtagagagattggcatccagtttttcgactccctactcgataccaagaagatcgagagattcaatccaccaagcaatgtgacagtgagatgtaataccactcactgcctcgtgcgctggaaacagccaagaacctaccaaaaactgagttatctggatttccagtatcagctggatgtgcacagaaagaacacacagcctggcacggaaaacctgttgattaatgtaagcggagatctcgaaaacagatataactttccaagttcagagccacgggcaaagcattctgtgaagattcgagcagccgatgtgagaatcctcaactggagctcctggagcgaggccatcgagttcgatcatctgggcggtatccaccccaggggcagggagagactgccccgaagggggctcgatcgggagggcaactacctgcggcctcgcggatgccgaaatggtatggatatatctgcaagcgccactagggggaactgttttctggacgatgcagtcaatctttacataattttttacgtttttatttag

SEQ ID NO: 183508 - DNA, 702 bp, Artificial Sequence
  Description of Artificial Sequence: Synthetic coding sequence
atgctgctgctggtgaccagcctgctgctgtgcgagctgccccacccagcattcctgctgatccctgagaagagcgatctgcgtacggtggcacctgccagcagtttaaatgtccgctttgatagcagaactatgaacttgtcctgggactgtcaggagaacactaccttcagtaaatgcttcctgacggacaagaagaacagagttgtcgaaccgcgcttgagcaacaatgagtgctcatgtacattcagggagatctgtctgcacgagggcgtcacctttgaggttcatgtgaacacatctcagagggggtttcagcaaaagttgctctaccccaacagcgggcgggaggggactgccgctcagaactttagctgttttatttataacgcagatctgatgaattgtacctgggcccggggccccactgcccctcgggacgttcaatattttctctacattcgcaatagtaagcgccgaagggagatcagatgcccatactacatccaagattcagggactcatgtggggtgccacctcgacaacctgtccggactgacgtctcgcaactacttcctcgtgaatgggacgtctagggagattggcattcaatttttcgatagtctgctggataccaagaagattggtagtttggggtactccggttgtagccgacaattccacaggtcaaagaccaattag

SEQ ID NO: 183509 - DNA, 1002 bp, Artificial Sequence
  Description of Artificial Sequence: Synthetic coding sequence
atgctgctgctggtgaccagcctgctgctgtgcgagctgccccacccagccttcctcttaatccccgaaaagtccgacttaagaaccgtggcacctgccagctctctgaacgtaaggttcgattctagaacgatgaatctgtcctgggactgtcaagaaaatactacattctctaaatgctttcttactgacaagaaaaatagagtggttgagcccaggctgtccaataatgaatgttcttgtacattcagagaaatctgcctgcatgagggagtcacattcgaggtgcatgtcaataccagccagcgcggattccagcagaaactcctctatccaaactccggcagggaaggtacagcagcacagaacttttcttgtttcatctacaatgccgaccttatgaactgcacttgggctaggggccccactgcacctagggatgtccaatacttcctgtatatccgtaactcaaagaggagaagagaaatccgatgtccttactacattcaggactcaggaacccacgtaggttgtcacttagataatttatctggactgactagtcgtaactactttcttgttaatgggacctccagggaaatcgggatccagtttttcgatagcttattggacactaaaaaaatcgaaagatttaacccaccctcaaacgttacggtgagatgcaacactacccactgccttgtgcggtggaagcagcccaggacgtatcaaaaactgtcttacttggattttcagtatcaattggatgtccacaggaagaatactcagcccggcactgagaacctcctaataaacgtgtctggggacctcgaaaacagatacaacttccctagcagcgagcctcgagctaagcattcagtgaagattagagctgctgacgtacgcatccttaactggtcgagctggtccgaggctatcgaatttggctccctcggatacagcggctgcagccggcagtttcataggtcaaagaccaactag

SEQ ID NO: 183510 - DNA, 1002 bp, Artificial Sequence
  Description of Artificial Sequence: Synthetic coding sequence
atgctgctgctggtgaccagcctgctgctgtgcgagctgccccaccctgcctttcttctcatccccgagaagtctgaccttaggactgtcgcaccagcttcctctcttaacgtgaggtttgattcccgcaccatgaatttgtcttgggattgtcaagaaaataccactttctccaaatgcttcctgacagacaaaaaaaatagagtcgtggagcctcgccttagtaacaatgagtgtagctgcactttcagagagatttgcctgcatgaaggagttactttcgaggttcacgtgaacacaagccagagagggttccagcagaagctgctgtaccccaactcggggagggagggcacagccgctcagaactttagctgcttcatctataatgctgatctcatgaattgcacctgggcgagaggccccaccgctccaagggacgtgcagtattttctatacattcgcaacagcaaacgccggagagaaatcaggtgtccttactatattcaggattcgggcactcacgttggctgccatttagacaacctcagtggcctcaccagtcggaactactttctggtcaatggtacatcccgagaaattggcatccagttctttgatagcctgctcgacactaaaaaaatcgagcgatttaaccctccatctaatgtaaccgtgagatgcaataccacccactgtctcgttcgctggaagcagcctagaacttaccagaagctcagttatctggacttccaatatcaattggacgtacataggaagaacacccagcctggcaccgagaacctgctgattaatgtgagcggtgacctcgagaatcgctataactttcctagctctgaaccacgggccaagcactcagtcaagattcgcgcggctgatgtgcgcatcctcaactggtcaagttggagcgaagcgattgaattcggttccctgggctatagcggatgctcccgccagttccaccggagcaagaccaactag

SEQ ID NO: 183511 - DNA, 861 bp, Artificial Sequence
  Description of Artificial Sequence: Synthetic coding sequence
atgctgctgctggtgaccagcctgctgctgtgcgagctgccccaccccgccttcttactgattccagagaagtctgacttgcgtactgtggcccccgcctcaagcttgaatgtacgcttcgattcaaggactatgaacttaagctgggattgccaggagaacacgacgttctccaagtgcttcctgactgacaagaaaaatagggtggttgaacccagactgagtaacaacgaatgttcctgcactttcagggagatctgccttcacgaaggagttacctttgaagttcatgtgaacaccagccaacgcggtttccagcagaagctgttgtacccaaactcagggcgtgaggggacggctgcccagaacttttcttgctttatttacaacgcggatctgatgaactgcacttgggcccgggggccgacagcacctcgcgatgttcagtatttcctttacataagaaacagcaagcgaaggcgcgagatccgctgtccctactacattcaagattccggtacacacgtgggatgtcatttagataatctgagcggcctgaccagccggaactatttcctggtcaacggcacctctagagaaattggcattcagttttttgactctcttcttgacactaagaagatagaaaggttcaatccgccaagcaacgtcaccgttagatgtaacaccacccactgcctagtaaggtggaaacagccacggacctaccagaagctctcctacctggatttccagtatcagctggacgtccacagaaagaacacacagcccggcaccgaaaacctgctggtagtcctgaccacaggcacaagcgccctatgcactttcatgtgttcctag

SEQ ID NO: 183512 - DNA, 1233 bp, Artificial Sequence
  Description of Artificial Sequence: Synthetic coding sequence
atgctgctgctggtgaccagcctgctgctgtgcgagctgccccacccagcctttcttttgattcccgagaagtccgatctgagaactgtcgctcccgcaagtagcctgaacgtgcggttcgatagcagaaccatgaatctgagctgggactgtcaggagaataccaccttctcgaaatgcttcctcacagataaaaagaatagggtggtcgagcctcgcctgtccaacaatgagtgttcctgtacgtttcgggagatatgtttacacgagggggtcacttttgaggtacatgtgaacaccagccaacggggatttcagcaaaaattgctgtatcccaactcaggccgagaggggaccgctgcccagaatttctcttgtttcatctataacgccgaccttatgaattgcacatgggccaggggcccaacagctcccagggatgtgcagtattttctgtacatcaggaacagcaagcgtcgtagagaaatccggtgtccctactacattcaggattctgggacccatgtcggctgccacctggacaatctcagtggcttgacgagccgcaactactttctggttaatggcacttccagagaaattggtatccagttctttgattcactgctggacacaaaaaagatcgagaggttcaatcctccatcaaacgttacagtgcgctgtaacaccacacattgccttgtgcggtggaaacagccaagaacttaccagaaactgtcctatctggattttcagtaccagttggacgtccatcggaagaatactcaacctggcaccgaaaacctcctgataaacgtgtccggagacctggagaatagatacaattttccaagctcagagccgcgggccaaacacagcgtgaagattcgtgcggccgacgtcagaattctcaattggagctcgtggtctgaggcgattgaattcggatcggacgacgggaacctgggctccgtgtacatctacgtgctcttaattgttggaacgctggtttgcgggatcgttttgggatttttgttcaagcgcttccttagaatccagcggcttttcccacccgtgcctcagattaaagataagttaaacgataatcacgaggtggaagatgaaatgggtccacagcgccaccataggtgtggatggaatctttacccaacacccggtccatcaccaggatctggatctagtcctagacttggatctgagtcaagcttatag

SEQ ID NO: 183513 - DNA, 1203 bp, Artificial Sequence
  Description of Artificial Sequence: Synthetic coding sequence
atgctgctgctggtgaccagcctgctgctgtgcgagctgccccacccagcttttcttctcattccagagaagtcagaccttaggactgttgcacccgcgagtagcctgaatgttcgctttgattccagaacaatgaatctgtcctgggactgccaagagaatacaacgttttccaaatgcttcctgacagataagaaaaacagagttgttgaacctaggctgagcaataacgagtgtagctgcacatttagagagatttgtctgcacgagggcgtaacctttgaggtgcacgtgaacaccagtcaacgcggcttccagcagaagctgctttatccaaacagcggaagggaggggacagccgcccaaaacttttcttgttttatttacaacgccgacttaatgaattgtacatgggcgcgcggaccaaccgctccccgtgatgtccagtacttcctttacatccgcaattcaaagaggcgaagagagatccgctgtccttattatatccaagattccggaacacatgtggggtgccacttggataacctttctggtctaacctctcggaactactttctggttaatggtacctcaagggagatcggtatccaattctttgacagcctgcttgacaccaagaaaattgaacggttcaacccgccctctaacgtcaccgtaaggtgcaataccacacattgcctggtgcggtggaaacagccgaggacctaccaaaaattatcttacctggacttccagtatcagcttgacgtacacaggaagaacacccagccgggaaccgagaacttacttatcaacgtgtccggagacctagagaacagatacaacttccctagctctgaacccagagctaaacacagtgtcaagattcgtgcagccgacgtgagaattctcaactggtcctcatggtctgaggcgatcgaattcggtagcgatgacggaaacctcgggtcagtttacatatacgtgctgctgatcgtgggtactcttgtctgcggcattgtgctggggttcctattcaaacgatttctgcgaatccagcggttattcccgccagtaccccagataaaagacaaactgaatgataaccatgaagtggaggatgaaatcatttgggaggagttcaccccagaagagggcaaaggataccgtgaggaggtccttacagtaaaggaaatcacctag

SEQ ID NO: 183514 - DNA, 1203 bp, Artificial Sequence
  Description of Artificial Sequence: Synthetic coding sequence
atgctgctgctggtgaccagcctgctgctgtgcgagctgccccacccggcattcctcctcatacctgagaagagtgatcttcgcaccgtcgctccagcctccagcctgaacgtgcggttcgatagccgcacgatgaacttgagttgggactgccaagagaacactactttctcaaagtgcttcctcaccgacaagaagaaccgtgtcgtggagcccagactgtctaataacgagtgcagctgcacatttcgcgaaatttgtctacacgagggggtgacatttgaagtgcacgtcaacacatcacagcgagggtttcagcagaagcttctctacccaaactctgggcgggagggaacagccgcgcagaatttttcctgctttatctataacgccgatttaatgaactgtacttgggcccgagggcccacagctcctcgagatgttcaatattttttgtacatccgcaacagcaaacgtcggcgggagatcagatgcccttactacattcaagatagtgggacacacgttggctgtcacttggacaatttaagcggcctgacctcaagaaactatttcctggtcaatgggacctcaagggaaattggcatccaattttttgactcactgcttgacactaaaaaaatcgaaagatttaatccgccgtcaaatgttaccgtgcgttgtaatacaacccattgtctggtgcgctggaagcagccccgaacctatcagaagctgagttatctggatttccagtatcagttagacgttcatagaaaaaacactcagcccggaacagagaacttgctcattaatgtgtcgggggatctcgaaaatcgttacaattttcccagctcagaaccccgcgccaaacatagcgtgaaaattcgggccgcggatgtgagaatactgaactggtcctcctggtccgaagcgatcgaattcggtagtgacgacggaaacctgggtagcgtctatatttacgtactactgatcgtgggtactctggtctgcggtatcgtgttgggctttttattcaaaaggtttctgagaattcagcggttgttcccacctgtgcctcagattaaggacaagctgaacgacaatcacgaggtcgaggacgaaatcatctgggaagaatttacgcccgaggaagggaaaggataccgcgaggaggtcctcactgtcaaggaaatcacttag

SEQ ID NO: 183515 - DNA, 717 bp, Artificial Sequence
  Description of Artificial Sequence: Synthetic coding sequence
atgctgctgctggtgaccagcctgctgctgtgcgagctgccccaccctgcattccttttgatcccagagaagtccgatttgagaacagtcgcccctgcctcaagcttgaacgtgcgcttcgatagtcgcacaatgaatctgagctgggattgccaggaaaacaccacgttttctaaatgcttcctcacagataagaaaaatagagtcgtcgagccaagactgagcaataatgaatgcagctgcaccttcagggagatttgtcttcacgaaggcgtgacattcgaagtgcatgtgaacacctctcaacgaggctttcagcaaaagctgctctaccccaactctgggcgtgaaggtactgcagctcaaaactttagctgttttatttataacgctgacctaatgaactgcacttgggctagaggtcccacggcaccaagggatgtgcagtactttctgtatattcggaactccaagcgacggagagaaatcaggtgtccctattatatccaggactctgggacccacgtgggctgccatctggataacctgtcaggactcactagtaggaattacttcctcgttaatggcacgtcgagggagatcggtatccagtttttcgacagtctgctggacacgaagaaaatcgagagatttaaccctccctcaaatgttaccgtgcggtgcaataccacccattgcctggttcgctggaaatag

SEQ ID NO: 183516 - DNA, 1305 bp, Artificial Sequence
  Description of Artificial Sequence: Synthetic coding sequence
atgctgctgctggtgaccagcctgctgctgtgcgagctgccccaccctgccttcctcttaatcccagagaaatctgacctccgtacagtggctcctgcaagttctctgaacgtgcgcttcgatagtagaactatgaacctgtcctgggattgtcaggaaaatacaacattttctaagtgcttcctgactgataaaaaaaatcgagtggtagagccccgattgtccaacaacgagtgttcatgtacattccgcgaaatatgtttacatgagggagtcacctttgaagtgcatgtcaatacctcgcagagaggatttcagcagaagctcctttatcccaactccggacgcgaaggtactgctgcacaaaatttttcttgtttcatttataatgccgacttaatgaattgcacatgggcgcgggggcctactgctcctcgcgatgttcagtatttcctgtatatccgaaatagtaagcgccgtcgcgagatcagatgcccctattatattcaagattcagggacgcacgtaggatgtcacctcgacaacttgtctggcctcacttctcgcaactacttcctagttaatgggaccagtcgcgagattggcattcagttttttgattctctactggacactaaaaagatcgaaagatttaatccaccgtccaatgttaccgtccggtgtaacacaactcactgtttggtgagatggaagcaacctagaacctatcagaagttgtcttaccttgatttccagtaccagctcgatgtgcaccgcaagaatacccagccggggactgagaacctgttgataaatgtgtcaggagacctggagaaccggtataacttcccatcttccgaaccccgagctaaacacagtgtcaaaattcgagctgccgatgtgcggatcctgaactggtcttcttggtcagaggccattgaatttggctctcattcagtgacacaggctggggtgcaatggcataacctcggcagcctgcaaccgccatcgccgagactgaaacgcttcagttgtcttcggctgcctggatctgatgatgggaatttgggatcagtttacatttatgtcctactgatagtgggaaccttagtatgcggaatcgtcctcggattccttttcaaaaggttcctgcggatacagcgcttgttcccgcccgtccctcaaataaaagataaactgaacgataaccacgaggtggaggatgagatcatttgggaagagttcacacccgaagaaggcaaaggatatcgggaggaggtgctgaccgtcaaagagatcacatag

SEQ ID NO: 183517 - DNA, 567 bp, Artificial Sequence
  Description of Artificial Sequence: Synthetic coding sequence
atgctgctgctggtgaccagcctgctgctgtgcgagctgccccacccggccttcttactgatcccggaaaaatctgacctgaggacggttgctccagcttcctctctcaacgttcgattcgattccaggactatgaacctgtcctgggattgccaagagaatacaacatttagtaaatgctttctgaccgataaaaaaaatagagtggttgagccacggttatcaaacaacgaatgctcatgtaccttccgcgaaatctgccttcatgaaggtgtgacattcgaagttcatgtcaatacgagccaaagagggttccagcaaaagttgctttacccaaacagcggcagagaggggaccgctgcacagaattttagctgttttatttataacgccgatcttatgaattgtacctgggcccgaggtccaacagctccccgcgacgtgcagtacttcctgtatataagaaactctaaaagacgccgcgagattcggtgcccctactatatccaggacagtggcacacatgtgggttgtcacctggacaacttgtctggcctgacatcatag

SEQ ID NO: 183518 - DNA, 1203 bp, Artificial Sequence
  Description of Artificial Sequence: Synthetic coding sequence
atgctgctgctggtgaccagcctgctgctgtgcgagctgccccacccagcatttcttttgatccccgaaaagtccgacctgagaacagtagccccagcgtcaagcctgaacgtgcggttcgattcacgcactatgaatttaagctgggattgtcaggaaaatactacttttagcaagtgcttcctgaccgacaaaaagaaccgggttgttgagcctaggctctctaataatgagtgctcttgcacttttcgcgaaatctgccttcacgagggcgtgacatttgaggtgcacgtgaatacctcacagcgcggcttccagcaaaaactgttgtacccaaattctggacgcgagggcactgccgcgcagaacttctcctgctttatctacaatgctgacctgatgaactgtacatgggcacgaggcccgacagcacctagggatgtgcagtacttcctgtatatcaggaattcaaaaaggcgacgcgaaatcaggtgcccctattacatccaagactctggaacacatgtgggttgccacctcgacaatttgtccggactcacttcacggaactacttcctcgtgaacggtactagcagggaaattggcattcaattcttcgactctttgttggacacaaagaaaatcgaaaggtttaatccaccatctaacgtgaccgtgcgttgcaacacaactcattgtttggtccggtggaaacagcctagaacttaccagaaacttagctacctcgacttccaatatcagttagatgtccacaggaagaacactcaaccgggtactgagaatctgctcatcaacgtgtcgggggacctggagaatcgctacaattttccctccagcgagccccgtgcaaagcattctgtgaagatccgcgccgccgatgtgcgaatcctgaactggtcttcctggagcgaagccatcgaattcgggagtgacgacgggaacctgggcagtgtctacatctacgtcctgctcattgtcggaacattggtgtgcggaattgtgctcgggtttctttttaagcgctttctccgaattcaacgcctgtttccgccggttcctcaaataaaggacaagttgaatgataaccacgaggttgaggacgaaattatctgggaggagttcactcctgaggagggtaagggatatagggaggaagtgttaaccgtgaaagaaatcacctag

SEQ ID NO: 183519 - DNA, 804 bp, Artificial Sequence
  Description of Artificial Sequence: Synthetic coding sequence
atgaactgcacctgggcccggggccccaccgccccccgggacgtgcagtactttttatacatccgcaattcaaaacggagacgggagattcggtgtccatattatatccaagattctggaacacatgtgggatgccatcttgataatctgagtggcttgacgagccggaattactttctcgttaacggcaccagtagagagattgggatccagtttttcgattcccttcttgacacgaagaaaatcgagaggtttaatccaccctccaatgtgacagtacgatgcaacaccacccactgcttagtgaggtggaagcaaccacgcacataccagaagctgtcttatttagacttccagtaccagctcgacgtgcatagaaagaatacgcaacccggcaccgagaacctccttatcaatgtttcgggggacctcgaaaatcgctacaattttccaagctccgaacctcgggcgaagcattccgtgaaaatacgggccgctgatgtgaggatcctcaattggtcctcttggagcgaggctattgagtttggaagtgatgacggcaacctcgggtccgtttatatctacgtgctgctgatcgtgggtacccttgtatgcggcatcgttttgggctttttatttaagcgcttcctgcgaatccagcgccttttccccccagtgccccagatcaaggacaagctcaatgataaccatgaagtggaggacgaaattatctgggaagagtttaccccagaggaaggcaagggctacagagaagaggttcttacagtcaaagagataacatag

SEQ ID NO: 183520 - DNA, 2712 bp, Artificial Sequence
  Description of Artificial Sequence: Synthetic coding sequence
atggtgctggcccagggcctgctgagcatggccctgctggccctgtgctgggagcggtcactcgccggagcagaagaaacaataccactccagaccttgcggtgctacaatgattacacgtcccacatcacttgccgctgggctgatactcaggatgctcagaggctggtgaatgtgacattgatccgtcgcgtgaacgaggatctgctggagcctgtgtcttgcgacttgtctgacgacatgccctggtcagcatgcccccatccacgttgtgtcccacggagatgcgtgattccctgccagagtttcgtcgtgactgacgtcgactattttagctttcagcccgaccgccccctggggacacgacttacagttaccctgacacagcatgttcagccacccgagccacgggatctgcagatttcgactgatcaggatcattttttgctcacctggtccgtggccctcggatcgccacagagtcactggctatcacctggcgatttagaattcgaggtggtgtataaaaggttgcaggacagctgggaagatgcggccatcctcctgtctaatacgtctcaagcgacgcttgggcctgaacaccttatgccaagcagcacatacgttgccagggtcaggactaggctcgccccagggtcccgcctctccggacggccatctaaatggtctcccgaggtatgctgggacagccagccaggggatgaagcccagccccaaaacttagagtgcttcttcgatggggctgcggttctgagctgttcatgggaggttaggaaagaggtggcctcgagcgtctcgttcggcctgttttacaagccaagtccagacgccggttcagctgttctgcttcgcgaggaagaatgctcccctgtgctgagggaaggcctcggatcactccataccagacatcattgtcagatcccggtgccagaccccgcaactcatgggcagtatatcgtaagcgttcaaccgaggcgtgctgagaagcacatcaagtcctctgtcaatattcagatggcccccccttccttgaatgtcactaaggacggtgatagctattccctgagatgggagacaatgaaaatgcgctatgagcacatcgaccatacctttgagattcagtatcgcaaggatacagcaacgtggaaagactccaagactgagactctgcagaatgcccatagtatggccctccccgcactggaaccatccacccgatattgggccagagtgcgagtacgcacctcccggacaggctataatgggatatggtccgagtggagtgaggccaggtcctgggacacagagagtgtcttgcctatgtgggtgttggcattgattgtgatttttttaaccattgcagtgctcctcgccctccgtttctgtggcatctatggctatagactgcgtagaaagtgggaggagaagataccaaatccttcaaaaagtcacctgttccaaaacggctcggccgaactctggcctccaggctctatgagcgctttcacttctggatctccaccacatcagggcccttggggaagcagattccccgagctggagggggtgttcccagtggggttcggcgactctgaggtgtctccacttactatcgaggatcctaagcacgtctgcgacccaccatccggtcccgacacgacgccagccgccagtgacctgcctaccgaacagcccccctctccccagccgggacctccagcagcgtcccacacacctgaaaaacaggcttccagctttgatttcaatggcccctacctgggccctccccactctaggagcctccctgatatcttaggacaacccgagcccccccaggaaggggggtctcagaagagtcctcctcctggaagcctggagtacttatgtctacccgcgggaggtcaagtgcagctcgttcccctggctcaggccatggggccaggccaggcggtggaggttgagcgtagaccctctcagggagcggcggggagcccatcactggagtcaggggggggcccagctcccccagcccttgggccgcgtgtcggcggtcaagaccagaaggacagtccagtagctattcccatgtcctctggtgacacagaagatcctggggtagctagcgggtacgtgagcagcgctgatctggtgtttactcccaatagcggtgcctcaagcgtcagcctcgtgccctccctgggattaccgagtgatcagaccccaagtctttgtcccgggctggcttccgggccccctggggctcctggccctgttaaaagcgggttcgagggttatgtggaactcccacccatagagggtagatcacctagaagtccaagaaacaatcctgttccccctgaagccaagtctcccgttctcaacccaggcgaacggcccgcggatgtgagtcccacctctcctcagcctgaaggcttactggtgctgcagcaagtgggggattattgcttcctgcctggccttggacctggccccctgtcgttgcgtagcaaaccctccagccctggccctgggcccgagattaagaatctggatcaggcttttcaggtaaaaaaacctcccggccaggctgtacctcaggtgccagtaatccagctgtttaaagctctgaaacaacaagactacctatctctgcctccttgggaggtgaataaaccaggagaggtatgttag

SEQ ID NO: 183521 - DNA, 2694 bp, Artificial Sequence
  Description of Artificial Sequence: Synthetic coding sequence
atggtgctggcccagggcctgctgagcatggccctgctggccctgtgttgggagcgatccctggccggcgctgaggagacaatacctctgcagacgctgcggtgttacaacgattacacctcacatattacttgtcgctgggccgatacccaggatgcccagagactggtgaacgtgactcttattagacgcgtaaatgaggatctccttgagccagtctcctgcgacctgagtgatgacatgccgtggtcagcctgtccgcatccgagatgtgtgcctcggcggtgcgtgattccgtgccagagcttcgtggtgaccgatgtagactactttagcttccagccggaccgaccactcggtaccagactgacggtgacactcacacagcacgttcaacctcctgagcccagagatctgcagataagcacagaccaggatcactttctgctgacgtggtccgtcgcactggggtcaccacagtctcattggctctccccaggagacctggaattcgaggtggtatataagcgtcttcaggattcctgggaggacgccgccatcttgctgagcaatacgtcacaggccacgcttggacctgagcatcttatgccctcctcgacctacgtggctagagtaagaactaggctggcaccagggagccgcctctccgggcggccttcaaaatggtcccccgaagtatgttgggattcacagccgggcgacgaggctcagccgcaaaaccttgagtgctttttcgacggcgcggcggtgctctcatgtagttgggaagtcagaaaagaggttgcttccagtgtgtcgttcggactgttctataagccaagccccgacgctggagaggaagaatgcagcccagtcttacgcgaaggattagggtccctgcacacacgtcaccactgtcaaatcccagtgccggacccggctacacatggtcaatatatcgtgtccgtccagccacgacgcgccgagaagcacattaagtctagtgttaatattcagatggcacctccttctcttaatgtcacaaaggacggggattcttacagccttcgatgggagactatgaaaatgcggtacgaacatatcgatcacactttcgagattcagtacagaaaggacacagccacttggaaagactccaagaccgagaccttacaaaatgcccacagcatggcactgcctgctctggagccttccaccaggtactgggctagggttagagttagaacatcaagaacaggctacaatggtatttggagcgagtggagtgaagccagatcttgggacaccgaaagtgtactccctatgtgggttttagcactgatagtcattttcctgaccatcgccgtcctgctagccctgcgcttctgcgggatatatggttatagactgcgccgtaagtgggaggagaagattcccaacccatccaaaagtcatctgttccagaatgggagcgcagagctgtggcctccaggatctatgtccgcctttacctctgggagtcctccgcaccagggtccctggggctctcggttcccggaattagagggagtattccctgtgggcttcggagattctgaggtgagcccactgaccattgaggaccccaagcacgtctgcgaccccccctccggtccggataccactcctgccgcctctgacctccccactgagcagccaccatccccacagcccgggccccctgcagcttcccacacacctgagaagcaagcctcctcttttgattttaatggcccctacctgggacctcctcactctagatcactgcccgacatcctgggccagccagaacctccacaggaaggtggctcccagaaatccccgccgcctggatcactcgagtatctctgcctcccggccgggggccaggtccaactggtacccctggcacaggccatgggacccggacaggcagtggaggtggaaaggaggccttcccaaggggccgctggctctcccagcttagaaagcggcgggggacccgctcctcctgcacttggtccccgtgtgggcggccaagaccagaaagacagcccagtagctatacctatgtccagcggagacactgaggatcctggcgtcgccagtggctacgtgtctagtgccgacctggtgtttacacctaattcaggcgccagttcagtgtctctggtcccttccctcggccttcccagtgaccagactcctagtctgtgtcccggcttagctagcggcccacctggggccccaggtccggtgaaatccggcttcgaaggatatgtcgagctccctcccatcgaggggaggtccccccgaagtccacgaaataatcctgtgccccctgaggcgaagagtcccgtcctgaaccctggcgagagaccagcagatgtgtcccccactagcccacagccagagggcctccttgtgctccagcaggtgggagattattgctttctccctgggttgggccccgggcccctatccctgcgaagcaagccaagttcccctggccctggccccgaaattaagaatcttgatcaggcgtttcaagtgaaaaagccccctgggcaagctgtgcctcaagtgcccgtcatccagctcttcaaggccttaaagcagcaagattacttatcactgccgccctgggaagtgaataaacctggggaggtgtgttag

SEQ ID NO: 183522 - DNA, 690 bp, Artificial Sequence
  Description of Artificial Sequence: Synthetic coding sequence
atgccctggagcgcctgcccccacccccggtgcgtgccccggcggtgtgtcattccatgtcagagctttgtagtgactgatgtggattacttctcttttcagcctgaccgacctcttggaactcgcttgaccgtcacactgacacagcatgtacagcccccagagcctagagatttacagatttctactgaccaggatcatttcctattaacatggtcggtagccctcgggtcacctcaatcccattggctgagtcccggagatctagaattcgaggtggtgtataagcgtctgcaggactcctgggaagatgccgctatactcttgagcaacaccagccaggcgactcttggccctgaacatttgatgcccagttcaacgtacgtagcaagagtccgaaccaggctggcaccgggtagcagactttcaggtagaccttccaaatggtctccagaggtttgctgggactcacagcccggggacgaggcccagcctcagaatttagaatgtttttttgacggagccgctgttctaagttgctcctgggaggttaggaaggaggtggctagctctgtctcgtttggcctgttttacaaaccttcacctgatgcaggcgaggaggaatgctctccggtgttgagggagggactgggcagcctgcacacgcgccaccactgtcaaattccctag

SEQ ID NO: 183523 - DNA, 2535 bp, Artificial Sequence
  Description of Artificial Sequence: Synthetic coding sequence
atgggcaagctgcggccctggcgggacctgctggagcccgtgagctgcgatctttcggatgatatgccttggtcagcatgcccacaccctaggtgcgtacctaggcggtgtgtgatcccatgtcagagtttcgtggtaaccgatgtggattacttttcatttcaacctgaccgcccgctgggaactagactgaccgtcaccctgactcaacatgttcagccgcccgagcctcgagatcttcagatctccacagaccaagaccattttttgctcacctggtctgtagcgctgggctccccccaatctcactggctgtcccccggagacctcgagtttgaggtggtttacaagcggcttcaggactcctgggaggacgccgccatcctactgtccaacacctcacaggcaaccttagggccagaacacctgatgccctcatcgacctatgtcgcccgggtgaggacgaggctggctcccggctccaggctgagcggtcggccgtcaaagtggtcgccagaggtgtgttgggattctcagccaggcgatgaggcccagccccagaacttggagtgcttcttcgacggcgctgctgttttaagctgttcctgggaggtgcgcaaagaggtcgcgagcagtgtttcgtttggactgttctataagcctagtccagacgctggctctgccgttctgcttcgcgaagaagagtgctctcccgtccttcgggaaggtttgggcagcctgcatactagacatcactgccagataccggttcccgatcctgctacccatggccaatatatcgtcagcgtgcagccccgccgcgcagaaaagcacatcaaatcatccgtgaatatccagatggccccacccagcttaaatgtgacgaaagacggcgacagttacagtttacgttgggagaccatgaaaatgcgctacgaacatattgatcacactttcgaaatccaatatcgcaaagacacagccacctggaaggattctaagaccgaaactttgcagaacgcacactctatggcactacccgcactggaaccttcgaccagatactgggcgagagtgcgggtcagaacctcccgcaccgggtataacggaatctggagcgagtggagcgaagcgagatcatgggacacagagtccgtccttccaatgtgggttcttgcactcatagttattttccttactatcgctgtgctgctcgcgttgaggttctgtggcatctacggttatcggctgaggcggaagtgggaggaaaaaatcccgaacccaagcaagtcccatctgttccaaaatggctctgctgaattgtggccccctggaagtatgtccgccttcacaagcgggagtccacctcatcaaggcccatggggatcccgctttcccgagcttgagggcgtgttccctgttgggtttggggactctgaggtcagtccattgactattgaggatcctaagcacgtgtgcgacccccccagcggcccggataccaccccggccgctagtgacttacccaccgaacagccacccagccctcagcctggccctcctgccgctagtcacaccccagaaaagcaagcaagctctttcgacttcaatggcccctacttaggaccgccccattcacgaagcctgccagacatcctgggacaaccggaacccccacaggagggcggaagccagaagagcccaccccctgggagcctggagtatctgtgcctgccagccggcgggcaggtccagctcgtgccgcttgcccaagctatgggccccggccaggctgtggaagtggagaggaggcctagccaaggtgcagctgggtcaccctcacttgagagcggaggtgggcccgccccacccgccctggggccccgcgtgggcggtcaggatcagaaggattcaccggtcgccatcccaatgtcctctggtgataccgaagaccccggtgtggcgtctggctatgtgtcgagcgcggacctcgtgttcactccaaattcgggggcttccagtgtgagcctggttccgagtttaggactgccgagtgaccagacaccttccctgtgccccggcctggctagcggacctcccggcgccccgggtcccgttaaatcggggttcgaggggtatgttgagctgccgcctatcgaggggaggtctccccggtcaccccgcaataatcccgttccacctgaagccaagtctccagttttgaatccaggggagaggcctgcagatgtgtccccaacatccccacagcccgaaggcctgctggttctgcagcaggttggcgactattgttttctgccgggtctaggtcccggacctttgagcctgcgctcaaagcctagctctccaggacctggcccagagatcaagaacctggatcaggccttccaggtaaaaaagccacctgggcaggccgtgccacaggtgccagtgattcagcttttcaaggccttaaagcagcaagattatctatccctcccaccatgggaggtaaacaagcccggcgaggtgtgttag

SEQ ID NO: 183524 - DNA, 2670 bp, Artificial Sequence
  Description of Artificial Sequence: Synthetic coding sequence
atggtgctggcccagggcctgctgagcatggccctgctggccctgtgttgggaacgctctctggccggcgctgaggagaccatcccactccagacgctgagatgttacaatgactacacttcacacattacatgtaggtgggctgatacacaagatgcccagcggcttgtgaacgtcactttgatccggagagtgaacgaagacctgctggagcccgtgtcctgtgatctaagtgatgacatgccctggagcgcttgcccccatccgcggtgtgtacccaggaggtgtgtgattccatgccagtcattcgtggtgactgatgtggactatttttcgtttcaacccgataggccactagggacgcgcctgaccgtcacactgacacagcatgtccagcctccggaaccccgcgacttgcagatctcaaccgatcaggaccattttctacttacctggagtgttgccttaggaagcccccagagccactggctcagtccaggcgacttagaattcgaggtcgtctacaagaggctgcaagattcatgggaggatgctgctatcctgctcagcaacacctcacaggctacactcgggcccgaacatctgatgccgtcatcgacgtacgtagccagagttcggactcgactggccccgggctctagactcagtggaaggccttccaagtggagtccagaggtgtgctgggacagccagcctggggatgaggcccagccacaaaatctcgagtgcttcttcgacggggccgccgtgttgtcttgcagctgggaggtgagaaaggaagtcgcttcttccgtttctttcggcctattctataagcctagccctgatgccggggaagaagaatgctcgcctgttctccgggaaggacttggatccttgcacacccgacaccattgccagatccctgttcccgaccctgcaacacacggccagtacattgtcagtgtccagccacgacgcgcagaaaaacatattaagagctcagtaaatatccaaatggcacctccttcactaaacgtgaccaaagacggtgattcatacagtctcagatgggaaacaatgaaaatgcggtacgagcacatcgatcacaccttcgagatccagtaccgaaaagatacagccacgtggaaggattctaagacagagactctgcagaacgctcactccatggccctccctgccctggaaccttccacgcgctattgggctagagtccgcgtgcgcactagcagaactggctataacggcatttggagtgaatggagtgaggcacgctcttgggacaccgaaagcgtgctcccaatgtgggtgttggcactgatcgtgatctttcttacaatcgcagttctcctggccctaaggttctgcggcatttatggctacaggctccggcggaagtgggaagagaaaattcccaatccgtccaagtctcacttattccagaacggcagtgccgagctgtggccccctggaagtatgagcgccttcacctccggaagccctccccaccaggggccgtggggctcccgatttcccgagctggaaggggtgttccccgtgggctttggggacagtgaagtgagtccactgacgatcgaagaccccaagcatgtatgcgacccaccctcgggacccgatactacgcccgccgcaagtgacttgcccacagaacagcctccctccccacagccagggcctcctgccgcctcccacacaccagagaagcaggccagcagtttcgatttcaatggtccttacctggggccaccacactccagatctttgcctgacatcctgggacagccggagcccccgcaggaagggggatctcagaaatcgcctccccctggaagcctcgagtacctgtgcctccccgccggcgggcaggtgcagctcgtgcctctggcccaggcaatgggcccaggccaagcggtcgaagtcgaacggagaccatctcaaggcgctgccgggtcccccagcctggagtctggaggagggcctgcgccacctgcattgggccctcgagtgggcggccaggaccagaaagactcccccgtggcaatccctatgagcagcggtgataccgaagaccctggggtggctagcggttacgttagctctgctgatttagtgtttacacccaacagtggggcttcaagcgtgagtctggtaccttcgttaggtctcccatccgatcagactccgtctctttgtccgggccttgccagcggtcccccgggggcgccgggccccgttaagtcaggattcgagggatatgtcgaactgccgccaatagagggcagaagtccccggagcccacgtaacaatccagtcccaccggaagccaagtctccagtgctgaatcctggagaaagacccgctgatgtgagcccaacctcacctcaacccgagggactgttggtcctgcagcaggtaggtgactattgcttcttgccggggctgggcccaggtccactatccctgaggtctaaaccttctagccccgggcctggtcctgagatcaagaacctggaccaggcattccaggtgaaaaagccccccggtcaagccgtaccccaggtgcctgtgatccaactgtttaaagccttggtggtaagcgtgatgagtgtaggcccaccggtgccatag

SEQ ID NO: 183525 - DNA, 2352 bp, Artificial Sequence
  Description of Artificial Sequence: Synthetic coding sequence
atggcccggctgggcaactgcagcctgacctgggccgccctgatcatattgctactccccggatcactggaggagtgtggacacatttcagtttcggctcctatcgtccatctgggggatccaatcaccgcaagttgcattattaagcagaactgtagccacctggatccagagccccagatactctggagacttggagctgagctgcagcctggaggtcggcagcagcgtctttcggatggcacacaggagtctatcataaccctccctcacctgaatcacacccaagccttcctctcatgttgcctcaactgggggaactccctccagattctcgatcaggtcgagcttcgtgctggataccctcccgctatcccacacaacctctcctgtctcatgaatctgaccacctcttcattgatatgccagtgggaaccaggtccggaaacacacctgcccaccagctttacactaaaatcctttaaatccaggggcaattgccagacccaaggggattcaattctggactgcgtgccaaaggacggtcaatctcattgctgtattcctcgcaagcatctgctcctgtaccagaatatggggatttgggtgcaggcggaaaatgcgctcgggactagtatgtctcctcagctttgcctcgatccaatggacgttgttaagctagaaccaccgatgctccggaccatggaccccagccctgaagctgctccacctcaggcgggctgcctgcagctgtgctgggaaccttggcaacccggactgcacatcaaccagaaatgtgagctaaggcacaagccccagcgtggagaggccagctgggcactggttggccctttgccgctcgaggctctgcagtatgagttatgtgggcttctacctgccactgcatacaccctgcaaatccgttgcattcgctggcctttgccgggtcattggtcagactggtctccttccttagagttgcgaactacagaaagagcgcccacagttcgtctggatacttggtggaggcaacggcaactggatcctaggactgttcaactgttctggaaaccagtgccactggaagaggacagtggtaggatccaggggtatgtagtcagttggagacccagtggtcaggctggtgctatcctgcccctgtgtaataccaccgagctgtcctgtacctttcatctccctagcgaggcccaggaagtagccctcgtggcgtacaacagtgcaggcacatcccgaccaactccagtagtcttttccgaatcacggggaccagcgctcacaagactgcatgcaatggcgagggatccacactccctatgggtaggctgggaacctcctaacccatggcctcaagggtatgttattgaatggggattagggccaccctccgctagcaattcaaataaaacatggcgcatggagcagaatggtagagccactgggtttctgttgaaagaaaatattcgacctttccaactttacgagattatcgtcacacctctgtatcaggatacgatggggccgagtcagcacgtttacgcttactctcaggagatggctccttcccacgcgcctgagttgcacctgaagcacatcgggaagacatgggcccagctcgagtgggtgcctgagccccccgagctcggaaagagtcctctgactcactatacaattttctggactaacgcgcagaaccaaagtttctccgcaattttaaatgcctccagcagggggttcgttcttcacgggctggagcctgcgagtctgtaccacattcatttaatggctgcaagccaggccggtgcgaccaacagcacagtgttaactctgatgacccttacacccgagggatctgaactgcacatcatcctgggcctctttggtttgctgcttctgctgacttgtttatgcggaactgcttggctgtgttgttcccccaatcgcaaaaaccctctgtggccatctgtccccgatcctgctcatagctctcttggtagctgggtacccaccattatggaggaggatgcttttcagctccccggcctcgggacaccccccattaccaagctgactgttctcgaggaagacgagaagaaaccagtaccatgggagagtcataatagttctgaaacttgcggtctccctacattggtgcagacctacgttctgcagggtgatcccagagctgtctcaacacagccccagtctcagtccggcaccagcgatcaggccggacctcctcgccgatcagcatattttaaggaccaaatcatgctgcaccccgcgccacctaacgggttgctttgcctgttcccaataactagcgtgctgtag

SEQ ID NO: 183526 - DNA, 2310 bp, Artificial Sequence
  Description of Artificial Sequence: Synthetic coding sequence
atggcccggctgggcaactgcagcctgacctgggccgccctgatcattctgctcctccctggttccttggaagaatgcggccacatctcagtgagcgcccctattgtgcatttgggcgatccaatcaccgcttcatgcataatcaaacagaattgctcgcacttagacccagagccccagattctatggcgcctcggtgccgagctgcagccaggaggccgccaacaaagactgtctgacggtacccaagagtccatcattaccttaccccacttgaaccacactcaggcatttctgtcctgttgcctgaactggggcaacagcctgcagattcttgaccaggtggagttgagagccggatacccaccagccatcccgcacaacctgagttgtttaatgaacctgaccacctcaagcctcatttgccagtgggaacccgggcccgagacacatttgcccacttcctttacactcaaatcttttaagtccagagggaactgccagactcagggcgatagtatactcgactgcgttccaaaggacggccagagccactgctgtattcctcgcaagcatctgctcctgtaccagaacatgggcatttgggtgcaggccgaaaacgctctaggtacttcgatgagcccccagctgtgtttagatccgatggatgtagtgaaactcgaacctccgatgctgcggacaatggacccatcccctgaggctgcaccccctcaggcaggctgcttgcaactctgctgggagccttggcagcccggactgcatatcaaccagaagtgtgaactgaggcacaagccccagcgtggtgaagccagttgggctctggttggacctctgccattggaagccctccagtacgagctctgcggattgttaccggccaccgcatatacattgcaaatacggtgtattagatggcctctgcccggtcactggagcgactggagcccctcattggagctcaggaccaccgagagggcgcccaccgtgcgcctcgatacctggtggcgacagaggcagctggatcctcgcactgtgcaactgttttggaaaccagtccccttggaggaggatagtgggaggatccaaggatacgtggtgtcatggcggccttctggccaggcaggtgctattcttcccttgtgtaacaccactgagctctcctgcactttccacctgccatccgaagcccaggaggtagccctcgttgcttataactctgccggtacctcaagacccacgcccgtcgtatttagcgagtcaagaggccccgcgcttacaaggctgcacgccatggcaagagaccctcattctctctgggtcgggtgggagccacctaatccgtggccacaagggtacgtgatcgagtggggcctcggaccaccctccgcctccaactcgaataaaacctggcgcatggagcaaaacggacgggcaactggattccttttgaaggagaacatacgcccatttcagctctatgaaatcatcgtaacacccttgtatcaggatacgatggggccctcccagcacgtctatgcttattcacaagagatggctccgagccatgcacccgagttgcatcttaaacacattggaaaaacttgggcccaactggaatgggtgcccgagcctccagagttgggtaaatcgcccttgactcattatactatattctggactaatgctcagaaccagagctttagtgcaatcctgaatgcctcctcgcggggcttcgttcttcacggcttggagcccgcaagcctgtaccatatccacctaatggcagcatcccaggccggcgccaccaacagtaccgtgctcactctcatgaccctcacaccggccggccggatcccttccggacaagtgtcccagacgcagctgaccgctgcctgggcacctggatgcccacaaagttggcgccgaatgcccagtagttgccctgccctggctcggcatccttcaccttcaagccaatgctggagacgaatgaagcgaagcaggtgtcccggatcaccgataactgcacagcgacccgttgcgagcccgctctggtctcggcccatgtgttctcgtggaactcaggaacagtttcctccgagccccaacccctcacttgccccagctatcagatcattcatggggtcatgctgggcagcgccgcaagctcagggtcagggcaccatttccgctgtcacaccactgagcccatcctggcgggcatcgcccccagcccccagtcctatgagaacgagtggttctagaccggccccttggggcccttggtag

SEQ ID NO: 183527 - DNA, 2511 bp, Artificial Sequence
  Description of Artificial Sequence: Synthetic coding sequence
atggcccggctgggcaactgcagcctgacctgggccgccctgatcatcctgctcctccctgggtccctcgaagagtgtggacacatttcagtgagcgcccccatcgtgcacctaggcgaccccataacggctagctgcattatcaaacagaactgtagccatttggacccggagcctcagattctatggcgcctgggtgccgaattacagcctggcgggaggcaacagcgattatccgacggaactcaagaatcgattattaccctcccccatttgaatcacactcaagccttcctctcctgctgtctcaattggggcaatagtctccagattctggatcaggtggagctgagggccggctaccccccggcgattccgcataacctcagctgcttgatgaatctgacaaccagttccctgatctgtcagtgggagccaggtcctgagacccacttgccaacctcttttacccttaagagcttcaaatccaggggaaattgtcagacccagggcgattctattttggactgtgttccaaaagacgggcaatctcattgctgcattcctcgaaagcatttactgttgtaccagaacatgggcatttgggtgcaggctgaaaacgcactgggcacgtcgatgagtcctcagctctgcctggaccccatggatgtggtgaagcttgagccaccaatgctccgtactatggatccctctccggaggcagcaccacctcaagccggttgtctgcaactgtgttgggaaccttggcagccaggacttcacataaaccagaagtgcgagctcagacacaagcctcaaagaggcgaggcgtcttgggcgctcgtgggcccactgcctctagaggcccttcagtacgaactgtgcggtttacttccggccacagcttacacgttgcagatcaggtgcatacgatggccgttacccggtcattggtccgactggtctccaagcctggaactgcgtacaacggaaagagcgcccactgtgcggctggatacatggtggagacagcggcagctcgacccccggaccgtgcagctgttctggaagccggttccactggaagaggactcaggaagaatccagggatacgtggtttcctggcgacccagtgggcaagccggagcgattctgccgctttgcaacacgaccgagcttagctgtacattccacctgccgagtgaggctcaagaggtagccctggttgcatataattctgccggaacatctagacctacccccgtggtattttccgagtcacgaggacccgccttaacgcgactgcacgcaatggcccgcgacccgcatagcctttgggtcggctgggagcctccgaacccctggcctcaagggtacgtgattgaatgggggctgggaccaccatcagcctccaactctaataaaacttggcggatggagcaaaacgggcgcgctactggcttccttttgaaggagaatattaggccttttcaattgtacgaaatcatcgtaaccccactgtaccaggacacaatgggccccagccaacacgtatacgcgtacagccaggaaatggcaccctcacatgctccagagctgcatctgaaacatatcggaaaaacgtgggcccaattggaatgggtccccgagcctccggagctggggaaatcaccactcacccactatacaatcttctggactaacgcccagaaccaaagtttctccgcaatcttaaatgcctcaagcaggggctttgtactgcacggcctggaaccagcctccctatatcacatccatctgatggctgcctctcaggctggcgccactaatagcaccgtgcttaccttaatgacgttaacccctgaaggctcagagctgcacattatcctcgggctcttcggtctcctgttgctgctcacatgcctatgtggtactgcttggctctgttgtagccccaatagaaagaacccactttggccctcggtgcccgatccagcccactcttccttaggcagctgggtacccaccattatggaggaagacgcgtttcagctacccgggttgggtacaccgcccatcacaaaattaacagtcctagaggaagacgagaagaaacccgttccctgggagtctcataactcgtcagaaacctgcggtctgcctacattagttcagacctatgtactccaaggcgatccccgtgcggtgagcacccagcctcagtcccagtccggtacctctgatcaggttctctacgggcagttgctcgggtcccctacttcaccaggccccggacactacctgcgttgtgattctacacagcccctgttagcaggcctgacaccctctccaaagtcctatgagaacttgtggttccaagcttccccattgggcactttagtcacaccagctcccagccaggaggatgactgtgttttcgggccgctcctgaatttcccgctgttacagggaataagggtgcacgggatggaggctttgggctcattttag

SEQ ID NO: 183528 - DNA, 2592 bp, Artificial Sequence
  Description of Artificial Sequence: Synthetic coding sequence
atggcccggctgggcaactgcagcctgacctgggccgccctgatcatattactgctgcctggttccctagaggaatgtggtcacatatcagtctcggcccctatcgtgcacctgggcgaccctataaccgcatcttgcatcataaaacagaattgctctcacctagatcccgagcctcagatcttatggcgactgggcgcagagctgcagccaggcggcagacagcagcgtttgtctgacgggacgcaggagagtattattaccctgccccatctcaatcacacccaagcctttctgtcgtgctgtctgaactggggcaattctttgcagattctggaccaggtggagctcagggccggttacccacccgccattccacataatctttcttgccttatgaatctgacaactagctcgctcatttgccagtgggaacctggtcccgagacacacctgcccaccagtttcacactcaaatcttttaaaagtcgaggaaattgccagacccagggggatagtatcctcgactgcgtgccaaaggatggacagtcgcactgttgcatccctcgtaaacatctcttgttataccaaaacatgggtatctgggtacaggctgagaacgctcttggcacatcgatgagccctcagctctgcttagatcctatggacgtggtgaaactggagcccccaatgctgaggacaatggacccatcgccagaggccgcccctcctcaggcagggtgcctgcagctgtgttgggagccttggcaacccggcctgcatattaaccagaagtgcgagctcagacacaagcctcaaaggggcgaagcctcatgggctttggtgggtccactgccccttgaggcactgcagtatgagctgtgcggcttgctaccagcgacagcgtatactttgcagatccggtgtattagatggcccttgcccggccattggtctgactggagcccatcgctcgagttacgtactaccgaaagagcccccacagttcggctggacacgtggtggcggcagaggcagctggatccaaggacagtccaactcttctggaaacctgtgccccttgaagaagacagcggccgcattcaaggctacgtggtaagctggaggccgtcaggccaggccggcgctatcctgccactctgtaacacaaccgagctgtcctgcactttccacctcccaagtgaagctcaagaagttgccttagtggcgtataactcggcagggacaagccggcctacgcccgtcgtgttcagcgagagtcgggggcccgcactaacgaggctacatgcaatggccagggatccgcattccctgtgggtgggatgggagccacccaacccctggccccaaggatatgtgatcgaatggggtttgggccctccctccgcgagtaacagtaacaagacctggagaatggaacagaatgggcgagctactggttttttgctcaaggaaaacatccggccttttcaactgtacgaaatcatcgtcaccccattgtatcaggacaccatggggccaagtcaacatgtttacgcctactcccaggagatggcaccctcacacgctccagaactccatcttaaacatatcggcaagacgtgggcacagttggaatgggtgccagagccacccgagctcggaaagtcacccctgacacactacacaatcttttggaccaatgcccagaatcaatcctttagcgctattctgaacgcctcgtcccgtggattcgtcctgcacgggctggagcctgctagcctgtaccacatccacctcatggccgcatcccaagctggagccacaaactcaaccgtcttgaccttaatgacattgactcctgaggggtccgagctgcacatcattttaggattgtttgggttgcttctgctgctgacttgcttatgtggcactgcttggctctgctgttcacctaaccgcaaaaacccactatggccaagtgtgcctgaccccgctcacagcagcctgggcagttgggttccaaccattatggaggagctgccaggccctcgtcagggacagtggctgggtcagacgtctgagatgtctagagccctgactccccatccctgtgtccaggacgctttccagcttccgggccttggcactccacctataacaaaactgacggtactcgaagaggatgaaaaaaagcctgtcccttgggaatcccacaactcctccgagacttgcggattgcccaccttagtccagacgtacgtgctgcagggcgatcctcgggccgtctcaactcagccacagagccaatccggcacaagcgaccaggtcctctatggtcagctgcttggaagccccacctctccaggccctggacattacctgaggtgtgacagcacccaaccactcctggccggactgacaccttctcccaagagctatgagaacctctggttccaggccagtccactgggcacgctggtgacccctgctcccagccaggaggatgattgtgtgttcgggccactgctgaactttcccctgctacagggcatcagagtgcacggcatggaggccctgggctccttttag

SEQ ID NO: 183529 - DNA, 2352 bp, Artificial Sequence
  Description of Artificial Sequence: Synthetic coding sequence
atggcccggctgggcaactgcagcctgacctgggccgccctgatcatcttgctcctccccggcagtctcgaggagtgtggtcatatcagcgttagtgcacccatcgtccatctcggagaccccattaccgcctcatgcattatcaagcagaattgcagtcatctggaccctgagccacaaatcctgtggcgcctgggggcggagctccagcccggaggacggcagcaacgtctgagcgacggtacccaggaaagcataattactcttcctcaccttaaccatactcaggcattcctgtcgtgttgtctcaattgggggaattctctgcagattttagaccaggtggagctgcgggcgggctatccccccgcaattccccacaacctgtcttgtttgatgaacctcacaacctcctctctcatttgtcagtgggaacccggacctgaaacccacctgcctacgtcttttactctgaaaagctttaaaagcagaggaaattgtcagacccaaggtgacagtattctggattgtgtacctaaggacggccagagtcattgttgcatacccagaaagcatttgctgttataccagaatatgggaatctgggttcaagccgaaaacgccttggggacgagcatgagtccccaactctgcctggacccaatggacgtggtgaagttggagcctccgatgcttaggacaatggatccatcccctgaagctgcacctccccaagctggatgcctgcaactctgttgggagccgtggcagccgggactgcacataaaccagaagtgcgaactgcggcataagccccagaggggggaggccagctgggctctagtgggaccgttacccctggaagcattgcaatacgagctctgcgggctattgccggccacagcctacaccttacaaataagatgtatccgttggccactgcccgggcactggtccgattggagccccagtctggagcttaggaccacagaacgggcacctacagtgaggctggacacgtggtggcggcagcggcagttggacccgagaaccgttcaactgttttggaagcctgtaccgctagaggaggatagtggccggatccagggctatgtggttagttggcgcccttctggacaagccggggccatactgccactctgcaatacaacagagctatcttgtactttccacctgccctccgaagctcaagaagtggccctggtggcgtataacagcgccggcaccagccgtccgacgccagtcgtgttctccgagtctcgcggccctgctctcacccgccttcacgctatggccagggacccacactcattgtgggtggggtgggagccacctaacccatggccccagggttacgtgattgagtgggggctcggtccacctagtgccagcaattcaaataaaacttggcggatggaacagaacggacgtgctacaggttttttattaaaggagaacattagaccatttcagctgtatgagataatcgtgaccccactctaccaggataccatgggccccagtcaacacgtctatgcatacagccaagagatggcccccagccatgcaccggagttacacttgaagcacatcggaaaaacgtgggcgcagctggagtgggtccccgagcccccagagttagggaagtcacctctcacacactatacaattttctggaccaatgcccaaaatcagtccttttccgcaattcttaacgcctcttcccgcggatttgtgttgcatggactggaaccagcctctctgtatcacatccacctcatggccgcctctcaggcaggtgcaaccaacagtactgttctgactcttatgacactcactccagagggctctgaactgcatataatcctgggcctgtttggattgctcctgcttctgacttgcctgtgcggcaccgcctggctatgctgtagccctaatcgtaaaaacccgctgtggccctccgtgcctgacccagcacattcctcgctcggtagctgggtccctactatcatggaggaggacgcattccaacttcccgggctggggacacctcctatcaccaaactgacagtccttgaagaagatgagaagaagcctgtgccatgggagtcacacaactcctcggagacctgcggactgccaacccttgtccagacctatgtgctacaaggagaccccagggccgtgagtacccagccccaaagccagtccggcacgtcagatcaggcggggcctccaagaagaagcgcttactttaaagatcagattatgctccaccctgcacctcctaatggtttgctatgcctgtttccaatcacatcggtgctctag

SEQ ID NO: 183530 - DNA, 2511 bp, Artificial Sequence
  Description of Artificial Sequence: Synthetic coding sequence
atggcccggctgggcaactgcagcctgacctgggccgccctgatcatcctgctgttgccgggatcccttgaggagtgtgggcatattagcgtgtcggccccgattgtgcaccttggtgaccctattaccgccagctgtatcattaagcaaaactgctcgcacctagaccctgaacctcagatcctgtggcggctcggcgcggagttacagcccgggggtaggcagcagaggctgtccgacgggacacaggaatctattatcactctccctcatctcaaccacactcaggcattcctgagttgctgcctgaactggggcaactccctgcagatcctggaccaggtggaacttcgggcaggctatccacccgccataccccataacttatcttgtcttatgaatcttactacctcgagcttaatctgtcaatgggaacccggcccagaaacacacctgccaacttcgttcactctgaaatcatttaaaagcagggggaactgtcagactcaaggtgacagtatcctcgactgcgtgcccaaagatggacagtctcattgctgcataccccgcaagcacctgctattgtatcagaacatgggcatatgggtgcaagccgaaaacgccctgggaacaagcatgtcacctcagttgtgtctcgatcctatggacgtcgtcaaacttgagccaccgatgcttcggaccatggatcccagcccagaggccgcccccccccaggccggatgtcttcaactctgctgggaaccttggcagcccggcctgcacataaatcagaagtgtgagctgcgtcataaaccccaacgcggggaagcaagctgggcgttggtaggccccctccctcttgaagctctccagtacgagttgtgcggcctacttcccgcaactgcatataccctccagataagatgtattcgatggcctctccctggccactggtccgactggtctccttcacttgaattaaggaccaccgagcgcgcccctaccgtccgcctagacacctggtggcgtcagcggcagctggatccacgcaccgtgcaactcttctggaagccagttccgctcgaggaagattctggcagaatccagggatatgtggtgagctggaggcctagcggccaggccggcgctatcttgccactttgtaataccactgaactgagttgcacattccatctgccgtcagaggcccaagaggtcgcacttgtagcatataacagcgcaggtacttcaaggcccactccagtggtcttttcagagtctcgggggccggcattgacacgcctccacgcaatggccagggatccacattcactgtgggtgggctgggagcctcccaacccatggccccagggctatgtaatcgaatggggcctgggacctcccagtgcttctaattctaataagacttggcgaatggaacagaatggccgagcgacgggcttccttctcaaagagaacatcagacccttccagttgtatgagattattgtcacccctctctaccaagataccatgggcccctcacagcatgtttatgcttactcccaagaaatggccccatctcacgccccagagctccacctaaaacatattgggaaaacctgggctcagctcgagtgggttcccgagcctcctgagttgggaaagtcaccccttactcactacactatcttctggactaacgcacagaaccaaagcttttcagccattctgaacgctagttccagaggttttgtgctacacggcctggagccggctagcctgtatcacattcatttgatggctgcctcacaagcaggggctaccaattccaccgtgttaaccctgatgaccctgacacccgagggtagcgagctacacatcatcctggggctctttggactgctgctgttactgacctgcctgtgtggcacagcctggctgtgttgttcacccaaccggaagaatccgctgtggccgtctgtccctgatcctgcacacagctctctgggatcctgggtgcctaccatcatggaagaagacgccttccagctccctgggctgggaactcctccaattactaagctcaccgtactggaagaagatgaaaagaagcctgttccttgggaaagccacaattcatctgaaacatgtgggctgccgacgctggtgcagacgtacgtgttgcagggagatccccgggccgtttctacccagccgcaatctcagtccggcacgagcgatcaagtcctgtacggtcaactgctggggtcccctactagtcccggccctggacactatctgcgatgtgattctacacaacctctgctggccggactgactccatcgccaaagagttatgagaacttatggttccaagcatctcctctcggcacccttgttacgcccgccccctcacaggaagatgactgtgtgttcggcccgcttctgaattttccactactgcaggggatcagagtgcatggcatggaggccctgggcagcttttag

SEQ ID NO: 183531 - DNA, 2511 bp, Artificial Sequence
  Description of Artificial Sequence: Synthetic coding sequence
atggcccggctgggcaactgcagcctgacctgggccgccctgatcatactgctgctgccgggatcactggaggaatgcggccatattagcgtgagcgctcctatagtgcacctaggcgacccaataacagcttcgtgcattatcaagcagaactgttcccacctcgaccctgaaccccaaattctttggcgcctcggggcagagctacaacctggaggcaggcagcagcgcctgtcagacggcacgcaggaatccatcattactctgcctcacctgaaccatactcaggcattcttgagctgctgtcttaactggggcaatagccttcagattctcgaccaggtggagctgcgcgctggatatcctcccgccatcccccataatctttcatgcctaatgaacttgaccacatcgtccctcatatgtcaatgggagcctggaccggagacccaccttcccacgtctttcacactaaaaagctttaagtcacgggggaattgccaaacccaaggtgattctattctggattgcgtgccaaaagatggacagtcccattgctgcattccgcggaagcacctcttactgtaccagaacatgggcatctgggtgcaggctgaaaatgctttaggcaccagcatgtctccccagttgtgcctcgaccctatggatgtcgtgaagctggagccgcccatgctcaggaccatggatccgtcccctgaggctgcccctccacaggccggttgcttgcagctctgctgggaaccctggcagccagggctccatataaatcagaagtgtgagctgcgccacaaacctcagcggggagaggccagttgggcactggtgggccccctcccattggaggctttacagtacgagctctgtggtcttctccctgctacagcctataccttacagattcgctgcatccggtggcccctccctggccactggtcagattggtcaccttcattggaactccgtactacagagcgggcaccaacagtcaggttggatacctggtggcgtcagcgccaactggatcccaggaccgtacagctcttctggaaaccggttccacttgaagaggatagcggtcgaatacaggggtacgttgtgtcatggagaccctcaggccaggccggcgcaatcctgcccctgtgtaataccaccgagctgagttgcacatttcaccttccgagtgaagcccaggaggtcgctctcgtggcctataatagcgctggaacctcacgacctactccagtagtttttagtgagagccgggggccagctctgaccagactccacgcaatggctcgagacccccactccctttgggtgggctgggaaccaccaaacccatggccacagggatacgtgatcgaatggggactgggaccgccaagcgcatccaattcgaacaagacatggcggatggaacagaacggccgcgctacaggattcctgcttaaagaaaatattaggccatttcaattatacgagatcatagtaactccactgtaccaggatactatggggccttcccagcatgtgtacgcgtattcgcaggagatggcgcctagtcacgctcctgagcttcacctgaaacatattgggaagacgtgggctcagctggaatgggtaccagagccccccgaacttggcaaatcaccactcacccattacaccatcttctggaccaacgctcagaaccagtcgttttccgccatcttgaacgccagttcccggggttttgtgctgcatggcctagagcctgccagcctttatcatattcacctgatggctgcctctcaggccggagccaccaatagcaccgtgctgaccttgatgacccttacaccagaaggctctgagcttcacattattttagggctctttgggctgctcctcctgctcacttgtttgtgtggcactgcctggctttgttgtagtcctaacagaaaaaaccctctgtggccctccgtccccgaccccgcgcattccagtctcggtagctgggtgccaaccatcatggaggaagacgctttccaactgccaggattaggcaccccacctatcacgaagttaaccgtccttgaagaagatgagaaaaagccagttccgtgggaaagccacaattcttctgagacttgtggcttaccaacccttgtgcagacctatgtgctgcaaggagacccccgcgccgtgagtacacagccccagtcccaatcaggcaccagcgatcaggtcttatatgggcagctacttggctccccaacatcccccgggccaggccattacctgcgctgtgactccacccaaccactgctagcgggactaacgccaagccctaaatcttatgaaaatctgtggttccaagctagccctttaggcaccctggtaacccctgctccctcacaggaggacgattgtgtttttggccctctgctgaacttcccattgctgcagggtatccgcgtgcacggcatggaagccctgggcagcttttag

SEQ ID NO: 183532 - DNA, 2592 bp, Artificial Sequence
  Description of Artificial Sequence: Synthetic coding sequence
atggcccggctgggcaactgcagcctgacctgggccgccctgatcatcttactcctgcccgggagcctcgaggaatgcggacacatttccgttagcgctccgatagttcatctgggcgaccccataactgcctcctgcataatcaaacagaactgctcgcacctggacccagagcctcaaatactgtggagactgggtgccgagttgcagcctggtggacggcagcagaggctctccgacggcacgcaggagtcaatcattaccctgccccatctgaatcacacacaggccttccttagttgttgtctcaattgggggaatagtcttcagatacttgaccaggtcgagttgcgagctggctatccacctgctattccccataacctctcttgtcttatgaatctcactacaagctccttgatttgccaatgggagcccgggccagagactcacctccccacctcctttacacttaaaagctttaagagtcggggcaattgccagacacagggagactctatccttgactgtgtccccaaggatgggcagtcacactgctgcatcccgaggaaacatctcttactttaccaaaatatgggcatctgggtgcaggcagaaaacgcactcggtacctcaatgtccccgcagctctgtctcgatcccatggacgtggttaagctggaaccacctatgcttcggaccatggatcctagccccgaagctgcaccaccacaggccgggtgtctgcagctgtgctgggagccctggcaacccgggttgcatatcaatcagaaatgcgagcttagacacaagccccagcgcggtgaggcatcttgggcgctggtgggccctctccctctggaggctcttcagtacgagctgtgtggtttactgccagcaacggcctataccctgcaaatcagatgcatccggtggccgctgcctggacattggtcagactggagtccatcgctggaactccgcaccactgagagggcccccactgtccgcctggacacctggtggagacaacgacaacttgaccccaggactgtgcagctcttctggaagcccgtgcctctggaagaggactccggccggatccagggttatgtggtctcctggcgaccaagcggccaggcaggggccatccttccattgtgtaacaccacggagctatcatgtacttttcacctaccgtccgaggcccaggaggttgctttggttgcttacaattccgcagggacttcccgtcccacgcctgtggtcttctctgaatcaaggggacccgctttgacccgtttacacgctatggcccgcgatcctcattctctatgggttggctgggagcccccaaacccctggccacagggatatgtgatcgagtgggggctgggacctccctcagcatccaactctaataaaacgtggcgcatggagcagaatggccgcgcgacaggctttctgctcaaggagaatatcaggccgttccaattgtacgaaataattgtaacacctctctatcaagacacgatgggccctagccagcacgtgtacgcctactcccaggagatggcgccgagtcatgcccctgagctgcacctgaagcacattggcaagacctgggcccagctcgagtgggttcccgagcccccggaactgggcaagagtcccttaacccactacacaatcttctggacaaatgcccagaaccagagcttctcagcaattcttaacgcatcaagtcgagggttcgtgcttcatgggctggaacccgcctccctgtaccatattcacctgatggctgcatctcaggcaggcgcaaccaactctaccgttctgacactaatgaccctgacacctgagggttcagagttgcacattattctaggccttttcggcctcttactcctgttgacatgtctctgcggaacggcttggctgtgttgctcaccgaaccgcaaaaatcccctgtggccttccgttcccgaccctgctcactcttcattaggtagctgggtgccaacgattatggaagaactcccaggccccagacaggggcaatggctggggcagacaagcgagatgtcccgcgcactgactccccatccctgcgtgcaagatgccttccagttacccggtctggggactcctccgatcacaaagctcaccgtcctggaggaagacgagaaaaaacctgtgccctgggagtcccacaacagtagcgagacatgcggtttgccaaccctggtgcagacctatgtgctccagggggatccgagagctgtgtcgacacagccccagtctcagtcgggaacaagcgaccaggtgctgtacggacagctgctaggcagccccacaagccccggtccaggtcactacctgaggtgcgacagcacacagccccttttagctgggctgacaccgtcccctaaatcatatgaaaacctgtggttccaggccagtccacttgggaccctcgtaacaccagctccctctcaagaggatgattgcgtgtttggtccactgctgaacttccctctcctccaggggatccgcgtccatggaatggaggccttaggatcattctag

SEQ ID NO: 183533 - DNA, 1167 bp, Artificial Sequence
  Description of Artificial Sequence: Synthetic coding sequence
tgaaccagccggcccacccccgtggtgttcagcgagagccggggccccgctctgactagactgcatgcgatggccagagacccccacagtctgtgggttgggtgggagccccctaatccctggccacagggatacgtgatagaatggggactaggccctccttctgcgtcaaattcgaacaagacatggagaatggagcagaacgggagagccacggggttcctcctgaaggcgccctcccatgcccccgaactccacctgaagcacattggcaaaacctgggcacagttagagtgggtgcctgagccccccgagctcggcaaaagtcccctgacccattacacaattttttggaccaacgcccagaaccagtccttcagcgccatcctcaatgcaagttctagggggtttgttctccacggacttgagcctgcctccttataccacatccatctgatggctgcttcccaggcgggtgccactaactctactgtgctgacgttgatgacgctaaccccagaaggctccgaattgcatattattttgggtctgttcggactgcttctcctactgacctgcttgtgcggtactgcctggctttgttgcagtcctaacagaaagaatccattgtggccctccgtgcctgacccagctcacagctcgttaggctcatgggtgcccacaatcatggaagaggacgcctttcagctacctgggcttggaacccctccaattacaaaacttactgtgctggaggaagatgagaaaaagccggtcccatgggaaagtcataattcctctgaaacgtgcgggctgcccactctcgtgcagacttacgtacttcagggtgacccgcgagccgtgtctactcagcctcagtcacaatccggtacgtctgatcaagtgctttacggccagctactggggtcccccactagtccgggccctggtcattatctccggtgtgattcaacacagccattattggcaggtctgacccccagccccaagagttacgagaacctctggtttcaggccagccctttggggacacttgttacccccgcgccatcccaggaagatgactgcgtgttcggtcctctgctcaacttccccttgttgcaggggatccgcgtccatggcatggaggccctaggttctttctag

SEQ ID NO: 183534 - DNA, 66 bp, Artificial Sequence
  Description of Artificial Sequence: Synthetic coding sequence
atggcccggctgggcaactgcagcctgacctgggccgccctgatcatcctattgctgcccgggtag

SEQ ID NO: 183535 - DNA, 675 bp, Artificial Sequence
  Description of Artificial Sequence: Synthetic coding sequence
atgagcgccgtgggcgccgccaccccctacctgcaccaccccggcgacagtcactctggacgcgtgtcattcttgggtgcacagttgcctcctgaggttgcagcgatggcacgcttactaggcgacctcgatagatccaccttccgtaagctgttgaagttcgtagtgtcatctcttcagggcgaggattgtcgggaggctgtccaacgcctgggagtgtcagccaacctgcccgaagagcagctgggcgctctgctggcagggatgcacaccttgcttcagcaagctctgagattaccacccacttccctgaagccagatacgtttcgggaccagctgcaggaactgtgcatcccacaggatctcgtcggcgacctcgcttctgtggtcttcgggtctcagcgaccccttctggacagcgttgcccagcagcagggggcctggctcccgcacgtggcggactttcgctggcgcgtggacgtcgccattagcacatctgcgttagcccgaagtctccagcctagtgtgctgatgcagctgaaactcagcgacggcagcgcttatcgctttgaggttcccactgcaaaattccaggagctgaggtatagcgtcgccctggtcttaaaggagatggcggatctggagaagaggtgtgaacgcaggctgcaggactag

SEQ ID NO: 183536 - DNA, 675 bp, Artificial Sequence
  Description of Artificial Sequence: Synthetic coding sequence
atgagcgccgtgggcgccgccaccccctacctgcaccaccccggcgatagtcatagcggcagggtgtcttttctgggggcgcaactgcccccggaagtcgctgcgatggctaggctcctgggagatctcgaccgctcaacgttcaggaagctgctcaaatttgtggtgagctcactgcagggggaggactgccgggaagctgtgcagagactcggagtgagtgctaatctacctgaggaacagctcggggccctgctggctgggatgcatactctcctgcaacaagcactcagacttccgcctacatcactgaagccggacacctttcgggatcagctgcaggagctttgcataccgcaggatctcgttggagacctcgcaagtgtggttttcgggtcacaaaggcctttgttagattcagtggcacagcagcagggggcatggctcccacatgtggccgatttcaggtggcgggttgatgtcgctatctccacgagcgccctcgcacgctcgttgcaacctagcgtgttgatgcaactgaaactcagtgacggttcagcctaccggttcgaggttccaacagccaagtttcaggagctgagatattcagtcgccttagtcttgaaagaaatggccgatctcgaaaaaagatgcgagcggcgcctccaggattag

SEQ ID NO: 183537 - DNA, 675 bp, Artificial Sequence
  Description of Artificial Sequence: Synthetic coding sequence
atgagcgccgtgggcgccgccaccccctacctgcaccaccccggcgactcccatagtggaagagtgtcatttctgggcgctcagcttccgcctgaagtggcagccatggcccgcctgctgggcgatctcgacagaagtacgttcaggaagctgctgaaattcgtggtcagctcattacagggcgaagactgcagggaggccgttcaacggctcggggtgtcagccaatttaccagaggaacaactcggagccttgctggccggcatgcacacactactccagcaggcgctcaggttgccaccaacaagcctgaagccagacaccttccgtgaccagctccaggaattgtgcattccccaggatctagttggggatctggcatctgttgtctttggcagccagcggcctcttctagattctgtggcacaacagcagggtgcatggctgccacatgtggccgattttaggtggcgcgtggatgtggccatctccacatccgccttggctcgctccttgcagccctctgtccttatgcaactcaagctgagtgatggaagcgcctacaggttcgaggtacctacagcgaagttccaggagttacgctattctgtggcacttgttctgaaggaaatggcagacctggagaagcgttgcgaaaggcgcctccaggattag

SEQ ID NO: 183538 - DNA, 297 bp, Artificial Sequence
  Description of Artificial Sequence: Synthetic coding sequence
atggaggccagcagcgagccccccctggacgccaagagcgacgtgacaaatcagcttgtcgactttcagtggaaactcggaatggcagtgagttcagatacatgtcgaagcttgaagtatccctacgtagcggtcatgctaaaagtggccgaccatagcgggcaggtcaaaacgaagtgcttcgagatgaccattccccaatttcagccccagcttctagctacttcttcactcttgtcagcctccaacttctacaggcagttcaaggaaatcgcagctgttattgaaactgtttag

SEQ ID NO: 183539 - DNA, 258 bp, Artificial Sequence
  Description of Artificial Sequence: Synthetic coding sequence
atggaggccagcagcgagccccccctggacgccaagagcgacgtgacaaatcagctcgtcgactttcagtggaaactgggaatggccgtttcttcagacacctgtcggtcgctcaagtacccttacgtcgccgtgatgcttaaggtcgctgaccactctggccaagttaaaaccaagtgcttcgaaatgacaattcctcaattccagaacttctaccggcaattcaaagagattgctgctgtcatagagacggtgtag

SEQ ID NO: 183540 - DNA, 258 bp, Artificial Sequence
  Description of Artificial Sequence: Synthetic coding sequence
atggaggccagcagcgagccccccctggacgccaagagcgacgtgactaatcagctcgtagactttcagtggaaactgggaatggctgtttcctcagatacgtgtagatccttaaagtatccttatgtggctgtaatgttgaaagttgctgatcattcgggccaagtgaagacaaaatgtttcgaaatgacaatcccacagttccaaaacttctaccgccagttcaaggaaatagccgcagtgatcgaaacggtttag

SEQ ID NO: 183541 - DNA, 7470 bp, Artificial Sequence
  Description of Artificial Sequence: Synthetic coding sequence
atgggcgccagcagcccccggagccccgagcccgtgggcccccccgcacccggtctaccattttgttgtgggggctccctgcttgccgttgtcgtacttctggctctcccggtggcttgggggcaatgcaatgcacccgaatggttgccatttgcacgccccacaaatctcactgatgaatttgagtttccaatcggcacctatctcaattatgagtgtcggcctgggtatagtggcagaccattttccatcatatgcttgaaaaactccgtgtggacaggggcgaaagataggtgtcggaggaaatcttgcaggaaccctcccgatcctgtaaacggcatggtgcatgtaattaaagggatccagtttggcagccagattaagtacagttgtaccaagggttatagactgattggcagctcctcagctacttgtatcatcagcggggataccgtgatttgggacaacgagacacccatttgcgaccgaatcccatgtggcctgccccctaccatcacaaatggggacttcattagcacgaatcgcgagaactttcattacggctctgtggtgacctacaggtgtaacccaggctccggtggccgaaaggtcttcgagcttgtcggggagccctctatttactgcactagcaacgacgaccaggtgggcatttggtctggcccagctcctcagtgcatcattcctaataaatgcacacccccaaacgtggaaaatgggatactcgttagcgataatcggagcctcttttctctcaatgaagtagtcgaattccgttgtcaacccgggttcgtcatgaaagggcctaggagagtgaaatgtcaggctttgaataagtgggagcctgaactgccaagttgcagccgggtgtgtcagcccccccctgatgtgctgcacgctgagcgcacccagcgcgataaagacaatttttctccaggtcaggaggtgttctacagttgcgagcccggttacgatctcaggggtgctgcctccatgcgttgcacacctcagggtgattggtctcctgcagccccgacatgcgaggttaaaagttgcgatgactttatgggacagctgttgaacggcagagtgcttttccctgtaaatcttcaactaggggcaaaagttgattttgtgtgcgacgaaggtttccagctcaaggggtcttccgctagctattgtgtcctagctggcatggagtccctctggaattcctcggtgccagtgtgcgaacagatcttttgcccatctccacccgtgatacccaacggcaggcacaccgggaagcctctggaagtgtttccatttggtaagactgtaaactatacgtgcgatccgcatccagatcggggcacatcttttgaccttatcggtgaatccaccatccgatgcaccagtgacccacaagggaatggcgtatggagttccccggctcccagatgtggcatcttaggtcactgccaagcccctgatcattttctcttcgccaaattaaaaacccagaccaacgcatcagatttccccatcggaacaagtctcaaatacgaatgcaggcctgagtattacggccggcctttcagcatcacgtgcctggataacttggtctggtcctcccccaaggatgtctgtaagcgcaaatcttgtaaaactcctcctgaccctgtgaacgggatggttcacgtgatcacagatatacaggtgggaagcagaataaactattcatgcactacgggccaccggttgattggacattcttcagctgagtgcattttaagcgggaacgctgcccactggtccacaaagccgcctatatgtcagcgcattccatgtggcttgcctccaaccatcgccaacggagattttatctcaacgaatagagaaaactttcattatgggtcggtggtcacgtaccggtgtaaccccggcagcggaggccggaaggtgtttgagctggtcggcgagccatcaatctattgcacaagtaacgacgaccaagtcggaatttggtcagggcccgctcctcagtgtatcattcccaacaagtgcaccccgccaaacgtagagaatggaatcctggtctctgacaacaggtccttatttagtttgaacgaggtcgtggaatttcgctgtcagccaggctttgtcatgaaaggaccaagaagagtcaagtgccaggctttaaacaagtgggaacctgaattgccctcatgcagccgcgtgtgccagcccccccctgacgtgcttcatgccgagcgaacacagcgcgataaagacaacttcagtcccggccaggaggtattctactcttgtgagcccgggtacgacttgagaggggcagcctccatgaggtgtacacctcagggagactggtcccccgcggcgcccacctgtgaagttaaatcttgcgacgattttatgggacagctgttaaatggccgggtgctgttccctgtaaacctacaacttggagctaaggtggacttcgtttgcgacgaagggtttcaactgaagggcagcagtgcaagttactgcgttctggccgggatggaatcactctggaacagttccgtccctgtatgtgagcaaatcttttgtcctagcccaccagtaatcccaaatggacgccacaccggcaagcctctggaagtatttccgtttggaaagacagtcaattatacctgcgacccccatcccgacagaggtacaagctttgatctgatcggcgaatcaaccatcagatgcaccagtgatccccagggcaatggggtttggtcttccccagccccaagatgtggaatccttggtcattgtcaggctcctgatcattttttgttcgcaaaactgaaaacacaaaccaacgcttctgattttcccattggaacatcgcttaaatatgagtgtagaccagaatactacggacggcccttctctatcacatgtctggataatctggtgtggtcgtctcccaaggacgtgtgcaagaggaaatcatgtaagactccgccagacccagtcaacggcatggtgcacgttatcaccgatatacaagttggaagccgtataaattatagctgcactacgggccataggcttatcggacattcctcagctgaatgcatactctctgggaatgctgcccactggtccactaagcctcccatctgtcagagaatcccctgtggccttccacccaccattgcaaatggcgatttcatatctactaatcgagaaaactttcactatgggtccgttgtcacgtacaggtgcaaccctggctctggggggagaaaagtctttgaactggtcggagagccatctatttactgcaccagtaatgacgaccaagttgggatatggtcaggtccagcaccacagtgcatcatccccaataagtgtacacctccgaacgttgaaaacggaattctggtgagcgataaccgttctttgttcagcctgaatgaggtagtggagttcaggtgtcaacctgggtttgtcatgaaagggcctcgtagggtgaaatgccaagcacttaataaatgggaaccagaactgcctagctgtagcagagtctgccagcccccccctgatgtactgcacgcggaacgcacacaacgcgataaagacaatttctccccagggcaggaggtcttttactcatgcgaacccggttacgacttaaggggcgccgcttctatgcgatgcaccccacaaggagactggtcacccgctgcgccgacttgtgaagtcaagagttgcgatgacttcatggggcagctgttaaatgggcgcgtgttgtttccagtaaacctgcagctgggtgccaaggtggattttgtgtgcgacgaaggcttccaactgaaggggagctcagccagctactgtgtgctcgccgggatggaaagcctgtggaattcaagtgtcccagtttgcgaacagatcttctgccctagtcctcctgtgatacctaatggacgccatactgggaaacccctggaggtgttcccgttcgggaaggctgtaaattacacttgtgacccccatcccgatcgaggcacaagtttcgatctgatcggggagtccacaattaggtgcacttcagatccacagggcaacggggtgtggagctccccagcgccacgctgcggcatacttgggcactgccaggctccagaccatttcctgtttgccaaattgaagactcagacaaatgcttccgactttccgatcggaacttccctcaagtatgagtgtcgcccagagtattacggccgccctttcagcatcacgtgtctggacaatctggtgtggagctcaccaaaggacgtctgtaagcggaagtcctgtaaaaccccgcctgatcctgtcaacgggatggttcacgttatcactgacatccaagtcggtagccggattaactattcgtgtacgactgggcatagattgataggccactcctctgccgagtgcattcttagtggtaacaccgctcactggtcgactaagccgcccatttgccagaggattccctgtggtctgcctccgacaatcgcaaatggtgactttatctccacgaaccgcgaaaacttccattatgggtctgttgttacctacaggtgcaacttgggttcccgcgggcggaaagtgttcgagctggtcggtgaaccttctatctactgcacttcaaacgatgatcaggtgggcatttggagcggtcctgcaccccagtgtattattccgaacaaatgcacacctcctaatgttgaaaatggaattctcgtttctgacaaccgcagcctgtttagtcttaatgaggtcgtagagttcaggtgtcaaccaggattcgtcatgaaaggccctcgcagagttaaatgtcaggccttgaataaatgggagcctgaactgccctcatgttcccgggtatgccagccccctccagagattctgcatggtgagcacactccaagccatcaggataactttagtcccgggcaggaggtgttctatagttgcgagccgggctatgatctgcgtggggcagcctcactacattgcacccctcagggcgattggtcgccggaggccccccgctgcgccgtaaaaagttgcgacgactttttgggccaactgccccacggcagagtgctgttcccactgaatttgcaactcggagccaaggtgtcattcgtctgcgacgagggatttagattgaaagggtcatcagtgagccactgcgttcttgtcggcatgcgcagcctgtggaacaattcggtccccgtgtgtgagcacatcttctgcccaaatcctcctgctattctgaacggccgccatactggcaccccctccggagacataccctacgggaaagaaatttcttacacttgtgatccgcacccggacaggggtatgactttcaacctgattggcgaaagtactatcaggtgtacttctgatccccacggaaatggtgtctggtcctcgcctgccccccgttgcgagctttctgtgagagccggccattgtaaaactcccgaacagtttccgtttgcgagtccgaccattcctatcaacgacttcgaattccccgtcggaacaagcttgaattacgagtgccgacccggttatttcggaaagatgttcagcatctcttgcttggaaaaccttgtgtggtcttccgttgaagataactgtcggcgcaagtcttgtgggccaccccctgagcccttcaacgggatggtgcacattaacacggacacacaattcggtagtaccgtgaattactcatgcaacgagggctttaggctgataggctcaccctcaactacttgcctggtaagcggaaataatgtgacttgggataagaaggctccaatctgcgaaattatctcttgtgaaccccccccaaccatatccaacggtgacttctattcgaacaatcggacgtcttttcacaacggaacagtggtgacataccagtgtcacaccggacctgacggggaacagctctttgaattggtcggggaaaggtctatttactgtacttcaaaggacgaccaggtaggtgtgtggagctcccccccaccccgatgcattagcactaataagtgtactgccccagaggtcgaaaacgccatccgtgtccctggcaaccgttcattcttcaccctgactgaaataattagatttcggtgtcaaccgggcttcgttatggtcggaagtcacaccgtccagtgccagaccaatggccggtgggggcctaagttgccccattgcagccgcgtttgccagccgccaccagaaattctgcacggtgagcacaccctgtcccaccaggataacttcagccctggtcaggaggttttctatagctgcgagccatcgtatgatctcagaggggctgcgagcttgcactgtactccccagggagattggagtcccgaagctccaagatgcacagtcaagtcttgtgacgacttcttgggacagctcccacatggccgcgttctgctgcccctaaatctgcagcttggcgctaaagtctcattcgtatgtgacgaaggcttccgcctgaaaggcaggtccgcctcacactgcgtactcgccggcatgaaggcactctggaattcgagtgtgcccgtttgtgagcagatcttctgcccgaacccccctgcgattctgaatgggcgccacacagggacaccattcggggacatcccttacggcaaggagattagttacgcttgtgacacccaccctgaccgcgggatgaccttcaacctcatcggtgagagcagcatcagatgtacctcagatcctcaaggaaacggcgtatggtcaagccccgccccacgatgtgaactgtctgttcccgcggcttgtccgcacccgccaaagatccagaacgggcattatatcgggggacacgtgtccttgtatctgcccggtatgaccatttcttatatttgtgaccctggctacctcttggtaggcaaggggtttattttctgcaccgatcagggtatctggtcgcaactggaccactattgcaaagaagtcaattgttcttttcccctcttcatgaatgggatttccaaggagctggagatgaagaaggtttaccactatggagattatgtgactctcaagtgtgaagacggttacacactggaaggttcaccctggtcccagtgccaagcggacgaccgatgggatccgcccctcgcaaagtgcacttctcggacccacgacgcgttgattgtgggaacactttccggcacgatcttctttattctattaatcattttcctgtcctggattattctgaaacaccgcaagggaaataacgcccacgaaaatcccaaggaagtggccatccatttgcacagtcagggcgggtcctcggtgcatcctcggactctgcagacaaatgaggagaacagcagggtcctgccgtag

SEQ ID NO: 183542 - DNA, 6120 bp, Artificial Sequence
  Description of Artificial Sequence: Synthetic coding sequence
atgggcgccagcagcccccggagccccgagcccgtgggcccccccgcccctgggctgccattttgctgcggaggctccctgctcgctgtggtagtgctattagccttgcctgtggcgtggggtcagtgcaacgcacccgaatggcttccttttgcgcggcccactaacctcactgatgagtttgagttcccgattggcacgtatctgaattacgaatgtcgcccaggatactcagggaggccgttcagcatcatttgcctgaagaacagcgtctggaccggcgcaaaggaccgttgccggagaaagtcctgtagaaaccctccggaccccgttaacggtatggtgcatgttattaaagggattcagttcgggagtcagattaagtatagctgcaccaagggatatagactgatcggcagctccagcgcaacatgtatcatctcaggcgatacggtgatatgggacaatgagacccctatctgtgacaggattccctgtgggttaccacctaccattgccaacggggatttcattagtaccaatcgagagaacttccactacgggagcgtagttacatataggtgtaaccctggcagcgggggccggaaggtttttgaattggtgggcgagccttcgatttattgtacttctaacgatgaccaggtggggatttggtccggacccgccccacagtgtattatccccaataaatgcaccccgcccaacgttgaaaatggaattctggtttctgataatagaagtctgttttctcttaacgaggtggtggaattcaggtgtcagcccgggttcgtgatgaagggacctcggcgcgtgaaatgtcaggctctgaacaagtgggagccggagcttccaagctgctcacgcgtctgccaaccccccccagatgtgttgcatgccgaacgcactcagcgcgataaagataacttctcccccgggcaagaggtgttctacagctgcgaacccggctacgacctccgaggagccgccagcatgagatgcaccccacagggggattggtccccggccgctcccacttgtgaggtcaagtcatgcgatgacttcatgggccagctgttgaatgggcgcgttctattcccagttaatctgcagctcggcgccaaggttgatttcgtgtgcgatgagggctttcagctcaagggcagtagtgcatcttactgcgtactggcaggcatggaatcactttggaactcttcggtgcctgtctgtgagcagattttctgtccatccccacctgtgatcccgaacggacggcatacaggcaagccactcgaggtgttcccattcggtaagactgtgaactacacctgcgatccacatcccgatagaggaacttcctttgatctgatcggcgaatcaaccatcagatgcactagcgacccgcagggtaacggcgtatggtcaagccctgcacccaggtgcgggattcttgggcactgtcaggcaccggatcactttttgtttgccaaacttaaaacacaaactaacgcttctgattttcctataggaacatccctcaagtatgagtgcagacccgagtattatggaagacctttctcgatcacctgtctcgacaacttggtttggagttctcccaaggatgtctgtaaaaggaagtcttgcaagacaccacctgatcctgtgaatggcatggtgcatgtgatcacagacattcaagttgggagccggatcaattattcatgtaccaccggccacaggctaatcgggcatagctcagcagaatgtatcttaagcgggaatgccgctcactggtcaaccaagccccctatttgtcagcgtatcccctgcggactgccacccaccatcgcaaatggcgacttcatttccactaaccgggagaactttcactatggttctgtggtcacatacagatgtaatcctggatccggtggcaggaaggtcttcgagctcgtgggtgaaccttctatctattgtacgtccaacgatgaccaggtgggaatctggagcggccctgctcctcagtgcataattcccaacaaatgtactccccccaatgtggagaatggaattctcgtctctgacaaccgatccttgttctcactgaacgaggtagtcgaatttaggtgccagcccggctttgtgatgaaggggcccaggagggtcaagtgccaagccttgaataaatgggagcctgaactgccttcttgctcacgagtgtgccagccacccccggacgtacttcacgcggaacgcacacagagagacaaggacaatttctcacccggacaggaagtgttctacagttgtgaacctggctacgacttaaggggggctgcttcgatgaggtgcactccacagggagactggagcccggccgctcccacctgcgaggtgaagagctgtgatgatttcatgggacagctcttaaatggacgtgtgctctttcccgtgaatttacagctgggcgccaaggttgacttcgtgtgtgacgaaggattccagttaaaggggagctctgcatcctactgtgtccttgccggcatggaaagtctttggaattcatcagtccctgtctgtgagcaaatcttttgcccgagcccaccagtgattccgaacgggagacacaccggcaagccacttgaagtgtttccttttggtaaggcagtgaattacacctgcgacccacaccctgatcgaggcacatcatttgacctgatcggcgagagtacaattagatgtacaagtgatcctcaggggaatggagtgtggtcaagccccgccccgcgctgcggaattctgggccattgtcaagccccagaccactttctcttcgccaagttaaagactcagacaaacgcgtctgacttccccattggaacaagcctgaagtacgaatgccggcccgagtactatggccgaccttttagtatcacctgcctggataaccttgtgtggtcatccccaaaggatgtgtgtaagcggaagtcctgtaaaacacccccggaccctgttaacggtatggtccacgtcatcacagacattcaggtcggctctaggattaactattcatgcaccactggacataggctgattggtcactcttccgctgaatgcattctaagcgggaataccgcacattggagcaccaagccccccatctgccagcgcataccatgcggcttgccccctacaatcgctaatggagatttcatttcgacaaatagggaaaattttcattatgggagtgtggttacatatcgatgcaatctgggcagccggggacggaaggttttcgagctggttggcgagcccagcatatactgcaccagtaatgacgaccaagtgggcatatggtctggacccgcgccacagtgtatcattcctaataagtgtacacccccaaatgtggaaaatgggatacttgtctcagataaccgttccttgttctccctaaatgaagtcgtggagttccgttgtcaaccgggcttcgtgatgaagggtcctaggagagtgaaatgccaggctcttaacaagtgggagcccgagttacctagctgcagtcgggtctgtcagccccctccagaaattctgcacggtgaacatactccaagtcatcaggacaacttcagccctggacaggaagtattctatagctgcgaaccagggtacgatctcagaggagccgccagccttcattgcacacctcagggagactggtcccctgaggctccgaggtgcgccgtgaagagttgcgacgactttctaggccagctgccacacggcagggtgctcttcccgctaaacctgcagctcggcgctaaagtttcttttgtctgcgatgaggggtttcgcctgaagggttcctccgtcagccactgtgttctggtgggcatgagatccctttggaacaacagcgtgccggtgtgcgaacacattttttgcccaaaccccccggctattcttaacgggagacatacagggaccccctccggggatattccctatggcaaagagatctcgtacacctgtgatccccatcccgaccgtggaatgacgtttaatcttatcggcgagtccactatcagatgcaccagcgatccacacggaaacggcgtttggtcctcccctgctcctagatgcgagttgagcgttagggcaggacactgtaagacacccgaacagtttccgttcgcttcccctacgatccctattaacgattttgagttccctgttgggacatctttgaactacgagtgtagacctggctacttcggcaaaatgttttccattagttgcctagagaaccttgtctggtcaagcgtagaagataattgtcggcgcaagagctgtggccctcctcccgagcccttcaacggaatggtccatatcaacacagatacccaatttggatctacagtaaattactcttgtaacgagggctttaggttaatcgggagcccatctaccacctgcctggtcagtgggaacaacgtcacctgggataaaaaggcaccaatctgcgaaataatcagttgcgaaccccctccgactataagtaatggtgacttttactctaacaacagaacctcttttcacaacggaacagtggttacctatcagtgccacactggtcccgatggagaacaactgttcgaactagtgggggagagatccatctattgcacttcaaaggacgaccaggtcggggtgtggtcctctccaccaccacgttgcataagtaccaataaatgcaccgcccctgaagtggaaaacgccattagggtgcccgggaatagaagctttttcacattgacagagataattagattcagatgtcagccgggttttgtgatggttgggtcgcatactgtccagtgccaaaccaacgggaggtggggtccaaagttaccacactgtagccgcgtgtgccagcccccacccgagattctgcacggagagcacactctttcccaccaagataacttctcccctggccaagaggtcttttatagttgcgaaccttcttacgatctgcgaggcgccgcaagcctgcattgcacccctcagggcgattggtctcccgaggccccaagatgtacggtcaagtcttgtgacgatttcctagggcaactcccgcacgggagagttctgctgcctctgaacttgcagctcggagctaaggtttctttcgtgtgcgatgaaggatttcgactcaaagggagatcagcgtcccactgcgtgctcgctgggatgaaggctctttggaatagcagcgtgcctgtgtgtgagcagattttctgccccaatccccccgcgatcctcaacggaagacatacaggcactccctttggtgatataccctacggcaaagaaattagctatgcctgtgatacccatcctgacagaggcatgacttttaacctgatcggcgagagcagcattcgctgcactagtgacccgcaggggaacggcgtttggtcttcacccgctccacgttgtgagctgtccgtgcccgccgcttgcccacacccgccaaagattcagaacggccactatatcgggggacacgtgtctctctaccttcccggcatgacaatttcttatatctgcgaccctggatacctgctcgtgggcaaaggctttatcttttgcactgatcagggcatttggtctcagctcgatcattactgcaaggaagttaattgctctttcccactcttcatgaacggcattagtaaggagctcgaaatgaagaaagtataccattacggcgactacgtaacccttaagtgtgaggacgggtatacattagaaggttccccgtggtcacaatgccaagctgacgacagatgggatcctccactcgccaagtgcacttcacgcactcacgacgctctgatcgttggtacactgtccggaacgatcttttttatactgcttattattttcctgtcctggattattttgaaacacagaaagggcaacaacgctcacgagaaccccaaagaggtcgctatacacctgcactctcagggcggctcgtccgtgcacccaaggacccttcagaccaatgaagagaactctcgagtcttgccttag

SEQ ID NO: 183543 - DNA, 6120 bp, Artificial Sequence
  Description of Artificial Sequence: Synthetic coding sequence
atgggcgccagcagcccccggagccccgagcccgtgggcccccccgccccaggcttacccttttgttgcggaggaagtttactggccgtagtggtcttactcgcactccccgttgcctgggggcaatgtaacgcgcccgagtggctcccgttcgctaggcccacaaatctcaccgatgagttcgaattccctattggcacatacctgaattacgagtgcaggcccggatatagtggccgcccattttcaatcatatgcctgaagaatagcgtgtggactggagccaaagatcgatgtaggaggaaaagctgtcgcaatccacccgaccctgttaacgggatggtgcatgtgataaagggtattcagttcggtagccagattaaatattcctgtaccaagggctacaggctcattggaagctcatccgctacctgcattatctcaggcgacaccgtgatctgggacaatgagaccccaatttgcgaccgaatcccctgcggattgccccccaccattaccaatggggactttatctcgacaaatcgcgagaacttccattatggaagtgtggtcacctacaggtgcaatcctggctcaggggggcgaaaggttttcgaacttgtgggggagcccagcatctactgcaccagtaatgatgaccaggtgggaatctggagtggtccggcgcctcaatgtataataccgaacaaatgcacaccccctaatgtggaaaatggtatactcgtgtccgataaccgctctctattttccctcaacgaagtggtcgaattccgatgtcagcccgggtttgtcatgaaaggcccacgccgcgttaaatgtcaggccctgaacaagtgggaacccgagttgccttcctgtagtagggtttgccagccccctccagacgtgcttcatgcggagcgcacacagagggataaggataacttttcccccggacaagaggttttctattcatgcgagccaggctatgatctgaggggggcggcttcaatgcggtgcactccccaaggtgattggagtccagcagcaccaacgtgcgaggttaagtcctgcgatgattttatgggacaactgctgaatggaagagtgctgtttcccgtgaacctgcaattaggggctaaggttgacttcgtctgcgacgagggctttcaactgaaagggagcagtgcgtcctattgtgtgctggcggggatggagagcctttggaattcgtcagttcctgtctgcgagcaaatcttctgccccagtcccccagtgatacccaatggacggcacaccggaaaacccttggaggtgttcccatttggcaagaccgtgaattacacgtgcgatccccaccccgatcgaggcacctccttcgacctgatcggcgagtccaccattcggtgcacttcagatccccagggaaatggcgtgtggtcgtcgccagccccgcgctgcggaattctaggacactgccaggcacctgatcatttcttgttcgctaagctcaagacccagaccaacgcgtccgacttccccatcggcacctccctaaagtatgagtgtagaccagaatattacggccggccatttagtattacatgcctggataatctggtgtggtcctcccccaaagacgtatgtaaacggaagtcttgcaaaacaccacccgaccctgttaatggcatggtccacgtgattacagacattcaggtgggctctcggataaattattcctgcaccacgggacaccgcttgatagggcatagctccgccgaatgcattctctcagggaacgctgcccactggtctactaagcctccaatttgccagaggataccatgtggactaccccccactatagccaacggagattttatctccaccaacagagaaaactttcattatggctcagtagtgacttatcggtgcaaccccgggagcggcgggcgcaaagtgtttgaactcgtcggcgagccctccatctattgcacatcaaacgacgaccaggtgggcatctggtcaggtcctgctcctcagtgtattattcctaacaagtgcacaccccccaacgttgagaatgggattctcgtgtccgataaccggagcctattttcgcttaacgaggtcgtcgagtttcgatgtcagccaggcttcgtgatgaagggaccacgtcgggtcaaatgccaggccctgaacaaatgggaacccgaattgcctagttgcagcagggtgtgccagccaccacccgatgtcttgcacgccgaacgcactcagagggataaggacaactttagcccggggcaggaagtcttctactcatgcgagcccggttacgatctgaggggggctgcttctatgaggtgcacaccccagggtgactggtcacccgccgcccccacatgtgaggtcaagtcctgtgacgacttcatggggcagcttctcaatggaagagtgttattcccggtgaatctccagttaggagccaaggttgactttgtgtgcgatgaaggctttcagctaaaaggctcctcggcatcgtactgcgtgttggccggtatggagtcactctggaactctagtgtacccgtttgtgagcagattttctgccccagcccccctgtcattcccaatggacgacatacaggcaagcccctggaagtctttccatttggtaaaactgtgaattacacctgcgacccccacccggaccggggaacatccttcgacctgatcggtgaatccaccatcagatgtactagtgacccacagggcaatggggtgtggtcctccccagctcctcgttgcggaatcctcggccattgtcaggctccggaccacttcttgttcgccaaattgaaaacacagactaatgcttccgatttccccattggcacttccttaaagtatgagtgtaggcccgaatactatgggcgtcctttttcaattacctgcctggataaccttgtgtggtcttcacccaaggatgtatgtaagcgcaagtcctgtaagactcctcccgatcccgttaatggaatggtccacgtaatcaccgatatccaagtcggatctcgcataaactactcctgcactaccgggcaccgattaatcggacacagctctgcagagtgtatcctttctggaaacaccgcacattggtctaccaagcctcccatttgtcaacggatcccgtgtggcctgccacctactatcgcgaatggagactttattagcacaaacagagagaattttcattatggctcagtagtgacgtacaggtgcaacctcgggagtagaggacggaaggtctttgaactggtgggcgagccgtccatctactgcactagtaatgacgaccaagtgggcatatggagcggacccgcacctcagtgcattatccccaacaaatgcacgcctccaaacgtggaaaatggcatcctggtatcagacaaccgctctctcttctctctgaacgaggtggtggaattcaggtgccaaccggggtttgtgatgaaaggtccgcgccgtgtgaagtgccaggccctcaacaaatgggagccggaactcccctcctgttcccgtgtgtgtcaacctcccccggagatcctccacggcgaacacacaccatcccaccaagataacttttcccccgggcaagaagtgttttattcctgtgagcccggttatgatttgaggggggctgcttccctccactgtactcctcagggggactggtcccctgaggcaccacgatgcgctgtaaagtcatgcgatgatttcctcggtcagctgccccatggacgagtccttttcccattgaatctgcagttaggagccaaggtatcatttgtttgcgacgagggcttccgcctgaaagggagcagcgtctcccactgtgttctcgtggggatgagatcactatggaataactctgttccagtctgcgaacatatcttttgccctaatccaccagcaatcctgaacggacgccacacagggaccccgagcggggacatcccatacggtaaggagatcagctacacgtgcgacccacaccctgaccgcggaatgactttcaacctgatcggcgagtctaccatcaggtgtacatccgatcctcacgggaacggggtgtggtcttccccagcaccacgctgcgagctctctgtcagggccgggcattgcaagaccccagaacagttcccgttcgccagccccacgatccctattaacgacttcgagttcccagtcggaacaagtctgaattatgagtgccgtcctggttactttggtaaaatgttcagtatcagctgtcttgagaacctggtgtggagctcagtggaagataattgccgcagaaaatcctgcgggcccccaccagagccatttaacggcatggttcacataaacacagacacacaatttggaagtactgttaattattcttgtaacgaggggttccgtttgattgggagcccgagcaccacctgtcttgtctcaggaaacaatgtaacttgggataagaaagccccaatttgcgagataatctcttgcgagccaccccccacaatctctaatggagacttctactcgaacaatagaaccagcttccataatgggaccgttgtaacctatcaatgtcacacaggccctgacggagaacagttgttcgagctcgtgggagagcggtctatttactgcacatccaaggatgatcaggttggggtgtggtcatcaccaccccctagatgcatatctaccaacaagtgtactgcccccgaagttgagaatgcaattcgggtccccggaaaccgatccttcttcaccctcaccgaaatcattcggttccgctgtcaacccggttttgttatggtcggaagccacactgtgcagtgccaaacgaatggccgctggggcccaaagctgccacactgctcccgggtgtgccagccaccacctgagattctccatggcgaacatacccttagccatcaggacaatttctctccagggcaggaggtgttctactcttgcgagccttcttacgacctgcgtggcgccgctagcctgcattgtactccccagggcgattggagccccgaagccccacgctgtaccgtaaaatcctgcgacgactttcttggccagctgccccacggaagggtgttactgcccctgaacctacagttaggcgccaaggtgagcttcgtttgtgacgaggggtttaggctgaaaggtcgttctgccagtcattgcgtattggctgggatgaaggccctgtggaattcttctgtgcctgtgtgcgagcagatcttttgccctaatccacccgccatactcaacggacggcacaccggtactccttttggagacataccttatggaaaagaaataagctacgcatgcgatacacaccccgatagaggaatgacttttaatctgataggtgaatcctcaattcgctgtaccagtgatccacagggtaatggagtatggagttctcctgcaccacgctgtgaactctcagtgccagcggcttgccctcatcctccaaagatacagaatgggcactacattggaggccacgtaagtctgtacctgcccggcatgacaatatcctatatctgcgacccaggctatctcctcgtgggaaaaggcttcatcttttgcacagaccaagggatctggagccagctggaccactattgcaaggaggttaattgcagcttcccactatttatgaatggtatcagcaaagagctcgagatgaagaaggtctaccactacggcgattatgtgacacttaagtgtgaagacggctatactttggagggttccccgtggagtcagtgtcaggccgatgaccgttgggacccgccactagccaagtgcacaagccgaacacacgacgcactaatcgtgggcacgctgtcaggcaccatcttcttcatcttgctgattatttttctgagctggatcattctcaagcatagaaagggcaataacgcccacgagaatccaaaagaagtcgccatccacttgcacagccagggtggctcatctgtccacccaaggacccttcagaccaatgaggagaacagtcgcgtgttaccctag

SEQ ID NO: 183544 - DNA, 6120 bp, Artificial Sequence
  Description of Artificial Sequence: Synthetic coding sequence
atgggcgccagcagcccccggagccccgagcccgtgggcccccccgcccctggcctgcctttctgttgcggggggtcactgctagcagttgtcgtgttacttgcgttgcctgtggcttggggacagtgtaacgcacctgagtggttgccctttgctcgtcccaccaatctcacagacgagttcgaattcccaattgggacctacttaaattatgaatgccgccccggttacagtggccgccctttcagtatcatatgcttaaagaatagcgtgtggacgggcgcaaaggacagatgcagacgaaagtcctgccgcaaccctccagatcctgtgaacggcatggtccacgtgattaaaggcatccagttcggaagccagattaagtacagctgcacaaaaggctaccgtctgatcggctcttcatcagcgacctgcataatttccggagataccgtcatctgggacaacgagacccccatatgcgaccgtattccgtgtgggttaccgcctaccatcactaatggcgactttattagcacgaacagggagaattttcactatggttccgtggttacatacagatgtaaccccggttccggagggagaaaagtgttcgagcttgtgggtgaaccaagcatttattgtaccagcaacgatgaccaggtgggcatttggtcaggacctgctccccaatgcatcatcccaaataagtgcacacccccaaacgttgaaaatggcatcctagtgtctgacaaccggtcactgttctcattgaacgaagtggtggaattccgctgtcaaccaggtttcgtcatgaagggacctcggagagtgaagtgtcaagcactgaacaaatgggaaccagagcttccgagctgctcgcgcgtctgtcaaccacccccagacgtactccacgcagagcgtacgcagcgcgacaaggacaactttagtcctgggcaggaagtcttttattcctgcgaaccaggttatgatcttcggggcgctgctagcatgcggtgtacaccgcagggagattggtcaccagccgctccaacatgtgaggtaaagtcttgtgacgattttatgggacagctcctgaacggcagagtcttgttcccagtgaacttgcagctgggcgctaaggtggactttgtgtgtgacgaagggttccagctgaagggcagctcagcttcctattgtgtcctggcaggtatggaatccctctggaatagctcagtccccgtctgcgagcagatcttctgcccctccccacccgtaatccccaatggacgtcatactggtaaacccctggaggtgtttcctttcggaaagacagtgaattacacgtgcgatccccatcccgacaggggcacttcctttgatttgataggggagtctactatccggtgcacctccgatccgcagggcaacggcgtatggagcagcccagcacccaggtgtggcatcctggggcactgccaggcccccgaccattttctgttcgccaagcttaagactcaaaccaatgccagcgacttccctatcggcacgagcctcaagtatgagtgcagacccgagtactacggaagaccctttagcattacctgtctagacaacctcgtatggagttcaccaaaggacgtgtgcaagaggaagtcctgcaagactccacctgatcccgtgaacggcatggtccacgtgataacagatatccaggttggatctcggatcaactatagttgcacaaccggacaccgcctcatcggacattctagcgcagaatgtatcttatctgggaatgccgctcactggagcaccaaacctccaatctgccagaggatcccctgtgggctcccgcccaccattgccaacggcgactttatttcgacaaaccgcgaaaattttcactacggcagcgtggtaacctatcgctgcaaccccggaagtggaggtcgaaaagttttcgaactggtgggagagccgagcatctattgcaccagtaatgatgatcaggtcggcatttggtcagggcctgcgcctcagtgcattatccccaacaagtgcaccccccctaatgttgagaatggcattctcgtaagcgacaatagatcgttgttctcactaaacgaagtagttgagttcaggtgccagccgggtttcgttatgaaggggcctaggcgggttaagtgtcaggctttaaacaagtgggaaccggagctcccttcatgctcccgggtctgtcagccaccaccagatgtacttcatgcagagagaacgcagagggataaagacaatttttcacctggccaagaggtgttctacagttgcgaaccgggctacgaccttaggggcgcggctagcatgcgatgcacgccccaaggtgattggagccccgccgcccctacttgcgaagtgaagtcgtgtgatgattttatggggcagctgctgaacggccgggtgctctttccagtgaaccttcaattgggggccaaggtggatttcgtgtgcgatgaagggttccaactcaaaggcagcagtgcttcttactgcgtgctcgcgggaatggagtcactttggaattcaagtgtgcccgtgtgcgaacagatcttttgcccctcaccccccgtgataccaaacggccggcacactggaaagccactggaagtgtttccattcgggaaggctgtaaattatacatgcgacccccacccagacagaggaacatcattcgatttgatcggagagtcaactattaggtgtacctcagatccacagggcaatggcgtgtggtcgagccctgcacctcggtgtggaatcctgggacactgtcaggctcctgaccactttcttttcgccaagctcaagacccagactaatgccagtgatttcccgattggtaccagcctgaagtatgagtgtcggcctgaatactacggtaggcctttcagcatcacttgtcttgataacctggtgtggagtagtccgaaggatgtttgcaaaaggaaatcgtgtaaaacccctccagaccccgtgaatggcatggtgcacgtgattactgatattcaagtggggagtcggatcaattattcttgcaccacagggcacagattaattggccactcttccgccgagtgcatcctctcgggtaatactgctcactggtctactaagcctcctatatgtcagcgcattccatgcggcttgccaccaacgatcgcgaatggtgattttatttctacaaatcgggagaactttcactacggaagcgtggtcacatataggtgtaaccttggatcaagaggcaggaaggtgttcgaactggttggagagccctcaatatactgcacctctaatgatgaccaagtgggtatctggagcgggcctgccccgcagtgcatcatccctaacaagtgcactccgcctaacgtggaaaacggcatactggtatccgataatcgtagtcttttctcactaaacgaggtcgtcgaatttcgttgccagccggggtttgttatgaagggccctcggcgggtcaaatgtcaggcactcaacaagtgggaacctgagctcccttcttgtagccgggtctgtcagccacctccggaaatccttcacggggagcacaccccgagtcaccaggataacttctcacccggacaggaagtattttactcgtgcgaacccggatacgatctgaggggtgctgccagtctgcattgtactccccagggcgactggagcccagaagcacctagatgtgcggtgaagtcttgcgacgacttcttaggacaattaccccatggccgcgtgctgttcccactaaacctacagctgggggccaaggtttcctttgtctgcgatgaagggttcagactcaagggctcctcagttagccattgcgttctagtcggaatgagatcactgtggaataacagcgtgccagtgtgtgagcacattttctgtcccaacccccctgctatcttaaatggacgtcacacgggaacaccatctggagatatcccctatggtaaggagatttcttacacgtgtgacccacaccctgaccggggaatgacgtttaacctgatcggagagtcaacgataagatgtaccagcgatccccatggaaacggcgtgtggagcagccctgctccccgttgtgaactgagcgtccgggctggacactgtaaaacccctgaacagtttccatttgcgtcacctactattcctattaacgattttgaattccccgttggcacgagtcttaattacgagtgtcgacctggttattttgggaaaatgttttcaattagctgcctggaaaacctggtttggtcatctgtggaagacaattgtcggagaaagtcctgtggccctccacctgagcccttcaacgggatggtgcatattaacaccgacacacagttcggctccactgtcaactattcttgcaatgagggcttccgtttaattggcagtccatctacaacatgtctggtgtctgggaacaacgttacctgggacaaaaaagctcctatttgcgagatcattagctgtgagccccctccaacaattagcaatggagacttttatagcaacaaccggaccagcttccacaacggaacggtggtcacctaccagtgtcacacgggacctgatggcgagcagctcttcgaattggtgggcgaaagatcaatctactgtacttctaaagacgatcaggtaggagtgtggtcatccccaccgccccgatgcatttctacaaacaagtgtactgctcctgaggttgagaacgctatccgggtgcccggcaacagatcattttttacgctaactgagatcattcgtttccgttgtcagcccggctttgtcatggttggctcccacaccgtgcagtgtcaaaccaatggaagatggggacccaagctgccacactgctccagggtttgccagcctccacccgaaattctccacggtgagcacacactgtcccatcaagataacttttcccccggccaagaagtattttacagttgtgaaccgtcctacgacctaaggggcgccgcctcgctgcactgcaccccacagggcgattggtcaccagaggcgcccaggtgcaccgtgaaaagctgtgacgactttctgggccaacttcctcacggcagagttttgctgccactgaaccttcagctgggcgctaaagttagttttgtgtgcgatgaagggtttcggctaaagggacggtccgcctcacactgcgtgctcgctgggatgaaggcactgtggaactcttccgtacctgtgtgcgagcaaattttttgtcctaaccccccagctatattgaatggccgtcacactgggacaccctttggcgacattccctacgggaaggagatatcctacgcgtgtgatacacaccctgatcgcggcatgacttttaacttaattggcgagtccagtatccgatgcacatcggaccctcagggcaatggagtttggtctagtccggccccccgctgtgagctcagcgtccctgctgcctgcccccatcctcctaaaattcagaatggtcattacataggcggccacgtgtctctgtatttgcctggaatgactatatcttacatttgcgaccccggttacttgctggtggggaagggatttatattctgcacagatcaggggatctggtctcaattggaccattattgtaaggaagtgaactgttcattccccctgttcatgaacggaatcagcaaagaactagagatgaaaaaagtgtaccattacggcgactatgtcacactaaaatgtgaggatgggtacactctcgaagggtcaccatggagtcagtgccaggctgatgaccgctgggatccccctctggctaaatgcacaagtcggacacacgatgctctgattgtgggaaccttgtccggtaccatcttctttattctacttataatctttttaagctggataatcttgaagcacaggaaggggaacaatgctcatgagaatcccaaagaggtggcaatccacctgcactcccagggtggcagctctgtccaccctcgcacactgcagaccaacgaggaaaacagccgggtgctgccatag

SEQ ID NO: 183545 - DNA, 6120 bp, Artificial Sequence
  Description of Artificial Sequence: Synthetic coding sequence
atgggcgccagcagcccccggagccccgagcccgtgggcccccccgccccaggactccccttttgctgcggcggatcactgctggccgtggtggtactgctggcccttcctgtggcatggggtcagtgcaatgcgccagaatggctcccatttgcacggccaacaaacttaactgacgagttcgaatttccaattggcacctatctgaactacgaatgtcgaccgggttacagcggcaggccgttcagtatcatttgtctgaagaactccgtctggactggcgccaaagaccggtgtcggcggaaatcctgcaggaatccccccgacccagtcaatgggatggtgcatgtcatcaagggcatacaattcggaagtcagatcaaatattcatgtaccaagggctaccggctaatcgggtcttcaagcgccacctgcattatttctggggacaccgtgatttgggacaacgagactccaatctgtgatagaataccatgcggcttgccacccaccattaccaatggggactttatatcaaccaatcgtgaaaatttccactacggttccgtggtcacttacaggtgcaacccaggatctggcggcaggaaagtctttgagcttgttggtgagcctagtatttactgcacatcgaacgacgaccaagtcggcatatggagtggtcctgcgcctcagtgcatcattccaaataaatgtacaccgcccaatgtggaaaacggaattctcgtttccgacaaccggagtttgttctcgctcaatgaggtggtggaattccgctgccaaccagggtttgtcatgaaaggaccccgtagagttaaatgccaggccctgaacaaatgggaaccagaactgcccagctgcagccgggtatgtcaacctcctccagatgtcctgcacgcggagcggactcagcgggacaaggataactttagccctgggcaggaggttttctattcttgcgagcccgggtacgatctcaggggggcggcctctatgagatgcaccccacagggggactggtcaccagctgcccccacttgtgaagttaaatcttgtgatgacttcatgggtcagctgctgaacggcagggtgttgttccccgttaatctgcagctgggcgctaaggtcgactttgtatgcgatgagggatttcagctgaaagggtcaagtgcctcttactgcgtcctggctggaatggagagtctttggaatagttccgtgcccgtctgcgagcagatcttttgtcccagcccacctgtaatcccaaatggcagacacactgggaaaccactggaggttttccccttcggtaaaacagtgaattacacttgcgatcctcaccctgaccgcgggacttctttcgacctaatcggagaaagcaccattcgctgtacctccgacccccaggggaacggcgtgtggtctagtcccgccccgcgatgtggtatcctgggacactgccaggcaccggatcacttcctgttcgctaaactcaaaactcagacaaacgcaagtgacttcccaattgggacctcacttaagtatgagtgtagacccgagtattatggcaggccattttcaataacctgcttggataacctcgtgtggtcctcacccaaggatgtgtgtaaaaggaaatcttgtaagaccccgcctgatccagtcaacggaatggtccacgtgattaccgatatccaagtgggcagtagaatcaactacagctgcaccacaggacaccggcttattggccattcgagcgctgaatgcattctcagtggcaacgctgctcactggagcaccaagcctccaatctgccagagaataccctgtggtctcccccctaccatcgccaacggagactttatatccacaaacagggaaaattttcattatggcagcgtggtgacttaccgctgtaaccctggcagcggaggacggaaggtcttcgagctggtgggggaaccttccatttactgtacctcaaatgacgaccaggtgggcatctggagcgggccggctccccagtgcatcatcccgaataagtgtaccccccccaatgtggagaacgggattctggtcagcgacaaccgaagtctgttctctcttaacgaggtggtggagtttcgctgtcagccaggtttcgtgatgaaagggccccggcgagtgaagtgccaggctctgaataaatgggagcctgagttgccatcatgttctagagtttgtcaacccccacctgacgtgctccatgccgagaggacccaacgggacaaggacaacttttcgcctggccaagaagtgttttattcttgtgagcctggatatgatctccgtggagccgctagcatgaggtgtaccccacagggcgactggtctccagctgccccaacttgtgaggtgaaatcatgcgacgattttatggggcagcttctcaacggccgggttctgttccctgtgaaccttcaactgggtgcaaaagtggactttgtgtgcgatgagggatttcagctgaaaggatcttctgcctcttactgcgttctggccggcatggagtctctgtggaatagctccgtgccagtatgcgagcagatcttttgcccaagcccacctgtcataccaaatgggagacacaccggaaagcctctcgaggtatttccttttggcaaagcggtcaattacacttgcgacccccacccggatcgggggacctcctttgacctaattggtgagagtaccattagatgcactagcgatccccagggaaacggggtgtggtccagccctgcccctaggtgcggcatcctcggtcactgtcaggcccctgatcattttctatttgctaagctcaagacacagactaatgcaagtgattttccaataggaacctccttgaaatatgagtgcagacctgagtactatggcagaccctttagtattacctgtcttgacaacctagtgtggtcttcgccaaaagatgtgtgcaaaaggaagtcctgcaagacccccccagaccctgtaaatggaatggtgcatgtgataaccgacattcaggttggatcacgcattaactacagttgcactaccgggcacagactgataggacacagctccgctgagtgcatactcagcggtaacaccgcccactggagcactaaaccccctatctgtcagaggattccatgcgggctcccccccacgatcgctaatggcgacttcatttctactaatagggagaacttccactatggatctgtagtcacatatcgttgtaacttaggcagccgagggcgcaaagtcttcgagctggtgggggagccgtcaatctactgtacctcaaacgacgatcaggtgggcatctggtctgggccagcaccgcagtgcatcatacccaataagtgcactccgcctaacgtcgagaatggcatactggtctctgataatagatcgctgttctccctgaacgaagttgtcgagtttaggtgccagccagggttcgtgatgaaggggcctaggcgggttaaatgtcaggcgctcaacaaatgggagcccgaacttccttcctgttctcgcgtttgtcaaccccctccggagatactacacggagagcatacgccctcacaccaggataacttctctcctggacaggaagtattctacagctgtgaacctggctatgatctccgtggcgccgcctcacttcactgcactccccaaggcgattggtcacccgaggccccacggtgcgcagttaaatcatgcgacgactttctgggacagcttccacacgggagagttctcttccctctgaatctccaacttggggcgaaagttagcttcgtgtgtgatgaggggttcaggttgaagggttcttccgtgtctcattgcgttctcgtcggtatgcgaagtctgtggaacaactccgtgcccgtctgtgaacacatattctgtccaaatccccctgctatattgaatgggaggcatactggaacaccctctggtgatatcccatatgggaaagagatctcttacacctgtgacccccatcccgacagggggatgactttcaaccttatcggggagagcaccatccgctgcacttctgacccacacggtaacggagtttggagtagtcctgctccccgctgtgagctgtctgtaagagccggccattgtaagactcccgagcagttcccatttgctagccctactatccctatcaatgactttgaatttcccgttgggactagtctcaactacgaatgtaggccggggtacttcggtaaaatgttcagtatcagctgcctggagaacctggtctggtccagcgtcgaggataactgtaggagaaaaagctgtggaccaccccccgagcccttcaatgggatggttcacatcaatactgacacccagttcggctctacagtcaactactcttgtaacgagggatttcgcctgattgggagtccctccaccacctgtctggtgtcaggaaacaatgtaacttgggacaagaaagcgccaatatgtgagatcatttcctgcgagccacctccaaccatttcaaacggtgatttttatagcaacaataggacaagcttccacaatggaaccgtggtgacctaccagtgtcataccgggccagatggagaacagctttttgaactcgtgggtgaacgctcaatctattgcaccagcaaagacgatcaggttggagtgtggagctcccctcctccccgctgcatctcgacaaataagtgtaccgcacccgaggtcgaaaacgcaatccgagtgcccgggaacaggtcctttttcacgctgactgaaataattcgcttccgttgccagccaggtttcgtcatggtggggagtcacacagtccagtgtcagactaacgggaggtgggggccaaaactgcctcactgtagtcgcgtatgtcagccacccccagaaatccttcacggagagcacactctcagtcaccaggataactttagtcccgggcaggaagtattctacagttgtgaaccctcctacgacctaaggggagctgcaagcctgcactgtactccccagggcgattggtctccggaagcccccaggtgtaccgtcaagagctgcgacgacttcctcgggcaactgccccatggccgagttctcttgccccttaatttgcaactgggagccaaagtgagctttgtgtgcgatgaaggatttcgcctgaaagggcgatcagcctctcactgtgtactagctggcatgaaagcactctggaattccagcgtgccagtgtgtgagcagatcttttgtcccaaccctcctgcaatactaaatggacgccacacgggcactcctttcggggatatcccctacggcaaggaaatctcttacgcttgtgacactcatcccgacagaggcatgacttttaacctgatcggagagtcaagcatccgctgtacctctgaccctcaggggaatggggtatggtcatcccctgccccccggtgcgagttatccgttccagctgcatgcccacaccctccaaaaattcagaacggtcattatattgggggccatgtatctctgtacctgccggggatgaccatttcctacatatgtgaccccggctatctgctcgtgggaaaaggtttcattttttgtactgatcaaggtatttggagtcagctggatcattactgtaaagaggtaaactgtagcttcccgctcttcatgaatgggatttccaaagagctcgagatgaagaaagtttaccactatggagattacgtcactttaaaatgcgaggacggctacacgcttgaaggttctccttggtctcagtgtcaggccgatgacaggtgggacccacccttggccaagtgcaccagtaggacccacgacgcactcatcgtgggcacattaagcggaactatttttttcatactgctgattatcttcttgtcctggatcatcctgaaacaccgtaaggggaataatgctcacgaaaaccctaaggaagtggcaattcacctacactctcaaggtgggtcctctgtgcatcccagaacgttgcagacaaatgaggagaatagtcgcgtgcttccttag

SEQ ID NO: 183546 - DNA, 1755 bp, Artificial Sequence
  Description of Artificial Sequence: Synthetic coding sequence
ggccactgccaggcccccgaccacttcctgttcgccaagctgaagacccaaacgaatgcctccgacttccctatcggcacatcactgaaatacgagtgccgtcccgaatattatgggaggccgttttccattacatgcctggataacttggtctggagcagccctaaagatgtgtgcaagcggaagtcctgtaaaacacctcccgatcctgtcaatggtatggtacatgtgataacagacattcaagtgggaagcaggatcaattatagttgcacaactggtcatcgccttatcggacactcatcagccgagtgcattctgagcgggaacgcagctcactggtctactaagccacccatctgccagaggattccttgcggcctgccacctaccatcgctaacggcgacttcattagtacaaacagagagaactttcactacggaagcgtggttacatatcgatgcaacccgggctcaggggggcgcaaggtttttgaactggtgggggagccgagcatttactgtacaagcaacgacgaccaggtcggaatctggtccggcccagccccacagtgcatcatccccaacaagtgcacaccacccaatgtggagaatggtatcctcgttagtgacaacagatccctgttttcccttaacgaggtggtggagttcagatgtcagcccggctttgttatgaagggtccgaggagggtgaaatgccaggcactcaataaatgggaaccggaattaccttcttgctctagggtgtgccagccccctcccgacgtccttcatgccgagcgcacccagcgcgataaagataacttcagcccggggcaagaagttttctactcttgcgagccaggttacgatttgcgcggcgccgctagcatgagatgcactccccaaggggattggtcccccgctgcccccacttgtgaggtcaagagctgcgatgatttcatgggccaactcttgaacggacgagttctgtttcctgttaacctgcagttgggcgccaaagtggactttgtgtgcgatgaggggttccagttgaaagggagctctgctagctactgcgttctggcgggaatggagagcctgtggaacagcagtgtgcctgtgtgcgaacagatcttttgcccttcgccacccgtgatcccaaacggtcgccacacaggaaaaccactcgaagtgtttccatttggaaagacagtgaattacacctgcgacccacaccccgacagagggacaagcttcgaccttatcggcgagagcacaatcaggtgcaccagcgacccgcagggtaatggcgtctggtcatctcctgctccaagatgtggcatattgggacattgtcaggcccccgaccacttcctatttgccaaactcaagacccaaacgaatgcgagcgatttcccaatagggacctctttaaagtacgagtgtcgaccagaatactacggacgtcctttcagtatcacatgtctggacaacctggtgtggagtagccctaaagatgtgtgcaaaagaaagtcctgcaaaacgcctcccgatccggtgaacggaatggtgcacgtaattacagacatccaggtcggaagtcgtattaactatagttgcactactggacacaggctgatcggccatagcagcgccgagtgcattttgtcaggcaatgccgcccactggtcaactaaacctccgatttgtcaaagaagttgtcatcttccttgcgaactgtttgggcggtag

SEQ ID NO: 183547 - DNA, 1335 bp, Artificial Sequence
  Description of Artificial Sequence: Synthetic coding sequence
atggccccccccgtgcggctggagcggcccttccccagccggcggttcccggggttactgctcgcggctttagtcctgctgctttcttcattctccgaccaatgtaacgttccagaatggctgccgtttgcaagacccacaaatctaaccgacgatttcgagttccctattggaacatacctgaactacgaatgccggcccggttattctgggaggccattctctattatctgcctgaagaactctgtatggacctccgccaaggacaaatgcaaaaggaagtcctgtcgcaatccacccgatcctgtgaacgggatggctcacgtcattaaggatattcagtttcggtcacagataaagtacagctgccccaaaggatataggctgattgggagttcctctgccacatgcataatcagtggaaacacggtgatttgggacaataaaactcccgtctgcgacagaatcatctgcggcctgccaccaactatcgctaatggggattttacgtcaattagtcgggagtattttcactatggatcggtggtaacctaccactgtaacctgggctcaagaggcaaaaaagtgttcgagctggtcggtgaacccagcatttattgcactagcaaagacgaccaggtaggtatctggagcgggccggctccacagtgtattatcccgaacaagtgtactccccccaacgtagagaatgggattttggtgagtgataaccggtctctcttttctcttaatgaagtagtcgagttcagatgccaacccggattcggaatgaaaggaccgagccatgtgaaatgccaagccctgaacaaatgggaacccgagttgccttcatgttcgcgcgtctgccaacccccgccagacgtcctgcacgcagagagaacccaaagagataaggacaacttttcaccgggacaggaagtgttctactcgtgtgaaccgggttatgacttgcgcggaagcacatatctccattgtactccccagggggactggtcgccagcagctcctaggtgtgaagtgaaatcctgtgatgacttcctaggccagctccctaacgggcacgtcctgtttcctctgaatctgcaactaggggctaaagtagatttcgtgtgcgatgagggcttccagctgaaaggaagtagtgcctcgtactgcgtgttggctggaatggagagcctttggaactcgtcagtgccagtttgcgagcggaagtcttgtgagacccctcccgtgccggtgaacggtatggtgcatgtgatcacagatatacacgtggggtcacgaataaactactcctgcacgacaggcttttag

SEQ ID NO: 183548 - DNA, 1710 bp, Artificial Sequence
  Description of Artificial Sequence: Synthetic coding sequence
atggccccccccgtgcggctggagcggcccttccccagccggcggtttccagggctcctgctggccgcgctggtcctcttgctttcttcttttagtgatcagtgcaacgtacccgaatggcttcccttcgcccgccctaccaacctcaccgacgacttcgaattccccatcggcacctacttgaattatgagtgtaggccgggctattctggtagacctttcagtataatttgtctgaaaaactcagtctggacctctgccaaggataaatgtaagaggaagtcttgtcgcaacccacccgaccccgtaaatggaatggcccatgtgataaaagacatccaatttcgctcgcaaatcaaatattcctgccctaaaggatatcgattaataggcagttccagtgccacttgcatcattagtggcaacactgtgatatgggacaacaaaacccctgtgtgcgataggattatttgcgggctgccacctacaatcgccaacggggactttacatccatctctcgtgaatactttcactacgggtcagtcgtgacctaccactgtaacctcgggagtcgtggtaaaaaagtgtttgaactggtgggcgaacctagcatttactgtacgtctaaggacgatcaggtcggcatatggagcggtccggccccacagtgcatcatccccaacaaatgtactccgcccaacgtcgagaatgggattctggtttccgataatcgctcactgtttagccttaatgaagttgtggagtttcgttgccaaccgggattcggcatgaaaggtccttcacacgtcaaatgtcaagccttgaataagtgggagcccgagttaccgtcttgtagcagagtctgccaaccacctcccgatgttctgcacgccgaacgcacccagcgagataaggataatttttcacctgggcaggaggttttttatagctgcgaaccgggttacgacctccgaggtagtacttatctccattgtaccccgcaaggagactggtcaccagccgcaccccggtgtgaagtgaaatcttgcgacgacttcctgggccagctgcccaacggtcacgttctgtttcccctaaacttgcaacttggagctaaagtagacttcgtttgtgatgaaggatttcagttaaaaggcagctccgccagttattgcgtgttggccggcatggaatccctttggaatagctctgtgcccgtatgcgagcggaaaagctgtgaaacgcctcctgttcccgtgaacggcatggtgcacgtcattaccgacatccacgtagggtcaagaatcaattattcatgtactacaggtcatcgcctaataggccattcatctgctgaatgcattctgagcggcaataccgcgcattggagcatgaagcctccgatttgccagcagatcttttgcccgaacccacccgcaatcctcaacggccggcacaccggaacacctcttggcgatattccttatggaaaggaggtgtcatacacctgcgatcctcaccccgataggggcatgacttttaatttgatcggcgaatcaacaattcgcagaacctctgaaccacacggtaatggagtgtggagttcccctgctccaaggtgcgagctgcctgttggagccggcagtcatgatgccctgatagtgggcaaattctacgaagtgttcgcagaggagttctgtcatctgtag

SEQ ID NO: 183549 - DNA, 3279 bp, Artificial Sequence
  Description of Artificial Sequence: Synthetic coding sequence
atgggcgccgccggcctgctgggcgtgttcctggccctggtggccccaggggtcctgggcatctcctgcgggtctcctcccccgattttaaacgggcgcattagctattatagtacccccatcgctgtgggaacggttattcgctacagctgcagtgggacgtttagacttattggagaaaagtcactcctttgtattacaaaggataaggtcgacggcacttgggacaagcctgcacctaagtgcgagtactttaacaaatatagctcatgtccagagcccattgtacccggagggtacaaaattagaggctcaaccccctaccggcatggcgacagcgtgacctttgcctgtaagactaatttttccatgaatggtaataagtccgtctggtgccaggcaaacaatatgtgggggcccactagattaccaacatgcgtgagcgtctttcccctcgagtgtcctgcactacccatgatccacaatggccaccacacttcagagaacgtgggatccatcgccccgggactgtccgtcacctacagctgtgagtctggatatctgctggtgggggagaaaataatcaattgcttatcgagtgggaagtggagtgcagtccctcctacctgcgaagaagcgcggtgcaaaagtctaggcagatttcccaatgggaaggtgaaggagccgcctattctgcgagtaggagtgaccgcgaacttcttctgtgacgagggctataggctgcaagggcctccctcctcaagatgtgtcattgccggtcagggcgtggcctggaccaaaatgccagtttgcgaagagattttttgccccagtccaccaccaattctgaatggacggcacatcggaaattctctggccaacgtgagttacggttctattgtcacatatacctgcgaccctgatcctgaggaaggcgttaattttattctgatcggagagtcgactctgcgctgtaccgtcgacagccagaaaaccggtacctggtctggacccgctcctcgctgcgagctgtctacttctgcggtgcagtgtccgcatccacaaattctgcgcggccgtatggtgagtggccagaaagatcgatacacttataatgacactgtgatctttgcttgcatgttcggcttcacactgaaagggtctaagcaaatcaggtgtaatgcacaaggaacctgggagccttcagcaccggtgtgcgaaaaggaatgtcaagcccccccgaatatcctgaatgggcaaaaggaggaccgccacatggtgcggttcgacccagggacatccattaagtacagctgtaatcccgggtacgttcttgttggggaggagtcaatccagtgcacctccgagggcgtgtggacccctcccgtcccccaatgtaaagtggctgcttgcgaggcaaccggacgtcagctgctgactaagccccagcaccagtttgtccggccggatgttaattcctcatgtggcgagggctacaaactaagcggctcggtttatcaggagtgccagggtacaataccatggttcatggaaatccggttatgcaaggaaatcacctgtcctccccctccagtgatatacaacggcgcgcacaccggatctagcctggaagactttccctacgggactaccgtgacatatacatgtaatccgggaccagaacgtggagtggaattcagcctaatcggtgagtccactatacggtgcacctctaatgatcaagagcgcggcacctggtctgggcctgcccctctgtgcaagctgagcttgctagctgtgcagtgctcccatgtccacatagctaacggctacaaaattagtggtaaggaagctccatacttttacaacgatactgtcacctttaaatgctattctggctttaccctgaagggatcttctcaaattcggtgtaaggccgataatacatgggacccagagatccccgtttgtgaaaaaggatgtcaatcacctcccggcctgcaccacggccgacacactggcgggaacacagtctttttcgtgagtggaatgactgtcgattacacctgtgaccccggttacctgctggtgggaaataagtctattcactgcatgccctcaggaaattggtctccatcagcccccagatgcgaggaaacctgtcaacacgttcggcagagtttgcaggagctgccagccgggagcagggtggaactagttaacactagctgccaggatggatatcagcttacgggtcacgcataccagatgtgtcaggatgcagagaatggaatctggtttaaaaagattccattgtgcaaagtcatccactgccaccccccaccagtgatcgtgaatgggaagcacactggcatgatggctgagaacttcctgtatggaaacgaagtttcatacgagtgcgatcaagggttttacctgctaggcgagaaaaaacttcagtgcaggtctgattcaaagggacacggaagttggagcggcccgagtccgcagtgtctccggtcacctccagtgacacggtgtccaaacccagaggtaaaacatgggtacaaactcaacaaaactcactcagcctatagtcacaacgatatcgtgtatgttgactgtaaccctggatttatcatgaacggttcaagggtgatcagatgccataccgataacacctgggtgccaggcgtcccaacgtgcataaagaaagccttcatcggctgtccgcctcctcctaaaactcccaatggcaaccatactggaggcaacatagccagattcagccctggaatgtccatcctctattcatgtgaccagggttacctattggtgggcgaggctttactgctatgcactcacgagggaacttggagccagcccgctccacattgcaaagaggtgaattgctcttcacctgctgacatggacggaatccagaagggactcgaaccccgcaagatgtatcagtatggggctgttgtaactttggagtgtgaagacggttatatgctggaaggctcaccacagtcacaatgccaatccgaccaccagtggaatcctcctctcgctgtgtgccgctctcgctccttagctcccgttctgtgtggcatcgcagccggactgatattactgaccttcttaatagtgattacgctgtatgtgatcagcaagcaccgggcccggaattactacacagacaccagtcagaaggaggcatttcatttagaggcacgggaggtgtactccgttgacccgtataaccccgctagctag

SEQ ID NO: 183550 - DNA, 3102 bp, Artificial Sequence
  Description of Artificial Sequence: Synthetic coding sequence
atgggcgccgccggcctgctgggcgtgttcctggccctggtggcccccggcgttttggggatctcatgcggctcccccccccctatccttaatggccgcatctcttactacagtacaccaatcgctgttggaaccgtaatccggtattcctgctccgggactttcagacttattggcgaaaaatcgctgctctgcatcactaaggataaagtcgacggcacctgggataagcctgccccaaaatgcgaatacttcaataagtattcgagctgcccggaacccatagttccagggggatacaagatccgcgggagtaccccctatcggcacggcgactctgtgaccttcgcctgcaagaccaatttcagcatgaacgggaataaaagcgtctggtgtcaggccaacaacatgtggggtcccactcggctgcccacctgcgtatctgtttttccccttgaatgtccagccttacctatgatccacaacggtcaccacacctccgaaaatgtaggctccattgcaccaggcctgtctgtaacttattcctgtgaaagcggctatctgctggtcggagaaaagattattaattgcctgtccagtgggaaatggtccgctgtccctccaacatgtgaagaagcacgatgcaagagtctgggaagatttcccaatggcaaggtcaaagaaccacccattttgagggttggtgtgacagcaaacttcttctgcgatgagggctatcgcttgcagggtcccccctcaagtagatgcgttatcgctgggcagggagtcgcctggaccaagatgcctgtctgcgaggaaatcttctgccctagtcccccccctattctgaatgggaggcatattgggaacagcctagctaacgtgtcgtatggttcgatcgtcacctatacttgcgatccagaccctgaggagggtgtgaacttcatccttatcggagagtctactctgcggtgtactgtagattcgcagaagactgggacatggtccggccccgcaccacgatgtgagctcagcacatccgccgtacagtgtcctcatccccaaattttacgcggacgtatggtctcagggcaaaaggaccgatacacttataacgatactgtgatctttgcctgcatgttcgggtttacactgaaaggatcaaagcagattcgttgcaacgcacagggaacctgggaaccctctgcgcctgtgtgtgagaaggaatgtcaggcccctccaaatattttgaatggccagaaggaagacaggcatatggtgcggttcgatccggggacctctattaagtacagctgtaatccgggctacgtccttgtgggcgaggagtctatccagtgcacgagcgagggagtctggaccccccccgtcccacaatgcaaggtcgcagcctgtgaagccacaggccggcagctgctcaccaagcctcagcatcaattcgttcggcctgatgtgaattccagctgcggtgaaggttacaaactgtcaggtagcgtctaccaggagtgccagggcaccattccatggttcatggaaattcgcttgtgtaaggagattacatgccccccccccccagtcatttataacggtgcgcacaccgggagctctcttgaggatttcccttatggcaccaccgttacctatacgtgcaatcccggccctgagcgcggggtagagttcagcctgatcggagagagcaccatcagatgcactagtaatgatcaggagaggggaacctggagcggcccagctccactctgcaagctcagtctcctcgcagtgcagtgtagccatgtacatattgcaaacgggtacaagatctccggtaaagaagctccttacttttacaatgatactgtgactttcaaatgttattctgggtttacacttaagggctccagtcagattcgatgtaaagcggacaacacctgggatccagaaatcccagtgtgcgagaaggaaacttgccaacacgttcgacagagcctgcaggaactccctgccggctccagggtggagctggtaaacacatcgtgtcaggatggttaccagctgacaggtcatgcataccagatgtgccaggatgcagagaatggtatctggtttaagaaaatccccttgtgcaaggtgattcactgccatccaccccctgtgattgtaaacggtaagcacaccggaatgatggccgagaactttctgtatggaaacgaagtgtcatatgagtgtgatcagggtttttacctcctgggagagaaaaaactacagtgccgttctgattctaaaggtcatgggagctggtccggccccagtcctcagtgtttacgctctccaccagtaaccagatgtcctaaccccgaagttaaacatggctataagctgaacaagacccactcagcttattcccacaatgacattgtctacgtggattgcaacccaggattcattatgaatgggtcccgggtgatccgctgccacacagacaacacttgggtgccaggggtgcccacatgcattaagaaggccttcattggatgcccccctccccccaagacccccaacggtaatcatactgggggcaacattgcccgcttcagcccgggaatgagcatactgtactcatgtgatcaaggatatctcctcgtgggcgaggctctgcttttatgcacccacgaaggcacctggtcacaacccgcgccacactgtaaagaggtcaattgttcctcaccagccgacatggacgggatacaaaagggcctggagcctcgcaagatgtaccagtacggcgccgtggtcaccctcgagtgtgaggacggatatatgcttgagggctcaccgcagtctcagtgtcagagcgatcatcagtggaatccgcctttagcagtatgtagatcacgcagccttgctccggtgttgtgcggcattgctgctgggctgattctgcttaccttcctcattgtgattaccctctatgtaatcagcaaacatcgggctagaaattactataccgacacatctcagaaggaggcctttcacctggaggctcgcgaggtgtattccgttgacccctataatccagcttcttag

SEQ ID NO: 183551 - DNA, 2916 bp, Artificial Sequence
  Description of Artificial Sequence: Synthetic coding sequence
atgggcgccgccggcctgctgggcgtgttcctggccctggtggccccgggcgttctaggcatctcctgcggaagccccccacccatcttaaatggccgcatctcctattattctacccccatcgccgtagggaccgtgattcggtacagctgctctggcaccttccgactgataggcgagaaaagtcttctttgcatcaccaaagataaagttgatgggacgtgggacaagcctgcccccaagtgtgaatacttcaataaatattccagctgcccagagccgattgtacctggcggctataaaattcgaggcagcactccttatcggcacggggattcagtaacctttgcttgtaaaacaaacttctccatgaatgggaataaatctgtgtggtgccaggcaaataatatgtggggaccgaccagactcccgacctgtgtttccgtttttccacttgagtgccccgcactgcccatgattcataatggacatcacactagcgagaacgttggatccatcgctcctggcctatcggtcacatatagttgcgagtctggttatctgttggtcggggagaaaattatcaattgcctgtctagcggcaaatggagcgctgtgccacccacatgcgaagaagcccgctgcaaatccctgggtagattccctaatgggaaagtgaaggaacccccgatcctccgggtgggtgtgaccgcaaacttcttctgtgacgagggctataggctgcagggacccccatctagcaggtgtgttatcgccgggcagggggttgcttggacaaaaatgcctgtctgtgaggaaatcttttgcccatcacccccgccaatccttaatggtcgacacatcggtaattccttagccaacgtgtcctacggaagtatcgtcacctacacgtgtgaccctgatccggaagaaggcgtgaacttcatcctgatcggagagtcaacattacggtgcactgtggattctcaaaaaacagggacctggtcaggccctgcgcccagatgtgagctaagcaccagcgccgtccagtgtcctcacccgcagattctgcgggggaggatggtcagtggtcaaaaggaccggtacacctacaatgacactgtaatcttcgcatgtatgttcggctttacactcaaggggtctaaacaaatcagatgcaacgctcagggaacctgggagcccagcgcacctgtatgcgagaaagagtgtcaggcccctccaaatatcctgaatggacagaaggaggatagacacatggtccgatttgatcctgggacaagcatcaagtacagctgtaatcccgggtacgttcttgtgggcgaggagagcatacaatgcaccagcgaaggcgtgtggaccccccccgtgcctcaatgtaaggttgcagcctgcgaagcaacaggtcgccagctgctgacaaaaccacagcatcagttcgtgcgccctgacgttaattcatcctgcggagaagggtataaactatccggttcagtctaccaagagtgccaggggacaatcccatggttcatggagatccggctgtgcaaagaaataacttgcccccctccgcctgtcatctataacggtgcacacacggggagttctctcgaagattttccttatggcactactgtcacctatacatgtaaccctgggcccgaaaggggggtggagttctctctcattggtgaaagtactatacgctgcacaagcaacgatcaggagagagggacgtggagcgggcctgccccactatgcaagctgagccttttggcggtgcagtgtagtcatgtccacattgccaacggatataagatatctgggaaagaggccccctacttctacaatgacaccgtcacttttaagtgctactctggttttaccctgaagggctcctcccaaattagatgcaaggctgacaatacttgggacccggaaatccccgtctgtgagaaggaaacatgtcagcacgtgaggcagagcctacaggagctccccgccgggtctagagtagagctggtcaatacctcatgtcaggatggttatcaattgacaggacacgcttatcagatgtgtcaagatgccgaaaatgggatttggttcaaaaagatcccgctctgtaaggtgatacactgtcatcctccccccgtgatcgttaatgggaagcatacaggaatgatggccgagaacttcctctatggaaacgaagtttcttatgaatgcgatcaggggttctatctacttggtgagaaaaagctgcagtgcaggtctgattctaagggacatggctcatggtccggcccttccccccagtgcctacggtcacctcccgtcacacggtgccctaacccagaggtaaagcacggatacaagctgaacaaaacacactccgcctactcacataacgacatcgtctacgtggactgtaatcctggctttattatgaatgggtcgcgggttattaggtgccacacagacaatacctgggtgccaggagtcccaacatgtattaaaaaggaagttaattgctcttcaccggccgatatggacggtatccagaaaggattggagccgaggaagatgtatcagtatggcgcagtggtgactctggagtgtgaagacggctatatgctcgagggaagccctcagtcccagtgtcagagcgatcatcaatggaacccccctttggccgtttgtaggtctagaagtctggcccctgtgctctgtggcatcgcggcaggactgatcctgctcacctttctcattgtcattactctgtacgttatctctaagcaccgggcaaggaattactacaccgatacttcccaaaaggaggcgtttcacctggaggccagagaggtgtattccgtggatccttacaatcctgcctcctag

SEQ ID NO: 183552 - DNA, 3021 bp, Artificial Sequence
  Description of Artificial Sequence: Synthetic coding sequence
atgggcgccgccggcctgctgggcgtgttcctggccctggtggccccaggggtgttggggatatcttgtggcagtcctccaccgattttgaacggccggatatcctattactcaaccccgatcgctgtgggcacggtcatccggtacagctgtagtggtacatttaggcttattggagagaagtccttgctgtgcatcaccaaggacaaggtcgatgggacctgggacaaacccgctcccaaatgtgaatatttcaataaatattccagttgccccgagccaattgtgcctggtggctacaagattcgcggctcgacaccctacagacatggcgacagtgtcacattcgcttgcaaaactaacttctcaatgaacggcaataagtcagtctggtgtcaggccaacaacatgtggggccccacaaggctgcccacctgtgtctctgtcttcccactagaatgcccagctctgcctatgatccacaacggccaccataccagcgaaaatgttggctcgatcgccccaggcttgtccgtgacctacagctgcgaatcgggatatctgctcgtgggcgaaaaaatcattaattgcctttcctcagggaagtggagtgcagtccccccaacatgtgaggaagctcgttgtaaatccttaggtcggttccctaatggaaaggtgaaggaacctccaatcctgcgcgtcggagtaacagcgaactttttttgtgacgaagggtaccgcctacaaggaccaccaagctcccgctgcgttatcgcaggacagggcgttgcttggactaagatgccagtgtgtgaagagatcttttgcccctcacctccgccaatcctgaatggccggcatattggcaactctttagccaatgtctcctatgggagcattgtcacttacacatgtgaccccgacccagaggaaggggtcaacttcatcttgattggagagtcaaccctaagatgtaccgtagacagtcagaagacaggcacttggagcggtcctgctccacgttgtgagctgagcactagcgccgttcagtgccctcacccacagatacttaggggacgaatggtgagcgggcagaaagaccggtatacctataacgatacagtaatcttcgcttgcatgttcggattcaccctgaagggaagcaaacaaatcaggtgcaacgcgcagggaacctgggaaccaagcgcgccagtctgcgagaaggagtgccaagcccctcctaacattctcaacggacaaaaggaagataggcacatggtgcgtttcgaccccggcacatctatcaagtattcctgtaacccaggctatgtcctcgttggtgaggaaagcatacagtgtactagtgagggcgtgtggaccccgcccgtcccccagtgcaaggttgccgcctgtgaggccaccggcagacagttgctcacaaaaccacagcaccagtttgtacgccctgatgtgaattcctcctgcggcgaggggaaccacctgccaactacaccgtgttatctacagtggggtacacatcgggagtttctgaggagattttccatctggaatcatggccatctacatatgccaggccctgagagaggcgtggaatttagtctgattggcgagtcaaccatcagatgtacatccaatgatcaggagaggggaacctggagcgggcctgccccgctttgcaaactttcgctgctcgctgttcagtgctcacatgtccatatagctaacgggtacaagattagtggaaaagaagcaccctatttttataatgatacagtgactttcaagtgctatagtggcttcaccctgaaaggaagtagccagattcggtgcaaggcagacaacacctgggatccggaaatccccgtgtgtgaaaaagagacctgtcagcacgtgcgccagtccctgcaggagctaccagccggatcacgagtagagttagtcaatacttcctgccaggatggatatcagttgactgggcacgcttaccagatgtgccaagatgccgagaatgggatttggttcaagaagatccccctgtgcaaggtcatccactgccacccaccccccgtgattgtaaatggaaaacatacaggcatgatggcagagaattttctgtatgggaacgaggtatcttacgaatgtgatcagggattctatttgttgggagaaaaaaaacttcagtgcagatcagatagcaaaggtcacgggtcctggtcagggccctccccccagtgccttcgtagccctcccgtgaccagatgcccaaaccctgaggtgaaacacggctacaagttgaataagactcactcagcatactctcacaatgacatcgtgtacgtagactgcaaccccggcttcattatgaacggatctagggtcatcaggtgccacacggacaacacatgggtccctggcgttcccacttgcatcaagaaagctttcattggctgccctccacctccaaaaactcccaacggcaatcatacaggtggcaacattgctaggttctcaccagggatgtcaatcctctatagctgcgatcaaggttacctgctcgttggcgaagccttgttgttgtgcacgcatgaaggcacttggtctcagcccgctccccactgcaaggaggttaactgtagttcccccgctgacatggatggcattcagaaaggtctggaaccgagaaagatgtatcagtacggggctgtagtcaccctggaatgcgaggacgggtacatgcttgaggggtcgccacagtcgcagtgtcaatctgatcaccagtggaaccctccactcgctgtctgcaggagcaggagtctcgcaccggtactctgcggcatcgcggccggcctaatcctactcacttttctgatcgtgatcactctgtacgttattagcaagcaccgtgccagaaattactataccgacactagccagaaagaggcgttccatttggaggccagggaggtctactccgtggatccttataatccagcttcttag

SEQ ID NO: 183553 - DNA, 2226 bp, Artificial Sequence
  Description of Artificial Sequence: Synthetic coding sequence
atggccgccgccgagggccccgtgggcgacggcgagctgtggcagacctggctgcctaaccacgtggtattccttcgtctgcgggaaggtctgaaaaaccaaagcccaaccgaggccgagaaaccagcaagcagctctttgccgagctccccaccaccccagcttctgacgcggaatgtggtgttcggccttggcggtgaactgtttctgtgggatggtgaagacagcagtttcctggtcgtcaggctgcgcggcccgtccggtggcggagaagagccagccctcagccagtaccagcgtcttctatgcatcaatcccccacttttcgagatctaccaagtgctattgtctcctacccagcatcatgtcgctctgattggaattaagggtctgatggtgttagaacttccaaagaggtgggggaaaaattccgaattcgagggcggcaaatcaacggtcaactgcagcactacaccggttgcagagcgcttctttacatccagcacctccctgactttgaaacacgctgcctggtacccgtctgagatactggacccccatgtggtgcttctgacttctgacaatgtcataagaatttactctctcagggaacctcagacccccacaaatgtgataatactctctgaggctgaagaagagtcccttgtcctgaataaaggcagggcttacaccgcatcactcggtgagaccgcagtggccttcgattttggcccgctggcagccgttcctaaaaccctcttcggacagaacggcaaagatgaagtcgtcgcatacccattatatatcctgtacgaaaatggggaaactttcctaacttatatctcgctgttacactcccccggcaatatcggaaaactcctggggcccctgcctatgcatccggcagcggaggacaattacggctacgatgcctgcgctgtgctctgcctcccctgcgtacctaacattctcgttattgccacggagtcaggaatgctgtatcattgtgtggttcttgagggggaagaagaggatgaccacacgtctgagaagagttgggattcacggatcgatctgatcccttcattgtacgtttttgagtgcgtagagttggaactggctctcaaactggctagcggagaagacgacccgtttgattccgatttctcctgccctgttaaacttcatagggatcctaagtgtccctctcgttaccattgcactcacgaggctggagtccactcagtgggacttacttggattcacaagctgcacaaatttctggggagcgacgaggaagacaaggatagcctccaggaactgtctacagagcagaagtgctttgtggaacacatcttgtgcactaagccgttaccatgtcgccagccagcgcctatcaggggcttctggattgttccagatatattgggcccgaccatgatctgcatcacctctacatacgagtgcctcatatggcctctgctgagtactgtccacccagcttcccccccactgctatgcacccgggaggacgtggaggtggcagaatcccccttgagggtcctggcagaaacaccagatagtttcgaaaagcacattagatccatcttgcaacgttccgtggcaaaccctgcttttcttaaagcctcagaaaaagacatcgctccacctcctgaagagtgcctgcagctactctccagggccactcaagtgttccgggagcaatacatcctgaaacaagatctggcaaaagaggagatccaaagacgggtgaaactgttgtgcgaccagaagaagaagcagctggaggatctgtcatattgcagagaggaacgcaagagcctaagagagatggccgagaggctagctgacaaatacgaggaagccaaggagaaacaggaagatatcatgaaccgtatgaaaaaacttctccacagtttccattctgaactgcccgtgcttagcgattctgagcgtgatatgaagaaagagctccagctcatcccagaccagttaaggcatctgggaaacgccattaaacaagtcaccatgaagaaagattaccaacaacaaaaaatggaaaaggtcctaagcctgcctaagcctactattattctcagcgcctatcaacgaaaatgcattcagtctatcctgaaagaggaaggtgagcacatccgcgaaatggtgaaacagatcaacgatattcgcaatcatgtcaatttttag

SEQ ID NO: 183554 - DNA, 762 bp, Artificial Sequence
  Description of Artificial Sequence: Synthetic coding sequence
atgatgatgaagatcccctggggcagcatccccgtgctgatgctgctgcttctcctggggctcatcgatatttcacaggcacaactgagttgcacaggaccacctgcgatccccggcatccccggcattccaggcactccaggtccagacggtcagcctggtacccctggcattaaaggagaaaaaggccttcctggcctggctggggatcatggagagtttggcgaaaaaggggatcccggtatacctggcaacccaggcaaagttggcccaaaaggtccaatggggcccaagggcggccctggagcgcctggagcacctgggcccaagggtgaaagtggcgattataaagctacacaaaagatagctttctctgcaaccaggacgatcaatgtgccattaagaagggatcagacaattcgctttgatcacgtgataaccaatatgaacaacaactatgagccacgctcaggtaaattcacgtgtaaggtgcccgggctctactatttcacttaccacgcttcttccaggggaaatttatgtgtaaaccttatgcggggccgcgagcgcgcacagaaagtggtcactttttgcgactacgcctacaacacattccaggtgacaactggtggcatggtcctcaaactggaacagggcgaaaatgtgttcctccaagccaccgacaagaactccctgctcgggatggagggagcgaacagcatattctcaggcttcctgctattcccagatatggaagcttag

SEQ ID NO: 183555 - DNA, 690 bp, Artificial Sequence
  Description of Artificial Sequence: Synthetic coding sequence
atgaagatcccctggggcagcatccccgtgctgatgctgctgctgctgttggggctgattgatatcagtcaggcgcaactttcatgtacaggaccgcccgctatccccggcattcccggaattcccggtacacccggtcccgatggccaacccgggactcccgggattaagggggagaaaggactgcccggtctggcgggcgatcatggggagtttggtgaaaagggcgaccctggcatccccgggaacccgggaaaggtaggcccaaagggtcctatgggtcctaagggcgggccgggagctccaggagcccctggtcctaaaggcgaatccggcgactataaggcaacccagaaaatagccttttcggctactagaactataaatgtccctctacgcagggatcagactatccgcttcgaccatgtgattacgaacatgaataacaactatgaaccgcggagcggaaagttcacctgcaaggtcccaggtctctactactttacttaccatgcaagtagtcgcggtaatctctgcgtcaatctgatgagaggccgggaaagggctcagaaagtcgtgaccttctgcgattatgcttacaatacattccaggtgaccaccgggggcatggtcttaaagcttgagcagggagagaacgtcttcctgcaggcaaccgataagaatagttag

SEQ ID NO: 183556 - DNA, 756 bp, Artificial Sequence
  Description of Artificial Sequence: Synthetic coding sequence
atgaagatcccctggggcagcatccccgtgctgatgctgctgctgcttctgggcctgattgacattagccaggcacagttgagctgcaccggtccacccgcaatacccggaataccgggtatacctggaacacccggacctgatggccagcccggaacacccggcatcaagggtgaaaaaggcttacccgggttagctggtgaccacggagagttcggtgagaagggcgaccctggaatccccgggaatcctggcaaggttggcccaaagggcccaatgggacccaagggaggaccaggcgcccctggagccccaggtccaaaaggggaaagcggggattacaaggccacacaaaagattgcattctctgccactcgtaccatcaatgtccctttacgaagggaccagactattcgattcgatcatgtcataacaaacatgaataacaactatgagcctagaagtggcaagtttacatgcaaggtgcctgggctgtactattttacctatcacgctagtagccggggcaatctgtgcgtgaacctaatgcggggacgtgaacgcgcccaaaaagtggtaaccttttgtgattatgcttacaacacatttcaggtaaccacaggaggcatggtactgaagttggaacaaggagagaatgtgtttctgcaggctacggataaaaattctctgcttggcatggaaggagcgaatagcatcttcagcggttttctcctcttcccagatatggaagcgtag

SEQ ID NO: 183557 - DNA, 462 bp, Artificial Sequence
  Description of Artificial Sequence: Synthetic coding sequence
atgaagatcccctggggcagcatccccgtgctgatgctgctgctgctcctcggcttgatcgacatctcacaggctcagctctcatgtactggacccccagccattcccggtattcccggcatacccggcacacccggccccgacggccaaccgggaactcctggaattaaaggagaaaagggcctgccgggtctcgccggagatcatggcgaatttggcgaaaagggcgacccaggaatacccggcaatcctggcaaagtaggtccaaagggaccaatgggacccaaagggggcccgggtgcgcctggagctcccggaccgaaaggggaatccggcgattacaaagccacccagaagatagcctttagtgctacaaggaccatcaacgtgcccttgagacgggatcagaccatcagatttgatcacgtgataacaaacatgaacaacaattatgaaccctag

SEQ ID NO: 183558 - DNA, 738 bp, Artificial Sequence
  Description of Artificial Sequence: Synthetic coding sequence
atggacgtgggccccagcagcctgccccacctgggcctgaagctgctgttgctacttctgttactgcctctgaggggacaggctaacacagggtgttatggtatccccggtatgccaggactgccgggcgcccctggcaaggatggatacgacggcttgccgggtccaaagggggaacccgggatcccagctattcccggaatccgggggccaaagggacagaaaggggagcccggactgccaggtcaccccggcaagaacggccctatgggaccgccggggatgcccggcgtgcctggccccatgggaatccccggggagcccggcgaagaaggcagatacaagcaaaagttccagagtgtgtttaccgtgaccagacagacacatcagccacccgctcccaactcacttattcgatttaacgccgtgcttacaaacccccaaggcgattatgacaccagcactggaaagttcacctgtaaggtccctgggctgtattacttcgtctatcatgcctctcataccgccaatctgtgcgtcctgctctaccggtcaggagttaaggtcgtgaccttttgcgggcacacatcaaagactaaccaggtgaatagtggcggagtattgctgagactgcaagtaggcgaggaagtgtggctggccgtgaacgattattacgacatggtcgggatccaggggtccgattccgtcttttcgggctttctcctgtttccagattag

SEQ ID NO: 183559 - DNA, 738 bp, Artificial Sequence
  Description of Artificial Sequence: Synthetic coding sequence
atggacgtgggccccagcagcctgccccacctgggcctgaagctgttgctgctgcttctgctcctccctctgcggggtcaggccaatacagggtgctatggtatacccgggatgcccgggctacccggcgctcctgggaaggatggctacgatggcctcccaggtccgaaaggagagcctggcatcccggcaatccccggaattaggggtcctaagggccaaaagggggaacccggcttacccgggcacccaggtaagaatggacccatgggacctcccgggatgccgggagttccggggcccatgggcattcccggcgaacccggcgaagaaggccgttataagcaaaagtttcagagtgtgttcactgttaccagacagacccaccagccccctgcaccgaatagcttgataagattcaacgctgtgttgacaaatccccagggcgattacgatacctcgaccggcaagttcacttgcaaggtgccggggttgtactactttgtgtaccacgcgtcacatacggccaatctgtgtgtgctgctttacagaagtggggttaaagtggttaccttctgtggtcatacctccaaaaccaaccaggttaactcaggcggagtgctcctgagactccaggtaggagaagaggtttggttggctgtgaatgactactatgacatggtcgggattcaaggatctgattcggtcttctcaggctttctcttgttcccagattag

SEQ ID NO: 183560 - DNA, 738 bp, Artificial Sequence
  Description of Artificial Sequence: Synthetic coding sequence
atggacgtgggccccagcagcctgccccacctgggcctgaagctgctgctgctcctgctccttctgcccttgaggggccaagcaaatacaggctgttatgggattcccgggatgcccggtttaccaggggcccccggtaaagatgggtatgacggccttcctggccccaagggagagcctggcatccctgcaataccaggaatacggggtccaaaagggcagaagggcgagcccgggctgcctggccatccaggcaagaacggccctatggggcctcctggaatgcccggcgtgcctggacccatgggcatccccggcgaacccggcgaggaaggacggtacaaacaaaagttccagagcgtattcaccgtcactaggcaaactcaccagcccccagctccaaactctctcataagattcaacgcagtgctgaccaatccccaaggagattatgatactagcactgggaagttcacgtgcaaagtgcctggactgtactattttgtctaccacgcatctcacactgcaaatctctgtgtgctcctttatcggtccggcgtcaaggtggtgactttttgcggacacacctctaaaacaaatcaggtcaacagcggcggggtactgctgagactccaggtcggagaagaagtgtggttggccgtgaacgactattatgacatggtgggcatccagggtagcgattctgtgttctccggctttctgctctttccagactag

SEQ ID NO: 183561 - DNA, 777 bp, Artificial Sequence
  Description of Artificial Sequence: Synthetic coding sequence
atgctgctggtgctggtggtgctgatccccgtgctggtgagcagcggcgggcctgaaggacactatgagatgttgggaacctgccgtatggtctgcgacccataccctgctcggggacccggagcaggggctcgcaccgacggtggtgacgcactgagcgagcagagtggagccccacctcctagcaccctggtgcaaggaccacagggaaaacctggcaggacaggcaaacctggcccacccggcccgccaggcgatcctggccctcccggacctgtgggacctcctggagaaaagggagaaccaggcaaacctggcccgcccggactccctggcgccgggggctcgggggccatctcgacggccacatacactacagtccctcgcgtggctttttacgccggcctgaagaatccccacgaggggtacgaagtgctgaagttcgacgacgtcgtgacaaaccttggaaacaactacgacgctgcatcaggtaaattcacctgcaatattccaggcacgtatttcttcacctatcacgtcctgatgagagggggtgacggaacatctatgtgggctgacctgtgcaagaatgggcaggtgcgggccagcgccatcgcccaagacgccgaccagaattacgactatgctagcaacagtgtcatcttacacctagatgcgggagatgaggtatttatcaagcttgacggaggcaaggctcatggcggaaactccaataaatatagcacattctccgggtttatcatttatagcgactag

SEQ ID NO: 183562 - DNA, 864 bp, Artificial Sequence
  Description of Artificial Sequence: Synthetic coding sequence
atggccctgggcctgctgatcgccgtgcccctgctgctgcaggccgctccacgcggcgcagcccactacgaaatgatggggacctgtaggatgatttgtgatccatatacagccgcccctggcggcgagccgccaggcgcaaaagctcaacctccaggcccatcaacagccgcgctggaggtgatgcaggatttgtccgctaatcctcccccgcccttcattcagggtcctaaaggagaccccggtcgaccaggaaagcccggtccaagagggccacccggcgagcccggacctcccgggcccagggggcctccaggagaaaaaggcgatagcgggagacctggattaccaggccttcagcttaccgcaggcacagcctcaggtgtcggtgtagttggggggggagccggcgtgggcggggacagcgagggggaggtgacgagcgctctgtctgcaaccttctctgggccaaagatcgcgttctatgtcggactgaagagtccccatgagggttacgaggtgcttaaatttgacgacgtggttacaaatctgggcaatcactacgatcctacgactggcaagttttcatgccaggtgagaggtatttacttttttacctatcacattctcatgaggggcggagatggcactagcatgtgggccgatttgtgtaagaatggccaggtccgagcctcggccatcgctcaagatgctgatcaaaattatgattacgcctcaaactctgtggtccttcatttagatagtggcgatgaagtatacgtgaaactggatggcgggaaggctcacggaggtaacaacaataagtacagtactttctccggatttctgttatatccagactag

SEQ ID NO: 183563 - DNA, 2007 bp, Artificial Sequence
  Description of Artificial Sequence: Synthetic coding sequence
atgagcgtgcggttccgggtgggccgggaggagaacgcccagtggtggctcctgtatctcctggtgccggccctgttttgccgagcagggggatccattcctatacctcagaaactctttggtgaggtcacctctcccttgttcccgaaaccttacccaaataattttgagaccacaactgtgattacagttcccactggctatagagtgaaactggtcttccagcaatttgacctcgaacccagcgagggttgcttttacgactacgtaaagataagcgccgacaaaaagagtctgggaaggttttgcggccagctgggttcgcccctcggaaatccgccgggaaagaaggaattcatgtctcagggaaataaaatgttgttgacgttccacacagacttctctaatgaggagaacggaacaatcatgttctacaagggctttctggcctactaccaggccgttgatctggacgaatgtgccagtaggtctaaaagcggcgaggaggatccccaacctcagtgccagcacctgtgccataattatgtggggggatacttttgctcttgtcggcctggctacgagctccaggaagaccggcatagctgtcaggccgaatgctctagcgaactgtacactgaagctagcggctatatcagctctctggagtatcccaggagctatcctcctgacctgaggtgtaattactcaatacgggtggaaagaggactcacactgcacctgaaattcctggagccgtttgacattgacgaccatcagcaagtccattgtccgtatgatcagttgcagatttacgcaaacggcaaaaatatcggtgagttttgcggaaagcagagaccacccgacctggatacatcaagtaacgctgtggatctcctgtttttcactgacgaatccggggactcgcgcgggtggaaactgaggtacactacagagatcatcaaatgcccccagccgaaaaccctggatgagtttacaatcattcagaatctgcagcctcagtaccaattcagagactacttcattgccacctgtaaacaagggtatcagttgatagaaggtatacaggtggttgctggggtcgtggacgtgtcagcagggagagtgtcgtggtccacgtcaagtcagacctgctgtacccgggtctacacatgcactgctcagggcatctggaagaatgaacaaaagggagagaagatcccacgttgtctgccagtgtgcggtaaacccgtcaatcctgtagagcagcggcagcggatcataggggggcagaaagccaagatgggcaactttccgtggcaagtgttcacaaacatccacggaaggggaggcggggccctgctgggggatagatggattcttaccgccgcgcataccctatatcccaaggaacatgaggctcagagcaacgcctcattagacgtattcctgggccacaccaatgtggaagagctgatgaaattggggaatcaccccataagacgcgtttcggtacaccccgattatcgccaggacgagagctataattttgagggggacatcgccctacttgagttggaaaatagtgtgactctggggcctaacctattgccgatctgcctcccggataatgacacgttctacgatctcggcttgatgggctacgtctccggctttggtgttatggaggaaaagatagcccacgacttacggtttgtgcgcttgcccgtggccaacccacaggcctgtgagaattggttaagggggaagaaccggatggatgttttttcacagaacatgttctgcgccggccacccttccctgaagcaagacgcgtgccagggggattcaggcggtgtctttgcagtgcgggatcccaataccgacaggtgggtcgccactggcatagtctcttggggtattgggtgcagtcgcgggtatgggttttataccaaggtgctgaactatgtcgattggattaagaaggaaatggaggaggaggattag

SEQ ID NO: 183564 - DNA, 1131 bp, Artificial Sequence
  Description of Artificial Sequence: Synthetic coding sequence
atgtggctgctgtacctgctggtgcccgccctgttctgccgggccgggggaagtatccctattccccagaagctttttggtgaagtgaccagtcctctatttccgaaaccttaccccaacaacttcgagaccaccaccgtgatcaccgtccctactggctaccgcgtaaagctggtcttccagcaatttgatcttgaaccgtctgagggctgcttttacgactacgtgaagatatccgccgataagaaatcgctaggaaggttctgtggacagttgggatcaccacttggtaatccacctggaaagaaagagttcatgtcacaggggaacaaaatgctcctgactttccatacagacttctctaatgaggagaacgggacaatcatgttttacaaaggatttcttgcttactaccaggctgtcgatctcgacgaatgtgcctcaagatctaagagtggggaggaagacccccagccgcagtgccagcacctgtgccataattacgtggggggttacttttgctcttgtaggccaggatatgaactgcaggaggaccgccactcatgtcaagcagagtgtagcagcgagctttatactgaagcgtcaggctacatttcctccttggaatatccccggtcctatccaccagatctccggtgcaactattccattagggtcgagcgaggactaacattgcacctcaagttcctggaacccttcgatatcgacgatcaccaacaggtgcactgtccatacgatcagcttcaaatctacgcaaatggcaagaacatcggggaattctgcgggaagcagagaccaccagacttagacacttcttccaatgctgtggacctgctgttcttcacagatgagagtggagacagcagaggatggaagctcaggtacacgaccgagattattaaatgcccccagccaaaaacactcgacgagtttaccatcattcagaatctgcagccccagtatcagttcagagactactttatagcgacctgcaagcagggttaccagctgatcgagggttgtacacccgcccagcaccgtgcttttggccgcatgaataggcgagagcggcggtttctaggagcctgtcaatgcgttggttccccttag

SEQ ID NO: 183565 - DNA, 1962 bp, Artificial Sequence
  Description of Artificial Sequence: Synthetic coding sequence
tggctgctgtacctgctggtgcccgccctgttctgccgggccggcggaagcatcccaattccccaaaagctgttcggcgaagtaacctcccctctgttccccaagccttatcccaataatttcgagactactactgtgataactgtcccgaccggctatagagttaagttggttttccagcagtttgatctggagccctctgagggctgcttttacgactatgtgaagatttctgccgataagaagagcttaggcagattttgcggccaacttggcagtcctctcggaaacccacccggaaaaaaagagttcatgagccaggggaataagatgttgttgaccttccacacggacttctctaatgaagaaaacggaacgatcatgttttataagggatttctagcctattatcaagccgtggatctggatgagtgtgcttcacgcagtaaatccggcgaggaagaccctcagcctcagtgccagcatctctgtcacaactatgtcggcggttacttctgttcatgcagaccaggatatgaactgcaggaggatcgccattcctgtcaagcggaatgttctagtgagctgtacacggaagcatctggttacatctcctcattagaatatcctcgcagttacccacccgatcttagatgtaattatagcatcagagtcgaaagggggctgaccctgcacttaaaattcctcgaacccttcgacatcgatgatcatcagcaggtccactgtccctatgaccagctgcagatttacgcgaacggaaaaaatattggagagttttgtggtaaacagaggcctcctgatctcgacacgagctccaacgccgtggatctcctcttcttcacagacgaaagcggcgactcacggggctggaagcttagatatactactgagataattaagtgcccccaacccaaaacgctcgatgagtttaccattatccagaacttacagcctcagtaccagttcagggactactttatcgcaacgtgcaagcagggttatcagctcatcgagggcatacaagtggtggctggcgtggtggatgtgagcgctggacgcgtgagttggtcaacctcaagccagacgtgctgcacaagggtgtatacctgcacagctcagggcatctggaagaatgaacagaagggcgagaaaattccccgctgtctccctgtgtgcggtaagccagtgaatccggtggagcagaggcaacgcatcatcgggggtcagaaggccaagatgggaaatttcccatggcaggtatttacaaatatccacggacgcggtggaggagcactgttgggtgacaggtggattttgaccgcagcccatacactgtatcctaaagaacacgaggcccagtcaaacgcctcactagacgtattcttggggcacacaaacgttgaagaactgatgaagcttggtaatcacccaatccgacgggttagtgtacacccggattatcgccaagacgagtcctataattttgaaggcgacatagcactgctcgaacttgaaaattccgtgaccctagggccgaatctgctgcctatttgcctaccagacaatgacaccttttatgacctcggtttgatgggatatgtgtcaggtttcggagtcatggaagaaaagattgcacacgatctcaggtttgtgaggctgccagtagccaacccgcaggcctgtgagaactggctacgtggaaagaaccgcatggacgtgttcagccaaaacatgttctgcgccggccaccctagcctgaagcaagacgcatgtcagggggattccggcggagtatttgctgtgcgcgaccccaacacagataggtgggtggctaccgggattgtgagctgggggatcggctgtagtcgggggtacgggttctacacaaaggtcctcaactacgtagactggatcaagaaggaaatggaggaggaagactag

SEQ ID NO: 183566 - DNA, 1464 bp, Artificial Sequence
  Description of Artificial Sequence: Synthetic coding sequence
atgcccggcccccgggtgtggggcaagtacctgtggcggagcccccattctaaggggtgcccaggcgcgatgtggtggctgctgctgtggggcgtcctacaggcgtgcccgacaaggggaagtgtgttgctggctcaggagttgccccagcagctcacatccccgggttacccggaaccctatggcaagggtcaggagagctcaacggacataaaagctccagagggatttgccgttagactcgttttccaggatttcgatctcgagccttcccaggattgcgctggtgatagcgtcactatctccttcgtggggagtgaccccagccagttctgcggacaacaagggagcccgttgggacgcccccctgggcagcgcgaattcgtctctagtggacggtcccttagactgacattcaggacacaaccaagctccgaaaacaaaacggcgcatttacacaaaggctttctggccctctatcaaacagtggctgtgaactacagccaaccaatttctgaagcttctcggggtagcgaggccattaatgccccaggcgacaatcccgccaaagtgcagaatcactgccaggagccatactaccaggctgccgctgctggagcactgacttgcgccacccccggcacctggaaggaccgtcaggatggggaagaggtgctgcagtgtatgcctgtgtgcggccgtcctgtgactcccatcgctcaaaaccagaccacgttaggctcgagtcgtgcgaaactgggaaattttccttggcaggcttttacgagcatacatggtaggggaggaggggcactgttgggcgatagatggatcctgaccgcagcccatacaatttatcccaaagactccgtgagcctaaggaagaatcagagcgtcaatgtctttcttggacacactgcgattgacgagatgctcaaattggggaatcaccccgtgcatcgcgtggtcgtgcaccctgactacagacaaaatgagagccataacttcagcggagacatagcactgctggagctgcagcattccattcccttggggcctaacgtgctcccagtgtgtctcccggataatgagactctgtatagatcagggttgcttggttacgttagtgggtttggaatggagatggggtggctgacaactgaactgaagtactctcggctgccagtagccccaagggaagcgtgcaatgcatggttacagaagcgccagaggcccgaggtgttttccgataacatgttttgcgtgggggatgagacacagcggcattcagtatgccagggcgattctggatcagtctacgtcgtgtgggataaccacgcacaccactgggtagcgacagggatcgtgagctgggggatcgggtgtggagaaggatacgacttctatacaaaagtgctgagttatgtcgactggattaagggtgtgatgaatggcaaaaactag

SEQ ID NO: 183567 - DNA, 1317 bp, Artificial Sequence
  Description of Artificial Sequence: Synthetic coding sequence
atgcccggcccccgggtgtggggcaagtacctgtggcggagcccccacagcaaaggttgccccggtgctatgtggtggctgctgctctggggcgtcctccaagcatgccccacacgcggcagtgttctgctggctcaggagttgccacagcagcttacgagcccaggctatcctgaaccctacggcaagggtcaagaatcaagcactgacattaaggctcccgaagggttcgcagtcagactcgtgtttcaggatttcgacttggagcccagccaggattgtgccggtgatagtgttacgatctcttttgtagggagtgatcctagccagttttgcggccagcaaggcagcccattaggcaggccaccaggccagcgggagttcgtctcaagcggccgcagcctgcgcctgactttccggactcaacctagctctgaaaacaagaccgcgcatctgcacaaaggcttcctggccttgtatcagacagttgccgtgaactactcacagccaatctccgaggcgtcccggggctctgaagctattaacgctccaggcgacaaccccgcaaaggtccagaaccactgccaggagccctactaccaagctgccgcagccggggctctgacttgcgctactcctgggacatggaaggatagacaggacggggaagaggtgctccaatgcatgcctgtgtgtggacgccctgtcactccaattgcccagaatcagacgaccttgggcagtagtcgggctaagcttggtaatttcccttggcaagcattcacgagcatccacggtcggggaggcggcgcactcctgggcgaccgctggattctaaccgcagcccacacgatttatcctaaagacagcgtgagcctgagaaagaatcagtccgtaaatgtctttctagggcatacggctattgacgaaatgctgaaactgggaaaccacccagtgcatcgcgtggtggtccacccagactaccgccaaaatgagagccataatttctccggtgatatagccctgctggagctccaacacagcattcctctgggccccaacgtgttgcctgtgtgtctccctgataacgagaccctgtaccgcagtggtctactcgggtacgttagcgggttcgggatggagatggggtggctgacgacagaacttaaatattcgaggcttccagtggctccacgcgaagcctgcaatgcctggctccagaaacggcaaaggcccgaggtgttttccgacaacatgttctgcgtgggtgatgaggccggagagagtctggagcccggtaggaggcggcttcagtag

SEQ ID NO: 183568 - DNA, 2067 bp, Artificial Sequence
  Description of Artificial Sequence: Synthetic coding sequence
atgtggtgcatcgtgctgttcagcctgctggcctgggtgtacgccgaacctacaatgtatggcgagatactcagtccgaactatcctcaggcttacccctctgaggtggagaagagctgggatatcgaggtgcccgaggggtatggcattcacctttattttacacacctggatatagagttaagtgagaactgcgcttacgatagcgtacaaatcatcagcggcgataccgaggagggtcgtttgtgtggacaaagaagttccaacaacccccactcccctatagtggaagagtttcaggttccttacaataagttacaggtgattttcaaaagtgacttctccaacgaggagcgcttcaccggcttcgcggcttattatgtcgccaccgacatcaatgagtgcacagattttgtagacgtaccttgtagtcatttttgtaataactttatcggcggctacttctgcagttgccctccagagtactttctgcatgacgatatgaagaattgtggggttaactgctctggggacgtctttaccgctctcattggggagatcgccagtccaaattatcccaagccgtatccagaaaattctcgctgcgagtaccagatacgcctggagaagggctttcaggtggtggtgacccttagaagggaggactttgacgtcgaggccgctgacagcgccggaaactgtcttgattcactcgtctttgtggctggagaccgacagtttggaccgtattgcggccacgggttcccaggtcccctgaacatagagaccaagtcaaacgctctcgacattatcttccagacggacctgaccggccaaaagaaaggatggaaactcaggtaccacggcgaccccatgccctgtcccaaggaggatactccaaacagcgtgtgggagcctgccaaagccaaatacgtgttcagggacgtcgtccagatcacatgtctggatggcttcgaagtcgttgaagggcgggtgggagccacatccttttatagcacctgccagtctaacggcaagtggtctaatagcaagctgaaatgccagcccgtcgactgtgggatccccgaatctatagagaacggcaaagtggaagaccctgagtcaactctctttggcagcgtgattcggtatacgtgcgaagaaccatattactacatggagaacggcggcgggggcgagtatcactgtgctggcaacggctcgtgggtgaatgaagtgctcgggcccgaactgcccaaatgcgtgccagtgtgcggagtaccaagggaaccgttcgaagaaaaacagagaattatcggggggtcggacgctgacatcaaaaacttcccctggcaggtgtttttcgataacccctgggctggcggagcattgatcaacgaatattgggtccttaccgccgcccatgtggtcgagggcaatagagaacctaccatgtatgttgggtccacctccgtccagacctcacgtctggcaaagtctaagatgctgacacccgaacacgtgtttatacaccctggctggaagctacttgaagtccccgaggggcgaaccaacttcgataacgacattgccttggtgcggttgaaggaccccgttaagatggggcccactgtgagtcccatctgcctccccgggacttccagtgactataacctgatggatggggatctgggcctgatttccggttggggccgcactgagaagagggacagggccgtccgcctgaaagctgcccgcctgccagtggcacctctacgcaagtgtaaggaggtgaaggtcgaaaagcctacggctgatgccgaggcgtacgtgtttactccaaacatgatctgcgcaggaggagaaaaaggcatggacagctgcaagggagacagcggtggcgcctttgccgtccaggatcctaacgacaagacgaagttctacgcggctggcctggtatcttggggtccacaatgcgggacatatggcctgtatacaagagtgaaaaattatgtggattggatcatgaaaacgatgcaggagaactccacccctagagaagattag

SEQ ID NO: 183569 - DNA, 2067 bp, Artificial Sequence
  Description of Artificial Sequence: Synthetic coding sequence
atgtggtgcatcgtgctgttcagcctgctggcctgggtgtacgccgaacccaccatgtacggtgaaatactgtctcccaactatccccaagcttatccctcagaagtggaaaagagctgggacatcgaagtgcctgaaggatacgggatccacctatacttcacacatctcgacattgaactgagcgagaattgtgcgtatgacagcgtccagatcatctccggcgatacagaagagggccggttgtgcgggcagagatcatccaacaatccccatagtccaatcgtcgaagagttccaggttccctacaacaagctgcaagtgatcttcaaatcggatttctccaacgaagagcgatttacagggtttgcagcatactatgtggccacggatatcaacgagtgcacagactttgtcgacgtcccatgctcccacttctgcaacaacttcatcgggggatatttttgttcatgccctcctgagtacttcctccacgatgatatgaagaattgcggcgtgaactgtagtggagatgtctttaccgccctcattggggagattgccagccccaactatccgaagccataccctgagaactccagatgtgagtaccagatccgactagaaaagggcttccaggttgtcgtgactctgaggagagaagattttgatgtggaggctgctgactcggctgggaactgccttgactctcttgtgtttgtggcgggagatcgccagtttgggccctactgtggtcacggcttccctggaccattgaatatagaaactaagtctaacgcccttgatatcattttccaaaccgatctgactggccagaagaaaggatggaagttacggtatcacggggaccctatgccttgtccaaaggaagacacccctaacagcgtgtgggaacccgcgaaggctaaatatgtctttagggacgttgtccaaattacctgtctggacggatttgaggtggtggaaggccgcgtaggagcaacctccttttactctacgtgtcagtccaacggaaagtggtcgaactcaaaactcaaatgtcagcctgttgactgcgggatacccgaatctattgagaacggaaaggtggaagacccagagtccacgctcttcgggtctgtcatcaggtacacctgtgaagagccctactattatatggaaaatggtgggggaggggaatatcattgcgctggaaatggatcatgggtaaatgaagtgctgggacccgagctccctaagtgcgtgccagtgtgcggcgtaccccgtgagccattcgaggagaaacagcgcatcattggggggtctgacgccgacatcaagaactttccgtggcaggtcttctttgacaatccatgggctggaggcgctctgattaacgagtattgggtcctcaccgccgcccacgtggtggagggaaatcgagagccaaccatgtacgtgggatccacaagcgtacagactagccggttggctaagtccaagatgctgacccctgaacacgtgttcatccacccgggctggaaattgctggaagtgcctgaaggaaggaccaatttcgacaatgatatagcactagtgaggctcaaggaccccgtgaagatgggacctaccgtttcccccatctgcctgccgggaacaagctctgattataatttgatggacggggatctgggcttaattagcggttggggcaggacggagaaacgagacagggcagtgcgactgaaggcagctcgactccccgttgctcctctaagaaagtgcaaagaggtaaaggtggaaaagcccacagctgacgcagaagcatacgtattcactcctaatatgatatgcgccggcggggagaaaggcatggatagctgtaagggagattccggcggcgccttcgcggtacaggatcctaacgacaagaccaaattctatgcagcaggcctagtgtcctggggcccacagtgcggaacttacggcctgtatacccgggtgaaaaattatgtggactggatcatgaaaacaatgcaagaaaattctacacctcgcgaggactag

SEQ ID NO: 183570 - DNA, 2049 bp, Artificial Sequence
  Description of Artificial Sequence: Synthetic coding sequence
atgtacggcgagatcctgagccccaactacccccaggcctacccctctgaggtcgaaaagagctgggatattgaggtccctgaagggtacggtattcacctgtattttactcacctggacattgagctgagtgagaattgcgcatacgattcggtgcagatcatctctggcgatacagaagaggggaggttgtgtggccagaggagctcgaacaatccccactcgccaatcgttgaagaatttcaggttccttataataaattgcaagtaattttcaaatcagatttcagtaatgaagagcggtttaccgggtttgcagcttactatgttgctactgataaagacgagtgctccgggcgcgcacagctgtggaaccacatgagtgacgtaccatgcagccatttttgtaacaacttcattggcggctatttctgctcttgcccgccagagtactttctgcacgatgatatgaaaaactgtggagtgaattgttccggagatgttttcacggcacttattggggagattgcatccccaaattaccctaagccctatccagagaattcccgatgtgagtatcagatcaggttagagaaggggttccaggtccacctctccctgctgctgaagcttgagtgttctggggcaatcactgctcactgttctctggaccttctgggttcaattgcaggcgacaggcaattcgggccatattgtggacatggctttcctggacctctcaacatagagacaaagagtaacgctctcgatatcattttccagacggacttgaccgggcaaaaaaaggggtggaaattgcggtaccacggtgatccaatgccatgccctaaagaggacacgcccaactccgtttgggagccagctaaagctaaatatgtcttccgggacgtcgtccagattacgtgtctcgacgggttcgaggtcgttgaagggcgcgtgggtgccacaagcttttactccacttgccagtccaacggcaagtggtcaaattccaaactgaagtgtcagcctgtggattgtgggatccccgagtctatcgagaatggaaaggtggaagacccggagtccaccttatttggttctgtgatcaggtacacctgtgaagaaccctattactacatggaaaacggaggcgggggcgaagagcgcgaacgaggagagtaccattgtgccgggaatgggagctgggttaacgaggtgcttggccccgagttgcctaagtgcgtgcctgtgtgtggcgtgcccagagaacccttcgaggaaaagcagcgaatcatcggtggaagcgacgcggatattaaaaatttcccatggcaggtgtttttcgataacccatgggccgggggagctctgattaacgagtattgggtcctcaccgccgctcacgtggtcgagggcaatcgggagcccaccatgtacgtcggttcaacttcagttcagacatctcggctggccaaaagcaagatgcttacgcccgagcatgtgttcatccatcctggctggaagcttctagaagtcccagaaggtcgtaccaactttgataacgacatcgctcttgtgcgcctcaaggaccccgtgaagatggggcctactgtgagtcctatctgcctgccaggcacatcctcggactataacctgatggacggcgaccttgggctaatctctgggtggggcaggactgagaagagagacagagcagtacgcttgaaagcagccagactgcccgtggcccccctccggaagtgcaaggaggtgaaggttgagaaaccgaccgccgatgccgaggcttacgtgtttacaccaaatatgatatgtgcaggcggtgagaagggtatggacagctgcaaaggcgatagtggtggcgccttcgccgtccaagaccccaatgataagaccaaattttacgccgcgggcctggtttcatggggaccgcagtgtggtacatacggtctatacaccagggtcaagaactacgtcgattggatcatgaaaactatgcaagagaattccacaccccgagaagattag

SEQ ID NO: 183571 - DNA, 507 bp, Artificial Sequence
  Description of Artificial Sequence: Synthetic coding sequence
atgtggtgcatcgtgctgttcagcctgctggcctgggtgtacgccgagcccactatgtatggtgagatcctgagtcctaattatccccaggcttacccatccgaggtggaaaagtcatgggatatagaagtgcccgaaggctacgggatccatctgtatttcactcacctggacatcgagctgtctgaaaactgcgcatatgactccgtccaaatcattagcggcgacacagaggaaggtcgtctgtgcggccagcgatccagcaataatcctcattctccaatcgtagaagaatttcaggttccctacaataagctacaggttatctttaagtccgacttcagtaacgaggagcggtttactgggttcgctgcttactatgtggcaacggatatcaacgaatgtacagacttcgtcgacgtgccttgctcacacttttgcaacaatttcattggaggctacttctgctcttgtccacctgagtactttttgcatgatgatatgtag

SEQ ID NO: 183572 - DNA, 2067 bp, Artificial Sequence
  Description of Artificial Sequence: Synthetic coding sequence
atgtggtgcatcgtgctgttcagcctgctggcctgggtgtacgccgagccaaccatgtacggtgagatcctctcgcccaactaccctcaagcctatccgtctgaggtggaaaaaagctgggatatcgaggtgccggagggctacggaattcacctgtacttcacccatttggacatcgagctgtcagagaattgcgcctatgactccgtgcagattatcagcggagatacagaagaagggaggctgtgtggccagcgcagctctaataatccccactctccgatcgtggaagaattccaggtcccctataataaactgcaggtcatatttaaaagcgatttttctaatgaagaacggttcactggattcgccgcctattatgtggccactgacattaacgagtgtaccgacttcgtggatgtcccctgcagccacttttgtaataactttatcggcggatatttttgttcctgtccccccgagtatttcttgcatgacgatatgaagaattgcggcgtaaactgttcaggtgacgtgtttacagcacttattggggaaattgccagcccaaactatcccaagccctatcctgaaaattcccggtgcgagtatcagattaggctcgagaagggcttccaagtcgtcgtgacacttaggcgggaagacttcgacgtggaggccgccgactccgctggtaattgtctcgactccctggtgtttgtggccggggatagacagttcggcccctactgtggtcatggattcccaggacccctgaatattgagactaaaagcaatgctctggacataatcttccagaccgacctcactggccaaaagaagggctggaagctgcgatatcacggtgatcccatgccctgtcctaaggaggataccccaaattccgtgtgggagcctgcgaaggccaagtacgtctttagggacgttgtccagattacctgcctcgacggattcgaagtagtggaaggccgagttggggcaacaagcttctattctacgtgtcaatcaaacggaaagtggtcaaattccaagctgaaatgccagccagtagattgcggtatcccagagtctatcgagaacggcaaggtcgaggatcccgagagcacattgtttggttctgttattcgctacacgtgcgaggagccctactattatatggagaacggcggcggtggcgaataccattgcgccggcaacgggtcttgggtgaatgaagtccttgggcctgaattacccaagtgcgtgcctgtttgtggagtgccaagagagcccttcgaagaaaagcagagaattataggcggttctgacgccgatatcaaaaactttccatggcaggtcttcttcgacaacccctgggccggcggcgctctgatcaatgagtattgggtcctgacggcagctcatgtggtcgagggaaatagggagccaacaatgtacgtagggagcacaagtgtgcagacttcccgtttagctaaatctaagatgctgacacccgagcacgtttttattcacccggggtggaaactgctggaggtgcccgagggccgcactaattttgacaacgacatcgctttagtcagattaaaagatccagtgaaaatgggccctacagtaagtcccatttgtcttccagggacaagctccgattataatctcatggacggcgaccttggcctgatttcggggtggggcaggacagagaaacgagacagggctgttaggctgaaagcagccagactgcctgtcgctccacttagaaaatgcaaggaggtaaaggtggaaaagccgacagccgatgctgaagcctacgtgttcacaccaaacatgatttgcgcaggcggagagaagggtatggactcgtgtaaaggggactccggtggcgcctttgcagtgcaagaccctaatgataagactaagttttacgcagcagggctcgtaagctggggcccccaatgcggaacatacggactgtacacgcgtgtgaagaactacgtcgattggataatgaaaaccatgcaggagaacagtactccccgtgaggactag

SEQ ID NO: 183573 - DNA, 312 bp, Artificial Sequence
  Description of Artificial Sequence: Synthetic coding sequence
atgtggtgcatcgtgctgttcagcctgctggcctgggtgtacgccgaaccaactatgtacggggaaatactttcacccaactacccacaggcatacccttcagaggtagagaagtcctgggatatcgaggtgccagaaggatatgggatccatctatatttcacgcatttggatatagagctctcagagaactgcgcgtatgattcagtgcagatcatcagcggagatactgaagaagggagactatgtggtcagagaagtagcaacaacccccacagcccaatagtcgaagaatttcaggtgccctattag

SEQ ID NO: 183574 - DNA, 306 bp, Artificial Sequence
  Description of Artificial Sequence: Synthetic coding sequence
atgtggtgcatcgtgctgttcagcctgctggcctgggtgtacgccgaaccaacaatgtatggtgaaattcttagcccaaattatccacaggcgtaccccagcgaggtagagaagagctgggacatcgaggtgcctgaaggttatgggattcacctatatttcactcacctggatatcgagcttagcgaaaattgcgcctatgacagcgtgcaaataatcagtggcgataccgaggagggcaggttatgcggacaacggtcctcgaacaaccctcacagcccaatagtggaggaatttcaggtgtag

SEQ ID NO: 183575 - DNA, 2259 bp, Artificial Sequence
  Description of Artificial Sequence: Synthetic coding sequence
atgggccccctgatggtgctgttctgcctgctgttcctgtaccccggactggccgacagtgcccctagctgtccacagaacgtgaacattagcggcggaactttcactctgtctcacggctgggccccaggatccttactgacatactcctgcccacagggcctgtatccctcccctgcatccaggctctgcaagtcatctggccaatggcaaacaccaggcgccacacggagccttagcaaggccgtgtgcaaaccagtcagatgccccgctcccgtttcttttgagaacggaatttacaccccccgcctgggatcttacccggtgggcggtaacgtgtccttcgagtgcgaagacggctttattctcaggggcagtcctgtgcgacagtgtcgcccaaatggaatgtgggatggagagacagctgtatgcgacaacggcgctggacattgtcccaatcctggtatctccctaggtgcagtgaggactggattcaggtttggtcatggtgacaaggtacgataccggtgctcatctaatctggtgctgacagggtcctccgaacgagagtgtcagggcaatggcgtgtggtcgggcaccgagcccatatgccgccagccttactcctatgactttcccgaagacgtggctcctgctctcggtacctcgttttctcacatgctcggtgccacaaaccctactcaaaagactaaagagtcccttggccgcaaaatacagatacaacggagtggacacctgaacctgtacctcctcctggattgctctcagagtgtatctgagaacgatttcttgatttttaaagaaagcgcgtccttaatggtggacagaatcttcagcttcgagatcaacgtcagcgtcgcaatcattacctttgccagcgagcccaaagtgctcatgagtgtgctcaatgacaattcacgggacatgactgaggttatttcttcgctcgagaacgctaactacaaagatcatgagaatgggactggtactaacacatacgccgcactgaactctgtttacctgatgatgaataatcagatgcggcttctaggcatggagaccatggcctggcaggagatacggcatgccattatcttgctgactgacggaaaaagcaatatgggcggatctcccaagactgcggtagaccacattcgagaaattttaaatatcaatcaaaaacgtaatgactatttggatatctacgctatcggcgttggaaagttggacgtggactggcgcgagctcaatgaactgggcagcaagaaagacggggagaggcacgctttcatcctccaggacaccaaagcgctgcaccaagttttcgagcacatgctcgacgtcagcaagttgacggatacgatctgtggtgtgggaaatatgtccgccaatgctagcgaccaagaaagaaccccctggcacgtgactatcaaacctaaaagccaagagacctgtcggggggctcttattagcgaccagtgggtcttgacggccgctcactgcttcagagacggtaacgatcattccttgtggagagtcaacgtgggtgaccccaagtcccaatgggggaaggaatttcttattgagaaggctgttatctctccgggatttgacgtattcgcgaagaagaatcagggcatccttgagttctacggtgatgatatagccctcttaaagctggctcagaaggttaagatgagcacacatgctcgtcctatttgtctcccctgcacaatggaggccaacctagccctgcgaagaccacagggatccacctgccgcgaccatgagaacgaactgctgaataagcagagcgtacctgcacactttgttgcactcaatggctccaagttaaacattaacctcaagatgggggtggaatggaccagctgcgctgaggtggtgtcccaagaaaagactatgtttcccaatcttacagacgtgcgggaggtagtgactgaccaattcctgtgcagcggtacccaggaggatgaatcaccttgtaagggggagtccggcggcgctgtgttcttggaacgaaggtttcgcttctttcaagttgggttggtgtcctggggcctgtacaacccatgcctaggtagtgctgacaaaaattctcgcaagcgggcacccagaagtaaagtaccgccgcctcgggattttcatatcaacctgtttcgcatgcagccatggctgcggcaacaccttggcgacgtcctcaattttctccctctctag

SEQ ID NO: 183576 - DNA, 1134 bp, Artificial Sequence
  Description of Artificial Sequence: Synthetic coding sequence
atgaccgaggtgatcagcagcctggagaacgccaactacaaggaccatgaaaatggaaccggaaccaatacttacgcagccttgaattctgtatacctgatgatgaacaatcagatgaggctccttggcatggagactatggcttggcaggaaattcgccatgccattattctgctgactgatgggaaatctaacatggggggatcgccgaagacggccgttgatcacatccgtgaaattctgaacattaaccagaagcgcaacgattacctggacatctatgctatcggagtcggcaaattggacgtggactggcgcgagttgaatgagttgggatccaagaaagatggggagaggcacgcatttatccttcaggatactaaggccttgcaccaggtgtttgagcatatgttggacgtgtctaagctgacagacacaatctgcggcgtgggtaacatgagtgcgaatgccagtgaccaagagaggaccccgtggcacgtgaccattaagcccaagtcccaggagacttgccgcggagcactgatctctgaccaatgggtgctcaccgcggcccactgttttcgtgacggcaacgaccattccctctggagagtcaacgtgggcgaccccaagagccaatggggcaaagaattcttaatagagaaagcagtgatctcccccggcttcgacgtattcgcaaagaaaaaccaaggtatcttggagttttatggagatgacatcgccctacttaagttggctcaaaaggtcaaaatgtccacccatgcgcgtcccatctgcttaccatgtactatggaggccaatctcgctctgagacggcctcagggctcaacctgtcgggaccatgagaacgagttgcttaataagcagtctgtacctgcgcattttgtggccctgaatgggtctaagttgaacataaacctaaagatgggagtagagtggacctcttgcgcggaggtggtgtcccaggaaaagactatgtttcctaaccttactgacgtaagagaggtggtaactgaccaatttttatgcagcgggacgcaagaggatgagtccccttgtaagggaggatccggcgagttgggctcactgcagcctctgccttggttatgctag

SEQ ID NO: 183577 - DNA, 2259 bp, Artificial Sequence
  Description of Artificial Sequence: Synthetic coding sequence
atgggccccctgatggtgctgttctgcctgctgttcctgtaccccggtctggcagattccgccccctcttgtccccagaatgtcaatataagcggagggactttcactttgagccacggctgggctccaggtagtttgctcacctactcctgtcctcaagggttatatccctctcccgcgtctagactgtgcaaatcgtcagggcagtggcagactcctggcgcgacgagaagtctctccaaagcagtgtgtaaacccgtccgatgtccagcccccgtgagcttcgaaaatggcatctatacccccaggttggggtcttacccggtggggggaaatgtgtcatttgagtgcgaggacggcttcattttgagaggttcccccgtgaggcagtgcagaccaaatggaatgtgggacggtgagaccgcagtgtgtgacaacggggccgggcattgccctaatcccggcatctcattaggcgccgtccgcaccggttttaggttcggacacggcgataaggtgcgctaccgctgtagttccaatttagtgctcaccggctcctcagagagagagtgccaaggtaacggcgtttggagtgggaccgaacccatctgtagacagccctatagctacgacttcccggaggatgtggccccagctctggggaccagcttcagccacatgctgggagccactaatcctacccagaagactaaagagtcactcggcaggaagatacagatacagcgatctggacatcttaacctttatttgctgctggattgcagtcaatcggttagcgagaatgattttctgatctttaaagaatccgcaagcctcatggtcgatcgcattttttcttttgagatcaacgtctctgtcgccatcatcacgttcgcatcagagcccaaggttctgatgagcgtattaaacgacaactctagggacatgacggaagtgatttcaagccttgaaaatgccaattataaagatcatgaaaatggaacaggaactaatacctatgccgcactcaattccgtctacctgatgatgaacaaccagatgcgcctgctgggtatggagacaatggcatggcaggaaattaggcatgccatcatactgctgaccgatggcaagagcaatatgggggggagccccaagaccgccgttgatcacattcgggagatacttaatattaaccaaaagagaaacgattatctcgatatctacgctattggcgtgggaaaactggatgtcgactggagggagctgaacgagttaggtagcaagaaggacggcgaaaggcatgcttttatcctccaagacacgaaggcattgcatcaggtttttgaacacatgcttgatgtgagcaaactgaccgacactatctgcggcgtcggaaacatgagtgcaaatgcttcggatcaggaacggaccccctggcacgtcaccatcaaacctaaaagtcaagaaacctgcaggggcgctctgatttctgaccagtgggtcttgactgcagcacactgtttcagagacggaaatgatcattctctgtggagggtgaatgtaggagaccccaagtcacagtggggaaaggagtttctgatcgagaaggcagtgatcagtccaggatttgacgtgtttgccaagaaaaatcaaggcatattggagttctacggggacgacatcgctctcctcaaactggcacaaaaagtgaagatgtccactcacgctcgacccatctgcctcccctgtaccatggaggccaatttggcgttacggcgcccccaagggagcacgtgcagagatcacgagaatgaacttcttaacaaacagtcagtcccagcacactttgtagctctgaatggcagtaagctcaacatcaacttgaaaatgggagttgaatggacctcttgtgcagaagtggtgagtcaagaaaagacaatgttccccaatctaacggatgttagggaggtggtgaccgaccaattcctgtgctctgggacgcaggaagatgaatccccatgtaagggggagagtggcggggcggtcttcctggaaagacggttccgcttttttcaggttggtttagtatcctggggtctttacaatccatgtttagggtccgccgataaaaatagcaggaagcgggcgccgagaagcaaggtacctccgcctagagatttccacatcaatttgtttaggatgcaaccatggctgcgtcagcacctgggcgatgtgctgaatttccttccactatag

SEQ ID NO: 183578 - DNA, 1578 bp, Artificial Sequence
  Description of Artificial Sequence: Synthetic coding sequence
atggtgctgttctgcctgctgttcctgtaccccgccggccactgcccaaaccccggcataagtctaggcgccgtgcggaccggtttcaggtttggtcatggggacaaggttcggtaccgctgctccagtaatctggtgttgactggctcgagcgaaagggagtgtcaaggaaacggtgtgtggtctggaaccgaacctatttgtaggcaaccttactcctatgacttccctgaggacgtggcccctgcactgggtaccagcttctctcatatgctgggtgctacaaacccaacacagaagaccaaggatcacgagaatgggactggcaccaacacttacgcagcacttaattccgtctatctgatgatgaacaaccaaatgcggttactggggatggaaacaatggcttggcaggagataagacatgccattattctgctcaccgacggaaaatccaacatgggcggttcccccaaaacggcagtggaccacattcgcgagatcttgaacatcaaccagaagcgcaacgactatctagacatttacgcaattggcgtggggaagttggacgtggattggcgggaattgaatgagttgggcagcaaaaaggacggcgagagacatgccttcattctacaggacaccaaagcacttcaccaggtgtttgagcacatgctcgatgtatccaagcttaccgatactatttgcggggtcggaaatatgagcgctaatgcttcagaccaggaacggacaccatggcatgtcaccattaagcccaaaagccaggagacctgtaggggcgctctgattagcgatcagtgggttctgacagccgcacattgcttccgggacggcaatgatcactccctttggagagtaaacgttggggacccgaagtcccagtggggaaaggagtttcttattgaaaaagctgtgatcagcccaggattcgacgtgtttgcaaagaagaaccaaggcatcctcgagttttacggcgacgatatagccctcctcaagctggctcagaaagtaaagatgtcaacccacgctcgccccatctgccttccttgcacaatggaggccaatctggcactgaggagaccccagggcagcacttgtagagaccacgagaatgagctgctgaacaagcagagtgttcccgcacactttgtcgccctgaacggaagcaagcttaatatcaacttaaaaatgggcgtggagtggacatcgtgcgctgaagtggtgtcccaggaaaaaaccatgtttcccaatctgacggatgtcagagaggtggtcaccgatcagtttctgtgttccggtacccaagaagatgagtctccttgcaagggtgagagtggcggggccgtgtttctggaacgccgatttcgttttttccaggttggactggtgtcctggggactttacaacccatgcttggggagcgctgacaagaattccagaaaaagggcaccccgctccaaagtgccccccccaagagacttccacattaacctgtttagaatgcagccatggctgagacagcatctgggcgacgtgctcaacttcctccctctatag

SEQ ID NO: 183579 - DNA, 2259 bp, Artificial Sequence
  Description of Artificial Sequence: Synthetic coding sequence
atgggccccctgatggtgctgttctgcctgctgttcctgtaccccggcctggcagatagtgccccgtcatgcccacaaaacgtgaacataagtggaggcaccttcactctctctcatgggtgggctcccggaagcctgctcacttactcttgtcctcagggactttaccctagcccggcctcccgtctgtgcaagtcctcgggtcagtggcagacccccggcgctacccggagcctgagtaaagccgtatgcaagcctgtccgctgccctgcacctgtgagttttgagaacggaatctacacgccacgtcttggcagctacccagtaggcggaaatgtatcttttgagtgcgaagacggctttatcttacgtggttcacctgtcaggcaatgtcgccctaacggcatgtgggacggcgaaaccgcggtgtgtgacaatggggctggccattgccctaacccagggattagcctcggcgcggtgcgcaccggttttcgcttcggccatggagataaagtgcgctacagatgctctagtaacctcgtactcaccggaagctcagagagagaatgccaaggaaacggtgtttggtctgggactgaacccatctgccggcagccatattcttacgacttcccagaggacgtggccccggcattgggaacatcctttagccacatgctcggcgcgacgaatccaactcaaaaaaccaaggaaagtctcgggcgcaaaatccagatacagcgatcaggtcatcttaacctctatctgctcctggattgctcacagtccgtgtctgaaaacgactttctaatcttcaaagagagcgctagcctaatggtggacagaattttttcgtttgaaattaatgtctctgtggctattatcacatttgcatcggagccaaaggtcttaatgtcagtgcttaatgacaatagccgggatatgacagaagtgatctcatccttagagaatgcaaattataaagaccacgaaaacggtactggtacgaatacgtatgccgctctcaatagtgtatatctgatgatgaacaatcaaatgagactgcttggcatggaaactatggcctggcaggagattagacacgctatcattctcttgaccgatggcaagtcgaatatgggaggttcaccaaaaaccgctgtggatcacatcagagaaattctgaacatcaatcagaagagaaacgactacctggacatctatgctataggtgtgggtaaattggatgtagactggagggagctaaatgagcttggttctaaaaaagatggagaacgacatgctttcattttacaggatactaaagctctccatcaggtttttgagcacatgctagatgtttccaagctgaccgacaccatctgcggcgtggggaatatgagtgctaatgccagtgatcaggagcggactccctggcatgtgacaattaagcccaagtcccaggaaacatgtcgcggcgcactaatttccgaccagtgggtgctgactgccgcccactgctttagggacggaaatgaccacagtttgtggcgtgtgaatgtcggggatcccaagtcccagtgggggaaggagttcctgatagaaaaggctgtgatcagtccaggattcgacgtttttgctaagaagaaccaagggatcctagaattctacggcgacgacattgccctcctgaaattggctcaaaaagtcaagatgtctacacacgccagaccaatatgcctgccgtgcactatggaagcgaacttagccctgcgtaggccccagggttctacatgccgggatcatgagaacgagctgcttaacaagcaaagcgtgccggcacactttgtggctctgaatggatccaagctcaacatcaacctgaaaatgggggtggaatggacctcctgcgcagaggttgtcagccaggagaaaaccatgtttcctaatctcactgacgtgagggaagtggtgaccgaccagtttctgtgttctggcacccaagaagatgagtccccctgtaaaggcgaaagcgggggtgctgtgttccttgaacgccggttcagatttttccaggtgggtcttgtgagctggggtttgtataatccgtgcctggggtcagcggacaaaaactcgaggaagcgggctcctaggtcaaaggtccccccccctcgcgattttcatatcaacctttttagaatgcaaccctggctgcgacaacaccttggggatgtgctgaacttcttgcccctttag

SEQ ID NO: 183580 - DNA, 1578 bp, Artificial Sequence
  Description of Artificial Sequence: Synthetic coding sequence
atggtgctgttctgcctgctgttcctgtaccccgccggccactgccctaacccggggatctctctaggcgcagtgaggactggctttcggttcggacacggcgacaaggtgcgttatagatgcagttcaaatctggtactgactggctcctccgagcgagagtgccagggcaacggagtctggtcggggactgagccaatttgcaggcagccatattcatacgacttcccggaggatgtagctccagccctgggcacctcattctcccatatgctgggcgccacaaacccaacccagaaaaccaaggaccacgaaaacggcaccgggacaaatacttatgctgcactcaattcggtgtacctcatgatgaacaatcaaatgagactgttagggatggagactatggcctggcaggaaatccggcatgcaattattctgttgacagacggaaagagcaacatggggggatcccccaaaacagcggtggaccacatcagagaaatactgaacatcaatcagaagagaaacgactatctggatatttacgccatcggcgtgggaaagctagacgtcgactggagagaactgaacgaattagggtcaaagaaggatggagagagacacgctttcatactgcaggacactaaggctcttcaccaggtgtttgagcatatgctggatgtgtccaagcttacagatactatttgtggggtcggtaatatgagcgccaacgcatcagaccaggaaagaaccccctggcacgtaaccatcaaaccaaaaagtcaggaaacatgtcggggagcactgatctccgatcagtgggttctgactgccgcccactgcttcagggacggcaacgaccattctctatggagggtcaacgttggagatcccaaaagccagtggggtaaggagttcttgattgagaaggccgtgatctcgcctgggtttgatgtctttgccaagaagaatcagggaatcctcgagttctacggcgatgatattgccctcctcaaactggctcagaaggttaagatgtccacgcacgccagacctatttgtctcccctgcaccatggaggcaaacctagcattacgcaggcctcagggcagtacgtgcagagaccatgagaacgaattgttgaataagcagtccgtgcctgctcatttcgtagcgcttaacggcagcaaactcaacattaatcttaagatgggggtagagtggacctcttgcgcagaggtggtgagtcaggaaaaaacaatgtttcctaatttgactgatgtgcgggaggttgtaacagaccagtttctgtgctcgggcacacaggaagacgagagcccttgcaaaggggagtcaggtggggccgtgtttctggagcgaaggttccggttcttccaggttggcctcgtcagctggggtttatacaatccgtgtctgggcagtgctgacaaaaactctcgaaaacgagccccccgctccaaggtgcctccaccaagagatttccacatcaacttattcagaatgcagccctggctgagacagcacctgggagatgtgttgaacttcctgcctttgtag

SEQ ID NO: 183581 - DNA, 2259 bp, Artificial Sequence
  Description of Artificial Sequence: Synthetic coding sequence
atgggccccctgatggtgctgttctgcctgctgttcctgtaccccgggcttgcagacagtgccccatcttgtcctcagaatgtaaacatatccgggggcacctttacactgtcccacggctgggcgccgggaagcctccttacatattcatgtcctcagggtctgtatccatcccccgccagtaggctgtgcaaatcttcggggcagtggcagacacccggggccacccggagtctcagcaaggctgtctgcaaacctgtgcggtgcccagcaccagtcagctttgagaatggcatttatactccccggttggggagctatccggttggcggcaacgtttcctttgagtgcgaggatggattcatcctgagaggctccccagtgcgccagtgtcgccctaacggcatgtgggatggcgagacggccgtgtgtgacaatggagccggccactgtcccaatcccggtatatctttgggcgccgtccgaactgggtttagattcggacatggagataaagtgaggtatagatgcagcagtaatttggtcctgacaggatcgtcagagagggaatgccagggcaatggtgtgtggtccgggaccgaacctatttgccgccagccctacagctatgatttccccgaggatgtggcacccgccttgggaacctccttctctcatatgctgggtgctaccaaccccacgcagaaaaccaaggagagtctcggacgtaagatccaaatacagcgctctggccatcttaatttgtatctgctacttgactgtagccaatctgtctctgaaaacgatttcctgatcttcaaagaaagcgcatccctaatggtagaccgaatattttccttcgagattaacgtctctgtagcaatcattacctttgcctctgaacccaaagttctcatgtcagtcttgaacgataacagcagagatatgactgaggtgatatcttcactggagaatgcgaactacaaggatcacgagaatggtacagggaccaatacgtacgcagctctgaattctgtctaccttatgatgaataaccagatgcgcctgctcggcatggaaaccatggcctggcaggagatcaggcatgcaataatccttctgacagatggtaagagcaatatgggtggttcccccaagaccgctgtggaccatataagagagattctcaacatcaaccagaagaggaacgactacctggatatatatgccattggcgtaggcaaattggacgtggactggcgagaacttaatgagttgggaagcaagaaggacggcgagagacatgcatttatcctccaggacaccaaagcgttacaccaggtcttcgaacacatgctggatgtgtctaagctgaccgatacaatctgcggcgttggcaatatgagtgcaaatgccagcgatcaggagcggacaccgtggcatgtgacgatcaagcccaaaagccaggagacctgtcggggcgcactcattagtgaccagtgggtgttgacagctgctcactgctttagagatggaaacgaccatagcctgtggcgggtaaacgttggagaccctaagtctcagtggggtaaagagttccttattgagaaagcggtgatctcccccggatttgatgtgttcgccaagaagaaccagggtattctcgagttttatggggacgacattgcattactcaaattagcacagaaagttaagatgtcaacacacgcccgccccatttgtttgccttgtaccatggaggctaacttggctctgcgcagaccccaagggagcacatgccgcgatcatgagaacgagctgttaaataagcagtctgtgccagcacatttcgttgctttaaatggttcgaaactcaatattaatctgaagatgggcgttgaatggacgtcttgcgccgaggtcgtctcacaggagaaaaccatgtttcccaatctaaccgatgtgagggaagtcgtcacagatcaattcctttgtagcggtacccaggaagacgagtcaccttgtaagggagagtctggcggggcagtttttctggagcggaggtttcggtttttccaggttggcctggtgagttggggcttgtataacccttgccttgggagtgcagataaaaactcaagaaagagagctcctcgatccaaagtcccccctcctagagattttcacattaacctgtttagaatgcaaccctggttacgacaacaccttggtgacgttctgaattttttacccctctag

SEQ ID NO: 183582 - DNA, 420 bp, Artificial Sequence
  Description of Artificial Sequence: Synthetic coding sequence
atgggccccctgatggtgctgttctgcctgctgttcctgtaccccggactggcagactcagcccccagttgtccccagaacgttaatatcagcggaggcactttcacactgagccacggatgggctccagggtccctgttgacctattcatgtccccagggactttacccgagccctgctagccggctctgcaaaagctcaggccagtggcaaactcccggcgctacacggtctctttctaaagccgtctgcaaacccgtacgttgtcccgcccccgtctccttcgaaaacgggatttacactccccggctggggtcctatcctgtgggcggcaacgtgtcctttgagtgcgaggacggcttcattttgaggggttcacccgtcagacagtgtcggcccaacggcatgtgggacggctag

SEQ ID NO: 183583 - DNA, 510 bp, Artificial Sequence
  Description of Artificial Sequence: Synthetic coding sequence
atgcgggccctgtgcatccgggagacctgcagcagcgagctgggcttcagtcgtaattggtcccggagaaaggccggccactgtcccaatcccggcatttcactaggggccgtgaggaccggctttcgctttggccatggggacaaagtgcgatatcgctgctcaagcaaccttgtgctcacaggaagcagcgagcgtgagtgccaggggaacggcgtttggtctggaaccgaacctatctgccggcagccttactcctatgactttccagaggatgtcgctcccgccctagggacatcattcagccacatgctgggcgcaaccaaccctacccagaaaacaaaagatcacgagaatggcacgggtactaacacatatgcggcactgaatagtgtctatctgatgatgaataaccagatgcgcttgttaggcatggaaacaatggcttggcaggagattagacacgccataatcttacttacagacggcaagagcaatatgggtggctag

SEQ ID NO: 183584 - DNA, 420 bp, Artificial Sequence
  Description of Artificial Sequence: Synthetic coding sequence
atgggccccctgatggtgctgttctgcctgctgttcctgtaccccggtttagccgactcagcaccatcctgcccccagaatgtcaatatttccggcgggaccttcacgcttagtcacggatgggcccctggtagcctcctcacatacagttgcccccaaggactgtacccttcacctgccagtcggctctgcaagtcttccggccagtggcagactccaggcgcgaccaggtctctgtccaaagctgtgtgcaaacccgtgcgatgtccagccccagtgtcttttgaaaatgggatctacacccctaggctgggcagttacccggtcggcggcaacgtctcctttgaatgcgaggatggctttatattacgcgggtctccagtaaggcagtgccgcccaaacggcatgtgggacgggtag

SEQ ID NO: 183585 - DNA, 2259 bp, Artificial Sequence
  Description of Artificial Sequence: Synthetic coding sequence
atgggccccctgatggtgctgttctgcctgctgttcctgtaccccggcttagccgactccgctccttcttgtccgcagaatgttaacattagcgggggaacctttaccctcagccacggatgggcacccggctcattactgacctattcatgcccccagggtctttacccatctccggcaagtcggttgtgcaaatctagtggtcaatggcaaactcccggagcgaccaggagtctatcaaaggctgtgtgcaagcctgttaggtgtccagcacctgtgtctttcgagaatgggatatatacccccaggctcgggtcctacccggtggggggcaacgtgtcattcgaatgcgaggatggcttcatcctaaggggatccccagtgcggcaatgccgccccaacggcatgtgggatggagaaaccgccgtgtgcgacaatggcgccggccattgcccaaatccaggtatttccctcggtgccgtgaggacaggattccggttcgggcatggtgataaagtgcgctatcggtgttctagcaatctagtgcttaccgggtctagcgagcgggagtgccagggtaacggcgtttggtcaggaacagaacctatttgtaggcagccctacagttacgattttcccgaagacgtcgcaccagctctgggaacttccttcagccacatgctgggtgcaaccaacccgacacagaagaccaaagagagcctcgggcggaaaattcaaatccagaggtcaggccacctgaacttgtacttgcttttagattgcagccagtccgtgagtgaaaatgactttctgatctttaaggagtctgccagcctgatggtcgataggattttctcttttgagatcaatgtctctgtcgcaatcatcacgttcgcttcagagcccaaggtgctgatgagcgtgctcaacgacaactctagagacatgaccgaggtaatctccagtcttgaaaatgccaattataaggaccatgaaaatggcacaggtactaatacatacgctgcactcaactccgtctatctgatgatgaacaaccaaatgaggttgctcggcatggagactatggcctggcaggaaattcggcacgcaatcattctgcttactgatggaaagtctaatatgggcgggtctcctaagaccgctgtggatcacattagggaaatcctcaacattaaccaaaagcgcaacgactacctcgatatctatgctattggggtaggcaagctggatgtggactggagagagctgaacgaactgggttccaaaaaggatggtgaaaggcatgctttcatcttgcaggacacgaaggctctgcaccaggtctttgagcatatgctggatgtgtccaaattgaccgacacgatctgcggggtgggcaatatgtctgccaatgcttctgaccaagaaaggacaccttggcacgtgactataaaacctaaatctcaggagacgtgtcgcggcgctctgatcagcgaccagtgggtcctcaccgctgctcactgtttccgggatggcaatgaccatagtctgtggagagtgaatgttggcgatcccaaatcccagtgggggaaggagttcctgatcgaaaaagcagtgatttcccctggcttcgacgtgtttgccaagaagaaccagggcattctggagttctatggagatgacatcgcgctgcttaaacttgcacaaaaagttaaaatgtctacacatgctagacctatttgcctgccatgcacgatggaggctaatctggcactgcgacggccccagggatctacgtgtcgcgaccacgagaatgagcttctgaataaacagtctgtgcctgctcactttgtcgccctgaacgggtccaagctgaacataaatctgaaaatgggggtggaatggacctcctgtgctgaagtggtttcacaagaaaagaccatgttccctaatttgactgacgtcagagaagtagtgacggaccagttcctatgtagcggaacccaggaggacgagtccccctgtaagggagagtctggtggagccgtgtttctggagcgccggttcaggtttttccaagtgggtctcgtaagctggggactctacaacccctgtttaggatctgctgataaaaacagccgaaaaagggcacccagaagtaaagtgccaccgccaagggacttccatattaacctcttccgaatgcagccatggttgaggcagcatctgggcgacgtcctgaattttctgcctctatag

SEQ ID NO: 183586 - DNA, 378 bp, Artificial Sequence
  Description of Artificial Sequence: Synthetic coding sequence
atgggccccctgatggtgctgttctgcctgctgttcctgtaccccggacttgccgattcagcaccctcatgtccccaaaatgtcaatatctctggaggaacctttacactaagccatggttgggcacccggctctctcctaacatattcgtgtccacaaggactgtatccatcccccgcttctcgcctctgtaagagttctggtcaatggcagacaccgggagctacacgaagtctcagtaaggcggtctgcaaaccaggccactgtcctaaccctggcatatcactgggcgctgtgaggactggctttagattcggccacggagacaaggtgcgctacagatgctccagcaacctcgtgctaactggcagtagttag

SEQ ID NO: 183587 - DNA, 510 bp, Artificial Sequence
  Description of Artificial Sequence: Synthetic coding sequence
atgcgggccctgtgcatccgggagacctgcagcagcgagctgggcttctcacggaactggtccaggcgcaaggcgggtcattgtcctaacccgggaatctcgctgggcgcagtccgcaccgggtttcggtttgggcacggcgacaaggtgcgatatcgatgttcctctaatttggtactgactggatcttctgagcgggagtgtcagggaaacggggtatggtccggtaccgagcccatatgccggcaaccatatagctacgattttcctgaagatgttgccccagcccttggaaccagcttcagccatatgctcggcgccacaaacccaacccagaagacaaaggatcatgagaacgggaccggaaccaatacctatgccgcacttaactctgtttacttgatgatgaataaccagatgagattgcttgggatggagacgatggcctggcaggagatccgacacgctatcatcctgctcacagatggcaagtctaatatgggcggctag

SEQ ID NO: 183588 - DNA, 1062 bp, Artificial Sequence
  Description of Artificial Sequence: Synthetic coding sequence
atgggccccctgatggtgctgttctgcctgctgttcctgtaccccgcaggacattgcccaaatccaggaatcagcctaggtgcagtgcggactgggtttagattcggccacggcgataaggtccggtatcgctgctctagcaacctggtactgactggttcctccgagagggagtgtcaaggaaatggcgtctggtctggcaccgaaccgatctgcaggcagccgtactcttacgattttcccgaggatgttgccccagcactgggaaccagcttcagccatatgctcggggcaactaatccaacccagaagacaaaggaaagtctgggtaggaagattcagattcagcggtccggccatcttaacttgtatctgcttttagattgctctcagtccgtcagtgagaatgactttctcatcttcaaggagtctgccagtctgatggtggatcgaatcttctcttttgagattaacgtgagtgtggctattatcactttcgcgtccgagccaaaggttctcatgagtgttttgaatgacaactcgcgggacatgacagaggtcatctcctccttagaaaatgctaattataaggaccatgagaacggcacagggaccaacacatacgcagccctaaactcagtctacctaatgatgaacaaccaaatgagactgcttggcatggagacaatggcatggcaggagatccgccatgccatcatcttgctaacagacggcaaaagcaatatggggggttctccaaagacagctgtggaccatattagggaaatactgaatattaatcaaaagcggaatgactatttggacatctatgcaattggcgttgggaagttggatgtcgactggcgagagctgaacgagttgggatctaaaaaagacggggagcggcacgcttttatcctccaggataccaaagcactccaccaagtctttgagcatatgttggacgtatccaaactcaccgacacaatctgcggcgtcggcaatatgagcgccaacgccagcgaccaggagagaactccatggcatgtgacaattaaatag

SEQ ID NO: 183589 - DNA, 2259 bp, Artificial Sequence
  Description of Artificial Sequence: Synthetic coding sequence
atgggccccctgatggtgctgttctgcctgctgttcctgtaccccgggctggctgactcggccccctcgtgtccccagaatgtcaatattagcggtggaacctttactctgtcgcatggctgggcccctgggtctctgttaacttatagttgtccgcaaggtctatatccgtcccccgctagtcgactctgtaagtccagtggacagtggcagacccctggcgccacaaggtccctttcaaaagccgtgtgcaagcccgtgcggtgcccggcccccgtgagcttcgaaaacggcatttataccccacgtctgggatcttatcccgtggggggcaatgtatcatttgagtgcgaggacggctttatactccgtggttcacctgtccggcagtgtaggccgaatgggatgtgggacggcgagactgctgtgtgtgacaatggggcaggccattgtcccaatcctggaatttcactcggcgctgtccgcacaggatttcgatttggccacggggacaaagtccgatacaggtgctcttctaaccttgttttaacagggagttctgaaagagagtgtcagggtaacggagtgtggagcggaaccgagccaatttgcagacagccatattcttacgacttccctgaggacgtggcccctgcactgggcacctccttctcgcacatgctgggcgccaccaacccaactcagaagacaaaagaatcccttgggagaaaaatacagatccagcggtctgggcatctgaatctgtacctgctgctagattgctcacaatccgtatctgagaatgactttctaatttttaaagaatctgcctccctgatggtcgaccgcatcttcagctttgagatcaacgttagcgtggccattattacatttgcctccgaaccaaaagttctgatgtccgtgctcaatgacaactcccgagatatgacagaagtcatttccagtctcgagaatgcgaattacaaggatcacgagaatggcaccggaacaaatacatacgccgctctgaattctgtctacctgatgatgaacaatcagatgaggctactggggatggaaacaatggcctggcaggagatccggcacgctatcattttgctgactgacgggaagagcaacatgggaggatcccctaagactgccgttgatcacattagagaaattctaaatatcaaccagaaacggaatgactacctcgacatttacgctatcggggttggtaagttagacgtagattggcgtgagttgaacgagctggggagtaagaaggacggggagagacacgcctttattctgcaggatactaaagccctccaccaagtgtttgagcatatgctggacgtcagcaaactaacagacaccatttgcggcgtggggaacatgtccgccaatgcatctgaccaagaaaggacgccctggcacgtcacaattaaacccaaatctcaggagacgtgtcgcggcgccttaattagtgatcagtgggtcctcacagccgcccactgcttccgggatggtaacgatcatagcctctggagagtcaacgttggagatccaaaaagtcagtggggtaaggaattcctcatagagaaagctgtgatctctcccggatttgatgtgttcgccaaaaaaaaccaggggatcctggaattctatggggacgacatagctctactgaagctggcccagaaagtgaagatgagcacgcacgctagaccaatatgcttaccatgtactatggaagccaacttggcactgagacggccccaaggatctacatgccgagatcacgaaaatgagctactgaacaagcagtcagtccccgctcacttcgttgcactcaacgggtctaaactcaacatcaacttaaagatgggagttgaatggactagctgcgctgaggtagtctctcaagagaagactatgttcccaaatttgacagacgtgcgcgaagtggtgacagatcagttcttgtgttccggaactcaggaagacgagagtccctgtaaaggcgagtcaggcggcgctgtgtttctcgaacgccggtttcggttcttccaagtcggcctggtctcctggggtctgtacaacccatgtctgggctctgcagacaagaactctcggaaaagagcaccgagatccaaagttccgcctcctcgcgatttccacatcaatctcttccgcatgcagccatggctgaggcaacacctgggcgacgtactcaacttcctccccttgtag

SEQ ID NO: 183590 - DNA, 1062 bp, Artificial Sequence
  Description of Artificial Sequence: Synthetic coding sequence
atgggccccctgatggtgctgttctgcctgctgttcctgtaccccgctggtcattgtcccaaccccgggatctcattaggggctgtgaggaccggatttcggttcgggcatggcgacaaggtccgctatcgctgctcctctaacttggtgctgactggctcttccgagcgggaatgtcagggcaacggagtgtggtccggaactgaaccaatttgtagacagccctattcgtatgactttcccgaggacgtggccccagccctcggcacatccttttcacacatgcttggcgcgaccaatccaacacaaaaaactaaagaaagtctgggcagaaagatacagatacagagatccggacacctgaatttgtacttgcttttagattgtagccaatccgtgtctgaaaacgacttcctcattttcaaggagagtgcctctcttatggtagatagaattttcagctttgaaattaacgtatcagtcgctattataactttcgcatcagaacctaaggtcctgatgagtgtgttgaacgataactcccgtgatatgaccgaggtgattagcagtttagagaatgcaaattataaggatcatgaaaacggcactggaaccaatacttacgccgcccttaattctgtatacctcatgatgaacaatcagatgaggctgctgggcatggagacaatggcatggcaggagatccgccacgccatcatactcctgacagacggaaagtctaacatgggcggctcgcccaaaaccgccgtggatcatatccgagaaattttgaacattaatcagaaaaggaatgactacctcgatatttacgcaatcggcgttggtaaactcgatgtggactggagggaactcaacgagttagggtcaaagaaggatggtgagcggcacgcctttattctgcaagacactaaagctctgcaccaggtatttgagcacatgctggatgtctctaaacttacagacaccatttgtggggttggtaacatgtccgccaatgctagcgaccaggagaggaccccatggcatgtgacaattaaatag

SEQ ID NO: 183591 - DNA, 1062 bp, Artificial Sequence
  Description of Artificial Sequence: Synthetic coding sequence
atgggccccctgatggtgctgttctgcctgctgttcctgtaccccgccggccactgtccaaaccccggcatcagcctgggtgccgtgcgaacaggatttagattcggccacggagacaaagtccggtacagatgcagcagcaacctggtgcttacggggtctagcgagagagagtgccagggcaatggagtgtggtctggcacagagcccatctgtcggcaaccctacagctatgactttcccgaagatgtggcacccgctctaggtacaagctttagccatatgctgggagctactaaccctacgcaaaagacaaaggaatctctaggaagaaagatccagattcagaggtccggccacctgaacctgtacctcctgctcgattgctctcagtctgtgagcgagaatgacttcctgatttttaaagaatctgcatcgttaatggtggaccggatcttctcatttgagatcaacgtaagtgtcgctataattaccttcgcttccgagccaaaggtcctaatgagtgtgctgaatgacaactccagagacatgactgaggtcataagctctctggagaacgctaattacaaggaccatgagaacggcaccggtacaaacacttacgcagcactgaatagtgtgtatctcatgatgaataatcagatgcggcttcttggcatggaaaccatggcctggcaggagatcagacatgccataatcctgctcaccgatgggaagagtaatatgggcggaagcccgaaaaccgcagtcgaccacatccgggagatattaaatatcaaccagaagcgtaacgattacctggacatctacgctatcggagtgggcaagctggacgtggactggagagagcttaatgagcttggctccaaaaaagacggagaacggcacgcctttatcctgcaagacactaaagctctccaccaggtgtttgaacacatgctcgatgtgtctaaactgactgacacgatttgcggcgtgggtaatatgtccgcaaacgcatctgaccaggaaaggacaccgtggcatgtgacaatcaaatag

SEQ ID NO: 183592 - DNA, 510 bp, Artificial Sequence
  Description of Artificial Sequence: Synthetic coding sequence
atgcgggccctgtgcatccgggagacctgcagcagcgagctgggctttagtcgaaattggtctagacgcaaggccggacattgtcctaacccgggcatttctcttggagctgtgagaactggcttcagatttgggcacggtgacaaagtgcggtatcggtgctcctctaacctggtgttgaccggctccagtgagcgagagtgtcagggaaacggcgtgtggagcggcaccgaaccaatctgccggcagccgtatagctatgacttccccgaggatgtggcccccgcactgggtacctccttttcacatatgttaggcgccacaaaccctacccaaaagaccaaagatcatgaaaacgggaccggcactaacacatacgccgccctgaatagcgtttacctaatgatgaacaatcagatgcggctcctgggaatggagaccatggcgtggcaggaaatacggcacgctattatattactgacggacggcaagtctaacatgggaggttag

SEQ ID NO: 183593 - DNA, 1578 bp, Artificial Sequence
  Description of Artificial Sequence: Synthetic coding sequence
atggtgctgttctgcctgctgttcctgtaccccgccggccactgccccaaccccggtattagcctgggagctgtgaggactggatttaggtttggccatggagataaggtgcgataccggtgtagttcgaatctggtgctgaccgggagctcggaaagagagtgccaaggcaatggagtgtggtctgggaccgagcctatttgtcggcagccgtattcttacgacttccccgaggacgtggccccagcccttggcacctctttctcccacatgctgggcgccacaaacccaactcaaaagacgaaggaccacgagaatggaacaggcaccaacacctacgctgctttgaattctgtgtacttgatgatgaacaatcaaatgagactgctggggatggaaactatggcttggcaggagattcgccacgccatcatattgctcaccgacggtaaatcaaacatgggaggtagccctaagacagctgttgaccacatcagggaaatattgaatattaaccaaaagaggaacgattatcttgatatatatgcaattggggtcggtaagctcgatgttgattggcgtgagctcaacgagttagggagcaagaaggatggcgaaagacatgcttttatccttcaggatacgaaggcactgcatcaggtatttgaacacatgctggacgttagcaagctaaccgatacaatctgtggggtgggaaatatgagcgcaaatgctagcgatcaggaaagaacaccttggcatgttactatcaaacccaagagccaagagacttgtagaggggccttaatttcagaccaatgggttctgacagctgcacattgtttccgggatgggaacgatcacagtctgtggagagtgaacgtgggggatcctaagtcacagtggggaaaggagtttctcattgaaaaagcagtcatctcacctggtttcgatgtgtttgctaagaaaaaccaaggcattctggagttctatggggacgatattgccttgttaaagcttgctcagaaggttaagatgagcacacacgcacgaccaatttgtttgccttgtaccatggaggccaatctcgcgctgaggcgcccacaggggagcacttgtagggaccacgaaaatgaacttctgaataaacagagcgtgccagcccattttgtggctttgaatggttccaagctgaacatcaacctcaagatgggagtggaatggacctcttgtgccgaggttgtgagccaggaaaagactatgttccccaatctgacggacgttcgtgaagtggtcacggatcagtttttatgtagtggaactcaggaggatgagtctccatgcaagggcgagagcggcggagccgtttttttggaacgaagattcagattctttcaggtcggcctggtgagttggggcctgtataacccgtgtctgggctccgctgacaaaaattcaagaaagagagccccgcggtctaaggttccacccccacgggatttccatattaacctgttcaggatgcagccttggcttcgccagcatttgggagacgtcctgaactttttacccctgtag

SEQ ID NO: 183594 - DNA, 1062 bp, Artificial Sequence
  Description of Artificial Sequence: Synthetic coding sequence
atgggccccctgatggtgctgttctgcctgctgttcctgtaccccgccggccattgccctaatcctggcatctcactgggcgccgtgagaaccgggtttaggttcggccatggagataaggttcgttaccgctgttcctccaatctcgtacttaccgggtccagtgaacgcgagtgccagggtaatggtgtatggagcggcactgagcctatttgccgccagccttactcgtacgatttccctgaggacgtggcgcccgcactagggacctcgttttcccacatgctgggtgcaactaatcccacacaaaagactaaggaatctctggggagaaaaattcagattcagcgctccggccaccttaatttatatctactgcttgattgctcccagagcgtgagcgagaacgactttttaatcttcaaggagtccgcctcgctgatggtggatcgcattttctcatttgagattaatgtgagcgtggccataatcacctttgcatcagagcccaaggtcttaatgtcagtcctgaacgacaactctcgcgatatgactgaagtgatctcgagtctagaaaacgctaactacaaggaccacgaaaatggaaccggcaccaacacatacgcagcccttaactcagtgtacttaatgatgaacaaccagatgcgacttctcggcatggaaacgatggcatggcaggagatacggcacgccattatacttctgactgatggaaagtcaaatatggggggttctcccaagaccgccgtcgatcacatccgcgagatcctgaatattaaccagaagcgcaacgactacttagacatttatgccattggggtggggaaacttgacgtcgactggcgcgagttgaatgagttgggatccaaaaaggatggcgagcggcacgctttcattctgcaggacacgaaggctctgcaccaagtgttcgaacacatgctggatgtatcaaaactgacggatacgatatgtggagtgggcaatatgtccgctaatgcctcagatcaggagcgcacgccttggcacgtgaccattaagtag

SEQ ID NO: 183595 - DNA, 405 bp, Artificial Sequence
  Description of Artificial Sequence: Synthetic coding sequence
tgaggccactgccccaaccccggcatcagcctgggcgccgtgcggacaggttttcgtttcggtcacggtgataaagtgaggtacagatgcagcagtaatttagtgctaaccggaagctccgagagagaatgccaaggcaatggtgtctggagcggtaccgagccgatatgtcggcaaccttacagctatgacttccctgaagacgtcgcaccagctctcggcacttcattttcgcacatgctgggggcaaccaacccgacccaaaagactaaggagagcctcggacgcaagattcagatccagcgctccggacatctgaacttatacctcctgttggattgctcacaatcggtctccgaaaacgacttcttgatctttaaagagtccgcttctctgatggtttag

SEQ ID NO: 183596 - DNA, 1578 bp, Artificial Sequence
  Description of Artificial Sequence: Synthetic coding sequence
atggtgctgttctgcctgctgttcctgtaccccgccggccactgccccaacccaggcatcagtctgggggcagtacgaaccggatttagatttggccatggtgataaagtccggtacagatgttcctctaatctagtgctcacgggatccagcgagagggagtgccagggcaatggagtatggtctggaacagaacccatttgcaggcagccctactcatacgatttcccagaagatgtagcccccgctttaggaacatcattttcgcacatgctgggagccactaaccccacacagaaaaccaaggatcacgaaaatggtacaggaactaatacatacgcagctctgaactccgtctatctaatgatgaataatcagatgcgactgctcggaatggaaacaatggcctggcaggaaatccggcatgcaatcatactgcttactgatgggaagtctaacatgggcggctctcccaaaacagccgtagaccatattcgtgagattttaaatattaaccagaaacggaacgattacctggacatatatgcaataggcgtgggcaagctggatgtggattggagagagttgaatgagctgggctctaagaaggacggcgagcgccacgcttttatcctacaagatacgaaggccctgcaccaagtcttcgaacatatgctagacgtgtcaaaacttactgacaccatctgtggcgtgggcaacatgagtgccaatgcttcagaccaagagagaaccccatggcatgtgacaatcaaacccaagtcccaggaaacgtgtaggggcgcgctgatttcagatcaatgggttttgaccgctgctcactgcttcagagacggaaacgatcacagcctatggcgcgtgaatgtcggcgatcctaagagtcaatgggggaaggaattcctgattgagaaggcagtaatctctcccggcttcgacgtcttcgccaagaaaaaccaggggatcctggagttctatggcgacgatattgcgctgttaaagctggctcagaaagtaaagatgagcacgcacgctcggcccatctgcctaccctgtacaatggaggccaatcttgcgctgcgccggccgcaggggagcacctgccgcgatcatgaaaacgaattgcttaacaaacagagcgttccagcccattttgtcgccctgaatggcagcaagctgaacattaacctgaaaatgggagttgagtggacgagctgtgctgaagtagtatcgcaggagaaaacgatgttccctaacctcaccgacgtcagggaggtggttaccgaccagtttctgtgttctggaactcaggaagacgagtccccctgtaagggcgaaagcggaggagctgtgtttctcgaaagaagatttaggtttttccaggtgggattggttagttggggactctataacccctgtctggggtctgcagacaagaatagccgtaaacgcgcaccccgttcgaaagtccctccaccaagagacttccacataaatttgttcagaatgcaaccatggctgcggcaacacttaggcgatgtcctgaattttctacctttgtag

SEQ ID NO: 183597 - DNA, 1578 bp, Artificial Sequence
  Description of Artificial Sequence: Synthetic coding sequence
atggtgctgttctgcctgctgttcctgtaccccgccggccactgccccaatcccgggatctcactgggtgctgtgcggaccgggttcaggttcgggcacggcgataaagtacggtacagatgtagctcaaaccttgtattgaccggctcttccgaaagggagtgccaggggaacggagtgtggtctggcacagaacccatctgccgccagccctattcttatgatttcccggaagacgtggctcccgccctgggtacatccttttcccatatgctgggagctacgaacccgacgcagaaaactaaagaccacgaaaacggcaccggaaccaatacctacgcagccctgaactcagtgtacctgatgatgaataaccaaatgcgtttgctgggaatggagacgatggcctggcaggagattcggcacgcaatcattttacttaccgatgggaagagcaatatggggggtagtccaaaaacagcggtcgaccacatcagagagatcctgaatatcaatcagaagaggaacgattacctggatatttacgcaattggtgttggcaaattagatgtcgattggagggagctgaatgagctgggctcaaaaaaggacggtgagcggcacgctttcattctgcaagacacaaaggccctccatcaggtgttcgagcacatgctcgacgtgtccaagttgacagataccatttgcggggtgggaaacatgtctgccaatgcgagtgaccaggagcgcaccccttggcacgttaccataaaacctaaatcccaggaaacctgccgtggagccttaatctcagatcagtgggtgctgacagccgctcactgttttcgggatggaaacgaccactctctgtggcgagtcaatgttggggatcccaagagccagtggggaaaggagtttctgattgaaaaagcggtgattagtcctggattcgacgtgtttgccaaaaagaatcaaggcattttggagttctacggagatgacattgctctgctgaagttggcacagaaggtcaagatgtcgactcatgcccgccccatttgtcttccctgtactatggaggccaatctagcattgcgacggcctcagggctccacctgccgcgaccacgaaaatgagctactgaataagcagtcagtgcccgcccacttcgttgcccttaacgggtctaagcttaacatcaacctcaagatgggcgtggagtggaccagttgtgctgaagtggtgtcccaagagaagactatgtttcctaatttgactgatgtgagggaagttgtgacagaccagttcctttgttctggcacgcaagaggacgagtctccctgtaagggagaaagtgggggtgctgtgtttctagagcgacggtttcgatttttccaagtcggacttgtctcttggggactgtacaacccctgcctcggttctgccgataaaaatagccggaaaagggcccctcggagcaaggtgcccccacctcgtgatttccacataaatcttttcagaatgcagccatggttgcgccagcaccttggcgatgtgctgaacttcctcccactctag

SEQ ID NO: 183598 - DNA, 1062 bp, Artificial Sequence
  Description of Artificial Sequence: Synthetic coding sequence
atgggccccctgatggtgctgttctgcctgctgttcctgtaccccgctggtcattgcccaaatcctggaatctctctgggagctgtgcgcactgggttccgatttgggcacggtgacaaagtgcgctaccgctgttcctccaatttagtgctcactggatcctcagagagagagtgccaggggaacggcgtgtggagtggcaccgagcctatttgcaggcaaccctacagttacgacttcccagaggatgttgccccagccttagggaccagttttagccatatgctgggagctactaaccccacgcagaagactaaagagtccctggggaggaaaattcagatccagagatctggacacctcaatttatacttgctgctggactgttctcagtccgtgagcgagaatgactttctgatcttcaaggaaagcgcctctttaatggtggacaggattttttcctttgagatcaacgtgagcgtagctatcatcactttcgcttcggaacccaaagtcctcatgtccgtgttgaacgataactctcgagacatgaccgaagttatcagcagtctcgagaacgctaattataaggatcacgaaaatggtacaggaaccaacacttacgctgccctgaacagcgtgtacttaatgatgaacaaccagatgaggttgctgggtatggagacaatggcttggcaagaaattaggcatgcaatcattctcttgacagatggaaagagcaatatggggggttctccaaaaacagcggtggaccatataagggaaatactcaacataaatcaaaaacgaaacgactatctggacatttatgcaattggggttggaaagctcgacgtcgactggcgcgaattaaatgaacttggctccaagaaagacggtgaaaggcacgcgtttatcctccaggacacaaaggcgttgcaccaggtgttcgaacatatgttagatgtgagcaagctaacagacactatctgcggcgttggcaacatgagcgccaatgcctctgaccaagagcgcacaccatggcatgtgaccattaagtag

SEQ ID NO: 183599 - DNA, 477 bp, Artificial Sequence
  Description of Artificial Sequence: Synthetic coding sequence
atgcgggccctgtgcatccgggagacctgcagcagcgagctgggcttttcaagaaactggtccagacgcaaggccggacattgccccaaccctgggatctccctaggcgccgtgagaactggttttcgctttggacacggcgataaggtccgttatagatgttcctctaacctggtgctcactgggagcagcgagcgggaatgtcaaggtaatggagtctggagcggtacagaacctatatgcaggcagccctactcttatgatttcccagaggacgtagccccagctctcggcacatcctttagtcacatgctgggtgcaacaaaccctacccagaaaaccaaggagagcctcggaaggaaaatccagatccagcggagtgggcatctgaacctctacctattattagattgttctcagagcgtgagcgaaaacgactttttgattttcaaagaatcggcaagtctcatggtttag

SEQ ID NO: 183600 - DNA, 477 bp, Artificial Sequence
  Description of Artificial Sequence: Synthetic coding sequence
atgcgggccctgtgcatccgggagacctgcagcagcgagctgggcttcagccggaattggtctaggcggaaagccggccattgcccgaatcccggtatctctctgggcgcagttcgcactggattccggtttggccacggagataaggttcggtatcggtgcagctccaaccttgttcttaccggctccagtgagagagaatgccaggggaacggtgtatggtccggaaccgagcccatctgcaggcaaccctattcatatgattttcccgaagacgtggcccctgctctcgggacaagcttttcacacatgttaggcgccaccaacccaactcagaagacgaaggaatctctaggacggaaaatccaaatccagagatcagggcatctaaacctgtatctcctgctagattgtagtcagtctgttagcgagaacgacttcttgatctttaaggaaagcgcctcgttaatggtgtag

SEQ ID NO: 183601 - DNA, 978 bp, Artificial Sequence
  Description of Artificial Sequence: Synthetic coding sequence
atgggcacccggagcgccatcgccgccccccggatcctgtgcagccgtggcttgcgctctggaagcgccagagccaccggttccggtgtggagcggtcacctagcgctgctaatccaaccttgatgacctctctccgcacctggcccttgccctgggccttaccttcccctacctgtcttgggcccccaatccccccaaggagacagcgcattttcagttttgaaatcaacgtgtccgtggccatcataacattcgcttcagagcctaaggtgctgatgtccgtcctgaatgataacagcagagacatgacagaagtgattagcagcttggaaaatgcaaattacaaagaccatgaaaacggaacagggaccaatacttacgccgcattgaacagtgtttatttaatgatgaataaccagatgcggctgcttggcatggagacaatggcctggcaagaaatccgccacgccattatattgctgacagatggaaagagtaacatgggcgggtcaccaaaaacagccgtggatcatattagagagatcctgaacattaatcagaaacggaatgactacctggatatctacgcgatcggagtaggcaagctggatgtagattggcgggagttgaacgaattagggtcaaaaaaggatggtgaaaggcacgccttcatcctccaggacaccaaggccttacaccaggtgtttgagcatatgttagatgtatcaaaactgactgacaccatctgcggtgtgggcaacatgtcagcaaatgcatcagatcaggaaaggacaccttggcatgtgactatcaagccaaagagccaagaaacctgtagaggagcactgatctctgatcagtgggttttgaccgccgcacattgctttcgagacggcaacgatcactcactctggagagtgaatgtgggcgaccccaaatctcagtggggaaaagagttcctgatcgaaaaagcttag

SEQ ID NO: 183602 - DNA, 477 bp, Artificial Sequence
  Description of Artificial Sequence: Synthetic coding sequence
atgcgggccctgtgcatccgggagacctgcagcagcgagctgggcttctcccgcaattggtctcgccgcaaggctggtcattgtcctaatcctgggatctctctcggagctgtgcgcaccggcttcagattcggccatggcgacaaagtgcggtatcggtgctcgagtaaccttgtgttgacaggcagctccgaaagggagtgccagggaaatggagtatggagtggtaccgagccaatttgtcggcagccttacagttacgactttccggaggacgttgctcccgccctgggtacgagcttcagccacatgctgggggcaaccaacccaactcagaaaacaaaggagagcctgggtcgaaagattcagattcagaggtctggccatctgaatctgtacttgctgctggattgctcgcaatctgtcagtgagaacgatttccttatcttcaaagagtccgcaagccttatggtgtag

SEQ ID NO: 183603 - DNA, 1062 bp, Artificial Sequence
  Description of Artificial Sequence: Synthetic coding sequence
atgggccccctgatggtgctgttctgcctgctgttcctgtaccccgccggacactgccccaatcccggcatctccctcggcgccgttaggaccgggtttcgcttcggccacggagacaaagtgagatatagatgtagttctaacctagtgttgacaggatccagtgagcgtgaatgccaggggaatggcgtctggtctggcacagagcccatttgccgtcaaccatactcctacgatttccctgaggacgtggcaccagctctcggcacctcattttcccatatgctgggagccaccaatccgacccagaagacaaaggaaagcttggggcgtaaaatccagatccagaggagcggccaccttaatctgtatttgctgctcgattgttcccagagtgtgagtgaaaatgattttcttatttttaaagagagcgccagcctcatggtggatcgcatattctcattcgagattaatgtctctgttgctataattactttcgcatcagaacccaaggtgcttatgtccgtgttgaacgataactcaagagacatgactgaagtaatctcatctcttgagaacgcgaactataaagaccacgaaaatggaactggcactaacacctacgcagccctaaactcagtgtacctgatgatgaataaccaaatgaggctgctgggcatggagaccatggcctggcaagaaattaggcacgccatcattctgctaaccgacgggaaatccaatatgggaggcagtccaaaaaccgccgttgatcacattcgggagatattgaacattaatcaaaaacggaacgattatctggacatctatgcgattggcgtcggtaaactcgatgtggattggagggagctcaacgaactcgggtcaaaaaaggacggggagcgccacgctttcatcttgcaagacaccaaggctctgcaccaagtgttcgaacacatgctggatgtatcaaagctgaccgacacaatatgcggcgttgggaatatgagcgccaatgcttctgatcaagaaaggaccccgtggcacgtcacaattaaatag

SEQ ID NO: 183604 - DNA, 420 bp, Artificial Sequence
  Description of Artificial Sequence: Synthetic coding sequence
atgggccccctgatggtgctgttctgcctgctgttcctgtaccccggcctagccgattccgcgccctcctgcccccagaatgtcaatatatcaggtggcacttttacgctgtcccacgggtgggcccccgggtctctgcttacctatagctgcccacaaggattgtaccctagccctgcatctcgcctctgtaagagtagcggccagtggcagactcctggcgctacccgctctctgagcaaagccgtttgtaaacctgtgagatgtccagccccagtgtccttcgagaacggtatttacactccaaggttagggtcctaccccgtgggaggcaatgtgtccttcgaatgtgaggacggctttattctccgagggtccccagtgaggcagtgcaggcccaacggaatgtgggatgggtag

SEQ ID NO: 183605 - DNA, 438 bp, Artificial Sequence
  Description of Artificial Sequence: Synthetic coding sequence
tgaggccactgccccaaccccggcatcagcctgggcgccgtgcggacggggtttagatttggtcatggcgataaggtacgctatcgatgtagctcaaatcttgtgctgacaggatcctcagagagagagtgccagggcaacggcgtctggagcggcaccgagccaatctgtagacagccctatagttacgattttccagaggacgtcgcccctgcgttaggtacatcattctcccatatgctaggtgcaacgaaccctactcaaaaaacaaaagaccatgagaacggcacagggaccaatacttacgctgcactcaattctgtctatctgatgatgaataaccagatgcggttgctgggaatggagactatggcctggcaggagattcgccacgcaattatcttgctgacggatggcaagtctaacatgggtggctag

SEQ ID NO: 183606 - DNA, 378 bp, Artificial Sequence
  Description of Artificial Sequence: Synthetic coding sequence
atgggccccctgatggtgctgttctgcctgctgttcctgtaccccgggctcgccgattctgctccatcttgtccccagaatgtcaatatctcaggaggtaccttcacactatcccacggatgggccccaggaagcttgctgacatactcttgtcctcagggcctttatccatctccggcgtcgagactgtgtaagtcctcagggcagtggcaaacaccaggcgctacacgtagcctgtccaaagcagtgtgtaaacctgggcattgtcctaatcccggcataagcttgggtgcagtgcgcaccggctttaggttcggccacggcgataaagtgcgatatagatgcagttctaatctggtgcttacaggatccagctag

SEQ ID NO: 183607 - DNA, 420 bp, Artificial Sequence
  Description of Artificial Sequence: Synthetic coding sequence
atgggccccctgatggtgctgttctgcctgctgttcctgtaccccggattggccgacagcgcgccctcatgtccacagaacgtgaatataagcgggggcacttttacactgtcgcacggatgggcccccggcagtcttctcacgtattcttgccctcaggggttatatccatcgcctgcttcccgcctttgtaagagcagcggccagtggcagacaccaggggccacccgctctctatcgaaagcagtttgcaaaccagttaggtgtccggccccagtatcattcgagaatgggatttacacccctagattgggcagttatcccgtgggggggaatgtatcattcgaatgcgaggacggcttcatcctgcggggttcacccgtccggcagtgccggcctaatgggatgtgggacggctag

SEQ ID NO: 183608 - DNA, 477 bp, Artificial Sequence
  Description of Artificial Sequence: Synthetic coding sequence
atgcgggccctgtgcatccgggagacctgcagcagcgagctgggcttcagccggaattggagccgacgtaaggcgggccactgtcctaatccagggatcagcttgggcgcggtgagaacgggattcaggttcggccacggtgacaaggtacgatatcgttgtagttccaacttggttctcaccggcagttcagagagggagtgtcagggaaatggcgtctggtccgggacagaaccgatctgcagacagccttacagttacgacttccccgaagacgtggcccctgccttaggcacatcattctcccacatgcttggggctaccaatccaacccagaaaactaaagagtccctcggacggaaaattcagattcagcgctcggggcacctgaatttatacttgttacttgattgttcgcaatctgtgtccgagaacgatttcctgatctttaaagaatcagcctccttaatggtgtag

SEQ ID NO: 183609 - DNA, 378 bp, Artificial Sequence
  Description of Artificial Sequence: Synthetic coding sequence
atgggccccctgatggtgctgttctgcctgctgttcctgtaccccggtctggctgacagcgcgccaagctgtccccagaatgtcaatatctccggcggaacctttacactctctcatgggtgggcccctggaagcctactgacctatagctgtccccagggcctttacccttctcctgccagcaggctgtgcaaaagtagcggacaatggcagacccctggtgccacgcgaagtctcagcaaggctgtgtgcaagcctggccactgccccaaccctgggatatccctgggggcagtgaggactgggttccgcttcgggcacggggacaaggtgcggtatagatgctcgtctaacttggtgctgactgggtccagctag

SEQ ID NO: 183610 - DNA, 1863 bp, Artificial Sequence
  Description of Artificial Sequence: Synthetic coding sequence
atgggccccctgatggtgctgttctgcctgctgttcctgtaccccgccggacactgccctaacccagggatttcgctgggcgccgtccgaactgggttccgctttgggcacggcgacaaagtgcgataccgttgcagttccaacctcgtactcacaggcagctcagagcgagaatgccaggggaatggcgtgtggtccggaacggagcctatttgcagacagccctatagctatgacttccctgaggacgtcgcgcctgccctcggcacatcattctcacacatgctaggggcaaccaaccctacccagaaaaccaaggagagcctgggacggaagattcagatccagaggtcagggcacctgaacctctacctgctgctggactgttctcagtccgtgtcagaaaatgacttcctgatctttaaggagtcagcgtctctgatggttgatcgcatcttttcttttgagataaatgtttcagtggctataattacctttgcctccgaacccaaagtcttgatgagcgttctgaacgacaattcgagagacatgaccgaggtcataagctctctcgaaaacgccaattataaggaccacgagaacgggaccggcactaatacctacgctgccctgaactcggtttacctgatgatgaacaatcagatgcggctgctggggatggagactatggcctggcaagaaatccgacacgccatcatcctcttgacggatggcaagtccaatatgggagggtctcccaagactgctgtcgaccacatccgcgaaatcctgaatatcaaccagaagcgtaacgattatttggacatctatgccatcggagtggggaagttagacgtggactggcgggagcttaacgagttgggatctaaaaaggacggcgagaggcacgcattcatcctgcaggacactaaagcactgcaccaagtctttgaacatatgctggacgtctccaagttaaccgatactatttgtggcgtcggaaacatgtctgctaacgcgagtgaccaggagcggacgccatggcatgtcaccatcaaaccaaaatcacaggaaacctgccggggagccctcatcagcgaccaatgggtcctcacggcagcccattgcttccgagacggcaatgaccattctctgtggcgtgttaacgtgggggaccccaagtctcagtgggggaaagagtttctgatcgaaaaggcagtcatctccccaggtttcgacgtttttgccaaaaaaaatcagggcatcctggaattttacggagacgatatcgctctccttaagcttgcacagaaggtaaagatgtctacacatgcccggcccatatgtctaccatgtaccatggaagctaacctggcactaaggaggccacaggggtcaacttgcagagatcacgagaacgaactcttgaacaaacagagtgttccggctcattttgtagccctgaacgggtcaaagctgaacattaatttaaagatgggtgtggaatggacatcttgtgcggaagtggtatcgcaggagaagactatgtttccaaacctgaccgacgtaagggaggtggtgactgatcagttcctgtgctccggcacacaggaggatgaaagtccctgcaaaggtgaaagcgggggagcagtgttcctagagcgccggttccggttctttcaggttggcctggtgtcttggggattgtacaacccttgtctcgggtccgcagataagaattcccggaagcgtgctccacgctccaaggttccccctcctcgtgacttccacattaacctgtttaggatgcagccgtggttaaggcagcacttgggcgacgtactcaactttctgcccctttag

SEQ ID NO: 183611 - DNA, 378 bp, Artificial Sequence
  Description of Artificial Sequence: Synthetic coding sequence
atgggccccctgatggtgctgttctgcctgctgttcctgtaccccggcttggcggacagcgcaccatcttgcccacagaatgtgaatatctccggcggtaccttcaccttgagccacgggtgggcccccggcagtcttctcacctacagttgccctcaggggctgtacccctccccagcttctcgactctgcaaatcaagcggccagtggcagactccaggagcgacccggtcattgagcaaggccgtctgtaagcccggccattgtcccaatcctgggatatccttgggggctgtacggactggctttcgtttcggccacggcgataaagtccgttatcgatgtagctctaatctggtgctaacaggttcctcctag

SEQ ID NO: 183612 - DNA, 420 bp, Artificial Sequence
  Description of Artificial Sequence: Synthetic coding sequence
atgggccccctgatggtgctgttctgcctgctgttcctgtaccccggccttgccgacagtgccccatcatgccctcagaacgtaaacatatcaggaggaactttcaccctctcccacggatgggcccccggctctctcttgacttattcctgtcctcagggattatatccctctccagctagccgcttgtgtaaatcatccggtcagtggcagactcccggcgccacaaggagcctgagtaaggccgtatgcaagcctgtccggtgtcctgcccctgtgtctttcgagaatggtatctacactcctcgactggggagctatccggtaggcggcaatgttagtttcgagtgcgaggacgggtttattctccgaggatcacctgtccgccagtgtagacctaacggcatgtgggatggttag

SEQ ID NO: 183613 - DNA, 378 bp, Artificial Sequence
  Description of Artificial Sequence: Synthetic coding sequence
atgggccccctgatggtgctgttctgcctgctgttcctgtaccccggattggccgactctgcacctagctgcccgcagaatgtaaacattagcggaggcaccttcactctctcccacggatgggctcctggttcacttctgacttattcatgcccccaggggctgtacccctcgccagccagcaggctatgtaagtcatccggacaatggcagacccccggtgccacccggagtctgagcaaagcggtatgcaaaccgggacattgcccaaacccgggaataagcttaggtgcagtgaggaccgggtttcggtttggacacggcgacaaggtcagatatcggtgcagttctaatttggtgcttaccggcagcagttag

SEQ ID NO: 183614 - DNA, 2259 bp, Artificial Sequence
  Description of Artificial Sequence: Synthetic coding sequence
atgggccccctgatggtgctgttctgcctgctgttcctgtaccccgggcttgcagactccgcaccatcatgtccacagaacgtgaatatttccgggggaacgtttacactgagccacggctgggcccccggtagtctgcttacctactcctgtcctcaagggttatacccctcacccgcatcgagactttgtaaatcctcaggacaatggcagacccctggggcgacccgcagtttatctaaagctgtatgtaaaccagtcaggtgccctgcaccagtctcattcgaaaatggtatttatacaccacgcctagggagttaccccgttggtggaaatgtgtccttcgagtgcgaggacggatttatcctgcggggcagccctgtgcggcagtgcagacctaacggcatgtgggacggagagacggcggtttgtgataatggagctggccattgcccaaatcctggcatctctctgggagccgtgagaacgggattcaggttcggtcatggggataaggtgagatacagatgttcttctaacctggtccttaccggatcatccgaacgtgagtgtcaaggcaatggcgtgtggagtggtaccgaaccaatatgccgtcagccttatagctatgacttcccggaagatgtggcaccagctctcgggacatcttttagccacatgttgggggccaccaacccgactcaaaaaaccaaagagagtctaggccgtaagatacagattcagcgttccggccatctgaatctgtacctcctgttggactgcagccagtcagtatccgagaacgacttcttgatttttaaagaaagcgcctccctaatggttgacagaatttttagctttgagatcaacgtgagtgtagcaatcattacctttgcatccgaaccaaaagttctcatgagtgtcctgaacgacaactcacgcgacatgacagaggtgatttctagccttgaaaacgcaaactacaaagatcacgagaacggcacgggaaccaacacgtacgccgccctgaactctgtttatctgatgatgaataatcaaatgagactcttgggaatggaaaccatggcatggcaggaaatcagacacgccataatcctgctgaccgatggaaaaagcaatatgggcggttcccctaaaaccgccgtcgatcacatacgtgagatcctcaatatcaatcagaaaagaaatgactacttagacatatacgccatcggggttggcaaattggatgttgactggagagaactcaatgaactgggttcaaaaaaggacggggagcgacacgcgttcatactgcaggataccaaggccctgcaccaggtgttcgaacacatgctggatgtgagcaaactgaccgatactatctgcggggtggggaatatgtccgcaaacgcatcggaccaggagaggacaccctggcacgtcacaatcaaacccaaaagccaggagacatgcagaggtgctctaattagcgatcagtgggtgctgaccgcagctcactgtttcagggacgggaatgatcatagcctctggcgcgttaatgtgggcgaccctaagagccagtggggaaaggaatttctcatagagaaagccgtgattagccccggctttgatgtttttgctaaaaagaatcaaggaatcctggaattttacggtgatgatatcgcactgcttaagttggctcagaaagtcaaaatgtccacacacgctcgaccgatttgtcttccatgcacgatggaggccaacctggcacttcggcggccccagggtagcacctgtagggatcacgagaatgagctgctgaataagcagtctgttccagcccactttgtggctctcaacgggtcgaaactgaatattaacctgaaaatgggggtggaatggacttcttgtgcagaggtggttagccaggaaaaaacaatgtttcccaatctgactgacgtaagagaagtggtgacagaccagtttctgtgttccggcacccaagaggatgaaagtccttgcaagggagaaagcggcggagctgtgtttctcgagaggcgcttccgattcttccaggtgggactggttagttggggtctttataatccttgcctcggctccgccgataaaaatagcaggaagagagcaccccgtagtaaagttccacccccgagggattttcatattaatctgttccgtatgcagccctggctacggcagcacctgggcgatgtattgaacttcttgcctctttag

SEQ ID NO: 183615 - DNA, 378 bp, Artificial Sequence
  Description of Artificial Sequence: Synthetic coding sequence
atgggccccctgatggtgctgttctgcctgctgttcctgtaccccggattggccgacagcgctccctcctgccctcagaatgtgaatatttcgggaggtacattcacgttgtcccacggatgggcccccgggtcacttctaacatacagttgccctcagggcctgtatccctccccagcgtctaggctatgcaagtcctccggtcaatggcagaccccaggggccactcgaagcttgagcaaagctgtctgtaagcctgggcactgtccaaaccctgggattagcttgggcgctgtccggactggtttccgcttcggacatggcgataaggtcagataccgctgttctagcaacctcgtgctcaccggttcgtcttag

SEQ ID NO: 183616 - DNA, 510 bp, Artificial Sequence
  Description of Artificial Sequence: Synthetic coding sequence
atgcgggccctgtgcatccgggagacctgcagcagcgagctgggctttagccggaattggtcccgtcggaaagcaggccattgtcctaatcccggcattagtctgggcgctgtccgtaccggttttcgatttggccatggtgacaaggtgagatatagatgttcatcaaatttggtcctcactgggagtagtgagcgtgagtgccagggaaatggtgtttggtccgggacagagcctatttgtcgccagccatactcctacgacttccccgaggatgtggcgcctgccctggggacctccttttcacatatgctcggcgctacgaaccccactcaaaagacaaaagatcacgagaatggaaccggaacaaatacctatgcagccctgaactccgtatacctcatgatgaacaaccaaatgcggttgcttggcatggaaacaatggcttggcaggagatcaggcacgctattattctgttaacagacgggaaaagcaacatggggggctag

SEQ ID NO: 183617 - DNA, 1578 bp, Artificial Sequence
  Description of Artificial Sequence: Synthetic coding sequence
atggtgctgttctgcctgctgttcctgtaccccgccggccactgcccgaacccaggcatctccctcggtgctgtgcgcactggattcagattcggccacggagataaggtgcgatacagatgctcaagcaatcttgtgctgaccggcagtagcgagcgggaatgccagggaaacggcgtgtggagtggaactgaacccatatgccggcagccttactcctatgatttccccgaggacgtggcccccgctcttggcacctcattttcccatatgctgggtgccacaaaccctacccaaaagaccaaggatcacgagaacgggaccggcacaaatacatacgctgcactaaattctgtgtatctgatgatgaataatcagatgcggctactgggaatggagactatggcatggcaggagattaggcatgccatcatcctgcttacagacggaaaatcaaacatggggggtagcccaaagacagctgtcgaccatattagggagattctgaacatcaaccagaagcggaatgattacctggacatatatgccatcggggtggggaagttggatgtcgattggagggagctcaatgaattgggatctaagaaggacggggaaagacacgccttcattctccaggataccaaggcactgcaccaagtcttcgagcatatgctagacgtgtcaaagctgacagacacaatttgtggcgtgggcaacatgtccgcaaatgctagtgatcaggaaagaaccccatggcacgtgacaatcaagccaaagtcccaggaaacttgtcgcggagctctgatttctgatcaatgggtgctgactgcagctcactgctttcgggacggcaacgatcactccctgtggcgtgtgaatgtgggcgatccgaaaagtcagtggggaaaggagtttttaatcgaaaaagctgtcatcagtcctggcttcgacgtgttcgctaaaaagaatcaggggatcctggagttttacggcgatgatattgcattgcttaagctggcacaaaaagtgaagatgagtactcacgcgcgccctatctgtctgccatgtactatggaggccaaccttgcactgcgtaggccacaggggtctacgtgtcgcgatcacgagaatgaacttttgaataaacagagcgtccccgcgcactttgtggccctcaatgggtctaaactgaacattaatctgaaaatgggggtagagtggacttcctgtgccgaagtcgtaagtcaagagaagactatgttcccgaatcttacagatgtgcgagaggttgtcacagatcagtttctgtgctcgggcacccaggaggatgagtcgccctgcaagggagaatctgggggagcagtgtttctggagcgccggttcagattcttccaggtcggcctggtctcctggggattgtataatccttgcttgggatccgccgacaaaaactccagaaaaagggctcccaggagcaaagttccccccccaagagatttccatatcaatctcttcagaatgcagccttggctgcgtcagcacttgggggacgtgctcaactttctccccctgtag

SEQ ID NO: 183618 - DNA, 438 bp, Artificial Sequence
  Description of Artificial Sequence: Synthetic coding sequence
tgaggccactgccccaaccccggcatcagcctgggcgccgtgcggaccggatttcgcttcggacatggcgataaggtgcgctaccggtgctctagcaacctggtcctgacagggagttctgagcgagaatgccagggaaacggagtgtggtcgggaactgaaccaatctgcagacaaccctattcatatgattttcccgaagacgtcgctccagccctggggacctctttctcacatatgctgggcgcaaccaatcctacgcaaaaaacgaaggaccacgagaacggcactggaactaatacgtacgccgccctgaattccgtgtacctcatgatgaacaatcagatgagactgttaggaatggagactatggcgtggcaggagataaggcatgctattattctcctgaccgacgggaagagcaatatggggggttag

SEQ ID NO: 183619 - DNA, 405 bp, Artificial Sequence
  Description of Artificial Sequence: Synthetic coding sequence
tgaggccactgccccaaccccggcatcagcctgggcgccgtgcggaccggattcagattcggacacggagacaaggttcgctatcgatgtagcagcaatctcgtcctgaccggcagctcagaacgcgagtgccagggcaacggggtttggtccggaaccgaacctatttgccggcagccgtactcctatgactttcctgaggacgtggccccggccttgggtacatctttctcacacatgctcggcgccaccaaccctacacaaaaaactaaagagtcactgggtagaaagattcagatccagcgatccgggcatctgaacctgtacctgctgttggactgtagccagtccgtttccgaaaacgatttcttaattttcaaagaatccgcctcattaatggtctag

SEQ ID NO: 183620 - DNA, 420 bp, Artificial Sequence
  Description of Artificial Sequence: Synthetic coding sequence
atgggccccctgatggtgctgttctgcctgctgttcctgtaccccggtttagccgactcagcccccagttgcccgcaaaatgtgaacataagtggcggcacctttaccctctctcatggctgggcacccggtagtttgctcacctactcctgcccacaggggttatatccttcaccagcttcgaggctgtgcaaatcgtctggacaatggcagactcccggagctactcgctctctcagcaaggcagtgtgtaagccagtgcgttgccccgcaccggtgagtttcgaaaacggaatttatacccctcgtctcggaagctaccccgtgggaggcaacgtcagcttcgagtgtgaagacggcttcatcctgagagggagtcccgtgagacagtgcaggccaaatggtatgtgggatggctag

SEQ ID NO: 183621 - DNA, 420 bp, Artificial Sequence
  Description of Artificial Sequence: Synthetic coding sequence
atgggccccctgatggtgctgttctgcctgctgttcctgtaccccggcttggccgactccgctccttcttgccctcagaacgtgaacatcagtggcggcacgtttacactgtcccatggatgggcccctggcagcctccttacatactcttgtccccagggactctacccaagccccgcctcccgcctatgtaagtcctctggacagtggcagacccctggtgccaccagaagtttgtcaaaggctgtgtgcaagccagtgcggtgcccggccccagtctcattcgagaatggcatttacacccctcgactcggctcctaccctgtcggggggaatgtcagttttgagtgtgaggacggtttcatactacgtggaagccccgtgaggcaatgtcgtcctaatgggatgtgggacggatag

SEQ ID NO: 183622 - DNA, 1617 bp, Artificial Sequence
  Description of Artificial Sequence: Synthetic coding sequence
atgcgggccctgtgcatccgggagacctgcagcagcgagctgggcttttctcgcaattggtcaagacgcaaggcaggccactgccccaatcccgggatttccctgggcgctgttcggaccggctttagattcggccatggagataaagtgcgttatcgatgcagctcaaacttggttctcactggaagcagcgagcgcgaatgtcagggaaatggcgtgtggagcggcacagagccaatctgtcggcaaccatactcctacgacttcccagaggatgttgctcccgccttgggcacctctttcagccacatgctcggagcgacaaaccctactcagaaaacaaaggaccatgagaacggcacaggcaccaatacatatgcggctctcaacagcgtctatctgatgatgaacaaccaaatgcggctcctcggcatggaaaccatggcatggcaggaaatcaggcatgctatcatcctcctcaccgacgggaaatccaatatgggaggcagcccaaaaacagcggttgatcatattcgggagatcctgaacattaaccagaaaaggaatgattacctggacatttatgcaatcggcgtggggaagctggacgtagactggagagagcttaacgagctgggcagcaagaaggacggagaacgtcacgcctttattttgcaggacaccaaagcccttcatcaggtattcgaacacatgctagatgttagtaagcttaccgatacaatatgtggagtagggaatatgtccgccaacgcaagtgaccaggagaggacaccttggcatgtgacgattaagcccaaaagccaggagacctgtcggggggcattgatctctgatcagtgggtcctgacagctgctcattgtttcagagacgggaatgaccacagcctgtggcgcgtaaatgtcggcgaccctaaaagtcagtgggggaaggaatttctaattgagaaggccgtgattagccccggttttgacgtatttgctaaaaagaatcaaggaatcttggagttttatggagatgacattgccttgctaaaacttgctcaaaaggtgaagatgagtacccatgcccggccaatttgcctgccttgcacaatggaagccaacctcgccctccggcgcccacagggttcaacttgcagggaccacgaaaacgaattactgaataaacagtccgttcctgcacattttgtggcactaaacggctcgaagctgaatattaacctcaagatgggtgtggagtggacttcatgtgcagaagtggtgtctcaggagaagacgatgttcccaaatcttaccgacgtgcgggaggtggtgacggaccagtttctctgtagcggtacacaggaagatgagtcaccgtgtaaaggtgagagcgggggagccgtcttcctggaaagacgcttcagattctttcaggtggggcttgtttcctggggcctctacaacccctgcctgggaagtgccgacaagaacagcaggaaaagagcccccaggagtaaagtgcctccaccaagggatttccatattaatctgttcagaatgcagccatggctgcggcaacacctcggcgatgttctgaattttctgcccctgtag

SEQ ID NO: 183623 - DNA, 1521 bp, Artificial Sequence
  Description of Artificial Sequence: Synthetic coding sequence
atgggcacccggagcgccatcgccgccccccggatcctgtgcagccgaggcttgcgatctggatcagctcgcgccacagggagcggcgtcgaacggagcccatccgctgccatcttttcattcgaaatcaatgtgagcgtggctatcataacgtttgctagtgagcccaaggtgctcatgagcgtgctcaatgacaatagcagggacatgacagaggtgatatcatctctagagaacgctaactacaaagatcacgaaaacggaactggcaccaacacgtatgcggctctgaactccgtgtacctaatgatgaataatcagatgagactgttgggaatggagaccatggcatggcaggaaatcagacacgccattatcttattgacagacggcaaaagtaacatgggggggagcccaaagactgccgtggaccacatccgagaaatcttgaacattaaccagaaacgaaacgattatcttgacatctacgcaatcggagtgggcaaactggacgtggattggcgcgaacttaacgaactggggtctaaaaaggacggagaacggcatgcctttatcctacaagacacgaaagctctacaccaagtctttgagcatatgctggatgtatcaaagctcaccgatacaatatgtggcgtaggaaacatgtccgcaaacgcctccgatcaggagagaacgccttggcatgtgacaattaagcccaagtcccaagagacctgtcgaggagctctgattagcgatcaatgggttttgacagccgcccattgcttcagggacggaaatgatcactctctctggagggtgaacgttggggacccgaaatcacagtggggaaaagagttcctaattgagaaggctgttatctcgccaggctttgacgtgttcgcaaaaaaaaaccaaggtatcttggaattctatggggacgacatcgcccttttgaaactggcacagaaagttaagatgtccactcacgccagacctatttgtcttccttgcaccatggaagccaacctcgcacttcgtcgtccacagggctcaacctgtagagaccacgagaacgaacttctgaacaaacagtctgtaccagcccactttgtggccctcaatggttccaaactgaacataaatttgaagatgggggtcgaatggacctcctgtgccgaagtagtctcccaggagaaaaccatgttccctaacctgaccgacgtgcgggaggtcgtgactgaccagttcctctgcagcggcacgcaagaggacgagagtccctgtaagggtgagtcaggtggcgctgtctttctcgagagacgctttcgattcttccaggtgggacttgtgtcttggggcctatataatccatgtcttggcagtgctgacaagaactcacgtaagagagccccaagaagcaaggtgccccccccccgggattttcatatcaacctctttcgcatgcagccttggctgagacagcacctgggtgacgttcttaatttcctccctctctag

SEQ ID NO: 183624 - DNA, 1521 bp, Artificial Sequence
  Description of Artificial Sequence: Synthetic coding sequence
atgggcacccggagcgccatcgccgccccccggatcctgtgcagccgaggtttgagaagcggctccgccagggctactggttcaggcgtggaacgatccccgtcagccgctatattcagctttgaaatcaacgtgagtgtggccataattacattcgccagtgagccaaaagttctgatgagcgtcttgaatgacaactccagggatatgactgaggttatctctagcttggaaaatgccaactacaaggatcacgagaatggtacaggaacaaacacgtatgcagccctgaactcagtctacctcatgatgaacaaccaaatgcggctgctggggatggagaccatggcatggcaagagatccggcacgccattatactcctgaccgacggcaagtctaacatgggcggatctcctaaaaccgccgtggaccatatcagagagatacttaacatcaaccagaaaaggaatgactatctcgacatttacgcaatcggcgtgggcaaattggacgtggactggcgggaactgaatgaactgggtagcaaaaaagatggcgagaggcacgctttcatattacaggataccaaggccctgcaccaggtcttcgagcacatgctcgatgtgagtaagttaactgatacaatatgcggcgtgggaaatatgtccgcgaatgcaagcgaccaggagagaacgccgtggcacgtgacaattaagccaaagagccaagagacgtgtagaggggcattgatcagtgaccagtgggtccttactgccgcccattgcttccgtgatgggaacgatcattccctttggcgagtgaatgtaggggatccaaagtctcagtggggtaaagaattcctcatcgagaaggcagtgatctcacctggctttgacgtctttgccaaaaagaatcagggtattctcgaattctacggagatgatatcgccctgctgaagcttgcccagaaggtgaaaatgtctacccatgccaggcctatctgtctaccttgcacgatggaggccaacctggccctgcggaggccacagggttctacgtgcagggatcatgaaaacgagctcctgaataaacaaagtgtacctgcccatttcgttgcacttaacgggagtaagctgaatataaatctgaagatgggtgtggagtggacttcctgtgcagaagtagtctctcaggagaaaaccatgttcccgaatttgacagacgtgcgagaggtagtcactgaccagttcctctgtagcggcacccaagaagatgagtcgccctgcaaaggggagtccgggggcgcagtctttttagagcgccggtttaggttcttccaagtgggactggtctcctggggactgtataatccttgtttgggaagtgccgacaagaacagcagaaagagagcacctcggagcaaagtaccgcccccccgagactttcacattaacctgttccgtatgcagccctggctacggcagcatctgggcgatgtactcaattttctgcccctgtag

SEQ ID NO: 183625 - DNA, 1521 bp, Artificial Sequence
  Description of Artificial Sequence: Synthetic coding sequence
atgggcacccggagcgccatcgccgccccccggatcctgtgcagccggggtctgcggagtggctccgctcgagccaccggttcaggcgttgagcgaagtcccagcgccgccatttttagttttgagattaacgtgtctgtggcaatcatcaccttcgcgtccgagccaaaagtactaatgagcgtgcttaacgacaactctagagacatgaccgaagtgatcagttccctggagaatgccaattacaaggaccatgagaatggcaccggaacaaacacttatgcagccctgaactccgtatatctcatgatgaataaccaaatgcggttactgggcatggaaacaatggcgtggcaggaaatccgccatgctataatcctgctgactgatggtaagagcaacatgggcggttctccaaagacggctgtggaccacatccgagagatcctcaatatcaatcagaagcgcaacgactatctcgacatttatgctatcggcgtcggaaagcttgatgtggattggagagaacttaacgaacttgggagcaagaaggatggggagaggcacgccttcatcctccaggacactaaggcgctgcaccaggtgttcgagcatatgctggacgtctccaaactgactgatacaatctgcggggtcggcaatatgtcagccaatgcttctgatcaggagagaaccccctggcacgtgaccattaaacccaagtctcaggagacttgtaggggggcgctaattagcgaccagtgggtcctcaccgccgcacactgttttcgtgacgggaacgaccatagtttgtggcgggtgaacgtgggcgaccctaagagtcaatggggtaaggagtttctgatcgagaaagccgttatctcaccgggcttcgacgtcttcgcaaaaaaaaaccaaggaatcctagaattctacggtgacgacatcgcattactcaagttggcccaaaaggtgaaaatgtccactcatgcgcgccccatttgcctgccatgtacaatggaggctaatctcgcactgcgccggccacaggggagtacatgccgagaccatgagaacgaactcctgaataagcagagcgtcccggcccacttcgtggcattaaatggatctaagctcaacatcaatctgaagatgggagtggagtggacctcctgcgctgaagttgtgtcgcaggagaaaaccatgtttcccaatctcactgacgtgcgcgaggtagtgaccgatcagtttctatgcagcggcacccaggaagacgagagcccttgcaagggtgaatccgggggtgcagtctttctggagcgacggttccggttctttcaggtggggttggtctcctggggtctgtacaatccatgcttgggatcagccgacaagaattcccggaagagggctcctaggagcaaggtcccgccccctcgagattttcacatcaacctatttagaatgcaaccatggctaagacaacatctgggagatgtgctgaatttcctaccactctag

SEQ ID NO: 183626 - DNA, 1134 bp, Artificial Sequence
  Description of Artificial Sequence: Synthetic coding sequence
atgaccgaggtgatcagcagcctggagaacgccaactacaaggaccacgagaatgggaccggaaccaatacctatgccgcattgaattcagtatatctgatgatgaacaaccagatgagattactcgggatggaaacaatggcctggcaggagatccgccatgctattatcttactgaccgatgggaaaagcaatatgggaggatcacccaaaaccgccgtcgaccacatacgtgaaatcctgaatatcaaccagaagcgcaatgattatctagatatttacgccattggggtgggaaaattagatgtggactggagggagctgaacgagctgggatcaaagaaagatggcgagagacacgccttcattctgcaggacaccaaggcattgcatcaagtattcgaacatatgttggacgtcagtaagctaacggacaccatctgcggagtgggaaacatgtccgcgaatgcctccgatcaagagagaaccccctggcacgtgacaatcaaacctaaatcccaagagacctgtaggggcgcccttatttcagatcagtgggtcctgaccgctgctcattgcttccgggacggcaatgatcattccctttggcgtgttaacgtcggagaccctaaatcccaatggggaaaggaattcctcatcgagaaggctgttatttcccctggcttcgacgtgttcgctaagaaaaaccaagggattctggagttctacggtgacgatatcgctctgctgaagctggcccaaaaggtaaagatgtccacccatgccagaccaatctgtctgccatgcacaatggaggctaatctggcactgaggcggccccagggctccacatgcagggaccacgaaaacgagttactcaacaagcagtcagtgccagcccacttcgttgcactcaatggttctaaattgaacattaacctcaaaatgggagtagagtggaccagttgtgctgaggtggtaagtcaggagaagacaatgtttcccaatcttacggacgtccgcgaggtggttacagatcagtttttgtgttctggcacacaggaagatgagtcaccttgtaagggaggcagtggtgagttggggagcttacaaccactgccctggctgtgttag

SEQ ID NO: 183627 - DNA, 978 bp, Artificial Sequence
  Description of Artificial Sequence: Synthetic coding sequence
atgggcacccggagcgccatcgccgccccccggatcctgtgcagccgcggcctgcgcagcggatctgctagggcgactggctcaggagtggagcgcagtcccagcgcagccaatcccacactgatgacctctctacgcacgtggcccctaccctgggctctccccagtccaacgtgcctaggcccccctatcccaccaaggagacagcgtatcttttctttcgagattaatgtaagtgtcgccattattacattcgctagcgagccaaaagttctcatgagcgtattaaacgataattctcgagatatgaccgaggtgatcagctccctggagaacgccaattataaagatcacgaaaatggaactggtaccaacacatatgccgccctgaacagcgtgtacctgatgatgaataaccagatgcggttactcggcatggaaaccatggcctggcaggagataagacacgccattattctgctgactgacggaaaatctaacatgggaggatcacccaagacggccgtggatcatattagagagatcttgaatataaatcagaagagaaatgactatctggatatttacgcgatcggcgtgggcaaactggatgtggattggagggagctgaacgagctaggcagcaaaaaagacggggagcgtcacgctttcatactacaggacactaaggccctgcatcaggtctttgagcacatgctggacgtgagtaagctaaccgatacaatctgtggtgttgggaatatgagcgctaatgcgagtgaccaggaacggaccccatggcacgttaccattaagcccaagagtcaagagacctgccggggcgccctgatcagcgaccagtgggtgttgacagcggcccactgttttagggatgggaatgaccactccctatggagggtgaacgtcggtgacccaaaatctcagtggggtaaggagttcttgatagaaaaggcatag

SEQ ID NO: 183628 - DNA, 1521 bp, Artificial Sequence
  Description of Artificial Sequence: Synthetic coding sequence
atgggcacccggagcgccatcgccgccccccggatcctgtgcagccgtggcctgaggagcggatctgcccgcgcaaccggtagtggagtggaaaggtccccaagcgcagccatcttctcctttgagatcaacgtctctgtggccattattacctttgctagcgaacccaaggtcctgatgtctgttttgaacgataactcccgcgacatgacggaagttatcagttctctagagaacgccaactacaaggatcatgagaatggtactggaaccaacacttatgcagcattaaattcagtgtacctgatgatgaataaccagatgagattgctggggatggagacaatggcctggcaggaaattcggcacgcaattatcttactgaccgacggcaaatccaatatggggggatctcctaaaacagccgtggatcacatacgcgagatccttaacatcaatcagaagcgaaatgactatctggacatttatgccataggcgtgggcaaactcgatgttgactggagagagctgaacgagctgggaagcaaaaaagatggagaaagacacgcttttatactccaggacacaaaggccctccaccaggttttcgaacacatgctggacgtatctaaacttacggataccatctgcggggtgggaaacatgtctgcgaatgcgtctgatcaggagcgaacaccctggcacgtgacaataaaacccaagtcccaggagacttgtcgtggggctcttatatccgatcaatgggtgctgactgccgcgcattgtttcagagatggcaacgaccatagcctttggcgggtcaatgtgggggacccaaaatcccagtggggcaaagagttcctgattgagaaagccgtgatttcaccagggtttgatgtgtttgcaaagaagaatcaggggatcttagagttttatggcgacgacatcgcgcttctgaaactggcacagaaagtgaaaatgtccacccacgcaaggcccatatgtttgccttgtacaatggaggctaatcttgccctgagaaggccccaggggtccacatgccgggaccacgagaatgaactcttgaataagcagtcagtgccggcccattttgtggcactgaatggatccaagttaaacatcaatttgaaaatgggagtagagtggaccagctgtgccgaggtggtgagccaggagaagaccatgtttcccaacctgacagatgtgcgagaagtggtcacagaccagtttttatgcagcgggacgcaggaggatgagtctccgtgcaaaggcgagtccggaggggcggtgtttcttgagcgaaggtttagattttttcaggttgggctggtgtcttggggcctatacaacccatgtcttgggagtgcagataaaaattcacgaaagcgagcccccaggagtaaagtgccaccaccaagagattttcacattaatctgttcagaatgcaaccgtggctaaggcagcacctcggagatgtgctgaacttcctgccactgtag

SEQ ID NO: 183629 - DNA, 1521 bp, Artificial Sequence
  Description of Artificial Sequence: Synthetic coding sequence
atgggcacccggagcgccatcgccgccccccggatcctgtgcagccgcggcctccgaagtggatcagcccgggccacagggtccggagttgaacgcagtccaagcgccgcaattttcagcttcgaaataaatgtctcagtggccattattaccttcgctagcgagcctaaggtgctgatgagtgtcctgaacgacaattctagagacatgaccgaagtgatcagttctctagaaaatgccaactataaggaccatgagaacggcaccggaacgaatacctatgcagcattgaatagcgtgtatctgatgatgaacaatcaaatgagacttctcggcatggagactatggcctggcaggagattaggcatgcgatcattcttctgacagacggcaaatctaacatgggtggttcccctaagacagcagtggaccacatccgcgaaatcctgaacatcaaccagaaacgtaacgactatctggacatctatgccatcggtgtggggaagctggatgtcgattggagagagcttaacgaactaggttcaaaaaaagacggtgagaggcacgcatttattctgcaggacaccaaggcattgcatcaggttttcgagcacatgctggacgttagcaagttgaccgatactatctgtggcgtgggcaacatgtccgcaaacgcctctgaccaagagagaaccccttggcacgtcactattaagcccaagagccaagaaacatgcaggggcgctctgatctccgatcagtgggttttgaccgcagcccattgctttagagacggcaacgaccatagcctatggcgtgtcaacgttggcgaccctaagagccagtggggaaaggaatttcttatcgaaaaggctgtcatttcccctgggttcgacgtcttcgccaagaagaatcaggggattttggagttctacggcgacgacatcgccttactgaagctagcccagaaggttaagatgtccacacacgctcgccccatttgcctgccttgcacgatggaagcaaatctggcgttacgtaggccccaaggaagtacctgcagagatcacgagaacgaactactgaataagcagtctgtacctgctcacttcgttgcgttgaatggctcaaaattaaacatcaacctgaagatgggcgtggagtggactagctgtgccgaagttgtatcacaggagaagacgatgttccctaacctcaccgatgtgcgcgaggtggtcacagatcagttcctatgttctggtacccaggaagatgagagtccatgtaaaggggagagcggtggggctgtgtttctcgaacggagatttagatttttccaagtaggcctggtgagctggggcctctacaacccatgtcttggatctgccgataagaacagccgcaagagagcaccaaggtcaaaggtgccacccccccgcgatttccatattaatcttttccgcatgcagccctggttgcgtcagcaccttggggacgtgttaaattttcttcccctgtag

SEQ ID NO: 183630 - DNA, 1617 bp, Artificial Sequence
  Description of Artificial Sequence: Synthetic coding sequence
atgcgggccctgtgcatccgggagacctgcagcagcgagctgggcttttctcggaactggagccgcaggaaggccgggcactgtcctaatcccggcatttctctgggtgccgtgcgcacgggtttccgattcggacacggtgacaaagtccgataccgctgtagctctaacctggttcttacgggctccagcgagagagagtgccaaggcaacggggtgtggagcggcactgagccaatttgtcggcagccttatagttatgatttcccagaagatgtcgcacccgcactgggcacgtctttcagccacatgctgggcgccaccaatcccacccagaaaactaaagaccacgagaatgggacagggactaatacgtacgcagcgcttaacagtgtttacctaatgatgaacaaccagatgcggctgttaggaatggaaaccatggcgtggcaggaaatacgtcatgctatcattttactgactgacgggaaaagcaacatgggtgggagtcctaagaccgctgtggaccatatccgggagatcctgaacatcaaccagaagcgaaacgactatctggatatttatgccatcggagtagggaaactggacgtagattggagagaactgaacgaactagggtctaaaaaggacggcgaaagacatgcttttatattgcaggacactaaagcattgcaccaggttttcgagcacatgctggatgtgagtaaactgacagacaccatctgtggtgtcgggaatatgtctgccaatgctagcgaccaggaacgcactccatggcacgtgaccatcaagcctaaatcacaggaaacttgcaggggagctcttatctccgatcagtgggtactcacagcggctcattgtttccgagacgggaatgatcacagcttgtggcgtgtcaacgtcggcgaccctaaatcccagtgggggaaggaatttctgatcgaaaaagcggtgatctcaccagggtttgatgtgtttgctaagaagaatcaaggaattctggaattctacggcgacgatattgccctcttgaaacttgcccagaaggtcaagatgagtacacacgcgagaccaatctgcctgccatgtacaatggaagccaacctcgccctgcgacggccacagggtagtacctgccgtgaccatgagaatgagttgctgaacaagcagtccgtccctgcccactttgtggccctgaatggctctaagctgaatataaatctgaaaatgggcgttgagtggacgagttgtgctgaagtggtctcacaggagaagacgatgtttcctaacctcacagacgtgcgagaggttgtgaccgatcaattcctttgcagcggcacccaggaagatgagtctccttgtaagggggagtccggaggggccgtctttctcgaacgcagatttaggtttttccaggtcgggctagtctcctggggcctgtataacccttgtctggggtccgcagacaagaactcacgaaagagggccccccgcagtaaagttccccccccacgcgactttcatataaacctgttccgcatgcagccctggctgagacagcatctgggggatgtcctgaattttctacctctctag

SEQ ID NO: 183631 - DNA, 1134 bp, Artificial Sequence
  Description of Artificial Sequence: Synthetic coding sequence
atgaccgaggtgatcagcagcctggagaacgccaactacaaggaccacgagaatggcactggcaccaacacttacgctgccctgaatagtgtgtatctgatgatgaacaatcagatgcggctgctcggcatggaaacgatggcctggcaggaaatccggcatgccatcatccttctgactgacgggaagagcaacatgggcggctcccccaaaactgccgtcgatcatatcagggaaatactcaacatcaaccagaagagaaatgattacctggacatctatgcaataggcgtgggaaaacttgacgtagactggcgggagctgaatgagctcggatcgaagaaggacggagaaagacatgcattcatcctacaggacacaaaggccctgcaccaggtgtttgagcatatgcttgatgtctccaagctgaccgataccatctgcggcgttggcaatatgtcggctaatgctagcgaccaggaacggactccgtggcacgtgaccatcaagccgaagtcccaagagacatgtcggggggccctgatttccgatcagtgggttctcaccgccgcccactgctttcgcgatggaaacgaccacagcctttggagagtgaacgtgggagaccccaagtcccaatggggcaaggagtttctgatcgagaaggcagtgatctctccgggcttcgatgtgtttgctaaaaagaaccaagggatcctcgagttctatggcgatgatatcgccttgctgaagctggcccagaaagtcaaaatgtccacacatgcaaggcccatttgcttgccatgtacgatggaagcaaatctcgccttgcgccgccctcagggctcgacctgtcgggatcacgagaatgaactcctcaacaagcagtcggtgcctgctcatttcgtagcactgaacggctcgaagttgaacatcaacctgaagatgggagtggaatggacttcatgtgccgaagtcgtcagccaggaaaagactatgttccctaacctgactgatgtgagagaggtagtgacagatcagttcctttgctctggtacacaggaggatgagtctccctgcaagggcggatctggtgagctcggatctttgcagcctctgccttggctttgctag

SEQ ID NO: 183632 - DNA, 1863 bp, Artificial Sequence
  Description of Artificial Sequence: Synthetic coding sequence
atgggccccctgatggtgctgttctgcctgctgttcctgtaccccgccggacactgcccaaaccccgggatatcgctaggggctgtgagaactgggtttcgctttggccacggcgataaagtccgctacagatgcagctctaaccttgttctcacaggatcatccgagcgcgaatgccagggaaacggggtgtggagcggaacagagccgatctgcagacagccatacagctacgactttcctgaagatgtggctccagcgctggggacctcattctcccacatgctgggtgcgacgaatcctacgcaaaagacaaaggagtctctcggcaggaaaattcaaatccagaggagcggtcacctgaatctctatctgcttttggactgttcacagtctgttagtgagaatgactttttgatattcaaggagtctgcctccttaatggttgaccgaatcttctcctttgagatcaatgtgtcagtggccatcattacgttcgccagtgagcccaaagtactcatgtccgtgctgaacgacaactcgagggacatgaccgaagtcatctccagtttggagaatgctaactacaaagaccatgagaacgggacaggaactaatacctatgcagctctgaacagcgtgtacctgatgatgaacaaccaaatgaggcttcttggcatggagacaatggcgtggcaggagattaggcatgccatcatcctactaacagacggcaagtctaatatggggggatcacctaagactgccgtagatcacatccgtgaaatcctcaacattaaccagaagcgtaacgactatctggatatctatgctatcggcgttggcaagttagacgtggattggcgggagcttaatgaactgggatctaagaaagatggcgagaggcacgccttcattcttcaagatactaaggccctgcatcaggtgttcgaacacatgctggacgtgtcaaagttgactgatacgatctgtggggtaggcaatatgtcggccaatgcctccgatcaggagaggaccccatggcatgtgacaattaagccgaaatcccaggaaacatgccgcggcgccctgattagtgaccagtgggtcttgacagccgcccactgctttagagatggaaacgaccattccctatggcgggtgaacgtgggggatcctaaatcacagtgggggaaggaattcctgatcgagaaggccgttatctctcctgggttcgatgtttttgccaagaaaaatcagggcattctggagttctacggagacgacattgcactcttgaaactggcccagaaggtgaagatgagtacccacgccaggcccatttgcctgccatgcactatggaggcaaacctggccctgagaagacctcagggatcgacttgccgagaccatgaaaacgaactgctcaacaaacagagcgtacccgcacactttgtcgccctcaacggttctaaactgaacatcaatcttaagatgggcgtagaatggacctcatgcgctgaagtagtgtcccaggaaaaaacgatgttcccaaatcttactgacgtgagggaggtcgtgaccgaccaatttctgtgctcaggaactcaggaagacgagtcaccatgcaagggagaatcgggtggtgctgtgtttctggaacgcagatttcgtttcttccaagtgggactggtgtcgtgggggctttacaatccctgtctgggtagcgccgacaaaaactctcggaaacgcgccccacgctctaaggtgccccctcctcgagactttcatattaacctgttccggatgcagccctggctccgccagcacctgggggatgttctcaactttctccccttgtag

SEQ ID NO: 183633 - DNA, 1863 bp, Artificial Sequence
  Description of Artificial Sequence: Synthetic coding sequence
atgggccccctgatggtgctgttctgcctgctgttcctgtaccccgctggccactgccctaatccggggatttctttaggggccgtaagaactggatttcgtttcggacatggcgataaagtgcgctatagatgctcgagtaatttggtgttgaccggaagtagtgagagagagtgtcagggcaacggcgtctggtcagggacggagcctatctgccgccagccttattcctacgacttcccggaagatgttgcccccgccctgggcacgtcattttcccatatgctgggagcaaccaatccaacccagaaaaccaaggagagcctcggcaggaaaatccagatccagaggagtgggcacctcaacctctacctactcctcgactgctcccaaagcgtgtccgagaatgatttcttgatatttaaggagagcgctagtctgatggtggaccgaatcttctcattcgaaatcaatgtgtccgttgccattatcacatttgcgtccgaaccgaaggttctgatgtctgtgctgaatgacaactcccgagatatgactgaggtaattagctcactcgaaaacgccaactacaaggaccatgagaatggcactggaaccaacacgtacgctgctctgaatagcgtgtacctgatgatgaataatcagatgcgcttgttgggtatggagaccatggcctggcaggaaattcgccacgctatcattcttctgactgacggaaaatcaaacatggggggcagcccaaaaacggctgtggatcatattcgcgagatcttaaatattaaccagaagagaaatgactatctcgacatatatgccattggcgtcggcaagctggacgtggattggcgggaattgaatgagctgggtagcaaaaaggacggtgagcggcatgcctttattctgcaggatacaaaagcgctacaccaggtattcgagcacatgctggacgtgagcaagttaacagataccatctgtggcgtcggcaatatgagtgctaacgctagcgaccaggaaagaactccttggcacgttaccattaaacccaaatcccaggagacctgtcgcggggccctaatttctgatcagtgggtgttaacagcagcccactgttttcgtgacggcaacgaccattcactatggagagtcaacgtgggtgatccaaaatcacagtggggcaaagagtttctgattgagaaagctgtgatatcaccgggattcgacgtgtttgcaaaaaaaaatcaggggattctggagttctatggcgatgacatcgcgctcctcaagctcgctcagaaagttaagatgtcaacgcacgccaggcccatttgtcttccttgcacaatggaggccaaccttgccctgcgaagaccccagggttccacctgccgggatcacgaaaatgagctactaaacaaacaaagcgtaccagctcatttcgtcgccttaaacggctctaaattgaacattaacctgaaaatgggcgttgagtggaccagctgtgctgaagtagtgtcgcaagaaaagaccatgtttcccaatctgactgacgtgagagaagtggtgacagatcaatttttgtgctctggcacacaggaagacgagtcgccatgcaagggcgaaagtgggggcgccgttttcctcgagcgccgatttagattttttcaggtgggcctggtgtcttggggtctctataatccatgtctaggcagcgctgataagaacagcagaaaaagggctccgagaagtaaggtgcccccaccccgggactttcacatcaacctgtttcgcatgcagccatggctccgccagcatctgggcgacgtactcaacttcctgccattgtag

SEQ ID NO: 183634 - DNA, 978 bp, Artificial Sequence
  Description of Artificial Sequence: Synthetic coding sequence
atgggcacccggagcgccatcgccgccccccggatcctgtgcagcaggggcttacggtccggctccgcaagagcgaccggtagcggggtggagcgcagccccagcgccgccaaccccacccttatgacaagcctgcgcacatggcctcttccctgggcactacccagccccacctgcctggggccccccatccccccgagaaggcaacgcattttttccttcgagatcaatgtgagcgtcgccatcatcacattcgcctctgaacctaaagtgctgatgagcgtgctgaatgacaattcgcgagacatgaccgaggttatttctagtctggagaatgcaaactacaaagaccacgagaacggtacaggtacaaacacctatgccgccctcaattcggtgtatctcatgatgaacaaccaaatgcgtctgttaggcatggaaactatggcttggcaggagatccggcatgccatcattctgctgactgatggcaagagtaacatggggggctcccctaaaaccgcagtcgatcatattcgggagatccttaacattaaccagaagaggaatgactatctcgatatctatgccatcggagtaggcaagctggacgttgactggcgcgagttgaacgaactgggatctaaaaaagatggagagagacatgcgtttatcctccaggacacaaaggctctgcatcaggtgtttgagcacatgctggacgtgtctaagcttacggacactatatgcggcgttggcaatatgagtgcgaatgcttccgatcaagaacgcaccccttggcatgtgacaatcaagccaaaatcacaggaaacgtgtcgtggggcactgatcagtgaccagtgggtcctgacagcagcccactgcttcagggatggtaatgatcatagcctctggcgggtgaacgtgggcgatccaaaaagtcagtgggggaaagaattcctaattgaaaaagcctag

SEQ ID NO: 183635 - DNA, 978 bp, Artificial Sequence
  Description of Artificial Sequence: Synthetic coding sequence
atgggcacccggagcgccatcgccgccccccggatcctgtgcagcagagggcttagatcaggaagcgctcgcgcgactgggtccggagtggagagaagcccctcagcagctaaccccaccctgatgacctctctgcgcacttggcccctgccttgggctctgccaagcccgacatgtttaggaccccccattcctccgagaaggcagaggatcttttccttcgagattaatgtgtccgttgcaattattacttttgcaagcgagccgaaagtgttgatgagtgtactgaatgacaattcacgtgatatgactgaggtcatcagtagtctggaaaacgctaactataaggaccatgaaaacggcacgggtaccaacacgtacgcagcattgaactccgtgtatctcatgatgaataaccagatgcggctcctcggcatggaaaccatggcatggcaagaaatcagacacgccataatcctcctaacagatggaaagtccaacatgggtggatctcctaaaacagccgttgatcacattagggaaatcctcaacatcaaccagaagaggaatgattatcttgatatttatgctatcggtgtgggcaagctggatgtggactggcgagagctgaacgagctggggtccaaaaaagatggggagcgtcacgcattcatcctgcaggacaccaaggcgcttcaccaagtttttgaacacatgctggacgtgagcaagcttactgacacaatttgcggcgttggtaatatgagtgctaacgcctccgatcaggaaagaacaccatggcacgtcacaatcaagccaaaaagccaggagacttgtaggggcgctctaatttctgatcaatgggtcctgacggcagcacattgcttccgagacggaaacgatcactccctgtggcgggtcaatgttggggacccaaagtcacagtggggtaaagagtttctgatcgaaaaggcatag

SEQ ID NO: 183636 - DNA, 1521 bp, Artificial Sequence
  Description of Artificial Sequence: Synthetic coding sequence
atgggcacccggagcgccatcgccgccccccggatcctgtgcagcagaggcctgcgtagtgggagtgccagggcaaccggctccggcgtggaacggtccccatctgccgccattttctcgttcgaaattaacgtgtccgtggctatcatcacgttcgcaagcgagcccaaagtcctgatgagcgtgttgaacgataactctcgcgacatgaccgaggtaattagcagtttggaaaacgccaactataaggaccacgagaacggcaccggcaccaacacatacgccgctcttaactcagtatatttaatgatgaacaatcagatgagattactaggcatggagacaatggcttggcaagaaattcgtcatgcaattattctcctgacggacggaaaaagcaacatgggtgggtcaccaaagaccgctgtggatcacatcagagaaattctcaatattaatcagaagagaaacgattatctggacatttacgccattggtgtggggaaactggacgtcgattggcgggaactgaatgaattgggatcaaagaaagatggggagcgccacgctttcattctccaggacactaaggcactccaccaagtgttcgagcatatgctggatgtctccaagctgacagacacaatttgcggggttggaaacatgtctgccaacgcctccgatcaggaacgtactccatggcacgtgacaatcaaaccaaaaagccaggagacttgccggggagccctcatttctgaccagtgggttctgactgccgcccactgcttccgcgatggcaatgatcactctctctggagggtaaacgtaggagaccctaagagtcagtggggcaaggaatttctcatcgagaaagcagtgatttcccccgggttcgatgtgtttgctaagaagaaccaggggattcttgagttctacggagacgacattgctctccttaaattggctcaaaaggtgaagatgtcgactcatgccaggcctatttgtcttccatgcaccatggaagctaatctggctcttcgtcggccccagggttccacatgtcgggaccacgaaaatgaactgctgaacaagcagtctgtccccgcacactttgtagcacttaatggctcaaagctaaacataaatcttaaaatgggtgtggagtggacatcttgcgcagaggttgttagccaggagaagaccatgtttccaaatttaaccgatgtgagagaagttgtgacggatcaattcttgtgttcgggcactcaggaggacgagagcccgtgtaagggagagagtggcggcgccgtcttcctagagagacgcttcagattcttccaggtggggttagtgtcatggggcttgtacaatccgtgcctggggtccgccgacaaaaatagcaggaagcgtgccccgagatctaaagtgcctcctccgcgagacttccatatcaacctgttcaggatgcagccatggctgagacaacatctgggggatgtgctcaattttctcccattgtag

SEQ ID NO: 183637 - DNA, 978 bp, Artificial Sequence
  Description of Artificial Sequence: Synthetic coding sequence
atgggcacccggagcgccatcgccgccccccggatcctgtgcagcagaggtctccgctctggctcagcccgcgcaaccgggtccggagtggagaggtcccctagcgctgcaaatccaacacttatgaccagccttcgaacctggcctcttccttgggcgctcccttcaccaacgtgcctgggcccacctattccgccaaggcggcaacggatctttagcttcgagatcaacgtgtctgtagccattattacctttgcatccgaacctaaagtgttgatgagtgtcttgaacgacaatagccgcgatatgacagaggttatctctagcttggagaacgcaaactacaaggaccatgaaaacggtacgggcaccaatacctacgcagcactaaactctgtctacctcatgatgaataaccagatgaggctactcgggatggaaaccatggcctggcaggagatacgccatgccatcatcctcctgacggacggaaaatccaatatgggtggaagtccaaagaccgcggtcgaccatatacgtgaaatcttgaacatcaaccaaaagcggaacgactatctggacatctacgccatcggggtgggaaagctggacgttgactggcgcgaattgaacgaattggggtcgaagaaagatggcgaacgtcatgccttcatccttcaggacactaaggccctgcatcaagtgttcgaacacatgctcgacgtcagtaagctgaccgacactatctgtggggtcggcaatatgtctgccaatgccagcgaccaggagaggacaccctggcacgtcacaattaagccgaagagtcaagaaacttgccgcggggcacttatcagcgatcaatgggtgcttaccgccgcacactgcttccgcgatggaaatgaccatagtctgtggagggttaacgtcggagatccaaagtcccagtggggtaaggagttcctcatagagaaggcttag

SEQ ID NO: 183638 - DNA, 1863 bp, Artificial Sequence
  Description of Artificial Sequence: Synthetic coding sequence
atgggccccctgatggtgctgttctgcctgctgttcctgtaccccgctggtcactgtccgaatccagggatctctctcggggctgtcagaaccggcttccggttcggacatggtgacaaagttagataccgctgctcctctaacctggttcttactggaagttccgagcgagagtgtcagggcaacggggtgtggtcaggtaccgagcccatctgtaggcagccctactcatacgatttccctgaggatgtggcgccggccttgggaacctccttttcccacatgctgggcgccaccaatccaacacagaagaccaaggaaagtctaggaagaaagatacagattcagaggtctgggcacctgaacctctatctgctgctggactgttcccaatctgtaagtgaaaacgatttcctgatattcaaagagagcgcatctcttatggtagataggatcttttcgtttgagattaatgtaagcgtcgccatcatcacattcgcttctgagccgaaagtgcttatgtccgtgctcaacgataacagtagagatatgacggaggtgatctcaagccttgagaacgccaactataaggaccacgaaaatggaacaggaaccaatacctacgcagctctgaacagcgtgtacttgatgatgaacaaccagatgcgtctgctcgggatggaaaccatggcttggcaagaaatcagacacgccatcattctgctgacggatgggaaatctaacatgggaggatcccctaagactgccgtcgatcatatacgggaaatactcaatatcaatcagaagcgaaatgactacttggacatatatgcgatcggagttggtaagctggatgtggattggcgcgagttgaacgaacttgggtccaagaaggacggtgaacgccacgccttcatcctgcaggatactaaggccctacaccaagtctttgaacacatgctcgacgtatccaagctaacggacactatttgcggggtggggaatatgtcggccaatgcatctgatcaagaaaggaccccgtggcacgtcaccattaagcccaagtctcaagagacttgcagaggtgcacttattagcgaccaatgggtgctcaccgccgctcactgctttcgcgacggcaacgaccatagcttgtggcgcgttaacgtgggcgatcctaaaagccagtggggcaaagagtttctcatcgagaaagctgttatctcccccggctttgatgtgtttgccaagaagaatcagggcatactggaattttacggcgacgacatagccctcctcaaacttgcacagaaggtgaagatgtccacgcacgccaggcccatatgtttgccatgcacgatggaggccaatttggctctacggaggccacaaggttctacctgtagagatcacgagaacgagcttctcaacaagcagtccgtgccagcgcatttcgtggctctcaatgggagcaagctcaacattaatctcaagatgggtgtggagtggaccagctgcgctgaggttgtaagccaggagaaaacaatgttccccaacctaaccgatgtgagagaagtcgtcacggatcaatttttgtgctcaggaacccaggaggacgagtctccctgtaaaggcgaatcagggggtgcagtattcctggaacgcagatttagatttttccaagtgggcctcgtgtcttggggactgtataacccctgcctcggttccgcagacaagaacagtaggaagcgcgctcccagatcaaaggtgcctccccctcgcgactttcacattaacctttttcgaatgcagccttggcttaggcagcacttaggcgacgtgcttaactttcttccactctag

SEQ ID NO: 183639 - DNA, 1134 bp, Artificial Sequence
  Description of Artificial Sequence: Synthetic coding sequence
atgaccgaggtgatcagcagcctggagaacgccaactacaaggaccatgagaacgggacaggcactaacacatacgccgcactgaactccgtttatcttatgatgaacaaccagatgaggctgctgggcatggaaactatggcatggcaggagattaggcacgctatcatcctactcacagatggaaaatccaacatgggaggaagccccaagacagccgtagaccacatccgcgagatcctgaacatcaaccagaaacggaacgattatcttgacatctatgccatcggggtcggtaaactggatgtggactggagagagctgaatgagctcggaagcaagaaggatggcgaacggcacgcattcattttacaggatacgaaggcccttcaccaagtcttcgagcacatgttggacgtaagtaaattgaccgatacgatctgcggtgttgggaacatgagcgcgaatgcaagcgatcaagagcgaacaccgtggcatgtaaccatcaagcccaagtctcaggaaacttgtcggggcgctctgatctctgatcaatgggtactgactgcagcacattgcttcagggacggtaatgatcacagcctgtggagagtgaacgtgggcgaccccaaatcccagtggggtaaggaatttctgatcgagaaagccgtgatttcaccagggtttgatgttttcgctaaaaagaaccagggaatcctcgagttctacggagacgacatagctttgctcaaactggcacagaaggtcaaaatgtccacgcacgccaggcctatctgcctgccgtgcaccatggaagccaatttagccctccgtcggccgcagggctcaacctgccgcgaccacgaaaatgagttgttgaacaaacagtctgtgccagcacattttgtggctcttaatgggtcgaagctgaacatcaatctgaagatgggggttgaatggacctcctgtgcggaggtcgtgagtcaagagaagaccatgttccccaatctcacagatgtcagagaagttgttaccgatcagttcttgtgttccgggacacaggaggacgaatcaccctgcaaggggggctcaggtgaactcggaagcctgcaacccctaccttggctgtgttag

SEQ ID NO: 183640 - DNA, 1134 bp, Artificial Sequence
  Description of Artificial Sequence: Synthetic coding sequence
atgaccgaggtgatcagcagcctggagaacgccaactacaaggaccacgagaacggcacagggacaaacacttacgctgccttgaactcagtctacctaatgatgaacaatcagatgcgtctgctgggcatggaaacaatggcatggcaggagatcagacacgccattatcctcctaaccgatggcaaaagtaacatgggcgggtctcccaagaccgctgtggatcacatccgggagatattaaatatcaatcagaaaagaaacgattatctcgatatttacgctatcggagtaggcaagctggatgtcgattggagagaactcaacgaacttggatctaagaaggatggagagaggcatgccttcatcctccaggacacaaaggcattacatcaggtttttgaacacatgttagatgtctccaagttgacagacactatctgcggcgtcggaaatatgagcgccaatgctagtgaccaggagcgcacgccctggcacgtgacgatcaaaccaaaatcacaagaaacctgcagaggcgctctgataagcgatcagtgggttctgaccgcagcccactgctttagagacggcaacgaccattcgctgtggagagtgaatgtgggagaccccaaaagccagtggggtaaggagttcctaattgagaaagccgtcatctcccccgggttcgatgtcttcgccaaaaagaaccaggggatcttagagttctacggagatgacatcgcgcttctgaaactagcccagaaagtaaagatgagtacccacgccagacctatatgcctgccctgtaccatggaagcaaatctcgctttaagacggccacaggggagcacctgccgggatcacgaaaatgagctcctgaacaagcagtccgttccagcccactttgtggctctcaacggttctaaactgaacatcaacctgaaaatgggagtagagtggacttcctgcgccgaagtggttagtcaagaaaagacgatgttcccaaatctgacggacgttcgggaggttgtcaccgaccagtttctgtgcagcgggacccaggaagatgagtctccatgtaaaggaggaagtggtgaactcgggagcctgcagccactgccatggctgtgctag

SEQ ID NO: 183641 - DNA, 978 bp, Artificial Sequence
  Description of Artificial Sequence: Synthetic coding sequence
atgggcacccggagcgccatcgccgccccccggatcctgtgcagccgcgggctaaggtctggttccgcgcgggccaccggaagcggcgtcgaacgctcaccctcagccgctaatccaactctgatgactagcctccggacttggccacttccatgggcgctcccaagtccaacctgtcttgggccaccgataccaccgagaaggcaacgcattttttccttcgagattaatgtttctgttgccatcatcacattcgcttctgaaccaaaggttttgatgagcgttctgaatgacaacagtcgcgacatgacagaagtgatcagctccctggaaaacgctaactacaaggaccatgaaaacgggacaggaactaatacctacgccgcattaaactcagtgtacttaatgatgaacaaccaaatgagactgctgggtatggagaccatggcctggcaggagatccgtcacgccattattctcttaaccgacggaaaaagcaatatggggggatcccctaagaccgcagtggaccacattagagaaattctgaatatcaaccagaaacgcaacgactacctggacatttatgccatcggcgtcgggaaattggacgtcgactggcgtgagctcaatgaactgggctctaagaaggacggagaaagacacgcgtttattctgcaagatacaaaggcactccatcaggtgtttgaacacatgctagacgtgtctaaactgactgacaccatctgtggcgtgggtaatatgtccgcaaatgccagtgatcaggagagaactccttggcacgttaccattaaacccaagagccaggagacctgccgtggggccctcatatctgaccaatgggtgcttacggccgctcactgcttcagggatggaaatgatcactcgctatggagggtaaatgtcggcgatccgaaaagccagtgggggaaggaatttctgatagagaaggcgtag

SEQ ID NO: 183642 - DNA, 1134 bp, Artificial Sequence
  Description of Artificial Sequence: Synthetic coding sequence
atgaccgaggtgatcagcagcctggagaacgccaactacaaggaccatgagaacggaactggcactaatacatacgccgccctcaactcagtgtatttgatgatgaataatcaaatgcgtctgctgggaatggaaaccatggcctggcaggaaatccgccacgcgatcatattgcttacagacggaaaatccaatatgggagggtcccccaagaccgcggtggatcatatccgagagatccttaacatcaaccagaaacgcaacgactatttggacatctatgccataggggtgggcaaactggacgttgattggagggagctgaatgagcttgggtctaaaaaggatggcgaaagacacgccttcattttgcaggatacaaaggcattgcatcaagtcttcgagcatatgcttgacgtctccaagcttacagatacgatttgcggcgtgggtaacatgtccgcaaacgccagtgaccaagaaaggacaccttggcacgtcaccattaagccaaagagtcaggaaacttgccggggggctcttatcagcgaccagtgggtgttaacagcagcccactgctttcgggacggcaacgatcattctctatggagagtgaacgtgggggaccccaagtcccaatgggggaaggaattcctcatagagaaggccgtgatctccccaggatttgacgtgtttgctaagaaaaatcagggtatcctcgagttctacggtgacgacatcgcgctgctgaagcttgctcagaaggtcaagatgtccactcacgctcgccctatttgcctgccttgcaccatggaggccaatttagctctgcgcaggccacagggcagtacttgcagagatcatgagaacgagctgctgaataagcagtcagttcccgcacactttgtcgccctgaacggctcaaaactaaacatcaacttgaagatgggggtcgagtggacatcctgcgccgaggttgtgagccaagagaagaccatgttccctaacttgactgatgtgagagaggttgtaaccgatcagtttctgtgttctggaacacaagaggacgagagcccgtgcaaaggagggagcggagagctgggatcactgcaacccttgccttggctctgctag

SEQ ID NO: 183643 - DNA, 1617 bp, Artificial Sequence
  Description of Artificial Sequence: Synthetic coding sequence
atgcgggccctgtgcatccgggagacctgcagcagcgagctgggcttttcacgcaattggagccgccgcaaagccggccactgcccaaaccctgggatttctcttggcgctgtcaggacagggttccgctttggccatggggataaggtaagatatcgatgcagttcaaatctcgtactgacagggtcaagcgaacgcgaatgccagggaaatggtgtgtggagcgggacagaaccgatctgcaggcagccgtattcctacgatttccccgaggatgtggccccagctctgggtacttcctttagccatatgcttggcgcaacgaacccaacgcagaagaccaaggaccacgagaatggaacggggacgaatacgtacgccgctttaaattctgtctacctcatgatgaacaaccagatgcgattactcggaatggagaccatggcctggcaagaaattcgccacgctattatactcctgaccgacggcaaatccaatatgggtggatctccaaagacggcggttgatcatattagggagattctgaatatcaaccagaaacgcaatgactatttagatatttacgcaatcggggtcggcaagctagatgtcgactggagagagctgaatgagctcggttccaaaaaggatggtgagcgccacgccttcatactgcaggacaccaaggctttacaccaggtcttcgaacatatgttagatgtgtctaagcttaccgacaccatctgtggagtgggaaacatgtccgccaacgccagtgatcaggaaagaacaccatggcacgtaactatcaagccgaaatcacaagaaacttgtcggggtgcactgatttcagatcagtgggtacttacggccgcgcactgttttcgggatggcaacgaccattcactttggcgagtcaacgtgggtgacccaaagagtcagtgggggaaggagtttttgattgagaaggccgttatctcgccaggttttgatgtgttcgctaagaagaaccagggaattctcgaattttatggcgacgacatagcactgctcaaacttgcccagaaagtcaagatgtccacccacgccaggccgatatgcctgccctgcacgatggaagccaacctcgccttgaggcgcccacagggatctacatgcagagatcacgaaaacgaattgcttaataaacaaagtgtgcccgcgcactttgtcgctctgaacggctcaaaacttaacatcaaccttaaaatgggcgtggaatggacatcatgcgccgaagtggtatcacaagagaaaaccatgtttccaaatctgacagatgttagagaagtcgttacagaccagtttctctgcagcggcacgcaggaggatgaaagtccatgtaagggagagtctgggggggcagttttcctggagcggaggtttaggttttttcaggtgggcctggtgagctggggactgtataatccctgtttaggctccgccgataagaatagcaggaagagggcgccacgtagcaaagttccccccccccgggactttcatattaatctgtttcgcatgcagccctggctgagacagcatctcggggacgtgcttaattttttacccttgtag

SEQ ID NO: 183644 - DNA, 1863 bp, Artificial Sequence
  Description of Artificial Sequence: Synthetic coding sequence
atgggccccctgatggtgctgttctgcctgctgttcctgtaccccgccggccattgccctaaccctgggatatcccttggagccgtgagaaccggtttccggttcgggcacggggataaggtgcggtatagatgcagttcgaatctagtgcttacaggatcctcagagcgagagtgccaggggaatggcgtgtggagtgggacagaacccatttgtaggcagccctatagttacgatttccccgaggacgtggctccagccttaggaactagcttctctcacatgttgggcgccaccaacccaactcaaaagactaaagagagcttagggcgcaagattcaaatacaaaggtctgggcacctgaacttgtaccttctactggactgctcccagagtgtatccgagaatgatttccttatcttcaaggaatccgcttctctgatggtcgatcggattttttcctttgaaattaacgtgtctgtagcaatcattacattcgcatctgagcctaaggtcctgatgtctgttttgaacgacaattctcgtgatatgacggaagtgattagcagcctagagaatgccaattacaaagaccacgaaaatggcaccgggaccaacacttacgccgcactgaacagtgtctatctcatgatgaataatcaaatgcggttgctcggcatggaaaccatggcctggcaggaaattcgacacgctattattctactcacagacggtaaatccaatatgggcgggtcccccaagactgcagtcgaccatataagggaaatactaaatataaatcagaagcgcaacgactacctggatatctacgcaatcggagttggtaagctcgacgtggactggcgtgaactgaacgaactcggaagtaagaaggatggcgagagacatgcatttatcttgcaggacacgaaggcacttcatcaggtgtttgaacatatgctggacgttagcaaactgactgacacaatttgtggggtaggtaatatgagcgccaacgcctccgaccaagagcgtacaccttggcatgtgacaatcaagcctaagagccaggaaacctgtcgtggggctctaatcagcgatcagtgggttttgaccgccgctcactgtttcagggacggtaatgaccattctctctggagggtgaatgtgggggacccaaagagtcagtgggggaaagaattcttgatagagaaagctgtaatctcacccggcttcgacgtgtttgccaagaagaatcagggtattcttgagttttacggagacgatatagcccttctgaagctggctcaaaaggttaagatgtcaacccatgctagacccatctgcttgccctgcaccatggaggccaacctcgccctgagaaggccccaaggaagcacctgcagggaccacgaaaacgagctactgaataagcagtcagtgcctgcacacttcgtggccctcaacgggtccaagctgaatatcaatctgaaaatgggcgtggaatggaccagctgcgctgaggttgtgtctcaggagaagacaatgtttcctaacctgacagatgtcagggaagtggtgaccgatcaattcctgtgtagtggaacacaagaagatgaatcaccttgcaagggagaatccggcggcgcagtgtttttggagaggcgattccgcttctttcaagtggggctggtgagctggggactgtataatccttgcttaggctcagccgataaaaactcacgtaaacgggcgcctcgatcaaaagtaccccctccccgcgacttccacataaatctgttccggatgcaaccttggctcagacagcatctcggcgatgtgctgaattttctgcccctgtag

SEQ ID NO: 183645 - DNA, 1863 bp, Artificial Sequence
  Description of Artificial Sequence: Synthetic coding sequence
atgggccccctgatggtgctgttctgcctgctgttcctgtaccccgcaggccactgcccaaatcctggcatctccctaggcgccgttagaacagggtttcgcttcggacatggggataaggtcagatataggtgctccagcaatctggtgctgacaggatcatcagaaagggaatgccagggcaatggcgtctggtctggcacagaaccaatttgcagacagccttattcttatgattttcccgaagatgtagcccctgctctcggcaccagcttctcccacatgctgggagctaccaacccgacccagaagactaaagagtccctggggcgtaaaattcagatccaacgaagcgggcaccttaacctgtaccttttgctggactgttcgcagagtgtgtccgagaatgatttcctaatcttcaaggaatcagcctccttgatggtagaccgtatctttagctttgagatcaacgtgtcagtggcaatcattacctttgcgtccgagcctaaagtgctgatgagcgtgctgaatgacaactcgcgcgatatgacagaagttatttctagtctggagaatgccaactataaagatcatgaaaacggaactggaacaaacacctacgctgcgcttaatagcgtttatctcatgatgaataaccagatgcggctgctcggtatggaaaccatggcgtggcaggagatcaggcacgcaatcatactgcttaccgacggcaaatcaaacatgggagggagtccaaagaccgccgttgatcacatacgagaaatcctcaatatcaatcagaagcgaaatgactacctcgatatctacgctataggcgttggtaaactcgacgtggactggagggagctgaacgagctggggtctaagaaagatggggagcggcacgcttttatacttcaggacaccaaagcgctgcaccaggtgtttgaacatatgttggatgttagtaagctgaccgacactatttgcggcgttggcaacatgagtgccaatgctagtgatcaggaaagaaccccttggcacgttacaatcaagcctaaaagccaggagacctgtcggggggcactcatttcggaccagtgggtgttaaccgctgctcactgcttccgcgacggaaatgatcactccctgtggagggtgaacgttggggatcctaagagtcagtggggaaaagagtttctgattgagaaggcagtgattagccctggttttgacgtgtttgccaagaaaaatcaagggatcctagaattttatggagatgatatagccctgcttaagctggctcaaaaagtgaagatgtcgacccacgctagacctatttgcttgccttgtacaatggaggcgaatcttgcactgcggaggcctcaggggagcacctgtagagaccacgagaacgaactgttgaacaagcaaagcgtgcccgctcactttgtggcattgaacgggtcgaagctgaacattaatctgaagatgggagtagagtggacatcttgtgccgaggtggtgagccaggagaagaccatgttcccaaacttgactgatgtacgcgaggtagttacagatcaattcctctgttccggtacacaggaggatgaatcaccatgcaaaggggagtcagggggtgccgtgtttttggaacgcaggttccgattttttcaggttggtttagtgtcttgggggttgtataacccatgccttgggtccgccgataagaactctcgtaagcgggccccgcgttcgaaggtacctcctcctagagactttcacattaacctttttaggatgcagccgtggttgcggcagcatctaggcgacgtcttgaatttcctgcccttgtag

SEQ ID NO: 183646 - DNA, 1863 bp, Artificial Sequence
  Description of Artificial Sequence: Synthetic coding sequence
atgggccccctgatggtgctgttctgcctgctgttcctgtaccccgctggtcattgtccgaacccaggtattagtctcggcgctgtcaggactggttttagattcgggcacggagataaggtcaggtacaggtgcagctccaacctcgtcctcaccggatccagcgaacgcgaatgccagggcaatggagtgtggagcggaaccgaaccaatatgtagacaaccatattcttacgattttccagaggacgtcgctcctgcactaggaaccagcttctctcatatgctcggggcgaccaaccctacccagaagaccaaggagagcctgggccgcaagatccagattcagcgaagcgggcatctgaacctgtacctcctgttggactgctcccagtctgtgagtgaaaacgatttccttatctttaaggaatcagcctctcttatggtggatcgcatcttttcttttgagattaatgtgagtgtggcaattatcacctttgcctcggaacccaaagtccttatgtctgtgctgaacgacaacagtagagatatgaccgaggtgataagttccttagagaatgcgaattataaggaccatgagaacgggaccggaaccaatacttatgctgccctgaacagcgtctatctgatgatgaacaaccagatgcgactcttgggtatggagaccatggcttggcaggagattcgtcatgcgatcatactgttgaccgacggcaagagtaacatgggcggcagccccaagaccgctgtggaccacattagggagatcctcaatatcaatcagaagagaaacgactatctggatatctatgccattggtgttggcaagctggatgtagactggcgagagctgaacgaactaggtagtaagaaggacggcgaacggcacgcgttcatccttcaagatacaaaagctctgcatcaagtcttcgaacacatgttggatgtctcaaaacttactgacaccatatgtggtgttggaaacatgtccgccaatgcatccgaccaagagaggacgccctggcacgtaactataaaaccaaaaagccaggaaacctgtaggggcgccctgatctcagaccagtgggtgctcactgccgcacattgttttagggacggtaacgaccactctctgtggagagttaacgtgggagatcccaaaagccaatggggtaaggaattcctcattgagaaggcagtgatctcgcccggattcgatgtcttcgctaagaaaaatcaggggatcctggaattttacggagacgacatagcactcctaaaactagcccagaaggtcaaaatgagcacccatgcccgaccaatctgcttaccatgtactatggaagccaatctggcactgagacggcctcaggggagtacctgtagagaccatgaaaacgagctgctgaacaaacagagtgtgccagcgcacttcgtcgctctcaacggcagtaaattaaacatcaatctgaaaatgggcgtggaatggacctcatgcgccgaagtggtgtcccaggaaaaaacaatgtttccgaacctaactgatgtcagagaggtggtcacagatcagtttctctgtagtgggacacaggaggacgagtctccttgtaaaggtgagtccggcggcgctgtgttcctggagaggcggtttcgcttcttccaggttgggctggtgtcttggggcctgtacaatccctgtttgggctcagccgataaaaattcacgcaagcgcgcaccccgtagtaaggtgccccccccgcgggacttccatattaatctgttccgtatgcagccatggctcagacaacacttgggcgacgttctgaacttcttaccactctag

SEQ ID NO: 183647 - DNA, 978 bp, Artificial Sequence
  Description of Artificial Sequence: Synthetic coding sequence
atgggcacccggagcgccatcgccgccccccggatcctgtgcagcaggggcctcagatctggatccgcgagggccacaggttctggcgtcgaaagaagcccctccgcggccaaccctactttgatgactagcttgcggacttggccccttccatgggctctccccagcccaacctgcctgggtccgcctattccacctcggaggcagagaatattcagctttgagattaacgtgagcgtggcgatcataacctttgcctctgaaccaaaagtgctcatgtcagtcctgaatgataattcccgtgatatgactgaggttatcagcagccttgaaaatgctaattataaggatcatgagaatgggactggcaccaatacgtacgctgccctcaactctgtgtaccttatgatgaataaccagatgaggctcctcggcatggaaaccatggcctggcaggagatccgacatgctattatcctgctgacagatggtaagagcaatatgggggggagcccgaagacagcggtcgaccacattcgggagattttaaacattaatcagaaacgaaatgactaccttgacatctacgccattggagtaggcaagctagacgtggactggcgcgagctgaatgagctaggttccaaaaaggatggagagcgccacgctttcatcctacaagataccaaagccctgcaccaagtattcgaacacatgctcgacgtgagtaagctcacagacaccatctgtggtgtcgggaacatgtctgctaacgcatcagatcaagaaagaaccccgtggcacgtgacaattaaacctaaaagccaggaaacatgccgcggggctctaatcagtgatcagtgggtactcacagcggctcattgttttagagacggcaacgatcattcattgtggagagttaacgtgggcgatcccaagtctcagtgggggaaagagtttcttatagagaaggcatag

SEQ ID NO: 183648 - DNA, 1134 bp, Artificial Sequence
  Description of Artificial Sequence: Synthetic coding sequence
atgaccgaggtgatcagcagcctggagaacgccaactacaaggaccacgaaaatggaacagggactaatacgtacgccgctttaaacagcgtctacctcatgatgaataatcagatgcggctgttgggcatggaaactatggcctggcaggagattcgacacgctatcatcctgttgaccgatgggaaatccaatatggggggtagtcctaaaaccgcagtggaccatatcagggaaattcttaacattaatcaaaagcggaacgactaccttgatatctacgccatcggcgtgggaaagctggacgtagactggcgtgaactaaacgagttaggttccaagaaggacggagaaaggcatgcctttatcctgcaggataccaaagccctccaccaggtgttcgaacacatgttagacgtaagtaagttaacagacacaatctgtggggtcgggaacatgtccgctaacgccagcgatcaagaaagaacgccctggcacgtgacaatcaagcccaagtcgcaggaaacctgtcggggagctctgataagtgatcagtgggtgctgaccgccgctcactgcttccgggacggcaacgaccacagtctgtggcgggttaatgtgggagaccctaaatcccaatggggcaaggagtttctcatcgagaaggccgtgatatccccgggctttgacgtgttcgccaagaagaaccaagggattctggagttctacggagatgacattgccctcctgaagttggcgcagaaagttaagatgtctacacacgccaggcccatttgcctgccatgcacaatggaagccaacttagcgctcagacgtcctcagggctccacttgcagagaccacgaaaacgagctgctgaataagcagtctgtacctgcacattttgtggcactgaatggttcaaagctaaatatcaaccttaagatgggggtcgagtggacatcttgtgccgaggtcgtttcacaagagaagactatgttccccaatcttactgatgttcgcgaggttgtcactgaccagtttctgtgctcaggcacacaggaggatgagtccccctgcaaaggcggtagcggcgagttgggctctctgcagccgttgccatggctgtgctag

SEQ ID NO: 183649 - DNA, 1617 bp, Artificial Sequence
  Description of Artificial Sequence: Synthetic coding sequence
atgcgggccctgtgcatccgggagacctgcagcagcgagctgggctttagcagaaattggtcacgacgaaaagcaggtcactgccctaatcccggcatcagtctcggcgctgtgagaactggcttcaggttcgggcacggtgataaagtcagataccggtgcagtagcaatttggtactaaccgggagctcagaacgcgagtgccagggcaatggcgtatggtccggcacagagcccatttgtaggcagccctacagctatgatttcccagaagacgttgccccggccctcggcacttcatttagccacatgctcggagccaccaacccaacccaaaagactaaggatcatgagaatggtacaggcactaatacatacgcagccctcaattcagtgtatctgatgatgaacaatcagatgagactactaggcatggaaaccatggcctggcaggagattagacatgcgatcatcctactgactgatggcaagagcaacatggggggaagtccaaagactgcagtagatcacatcagagagatcctgaacattaaccagaagcgtaacgattatctggacatctacgccatcggcgtgggaaagcttgatgtggactggcgagaattgaatgagctaggctctaaaaaagatggtgaacgccatgcatttattcttcaggatacgaaagccctccaccaggtgttcgagcacatgcttgatgtgtcaaagctgacggataccatttgtggagtcggcaatatgagtgccaatgctagcgaccaggaacggacgccctggcatgtgacaataaagcctaagtctcaggagacttgtcgaggagccctcatctcagaccagtgggttctaaccgccgcacattgttttcgggatggcaacgatcacagtctttggcgggtaaatgtgggcgaccctaaaagtcaatgggggaaagaatttttgatagaaaaggcagtgatttctcccgggttcgatgtatttgccaagaaaaaccagggcatactagagttttacggagacgacattgccctgctgaaactagcccaaaaggtcaagatgtccacccacgcacgccctatctgtcttccatgcacgatggaggccaatctcgcattacgccggccccaaggcagtacttgcagggatcacgagaatgaacttctgaataagcagtctgtgcctgcacactttgtggcccttaatggctccaagttaaacatcaatcttaagatgggtgtggaatggaccagttgcgcagaagtggtcagccaggaaaagactatgtttccaaatttaacagacgtgcgcgaagtggtgactgatcagtttctgtgctccgggacgcaggaagatgagagcccatgcaaaggagagtcaggtggcgctgtgttcctggagcggcgcttccgtttctttcaggtcggactcgtgtcctgggggctgtataacccctgtctgggcagtgccgacaaaaatagcaggaagagggccccgcgatccaaagtgcccccccccagagactttcacattaatctgttcaggatgcaaccgtggttacggcaacacctcggggacgttctgaattttctgcccctgtag

SEQ ID NO: 183650 - DNA, 1617 bp, Artificial Sequence
  Description of Artificial Sequence: Synthetic coding sequence
atgcgggccctgtgcatccgggagacctgcagcagcgagctgggcttctctcgcaattggtcccgtcgaaaagctggacattgcccaaacccaggcatcagtctcggggctgtgcgtaccggcttcaggttcggtcacggagacaaagtgaggtaccggtgttcatctaacctggtcttaacaggctcctctgaacgcgaatgccaaggaaatggggtttggagcggaaccgaacccatctgcaggcagccatactcctatgacttccctgaggatgtggcacctgccttggggacttcgtttagccacatgcttggggctacaaacccaactcaaaagacaaaggatcacgagaacggtactggaacaaatacgtatgccgccctaaatagcgtctacctaatgatgaataaccagatgcggctcctagggatggagacgatggcctggcaggagattcgccacgccatcattctgcttaccgatggaaaatccaatatgggaggtagccctaagacggcagtggatcacattcgggaaatcctgaacatcaaccagaagagaaacgactacctggatatttacgctataggggttggcaaactggacgttgattggcgcgaactaaacgaactgggctcgaagaaggatggagagcgccatgcattcatactccaggacacaaaggccctgcaccaggtcttcgagcacatgttggacgtgtctaaactgaccgataccatttgtggggtaggtaacatgtctgccaacgcatcggaccaggagcgcaccccttggcatgtgactattaagccgaaatcccaggaaacatgccgaggggccctgatttccgaccaatgggttctcaccgccgctcattgcttccgagacggcaacgaccattccttatggagagtgaacgtcggtgatccaaagtctcagtggggcaaggagttcttaattgaaaaagctgtaatctcgccaggattcgacgtttttgccaagaagaaccagggcattctggagttttatggagatgatattgccctgcttaagctcgcccagaaagttaaaatgtcgacccacgcaaggccgatctgcttaccatgtaccatggaggcaaacttggctttgcggcgccctcaggggtcaacttgtagagatcacgaaaacgagttattaaacaaacaatcggtgcccgcccacttcgtggctctcaatggatccaagctgaacatcaacctgaaaatgggagtggagtggactagctgcgctgaagttgtgtctcaggaaaaaactatgttcccgaaccttacagacgtcagagaggtcgtgactgaccagttcctgtgcagtggcacacaggaggatgagtctccttgtaagggcgagagcgggggcgccgtgtttctggaaagacgcttccggttttttcaagtcggccttgtgagctggggtctttataatccctgtctgggttcagccgacaagaattctcgtaagcgcgcgccccgctctaaagtgcctcctcctcgtgacttccacattaacttgtttagaatgcagccgtggcttaggcaacacctgggcgacgtgctgaactttttgcctttgtag

SEQ ID NO: 183651 - DNA, 4992 bp, Artificial Sequence
  Description of Artificial Sequence: Synthetic coding sequence
atgggccccaccagcggccccagcctgctgctgctgctgctgacccacctccccttagcccttggttctcccatgtactctattattactcctaacatcctcagactggagtcggaggaaacaatggtcctggaagctcatgacgctcaaggagatgtgccagttacggtgacagtccatgattttcccggcaagaaattggtgcttagctcagaaaagactgttctgacacctgctacaaatcatatgggtaacgtgacgttcactataccggcaaatcgggagtttaagtcggaaaagggccggaacaagtttgtgaccgtccaagctactttcggcacacaagtggtggaaaaagtggtgctggtttcactgcagagcggctacctgttcatacagacggataagactatttacaccccaggctctacagtactatatcggatattcacagtcaaccacaagctgttaccagtgggacgcaccgtgatggtcaatattgagaacccagagggcatacctgttaagcaggattccttgtcttcccagaatcagctgggggttctccctttgagctgggatatcccggagctggtgaacatgggccagtggaagatcagagcatactatgaaaactccccacagcaggtgtttagcaccgagtttgaggtgaaggaatacgtgctcccctcattcgaagtcattgtggaacctactgagaaattctattatatttacaacgaaaaaggcctagaggttaccatcactgcgaggttcctgtatggtaaaaaggtggagggtactgcgtttgtgatttttggcattcaagatggggaacagcgtatatccctgccagagagcctgaaacggatacccatcgaggacggaagtggagaggttgtgctgtccaggaaagtacttttggacggtgtccagaatccaagggcagaagacctggtagggaagtcattgtatgtgagtgccaccgttatcctgcattctgggtctgacatggtccaagccgagaggtccggaatacctattgtgacgagtccatatcaaattcacttcaccaagaccccgaagtattttaaacccgggatgcccttcgatttaatggtatttgttacaaatcccgacggaagtcccgcctacagggtgccagtcgccgtgcaaggagaggacaccgtgcaatccctgacacagggcgacggcgtggccaaactgagcataaacacccacccttcccagaagcctctgtcgataacggtacggaccaagaagcaggagctaagcgaagccgagcaggcaacaaggacgatgcaagccctaccctactccactgtggggaactctaataactacctacacttatccgtcctgcggacagaactcaggcctggcgagactttgaacgtcaattttttgctccgtatggatcgggctcatgaagccaagattagatactacacatacctgataatgaataaggggagacttctaaaggctggcaggcaagtgagggaaccaggacaggacctcgtagtcctccctctgtcaataaccaccgactttatcccttcttttcgtctggtggcatactacaccctgataggggcctccggacagagggaagtggtggccgattctgtatgggttgatgtcaaggactcctgcgtggggtctcttgttgtgaaatccggccagtcagaggaccgtcagcctgtgcccggtcagcagatgactctcaaaatcgaaggcgaccacggggctcgggtggtgctggtggctgtggataagggagtttttgtgttaaacaaaaaaaacaaattgactcagtcaaagatttgggatgttgttgaaaaggccgacataggttgcacaccaggaagcggaaaagattacgccggcgttttcagtgatgcgggacttaccttcacctctagtagtgggcagcaaacggctcagagggccgagctgcagtgccctcagccagctgctcggaggaggagatccgtgcagctgacagaaaaacggatggataaggttggaaagtacccaaaggagttgcgaaagtgttgtgaggacggcatgcgggagaaccctatgcggttttcttgtcagcgcaggacccgctttatatcccttggcgaggcttgcaagaaagtgttcctggattgctgcaattatatcacagaactcaggcggcaacacgctcgtgccagtcatcttgggctagcccgatctaacttagacgaagacatcatcgctgaggaaaacatcgtctcccggagcgaattccctgagtcttggctgtggaacgtcgaggacctcaaggagccgccgaagaacggaattagcaccaagctgatgaatattttcctgaaggactctataactacttgggagatcctggccgtgtccatgtccgacaagaaaggcatctgtgtggccgacccctttgaagtgaccgttatgcaggatttttttatcgatctccggctgccatacagtgttgtcaggaacgagcaagttgagattcgcgcagtgctgtacaactatcgtcagaaccaggaactgaaagtccgcgtcgaactattgcataaccccgccttctgtagcctggctacgactaagagacgacaccagcagaccgttaccatacccccaaagtcctctctgtccgttccttatgtgatcgtgcctttaaaaactgggcttcaggaggtcgaagtgaaggccgccgtgtaccatcattttatatccgatggggtgaggaaatccttgaaggtcgttccggagggcatccggatgaacaagaccgtggccgtgcggaccctagaccctgaacggctgggccgcgagggtgtacaaaaggaggatatcccgccagcagatctgtcggatcaagttcctgacaccgagagtgagactcggatcctcctccaaggtacaccagtcgcccagatgactgaagacgctgtagacgccgagcgcctcaagcacctaatcgtcacaccaagcggttgcggggaacagaacatgattggtatgaccccaaccgtcattgctgtccattatctcgatgaaacagaacaatgggagaaattcggactggagaaaagacaaggagcactcgaactgataaaaaaaggctatacccagcaactggccttccggcagccttcctcagcctttgcagccttcgttaagcgagctccctccacttggctgacggcatacgtggtgaaggtcttctctttagctgtcaacctcatcgccatcgattctcaggtcttatgtggcgccgttaaatggctcatcctggaaaagcagaaaccagacggcgtctttcaggaggatgcccccgttattcaccaagagatgataggcggtctgcggaacaacaatgagaaggatatggctttgaccgccttcgttcttatctcattacaggaagccaaggatatctgtgaggagcaggtgaattcgctcccaggcagcataacgaaggccggcgatttcctcgaagcaaattacatgaaccttcaacgctcctacacagtcgccatcgccggctacgcactagcccagatgggcaggctgaaaggccccctgctcaacaagttcctgaccaccgctaaggataaaaatcggtgggaagaccccggaaaacagttatataatgtcgaagcgactagctatgcactcctcgctcttttgcagctgaaggacttcgacttcgtcccaccagttgtaaggtggttaaatgagcaacgatactatggcggaggctacggctccacacaagcaacatttatggtattccaagccttggcacagtaccagaaggatgctcctgaccaccaggagctgaacctggacgtcagtctgcagctcccatctagaagtagcaagattacacatagaatacactgggagagcgcatcactgcttcggagcgaagagacaaaggagaatgagggatttactgtcaccgccgagggaaaagggcaggggaccctgagtgtggtcacaatgtaccacgctaaggctaaggatcaattaacctgcaataagtttgaccttaaggtaacaatcaagcccgccccggaaaccgaaaagcgcccccaagatgccaagaacaccatgattctcgagatctgtacaagataccggggcgatcaggatgccactatgtccattcttgacatttccatgatgaccggttttgcacccgacacagacgatctgaagcagcttgcaaatggcgtggacaggtacatttctaagtacgagctggataaggcgttttctgacagaaacacgttgatcatctatcttgataaagtgagccactcggaagatgactgcctggcatttaaggtgcaccagtacttcaatgtggagcttatccaacccggagccgtcaaggtttacgcttactataatctggaagaaagctgcaccaggttttatcacccggaaaaggaagatggaaaactgaataagctgtgcagggacgaactgtgcagatgtgccgaagagaattgcttcatccaaaaaagtgatgataaggtgactctggaagagagattggacaaggcttgcgaaccgggggtggattacgtttataaaacccgactggtaaaagtgcaactgtcaaatgactttgacgagtatatcatggccatcgagcagactataaaatctgggtctgacgaggtacaggtggggcagcagcgcacatttattagccccatcaagtgtagggaagctcttaagctcgaagaaaagaagcactacctcatgtgggggctcagctcagacttttggggtgagaaaccaaatctgagttacatcatcggcaaagatacgtgggtggagcattggccagaagaggacgagtgtcaggatgaggagaatcagaaacaatgtcaggacctgggcgcatttactgagtctatggtggtgtttgggtgtccaaactag

SEQ ID NO: 183652 - DNA, 1794 bp, Artificial Sequence
  Description of Artificial Sequence: Synthetic coding sequence
atgcacccccccaagacccccagcggcgccctgcaccggaagcggaagatggctgcctggcccttcagtcggctctggaaggtgtccgatcccatcctgttccagatgacattaatcgctgccttgctccccgctgttctcggcaattgtggccccccacctacccttagctttgctgcccccatggatataacactgactgagacccgctttaagacaggaaccaccttaaagtacacttgtctgcccggctacgtgcgcagtcattcaacccagactctcacctgtaactctgatggagaatgggtttacaacacgttctgtatctataagcgctgcagacatcccggagagcttagaaacggccaggtcgagatcaaaacagacctgtccttcggatctcagatagaattttcatgttcggagggcttcttcctgataggcagtacaacgtctcgttgcgaggtgcaggacagaggagtcggctggtcccaccctctcccacagtgtgagattgttaagtgcaaaccccccccagatatccgaaacggccgtcactcaggcgaggaaaatttctatgcatatgggttttctgtgacatactcttgcgaccctaggttctcattgctgggacacgcctctatatcctgcactgtcgaaaacgagacaattggtgtctggcggcctagcccaccaacgtgtgagaaaataacgtgtcggaagccagacgtgagccacggggagatggtgtccggctttggaccaatttacaattataaagatacaatcgtgttcaagtgtcagaaggggtttgtgcttagagggtcatctgtgatccactgcgatgcagactcaaaatggaacccttcacctcctgcatgtgagcctaattcctgcatcaatttaccggatatacctcatgcctcttgggaaacgtaccccagacctacgaaagaggatgtttacgtggtaggcacggtgctgcgctaccggtgtcacccaggttacaaaccaacaaccgacgagcctaccactgttatttgtcaaaagaacctcaggtggaccccataccagggctgtgaggccctttgctgcccagagcccaaactcaacaatggagaaataacgcagcatagaaaatcccgacctgcaaaccactgtgtgtacttttacggtgacgagatttctttctcatgtcacgagacctcgcgattctccgctatctgccagggcgatggaacttggtcccctcggacccctagctgcggggacatttgcaactttcccccaaaaattgctcacggtcactacaaacagtcgtcatcctatagcttcttcaaagaagaaattatttacgagtgcgataaagggtatattcttgtaggtcaggctaagctcagttgcagctattcccactggtctgcccccgcgccccaatgtaaggcactgtgtcgaaagccggagctcgtaaatggccgtctgtccgtggacaaggaccagtatgtggagccagagaatgttaccattcagtgcgactcagggtacggtgtcgtgggtccccaatctattacctgttccggcaataggacctggtaccccgaagtgcccaagtgcgagtgggaaacccctgaagggtgcgaacaggtccttaccggtaaaaggctgatgcaatgcctaccaaaccctgaggacgtaaagatggcccttgaggtgtataaactaagcttggaaatcgaacagctggagctgcagagagacagcgctcgacaaagcacccttgataaagaactatag

SEQ ID NO: 183653 - DNA, 459 bp, Artificial Sequence
  Description of Artificial Sequence: Synthetic coding sequence
atgcacccccccaagacccccagcggcgccctgcaccggaagcggaagatggctgcctggcccttttctcggctgtggaaagtgagcgaccctattctgttccagatgaccctgatcgccgctctgctcccagcagtattgggcaattgcgggcccccccctactctatcctttgccgctccgatggatatcactctaactgagacacgattcaagaccggaacgacactgaagtacacctgtctgcctgggtacgtgaggtcccatagcactcaaaccctcacctgcaattcagacggtgagtgggtatataatacattctgtatatacaagagatgcagacatcccggtgaattgcgcaacggtcaggtggaaattaagactgatttgagtttcggttcgcagatagagttttcgtgttccgaaggtttctttctcatcggcagcactacctcatag

SEQ ID NO: 183654 - DNA, 759 bp, Artificial Sequence
  Description of Artificial Sequence: Synthetic coding sequence
atgttcttctggtgcgcctgctgcctgatggtggcctggcgggtgagcgcctcagacgctgaacactgtcctgagttgcctcccgtagacaattcgatcttcgtggccaaggaagtggaaggtcaaatcttgggcacatatgtgtgtatcaaaggataccacctagtcgggaagaagacactgttttgtaacgcctccaaggagtgggacaacaccacaaccgaatgcagattgggccactgtccagatcctgtcctcgtgaatggtgagttctcgtctagtggacccgtgaatgtctcggataagatcacattcatgtgcaacgatcattacatcctgaagggctcaaaccgtagccagtgcctggaggaccacacgtgggctcctccattcccgatctgcaaatcccgagattgtgatccgcctggaaatccagtgcatggctattttgagggaaacaatttcactctgggctccaccatctcctattattgcgaagatagatactatctggttggtgtgcaggagcaacagtgtgtggatggcgaatggagcagtgcactgcccgtctgtaaactgatccaggaggcgcctaaacctgaatgcgaaaaggcactcctggcattccaggaaagcaaaaacctgtgcgaggcaatggaaaattttatgcagcaactaaaggagagtggaatgactatggaggagctcaaatacagcttggaactgaaaaaagctgaactgaaagcgaagctgctctag

SEQ ID NO: 183655 - DNA, 756 bp, Artificial Sequence
  Description of Artificial Sequence: Synthetic coding sequence
atgttcttctggtgcgcctgctgcctgatggtggcctggcgggtgtccgccagtgacgagcactgccctgagcttcctcctgtggataatagtatcttcgtagctaaggaagtcgagggacagatccttggaacctacgtttgcattaagggctatcatctggtcggtaagaaaacccttttttgtaatgccagcaaggaatgggataacacaaccactgagtgtcgactggggcattgccctgatcccgtcctcgtgaatggcgaattttcaagcagcggccctgtgaacgtgagcgataaaattacgttcatgtgcaacgaccactatatcttgaaaggttcgaacaggtctcagtgtttggaagatcacacgtgggcgcctcctttccctatttgcaaaagccgggactgtgatccccccggaaacccagtgcacggctacttcgaaggaaacaacttcacgcttgggagcacaatcagttattattgtgaagatagatactacttagtcggtgtgcaggagcaacagtgtgtggatggggaatggtcttcagcccttcccgtgtgcaagctgattcaagaagcaccaaagccggagtgtgaaaaagccctactggccttccaggagtcaaagaatctgtgcgaggcgatggaaaactttatgcagcagctgaaagagtctgggatgaccatggaggaactgaaatactccctggaactgaagaaggcagagctgaaagccaaactgctgtag

SEQ ID NO: 183656 - DNA, 759 bp, Artificial Sequence
  Description of Artificial Sequence: Synthetic coding sequence
atgttcttctggtgcgcctgctgcctgatggtggcctggcgggtgtcagcctcagacgcggagcactgccctgaactcccccctgttgataatagcatcttcgtggctaaggaggtcgagggccagattctgggtacatacgtctgcatcaaggggtatcacctcgtgggcaagaagacattgttttgcaatgcaagtaaggaatgggataatacaacaacggaatgccgactgggccactgtcctgatccagttctggttaacggtgaattttcgtcaagcgggcctgttaacgtctctgataaaataacatttatgtgtaatgaccactacattctcaagggttccaatcggagccaatgcttagaggaccatacatgggctccaccattccctatctgcaagtctcgtgattgcgatccccctggaaatcccgtgcacggctatttcgaagggaacaactttactctggggtctaccattagctactactgtgaagataggtactatctcgtcggggtgcaggaacagcagtgtgtggatggagaatggtctagcgcgctgcctgtgtgtaagcttattcaggaagctccaaagcctgaatgtgaaaaggcacttctggcatttcaggagagcaagaatctatgcgaggccatggaaaacttcatgcagcaattgaaggaatctggaatgacaatggaggagcttaaatactcactcgaactgaagaaggccgagctgaaagccaagctcctctag

SEQ ID NO: 183657 - DNA, 759 bp, Artificial Sequence
  Description of Artificial Sequence: Synthetic coding sequence
atgttcttctggtgcgcctgctgcctgatggtggcctggcgggtgagcgcttctgatgctgagcactgccccgaactcccacctgtcgacaatagtattttcgtggcaaaggaagtggaaggacagatcctcgggacctacgtgtgtatcaaaggctaccatctcgtgggcaagaagactctgttctgtaatgcatccaaagagtgggataataccaccacagaatgccgtctggggcactgtcctgaccccgtgctagtcaacggtgagttctccagttctggccccgttaacgtatctgacaagatcacgttcatgtgcaacgaccactacatcttgaaaggctcgaataggtcccagtgtttggaagaccatacctgggccccaccattcccaatatgtaagtccagagattgtgacccccccggcaatccagtgcacggatactttgagggtaacaatttcacgcttggctcaaccatatcttattattgcgaagatagatattatcttgtaggggtccaagaacaacaatgtgtcgatggggaatggagctcagccctgcctgtgtgcaaacttatccaggaagcaccaaaacccgagtgcgaaaaggctctgctcgccttccaggaatctaagaatctttgtgaggccatggagaacttcatgcagcaactcaaggaaagcggcatgactatggaggaattaaaatatagtcttgaactgaaaaaggccgaactgaaggcaaagctgctctag

SEQ ID NO: 183658 - DNA, 657 bp, Artificial Sequence
  Description of Artificial Sequence: Synthetic coding sequence
atggtggcctggcgggtgagcgccagcgacgagcactgccccgagctgccgcccgtcgataactcaattttcgtagcaaaagaggtcgaggggcagatcctggggacctacgtgtgtatcaaaggatatcatctggtgggaaagaagaccctcttctgcaatgcgtcgaaagaatgggataacacaacgacagagtgccggctcggccactgccccgatcccgtgttggttaatggagaattcagtagcagcggacccgtcaacgtttcagataagatcacattcatgtgtaacgatcactacatcctgaaaggatcaaatcgctcccagtgccttgaggatcacacttgggctccccctttccccatctgtaagagcattccccagacacgacccctcccttttcaaccttgctcccctctcttcctgttcctgctgcgccagagcctcgccctgttccctagacttgaatgttcgggccggatcctcgcccattgtaacctccacctccctggatccagttctagccatgcgtctgctagccaagtggcaggaattacgggagcacatcccaggtgggcgaacttttgtatcttctctcgcgactgggtgtccccttgctggccggggtggtcacaaatccctgatttgagatag

SEQ ID NO: 183659 - DNA, 546 bp, Artificial Sequence
  Description of Artificial Sequence: Synthetic coding sequence
atgttcttctggtgcgcctgctgcctgatggtggcctggcgggtgtctgccagtgatgccgagcattgtcccgaactcccacctgttgataattccatcttcgtggcaaaggaggtggaaggacaaattcttggaacttatgtgtgcataaagggctaccacctagtgggcaagaagactctgttctgcaacgccagtaaggaatgggacaacacaacaactgagtgtaggctgggacactgcccggatcctgtactggttaatggagagtttagctcctctggccccgtcaatgtgtcggacaaaattacgttcatgtgtaatgaccactatattctgaaggggtctaaccgaagccagtgcctcgaagaccatacttgggcacccccgttcccaatttgcaaatcccgcgactgtgaccctccaggcaatcctgtccacggctatttcgaggggaataacttcaccctcggcagcaccatctcttattactgtgaggatcgctattacttagtgggagtgcaggagcagcagtgtgtggactag

SEQ ID NO: 183660 - DNA, 5235 bp, Artificial Sequence
  Description of Artificial Sequence: Synthetic coding sequence
atgcggctgctgtggggcctgatctgggccagcagcttcttcaccctctcactgcagaaaccacgactcctgcttttctctccctcagtggtgcatctcggagtgccgctgtctgtgggagtccagctgcaggatgtgccccgtggccaggtcgtgaaggggagcgtcttcctgcggaaccctagtagaaataatgtgccatgtagccccaaggtggacttcaccctttcaagcgaacgcgacttcgccttgctgagcttacaagtcccgctgaaagacgccaagtcctgcggtcttcatcagctactgcgcgggccggaggttcaattggttgcacactctccttggctgaaagacagcctgtcccgaactaccaacattcaggggatcaaccttttgtttagttcacgacgagggcatctgttcctgcagacagatcaaccgatctacaaccctggtcagcgcgttcggtatcgagtgttcgcactggaccagaagatgcggccttccactgacacaattacagtgatggtggagaactctcacgggctgcgggtgcgtaaaaaagaggtgtatatgccaagctcaatattccaggacgacttcgtgatccccgatatcagtgaaccggggacttggaaaatctcagctagattcagcgacggactcgagagcaattcctcaacacaattcgaggttaagaaatatgtgttgcctaactttgaagtcaagatcacacccggcaagccgtatattctgaccgtccccggtcacctggatgagatgcagttggatatccaggcgcgatacatatacgggaaacccgtgcagggtgtcgcatatgtgaggtttggcctgttagacgaggacggcaagaaaactttttttagggggctggaatcccagaccaagctcgtaaatggacagtcccatattagtctatcaaaggccgagttccaagatgccctggagaaactcaatatgggtattacagacttacaggggttaaggctgtatgtcgcagccgctataatcgaataccccggaggtgaaatggaagaagctgagctcaccagctggtactttgtctcttcgcccttctcattggacctgtcaaagaccaaacggcaccttgtgcctggcgcgccttttttgctccaggccctggtacgagagatgtctggcagtcccgcctctggaataccagtgaaagtttcagcaaccgtctcttccccaggctccgtccctgaagtccaagacatccaacagaacaccgatggatccggtcaggtgtctatccccataattatcccccagacaattagcgagctgcagctgagcgtgtcggccggctccccacacccggcgatagctcgtcttactgtcgcggcccccccttctggaggacctggattcctgagcattgagtggcctgacagccggcctcccagagtgggcgacactctgaacctgaacctgagagccgtgggctccggggcaaccttctctcactactattacatgattctgtcacggggccagatcgtctttatgaacagggagccaaaaaggactctaacaagtgtctcagtcttcgttgaccaccacctggcaccttccttctacttcgtcgccttctactatcacggcgatcatccagtggccaacagcttgagggtagacgtccaggccggcgcctgtgaaggcaagttggagctgtccgtggatggggctaagcagtaccggaacggcgaatccgtcaaactgcacctggagacagactccctcgctcttgtggctctcggagccctggatacggctctatatgctgcaggcagcaagagccataagcctttgaacatggggaaagtgttcgaagccatgaactcctatgaccttgggtgcggaccggggggcggcgatagtgctttgcaggtgtttcaggccgcgggcctggccttctccgatggggatcagtggacactgtccaggaaaaggctcagctgtcccaaggagaaaaccacccgcaaaaagcgaaacgttaatttccagaaggctattaatgaaaagttagggcagtatgctagtccaaccgccaaaaggtgttgtcaggacggggtcacacggctaccgatgatgcgctcctgcgagcagagagcagccagggtccagcagccggactgccgggagcctttcttgagttgctgccaatttgctgaatcactgaggaagaaatcacgggataaaggccaagccggactccagagggctctggaaattctgcaggaggaagacttgatagacgaagatgatattccggtgcgcagtttttttcccgagaactggctgtggagggtggaaactgtggaccgcttccagatccttaccctgtggttgccggatagcttgacaacttgggagatacatggcctgtccctgagtaagaccaagggcctctgtgtagcaacccctgtgcagctgcgagtgtttagggagttccacctgcatctgcgactccctatgtctgttcgtcgcttcgaacagcttgagctgagacccgttctatataactacctggataaaaacttgactgtttctgtgcacgtttcccctgttgaaggtttgtgtctggcggggggcggaggactggctcagcaggtgctggtaccagcagggagcgctaggcctgtggcgtttagtgtcgtccccactgcggccgccgccgtttcattgaaggtcgtggctaggggttccttcgaattcccagtgggagatgccgttagtaaagtgttgcagattgaaaaggagggagcgatccacagggaagagttggtctacgagttgaatcccttggaccaccgaggtcgcaccctagaaatcccgggtaactccgacccaaatatgatcccagatggtgacttcaacagttatgtgcgggtaacagccagtgatccgttagatacactggggagtgaaggcgccttatcaccaggcggcgtagcatctctactgaggctcccccgaggatgcggggagcaaacaatgatctacttagcccccaccctggctgcctcccgttatctggataagacagaacagtggtccacactgcccccggaaaccaaagaccatgctgtcgatcttatccagaaaggctatatgaggatccagcagttcagaaaggcagacggctcgtacgccgcctggctcagcagggatagcagtacctggttgacagcttttgtactgaaggtgctgagtctggcccaggagcaagtcggtgggtctcctgagaaattacaggaaacaagcaactggctgctttcccagcagcaggcggatggatctttccaagacccctgcccagtgcttgacaggtctatgcaaggcgggttggtgggcaacgatgagacagtcgcactcacagcctttgtgacaatcgcgctccatcacggcctcgcagtgtttcaggacgaaggcgctgaaccccttaaacaaagggtagaagctagcatatcaaaggccaattccttcctaggagaaaaagcatccgcgggcctcttgggggcacacgcggccgctatcaccgcctatgcactgacgctcaccaaagcccctgtggacctcctcggagtagctcacaataatctgatggccatggcccaggaaacgggggataacttatactgggggtctgtcaccggctcccagagcaatgcagtgtccccaacacccgctcccagaaaccccagtgatcccatgccacaggcccccgcactttggatcgaaacgacagcttatgcgttgctgcacttactcctccatgagggcaaagcagagatggccgaccaggccgctgcatggcttacacggcagggctcatttcaggggggttttagatctacgcaggatacagtgatcgccctggatgcccttagcgcctactggattgcctctcacactacagaagaaagaggactgaacgtgacgttgagcagcaccggcaggaatggttttaagagccatgcattgcagctgaataaccggcaaattagaggattggaggaagagctgcaattcagtctggggtcaaagatcaacgtgaaggtgggagggaactctaaagggacccttaaggtgcttcgaacatacaatgtccttgatatgaagaataccacctgccaggacctacaaatcgaagtgaccgtgaaggggcatgtggaatacactatggaggctaacgaggactacgaggactacgaatacgacgagctgccggcaaaggacgatcccgacgctcccctgcaaccggtaacccccctccagttgttcgaagggcggaggaaccgaagaagaagagaggctcccaaagtcgtggaggaacaagagagcagagtgcactacacagtgtgcatctggagaaatgggaaagtagggctgtccgggatggccatcgccgacgtaacactactgagtggcttccatgcacttcgggccgacctcgagaaattgacttccctctcagacaggtatgtgagccatttcgagactgagggccctcatgtgctgttatatttcgattctgtgcctacaagccgcgaatgcgtcggatttgaagcagtgcaggaggtgcccgtaggactggtgcagccagcgtccgctacactgtacgattattataatcctgagcgccgttgctcagtcttctacggggccccttccaaatctaggctcctggccacgctctgctccgctgaagtttgccagtgtgccgagggtaagtgccctcgccaacgcagggcactggagcgagggctgcaagacgaagacgggtatcgtatgaagtttgcttgctactacccacgtgtggagtatgggttccaagttaaggtgctaagggaagactcacgggccgcattccgcctctttgagactaagatcacacaggtcctgcactttaccaaggatgtaaaggctgccgccaaccaaatgagaaattttctcgtgagggcctcttgtagactgaggctcgagccaggcaaggaatacctaatcatgggtctggacggggccacttacgacctcgaggggcatccacagtatctgcttgatagcaactcctggattgaagagatgcctagcgagcgcctgtgtaggtccactaggcagcgggcagcctgcgcgcagctgaatgacttcctgcaggaatacggcacccagggctgccaggtatag

SEQ ID NO: 183661 - DNA, 5235 bp, Artificial Sequence
  Description of Artificial Sequence: Synthetic coding sequence
atgcggctgctgtggggcctgatctgggccagcagcttcttcaccttgagtttgcagaaacccagactgctccttttctcaccatctgtggtccacctcggggtacccttatccgtgggagttcaactgcaggatgtgcccaggggacaagtagtgaagggatctgtattcctgcgaaacccatcaagaaacaatgtgccatgcagtccaaaagtcgactttactttgtccagtgagcgggacttcgccttactgtccttgcaggtaccgttgaaagatgctaagagctgcggactgcatcagttgctgcggggacccgaagtacagctggtcgcacattccccatggctgaaggacagcctgtctcgcacgaccaatattcagggcatcaacttgctgttctccagcagacgaggccacctctttctgcaaaccgaccagcccatctacaatccagggcagcgggtgagatacagggtgttcgctttggatcaaaagatgcgccccagcacagacaccataaccgtgatggtggaaaactcacatggcctcagagtcagaaagaaggaagtctatatgcccagttctatctttcaggatgactttgtgattcccgacattagcgagcctgggacatggaaaatctcggcaaggtttagcgacggactggaaagcaactcatcaacccagtttgaggtcaagaaatacgttctgcctaactttgaggtaaagattacacctggaaaaccctatatactgacggttccagggcatttggatgaaatgcagttggacatccaggcacgatacatctacggaaaacctgtgcaaggggtggcctacgtgcggtttggtcttttagatgaagatggcaaaaaaacgtttttcagaggccttgaaagccagactaagctggtaaatggccagtcccacatatcgctgagcaaagccgagttccaggacgctttggagaagttaaatatgggcattactgacctgcagggactcagactgtatgtcgcggcagccatcattgaaagtcccgggggagaaatggaagaagctgagttgacttcatggtacttcgtcagcagtccattttccctggacctcagtaagaccaagaggcatctcgtcccaggtgccccatttctactccaggctctagtcagagaaatgagcggcagccctgcctctggcattcccgtcaaagtgtccgcaactgtctcttcccctggctcagtccctgaagtacaagatatccagcagaacactgatgggtccggccaagtttcgattccaattattataccccagaccattagcgagttacagctctcagtgtccgccggaagtccccaccctgccattgcacgcttgaccgtcgccgccccgccaagcgggggccccggttttctttccattgagcgtcctgatagcaggccacccagggtaggcgacacattgaacttgaatttacgcgccgtgggaagcggagccaccttttcacactattattacatgatcctctcacgtggacaaatcgtgtttatgaatagagagcctaagcggacgttgacctcagtgtcagtgttcgtcgaccatcacctggccccttccttctacttcgttgccttttactaccatggggatcacccggtcgccaactcactccgagtggacgtccaggccggtgcatgtgaagggaaattggagctgtctgtggacggcgctaagcagtatcgcaacggggagtctgtgaagctgcatttagagactgatagcctagcactggttgcgttaggcgctctggatactgcgctgtatgccgccgggtctaaatcacacaagcctctgaacatgggtaaggtgtttgaggcaatgaactcctacgacctcggatgcggaccggggggtggagattccgctttgcaagtctttcaggctgcaggcctggcttttagcgacggggatcaatggaccctttcacggaaacggctgtcgtgccccaaagaaaagaccacgaggaaaaaaaggaatgtcaatttccagaaagcgatcaacgagaaactaggccagtatgcttcacctacagcgaagagatgttgtcaagacggcgtgactagactgccaatgatgaggagttgcgagcaacgggccgctcgcgtgcagcagccagactgcagggaaccctttctctcctgttgccagtttgcagagtctctgcggaaaaagagcagagacaaagggcaggctggtctgcaaagggccttagaaattctgcaagaggaggatttgatcgatgaggacgacatcccagtcagaagcttttttcctgagaactggctctggcgcgtagagaccgtggaccggtttcaaatactcactctttggctacccgatagcctcactacttgggaaatccatggcctgagtctgagcaagacgaagggactatgcgtggcaacacctgtacaactaagggtgttcagggagtttcatcttcacctacggcttcctatgagtgtgaggcggttcgaacaactggaactacgccccgtcctgtacaactatctggacaagaaccttactgtatccgtacacgtcagtccggtggaaggcctgtgcttggcaggaggaggaggcttagctcagcaggtcctcgtgccggcggggtcagcaaggcccgtggcattcagtgtcgtgcctactgctgctgcggcagtcagcctgaaagttgtggcaagaggtagctttgaattccctgttggcgatgccgtgagcaaagtgctgcaaattgaaaaggaaggggcaattcacagggaagagctggtttacgagctaaatccactggaccacagggggcgaactcttgagattccaggcaattcagatcctaacatgattccagatggagattttaatagctatgtgagggtgacggcctcagaccctctagatacactcgggagcgagggcgccctgtcccccggcggtgtggctagtttgcttagactgcctcgagggtgcggggaacagaccatgatctatctggctcctaccctggctgcatcccggtacctggataaaaccgaacagtggtccacactgcctcccgagaccaaggaccatgccgtggacctcattcagaagggatatatgcgcatccaacaattcagaaaggctgatgggagctatgcagcatggctgtcaagggacagttccacgtggcttaccgccttcgtcctgaaagtgttgtcgctggctcaagaacaggtggggggatcgcctgagaaactgcaggaaacctcgaattggctgctctcacagcaacaggcggatggaagttttcaggacccttgtcccgtgctagaccgctccatgcagggagggctcgtgggcaacgacgaaacagtagcacttacggcctttgttaccatcgccctccatcatgggcttgccgtgtttcaagatgaaggggctgagccgctgaaacaacgcgttgaagcgtctatcagtaaggcaagttctttcttaggggagaaagctagtgcgggcctgcttggtgcccacgccgccgccattaccgcatacgccttgaccctgaccaaggctcccgttgatcttcttggcgtggcacacaacaacctgatggccatggcgcaggaaacaggcgacaacctttactggggatccgtgactggcagccaatcaaacgccgtgtctcccacacccgcaccgaggaacccgagcgatcccatgccccaagctccagcattgtggatagagaccacagcctacgcgctcttgcatttgctgctgcatgagggtaaagcagagatggccgatcaggccgcagcatggcttacccggcaaggctcatttcagggaggtttccggtcaacccaggacactgtaattgcccttgatgccctgtctgcttattggatcgccagccataccacagaagaaagaggcctgaatgttacactgtcgtctaccggcaggaatggttttaaatctcatgcactacagctaaacaataggcagataagaggactcgaagaggagctgcagttctcgctgggctcaaagattaatgtgaaggttggcggaaactccaaaggcacactcaaagtgttgaggacgtacaacgtcctggacatgaagaataccacctgccaggaccttcagatagaagtcactgtcaaaggccacgtcgaatataccatggaggccaatgaagattacgaagattatgaatatgacgagttacccgctaaagacgaccccgatgcacccctccagccggtgacaccactccaactgttcgagggacggagaaatcgcaggcgtcgcgaggccccaaaggtagtcgaagagcaggagagccgcgtccactacacagtgtgcatctggcgtaacggaaaagtgggcttgtcaggaatggctattgcggacgttactttgctgtccgggttccatgcactgcgcgctgacttggagaagctgacctccctgtccgatagatacgtgagccattttgagaccgagggccctcacgtgcttctctactttgatagtgtgccaacatcacgcgaatgtgtcggctttgaggcagttcaagaggtccccgtggggctggtgcaaccagcttcagctactctgtacgactactacaaccccgaacgcaggtgtagtgtgttttatggggccccctcaaagagccgactcttggctactctctgctccgcagaggtttgccagtgtgctgaggggaaatgtccacgtcaaaggagagccctcgagagaggcctccaggatgaagacggctacagaatgaaatttgcgtgctactacccaagggtcgagtatggttttcaggtgaaggtcctgcgggaagattcacgtgctgcattccggctcttcgaaacaaagatcacccaggtgctgcatttcactaaagacgtcaaagccgccgcgaatcagatgcggaacttcctggttcgcgcttcctgtagactgcgacttgagccgggtaaagaatacttaattatgggactagatggagccacctatgacctagagggccacccacagtatctcctggattctaacagctggatagaggaaatgccctcagagcggttatgccgatcaactcggcagcgcgccgcgtgcgcccaacttaatgatttcttgcaagagtacggtacacagggatgtcaggtatag

SEQ ID NO: 183662 - DNA, 5235 bp, Artificial Sequence
  Description of Artificial Sequence: Synthetic coding sequence
atgcggctgctgtggggcctgatctgggccagcagcttcttcaccctgagcctgcaaaaacccaggcttctgctttttagcccctccgtagtacatctgggcgtgccattgagtgtgggcgtccaactgcaagatgtgcctcgggggcaggtggtgaagggatctgtgtttctacgaaacccctcccggaacaacgttccatgctccccaaaggtggatttcacactctcatcagaacgcgatttcgctctgctgtctcttcaggtaccactgaaagacgccaagtcctgtggtctgcatcagcttctgaggggtcctgaagtccagctcgtggcccattcaccgtggctaaaagacagcttgtctagaacaaccaatatccagggcatcaacctcctgttctcatcaagacgtggtcatctgttccttcagaccgatcagccaatctataacccaggacaacgcgtccgctatcgtgttttcgcccttgatcaaaaaatgcgtccaagcacagacacaattaccgtcatggtggaaaactcacacgggctacgggtgaggaaaaaggaagtctacatgccaagctcaatttttcaggatgacttcgtcatcccagacataagtgagcccgggacatggaagatatccgcacgattcagtgatggcttggaatccaacagttccactcagttcgaggtgaagaagtacgtgttgcctaatttcgaggttaagatcacgccagggaaaccttacatcctgacagtacccggccatctcgacgagatgcaacttgacatacaggcgagatacatttacggcaaacccgtccaaggtgtcgcttacgtgcggtttggactgctagacgaggatggaaaaaagacattcttccgaggacttgagtcgcagaccaaattagtaaatggacagtcgcatatttctctatcaaaagcagaatttcaggatgccctggaaaaactgaatatggggattaccgacctgcaaggactgcgcctgtacgtggccgcagccattattgagtaccccggaggagagatggaagaagccgagctgacctcctggtacttcgtctcctctccattctctctggatctaagcaagacgaaacggcatcttgtgccaggtgcaccttttctgctgcaggccctggttcgggagatgtccggatcacctgcatccggaatccccgttaaagtttcggccactgtttctagtcccggttctgttcccgaggtgcaggatatccagcagaacaccgacggctcaggccaggtatcgatcccaattatcatcccccagactatcagtgagctccaactgtcggtgagtgcaggctcccctcacccagccatagctcgtctgactgtggcagcccctcctagcggggggcctggctttttgtccatagagagaccggattccagaccccctcgggtgggtgacaccctgaatctgaatttgcgagctgtagggagcggcgctacgttctcccactattattacatgattctgtcaagagggcagattgtgtttatgaatagggaacccaagcggacactgaccagtgtgagcgtgttcgttgaccatcacctggcaccttccttttatttcgtcgcattctattatcacggggaccaccccgtagccaacagccttcgcgtggatgtgcaggctggggcttgtgagggtaagctagaactttctgtggatggtgcgaagcaatacagaaatggtgagtccgtgaagctgcatctggaaaccgatagcctcgcccttgttgcactgggcgcccttgacactgctctctacgcagctgggtccaaatcccataaaccgctcaacatgggtaaagtgtttgaggcgatgaacagctacgatttgggatgcgggcctggagggggggattcagcccttcaggtgtttcaagccgccggactcgcattttcagatggcgatcagtggacactgagtaggaaaagactaagctgccccaaggaaaaaaccactcgcaaaaagcgcaatgttaatttccagaaagctatcaacgagaagttagggcagtacgcgtcacctacagccaagcgttgttgtcaggatggcgttaccagactgcccatgatgcggagctgcgagcagcgggccgcccgggtacaacagccggattgtcgggagcccttcctgtcatgttgccaatttgcggaatctcttagaaagaagtccagagacaagggtcaggcgggtctccaacgcgcgctggagatccttcaggaagaagatttgattgatgaagatgacatcccagtgagaagttttttccctgagaactggctctggcgagtggagacggtcgatcggtttcagatcctcactttgtggctgccagactcactgacaacttgggaaatccacggactgtcactctctaagaccaaaggcctttgtgtggccacccccgttcagttgagggtttttcgcgagttccacctccaccttcgtctgcctatgagcgtgaggcggtttgagcagctcgaactgagaccagtactgtacaattaccttgacaagaatttaactgtgtccgtacacgtgagccccgttgaaggtctgtgtctcgctggcggcggcggattggcccagcaggtgctggttccagccggatctgcccggcctgtggcgttcagcgttgtgccaaccgcagcggcagccgtctctctcaaagtggtcgccagagggtcatttgagttccccgtcggcgacgccgtgtccaaggtccttcaaattgaaaaggagggcgccattcaccgagaagaacttgtgtacgaactcaaccccctggaccaccgcgggcggactttagagatccccggaaactctgaccctaatatgatcccggacggcgattttaacagctacgtacgtgtcaccgcgagtgacccattggataccctaggttccgagggggcgctcagtcctggtggcgtggcatccctactaagactgccacgtggctgtggcgagcagaccatgatctatctggctcccaccttggccgcctcccgctacttggacaagacagagcaatggagcacccttccacctgagacaaaggatcatgccgtcgatctcatccagaagggatatatgcgcatccagcagtttaggaaggcagatgggagctacgctgcctggctctcccgagactcatctacatggctcacagccttcgtcttaaaagtactgtccttagctcaagagcaagtaggtggctctcctgagaagctgcaggagacctcaaactggctgcttagccagcaacaggcagacggctctttccaagatccctgccccgtattggaccgtagcatgcaaggaggactggtagggaacgatgaaaccgtcgcattgactgccttcgtcacaatcgctctccaccatggcttggcagttttccaggatgaaggcgccgaacccctcaaacagcgcgtggaggctagcatttcgaaagctaactccttcctaggagagaaagcgagtgccggcctcctgggtgcacatgctgccgctataaccgcttacgcactgacgctcactaaggcccccgtagaccttctgggggttgcacataataatcttatggctatggcacaagaaactggagacaatctgtactggggctctgtaacaggatcccaatccaacgctgtgagcccaacccccgctcccaggaaccccagcgatcccatgccacaggcgccagctctctggatcgagacgacggcgtatgcccttctccacctcttgcttcacgagggcaaggctgagatggctgaccaggctgcagcctggctgactaggcagggtagcttccagggaggttttcggtcaacccaggacacagttattgccttagatgccctgtccgcatactggatagcctctcacaccactgaagaaagaggactgaacgttaccctgagcagtactggaagaaacggattcaagtcccacgcacttcaattgaataaccgacagatacgaggattagaagaagagcttcagttcagcctgggctccaagataaatgttaaggtggggggtaacagcaaaggcactttaaaagtactgcgaacttataacgttctcgatatgaagaacacaacttgccaggatctgcagattgaggttacagtcaaaggtcatgtggagtatacaatggaggccaacgaagattatgaggactatgagtatgacgagttacctgcgaaggacgatcctgacgctcctttgcagcccgtcacaccattgcagttgttcgaaggacgccggaaccgcagacgtcgagaggccccaaaggtggtagaagaacaagagagcagggtgcattacaccgtgtgtatttggaggaacggaaaagtgggcctatcaggaatggcaatagcagacgtgacactgctgagcgggtttcacgcacttagggcagacctcgaaaagttaacatcactgtccgaccgctacgtttcacactttgaaactgaagggccccacgtgctcctgtattttgatagtgtaccgactagtagggagtgcgtgggttttgaagccgttcaagaggtccctgttggcctggtccagcccgcaagcgccacgctgtatgactactataaccccgagagaagatgcagcgttttttatggagcaccatccaaatcacggctgctggctaccctctgctctgcggaagtttgtcagtgcgcggaaggcaagtgcccaaggcagcgccgcgcactggagcgggggctacaggacgaggatggttaccgcatgaagtttgcatgctactacccccgcgttgagtatgggtttcaggtgaaggttcttagagaagatagtagggcggcttttaggctattcgaaaccaagataacccaggtgctgcattttactaaagacgtcaaagccgctgcgaaccagatgcgcaactttctggttcgcgcctcctgccgacttaggctggaaccgggtaaggaatatttgatcatgggcctggacggggccacatacgatttggaaggacacccccagtatctcttggattccaattcatggatcgaagagatgccgtccgagagactgtgtaggtccacccgtcagcgcgccgcctgtgcgcaactaaacgacttcctccaagaatatggtacccagggatgccaggtgtag

SEQ ID NO: 183663 - DNA, 5235 bp, Artificial Sequence
  Description of Artificial Sequence: Synthetic coding sequence
atgcggctgctgtggggcctgatctgggccagcagcttcttcaccctgagtctccagaaaccccgactgctcttgttttcacctagtgtcgtgcatctcggtgttccccttagcgtcggtgtgcagctccaggacgtgccgcgcggtcaggttgtgaaggggtccgtcttcttacggaacccctctcgcaacaatgtgccatgttctcccaaagtcgacttcaccctcagttccgagagggactttgcgctgttatcgctccaagtccctttgaaagacgctaagagctgcggtctgcaccaattgctgcgtggaccagaggtgcagctggttgcccactctccgtggttaaaggattcgctttccaggactacaaacatacaggggatcaatctccttttctcctcaagaagaggtcacctttttctgcagactgatcagcctatttacaaccccgggcagcgcgtgcgctatagggtcttcgcgttagaccaaaaaatgcggccaagtacggacaccatcaccgtgatggtagagaattcacatgggctgcgggttcgcaagaaggaggtatatatgccaagttccatatttcaggatgactttgtcattcccgacatctccgagccaggaacatggaagatctcagcaaggttctcggacggactggaaagtaacagctccactcagtttgaagtgaagaagtacgttctacccaacttcgaggtaaagatcaccccgggtaagccttacatcctgaccgtgcccgggcatctggatgaaatgcaattggacattcaggcgcggtatatctacggcaagcccgtgcagggcgttgcgtacgtaaggtttgggctgttggatgaggacggcaagaaaacattctttcgcggcctcgagtctcagactaaactggtgaacgggcagagtcatatttccctttccaaggctgagtttcaggacgctctcgagaaactgaacatgggcatcaccgatctccagggcctgagattgtatgtcgccgccgcaattatcgaatcgcctgggggcgaaatggaggaggctgagctcacatcctggtactttgtgagctcccctttctcccttgatctgtctaagaccaagaggcacttggtgccaggcgcccctttcttgctacaggcattggttagggagatgtcaggttctcctgcatcaggcatccctgtcaaggtgtctgccacggtgtcatcaccaggaagcgtgccggaagtgcaggacatccaacagaacactgatgggtccgggcaagtgtccatccctattatcatccctcagaccatctccgaactgcagctgagcgtgagtgcaggtagcccccatcccgcaatcgcacggcttaccgtagccgcacccccaagtgggggcccaggattccttagcatcgagcgcccagatagcagacctccccgtgttggtgacaccctcaacctcaatctgagggctgtcggctcaggtgccaccttctctcactactactatatgatactgtctagaggccagattgttttcatgaaccgggaaccaaaaaggactctaacatctgtcagcgttttcgtggatcaccacctcgctccgtcgttttatttcgtggctttttattaccacggcgaccacccggttgctaacagtttgagggtggatgttcaggctggtgcttgcgagggcaagttggaactcagcgtcgacggtgctaaacaatatagaaatggcgagtctgtcaagcttcacctggagactgactcgttggccctggtggctttgggcgcattggataccgccctgtacgcggctggatccaagtctcataaacccttgaatatgggtaaggtgtttgaggctatgaacagctacgatctggggtgtggccccggcggtggagacagtgccctccaggtgttccaagccgctggcctggccttcagtgatggagatcagtggactctctcgcgcaagcgcctttcctgtcctaaggagaagaccacacgcaaaaaacgaaacgtcaactttcaaaaggccatcaatgagaagttaggtcaatatgcctcgccaactgcaaagaggtgctgtcaggatggggtgactcgcctgcctatgatgagaagttgcgagcagagagcagctcgggtccagcaaccagactgcagagagcccttcctgtcatgttgtcagtttgctgagtccctgcggaagaaatccagagacaaggggcaggctggactgcagcgcgctctggagatcctccaggaggaggaccttatagatgaggacgacatccctgtgcggagtttcttcccagagaactggctctggcgggtggagaccgttgaccgttttcagatcctgacgttgtggctcccggattccctgaccacctgggagatccacgggctctcattgtccaagactaaagggctgtgcgtggcaacgccagtacagctaagagtttttcgggaatttcacctgcatctgcggttgcctatgtctgtccgccgctttgagcagttggaacttcgtcctgtcctttataactatcttgataagaaccttacagtgtctgtccacgtctctccagtagagggtctgtgtttggctggaggcggtggactggctcagcaggtactggtgcctgcgggctcagcgcgaccagtggccttctctgtggtcccaacagccgccgctgctgttagcttgaaagtggttgcaagaggatcatttgagttcccggtaggtgatgctgtgtccaaagtgctgcaaattgagaaggagggagctattcatcgggaggagctggtgtacgagctaaatcccttggatcaccgcggaagaacgctggagatccctggtaattctgatcccaatatgattcccgatggggacttcaatagctatgtgagggtaacagcatccgatcccctggacacactggggtccgagggcgctctctccccgggaggggttgcgtcgctcctgcggcttccccgggggtgtggcgagcagaccatgatttatttggcccccactctcgccgcatcaaggtatttggataagaccgaacagtggagcactctacctcctgagacaaaagaccatgccgtcgatctcattcagaaagggtacatgaggatccagcagtttagaaaggctgatggatcctacgctgcatggctgtccagagattcttccacttggttaactgcgttcgttttgaaagtgcttagtctcgctcaggaacaagttggcggatctccggagaagttacaggaaacatcaaattggctgctgagccagcagcaggcagacggaagttttcaggatccatgtcccgtgctcgataggagcatgcagggagggctggtagggaatgacgagacagtggctcttacagcatttgtcactattgcccttcatcacggactcgctgtgtttcaagatgagggagcagaacctttgaaacagcgagtggaagccagcatttccaaggccaacagcttcctgggcgagaaggcaagcgctggattgttgggtgcccacgcagccgccataaccgcttatgccctcacactcacaaaagcccccgtcgacctgttgggcgtggctcacaataatttgatggccatggcccaggagaccggtgacaacctctactggggctccgtgacaggaagtcagagcaatgcagtgagcccaacaccagctccgaggaatcccagcgaccctatgcctcaggcaccagccctatggattgagacaacagcttatgctctgctccacctcttgcttcacgagggaaaagctgaaatggctgaccaggctagcgcatggctcacacgccagggctcattccagggaggcttccgcagcactcaggacactgttatagccctggacgctctgtcagcctattggattgcctctcatacaaccgaagaacgggggcttaacgtcactctgtcgtccaccggcagaaacggctttaagagtcatgctctccagctaaacaatcgccagattcgcgggctggaggaggagcttcagttctccctaggatccaagatcaatgttaaagtgggcggtaacagcaagggcactctgaaggtgttgcgcacgtataatgtgctggatatgaaaaacactacttgtcaggacctgcagatcgaagtgaccgttaaaggacatgtggagtataccatggaggctaatgaggactacgaggactatgagtatgatgaactccccgccaaggatgacccagatgcacctctgcagcccgtgactcccctccagctgttcgaaggtagaaggaatagacgaaggcgcgaggcccctaaggttgtagaggaacaggagagcagagttcactacaccgtttgtatctggcgtaacggaaaggtgggcctgtcgggtatggcaatcgccgacgtcactctgctcagcggttttcacgcgttaagagccgatttagagaaactcacttccctctcggacagatatgtgagtcacttcgagacagaaggtccgcatgtgctgttgtatttcgactctgtgccaacttcacgagagtgcgtgggattcgaagcagtccaagaggtgccagttggcctggtgcagcctgccagcgcaaccctctatgattactataaccctgagaggcgatgttctgttttttacggggctccttctaagagtagattgttagcgaccttgtgttctgccgaggtttgtcagtgcgcagaaggcaagtgtccccggcaacggcgcgcccttgaacgtgggctgcaagacgaggatggataccgcatgaaattcgcgtgctactatcccagggtcgagtacggctttcaggtcaaggtgctccgggaagattctagagctgctttccggctttttgaaaccaagattacccaggtgcttcactttactaaggatgtgaaagccgcagccaatcagatgcgcaactttctagtgagggcctcctgccggctgaggctcgagccagggaaggagtatctgatcatgggtttggatggcgccacctatgatctggaagggcacccccagtacctgctcgactccaactcctggattgaggagatgccaagcgagaggttgtgtcggagcacaaggcagcgagctgcttgtgcgcagttgaatgatttcttgcaggaatacggcactcagggatgccaggtttag

SEQ ID NO: 183664 - DNA, 5097 bp, Artificial Sequence
  Description of Artificial Sequence: Synthetic coding sequence
atgcggctgctgtggggcctgatctgggccagcagcttcttcaccttgtctttgcagaagccccggttgttgctctttagccctagcgtcgtccatctaggtgtgcccctgagcgtgggagtacaattgcaggatgtgcccaggggccaggtagtgaagggcagcgtcttcctgaggaatccatctcgaaataatgtgccctgcagccccaaagtggacttcactctgagcagtgagagagatttcgcactcctcagcctgcaagtgcccttgaaggacgctaagtcctgtgggttgcaccaactgctgcggggtccagaagtccagctggttgctcacagcccatggttgaaggacagcctgtctagaaccacaaatattcagggaattaacctgctctttagctctagacgggggcacctgtttctacagactgatcagccaatctacaacccaggccagagggttcgctaccgcgtgttcgcacttgaccagaagatgcgtccaagtacagacaccataaccgtcatggtggaaaatagtcacggcctcagagtccgtaagaaggaggtgtacatgccttctagcatctttcaggacgatttcgtgattcccgacatcagcgagcccggcacatggaagatcagtgcccgtttctccgacgggctggagtcaaactcttctactcagttcgaggtgaagaagtatgtgctgcctaattttgaagtcaaaatcacgcccggaaagccctacattctcactgtaccaggacatttagacgaaatgcagctcgacattcaggcacgatacatttatggaaagcctgtgcagggagtcgcttacgtcagattcggactactcgacgaggacggcaagaaaacttttttcaggggcctcgagtcacagactaagcttgtcaatggccagagccatatcagcctgagcaaagcggaattccaggatgcactcgagaagctcaacatggggattacggatctgcagggcctgagattgtatgtggcggccgctattatagagtcacccggcggagagatggaagaagccgagctcacgtcatggtattttgtgtcttcccccttttcactggacctctcaaaaaccaaacggcacctggtgccaggggcgccctttcttctccaagcacttgtgagagagatgagcggttcccctgcttccggcataccagtgaaagtatcagcgacagtgtcatcccctggctctgtcccagaagtgcaggacatacagcaaaacactgatggtagtgggcaggtctccataccgattataattccccagacgatttcagaacttcagttatctgtttccgctggtagtccacatcctgccattgcacgattgacagtggccgcccctcctagcggggggcctgggttcttgagcattgagagacccgattctagaccacctcgcgtgggagacaccctgaacctgaacctccgagccgtgggctccggtgcgacgttttctcattactactacatgatcctgtcccgcgggcagattgtgtttatgaatcgggaacccaaaagaacattaacaagcgtgagcgtgttcgtggaccaccacttggcaccctctttttatttcgtcgcattctactatcacggcgatcacccggttgccaactccctcagagtggacgtgcaagccggggcatgtgaaggaaagctggaactttcagtggatggagcgaagcagtacagaaacggagaaagcgtgaaactccacttggaaacagatagcctagccttggtcgccttgggggcccttgacacagccctatatgctgctggatccaagtcacacaaaccactcaatatgggaaaggtcttcgaggcgatgaactcttacgaccttggttgtggtcctggcgggggcgacagcgccctgcaagtcttccaggctgccggcctcgcctttagcgacggagaccagtggacactgagccgtaaacgtttgagctgccctaaggagaaaactacaagaaagaagcgcaatgtgaacttccagaaagccataaatgaaaagctgggccagtatgcctcccccactgccaaacgttgttgtcaggacggcgtcactcggcttcccatgatgagatcgtgtgagcaacgcgcggccagggtgcagcagccagattgcagggagccatttctctcatgctgtcagttcgccgaaagcctgcgcaagaaaagcagggacaagggtcaggccggcctgcaaagagcactcgaaatacttcaggaagaagacctgattgatgaggacgacattccagttagatcattcttccccgaaaattggttatggcgggtggaaactgtagacaggttccagatcttaacactttggctgccggattcactgacaacctgggagatccacggattatctctgagcaagactaagggtctatgtgtggccacacccgtgcagttgcgtgtattcagggaattccacttacatctcagactccccatgtccgtccgaagattcgagcagctcgaactccgacctgtgctgtataattatctcgataaaaacctgactgtgtcagtccatgtgagtcccgtggaaggcctctgtcttgcaggcggcggtggcctggcacagcaagtgttagttcctgccggaagcgctagaccagtagctttcagcgtagtccctacagccgctgctgctgtgtctctgaaagtggttgctcgcgggtcctttgagttccccgtgggcgacgccgtctccaaggtccttcagatcgagaaggaaggcgctatccatcgtgaggagcttgtctatgaattaaatcccctagatcatcgaggccgcaccttggagatccccggtaatagtgatcctaacatgattccagacggagacttcaactcctatgttcgggtgactgcgtctgaccctctggacacactgggttccgaaggcgctctgtctcctgggggggtggcgtcgctgctccggctccctcgcgggtgcggcgaacagaccatgatttacttggcgcccacacttgcggcaagtcgttacctggacaaaactgagcaatggtctactcttcctccggaaacaaaggaccacgctgtggacctcattcagaaaggatatatgagaatccaacagttcaggaaggctgacggcagctacgccgcctggctgagccgcgacagctctacctggctgacagcctttgttctgaaggtcctatccttagcccaggaacaagtcggagggagcccagagaagctgcaggagacttctaattggctgctctcgcagcagcaagccgatggatctttccaggatccatgtcctgtgctggacaggtctatgcaggggggccttgtgggcaacgatgagaccgtcgcactaaccgcattcgtgaccatagccctgcaccacgggctggccgttttccaagatgaaggcgccgagcctctgaagcagcgggtggaagccagcatcagtaaggccaattctttcctgggagaaaaggcctcagccggactcctcggagcacacgctgccgccatcaccgcttacgctctgaccctaactaaggcgcctgtagatctgctgggagtggcccataacaacttgatggcgatggcacaggagaccggggacaacctttactgggggtcagtgacgggatcccagagtaatgccgtatctcccacccctgcccctaggaaccccagcgaccctatgccgcaagcacctgccttgtggatcgagactacggcttatgccttactccatctcctgctccacgagggtaaggcggagatggccgaccaagcctcagcttggctgacccgacagggatctttccagggcggcttccgctcaactcaggataccgtgattgctttggacgcactgtcagcctactggattgcgtctcacaccacagaagagaggggcctgaatgtgacactgagttctaccgggcggaatgggtttaagtcccacgcactccagttaaacaaccgccagatcaggggactggaggaggaactccagttcagcctcggcagcaagatcaatgttaaagttggagggaattcaaaaggtactttaaaggttctgagaacctacaatgtcctggacatgaagaataccacctgccaggatctgcaaatagaggtaacagtgaagggccacgtggagtacacgatggaagctaacgaagattacgaagactacgaatacgacgagctccccgccaaggacgatccggacgcgcccctccaacctgtcacaccccttcagctgttcgagggtcgcagaaacagacgccgtcgcgaggcaccgaagttaaccagtctcagcgatagatacgtctctcacttcgaaacggaaggtccccacgttttactgtatttcgattccgtgcctactagccgtgaatgtgttggtttcgaagcagtgcaggaggtaccagttggattagtccagcctgcttcagcgaccctgtacgactattataaccctgaacgccggtgtagtgtgttctacggagcaccaagcaagtctcggctgctggcgaccctgtgcagcgcagaagtgtgtcagtgcgccgagggtaagtgtccgagacagagacgtgcccttgaacgaggtttacaggatgaggacggctatagaatgaaattcgcatgttactacccacgggtagaatatggatttcaggtaaaggtgcttagggaggattcccgggccgcctttaggctctttgaaactaagatcacccaggtactgcacttcactaaggacgtgaaggcagcggctaaccagatgcgcaattttctagtacgcgcctcctgcaggctgagacttgagcctggtaaggaatacttgatcatgggcctcgacggcgcgacttatgatttggagggccatccccagtacctgctcgattccaacagctggatcgaggaaatgccaagtgaacgcctctgcagatccacccggcagcgggccgcatgtgcccaattgaacgatttcctgcaagagtatggcacacaaggctgccaggtgtag

SEQ ID NO: 183665 - DNA, 813 bp, Artificial Sequence
  Description of Artificial Sequence: Synthetic coding sequence
atgtgccccgaggacagcctgcaggtgcccctgaaggacgccaagagttgtggactgcaccagttgctcagagggcccgaggtccagctcgtggcccattcaccttggcttaaggactctcttagtcgcaccacaaacatccaaggcatcaaccttctattcagctcacgccgaggccacttattcctgcagaccgatcagccgatctacaacccagggcagcgcgtgagataccgagtgttcgctctggaccagaagatgagaccttccacagacactatcaccgttatggtggaaaactcccacggcctccgcgttagaaagaaggaagtctacatgccctcatctatcttccaggatgacttcgtgatacccgacattagtgagcccggaacctggaagatttcagcacgattcagcgatggccttgagtcgaattcttccactcagttcgaggtgaagaaatacgtgttgcccaattttgaggttaagataacccccggcaaaccatacatcctgacggttcctggccatctggacgagatgcagctagatatccaagctcgatatatctacggaaagccagtccagggcgtagcatacgtccgatttgggcttctggatgaggatggaaaaaagacattcttccggggcctggagtctcagactaaactggttaacggacagtcccacatctctctgagcaaggctgagtttcaggatgctcttgaaaaactcaatatggggatcactgatttacaagggctacgcctctatgtggccgctgccatcattgagagtcctggcggctag

SEQ ID NO: 183666 - DNA, 5097 bp, Artificial Sequence
  Description of Artificial Sequence: Synthetic coding sequence
atgcggctgctgtggggcctgatctgggccagcagcttcttcaccctatccctgcagaagcctaggctcttgttgttcagtcccagcgtggtccatcttggagtgcctctttccgtgggggttcagttacaagacgtgccaaggggacaagtcgtgaaaggatctgtgtttctcaggaatccctcgcgtaacaatgtgccctgttcacccaaagtcgatttcacactgagctcagaacgcgactttgccctgctctctctccaggttcctctcaaggacgcgaaaagttgtggcttgcaccagctccttcgcgggccagaggttcagctggtcgctcattccccttggctcaaggactcactctccaggactactaatatccagggaattaatttgcttttttccagcagaaggggccatctgtttctgcagaccgaccagcccatttacaatccagggcagcgggtgcggtacagggtctttgccttagatcagaagatgcgcccttcaaccgataccattactgtgatggtcgaaaattctcatggactgcgtgtgcggaagaaggaagtgtatatgcctagttctatcttccaagacgacttcgtcattccagatatttctgaacccggcacatggaaaatatccgctagattcagcgacggcctggagtccaattcctccacacagttcgaagtgaagaagtatgtgctgcccaactttgaggtgaagatcactccaggcaaaccttatattcttactgtgccaggccatttggacgaaatgcagttagacatccaggctcgctatatttacgggaagcccgtccagggtgtggcctatgtgaggttcggcttgctcgatgaggacggcaaaaaaaccttctttcgaggacttgagagtcagacaaagctcgtcaacggccaaagtcacatatctctgagcaaagctgagtttcaggatgccttggaaaaactgaatatgggcattaccgacctgcagggactacgtttgtatgtggccgccgccatcattgaatacccagggggggagatggaagaggctgaactcacctcttggtactttgtttcctcacccttcagcttagacctgtcaaaaacaaagaggcacctggttccaggcgccccttttctgctccaggctctggtgagggagatgagcggatcacctgcctctggcatcccagttaaggtgtctgcaaccgtgtcgtcccctggctccgtgcctgaggtgcaggacatacagcagaacaccgatggctcgggacaggtgagtatccccattatcataccccagaccatatcagagctacaacttagcgtcagcgccggctccccccacccggcaatagcccgacttacagtggccgcccccccaagtggggggcctgggtttctgtccatagagtggcctgactccaggcctcctcgagtgggggataccttgaatctcaatcttagagctgtgggctctggcgccacctttagtcattattattatatgattctgagtagaggtcagatcgtgttcatgaacagagagcctaaacggaccctgacatcggtgtcagtctttgtagaccatcacctggcaccatcattctacttcgtcgccttttactatcacggcgatcatcccgttgcaaactctctgcgagtggacgtgcaggccggggcttgcgagggaaaactggaattgagtgtggatggcgccaagcagtatagaaacggggagtccgtgaaactgcacctagaaaccgactcgctagcattggtagccctaggggcattagacactgccctgtacgcagcgggatccaaaagccacaaaccactgaatatgggcaaagttttcgaagctatgaatagctatgacctgggatgcggacccgggggcggcgactccgctcttcaagtttttcaggccgcagggttggcattctcagacggcgatcaatggacactgagccggaagagactcagttgccctaaggagaaaactactagaaagaaacggaatgttaattttcagaaggctatcaatgagaagctgggacagtacgcatcgcctacggccaagagatgctgtcaagatggcgtcacgaggctgccaatgatgaggagctgcgagcagagggcagcacgggtgcagcagccagactgtcgcgagccttttttgagttgttgccagttcgccgagagcttgcgcaaaaaatctcgggataagggtcaggcaggtctgcaaagggcgctggaaattctgcaggaggaagatctgatcgacgaggatgatatcccagtgaggtcttttttcccagaaaattggttgtggcgggtagagacagtggacaggttccagatcctgactctgtggctccccgactcattaacaacctgggagatacacgggctctctctgagtaaaacgaaaggtctttgcgtcgcaacaccagtccaactgcgcgtgtttagggagtttcacctgcacctgcgtctccccatgagcgtgcggcgctttgagcagctcgaactgcggcctgtgctttacaactacctggataaaaacctcacggttagtgttcacgtgagccctgtggaaggtttgtgcctggcgggcggcggaggacttgcacaacaggttctcgttcccgccggctctgctaggcctgtggcctttagcgttgtgccaaccgcagccgccgcagtaagcctgaaggtggtggcacgtgggtcattcgaatttcccgtgggagatgccgtgtctaaggtgctgcagatagagaaggaaggggccatccatcgagaagaattggtgtatgaacttaatcctttggaccataggggccggaccctagagatccctggcaactccgatcctaacatgatccctgatggcgactttaatagctacgtgagggtgacagcctcggacccactcgacacactgggaagcgaaggcgccctctcacccggcggagtagcctctctgctccgcttgcctcgtggttgtggcgaacaaactatgatctacctggcccccaccttggccgctagcaggtacctcgataagacagagcagtggtcaaccttaccgcccgagacaaaagaccatgctgttgacttgatccagaagggttacatgagaattcagcagttcaggaaagccgatggttcttacgcggcctggctgtcgagagactcctcaacttggttaaccgcttttgtgcttaaagtgttgagccttgcacaggagcaggtggggggctcaccagagaagctccaggagaccagtaactggctgctgtcccagcaacaggctgacggcagcttccaggatccctgtccggtcctagatcggagcatgcagggcggactggtcggcaacgacgaaaccgtggccctcacagcatttgttacgatcgcgctgcaccacggactggctgtatttcaggacgaaggggctgagcctctgaaacagcgcgtcgaagctagcatctcaaaggctaatagcttcctgggcgagaaggcttccgccgggctccttggtgcccacgccgcagccatcaccgcctatgcgctcactttgacaaaagcacctgtggacctgttgggtgtcgcccataataacctgatggctatggcccaagagactggcgataatctatactggggatctgttactggatctcagagcaacgcggtgtcacccacgccagctcccagaaatccttccgatcctatgccccaggctccagccctgtggatagaaacgaccgcatatgcactcctccacctcctcctccatgaagggaaggctgagatggccgatcaagccgctgcatggctgaccagacagggttcattccagggaggcttccgatcaacacaggatacagttatcgccctagatgccctcagcgcctattggattgcctcgcacacaacagaggaacgtggcttgaacgtcacactctccagcaccggccgcaatgggttcaagagtcacgccctgcagctgaacaaccggcagatacgaggcctggaagaggagctgcaattctccttgggctctaagataaacgtcaaagtggggggcaacagtaagggcactctcaaggtccttcgcacctacaacgtactcgatatgaaaaatacaacatgtcaggatctgcagatcgaggtgacagtgaaggggcatgtagagtacactatggaagctaatgaggactacgaggattacgagtacgacgaactgcccgcaaaggacgatccagacgcaccgttacagcctgtaacacctctccagctgttcgagggccgtagaaatcggcgcagacgtgaggcacctaaactgacttctctgagtgacaggtacgtaagccatttcgagacggaaggccctcacgtccttctgtacttcgattctgtcccaacctcccgggagtgtgtgggtttcgaggctgtccaggaggtgccagtggggctcgttcagcctgcctccgctacactttacgactactacaaccccgagcggaggtgcagtgttttctacggcgccccttccaaatcccgcttgttggctacattgtgctccgcggaagtatgtcagtgtgcagagggtaagtgcccaagacagcgaagagctcttgagagaggtcttcaagatgaagatgggtaccgaatgaaatttgcatgctactatccacgagtggagtacggcttccaggtcaaggtgctccgggaagattctcgggccgctttccgcttgtttgaaaccaagatcacccaagtcctccacttcaccaaggacgtgaaagccgcagctaatcagatgcggaatttcctcgtaagagcctcatgccgcctgcggttagagccaggaaaagagtaccttataatgggtttggatggtgctacatacgacctagagggccatccccaatatctgcttgacagtaatagttggatcgaagagatgccgtccgagcgcctgtgtcggtcaaccaggcagagggccgcatgtgcccagctgaacgactttctccaggaatacggcacccagggctgtcaggtttag

SEQ ID NO: 183667 - DNA, 1536 bp, Artificial Sequence
  Description of Artificial Sequence: Synthetic coding sequence
atggccaagggcctgagcgtgcagaacgacaagcaccccggctaccagcccgcactgctgctctctcctggagcccccctgtttgccgatgggcctgcttacgccttgcttcatctgctgcttcacgaaggcaaggcagaaatggccgatcaagctgccgcctggctcactaggcagggtagtttccaaggggggtttagatccacccaggatactgttattgctctcgacgccctgagcgcatattggattgcatcacacacaaccgaggagagaggactaaacgtgaccttaagcagtaccgggcgcaatggattcaaaagccatgcgctgcagctgaataaccggcagataagggggttggaggaagaactccagttctcgctgggatctaagatcaacgtgaaggtgggcgggaactccaaaggcacactcaaggtcctgcgtacttataatgtcctggatatgaagaacacgacctgtcaggacctgcagattgaggtgacagtgaaggggcatgtggagtataccatggaggccaatgaggactatgaagactacgagtacgatgagctgccagccaaagacgacccagacgccccactccagcctgtcacacccttacagctgtttgagggccgtcgtaacagaagaagaagggaagcacccaaagtggtagaggaacaggagtctcgcgtgcattacacggtctgtatttggagaaatgggaaagtgggactatctgggatggccatcgcggatgtgacgttgttaagcgggtttcacgccctccgcgccgacttagaaaagcttacttcattgagtgacagatacgtgagccacttcgaaaccgagggcccccatgtactcttatacttcgactctgtgccgacgagcagggaatgcgttggcttcgaagcggttcaagaggtgcctgtgggtctggtccaaccagcttccgccactctttatgactactacaaccccgagcggcgttgttccgtcttctatggcgccccatccaaaagccgtctgcttgctaccctttgtagcgccgaggtttgtcagtgcgctgaagggaagtgccctcggcagagacgggcattagagaggggactccaggacgaggacggatacaggatgaaatttgcctgttactatccacgtgtagagtatggtttccaggtgaaagttctgagagaggatagcagagccgcatttcgcttattcgagaccaagatcacacaagtactccattttactaaagacgtgaaggctgcggccaatcagatgaggaacttcctggtgcgcgctagctgcaggctgcgcttagagcctggtaaggaataccttattatgggtctggatggggctacttacgatttggaggggcatccccaatacctgctcgattccaatagttggatcgaggagatgccttcagagcgtctttgccgctccacccgccagagagctgcttgtgctcagttgaacgacttcttgcaagagtacggaacccagggctgccaggtgtag

SEQ ID NO: 183668 - DNA, 5097 bp, Artificial Sequence
  Description of Artificial Sequence: Synthetic coding sequence
atgcggctgctgtggggcctgatctgggccagcagcttcttcaccttgtcgctgcagaagccgcgcttgctgctgttcagcccttcggtggtgcatttgggtgtgcccctttcagttggagtacagcttcaagatgtccccagaggccaagtggtgaaaggatccgtgtttcttagaaacccttctagaaataacgtgccatgcagtccaaaggtggattttacactctcttctgaacgggactttgccttgctcagcctgcaggtccccctcaaggatgctaaaagctgcggcctccatcagctgttgaggggaccagaagtccagcttgtcgctcactccccctggttgaaggactcactgtcacggaccaccaacatacagggaatcaatctcctgtttagttccagacgcgggcacctcttcttgcagacggatcagcccatttataaccctggacaacgggtaaggtatcgcgtgttcgcgctggatcagaagatgagaccatccaccgatacaataaccgtgatggtggaaaatagccacgggttaagggttcgtaagaaagaagtgtatatgccctccagtatctttcaggatgatttcgtaattcctgatattagtgagcccggcacctggaaaatcagcgcccggttttcggacggactcgagtctaattcctcaacacaatttgaggtcaaaaaatacgtcttacccaacttcgaggtgaaaattacacccgggaagccctatatcttgaccgtgccaggacacctagacgaaatgcagttggatatacaggctcgttatatttacggcaaacctgtgcagggggtggcctatgtaaggtttggattattggatgaggatggaaaaaaaactttcttcagggggctggaatcccagactaaactcgtgaatggacagtcccacatctcactgagcaaggctgagttccaagacgccctggagaagttgaacatgggaattacagacctgcagggtctgcgcctttacgtagccgcggctattattgaatcccctgggggcgaaatggaagaagccgaactgaccagctggtatttcgttagctcccctttttccctggacttaagcaagaccaaaaggcatctcgtgccaggggctccattcttactccaggcactggtcagagaaatgagcggttcgccggcctctgggatccccgtgaaggttagtgccactgtctcctcacccggatccgtgccagaagtgcaggacattcagcagaatacagatgggagcggccaggtttccattcctatcattattcctcagaccataagcgagttacagctaagcgtgagtgccggctccccacaccctgcaatcgctagactgactgtggctgccccacccagtgggggccctgggtttttgtctatcgagcgtcctgatagccggccaccccgcgtgggagacaccctcaaccttaatcttagggctgttggcagtggagctacattctctcactattattatatgatactttctagggggcagattgtatttatgaatagggaaccaaaacgcactctgaccagcgtttctgtatttgtggaccaccatctggctcccagcttttattttgtcgctttctactaccacggcgaccaccccgtcgcgaattccctgcgagtggatgttcaggccggagcttgcgagggaaagctcgagctctcagtggacggcgcaaagcagtatagaaatggcgagagtgtgaagttgcacctcgaaacagattcactggcactcgtagccctgggagctctggacactgccctctacgcagccggcagtaaatcacataagcctctcaacatgggcaaagtcttcgaggccatgaatagctatgacctcggctgtggccccggtggaggcgactctgcccttcaggtatttcaagcagctggcctggcttttagcgacggcgatcagtggacactgtctcggaaaaggttgagctgtccaaaggaaaaaaccacaagaaaaaaacgcaatgtcaacttccaaaaggccatcaatgagaagctggggcagtacgcctcacccacggccaagcgctgctgccaggacggagtgactagactccccatgatgcgctcctgcgagcagagggccgcgagagttcaacagccagactgccgggaaccctttctgtcatgctgtcagtttgcagagtcactgagaaagaagagtcgggataaaggtcaggcggggctgcagagggccctggagatattacaggaggaggacctcatagacgaagatgatatcccagtgaggtctttttttcccgaaaattggttgtggcgggtggaaacggtcgatcgttttcagatcctgacattgtggcttccagatagcctgaccacatgggagatccacggcctcagtctgtcaaaaactaagggcctgtgtgtggccactcctgtgcaattgagggtgtttcgggagttccacctgcacctgagattgcccatgtctgtccgccgattcgagcagctcgagttacgacccgtgctgtacaattacctggacaagaatctgacagtgagtgtgcacgtgagccccgtggagggcctctgtctggcagggggaggaggcctggctcagcaggtcctggtgccagcaggcagcgccagaccagtggccttctcggtcgtgccaaccgcagctgccgcggttagcctcaaggtcgtggcaagaggctcatttgagttccctgtgggggacgccgtgtctaaagtcttgcagatagagaaggagggagccatccaccgtgaggagctcgtctacgagcttaacccactagatcatcgcggcagaaccctggagatccctggcaattctgatcctaatatgattcctgatggcgactttaatagctatgtccgggttacggcgagcgacccccttgataccctcggcagtgagggagctctgagtcccgggggcgtcgcttctcttctgcgcctacccaggggctgtggtgagcagacgatgatataccttgctcccaccctggctgcgtctcggtatctagataaaaccgaacagtggtctacactgcctccagaaacaaaggatcacgcagtcgacctgatacagaaaggctatatgcggatccagcagtttaggaaagcggatggatcctacgctgcttggctgagcagagatagcagcacttggttaacagcttttgtgctcaaagtactgtccttggctcaggagcaggtcgggggcagccccgaaaaattgcaagaaacatccaattggttgctcagccaacaacaagcggacgggagcttccaggacccatgccccgtgctagaccgttctatgcagggtggcctggttggaaacgatgagacagtggcactgacagcctttgtgactatcgccctccatcatggtctggctgtgtttcaggatgagggtgcagaacccctgaaacaacgtgtcgaggcttccatttctaaagcttcctctttcctcggagaaaaggcatccgccggcttgctgggggcacatgccgcagccatcactgcctatgccttaacccttactaaggcccctgtggatctcctgggagttgctcacaataatttgatggccatggcccaggaaaccggcgataatttgtactggggatccgttaccggctcacagtcgaacgccgtctctccaacacctgcccccagaaatccaagtgaccccatgcctcaagccccggcgctgtggatcgagactacagcctatgcccttttgcacctgcttctgcacgaaggcaaagctgaaatggcagaccaggcagcagcatggctcactcgacaaggttcctttcagggaggatttcgaagcacacaggatactgtcattgccctggacgctctatccgcctactggatagcatcgcacactaccgaggagagggggttgaacgtgactctttccagcaccggcagaaatggatttaaatcgcatgcactccaattgaacaatagacagattcgtggcctggaagaggagcttcagtttagtttaggctctaaaattaatgttaaggtgggggggaattctaaggggactttaaaggtgctcagaacctataatgtgctggacatgaagaacacaacatgccaggacctccagatcgaggtcacggtgaaagggcatgtcgaatatacaatggaagccaacgaggactacgaagactacgaatacgacgaactgcccgctaaggacgatcccgacgcccctctacagcccgtcacgcccctccaattatttgagggacgccggaaccgcagacgcagagaggcgcccaagcttacttccttgtcggaccgatatgtctcacacttcgagaccgaagggccacacgtactcctgtattttgatagcgtgccaacatccagggaatgtgttggcttcgaagctgtgcaagaggtcccagtaggactggtgcagcctgccagcgctacactgtatgactattacaatcccgaaagaaggtgtagcgtgttctatggagcaccttctaagagcagactccttgctacgctgtgctctgccgaggtgtgtcaatgcgctgagggcaaatgccccaggcagcggcgcgcactggagcgtggcctgcaagatgaggatggttatagaatgaaatttgcgtgttactatcctagagttgagtacggtttccaggtaaaggtgctgagagaggactcgagggcggccttcaggctctttgagactaaaatcacgcaagtgttacactttaccaaggacgttaaagcggccgccaaccagatgaggaatttcctggtgagggcgagttgtaggctccgcctagagcccggtaaagagtacctcattatgggtctagatggagcaacatatgacttggagggtcacccccagtacctgctcgactctaactcgtggattgaagaaatgcctagcgaaagactttgtcgctccacaagacagcgtgcagcttgcgctcagctcaatgacttcttacaggaatacggtacccagggctgccaggtgtag

SEQ ID NO: 183669 - DNA, 5097 bp, Artificial Sequence
  Description of Artificial Sequence: Synthetic coding sequence
atgcggctgctgtggggcctgatctgggccagcagcttcttcaccttgtcattacagaaaccacgtcttctgttgttctccccatctgtggtgcacctcggcgttccactctcagttggcgttcagctccaagacgttccccgtgggcaagtcgtcaaaggaagcgtgtttctccgcaacccaagtcggaataatgtgccgtgttctccaaaggtggacttcactctgtcctctgaacgagacttcgccctgttgagtctgcaggtgcctctgaaggacgccaagtcttgcggactccatcagctgcttcgggggcccgaagtgcaactggtggcacattccccatggcttaaagatagcctgtccaggacaactaacatccagggcatcaacctattgttttcttctcgacgcgggcatctcttcctacagaccgatcagccgatctataacccagggcagagggttaggtacagggtatttgcactggaccagaagatgaggccctctaccgataccatcactgtgatggtggagaacagtcacggactgcgcgtgcgcaagaaagaagtgtatatgccctcaagcatctttcaagatgatttcgtgatacccgacatatctgaacccggaacctggaagataagcgcccgcttttccgatgggctggaatctaacagctctacacagtttgaggtcaagaaatatgtgctgccgaactttgaggtcaagattacgcctggaaagccttatatccttacagtgcctggccacctggacgaaatgcagctggatattcaagccaggtacatctacggaaaacccgttcaaggtgtggcctatgttaggtttggcctgctggatgaagatggcaagaagacgttttttaggggccttgaaagccagaccaagctggtcaatggccagagccatatcagcttgtccaaggccgaatttcaggacgccctagaaaaattaaatatgggaatcacggatctccaggggttaagactgtacgtggcagccgctattatcgagtacccagggggagagatggaggaagccgagttaactagttggtacttcgtgtctagtcccttctcgctggaccttagcaaaacaaagcgccatctggtgcctggtgcccccttcctcttgcaagcactggttcgagagatgtccggatctcctgcaagcggtattccagtcaaggtgagcgctactgtcagtagtcccggctcagtccctgaggtccaggatatacagcagaacaccgatgggtcaggtcaagttagcatccctatcatcatcccccagacgatcagtgagcttcagctgtccgtaagtgccggtagcccacacccggccatcgcccgcctgacggtcgcagctcctccttccggagggcctggttttctgagcatagaaaggccggactctcggcctccgagggtcggcgatactctgaatttaaatctcagagcggtcggctctggagctacctttagtcactattactacatgattctgagccgcggccagatcgtctttatgaatagagagcctaagcgaaccctcacttccgtgagcgtgttcgttgaccaccatcttgcgccctcgttttatttcgtggccttctactatcatggggaccatcctgtcgctaatagcctcagagtggacgtacaggcaggggcctgtgagggcaagctcgagctctcagtcgatggagccaaacagtacaggaacggcgagtctgtgaaactccatctcgagacagatagcctggctcttgtcgctctgggtgccctggataccgccctctacgccgccggctcaaaaagccacaagcccctcaacatgggcaaagtctttgaagcaatgaattcctacgatctgggctgcggaccggggggaggagactctgcgcttcaagtcttccaggccgctggattggccttttcagacggagatcaatggacactctccaggaagagactgtcttgtcctaaggaaaagaccacaaggaagaaaagaaacgttaacttccagaaggctatcaatgagaagctggggcagtatgctagcccaaccgccaagaggtgttgccaggacggcgttactcggctccccatgatgcggtcttgcgaacagcgcgccgctcgggtgcaacaacctgactgccgggagccctttctgtcctgttgccagtttgcagagagcttgaggaaaaagagtcgtgataaggggcaggccggactgcagagagccctggagatactccaagaggaggacctgatcgatgaagatgatatccctgtcaggtcattttttcccgaaaattggttgtggagagtcgagacagtagaccgatttcagattctcaccttatggctcccagactccctgaccacttgggaaatccatgggctgtctctgtccaaaactaaggggctatgtgtcgcaacccctgttcagctgagagtttttcgggagttccacctgcacctgcgtcttccaatgtcagtgcgcaggtttgagcagctggaattgaggcctgtgctgtacaactatctagacaagaacctgaccgttagtgtgcacgtgtcccccgttgagggtctgtgtctcgcaggaggaggaggtttggctcaacaggtgctggtgcctgccgggtccgcaagacctgtcgcttttagcgtagtacccactgcagccgcagccgtctccttgaaagtggtggctagaggttctttcgaatttccagtcggcgatgccgtgtctaaggtattacagatcgagaaggaaggcgcaatccaccgggaagaactggtttacgagcttaaccctctggaccacagggggaggacacttgagatccccggcaacagcgacccaaatatgattccggacggcgatttcaacagctatgtgagagtcacagcatcagatcccctcgatacactgggtagtgaaggggccctctccccaggcggtgtggcatctctgctaagactcccacgcgggtgcggagaacagaccatgatctaccttgcccccaccctagccgcctccagatacctcgataagacagagcagtggagtaccctacctcccgagacgaaagatcacgccgttgaccttattcaaaagggttatatgaggatccaacagtttagaaaagctgacggctcatacgccgcctggctgtccagagactccagcacctggttgaccgcgttcgttttaaaagtcctaagtctagctcaggagcaagtgggagggtcaccagagaagctccaagagacctctaactggcttttgtcccagcagcaggcagatgggtccttccaggatccatgtcccgtccttgacagatcaatgcaaggcgggctggttggcaatgatgaaactgtggcccttactgcgttcgtgactatagctctgcatcatggcttggccgtgttccaagatgagggcgccgaacccctgaaacagcgcgtcgaggcctctattagtaaggccaactcctttctaggcgagaaagctagtgctggcttgctgggagcccatgccgccgcaattactgcttacgcactcacgctcacaaaggcccctgtagacctcctgggcgtagctcacaataatctgatggcaatggcccaagaaaccggggacaatctgtattggggcagcgtcacaggaagccagtctaatgctgtgagcccaacacccgcacccagaaatccttcagacccaatgcctcaagcccccgccctgtggatagaaacgaccgcttacgctctgctccacctgctgctccacgagggcaaagcggagatggctgaccaggccgcagcatggcttacacgccagggcagcttccagggggggttccggtccacccaggataccgtgattgcactggacgccctgagtgcctattggattgcctcgcatacgactgaagagcgagggttgaatgttacattaagctccacgggacgcaacgggttcaagtctcatgccctgcaactgaacaacagacagatccgcggactcgaggaagagctgcaattttccctcggaagcaaaatcaatgtgaaagtgggaggtaacagtaagggcactctcaaagtgttgcgcacttacaacgtgcttgacatgaagaacacaacatgccaagacctgcagatagaggtgactgtgaagggccacgttgaatacaccatggaagccaacgaggattacgaggactatgaatatgacgagctgcctgctaaagacgaccctgacgcacctttgcagcccgtaactcctttgcagctgttcgaggggcgtcggaaccgccggaggcgggaggctcctaagctgaccagccttagtgaccgatatgttagccactttgagaccgagggaccacacgtgctgctctatttcgattctgtcccaacctctcgagaatgcgtgggctttgaggcagtacaggaagtgcccgtaggactggtgcaaccagctagcgccacattatacgactactacaaccccgagcgccgctgttctgtgttctatggggccccgtccaagagcaggttacttgccactctgtgtagtgccgaagtgtgccagtgcgctgagggcaagtgccctaggcagaggagagctctggagaggggtttgcaggacgaggatggctatcgaatgaagtttgcctgctactatcctcgggtggaatatggatttcaggtgaaggttctacgggaggactcccgtgctgcttttcggctcttcgagaccaagataacgcaagtgcttcatttcacaaaagacgtcaaagcagccgccaatcaaatgcgcaatttcctggtgagagcgagttgcaggctgaggctagagcccgggaaagagtatcttattatgggcctggacggcgcaacttatgatctggagggacatccccagtacctcttggattctaattcttggattgaggaaatgcccagtgaacggctttgtcgatccacacgacagcgggctgcctgcgcccagttgaatgatttccttcaagagtatggaacgcaaggatgtcaggtttag

SEQ ID NO: 183670 - DNA, 1536 bp, Artificial Sequence
  Description of Artificial Sequence: Synthetic coding sequence
atggccaagggcctgagcgtgcagaacgacaagcaccccggctaccagcctgcgctattgctgtcaccaggagcccccctttttgccgatggcccggcctatgccttgctgcacttgctgctgcatgagggcaaggcagaaatggccgaccaggcagccgcctggctgaccaggcagggtagctttcaggggggattcaggtccacccaggacaccgtgatcgcactggacgcgctgagtgcttactggattgcctcacataccacagaggaaagaggcctgaatgtgaccttgagttccaccggacgaaatgggttcaagtctcacgcgctgcaattaaataataggcaaatcaggggcttggaggaggaactgcaattttcccttggatctaagattaatgtaaaggtgggtggcaattccaagggcacactgaaagtcttgaggacttacaatgttctcgacatgaagaataccacttgccaggatttacagatcgaggtcactgtaaaaggccacgtcgaatatacaatggaggccaatgaagattatgaggactatgagtacgatgagctacccgcaaaggatgacccagatgccccattacaacctgtcaccccactccagctgtttgaggggcgccgtaatcgcaggagaagagaggcacctaaagtcgtggaggaacaggagtctcgcgtgcattacacggtctgcatctggcgaaacgggaaagtgggcctatccggtatggccatcgccgacgtaacccttctgtccggcttccatgccctcagagccgatctggaaaagctgacctccctaagcgatcggtacgttagtcacttcgagactgaaggcccacacgtcctcttgtattttgacagcgttccaacatcacgagaatgcgtggggtttgaggctgtccaggaagtccccgtgggtctcgttcaacccgccagtgccaccctctacgattactataatcccgagaggagatgttcagttttttatggcgcaccctcgaagagtcgcctgctggcaaccctctgcagcgccgaggtgtgtcagtgtgccgaaggcaagtgcccaaggcaacggcgtgcattggagcgcggcttgcaggacgaagatggctacaggatgaagttcgcttgttattatcctcgtgtggagtacgggtttcaggtgaaagtgttaagggaggactccagagccgctttccgtctctttgagacaaagatcacccaggtattgcactttactaaggacgtgaaggctgctgctaatcaaatgcggaattttcttgttagggcctcctgccgacttcgcctggagccaggcaaagaatacttgattatggggctggacggggcaacatacgatcttgagggacaccctcagtaccttttagacagcaacagttggatcgaggagatgcccagtgagaggctgtgcagaagcacccgccagcgcgccgcatgtgctcagttaaatgatttcctccaggagtatgggacacagggctgtcaggtgtag

SEQ ID NO: 183671 - DNA, 813 bp, Artificial Sequence
  Description of Artificial Sequence: Synthetic coding sequence
atgtgccccgaggacagcctgcaggtgcccctgaaggacgccaagagttgcggactccatcagctgctgcgaggccctgaagtccagcttgtcgcccatagcccttggctcaaggattctttgtcacgcacaactaacatccagggcatcaatcttttgttcagtagccggcgggggcacctattcctgcagaccgaccagccgatctataatccaggccagcgcgtgcggtaccgcgtttttgcactggaccagaagatgcgcccctcaaccgacacaatcaccgtcatggtcgagaattcccacgggctcagggtcaggaaaaaagaagtttacatgccaagcagcatctttcaggacgacttcgtcatcccggatatctccgagccgggcacatggaagatctctgcgcggttctctgacgggctggagtcgaactcctcaacacaattcgaagtgaagaagtatgtgctgccgaacttcgaagtgaagatcacccccggtaaaccgtacattctcaccgtcccaggccatttggacgagatgcagctagacatccaggcgaggtatatctatgggaaaccagttcagggagtggcttatgtcagattcggcttgctagacgaggacggtaagaagaccttctttcggggactcgaaagtcagacaaaactcgttaatggccagagccatatctcgctgtccaaggcagagttccaggacgccttggaaaagctcaacatggggattactgacctgcagggactgcgactttatgtggctgccgcaatcatcgagtaccccggaggctag

SEQ ID NO: 183672 - DNA, 5235 bp, Artificial Sequence
  Description of Artificial Sequence: Synthetic coding sequence
atgcggctgctgtggggcctgatctgggccagcagcttcttcaccctgtcacttcagaagccaagacttctgctgttctccccttccgtagtacacttaggtgtccccctttccgtcggggttcagctccaggatgtgccccgcgggcaggtcgtgaaaggctcagtcttcctaaggaatccgagccggaacaatgttccgtgttcccctaaagtggacttcactttaagtagtgaacgtgactttgctttgctctccctgcaggtacctctcaaggacgctaagagctgtggtctccatcagctgcttagaggtccagaggtccagctggtagcacattcaccttggctgaaagacagcttgagcaggacaacgaacatccagggcattaaccttctctttagttcacgccgcggtcatttgtttttacagacggatcaaccaatatacaacccaggccaaagggtgcggtatagggtttttgcactggaccagaagatgcgaccttctacagacacaattactgtcatggttgagaattcccatggcctgcgggtacgcaagaaggaggtctacatgccctcctcaatttttcaggatgacttcgttatcccggacattagtgaaccaggcacgtggaagatatctgcccgcttttcggatggcttggaaagcaattcctctacccagtttgaagtgaaaaagtacgtcctgccaaactttgaagttaagattacgccagggaagccttacatcctgactgtccccggacacttggatgaaatgcagttggatattcaggcgcgctacatctacggcaagcccgtacagggagtggcatatgtacgcttcggtctcctggatgaggatggaaagaaaacattttttcgcggtctggagagccagacaaaactggtgaacggccagtcccacatttccctgtcaaaggcggagttccaggatgctttggaaaagcttaacatgggcattaccgatcttcagggcctgagactgtatgtggcggctgccatcattgaatccccgggaggcgaaatggaagaagctgagctcacctcatggtatttcgtctcatcccccttttccctcgacttatccaaaaccaaaaggcacctggtcccaggtgcgccctttttgttacaggcccttgtgcgcgagatgagcggaagtccggcatcgggaataccagtcaaagtgagtgccaccgtgagtagccccggaagcgtccccgaagttcaagatatccaacagaacacggatggatcaggtcaagtttctatccctataatcatccctcaaactatcagcgaactgcagctgtccgtcagcgccgggagcccgcacccggcgatcgctcgactgaccgtcgccgcccccccttctggcggcccaggtttcctgtcgatcgaacgcccagatagccggccaccccgggtgggtgatacacttaatctgaatttgcgagctgtcggatctggagcaactttctcccactattactatatgattttaagccgtggccagattgtctttatgaaccgggaaccaaagaggacactgactagtgtttccgtgttcgtagaccaccacctggctccttccttctatttcgtggccttttactatcacggtgaccaccccgttgccaatagcctgcgcgtagacgtgcaggccggtgcttgcgagggaaaactggaactgagcgtcgatggcgcgaaacagtatcgaaacggcgagagcgtgaagctccacttggagacagatagcctggctttagtcgcgctgggcgccctcgataccgccctgtacgcagccggctctaaatcgcacaaacctttaaatatggggaaagtcttcgaagcaatgaattcttatgatctaggctgcggccctggggggggggattccgcccttcaggtattccaggctgcggggctggctttctccgatggcgatcaatggacattgagtcgtaagagactctcttgtcccaaggagaaaacaactaggaaaaaacggaacgtcaattttcagaaagccattaacgaaaaacttggtcagtatgccagccctaccgcaaaaaggtgctgccaggacggggtgacgcgacttcccatgatgcggtcttgcgaacaacgcgccgccagagtgcagcagcctgattgccgggaaccattcctgtcgtgttgtcagtttgctgaaagtctgagaaaaaagagtcgagacaaagggcaagccgggctacagagggccttagagatcctgcaggaagaggatcttatcgacgaggatgatatccctgtccgttctttttttccagagaactggttgtggcgggtcgaaactgtggatcgctttcagatactgaccctgtggctgcctgatagtctcacaacatgggagattcacggtctgtcactctcaaagaccaagggcttgtgcgtcgccacgcccgtgcagctgagagttttccgggagtttcatctgcacctgcggctgcctatgtccgtaagacgcttcgagcagctggagctgcggccagttctttataattacctggacaaaaacctcaccgtgagcgtgcatgtatcaccagtggaaggcttatgcttggctggagggggtggtctggcacagcaggttttagttcccgccggctccgctagacctgtcgccttctcagttgtacctacagctgcgaccgccgtttcccttaaagtcgtcgcccggggatcttttgaattccccgtgggtgacgccgtgtctaaagtactgcagatcgagaaagaaggtgcaatccatagagaagagctggtctacgaacttaaccccttggaccaccgggggcggactctcgagatcccaggaaatagtgatcccaacatgattcctgatggagacttcaactcgtatgtccgcgtcacggcaagtgatccattagatacactcggaagcgaaggggcgctgagcccaggcggtgtggcttccctcctgcgcctcccccgcggctgcggagagcagactatgatttaccttgcccctactcttgcggccagtaggtatcttgataaaaccgaacagtggagcacactacccccggaaacaaaagaccatgcagtcgacctcattcagaaggggtacatgcgcatacaacagtttaggaaggctgacggtagctatgctgcttggttaagccgcggctcgtcaacctggttaacagccttcgtgttaaaagtgttgtcacttgctcaggaacaggtcgggggatctccggaaaagctccaagaaacttctaattggctgctgtctcagcagcaggctgacggctcatttcaggatctatcacccgtgatacatcggtcaatgcaaggcggcctggtcggcaatgatgagaccgttgctttgaccgccttcgtgactattgcgctgcatcacggtctggctgtcttccaagatgagggggcagagcctctcaagcagcgggttgaggcaagtatttctaaggctagcagcttcctgggagagaaggcaagcgcagggttgctcggagcgcacgccgcagcaatcactgcatatgccctgacactgactaaggcccccgccgacctgcggggagtcgctcacaataatcttatggctatggcgcaggaaaccggcgataacttgtattggggcagtgtaaccgggagtcagagcaacgccgtgtctcccacacctgcccctagaaacccttctgatccgatgccccaggctcctgccctttggattgagactaccgcctacgcactgctacatttgctgcttcatgagggtaaggccgagatggccgatcaggctgcagcttggctcacacgtcagggcagcttccagggcgggttccggtccacacaggatacggttatagcgctcgacgccctgtcggcctactggattgcatcccataccactgaggagaggggccttaacgtgaccctgtcctccactggcaggaatggtttcaagagccacgccttacaactgaataatcgacaaatcagaggtctggaagaggagctacagttctcactgggatccaagataaatgtgaaggtaggtggaaattcaaagggcacgcttaaggtgctcagaacgtataatgtgcttgacatgaaaaatactacctgtcaggacctccagatcgaagtgaccgtgaaaggacacgttgaatataccatggaggctaacgaagattatgaagattatgagtacgacgagctcccagctaaggatgaccccgatgctccattacagccagtgaccccgctccaactttttgaagggaggagaaatcggcgacggagagaggcccccaaggtggtggaagagcaggagtcacgggtgcattataccgtgtgcatttggcgtaatggcaaggtgggcctgagcggtatggccatcgccgacgtgacactgctgtccgggtttcacgcactgagagcggatttggagaagctaacttcactgtcagaccgctacgtgagccatttcgagacggaggggcctcatgtgctgctgtactttgactctgtcccaacatcacgcgagtgcgtgggttttgaagctgttcaggaagtccccgttggcctggtgcaaccagctagcgcaacgctgtacgattactataatccggagcgacgatgctccgtcttctatggcgcaccctcaaagagtcggctcctcgccacgctttgttctgcagaggtctgccagtgtgccgagggaaaatgccctagacaaaggagagccctagagcgaggcttgcaagatgaagatggctaccgtatgaagtttgcctgctattaccctagggtggagtacggtttccaggtgaaagtgctgagagaagatagcagagctgctttccggctcttcgagacaaagataactcaggtgctccatttcaccaaagatgtgaaagcggccgctaaccagatgagaaacttcctggtgcgcgcctcttgccgtttgcggctggagcccggcaaagaatatctgattatgggactcgatggggcgacttacgacctggaaggtcacccccagtacctgttggatagtaacagctggatcgaggagatgccgtcagaacgactgtgcaggagtacgcgccagcgcgcagcgtgtgcacaactcaacgatttcttgcaggagtacgggacgcaaggatgccaggtgtag

SEQ ID NO: 183673 - DNA, 5097 bp, Artificial Sequence
  Description of Artificial Sequence: Synthetic coding sequence
atgcggctgctgtggggcctgatctgggccagcagcttcttcaccttgtctctccagaagccacgactgctgctattttccccctctgttgttcatctaggggtcccactcagcgtgggcgttcagctccaggacgttccccggggccaggtggttaagggatctgtctttttgcgtaatcccagccgcaacaacgtaccatgcagtcctaaggtcgacttcaccctgtcctccgaacgggacttcgcactgctgagcctccaggttcccctgaaggacgctaagtcttgtggactgcaccagctcttgcgaggtccggaagttcagctcgtagcacattccccctggctcaaggatagccttagcagaactacaaatatccagggaatcaacctgctgttctcttcccgccgcggacatctgttcttgcagactgaccaacccatctataatcctggccaacgagtcaggtatcgggtttttgctttggaccagaaaatgcggccctcaacggacaccattacggtgatggtggaaaacagccacgggttgcgagtgcgaaaaaaagaagtgtatatgccttcctctatattccaagacgatttcgttatacccgacatatctgagcccggaacttggaaaatcagcgctcgtttctctgacgggctggaaagtaacagtagcactcagtttgaggtgaagaagtacgtcctaccaaactttgaagtcaagatcacacccggaaagccatacatactgaccgttcccggacatctcgatgaaatgcagctggacatccaagccaggtatatttatggaaaacccgtgcagggtgttgcctatgtgaggttcggactgttggatgaagacggcaagaagacttttttccggggactcgagagtcagaccaagctcgtgaatggccagtctcacatctctctctcaaaggctgaattccaagatgctttggagaagctgaatatgggtattacagacctgcagggtctgagactttacgtagcggccgccatcattgaaagtccagggggtgaaatggaagaggcagagctgacctcttggtacttcgtgagttctccattttccctggatctctcaaagactaaacgacacctagttccaggcgcccctttcctgctccaggccttggtccgcgagatgtctggctcacccgcctccgggatcccagtgaaggttagcgcaacagtgtcttccccaggctcagtgcctgaggtgcaggatatccagcagaacaccgacggcagcggacaggtgagtattccaatcatcatcccccagacaatttctgagttgcagctctcagtgtctgcaggctccccacacccagccattgcacgactcacagttgctgcacctccttctggcggtcctggctttctaagtattgaaagaccagactccaggccccctcgggtgggcgacacgctcaacctgaatctccgcgccgtgggtagcggggcaacatttagccactactattatatgattctctccaggggacagattgtattcatgaaccgcgaaccgaagcgtaccctgactagtgtgtctgtgttcgtagaccatcacctcgctccctccttttactttgtagctttttattatcacggcgaccacccagtagccaattccctgcgcgttgacgtacaagcaggcgcgtgcgagggcaagctggagttgtcggtggatggtgccaagcaataccggaatggggagtctgtgaagttgcacctcgagacagatagcctggccctggtcgccttgggagccttggacactgctctgtacgcagctggttctaagtctcataaacctctgaacatggggaaggtctttgaggcaatgaactcctatgatctggggtgcggccctggcggcggcgactcggctcttcaggtgtttcaggctgcgggccttgcattctcggatggggaccagtggacactgtctcgcaaaagactctcctgccctaaggagaagaccacgcgcaagaagagaaatgtaaactttcaaaaagcgatcaatgagaagttaggccagtacgcctctccaacagccaagaggtgctgccaggatggggttactcggttacccatgatgcggagctgcgagcagcgagccgcccgcgtgcagcagcctgattgccgtgaaccttttctcagctgctgccagttcgctgaatcattaaggaagaagagtcgcgataaagggcaagccgggctccagagagctctggaaatattgcaggaggaagacctgattgacgaggacgatatccccgtacgcagtttcttccctgagaattggctgtggagagtagaaactgtagacagatttcagatcctgaccctgtggcttccggatagcctgaccacctgggaaattcatggactctccctgtctaaaactaaagggttgtgcgtagccaccccggtccagcttcgggtgtttagggagttccacttgcacctgcggctgccgatgtctgtccgcagatttgagcagctcgaattgaggcccgtgctgtacaactatctcgataagaacctgaccgtgtccgtgcatgtgtcaccagtggaagggctgtgcctggcagggggcggcgggctagcccagcaagtgttggtgcccgctgggtcggccaggcccgttgcatttagcgtggtgccaacagcggccacagctgtgtcccttaaggtcgtcgcacgcgggagctttgagttcccagtcggcgacgccgtgagtaaggtgctgcagatagagaaggagggcgctatccatcgtgaggagctggtttacgaacttaacccactcgaccatcggggacgcaccctggagatcccaggtaattcggatcccaatatgataccagacggcgattttaactcctacgttcgggttacagcatcggaccctcttgacacactcggatctgaaggggccctgtcaccagggggcgttgctagcctgttacgcctcccccggggctgcggggaacaaacgatgatatacttagcccccaccctggccgcatcccgatacttagacaagacagaacagtggagcaccttgcctccggagaccaaggatcacgcagtggatctgatccaaaaaggatatatgaggatccaacagttccggaaagccgacggttcttatgctgcctggctgtctagaggatcctccacctggctgactgcctttgttctcaaggtgttgagcctggcgcaggagcaggtgggggggtctccggagaaacttcaggagacttctaattggctactgtctcagcagcaagcagatggtagttttcaggacctctcacccgtgattcacaggtccatgcagggcgggctggttggtaatgacgagacagtggcactgactgcattcgtcacaattgcgttgcatcatgggcttgctgtgttccaagacgaaggagccgaacctttgaaacagcgggtggaagcttccatcagcaaagccagcagctttctcggggaaaaagcttcagcgggactcctgggcgctcatgcggcagctattacggcctacgccctgaccctgacgaaggctcccgccgatcttaggggcgttgcacacaataatctcatggctatggcacaggagaccggggacaatttatactggggaagtgtgacggggtctcagagtaatgccgtgtctccaacacccgcaccccgaaacccttcagacccgatgcctcaagcaccggctctgtggatcgaaaccacagcgtacgcccttcttcatctactgctccacgaaggcaaggctgaaatggccgaccaggcagccgcatggttgacacggcaaggttcatttcagggcggcttccgctctacccaggacaccgtgatcgccctggacgcactttccgcatattggatcgccagtcatacaactgaagaaagaggactcaatgtcacgctttcgtcaaccggtcgaaatggctttaaaagccatgcacttcagcttaataaccgccagattcggggtttagaggaagagctgcagtttagcttgggatcaaagattaacgtgaaggtgggcggaaattcaaagggaacgctgaaggtgctgagaacctacaacgtgctcgatatgaagaacactacctgtcaggatttacagattgaggtgactgtaaagggtcatgtagaatacaccatggaggcaaacgaggattatgaagattacgaatacgacgagctgcccgccaaggatgatccagacgcaccccttcagcctgtgacccctttgcaactgttcgagggccgcagaaatcggagaaggcgcgaagccccgaagctcacatccctgagtgaccgctacgtatcccatttcgaaactgaaggcccacatgtgttactctattttgacagtgttcccacatctagggagtgcgtaggcttcgaggcagtgcaggaggtacccgtggggctggtgcaacctgcctccgcaacactctatgattactataatcctgagcggaggtgttccgtgttctatggcgcacccagtaagagcaggcttctcgccactttatgtagtgctgaggtatgccaatgcgcggagggtaagtgtccaagacagaggcgtgctctggaaagaggcctgcaggatgaggacggatatcgcatgaaattcgcatgctattatcctcgggtggagtatggatttcaggtgaaagttctccgggaggactccagagcagcgttcagattgtttgagaccaaaatcacccaagtgttgcattttaccaaggacgtgaaagctgcggctaaccagatgcgaaacttcctggtgcgggcctcctgtcggctcaggctggaaccagggaaagagtatctcatcatgggactcgacggagcgacttacgatttagaagggcatcctcaatacctgctcgattctaattcctggatcgaggaaatgccctcagagagattgtgtaggtccacaagacagcgcgcggcctgcgcacagcttaacgattttctgcaagagtatggcacccaaggctgccaggtttag

SEQ ID NO: 183674 - DNA, 5235 bp, Artificial Sequence
  Description of Artificial Sequence: Synthetic coding sequence
atgcggctgctgtggggcctgatctgggccagcagcttcttcaccctgtcactgcagaaaccgaggctccttctatttagcccttctgtcgtgcaccttggtgtgccccttagcgtgggggttcaacttcaggacgtccctcgcggacaagttgtgaaaggaagtgtgtttttgaggaacccatctaggaataatgtaccatgtagccctaaagtggatttcacattgtcaagcgagagagactttgctctgctgagcctgcaagtccctttgaaagacgccaagtcctgtgggcttcatcagttgctaagagggcctgaggtgcaattggttgctcactccccgtggctgaaggactcgctaagcaggaccactaacattcaaggcattaatttgctgtttagctctagacgtgggcacctcttccttcagacagaccagcccatatataaccccgggcagagagtgcgatatcgggtgtttgctttggaccaaaagatgcggcctagcaccgataccatcacagtgatggttgaaaactctcatggtcttcgagttcggaaaaaagaagtttacatgccctcatcgatttttcaagacgatttcgtgataccagacatcagcgagcctgggacatggaagatttccgccagatttagcgacggtctagagtccaattcctcaacacaatttgaagtcaagaaatacgtcctgcccaattttgaggtgaagatcaccccgggcaagccgtacatcctcacagttcccggccaccttgatgaaatgcaattagacatccaggcaagatatatctatggcaagcccgtacagggtgttgcatatgtccggttcgggttgttagacgaagacggcaaaaaaacatttttcagaggccttgagtcacagacaaagctggtcaacgggcagtcccatatttcactgtctaaagccgagtttcaggacgcccttgagaaacttaatatgggcattacggatttacaaggcctccgtctgtacgtggctgcagctataatagaaagtcctggcggcgaaatggaggaggctgagctgacaagttggtactttgtgagcagtccattctccctcgacctctccaaaacaaaaagacacctggttccaggggccccctttcttttgcaagctcttgttcgagaaatgtcaggcagcccagcaagcggtatcccagtcaaagtcagcgcaacagtttcgtcccctgggagcgtgcctgaagtgcaagacatccagcaaaacactgacggttctggtcaggtgtctattcccataataataccacagacaatctccgaactgcagctttcggtcagcgcagggtcccctcatcctgctatagcacggctgacagttgctgctccgccctcagggggacctgggttcctatctattgagcgccctgactcaagaccacctagggtcggtgataccttgaacctgaacctgagggctgtagggtccggggccacctttagtcactactattatatgattctgtccagaggacagatcgtcttcatgaacagggaacccaaacgcacacttacttcggtcagtgtgtttgtagaccaccatcttgctccctctttctacttcgtggcattctattaccacggcgaccatcccgtagcaaactcgttacgcgtagatgtgcaggcaggagcctgcgagggcaagctcgaactgtcggtggacggagccaaacagtatcggaacggcgaatctgtgaaattacaccttgagaccgacagtctcgccttggtggctcttggtgctctcgacacagccctgtacgccgcgggcagcaagtcccacaaaccgctcaatatgggtaaagtgttcgaagcaatgaattcttatgatctcgggtgcgggcccgggggaggagatagtgccctgcaagttttccaggccgccggcctggcttttagcgacggagaccagtggacactgtcaaggaagcgcttaagttgccccaaagagaagacaacaagaaaaaagcggaacgtgaatttccaaaaggcaatcaacgagaagctgggacagtatgccagccctactgctaaacgctgctgccaggacggcgtcacccgcctgcctatgatgagaagctgcgagcagcgagccgcgcgggttcagcagccagactgccgagagccatttctgtcctgctgccagttcgctgagtctttacgcaaaaaatctcgagataaaggccaggctggcctgcagagggcgctggaaattctgcaggaggaagatctgattgatgaggacgacattcctgttcgcagtttctttcctgagaactggctgtggagggtggagaccgtagaccgttttcagatactgactctgtggctccctgattcgctaacaacatgggagatccacgggctttccttatcaaaaacaaagggcttgtgcgttgcgacccccgttcagcttagagtcttccgtgaatttcatctgcatctgcggttaccaatgtccgtgagacgtttcgagcagctggagttgcgtcctgtcctctacaattacctagacaaaaatctcaccgtgtcagttcacgtttcccctgtggaagggctgtgcctggccgggggtggcggtcttgcccaacaggtcctggtgccagccggatccgcccgcccggtggctttctctgtggtgcctactgccgccactgcggtctccttgaaggtggttgccaggggcagcttcgaattccccgtgggcgatgccgtgtccaaagtgttacagatcgagaaagagggtgccatccatcgtgaggaactggtctacgagctcaacccactcgaccaccgcggacggactctcgagatcccaggcaattctgatccaaacatgattccagacggcgattttaactcttatgtgcgcgtcacagcaagcgaccccttggacacgctgggatccgagggtgccctgagcccagggggagtggcgtccctacttagattgccaagaggttgcggtgagcagaccatgatttaccttgccccgacactcgcagctagtagatatctcgacaagaccgagcagtggtcaaccttgccccccgaaacgaaggatcacgccgtagacctgattcagaaaggatatatgcgcatacagcagtttagaaaagccgacggctcatatgcggcctggctgtctcgagggagtagtacctggctcacagccttcgtactgaaggttctgtcgctcgcccaggaacaggttggaggctctccagagaagttacaagagacctcaaactggctgttatcacagcagcaggccgacgggtccttccaagatctgtcacctgtgattcatcgctcaatgcaggggggccttgtgggcaacgacgaaacagtggctcttacagcgtttgtaacgatcgccctccatcatggtctggcggtgttccaggacgagggggccgagccactgaagcagagagtcgaggccagtatcagcaaggcctcgagttttctaggggagaaggcatccgcgggtctcctgggcgcacatgcagccgctattaccgcatatgcactcacactcacgaaagctcctgctgatcttaggggggtggcacacaacaatctgatggctatggcacaggagaccggggacaatctgtactggggatctgtgacaggctctcagagcaacgctgtgagtcctacccctgcgccacgaaatccatccgatccaatgccccaggctcccgccttgtggattgagactacagcttatgccctgctccacctgttattgcatgaagggaaggccgaaatggccgaccaggcagccgcctggcttacccgccagggctcctttcaaggtggctttcgctctacacaggatacagtgattgccctggatgccctgtccgcctattggatcgcctcacacacaactgaagaacgtggcttgaatgtgactctcagcagcacggggcgaaatgggtttaagagccatgccctgcagcttaataaccgacagatacgaggactcgaggaagagttacagttcagtctcggatcaaaaatcaatgtcaaggtgggaggtaactctaaggggacattaaaagtcctgcgcacttataatgtgctcgatatgaagaacactacctgccaggatctgcagatcgaagtaacagtgaagggacacgttgagtacaccatggaggcaaatgaggactatgaagactatgagtacgacgaacttccagctaaagacgacccagatgctccccttcagcctgtaacaccgctccaactttttgaggggagacgaaatcggcgaaggagggaagcccccaaggtggtggaagaacaggagtcccgcgtccactacaccgtgtgtatatggcgtaacggaaaggtgggattaagtgggatggcgatcgccgacgtgaccctcctcagtggctttcacgccctgcgagccgacctagagaagctgacctccctgagcgaccgctatgtatctcatttcgaaacagaaggaccgcacgtgcttctgtactttgattcagtgcctacctcccgggagtgtgtcggctttgaggctgtgcaggaggtgcccgtaggcttggtgcaacccgcctcagccactctgtatgactattacaatccagagcgcaggtgtagcgtcttttacggcgccccatctaaatcacgattacttgctaccctgtgctccgccgaggtgtgccagtgcgctgaggggaagtgcccacggcaaaggagagcactggaacggggtttgcaagacgaggatggatatcgcatgaagttcgcttgctactacccaagggtggaatatgggtttcaggtgaaagtgttgcgtgaggactcgcgagccgcgtttcgcctgtttgagaccaagattacccaagtgttacacttcaccaaggatgtaaaagcagctgccaaccaaatgagaaattttctggtgagagcctcttgtcggcttcgcttggaacccggaaaggaatatttgatcatgggcctcgatggtgcgacatacgatctcgaaggtcacccacagtacttgctcgattcgaactcgtggatagaggagatgccatcggagaggttatgccgatctacaagacaacgtgcagcttgtgcccagcttaacgatttcctgcaggagtacggcactcagggttgccaagtgtag

SEQ ID NO: 183675 - DNA, 5235 bp, Artificial Sequence
  Description of Artificial Sequence: Synthetic coding sequence
atgcggctgctgtggggcctgatctgggccagcagcttcttcaccctatcactgcagaaacccaggctgctgctgttctcacccagtgtggtgcacctgggagtccccctgtctgttggcgttcagctccaggacgttccccgcggccaagtcgtgaagggttcggtgttcctgagaaacccatctcgaaataacgtcccatgttcacctaaggtcgatttcacactgtcttcagagagagattttgctctgctgagcctgcaggtaccgcttaaggacgctaagtcctgtgggctgcaccagctgcttcggggaccagaggtccagctcgtggcccattctccgtggctgaaggacagccttagtcggaccacgaacattcagggtatcaatctcttattctcgagccggcggggccatttgttcctccaaaccgatcagcctatctacaaccctgggcaacgggtgcggtacagggttttcgccctcgaccagaaaatgagaccctctactgatactatcaccgttatggtcgagaactcacatggtctccgagttaggaaaaaggaagtttatatgccctcgtctatctttcaggacgatttcgtgattccggacatttcagaacctggcacttggaagatttccgccagattttctgacggcttggaaagcaacagctccacacaatttgaggtcaaaaagtatgtattacccaactttgaagtcaagattaccccagggaaaccttacattttgaccgtgccagggcatttggacgagatgcagcttgatatccaagcccgatacatttacggaaagccagtgcagggagtagcttacgttcggttcggccttctggacgaagacgggaaaaaaacattttttaggggtcttgagagtcagaccaagctagtcaacgggcagagccacatatccctcagcaaggctgagttccaggatgcattagagaagttgaacatgggtatcaccgacttacagggactgagactgtatgtggcggccgccattattgaatcccctggtggggaaatggaggaagccgagcttacttcttggtatttcgtgtcctctccgttcagcctcgacctgtcaaagaccaagcgtcatctggtcccaggcgcccccttcctgctgcaggctctggtgcgagagatgtctggtagcccagcctcaggcattcctgtaaaagtgtccgcaacagttagcagtcccggctcggtgcccgaagtccaagacattcagcagaatacagatggctccgggcaggtgtcaatacccataattatcccccagaccattagcgagttgcagctgtctgtgtctgccggcagcccacatcccgctatcgcacggttgactgtggcagccccaccatccgggggacccggcttcctgtctatcgagcgacccgacagcagaccccctcgcgtgggggatacacttaatctgaacctgagagccgtgggaagcggagctaccttcagccactattactacatgatccttagtagaggacagatagtgttcatgaatcgcgagcccaagcgcaccttaacatctgtgtccgtctttgtggatcatcacctggctccttctttttatttcgtcgccttctactaccatggcgaccacccagttgctaattcattgcgcgtcgatgtgcaggccggcgcctgcgagggaaagctggagctgtctgtggacggcgccaaacagtacaggaatggtgagtccgttaagctccacttggagaccgattctcttgctttagtggcgctgggagccctggataccgctctgtacgccgccggcagcaaatcccacaaaccccttaatatggggaaggttttcgaggcaatgaactcatacgatcttggctgcggaccaggtggaggggactcagctttgcaggtattccaggccgcaggtctggccttcagcgacggagatcagtggacgctgagccgcaagagactgagctgccctaaagaaaaaaccaccagaaagaagaggaacgtcaacttccagaaagctataaacgagaagctgggccagtatgccagcccgacggcgaagcgctgctgccaggatggcgtgacacgattgcccatgatgcggagctgcgagcagcgggcagcccgcgtgcaacagcctgactgccgtgagccgtttttgtcctgctgtcaatttgccgaaagtcttcgcaaaaagagccgcgataaaggacaggctggtttacaaagagctctggaaatcctacaggaggaggacctgattgatgaagatgacatccctgttagatcctttttccccgagaattggctgtggcgtgtcgagaccgtcgaccgattccagatcctcacactctggcttcccgacagcttaacaacttgggaaatacatgggctgtctctgagcaagaccaagggtctgtgcgttgccacacccgtccagctccgtgtttttcgcgaattccacctgcatctgaggctccccatgtcagtccggagattcgaacagctggaactgcggcctgtcctttacaactaccttgacaagaatctgaccgtgtccgtgcatgtttctccggtggaaggtctgtgtctggctggaggcggtggcctggcccagcaggtgctggttcccgccggaagtgcccgcccagttgccttttcggttgtgccaaccgccgctgccgctgtcagccttaaagtagtggcacgtggatcgtttgaatttccggtgggtgacgcggtgtccaaggtgctgcagatcgagaaggagggcgccattcaccgcgaggaattggtctatgagttgaaccctctggaccatcggggacgaactcttgaaattccggggaactcggaccccaatatgatacctgacggggatttcaactcctatgttcgcgttactgcgtccgatccacttgatacactcggatctgagggggccctatctcctggcggagtggcttccctgctgaggcttcctcgcggctgcggcgaacagaccatgatctatctggcgccaacgctcgccgcttctaggtacctggacaagactgagcagtggagcacattacctcctgaaactaaggaccatgcggtggacctgattcagaaaggctacatgagaatccaacagtttcgcaaagcagatggttcatatgctgcttggttgtcacgggggtcctccacgtggctcactgctttcgtgctgaaagtactcagtttggcacaggagcaggtgggcggaagccccgagaaattacaggagacctcaaactggttgctgtcccagcagcaagcagacggttctttccaggatctgtccccagttatccacagatcgatgcagggcggcctggttggtaacgatgagacggtcgcgttgacggctttcgtgaccatcgctctgcaccatggtttagccgtctttcaggacgagggagccgaacccctgaaacagcgcgtggaagcatctatcagcaaggcaaactcattcctgggtgagaaagcttcagccggcctacttggagctcatgctgccgctatcacagcttacgctttaaccctcactaaagctcctgccgacctgcgcggcgtcgctcacaataaccttatggctatggctcaggagacaggcgacaatctctactggggttctgtcacgggcagccaatccaatgccgtttcccccacgccagcaccacgcaatccaagcgaccctatgccccaggcacctgcgctctggatagaaacaacagcatatgccctcttacacctcttgctccatgagggcaaagcagaaatggcagatcaggcggcggcttggctgaccaggcagggctctttccagggaggcttccgatccacccaggacactgtgatcgccctggacgcactaagtgcttactggatagcctctcatacaacagaggaacgagggctcaatgtgactttgagcagtaccggtcggaatggttttaaatctcacgcgctgcagctcaataatagacagattcggggcctcgaggaagaactacaatttagcctggggtcgaaaatcaacgtaaaggtgggaggcaattccaagggcacattaaaggtcctgagaacatacaatgtgctagatatgaagaatacaacctgccaggacctccagatcgaggtgacagtgaaaggacacgtggaatacactatggaagccaatgaggactacgaggattacgagtacgatgagctaccagccaaggatgatcccgatgccccacttcagcctgtgacccccctccagttgttcgagggaagacgcaatcgtcgaagaagggaagctcccaaagtggtggaagaacaggagtcccgcgttcactataccgtgtgcatttggcggaatggtaaagtcggcctaagtgggatggcgatcgccgatgtaacactgctttccggctttcacgccttgagggccgatcttgaaaaacttaccagtctgtccgatagatatgttagccatttcgaaacagaaggcccacatgtactgctgtatttcgattctgttcccacttctagggaatgcgtggggttcgaagccgtccaggaggttcctgttgggctcgtgcagccggcaagcgccactctgtacgattattacaatccagaacggaggtgctccgtattctatggcgccccctctaagtccagactgctggctactctatgctctgcagaggtctgtcagtgtgccgagggcaagtgtccccgtcagagaagagccctggagaggggactgcaggatgaagatggataccggatgaagtttgcctgttattacccacgggtcgaatacggattccaggtgaaggtactcagagaggactcccgcgcggcttttcgactgtttgaaacgaagattacacaggtgctacacttcaccaaggacgttaaagcagcggctaaccagatgcgcaacttcctggttcgcgcgagctgcaggcttaggctcgagcctggtaaggagtatctgataatgggcctggacggagctacctacgacttagagggtcaccctcagtacctgttggattccaattcatggatagaggaaatgccatcagagagactgtgtcggagtacgcggcagcgcgcggcttgtgcccaattgaatgacttcctgcaggagtatggtacccagggttgccaggtgtag

SEQ ID NO: 183676 - DNA, 807 bp, Artificial Sequence
  Description of Artificial Sequence: Synthetic coding sequence
atgtgccccgaggacagcctgcaggtgcccctgaaggacgccaagtcttgcggactccaccagttgcttaggggtcccgaggtacagcttgtggctcattcaccctggctgaaagattctctcagccggacaaccaacattcaggggatcaatctattgttttcatcccgacgaggccatctgttcctgcagactgaccaacctatctataatcccgggcagagggtgcggtatcgtgtttttgcattggaccaaaagatgaggccttccaccgacactatcactgttatggttgagaatagccacggacttcgagtacgaaagaaagaggtttacatgccctctagcatctttcaggacgacttcgtgattccggatatatctgagccaggtacatggaagattagcgccagattctcagacggcctggagagtaactcaagcacccaattcgaagtcaagaagtatgtgttgccgaactttgaagtgaagatcactccaggcaaaccttatattctgacggtacccggccatctagatgagatgcagctagacattcaggcgcgctacatttatggcaaacctgtccagggtgtggcttatgtgaggttcggtctgctggacgaagacgggaagaagactttcttccgaggcctggagtctcaaacaaagctggtgaacggacagtctcacattagtttgagcaaagctgagttccaggacgctctggaaaaacttaatatgggaatcaccgacctccagggtctgcgcctttatgtggctgctgcaatcattgaatcaccatag

SEQ ID NO: 183677 - DNA, 5097 bp, Artificial Sequence
  Description of Artificial Sequence: Synthetic coding sequence
atgcggctgctgtggggcctgatctgggccagcagcttcttcaccctctctctacaaaagccaagactgctgctattctcaccaagtgtcgtgcatctaggagttccactgtccgtgggcgtgcaactccaggatgttccccggggccaggtggttaaggggtcagttttcctgaggaatccttccagaaacaacgtgccctgttccccgaaagtggattttaccctcagtagtgagcgggattttgccttgctttctctgcaggttcccctaaaggacgccaagagttgtggactgcaccagctactgcgcgggccagaggtacagttagtcgctcatagtccctggctgaaagatagccttagccgcactaccaacatccagggtatcaacctgcttttcagttcacggcgtgggcatcttttcctccagaccgatcaaccgatttataatcccggccagagggtcaggtaccgcgtgttcgcactggaccaaaaaatgaggccttcgacagacacgatcacagtgatggttgaaaattcacacggtttgcgagtccggaagaaggaggtgtatatgccctcttcgatctttcaggacgacttcgtcattcctgatatttctgaacctggcacttggaaaatttctgcaaggttctcagacggcttagaaagtaacagttcaacacagttcgaggtgaagaaatacgtgctgcctaactttgaggtgaagatcactcccgggaagccctacatcctcaccgttcctggccacctggacgaaatgcagctggacatccaggctagatatatttatggaaagccagtgcagggagtggcctatgtaagattcggattgcttgatgaagatgggaaaaaaacattttttagaggcctggaaagccagaccaagctggtgaacggccagagtcacatttctttgagtaaagctgagttccaggacgctctcgagaagctcaacatgggcattacggatctacaggggctgcggctatatgtcgctgccgcaatcattgagagtcccgggggcgagatggaggaggccgaattgactagctggtatttcgtgagctcaccttttagtcttgacctttccaaaacaaagcgacacctggtacccggcgcacccttcctactgcaggccctcgtacgcgaaatgtctggaagcccggcatctggcatccccgtcaaagtgtcagctactgtctcgtctcccggatccgtgcccgaggtccaagacattcagcagaatactgacggctctggacaggtttcgattccaatcattataccacaaactatctctgaattgcagctgagtgtatctgccggctccccccaccctgctatcgctcgtctgacagtggcggccccacctagcggtggaccaggcttcttgtctatcgaaagaccggactcacggccacccagggtgggtgacactctgaacctcaatttgcgtgctgttggcagtggagctaccttctcccactactactacatgattctttccagaggccaaatcgtctttatgaaccgcgagcccaagaggactctgacatccgtaagcgtgtttgtcgatcaccacctagcaccctccttctactttgtggccttttattaccatggcgatcatcctgttgccaactctctgagagtggacgttcaagcaggtgcctgtgaaggaaaactggaactttctgtggatggagctaagcagtacagaaatggagagtctgtcaaacttcacctcgagaccgacagcctcgccctagtggcgctcggagccttagacactgctctttatgccgctgggagcaagtcacataagcctctaaacatgggtaaggtgtttgaggccatgaatagttatgatctgggctgcggcccagggggcggcgactccgccttgcaggtcttccaggctgccgggctggccttctccgacggcgatcagtggactctgagcaggaagcgcctcagctgccccaaggagaaaactactagaaagaaacgcaatgtgaatttccagaaagcgattaacgaaaagcttggccaatatgcttccccaacagccaagcggtgttgtcaggatggcgtgacaagactgccgatgatgcgatcttgcgaacagcgcgcagctcgcgttcaacagcccgactgtcgtgaacctttcctgtcctgttgccagttcgccgagtccctccggaagaagtctcgcgacaaaggtcaagccggtctgcagagagcactggagatactgcaggaagaagatcttatagatgaggacgacataccagttcgatccttcttccctgagaactggctctggagagttgagacggtggaccgcttccaaatcctgacactttggttgcccgacagcttgacgacctgggaaatccacggcctcagcttgagcaaaacgaagggtctatgtgtggcaacccccgtacagttgcgggtgtttcgcgagtttcacttacacctgcgcctccctatgtcagtgcgcagatttgaacaacttgaactgaggccagtcctgtacaattatctcgacaaaaacttaactgtgagcgtgcacgtgtcacctgtggaggggctgtgtttagcaggcgggggcggtttagctcagcaagtgctggtgccagctggtagcgcccgccctgtggcgttttccgttgtgccgacagcagccgctgcagttagtctcaaggtagtggcccgtgggtcttttgaattcccagtgggggacgccgtcagtaaggtgctccagattgaaaaagagggggctattcacagagaagaactcgtgtatgaattgaaccccctggatcaccgcgggaggacactagagatccccggcaactccgaccccaacatgattccagacggagactttaactcgtatgtgagggtaacagcgagtgacccgctcgatactctgggttccgaaggagctctgtctccgggaggcgtcgcaagccttctgcggttaccccggggctgcggagaacagaccatgatctatctagctccaacgctggcagccagcaggtacttagataagacggaacaatggagcacactgccacccgagacaaaagatcacgcggttgacttgatccagaaaggctacatgaggatccagcagttcaggaaagcagacggctcttacgctgcttggctgagccgcgggtcctccacatggctcacagcgtttgtgctcaaagtactgtcgctggctcaggagcaggtcgggggcagcccagagaaactgcaagaaacaagcaactggttgctatcccagcagcaggctgatggatcttttcaggatctgagcccagtgatccaccggtctatgcaaggcgggctcgtcggaaacgacgagaccgtcgccctgaccgcctttgtgacgatcgccctccatcacggattagcagtctttcaggatgagggtgcggaacccctgaagcagagagtggaagctagcattagcaaagccaattcctttctgggggagaaagcgagtgccggactgctcggggcccacgctgccgctatcaccgcttatgcactaacattgaccaaggccccagctgatttgcgcggagtggcccacaacaatctcatggcgatggcacaggagaccggggataacctgtattggggatcagtcacaggctcccagagcaacgcagtaagtccaacccccgcccccagaaacccatccgaccccatgccacaagcccccgcgctgtggattgaaactactgcctacgccctcctgcatctcctgttgcacgaagggaaggccgaaatggccgatcaagccgctgcttggctgacgaggcaggggagcttccagggcgggtttcgttctacacaagataccgtcattgctctggacgccttgtcagcctattggatcgcctcccacactacagaagagaggggcttgaacgtgactcttagtagcactggcaggaatggttttaagtcccatgctctccagcttaacaacagacagattcgtgggttagaggaggagttacagttttccctgggttctaaaatcaacgtgaaagtgggggggaattctaaagggactctgaaagtgctaagaacttacaatgtgcttgatatgaaaaataccacctgtcaggacctgcaaatagaagtcaccgttaaaggtcatgttgaatatactatggaggccaacgaagattacgaggactatgaatacgacgaactccccgcgaaggacgacccagatgctccactccaaccagtgaccccactgcaattatttgaaggtaggcggaacagacgcagacgcgaagccccaaaattgacctccttatccgataggtacgtcagtcactttgagaccgaaggccctcacgtgctgttatatttcgattccgtccctacgtcacgcgagtgcgtggggttcgaagccgtccaggaggtgcccgtcggcctagtccagcctgcttccgccactctgtatgactactacaaccccgagcgcaggtgctcagtcttttacggcgccccctcaaagagtcgtctcctagcgactctctgcagcgcagaagtctgccagtgtgccgaagggaagtgccctcgacaaaggcgggccctagagaggggactgcaggacgaggacggatatagaatgaagttcgcctgctactacccccgggtcgaatacgggttccaggtcaaggttttacgcgaggactcgagggccgcgttccgactgttcgagacaaagattacacaggtgctccactttaccaaggatgtcaaggccgccgccaaccaaatgcgaaactttcttgtgagagcctcttgtcgactgaggttagagcccggtaaggagtatctcatcatgggactggatggtgctacctatgaccttgaaggtcacccacagtatttgctggattctaactcatggatcgaggagatgcctagcgagagattatgtcggagtacccgccagagagctgcatgtgcccagctgaacgacttcctgcaggaatatggtactcagggctgtcaggtatag

SEQ ID NO: 183678 - DNA, 813 bp, Artificial Sequence
  Description of Artificial Sequence: Synthetic coding sequence
atgtgccccgaggacagcctgcaggtgcccctgaaggacgccaagtcttgcggccttcaccagctccttagagggcctgaagtgcaattggtcgcccattccccgtggctgaaagattcgctaagccgaacaactaatatccaggggatcaatcttctcttcagctctaggcgcggacacctgtttctccagaccgaccagccaatatacaacccagggcaaagagtgcgttacagagtgtttgccctagaccagaaaatgaggccttctacggacaccattaccgtcatggttgaaaactctcacggcctccgcgttcgcaagaaggaggtctacatgccatccagcatctttcaggatgactttgtgattccggacatttcggaacccgggacctggaagatctccgcccgattttccgacggacttgaaagcaatagcagcactcagtttgaggtgaaaaagtacgtgctgccgaactttgaggtcaagattacccctgggaagccgtatatactaactgtaccaggacacctggacgagatgcagctcgatattcaggctaggtacatctacggcaaaccagttcagggagttgcatatgtacggtttggtctgctcgacgaggacggtaagaaaaccttttttagaggactagagtctcagaccaagttagtgaatggccagagccatatctccctctctaaggcggagttccaggatgcattagaaaagcttaacatgggcatcaccgacctccagggccttcgcctatatgtggcggcagcaattattgagtcgcctggaggatag

SEQ ID NO: 183679 - DNA, 5097 bp, Artificial Sequence
  Description of Artificial Sequence: Synthetic coding sequence
atgcggctgctgtggggcctgatctgggccagcagcttcttcaccctcagcctccagaagcctcgattgttgcttttctcaccttccgtggtgcacttaggagttccactgtcggtgggggtacagctgcaggatgtgccccgagggcaggttgtgaaaggatctgtctttctccgaaacccctccagaaataacgtaccgtgctcacccaaggtggactttacgctcagttctgagcgcgattttgcactgcttagcctgcaggtccctctgaaagacgccaagtcttgtggtctgcaccaactattgcgcggtcctgaggtgcagctcgtggcccactctccctggctcaaagatagcttaagcaggacgactaatattcagggaatcaatctactgttttcgtccagacgcggtcatctctttttacagacagatcaacctatatacaatcccgggcagcgcgtccgctacagggtcttcgcactggaccagaaaatgcgtccaagcacagataccatcactgtaatggtggagaattctcatggattgcgcgtccggaaaaaggaagtgtatatgccctccagcatcttccaggatgactttgtgatcccagatatatccgaaccaggtacctggaagatttctgcgaggtttagcgatggtctggaaagcaactccagtacacagtttgaagtgaagaagtacgtcctccccaactttgaagttaagatcaccccagggaaaccatacatactcaccgtccctggccatctggacgaaatgcagcttgacatccaggcacgttacatctatggaaagccggttcaaggagtcgcatacgttaggtttggcctgctggacgaagatggaaaaaagacttttttcagaggcctggaatcacagacaaagcttgtaaacggccagtcacacatcagcttgtcgaaagccgagtttcaggatgcccttgaaaagctgaatatggggataaccgatctgcaaggcctgcgattgtacgtggctgccgctatcatcgaatcacccgggggagaaatggaggaagcggaacttacctcctggtatttcgttagttctccgttctctcttgacttgtctaagacaaagcgacacctcgtacccggtgccccgtttctcttgcaggctctggtacgggagatgtccggcagccctgctagtgggatccctgtgaaggtgtcagcaacagtctccagcccggggtctgtgcccgaggtccaggatattcaacagaacacagatggcagcggccaggtgtctattccgatcataattccacagacaatatctgagctgcagcttagtgtctccgcaggatctccgcacccagctatcgctcgtctgaccgtcgccgctccgccatcagggggcccaggctttcttagtatagaacgccccgattctaggcccccacgggtgggcgataccctgaatctcaacctgcgcgccgttgggtcgggcgccacatttagtcactactattacatgatcctgtccagaggacaaatagtcttcatgaatcgcgaaccaaagagaaccctcaccagcgtgtcggtgttcgtagatcatcatttggcaccatccttctacttcgtcgccttctactaccatggagatcaccccgttgcaaactcacttcgggtggacgtccaggctggcgcgtgcgaaggcaaattagaacttagcgtggatggggccaaacaataccggaatggcgagtccgtcaagctgcatctggaaaccgattccctcgcactcgtcgctttgggcgctctagacacagcactctacgcagccgggagtaaatcccacaagccattgaacatgggtaaggtttttgaggcaatgaactcctacgacctgggatgtgggccaggtgggggagacagcgccctgcaggtgtttcaagcagcagggcttgccttcagcgatggcgatcagtggactctgtctcggaagcgcctcagctgcccgaaagaaaagacgactagaaagaagagaaacgtcaacttccagaaggctatcaatgaaaagctaggtcaatacgccagcccgaccgcaaaacggtgctgccaggacggggttacaaggcttccgatgatgaggtcatgcgagcagcgggctgctagggtccaacagcctgattgcagggagccttttttgtcatgttgtcagtttgcggaatcgcttcgcaagaagagccgggacaaaggccaggcaggcctgcagcgcgccttggaaatactgcaagaagaagacctaattgatgaagatgacattcctgtacgttccttctttccagaaaactggctgtggcgcgtcgaaactgtggataggttccaaatccttaccctctggctgcccgattcactgaccacctgggagatccatgggctgtcgctctcgaagaccaaaggcctttgcgttgctactcccgtacagctgcgtgtcttccgggagttccatctacacctacggctacctatgtctgtaagacggttcgaacaactggaactgcgacccgtgctgtataattacttagacaagaatctgacggtgtctgtgcatgtgtcacccgttgagggtctgtgtctggccgggggagggggacttgcacagcaagtgttggttccagcaggcagcgcacgcccagtagccttttcggttgttcctaccgctgccacagcagtgtcattgaaagtggtggcccggggcagttttgagttccccgtcggcgacgcagtgtcgaaagtacttcaaatcgagaaggagggcgccattcatagggaggaactggtgtacgaacttaatcccctagaccacaggggtaggacccttgaaatccccggaaatagcgacccaaatatgatccccgacggcgactttaatagttatgtgcgagtgactgcttcggacccactggacacactgggcagtgagggagcgctgagtccaggcggcgtcgcttccctgctacgcctgccccgcgggtgcggggagcagaccatgatctatttggcacccactctggctgctagccgttatctggacaaaaccgaacagtggtctaccctccccccagagaccaaagaccatgccgtggatctgatccagaaaggttacatgaggatccagcaatttcggaaggcagacgggagctacgcggcgtggctgtctagggggtcctcaacctggctgacggcattcgtgttgaaggtgctgtccctggcccaggaacaagtagggggcagcccagagaagctccaggaaacatctaactggctcctcagccagcagcaggccgatggcagctttcaagacctttcgccagttatccatcgctccatgcaaggaggactggttggcaatgacgagacagtcgctctaaccgcctttgtgactatagctctccatcatggtctagctgttttccaagatgagggggcggagcctctgaaacaacgggtggaagccagcatctctaaggcctcgtcgttcctgggtgaaaaggctagtgcaggactgctgggcgcgcacgctgccgcgattacagcttacgcgttgaccctaacaaaggcgccggcggacctccgcggagttgcacacaataacctgatggcgatggcccaggaaacaggtgacaatttatactggggcagcgtcactgggagtcagagtaatgcggttagccccacccccgctccaaggaatccctccgacccaatgccacaggcacccgccctgtggatagagacaacagcgtacgccctcctccaccttctcctgcacgagggaaaggccgagatggccgatcaagcagctgcatggcttacccggcaggggagctttcaaggcgggtttcgctccacacaagatactgtgatcgccctagacgccctcagcgcttactggattgcctcacacacaactgaggaaaggggccttaatgtgacactgtcctcaacgggcaggaacggctttaaaagccatgccttacagcttaataataggcagatcagaggactggaagaagagttgcagttcagcctgggaagcaaaattaatgtgaaagtgggggggaattcaaaaggtaccctcaaagtgttgcgcacgtataatgtgctcgatatgaagaacaccacatgccaggacctacagatcgaggtgactgtcaagggacatgtggaatacactatggaagccaacgaggactacgaggactacgaatacgatgagctgccagccaaggacgaccccgatgcacccttacaacccgtcacacccctgcagctgttcgagggacgtaggaacagaaggaggcgtgaggctccgaagttaactagcttgagcgacagatatgtctcacacttcgagacagaaggaccacacgtgctgttgtatttcgattccgttcctaccagtagggagtgcgtgggcttcgaagccgtgcaggaggtgccagtcggccttgtgcagcccgcgtccgccaccctgtacgactactataacccagagagacgctgttctgtgttctatggagcacccagcaaatcccgccttctggccacactgtgcagtgcagaagtatgtcagtgcgccgagggtaaatgcccgcgccagcgtagggctctcgagcgcggattgcaggacgaagacggttaccgcatgaagttcgcctgctactaccctagagttgagtacggcttccaagtgaaggtcctgagggaagattccagagcagccttccgcctgttcgagaccaaaatcacgcaggttcttcatttcaccaaggacgtcaaagcggcagccaaccagatgaggaacttcctggtgcgggccagctgtcgcctgaggttggagcccggaaaggagtatctgatcatgggacttgatggagcgacctatgacctcgaaggacacccgcagtacctcctggattctaactcatggatagaagaaatgccctccgaacggctctgcaggtccacaaggcagcgcgccgcatgtgcgcagctcaacgattttctgcaagaatatgggacacaagggtgtcaagtctag

SEQ ID NO: 183680 - DNA, 1536 bp, Artificial Sequence
  Description of Artificial Sequence: Synthetic coding sequence
atggccaagggcctgagcgtgcagaacgacaagcaccccggctaccagcccgcgctcctgctgagccccggggctcctctgttcgcagacggccccgcatacgcgcttttgcatctgttacttcacgaaggtaaggccgagatggccgaccaggctgcagcatggctcacgaggcaagggtctttccagggaggattccgatccacgcaggacaccgtgatcgctctcgacgccctctcagcctactggattgcctctcatacaactgaagaacgcgggctgaacgtgacactaagtagtaccggcaggaacggttttaaatcacacgctctgcagcttaacaaccgccagatccgcgggttggaggaggagcttcagtttagcctggggtccaaaattaatgtgaaagtgggcgggaactccaaagggactctgaaggtgctcagaacttataatgtccttgacatgaaaaacaccacctgtcaggatttacagatcgaggtgaccgtaaagggtcacgtggaatacacaatggaggcgaacgaagattatgaggactacgaatatgacgagctgccagccaaggatgatccggacgcacccctccagccagtgactcccttacagctctttgagggtcgccgcaaccggcgtcgcagagaagcacccaaagtggtggaggaacaggaaagcagggttcattacactgtttgcatctggagaaacggtaaggtcggactgtcaggcatggcgatcgctgatgtaacactactgtctggcttccacgccctcagggccgatcttgaaaaactgacatctctatcggatcggtatgtgtctcattttgaaaccgaagggccgcacgtgctgctgtactttgatagcgtgccaacttcccgcgaatgcgttggattcgaggcagtccaggaagtacctgtggggctcgtgcaacctgcgagtgctaccctgtatgattactataacccggagaggagatgtagtgttttttacggcgcccccagtaagagtagacttctcgcgactctgtgtagcgctgaagtgtgtcagtgcgctgaagggaaatgcccccgacagaggagggccctggaaagggggctacaggacgaggatggatacaggatgaagtttgcgtgctactatcccagagttgagtacggatttcaggtcaaggtcctccgggaagattcccgggcagccttccgactgtttgagactaagataacccaagtgttgcattttaccaaggatgtcaaagccgcggccaatcaaatgcgaaattttctggtgcgcgccagctgcaggttgaggctggaacccggaaaagaatacctcatcatgggacttgacggtgccacatacgacctggagggccatccccaatacctgctggactcaaattcgtggattgaggagatgccgagcgagagactttgtcgctcaacaaggcaaagagccgcttgcgctcagctgaatgacttcctacaggagtacgggactcagggctgccaggtttag

SEQ ID NO: 183681 - DNA, 1953 bp, Artificial Sequence
  Description of Artificial Sequence: Synthetic coding sequence
atgggcagccagtgccggggctggcacatgtgcgccctgggcagccagcagcaggcggacggatcttttcaagatctatcacccgttatccatagaagcatgcaaggcggacttgttggaaacgacgagacagtggccctaacggcctttgtgacgatcgccttgcatcacggactggcggtgttccaagatgagggcgcagaacctctgaagcagcgggtggaggccagcatctctaaagcgtcctctttcctcggcgaaaaagcgagcgcaggacttctgggcgcacacgccgcagccatcaccgcatatgccctgacgctcacgaaagcacccgctgacctgcggggggtcgcccataataacctcatggcgatggcccaggagactggggataacctgtactggggctctgtgacaggatctcagagtaatgctgtcagccctacaccggcaccaaggaatccctctgatccgatgccccaggctcccgcactgtggatcgagaccactgcctatgctctgttacacctgctgcttcatgaaggcaaggcagagatggcagatcaggccgccgcctggcttacccggcaggggtcatttcagggcggattcagatcgacccaggataccgtgatcgcactggatgccctgagcgcttattggatagcctcacatacaaccgaagaacgaggcctgaacgtaactctgtcttcaaccggtcgcaatggatttaaatcccatgcgcttcagcttaacaaccggcagattcggggactcgaggaggagcttcagttctcacttggctccaagattaatgtgaaagtgggcggtaactccaaaggaaccttgaaggtgcttagaacatacaatgtgctggatatgaagaacactacatgtcaggatctgcagattgaggttactgtgaagggccacgttgaatacacaatggaagccaacgaggactacgaagactatgagtacgatgagcttccagccaaggacgatccagatgcgcccctccagccagtaacaccgctgcaattgttcgaaggcagaaggaaccgcagaagacgtgaagcgccaaaggtcgtggaggaacaggagagccgagtccattatacggtctgcatatggagaaacggtaaggtgggcctgagtggcatggcaattgctgacgtcactctgctctccgggtttcatgcattgagggccgatcttgaaaagcttacatctctgagtgaccgctatgtgtcccactttgaaaccgaagggcctcatgttctgctttattttgactctgtgcccacttctcgcgagtgtgtgggatttgaagcagtgcaggaagtgccggtaggactcgttcaaccagcttccgctaccctgtacgactactacaatcccgagagaagatgcagtgttttttacggagcccccagtaaatcacgcctgctagccactctttgtagtgccgaagtttgccaatgcgcggaggggaagtgtccccgccagaggcgagccctggagaggggacttcaggacgaggacggttaccgcatgaagtttgcatgctactatccaagagtcgaatatggattccaggtgaaagtattgagagaggactctcgggctgcgtttcggctgttcgaaacaaagatcacccaagttcttcattttaccaaggacgtcaaggccgccgccaaccaaatgagaaactttttagtaagagcaagttgccgactcagacttgaacccgggaaagagtacctgatcatggggctcgacggcgcaacttatgacctcgaaggccatccccagtacctgttagatagcaacagctggatcgaggaaatgccttctgagcgcctatgcagatctactaggcagcgagcagcatgcgcccagctgaatgatttccttcaagaatacggaacccagggatgccaggtgtag

SEQ ID NO: 183682 - DNA, 291 bp, Artificial Sequence
  Description of Artificial Sequence: Synthetic coding sequence
atgcccggccccacccccagcggcaccaacgtgggcagcagcggccgatcgccaagcaaggcggtggcagcccgggccgccggttctacagttagacagcgcaagaatgccagctgcgggaccagaagcgctggacgtacaaccagcgccgggaccggcgggatgtggagattttacactgaagactcgcccggcctgaaagttgggcccgtacccgtcctagtaatgtctctgctgttcatcgcaagcgtattcatgctgcacatatggggcaagtatacacgatcctag

SEQ ID NO: 183683 - DNA, 3318 bp, Artificial Sequence
  Description of Artificial Sequence: Synthetic coding sequence
ggccgggccggcgaggtgcgggccctgagcagcggcgcccagcggagaggaagccacttcgtagttctgtgtcggttgcctcgcgggagggccagggtggtcggtgcctctctatcacacgctcccctgcccctccgatattgttggaaggggcgaggaggggtctcaaggctgttttgctctcagcgtgcccggatgcctggcagcctggggagagaagctagcgggcgcgccggtccaacgggttgtggagcctttgccttcggcctacgctgccgttatgtcattagcgccccgaagatctttcgtgtgggcgcttcagagaacatagtgatccaagtatacggttatactgaagcttttgacgctaccatttctatcaagagttaccctgataagaaattctcctattcatctgggcacgtacacctctcgtccgaaaataaatttcagaatagtgcaatactgacaatccagcctaagcaactgcctgggggccagaacccagtgtcatacgtttacctggaagtggtgagcaagcacttttcgaagagtaaacgaatgccaatcacctatgataatggcttcctgttcatacacacggataagccagtatatactccagatcagtcagtgaaggtgcgtgtctattctctaaacgacgaccttaagcccgccaagagagaaaccgtgctgacattcattgaccctgagggctctgaggttgatatggtggaagaaatcgatcatataggcatcatctcattccccgatttcaaaataccttctaaccctcgctacgggatgtggacgattaaggctaaatacaaagaagatttcagtacaaccgggacagcatattttgaggtcaaagaatacgttctgcctcacttttctgtgtccatagagcccgaatacaattttatcggttataaaaattttaaaaacttcgaaattacaatcaaagctagatacttctacaacaaagtggtgaccgaagccgacgtgtacattacttttggtatcagggaagacctgaaggatgaccaaaaagagatgatgcagactgccatgcagaatacgatgctgattaacggcattgcccaagttacgttcgatagcgaaacggctgtcaaggaactgagctattactcattggaagacctcaataataagtatctctatatcgctgtcacagtgatagagtctaccggagggttctcagaggaggcggaaataccagggataaaatacgtactgtcaccctacaagctgaacctggttgctactccattgtttctgaagcctggcatcccctatccaatcaaggtgcaggtgaaggatagcctcgatcaacttgtcggtggtgtccctgtgacactgaacgcccaaacaatcgacgtgaatcaggagacatcagatttggatccgtcaaagagcgtgacccgggtagacgacggcgtggcctcatttgtcctgaacctgcctagcggagtgaccgttctggagttcaatgttaagacagacgcccccgacctccctgaagagaatcaagctcgggaaggatatagagcaatagcctacagctcgctttcccagagctacttgtacatagactggaccgataaccataaagctttgttagtcggggagcatctcaatatcattgtcacccccaagtctccttatatcgacaagatcacccattacaattacctaatcctgtccaaggggaagataatccattttggcacccgcgaaaagtttagtgatgcctcctaccagtctatcaatattcctgttactcagaatatggttccttcctcccgactcctggtgtactacattgtgaccggtgaacagactgctgagctggtgagcgactcagtctggttaaacatcgaggaaaagtgtggcaaccagctgcaggtgcacctcagccctgacgccgatgcttattccccagggcagaccgtttctcttaacatggccacgggcatggatagttgggtggccctcgcagctgtggactctgctgtctatggcgtacagcgcggtgctaaaaagccgctagagcgcgtattccaattcctggagaagtcagatctggggtgcggagcgggcggggggctgaacaacgccaatgtgttccatctggccggactgacgttcttgactaacgcaaacgccgatgattctcaggaaaacgacgagccctgcaaagaaattctccgaccacgtcggacgctgcagaagaagattgaggagatagccgctaaatacaagcattcggtcgttaaaaagtgttgctatgacggagcatgcgtgaacaacgacgagacatgcgagcagcgtgccgcaagaatctcactgggaccccggtgcatcaaggctttcaccgaatgttgtgtcgtggcgtcacagcttagagccaatatcagccataaggacatgcagctgggcagattgcatatgaaaacgctgctgccggtgagcaagcctgagattagatcctatttccctgaaagctggctgtgggaggtacatctggtgccgcgccgaaagcaacttcaattcgctctccccgacagtctcaccacttgggagattcaaggagtgggcattagcaataccggtatctgcgtggcagataccgtgaaagccaaagtctttaaggatgtgttcctggagatgaatattccgtactctgtagtaagaggtgaacaaatccagttgaaggggacggtgtataactacagaacttctgggatgcagttctgcgtcaagatgagcgcagtggaagggatttgtacttccgaatccccggtaattgatcatcagggtactaagagctctaaatgcgtacgacagaaagtggagggaagctcttcgcacctggtcacgttcacagtcctgccactcgaaatcggcctacataatatcaacttcagcctggagacatggtttggcaaagagattctcgtgaaaaccctgcgcgtggtgccagagggggtgaagcgcgaatcctactccggcgtgaccctcgatccaaggggaatttatggcactataagccggagaaaggaattcccttatagaatcccactcgacctggtcccgaaaacagagatcaaaagaatactgtcagtcaagggcctgctagtgggagagattctgagcgctgttctatctcaagagggtataaacatcctgactcacctgccaaagggtagcgcggaggccgaacttatgtctgttgtcccagtgttctacgtgtttcccgggaatcgcaaaagccttgaacacttttccttttag

SEQ ID NO: 183684 - DNA, 2805 bp, Artificial Sequence
  Description of Artificial Sequence: Synthetic coding sequence
atggcccggcggagcgtgctgtacttcatcctgctgaacgccctgatcaacaagggacaggcctgtttttgcgatcactacgcatggactcaatggacaagctgcagtaaaacctgcaacagcggaacacaatcaaggcacagacagattgtagtggataagtattatcaggaaaatttctgtgagcagatatgtagtaagcaggaaacacgtgagtgcaactggcagcgctgccctattaactgtctgctgggcgattttggtccctggtccgactgcgacccttgtatcgaaaaacagagcaaagttcgctcagtcttgcgcccaagtcagttcggcggccagccctgtacagccccccttgtcgcattccagccttgcattccgagtaagttgtgtaagattgaggaagccgattgcaaaaataagttcagatgtgacagcggcagatgcattgcccggaaactggagtgtaatggagaaaatgattgcggtgacaattccgatgagcgagactgcggacgaacgaaagccgtctgcacaagaaaatataaccctatcccatccgtccagctcatgggaaatgggtttcactttttggccggagaaccccgtggagaggtcctggataacagctttacaggcggaatatgtaaaaccgtgaaaagcagccggacttctaatccatacagggtcccagccaatctcgaaaatgtggggttcgaggtccagactgcggaggatgatttgaagactgacttctataaggacctgacctctctcgggcacaatgagaaccagcaggggtccttttcaagccaaggcggaagctcattctccgttccgattttttacagctcaaagcgatctgagaacattaaccacaattctgcatttaagcaagcaatacaggctagccataaaaaggactctagcttcatccgaattcataaagtaatgaaagtgctgaatttcactacaaaggctaaggatctgcacctctccgacgttttccttaaagccctgaaccacctccccctggagtacaatagtgcactgtattctaggatcttcgacgacttcggaactcactatttcacttctggcagcctcgggggcgtctacgacctcctttaccagttttcctctgaagagcttaagaacagcgggctgaccgaggaggaagcaaagcattgcgtccggatcgaaacaaagaagcgcgttctctttgcaaaaaagaccaaggtcgaacaccgttgcactacgaataaactgtctgaaaagcatgagggatccttcatccagggcgcagagaagtcgataagcctcattagagggggccgcagtgagtacggggcggcattggcctgggagaagggatcctcgggacttgaagagaaaactttttcagagtggctggagtcggttaaggaaaaccccgccgttatcgatttcgagctcgcacccatcgtagacctggttagaaatattccctgtgccgtcacgaaaaggaacaacttgagaaaggcccttcaggagtacgcagccaaattcgacccttgtcaatgtgccccttgcccaaataacggccgacctaccctttccggcaccgagtgcctttgcgtgtgccaaagtgggacatatggggagaactgcgaaaagcagtcccccgactacaagagtaacgcagtggatggccagtggggatgttggtccagttggagtacatgtgatgcaacgtacaagaggtcacggacacgggagtgcaacaatcccgcaccccaaagaggagggaagagatgcgagggtgagaagcggcaagaagaagactgtacgttctctatcatggagaacaatggccagccctgcatcaacgacgatgaggaaatgaaggaagttgatttgccagagattgaggccgactcggggtgtcctcagccagtccctcctgagaatggatttatcagaaatgaaaagcaactttatcttgtaggcgaggatgtggaaattagctgcctaacgggatttgaaactgttgggtatcagtacttcaggtgtctccccgacggtacttggcgccagggggatgtggaatgccaacgcacggagtgcatcaagcccgtcgtccaagaggttctgactataaccccattccagcggttatacaggattggcgagagtatcgagctgacctgtcctaagggatttgtggttgcaggacctagtagatatacctgccagggtaactcatggacacctccaatcagcaatagccttacctgtgagaaagataccctgaccaagctcaaaggacactgccagctgggccagaaacagtccggctcagagtgcatctgcatgtcccctgaggaagattgttcacaccactccgaagatctctgtgtattcgacaccgattcaaatgactacttcacgtccccagcgtgcaagtttttggccgaaaaatgccttaacaatcagcagctgcactttttacatatagggtcctgccaggacggccgtcaactggagtggggactagagcgcacccgcctttccagtaacagcacaaaaaaagaaagctgtggttacgatacttgttatgactgggagaagtgttccgcttcgacatctaaatgcgtatgtctgttaccccctcaatgcttcaagggaggtaatcagttgtattgcgtcaaaatggggtcttctactagcgaaaaaactctcaatatctgtgaggtcgggaccatacgctgtgccaataggaagatggagattcttcacccggggaaatgtctagcgtag

SEQ ID NO: 183685 - DNA, 2805 bp, Artificial Sequence
  Description of Artificial Sequence: Synthetic coding sequence
atggcccggcggagcgtgctgtacttcatcctgctgaacgccctgattaacaagggccaagcgtgcttttgtgaccattatgcttggacacagtggacctcctgctccaaaacttgtaactccggcacccagtctagacacagacagatcgtggtggataagtattaccaagaaaacttctgcgaacagatatgctccaaacaggaaacccgagagtgcaattggcaacgctgccccatcaactgcttgcttggggactttggaccatggtcggattgcgacccctgcatcgaaaaacaatcaaaagttcggagcgtgctccggcccagtcagttcggcggccagccctgtacagctccattagttgcatttcagccctgcattccatctaagctatgcaaaatcgaggaagcagactgtaagaataagttcagatgcgactccgggagatgtatagcgaggaagctagagtgtaatggtgagaatgattgcggagacaactccgacgagcgggactgcggacggacgaaggctgtctgtacccgcaagtataaccccatcccgtcagtgcagctgatggggaacggctttcatttcctagcaggcgagccaaggggagaagtccttgataattcctttacgggaggcatatgtaagacggttaagagctctcgaacctcgaacccctaccgcgtgcccgcaaacctagaaaacgtaggctttgaagtgcaaacagctgaggatgatcttaagacggacttttataaggaccttacgtcccttggccacaatgagaatcagcaggggagcttttcctcccagggagggagttccttttccgtgccgatattttatagttccaagagatctgagaatatcaatcacaattccgctttcaaacaggctatccaggcgagccataagaaagacagcagcttcataaggatacataaagtgatgaaagttttgaattttactaccaaggccaaggacctgcacctgagcgacgtgttcctcaaggcgctgaatcatctcccccttgaatacaacagcgccttgtacagtaggatattcgacgattttgggacacactactttaccagtggctctctgggtggtgtgtacgatttgctgtaccagttcagtagcgaagaactcaagaattcaggactcacagaagaggaggctaagcactgcgtccggattgaaactaagaagcgggtgctttttgctaagaagaccaaggttgagcatcgatgcacaactaataagctgtctgagaaacacgagggatcttttattcagggggccgaaaaatctatctccctgattcgtggcggccgatccgaatacggagccgcgctagcctgggaaaaaggcagcagcggcttagaagaaaagacattcagcgaatggctcgagagcgttaaagaaaaccccgccgtcatcgacttcgaacttgcccctatagttgatctggtgagaaacatcccttgtgccgtgacgaagcggaacaatctgaggaaggccctgcaagagtatgcggctaagtttgatccctgccagtgcgctccatgtcctaacaatggtaggcccactctgtcgggcacagaatgcttatgcgtctgccaaagcggcacatacggggagaattgcgagaagcagtctcctgactataagagcaatgcagtggacggacagtggggctgctggagctcctggtcgacctgcgacgcaacttacaagagatcacgcacccgagagtgcaataaccccgccccccagcgagggggaaagcggtgtgaaggggagaaaagacaggaagaagactgtaccttctcaattatggagaacaatggtcagccctgcattaatgacgatgaggaaatgaaggaggtggacctgcctgaaatcgaagcagatagcggatgtccccagccggtgccacctgagaacgggttcattcggaacgagaaacagctatatctggtgggcgaggacgttgagattagctgcttaacagggttcgagacagtggggtatcagtatttcaggtgcttgccagacggcacttggagacaaggagacgtggaatgtcagcgaactgagtgcatcaaaccggtggtgcaggaggtgttgaccatcacgcccttccagcgtctttatagaatcggggaatcaatcgagttaacttgcccaaagggattcgtggtggcaggccccagccggtatacgtgtcagggaaactcttggacaccacccatcagtaattctttgacttgtgagaaagatacactaacaaaattgaagggccattgtcaactcggacaaaaacagtcgggctctgagtgcatctgtatgtctccagaagaagattgtagccatcattcagaggacctgtgcgtttttgacaccgatagcaacgactatttcaccagcccagcttgtaaattcctggcggagaagtgtctaaacaaccaacagctgcactttcttcatattgggagctgtcaggacggacgtcagcttgagtgggggctcgaaaggacccggctgtcctcgaattccacaaagaaggaatcctgtggctacgatacatgctatgattgggagaaatgcagcgctagcacctctaaatgtgtgtgcctgctccccccacaatgctttaaggggggtaatcagttatactgcgttaaaatgggtagtagcacatctgaaaagaccttgaacatatgtgaggtaggcaccattcggtgcgccaatagaaaaatggagatcttacatccagggaaatgtctggcatag

SEQ ID NO: 183686 - DNA, 2532 bp, Artificial Sequence
  Description of Artificial Sequence: Synthetic coding sequence
atgaaggtgatcagcctgttcatcctggtgggcttcatcggcgagttccagtccttctcatctgctagtagccctgtcaactgccagtgggacttttacgccccttggtccgaatgcaatggctgcaccaagactcagactcgcagacgctcagtcgccgtctatggccagtacggcggacagccttgtgtgggaaacgcctttgagacccaatcgtgcgagcctactcgtggatgcccaacggaggaggggtgcggcgagcgcttccggtgtttctcaggtcagtgcatttctaagagcctcgtctgtaatggcgactccgattgcgatgaggattccgcggacgaggacaggtgcgaggacagtgaacgcagaccttcttgcgacatcgataagcccccaccaaacatcgaactcaccggaaacggctacaatgagctgaccggccagtttaggaatagagtgatcaataccaaatctttcggtgggcagtgcaggaaagtcttcagcggagatggcaaggatttttaccgcctaagcgggaatgtactgtcatacacctttcaggtgaagatcaacaacgatttcaactacgagttttacaatagcacctggtcctacgtgaagcacactagcacggagcataccagctcttcaaggaagcgtagttttttcagatcaagtagttcaagtagccggtcttacacgtctcatactaacgagatacataaaggcaaatcctaccagctcctggtggttgagaacaccgtggaagtggcacagtttatcaacaacaatccggagttcctccagctcgccgagcctttttggaaagaattgtcccatctgcccagcctgtatgactacagcgcctacaggagactcatcgatcagtatggtacacactatctacagagcggctctttagggggagagtacagagtcctattctacgtagacagcgagaagctgaagcagaatgacttcaatagtgttgaggagaaaaagtgcaaatcctccgggtggcattttgttgtgaaatttagttcccacgggtgcaaagagctagagaatgctctcaaagcagccagtggcacacagaataatgtactgagaggggagccttttatcaggggagggggtgccgggttcatctccggcttgtcctacctcgaactggacaatcctgcaggcaacaagagaaggtattcggcttgggccgaatcagtcacgaacctgcctcaggtaatcaagcagaagcttactcctctgtacgaattagtgaaggaggtgccgtgcgcctcagtcaaaaagctgtacctgaaatgggcactcgaggaataccttgatgagttcgacccgtgtcactgccgaccttgccaaaatgggggcctggccacagtggaaggcacccattgcctgtgtcactgtaagccctatactttcggtgcagcctgtgagcagggcgtgctggtgggcaaccaggcaggtggcgtcgatggtgggtggagctgttggagctcatggtcgccatgtgtccagggtaaaaaaaccaggtccagagagtgcaataatcctcctcctagcgggggtggacggtcctgtgttggtgaaacaaccgaatccactcagtgtgaggatgaggagctggagcatctgcgcctgctagaaccccattgttttcccctaagcctggtgcctactgaattttgtccgtcgccacctgccctcaaagacgggttcgtgcaggacgagggtactatgttcccagtcggcaaaaatgtggtgtacacttgtaatgaaggatactctctgatagggaaccccgtggcgcgctgcggcgaagacttgagatggctggtgggcgagatgcactgccagaagattgcctgtgtgctcccagtgttgatggacggaattcagtcacacccacagaaacccttctacactgtcggggagaaagttaccgtatcttgttccggtgggatgagcctagaaggaccttctgcctttctatgcggctcttcactcaagtggagtcccgaaatgaagaatgcgcgatgtgttcaaaaggagaatccattgacacaagccgtaccaaaatgtcagcgttgggaaaagctgcagaactcccggtgcgtgtgcaaaatgccttatgagtgtggcccttctcttgatgtttgcgcccaagatgaaagaagtaaacggatcttgcccctcactgtttgtaagatgcatgttctgcactgccagggccgtaattatactttaaccggacgcgactcgtgcaccctcccggcaagcgccgaaaaagcatgtggcgcctgcccactgtgggggaagtgcgacgctgaatcttccaaatgtgtctgccgggaagcttctgaatgcgaagaggagggattcagcatttgtgtggaagttaatgggaaggagcagacgatgagtgagtgtgaggcaggagccctgcgctgccgcggacagtctatatcggtgacaagcatccggccatgcgctgcggagacccagtag

SEQ ID NO: 183687 - DNA, 1461 bp, Artificial Sequence
  Description of Artificial Sequence: Synthetic coding sequence
atgaaggtgatcagcctgttcatcctggtgggcttcatcggcgagttccagagcttcagctctgcatccagtccagtgaactgtcagtgggacttctacgcgccctggagcgaatgtaatgggtgcacaaagacgcagacaaggaggagatctgtcgcagtctacggtcagtatggtgggcagccctgcgtcggaaacgcgttcgagacccagtcatgcgagccgaccaggggctgtccaaccgaagaaggctgtggcgagcggtttcgatgcttttctggacagtgcatttcaaagtccttggtgtgcaacggcgattcggactgcgacgaagatagcgccgatgaagaccggtgcgaagattctgagcggaggccttcttgtgatatagataaaccccccccaaacatagagctgaccggcaatggatacaacgaacttacagggcaattccgaaaccgcgtgttgttttacgtcgactccgagaagctgaaacaaaacgactttaattcagtggaggaaaagaaatgcaaatcatccgggtggcacttcgtggtcaaattctcatcccacggctgcaaagaattggagaacgcactcaaggccgccagtggcacgcagaataacgtcctccggggcgagccatttatccgaggcgggggcgccggattcatatccggactatcatacctggaactggacaatccggcaggaaacaaaaggcggtatagcgcatgggcagaaagtgtcacaaaccttccacaggtcattaaacaaaaattgaccccgctatatgaacttgtgaaggaggtgccctgcgcatccgtaaagaaactttacctgaagtgggcgctggaagaatacctggatgagtttgacccatgtcattgcagaccgtgtcaaaatgggggacttgccactgttgaaggtacacactgtctctgccactgtaaaccctacacatttggcgcagcctgcgaacagggcgtcctggtgggaaaccaggccggcggtgtagatggaggatggtcatgctggtcttcatggagcccctgcgtgcaggggaagaaaacacgttctcgagagtgtaacaaccccccaccttctggtggcggtcggtcctgtgtcggtgagacaactgaatccacccaatgcgaagacgaagaacttgagcacctgagactgttagagcctcactgcttcccattatcattggtgcctaccgaattctgccccagcccccccgccctgaaggacgggttcgtgcaggacgaaggcacaatgttcccggtaggtaagaacgtggtctacacttgtaatgaaggatattctctaattggaaatcccgttgcaagatgcggggaggaccttaggtggctcgtcggagagatgcactgccagaacgggaagataagcaactggatgaaggtgaacgagaccctcctcgtggaacatcactag

SEQ ID NO: 183688 - DNA, 1032 bp, Artificial Sequence
  Description of Artificial Sequence: Synthetic coding sequence
atgaaggtgatcagcctgttcatcctggtgggcttcatcggcgagtttcaatcctttagctccgccagttcccctgtgaattgccagtgggacttctacgccccctggagcgaatgcaacggctgtacaaaaacccagacacggcggagaagcgtggcagtatacgggcagtatggcggacaaccctgtgtggggaacgccttcgaaacccagagttgcgagcctacaagagggtgccctaccgaagagggctgcggtgaacgcttccgctgcttttcgggacagtgcatcagcaaaagtctcgtgtgtaatggcgattccgactgtgacgaggatagtgctgacgaagacagatgtgaagattctgaacgccgcccatcatgcgatattgacaaacctccacctaatattgaactgactggcaacggatataacgagttgactgggcagtttcgcaatagggtgatcaacacaaagagttttggcggacaatgccgcaaagtgttctctggcgacggaaaggacttttatcgcctgtctggaaacgtcctcagctacacattccaggtgaagataaataacgacttcaactatgaattttataacagcacctggtcatatgtgaagcatactagcaccgaacacacaagttccagccgcaaacgcagtttctttaggtcttcaagttctagctcacggtcctacacctcgcacaccaatgaaatccataaggggaaaagttaccagctgctggtagtcgaaaacactgtggaggtggcacagtttattaacaataacccagagttcctccaactggctgagcctttctggaaagagctatctcatctgccctcgttgtacgattacagtgcctatagacggcttatcgatcagtacggcacgcactacctgcagtccgggtcacttggaggcgagtacagagtcctcttctacgtggacagtgagaagctcaagcaaaatgattttaactccgttgagaaaaagaagaagaaaaagaaaaaaaagaaatag

SEQ ID NO: 183689 - DNA, 1755 bp, Artificial Sequence
  Description of Artificial Sequence: Synthetic coding sequence
atgttcgccgtggtgttcttcatcctgagcctgatgacctgccagcccggggtgactgctcaagaaaaggtgaatcagcgggtgagaagggctgctacacccgcagctgtgacgtgtcagctgtcgaactggtctgagtggacggactgcttcccctgtcaggacaagaaatacagacatcgcagtctgttacagccgaataagtttggggggactatttgtagcggagatatttgggaccaagctagttgttccagttccacgacctgtgtcagacaggctcaatgcggtcaagacttccagtgcaaggagaccggaaggtgtctcaaaagacacctggtttgtaacggagatcaggactgcctggatggatcagacgaagatgattgcgaggacgtgcgtgcaattgatgaggactgtagccagtacgaacccatcccaggctcccagaaggcagccctgggctataacattcttacccaagaggatgcacagtccgtgtatgacgcttcctactacgggggacagtgtgaaacggtttataatggcgagtggcgagagttaagatatgattctacatgcgaacggctatattacggagacgacgaaaaatacttccggaaaccatacaacttcctcaaatatcacttcgaagctttggccgacacaggcatttcatccgaattctatgacaacgcaaacgatcttctgtctaaagtgaagaaggacaaatctgatagctttggagtgactatagggattgggcctgccggatcccctctgctggtgggtgtgggagtttcacattcccaggacacttcctttctcaatgagctgaacaaatacaacgagaagaaattcatcttcacccggatcttcaccaaagtgcaaacagcccatttcaagatgcgcaaggatgatattatgctggacgagggaatgttgcagtccctgatggagctgccggaccagtataattatggtatgtacgctaaatttatcaacgattacggcacccactacatcacaagtggatcaatggggggaatatacgaatatatactggtcatcgataaggctaagatggagtcccttgggatcacttccagggatattacgacgtgcttcggaggaagcctcggcatacagtacgaggataaaatcaacgtaggggggggcctctcgggcgaccattgcaagaaatttggaggcggcaagaccgagagagcaaggaaggcgatggctgtggaggatataatctcccgagttcggggcggatctagcggatggagtggcggcctggcacagaaccggtcaacaatcacttaccggagctggggtcggtctctcaagtataatcccgtggtgatagactttgagatgcaaccaattcatgaagtccttcgccacacatctctgggtccgttggaggcaaagagacaaaatctgcggagggctctggaccagtacctgatggaatttaatgcctgtcgctgcggaccatgctttaataatggcgtgcccattctggaaggcacttcctgcaggtgccagtgcaggcttggaagccttggcgccgcctgtgaacaaactcagactgagggggccaaggccgatggctcatggtcctgctggagcagctggtccgtgtgcagagcgggcattcaggaaagaaggcgggagtgcgataaccccgcaccgcagaacgggggtgcttcgtgccccgggcgcaaagtgcagacacaggcatgttag

SEQ ID NO: 183690 - DNA, 1776 bp, Artificial Sequence
  Description of Artificial Sequence: Synthetic coding sequence
atgaagaacagccggacctgggcctggcgggcccccgtggagctgttcttattgtgcgccgctctgggctgcctcagcttgccaggcagtagaggggagaggccccattcattcggaagcaatgctgtcaacaagtccttcgcgaagagcagacagatgcgatctgtcgatgtgacattgatgccgatcgactgtgaacttagcagctggtcatcctggaccacatgtgatccttgccagaagaagcgctaccggtacgcttacttgctgcagccgtctcagttccatggggaaccctgcaacttttctgacaaagaggtcgaagattgtgtgaccaaccgcccatgtggctctcaggttcgatgcgagggcttcgtatgtgcccagaccggccgctgcgtgaaccggagactgctgtgcaacggtgataatgattgtggagaccagagtgatgaagccaactgccgcaggatatacaaaaagtgccagcatgaaatggaccagtactggggaatcgggtcgttggcctctgggatcaatctgttcacaaatagcttcgaagggcctgtgctcgaccacagatactacgccggaggctgttcaccacattacatcttgaatacaagatttaggaagccttataacgtggagagctatactccccaaacacagggaaagtatgagttcattttgaaggaatatgaatcgtactccgattttgagaggaacgtgacagaaaaaatggcttcaaagtcgggtttctctttcggtttcaagatacccgggatcttcgagcttggtatcagcagtcaatccgatcgtggaaaacactacattcgccggacaaagcggttctctcatacaaagtctgtgtttttgcatgcgaggagcgacttggaagtcgcccattataagcttaaaccaagatctctcatgctgcattacgaatttctccagcgcgtgaagcgcctgccactggagtactcctacggcgaatacagagatctgttcagggacttcggcacccactacatcaccgaagccgtactcggcggcatctacgagtatacactggtgatgaataaggaggctatggaaaggggggactacactctcaataacgtgcatgcctgtgccaagaacgattttaaaatcggcggggcaatcgaagaggtctatgtgtccctgggtgtcagcgttggaaagtgcagaggaatcttgaacgagatcaaggaccggaataagagagacaccatggtggaagacctagtggtgctggtgcggggcggggcatcagagcatataacaacactcgcctatcaggagctgccaactgccgacctcatgcaggagtggggggacgcggtgcagtataatcccgcaataataaaggtcaaggtagaacccctctacgaactggtgaccgccaccgattttgcgtactcatctaccgttagacagaatatgaagcaggccctggaagagttccagaaggaggtgtcatcctgtcactgcgctccatgccaaggcaatggggtgccagtactgaaagggtcgcgctgcgattgcatctgtcccgtaggaagtcagggtcttgcctgtgaggtttcatacaggaagaataccccaattgatggtaaatggaactgctggtccaactggagtagctgttccggccgaaggaaaacccgacagagacagtgcaacaatcccccaccccagaatggtggttccccctgcagcgggcctgcctctgagaccctggactgtagctag

SEQ ID NO: 183691 - DNA, 1590 bp, Artificial Sequence
  Description of Artificial Sequence: Synthetic coding sequence
atggacacctgcatgaccctggccttcaccctgagcggccggttcttcatgctactgagccagtatcgatatgcctacctgctgcagccttcccagtttcacggagagccatgtaattttagtgacaaggaagtagaggactgcgtgacaaaccggccctgtggctcacaggtcagatgcgagggcttcgtctgcgctcagacaggccgttgtgtgaacaggcggctgttatgtaatggcgataatgactgcggagatcaaagcgatgaagcgaattgccgaaggatatataagaaatgtcagcacgagatggatcagtattgggggattggatcgctggcctctggtatcaacctttttaccaacagcttcgaaggacccgtcctggaccacaggtactatgcaggcggatgctccccacactacattctgaacacgagatttaggaagccttacaatgtagagtcctacaccccgcagacccaggggaagtatgagttcatcctcaaagagtacgagtcctattccgattttgaaagaaacgtaaccgaaaagatggctagcaaatcaggcttctctttcggcttcaagatcccaggtatcttcgagctggggatctcctcacagagtgatagaggcaagcactacatccgtcgtactaagcggttttcgcacacaaaaagcgtcttcctgcatgctcggtcagacctagaagtggcccactacaagctgaagccacggtctctcatgttgcactacgaatttttacagcgagtcaagcggctccccctggaatattcctatggggagtatcgagatctgttccgagacttcgggacgcactatatcactgaagccgttctgggcggcatttacgagtatacccttgtgatgaacaaggaggcaatggagcgaggggattacacccttaacaatgttcacgcgtgtgccaagaacgattttaaaatcggaggcgctatcgaagaggtatatgtctccctcggagtgtccgttggaaaatgcagagggatactgaatgagatcaaggataggaataaacgggatacaatggtggaggacttggtagtgttggttcgtggaggtgccagcgagcacataactacccttgcatatcaggaacttcccaccgctgacctcatgcaagaatggggggacgccgtccaatacaatcctgccattattaaggtcaaggtcgagcctctgtatgaactggtgacagccacagacttcgcttactctagcactgtgagacagaacatgaagcaggccctcgaagagtttcagaaagaagtctcttcatgtcattgcgcaccatgtcagggtaatggtgttcccgtgttgaagggcagccgctgcgactgtatttgcccagtgggctcacagggcttggcctgcgaagtcagttaccgaaaaaacacccctatcgacgggaaatggaattgctggtcaaattggagctcttgcagcggtagacgcaagacccggcaaagacagtgtaataacccgcccccccaaaacggagggtcaccttgctccgggccggcctctgagacgctggactgctcatag

SEQ ID NO: 183692 - DNA, 1620 bp, Artificial Sequence
  Description of Artificial Sequence: Synthetic coding sequence
atgcggagcgtggacgtgaccctgatgcccatcgactgcgagctgagctcatggtcgtcatggaccacttgcgatccctgccagaagaagcgctatcgatacgcctaccttctgcagccctctcaattccacggggaaccctgtaacttcagtgacaaagaggttgaggactgtgtgactaatcggccctgcggaagtcaggtgcgctgcgaaggcttcgtatgtgcgcagactggcagatgtgtcaatcggaggctgctgtgtaatggagataacgactgcggcgaccagagtgatgaggcaaactgtaggagaatctacaaaaagtgccagcatgagatggaccagtactgggggattggctctttggcctctggcattaatctctttaccaacagttttgaaggccctgtactcgaccatagatactacgccggagggtgctccccgcactacatattgaacactcggtttagaaagccatataatgtggagagttacacaccacagacccagggaaagtacgaatttatacttaaagagtacgagtcctacagcgacttcgagcggaacgtaactgagaaaatggcgtcaaaatcaggctttagctttgggttcaagattcctggcatcttcgaactcggtatcagttctcaatctgatcgtggtaaacattacattcgtcggacgaaaagattttctcatacaaagtcagtgttcctgcatgctcgcagcgacctagaagtggcccattataagctgaaaccaaggtctctgatgctccactacgagttcctgcaacgcgtgaagagactgccattggagtactcttatggcgaatacagagatcttttccgtgattttggtactcactacataaccgaggccgtcttgggcggcatatacgaatataccttagtgatgaacaaagaagctatggagaggggagattatacgcttaataatgtccatgcgtgcgccaagaacgattttaagattgggggtgctatcgaagaagtctacgtctcattgggagtctcagtaggcaaatgtagaggaatcctcaacgaaataaaagaccgaaacaagagagacaccatggtggaggacttagtggttctagtgcgcggaggggccagtgagcacataaccaccctggcataccaagaactaccaactgccgacttgatgcaagagtggggagacgccgtgcagtataatcccgccataataaaagtcaaggtggaaccactgtatgagctcgtgaccgcaaccgacttcgcttactcgtctacagtgaggcagaatatgaagcaggcgttagaagagttccagaaggaagtttcctcctgtcactgcgccccgtgtcaaggtaatggggtccccgttctgaaggggtcccgctgtgattgtatttgcccagtaggtagccagggactggcctgtgaggtgtcctatcggaaaaatacgccaattgatggcaaatggaattgctggtctaactggagcagctgcagtggacgtcggaagacccgtcagcggcagtgcaataacccgcctccccagaacggggggtcaccatgcagtggcccagctagtgaaaccttggattgctcttag

SEQ ID NO: 183693 - DNA, 675 bp, Artificial Sequence
  Description of Artificial Sequence: Synthetic coding sequence
atggccacccaccacaccctgtggatgggcctggccctgctgggcgtgctgggcgacttgcaggcggcaccagaggcgcaggtctcagtgcagccaaacttccagcaggacaagtttctcgggcgctggttctcagctgggctcgcttccaactcgtcatggctgagggaaaagaaagcagcgctctcgatgtgtaaatctgtggttgcgcccgccaccgacggaggcctgaatttgaccagcacttttctcagaaagaaccagtgtgaaacacgcactatgctcttacaacctgccggcagcctgggttcttactcctacagatcaccgagggagtggggcttacatcggccaccaggcccatcattaggagctaccctggcaggcaccaccctcggccaacctccggccgccgaaatccacggtgtgggcgactgggggtctacatatagtgtctcagtggttgaaaccgattacgaccagtacgctcttttgtatagccagggaagcaaggggccaggggaggatttccgtatggctactttgtactcgaggactcagactccacgggccgagctgaaggagaaattcacagcattttgcaaagctcagggctttaccgaagacacgatcgtctttctgccacagacagataaatgtatgactgagcagtag

SEQ ID NO: 183694 - DNA, 495 bp, Artificial Sequence
  Description of Artificial Sequence: Synthetic coding sequence
atgctgccccccggcaccgccaccctgctgaccctgctgctggccgctggctccctcggtcagaaaccacagcgaccccgacggccagctagccctattagcactatccagcccaaggccaattttgacgctcagcagtttgctgggacatggctcctggtggctgtcggcagcgcctgcaggttcctgcaggaacagggacatagggctgaggcaacaacactccatgttgcccctcaggggacagcaatggcggtgtccacttttcgaaagctggatggtatctgttggcaggtccgccagctttacggagacaccggagttttgggtagatttctcttgcaagctagggacgcgagaggcgcggttcacgtcgtcgtggccgagaccgattatcagagtttcgcggtcttgtatctggagcgcgcaggccagctcagtgtgaagctctacggcgcccaaggggtggtgacagaccgtccaggagtagggtag

SEQ ID NO: 183695 - DNA, 1680 bp, Artificial Sequence
  Description of Artificial Sequence: Synthetic coding sequence
atgagcgcctgccggagcttcgccgtggccatctgcatcctggagatttcaattctgacagcacagtataccaccagttacgacccggaattgacagagtcatcaggcagtgcttctcatatcgattgtagaatgagcccgtggagcgaatggtcccagtgcgatccatgtttgagacagatgttcagatctcgatctatcgaggtcttcggacagttcaatgggaagcggtgtaccgatgccgtgggagatcggaggcagtgcgtacccaccgagccttgtgaggacgccgaagacgactgtgggaatgacttccagtgcagtacaggtcgttgcatcaagatgcggctgaggtgtaacggtgataacgattgcggagatttctctgatgaggacgattgtgaaagcgagccgcggcccccatgccgcgatagggtggtggaggagtctgaactagcacgcacagccggttacggcatcaatattcttggcatggacccactttctactccattcgataatgaattctacaacgggctttgcaaccgcgaccgtgatggaaacaccttaacttactaccgccggccgtggaatgtggctagtcttatctacgagaccaagggggagaaaaactttcggaccgagcactacgaggagcaaatcgaggctttcaagagtatcattcaggagaagacctccaattttaatgctgccatatccctcaagttcacccctaccgaaaccaataaggccgaacagtgttgtgaagaaacggcctctagcatctccctgcatggcaaaggctcatttcgattctcctatagtaaaaacgagacctaccagctcttcctgagctacagtagcaagaaagagaagatgtttctccacgtaaaaggcgaaatccatttaggtcgtttcgtgatgaggaaccgggacgttgtactcacaaccacttttgtggacgatatcaaagccctgcctacaacgtacgagaaaggagagtatttcgctttcctcgagacatatggcactcactactcatcttcaggatccctggggggattatatgaattaatctatgttttggataaagcgtcaatgaagcgcaaaggggttgaacttaaggatatcaagcgctgcctgggctaccatctcgacgtttcattggcctttagcgaaatatcagtgggcgccgaatttaacaaagacgattgcgtcaagagaggggaaggccgcgctgtcaatattaccagcgaaaatctaatcgatgacgtcgtttctctgatacgtggaggcacacgcaaatacgcattcgagctgaaagagaagctgctaaggggaacagtcatcgacgttaccgacttcgtgaattgggccagctctataaatgatgcaccagtcctgatttctcagaaactttcaccaatctacaatctagttccagtgaaaatgaaaaacgcccacctaaagaaacagaacctggaacgcgccatagaagactatataaacgaatttagcgtgcgaaagtgtcatacgtgccaaaacggaggcactgtgatactaatggacgggaaatgtttgtgtgcatgcccctttaagttcgaaggcattgcgtgtgaaatctctaagcaaaagatctcagaggggttgcctgctctggaattccctaacgaaaaatag

SEQ ID NO: 183696 - DNA, 1770 bp, Artificial Sequence
  Description of Artificial Sequence: Synthetic coding sequence
atgggcagcaacctgagcccccagctgtgcctgatgcccttcatccttggccttctgtcgggaggtgtcaccacaaccccatggtcgctggctcagccacaggggtcatgtagcctcgaaggggtggaaatcaaggggggctcctttcgcttgctacaggagggacaagctctcgagtatgtttgcccgtccggcttctacccttatccagtgcaaacccggacatgtaggagcacaggctcgtggtctacactaaagactcaggatcaaaagacagtgagaaaggccgaatgtagggcaattcactgtcctcgtcctcatgatttcgagaatggagagtactggcctcgctccccctactacaacgtcagcgatgaaatttctttccattgctacgacggctatacccttcggggctccgctaacagaacctgccaagtcaacggtaggtggagtggacagacagctatctgtgacaacggcgcgggttactgcagtaaccccggtatccctattggtacaagaaaagtgggttcgcagtaccgcttggaggactcggtgacctatcactgctcacgaggtctgaccctgcggggtagccagaggagaacctgccaagagggaggatcttggagtggcacagaaccatcctgccaggattctttcatgtatgatacgcctcaggaagttgctgaagcattcctaagcagcttgacagaaactatcgagggtgttgatgctgaggatggtcatggccctggcgagcagcagaaaagaaagattgttttagatcccagcggctccatgaatatctacctcgtgctggatggatcagacagcatcggggcctctaactttaccggtgccaagaaatgtctggttaatctgatcgagaaagttgccagctacggcgtgaagccaaggtacggcctagtgacttatgcaacctatcctaagatttgggtgaaggtctccgaggcggattccagtaacgccgattgggtaacgaagcagttaaatgaaataaattacgaagaccataagcttaagtctgggacaaatacaaagaaagccttgcaagctgtgtacagtatgatgtcctggcctgacgacgtcccacccgaggggtggaatcgtactcgccatgttatcatactcatgactgacgggctccacaacatggggggcgaccctatcacagtgatcgacgaaatcagggacctgctttatattgggaaggaccgcaaaaatcccagagaggactaccttgacgtgtatgtgttcggtgtgggaccgttggttaatcaggtgaatatcaacgccctggctagtaagaaagataatgaacaacacgtgttcaaagtgaaggacatggagaacttggaagatgtcttttaccaaatgattgatgaatcccaatccctctccctgtgtggcatggtttgggagcatcgcaagggcaccgactaccacaagcagccttggcaggctaagatctctgtgatcagaccttccaaaggccacgaatcgtgtatgggcgctgtggtaagcgaatactttgtgctgaccgccgcccattgttttacagtggacgataaggagcactccatcaaggtgtccgttggcggggaaaagcgcgatctggagattgaggtcgtcctctttcatcccaactataatataaacggcaagaaggaagccgggatcccagaattctatgactatgacgtggctttgataaaactgaaaaacaagctgaagtatggctag

SEQ ID NO: 183697 - DNA, 1770 bp, Artificial Sequence
  Description of Artificial Sequence: Synthetic coding sequence
atgggcagcaacctgagcccccagctgtgcctgatgcccttcatcctaggtctcctgtctggcggggtaaccaccaccccctggtccctggcgcaacctcaaggttcctgctccctggaaggagtggagattaagggcgggtccttcaggctgctgcaggagggtcaagcgcttgaatacgtctgtccctctgggttctatccatatccagttcagacccgcacatgcagatccaccggctcttggtcaaccctgaagacacaggaccagaagaccgtccgcaaggccgaatgcagagccatccactgtcctaggccgcacgactttgaaaatggtgagtactggcctcgctctccttactacaacgtgagcgacgaaattagcttccattgctatgatggttacacgctaagaggctccgccaatcgaacttgccaggtgaatggtaggtggtcaggtcagaccgccatatgcgataatggggctggctattgcagcaatcccggcatcccaatagggactagaaaagtgggatcgcagtatagactggaagattccgtcacgtaccattgcagccggggcctgaccctgcggggctctcagcgcaggacttgccaagagggaggatcctggagcggcactgagcctagctgtcaggactcttttatgtatgataccccccaggaagtcgctgaggcttttttatctagcctgacggaaaccatcgagggcgtggacgcagaagacggacacggtcccggcgaacagcagaagagaaagatcgtcttggacccatcaggcagtatgaacatctacctcgtgcttgacggttcagatagcattggtgcctctaactttactggggctaagaaatgcctggtcaatctcatcgaaaaggtggcctcttacggtgtgaaaccccggtacggcctggtgacatatgctacataccctaagatctgggtaaaggtcagtgaggcggactcatcaaatgctgactgggtgactaagcaactcaacgagattaactacgaggatcataagttgaagagcgggacaaatacaaaaaaagctttacaagcagtgtacagcatgatgagttggccagatgatgtcccaccagagggatggaacaggacccggcacgtgatcatcctgatgaccgatggcttgcacaacatgggtggagatcctatcacggttatcgacgaaattcgcgatttgctctatatcgggaaagaccgtaagaatcctagggaggattacctcgacgtgtacgtctttggcgttgggccccttgtcaaccaagtgaacatcaacgccctagcgtccaagaaagataatgagcaacatgtctttaaggtgaaggacatggaaaatctggaagacgtgttctatcagatgatcgatgagtcccagtccctgtcactttgtggtatggtttgggaacataggaagggtactgattatcacaaacaaccatggcaggccaagatatcagtgatcaggcccagtaagggacacgaatcttgtatgggagcagtggtcagtgagtacttcgttctgaccgccgcccattgcttcaccgtggatgacaaagagcactcaataaaggtgtcagtgggtggagaaaaacgagatctggagatcgaagtggtgctgtttcacccaaattataacatcaatggcaaaaaagaggcaggtatcccagaattctacgattatgatgtggcacttataaagctgaaaaacaaactgaaatacggatag

SEQ ID NO: 183698 - DNA, 2295 bp, Artificial Sequence
  Description of Artificial Sequence: Synthetic coding sequence
atgggcagcaacctgagcccccagctgtgcctgatgcccttcatcctaggtctgctgtcggggggagtcacaacaaccccatggagtctcgctcgaccccagggctcatgctctcttgagggagtggagatcaagggagggagcttccgtctgcttcaggagggccaggcattggaatacgtgtgccccagtggtttttatccctaccctgtgcagacaaggacttgtaggagcactggatcctggagtaccctaaaaactcaggaccagaagaccgttagaaaagctgaatgtcgtgcaatccattgcccccgaccccacgatttcgagaatggggagtactggccccgttccccctactacaacgtctctgacgaaattagctttcactgttatgatggctatacactgcgaggcagtgccaatagaacttgccaagtgaatggacgatggagtggccaaaccgcaatatgcgataatggtgccggttactgctctaatccaggcattccaattgggacccgaaaagtgggttcccaataccgactcgaggacagcgtgacttaccactgcagcagaggactcacgcttcggggctctcaaagacgcacatgtcaggagggcggctcatggtcagggaccgaaccatcctgccaagacagctttatgtacgacacacctcaggaggtggccgaagcctttctgagctccctaacagagaccattgagggggtggatgctgaagacggacacggccccggggagcagcagaagagaaaaattgttttagacccaagtggatcaatgaacatctatctggtgctggacggcagtgactccatcggagcaagcaatttcaccggggctaagaaatgcctggtgaacctgatcgagaaggttgcatcctacggagtaaagcctagatatggactggtcacatatgcgacctaccccaagatctgggtgaaagtatcagaagccgattcttctaatgccgactgggtaacaaagcagctgaacgaaatcaactacgaggatcacaagctaaagagtggcactaatacgaaaaaggctctccaggccgtttactctatgatgagctggccagatgacgtgccacctgagggctggaaccgaacacgtcatgtgataatcctaatgaccgacgggctgcataatatgggtggggaccctataaccgtgatcgacgagattagagacctgctgtacatcggtaaagatagaaaaaatccccgcgaagattacctcgatgtctacgtgtttggggtaggtcctctggttaatcaggtcaacattaatgccttggccagcaagaaggataatgaacagcacgtcttcaaggtaaaagacatggagaacctggaagatgtgttttaccagatgatagatgagtcacagtcactcagcctgtgtgggatggtgtgggaacaccgcaagggaacggactatcacaagcagccctggcaggcaaaaatttcggtcatccgccctagcaaaggtcatgaaagctgtatgggggctgtcgtctctgagtattttgtgctcacggcagcgcactgctttacagtcgacgacaaggaacactccattaaggtctcagtggggggagaaaagagggatttagagatcgaagttgtgctcttccaccccaactacaacatcaatggcaaggaggaggcagggatcccagaattctacgattacgatgttgcgctgatcaagctgaagaacaagctgaagtacggccagaccatcagaccaatctgtctgccctgtactgagggcactactcgcgcccttagacttccccccaccacaacctgccagcagcagaaggaggagctcctgccggctcaggatattaaggctctgtttgttagcgaggaagaaaagaaactgactcggaaggaggtgtatataaaaaacggggataaaaaaggcagttgtgaacgcgacgcgcagtatgctcctggttatgacaaagtgaaagatatatccgaagtggtgacaccaagatttctctgtactggaggggtgtctccctatgccgacccaaatacatgtaggggggattcgggaggaccactaattgttcacaagaggagcaggttcatacaggtgggggtaatcagttggggtgttgtagacgtatgtaagaatcagaaacgacagaagcaggtgcccgcccatgcaagggactttcacattaacctttttcaggtgctgccatggctcaaagagaaattgcaggacgaagatcttggctttctatag

SEQ ID NO: 183699 - DNA, 2295 bp, Artificial Sequence
  Description of Artificial Sequence: Synthetic coding sequence
atgggcagcaacctgagcccccagctgtgcctgatgcccttcatcctgggtttactttcaggaggagtgacgactaccccatggtcacttgctcggccacagggtagctgctctttagagggtgtggaaatcaaaggggggtcctttagactgttgcaagaaggtcaggctctcgagtatgtttgccccagcggtttttatccatatcctgtacaaacacgcacctgcaggtcaacaggctcatggagcacccttaaaacccaagaccagaaaaccgtgaggaaggccgaatgtagagccatccattgtcctagaccccacgatttcgaaaacggcgaatattggcctcggagtccctattataatgttagcgatgagatctcctttcattgctacgacgggtatacccttcggggcagcgcaaatcggacatgccaagtgaatggaagatggagcggccagaccgctatctgtgacaacggcgcaggctactgtagtaacccaggtattcctataggtacgaggaaggtgggcagccagtaccgcctggaggattctgttacgtatcattgcagtagagggcttactctaagggggagtcagaggcggacgtgccaggagggggggtcatggtccgggactgaaccatcgtgccaggattcattcatgtacgatacacctcaggaggttgcggaagccttcctctcttctcttacagagactattgagggcgttgacgctgaagatgggcatgggcctggcgaacagcagaagcggaaaatcgttttggatccctcagggtccatgaacatttatctggtgctggacggttctgatagcatcggggccagtaattttacgggggctaagaagtgcctggtgaatctgattgaaaaagtggcctcctatggggttaagcccaggtatgggctggtgacctacgcgacatacccaaaaatctgggtgaaggtgtctgaagctgattcctcaaacgctgattgggtcactaagcagttgaatgaaattaattacgaggatcataagcttaaatccgggaccaacaccaaaaaagctctgcaggccgtgtactcaatgatgtcatggcctgacgatgtgcccccggagggctggaacaggacaaggcacgtcattatacttatgacagacgggctgcataacatgggaggagacccgatcaccgtgattgacgagatacgagatctcctctatataggtaaggatcggaaaaaccccagagaagactatctggacgtgtatgttttcggagtcggccctctggttaatcaggttaacattaacgctctcgcgtctaaaaaagacaacgagcagcatgtgttcaaggtgaaggacatggagaacctggaagatgttttctatcagatgattgatgaatcacaatctctgtctctgtgcgggatggtatgggaacaccgaaagggaaccgattaccataagcagccctggcaggccaaaatcagcgtaattagacccagcaagggccatgagagctgcatgggagctgtggtgagcgaatacttcgtccttactgcggcccactgtttcaccgttgatgataaggagcacagcattaaggtgtcagtgggcggcgagaagcgcgatctcgaaattgaggtggtactgttccacccaaactataacattaatggtaagaaggaggctggaatccccgaattttacgactatgacgtggctttaatcaaactaaagaacaagttgaagtatgggcagacaatcagacccatttgtcttccttgtaccgaaggaaccacaagggccctcaggctccccccaaccaccacttgtcagcaacaaaaagaagaactcctgcccgcacaggacatcaaggctttatttgttagtgaagaggagaaaaaactgacacggaaggaagtctacataaagaatggcgataagaagggcagttgcgagcgtgatgcccaatatgcccctggctacgataaggttaaagacatctccgaggttgtgactcccagattcctatgcactggaggcgtgtctccttacgccgacccaaatacgtgcagaggtgactccggcggccccctcatcgtgcacaaaaggtcccgcttcatacaggtgggagtgatcagttggggcgtggtggatgtttgtaaaaaccagaaaaggcaaaaacaagtccctgcccacgccagagatttccacatcaacctctttcaggttctcccctggctgaaggaaaagctgcaggacgaggatttgggatttctttag

SEQ ID NO: 183700 - DNA, 2295 bp, Artificial Sequence
  Description of Artificial Sequence: Synthetic coding sequence
atgggcagcaacctgagcccccagctgtgcctgatgcccttcatccttggactgctgtccggtggtgtaacaaccaccccttggtcgcttgcccgcccgcagggttcctgcagccttgagggtgttgaaatcaaaggcgggtcatttagattactgcaggaaggccaggccctggagtacgtgtgtcctagcggcttttatccttaccctgtccagactaggacttgtcgctcaaccggatcatggtcgaccctgaaaactcaggatcaaaagacggtacggaaagctgaatgccgagctatacactgcccccgcccccatgacttcgagaacggcgagtattggccgcgcagcccatactacaacgtgagtgacgagatctcttttcactgttacgacgggtatactctgcgcggttcagcaaatcgcacgtgccaggtgaacggacggtggtcaggccagaccgccatctgcgataacggcgctggctattgctctaatcccggaatccccatcggcacccggaaggtgggtagccagtacaggctggaggattcagtgacttaccactgctcccgtgggctaacactacgaggtagtcagcggaggacctgtcaggagggcggtagttggagcggcaccgaaccaagctgtcaagactctttcatgtatgacacgccacaggaggtagcagaagccttcttgtcatccctcacagagaccattgagggcgtcgacgccgaagacgggcacggccccggcgaacaacaaaagcggaagatagtgctggatccctctggctccatgaatatttacctggtgctcgatggctcagacagcattggcgcatcgaatttcaccggtgctaaaaagtgcctcgtcaacctgatcgagaaggtggcctcttacggcgtaaagcccagatacggacttgtcacctatgccacgtacccaaaaatctgggtcaaggtgtccgaagcagacagttccaacgccgactgggtgaccaaacaactcaacgaaattaattatgaagatcacaaactaaagtcaggcacaaataccaagaaagccctgcaggccgtgtacagcatgatgagctggcccgatgacgttccaccagaggggtggaaccggaccaggcatgtgatcattctgatgaccgacggactccacaatatgggcggcgaccccattaccgtgatcgacgaaatccgcgacctgctttatataggcaaggaccgaaagaatccgcgcgaggactacctcgatgtctatgttttcggggtggggccccttgtcaatcaagtaaatattaacgcactggcatctaagaaagataacgaacagcatgtgttcaaagtgaaggatatggaaaatctggaggacgtcttctatcaaatgatcgatgaaagtcaatcgctgtccctttgtggcatggtgtgggaacatcggaagggcactgattaccacaagcaaccatggcaggcaaagatcagcgtaattcgaccatccaagggccacgaaagctgcatgggggcagttgtatccgagtactttgtcctaactgcagcacactgttttacagtggatgataaagaacactcaatcaaagtgagcgttgggggcgagaaacgggacctagaaatcgaggtggtgctcttccatccaaactacaacattaatggcaaaaaggaggccgggatccccgagttctacgactatgatgtggcactgatcaaactcaaaaataagctgaaatacgggcagacaataaggcccatttgtctcccctgtacggagggcaccacccgcgccctgaggctgccccccacaaccacctgccagcaacagaaggaagaactgctgccagcccaggatattaaagcactcttcgtttcagaggaagagaaaaaattgactaggaaggaggtctacataaagaacggcgataaaaagggctcgtgtgaacgagatgcccaatacgcccctggatatgataaggttaaggacatctctgaggtggtgacgcccagatttctttgtacgggaggggtatctccatacgctgaccccaatacatgcaggggagattcggggggccccttaattgtgcataagaggagccgatttattcaggtcggcgtgatatcgtggggagtggttgacgtttgtaagaatcagaagagacagaagcaggtgcccgcccatgctcgcgactttcatataaatctctttcaggtgttgccatggctaaaggagaaacttcaggatgaggatctggggttcctttag

SEQ ID NO: 183701 - DNA, 2295 bp, Artificial Sequence
  Description of Artificial Sequence: Synthetic coding sequence
atgggcagcaacctgagcccccagctgtgcctgatgcccttcatcctagggctgttgtcaggtggggtgacgactacgccctggtctctcgccagaccgcagggcagttgttccctggaaggggtggaaattaaaggtggatccttccgacttcttcaggagggccaagccctggaatacgtgtgcccatctggcttttatccttacccggtgcagacaaggacctgcaggagtactggatcatggagtacactgaagacgcaagaccagaagaccgtcagaaaggccgaatgtagagccattcactgccccaggccccatgattttgaaaacggcgaatactggcccaggagcccctactacaatgttagtgatgaaatctctttccattgttatgacgggtacaccctgcgaggctctgcaaaccgcacctgtcaagtcaacggtcgttggtcaggacagaccgccatctgtgataatggcgccggctactgctctaatcccggaatccccatagggacaagaaaggtaggctcacagtacaggcttgaagactccgttacctaccactgcagccgaggcttaactctgcgtggcagtcagcgccgaacgtgccaggaaggtgggagctggtctggtactgaaccttcatgtcaggacagtttcatgtacgatacaccccaggaggtcgcggaagctttcttgtcatcattgacagaaactattgagggcgtagacgcagaggatggccatggccccggagaacagcagaaacgcaaaatcgttcttgaccctagcggctccatgaacatttatctggtgttagatggttctgattccattggagccagcaatttcactggtgctaagaagtgtctggttaacctaattgagaaggtggcctcgtatggagttaaaccaagatacggactggttacatacgctacatacccaaaaatctgggtaaaggtctccgaggccgactctagtaatgctgactgggtgactaagcagctcaacgaaattaattatgaggaccacaagctgaagtccggcactaacacaaaaaaggctcttcaggccgtttacagcatgatgagctggccagacgatgtgcccccagagggctggaacaggacacgacatgttattattttgatgaccgatggactgcacaacatgggcggagatccgatcactgtgattgatgagattcgcgatcttctatatatcggtaaggatcgaaaaaatcctcgcgaggattatctcgacgtctacgtgtttggagtcggcccgcttgtaaaccaggtcaacattaacgccctggccagcaaaaaagacaatgagcagcacgttttcaaagtgaaggatatggagaacttagaagacgtgttctatcagatgatcgacgagagccaaagtcttagtctttgcgggatggtgtgggaacaccgtaaggggacagattatcataaacagccgtggcaagccaaaatttctgtgattagaccttcaaagggtcacgagtcgtgtatgggcgcagttgtgtctgagtatttcgtcctcactgccgcacattgttttacggtggatgataaggagcattcaataaaggtgtctgtggggggagagaaaagggatcttgagatagaagtcgtactttttcaccctaactacaacataaacggaaaagaagaggcgggaatccctgagttttacgattatgatgtggccctgataaaattgaagaacaaactcaagtacggccaaaccattcgccctatttgtctaccatgcacggaaggtaccacccgtgctctacgactgccaccaacaaccacctgccagcagcagaaagaggagctgctgcctgctcaggacatcaaggccttatttgtctcggaagaagagaaaaaacttacccgtaaagaggtgtacatcaagaatggcgacaaaaaaggctcatgcgagagggacgcccagtatgctcctggttatgataaggtgaaggacataagtgaagtcgtaaccccccgcttcctgtgcaccggtggtgtgtcaccatatgcggatcctaacacttgcaggggcgacagtggtggcccccttatagtccacaagagatcacggttcatacaggttggcgttataagttggggggtagtggacgtctgcaaaaatcagaagcggcagaaacaggtgcctgcccatgcgcgcgactttcatattaacctgtttcaggtgctgccatggcttaaagagaagctacaagatgaggatctgggatttctgtag

SEQ ID NO: 183702 - DNA, 2295 bp, Artificial Sequence
  Description of Artificial Sequence: Synthetic coding sequence
atgggcagcaacctgagcccccagctgtgcctgatgcccttcatcttggggctcttgagcggcggtgtcacaacaaccccttggagcctagccagaccccaagggagctgctcactcgagggcgtggaaatcaagggcggttcttttcggcttctgcaggagggtcaggcactggaatacgtctgtccatcaggcttctatccttacccggtacagacgcgaacttgccgttccaccggctcgtggtctacccttaaaacacaggatcagaagaccgtacgaaaagcagaatgtcgcgctatacattgcccccgaccacatgactttgagaatggtgagtactggccgcgcagcccttactacaatgtcagtgatgagatctccttccattgctacgacggctacacgctccgaggcagtgccaaccgaacctgccaggtgaatgggaggtggagtggacagactgcaatctgtgacaacggggccggttactgtagtaatccaggtattccaatcggtacaaggaaggttggctctcagtataggctggaggactctgtcacataccactgttcacgtggactgaccctgcgcggcagccagaggcgtacctgccaggagggcggttcatggtccggcacagaaccgtcttgccaagacagcttcatgtatgacacgcctcaggaagttgcagaggcattcctctcatcactcacagaaacaatcgaaggcgtggatgctgaggatggacatggccctggcgagcagcagaagaggaagatagtgttagacccatctggcagtatgaacatctaccttgtcctggacggaagcgactccatcggcgcctccaattttacaggggcaaagaagtgcttggttaatctaatcgagaaggtcgccagctacggggtgaagccacgctatggactggtgacttacgccacctacccaaaaatttgggttaaagtgtccgaagcggactcaagcaacgccgactgggtcactaagcaattgaacgagatcaactacgaagatcacaagttgaagtcgggaaccaatactaaaaaagctttgcaagctgtatattcgatgatgtcctggccagacgatgtgccccccgaaggttggaacaggacaagacacgtgatcatcctcatgaccgacggtttgcataatatgggaggtgatccaatcaccgtcattgatgaaatcagagatctattgtacattggcaaggataggaaaaacccccgagaggattatttagacgtgtatgtgtttggtgtcggtccgttggttaatcaggtgaacatcaatgccctggcatccaaaaaggacaacgaacagcacgtgtttaaagtgaaggacatggaaaacctcgaagacgtgttttatcagatgattgacgaaagtcaaagtcttagtctgtgtggcatggtctgggagcataggaaggggacggactaccataaacaaccttggcaggctaaaataagtgttatccggccaagcaagggccacgagtcatgtatgggagcagtcgtcagcgagtacttcgttctgacagcagctcactgcttcacagtggacgataaagagcacagtattaaggtttcagtcggcggagaaaagcgggatctggagattgaagtggttctgtttcacccaaactacaatatcaatgggaagaaagaggctggtatccctgagttctacgattacgacgtggcattgattaagctcaaaaacaaactcaagtatggtcagacgataaggcccatatgtttaccgtgcaccgaaggaacaacccgagctctgcggctcccccctactaccacgtgtcagcagcagaaggaggaactgttgccagcacaggatattaaggccctttttgttagcgaggaagaaaaaaagctgacccgcaaagaggtgtacatcaaaaacggggacaagaaagggagctgcgaacgagacgcccaatatgcacccggatacgacaaagttaaggacattagtgaagtggtgactcctcgcttcctctgtacaggcggtgttagtccctacgcggatcctaacacatgcagaggagattcgggcgggccactgattgtacacaagcggtccagattcatacaggtgggagttatcagttggggcgtcgtcgacgtttgcaagaatcagaagcggcagaagcaggtccccgcgcacgcacgagacttccatattaacctgttccaggttctgccgtggctgaaggagaaactgcaggatgaggacctaggatttctgtag

SEQ ID NO: 183703 - DNA, 2295 bp, Artificial Sequence
  Description of Artificial Sequence: Synthetic coding sequence
atgggcagcaacctgagcccccagctgtgcctgatgcccttcatcttgggactgctgtccggaggcgtgactaccactccctggtctctcgcccgcccacagggaagctgctcgctcgaaggggtagagatcaagggagggagttttcgacttctgcaagaaggccaagctctcgaatatgtttgccccagtggcttctacccctaccccgttcagacccggacctgccgctcaacagggtcatggagtaccctgaaaactcaagaccagaaaaccgtgaggaaggccgagtgtcgagctatccattgtccaaggccgcacgactttgagaatggcgaatattggcctcgatccccgtactataatgtgagtgacgaaattagcttccactgttacgatggctacacgctgcgtggctcagcaaacagaacttgccaggtgaatggcagatggtctggccagaccgccatttgtgacaatggagctggctactgtagtaatcccggaattcccattggtaccaggaaggtgggcagccagtacaggctcgaggattctgtcacttaccattgcagccgcggtctgacccttcggggctcacagcggcggacctgtcaagaaggaggtagttggagcggtaccgaacccagttgccaggattctttcatgtacgacacacctcaggaggtggcagaagctttcctgagcagcctcacggagacaattgagggggttgatgcagaggacggtcacgggccaggagaacagcagaagcggaaaatagtcctcgatccgtctggcagcatgaatatctacctggtgctcgacggcagcgattcaattggagcttctaacttcaccggtgccaaaaagtgtttggtcaaccttatcgagaaagtcgcatcgtacggtgtgaagccaaggtatgggctagtgacatatgccacttacccaaagatatgggttaaggtgtctgaggccgacagcagcaatgctgattgggtcacaaagcagcttaacgagatcaattatgaagatcacaagctgaaaagcggcaccaacactaaaaaggctctacaggccgtgtattccatgatgagttggcccgacgatgtgcctccagaggggtggaataggaccaggcatgtgataatcttgatgacggatggccttcataacatgggcggcgacccgataactgtaattgacgaaattcgggatttgctgtatatcgggaaggatcgaaagaacccacgcgaggactatcttgatgtgtatgtatttggagtgggccctctcgtaaatcaggtgaacatcaacgctctcgcgagcaagaaggacaatgagcagcacgttttcaaggtgaaggatatggagaatttagaagatgtgttttaccagatgattgacgaaagccagtcactatccctttgcggcatggtctgggaacataggaaaggaaccgattaccacaaacagccctggcaggcaaagatttcagtgattagaccctctaaaggccacgaatcttgcatgggtgccgttgtttcagaatattttgttttgacagccgcccattgttttacagtggatgacaaggaacattcgatcaaagtgagtgtggggggtgaaaaaagggatttagagatcgaggttgtgctttttcaccctaattacaatattaatggtaagaaggaggcaggtatccccgagttttatgattacgacgtggccctcatcaagctgaaaaacaagttgaagtatggccagaccatcagacccatttgtctaccatgcaccgagggtaccacacgggcgctgaggctccctcctactacaacctgtcagcagcagaaggaagagttactccccgcccaggatattaaagccctgttcgtgtctgaagaagaaaaaaagctcactcgcaaggaggtgtatattaagaacggcgataagaaagggtcctgcgagagggatgcccaatatgcccccggctacgacaaagtcaaggatatctccgaagtagtaacgcctagatttctgtgcacaggtggtgtaagcccgtacgcagatcctaacacatgtagaggagatagcgggggcccactgattgtacacaagaggtcaagattcatccaggtaggggtgattagctggggagtggtggacgtgtgcaagaatcagaaacgccagaagcaagtgcccgcccacgcgagggacttccacatcaacctgtttcaggttctgccgtggcttaaggaaaagctgcaggacgaagacctgggctttctgtag

SEQ ID NO: 183704 - DNA, 2295 bp, Artificial Sequence
  Description of Artificial Sequence: Synthetic coding sequence
atgggcagcaacctgagcccccagctgtgcctgatgcccttcatcctgggactgctttccggaggcgtgaccactactccatggtccctggctagacctcaggggtcctgctcattagagggtgtagaaatcaagggcgggtccttccgcctgctgcaggagggccaggcactggagtatgtatgccctagcgggttctatccctacccagtgcagacccggacgtgccggtccactggatcttggtccaccctgaaaactcaggaccagaagactgtgcgaaaagccgaatgccgcgctatacactgtcctcggccgcatgatttcgaaaatggggaatattggccgcgcagtccctactacaacgtgtcagacgagatcagcttccactgctacgatggttacacactgcgcggctccgccaaccgtacctgtcaggtaaacggaagatggtccggacagactgctatatgtgataacggtgccgggtactgttctaaccccgggatacccattggtactcggaaggtgggatcccagtatcgcttggaagatagcgtgacctatcattgttcccgcggtttgaccctccgcggctcgcagcgcaggacttgtcaggaaggaggatcatggagcggcacagaaccttcttgtcaggactcctttatgtatgacaccccccaagaggttgctgaggcgttcctatctagtctgaccgagacaattgagggagttgacgcagaggacggccatgggcctggcgaacagcagaagcgcaaaatagtacttgatcccagcgggtcaatgaacatttatctggtgctagacgggtcagactcgataggtgcatctaatttcaccggggcgaagaagtgtttagttaatctgatcgaaaaagtagcatcgtacggtgtaaagccaagatacggccttgtaacctacgcgacgtatcccaaaatatgggtgaaggtttcagaagccgacagtagtaatgctgattgggtcacaaagcagctgaatgagatcaactacgaagaccataaactcaagagcggcaccaacactaagaaggccctccaggctgtttacagtatgatgagttggccagatgacgtgccccctgagggctggaaccggacacgccatgtgattatattgatgacggatggtttacataacatgggcggggatcctattacagttattgacgagattcgtgatttattatatatcggaaaagaccggaagaacccacgagaggattatttggacgtgtacgtcttcggtgtgggtcccctcgtcaatcaggttaacataaacgctctggcgagcaaaaaggataacgagcagcacgtgttcaaggtgaaagacatggagaatcttgaggacgtgttttatcagatgattgatgaaagtcagtccctgagcctctgtggcatggtgtgggaacatcggaaaggcactgactatcacaaacaaccctggcaggctaagatatccgttataagaccgagtaaggggcacgagagctgcatgggagcagttgtctcagagtacttcgtgctgacagccgcccactgttttactgtggacgataaggagcacagcatcaaagtgtctgtggggggagagaaaagggacctggaaattgaggtggtactcttccatcccaattacaacatcaatggcaaaaaagaagcagggatccctgaattctacgactatgacgttgccctcattaaactgaagaacaagctcaaatacgggcagaccattcggcccatatgccttccctgtactgagggcacaaccagagcgcttcggctgcccccaaccacaacctgccagcagcaaaaagaagagctgctccctgctcaggacattaaagctctgttcgtctctgaagaggagaagaagctgaccaggaaagaagtgtacattaagaacggcgataagaaggggtcctgcgagagagacgcccagtacgcgcccgggtacgacaaagtcaaagacatctccgaagtagttactcctcgttttctgtgcaccggtggagtctcgccatatgccgatcccaacacatgtcgtggagatagcggaggacctttgattgttcacaagcggtcccggttcattcaggtaggagtaatttcatggggtgtcgtagacgtgtgtaagaaccagaaacggcagaagcaggtgcccgcccatgcgcgcgatttccatatcaacctgttccaggtcctgccctggctcaaagaaaagttacaagacgaagatcttggctttctgtag

SEQ ID NO: 183705 - DNA, 2295 bp, Artificial Sequence
  Description of Artificial Sequence: Synthetic coding sequence
atgggcagcaacctgagcccccagctgtgcctgatgcccttcatcctgggcctgctgtccgggggggtcaccacaactccatggtcactggcaaggccccagggctcctgctcacttgagggggtggagatcaaggggggcagctttaggcttctccaggagggccaagccttggagtacgtctgcccttctggcttctacccctaccctgtgcagacacggacatgccgcagcactggctcctggtctaccctgaagacccaggatcagaaaaccgtgcgcaaggcagagtgccgggcgattcactgtcccaggccacacgactttgagaacggcgaatactggccccgcagcccatactataatgtgagcgatgaaatttcgttccattgctacgacggctacacactgcgggggtctgcgaacagaacttgccaggtgaatggccgctggagtggacaaacggcaatatgcgacaatggtgcggggtattgctcaaaccccggaattcccattgggaccagaaaggtaggctctcagtaccgcttggaggattcagtgacttatcattgttcgcgtgggctgactctgcggggctcccagcgtcggacctgtcaagaaggcggttcgtggtccggaactgaaccatcttgtcaggacagttttatgtacgacaccccgcaggaggtagctgaagccttcttatcaagtttaacagagaccattgagggggtcgatgctgaggacggacacggccctggcgaacaacaaaagaggaagatcgtgttggatccttctggttccatgaatatctacctagtgctggatggatcggactcaattggagcctctaatttcacgggcgccaagaagtgcctagttaatctcatagaaaaggtcgcttcttatggggttaagccacgttatggtctcgtgacctacgcaacctacccaaagatttgggttaaggtgtctgaggcagattcttcaaatgccgattgggtcactaagcaactcaatgagataaactacgaagaccataaattaaaatcaggcactaatacaaaaaaggcacttcaagcagtgtattccatgatgagttggccagacgacgttccaccagagggctggaatagaaccaggcatgtaataattcttatgactgatggcctgcacaatatggggggtgacccaatcaccgtaatcgatgaaatcagggatctgctgtacatcggcaaggacagaaaaaatccaagagaggactatttggacgtttatgtgtttggagtgggacctctcgtgaaccaagtgaacattaatgccttagctagtaaaaaggacaacgagcaacacgtcttcaaggtgaaggatatggaaaacctcgaggatgttttctatcagatgattgatgaaagtcagtccctcagcctgtgcgggatggtctgggaacacagaaaggggaccgattaccataaacagccatggcaggctaagatcagcgttatcaggccttccaaagggcatgagtcatgcatgggtgcagtggtctccgagtatttcgtcttgacagcggcccactgctttactgtcgacgacaaggagcattcaattaaagtgtccgttgggggagaaaagagggaccttgagatcgaggtcgttttatttcatcccaattataatatcaatggtaagaaagaggcgggtattcccgagttttacgactacgatgttgccctgattaagctgaagaacaagctgaagtatggccagacaatcaggcctatttgcctaccatgtaccgagggaacaactcgtgcactgcgactcccacctacaaccacatgtcagcagcagaaagaggagctgctgcccgcgcaggacataaaagccctgtttgtatcagaagaagagaagaaattaacacggaaagaagtctacattaagaacggagataaaaaagggtcatgcgaacgggatgcccagtacgcaccaggttatgacaaggtgaaagacatctcggaagttgtgaccccgagatttctttgtaccggcggggtgagtccatacgcagacccaaacacctgtagaggggattctggcgggcctcttatcgtccacaagcgttcccgatttatccaggtcggtgtgatctcttggggtgtggtcgacgtatgcaaaaatcagaagaggcagaagcaggttcctgcacacgcccgcgatttccatataaatctcttccaggtgctaccatggctgaaggagaaactccaggatgaggatctggggttcctctag

SEQ ID NO: 183706 - DNA, 2295 bp, Artificial Sequence
  Description of Artificial Sequence: Synthetic coding sequence
atgggcagcaacctgagcccccagctgtgcctgatgcccttcatcctgggccttctgtctggaggcgtgacaaccacaccttggtccttagcaaggccacagggaagttgcagccttgaaggtgtcgaaattaaaggaggcagttttcgcttgctccaggagggacaggctctggagtacgtttgcccctccgggttttacccttatccggtgcagacccgtacatgtcgttctaccggctcctggtctactctgaagacccaggaccagaaaacggtgcggaaggcggaatgcagagcaatccactgtccccggccacacgattttgagaatggtgagtattggcctaggtctccctactacaacgtgagtgacgagatatctttccactgctacgacggctacaccctgagaggatctgccaaccggacctgtcaggtcaatggtcggtggagtggacagactgccatttgcgacaatggagccggttattgctcaaacccaggcatccccattggaacccgcaaagttggtagccagtatcgccttgaggattccgtgacataccactgcagcaggggactgacgctgagggggtctcagaggcgcacctgtcaagagggcggcagctggtcaggcacggaaccttcttgtcaggactccttcatgtatgataccccacaagaagttgcggaggccttcctgagcagtttaacagagaccatcgagggtgttgatgctgaggacggccacggccctggagagcagcagaaaaggaagattgtcctggatccgtcggggagtatgaatatctatcttgtgctcgatgggtccgatagtattggcgcatcaaactttactggtgctaagaaatgtctggtcaacctgatcgaaaaagtagcttcctatggcgtaaagcctcggtatggcctggtgacctacgcaacctatccaaaaatctgggtaaaagtgagcgaggctgattccagtaatgcggactgggtgacaaagcagctgaatgagataaactacgaagaccacaagctgaaatcaggtacaaacacaaagaaagcccttcaggccgtgtactcaatgatgtcatggcctgacgacgttcctccggagggctggaaccgcaccaggcatgtgattatcttgatgaccgacggactccataatatgggcggcgatcctattaccgttatcgatgaaatcagagacctgctgtacatcggcaaagatcgcaaaaatcccagagaagattatctggacgtatacgtattcggagtgggcccactcgtaaatcaagtcaacataaatgcccttgctagcaaaaaagacaacgagcagcacgtgtttaaggtcaaggatatggaaaaccttgaagacgtgttttatcaaatgatcgatgagagccagtcattgagtctgtgtgggatggtgtgggaacaccggaagggcacagattaccacaaacagccgtggcaggcaaagatatcggtgatacgtcctagcaaaggccacgaatcttgtatgggcgccgtcgtcagcgagtattttgtcttgaccgcagcccactgcttcactgtggatgacaaagaacactctatcaaagtaagcgtgggtggagaaaaaagggatctggagatcgaggtcgtgctctttcaccctaactataatattaatggaaaaaaagaagctgggattcccgagttctatgattatgatgtagctctgattaagttaaaaaataagctgaaatacggccagacgatacgacccatttgtctgccttgcacagagggaaccacacgggctctccggctgccaccgacgaccacatgccagcagcagaaagaagaactgctgcccgcccaggacatcaaagccctgtttgtatccgaggaagagaagaagctgaccaggaaagaagtgtacatcaagaacggggacaagaagggatcatgtgaacgggacgcgcaatacgcgccgggctacgataaggtgaaagatatctcagaagtagtgacgcctaggtttctttgcacaggcggcgtctcaccatacgctgacccaaacacgtgcagaggagactccgggggccccctgatagtccacaagcgcagcagattcattcaagtgggggtcattagctggggcgtggtggacgtgtgtaaaaaccaaaaacgccagaagcaggtgcctgcccatgcgagggatttccacattaatctgttccaggtactcccttggctgaaggagaagctccaggatgaggacctgggcttcctctag

SEQ ID NO: 183707 - DNA, 2295 bp, Artificial Sequence
  Description of Artificial Sequence: Synthetic coding sequence
atgggcagcaacctgagcccccagctgtgcctgatgcccttcatcctcggactgctgtccggaggagtgaccaccaccccttggtccctggcccggcctcagggctcctgtagccttgaaggcgtagaaatcaagggcgggtctttccgacttctgcaggaggggcaggcgctggaatacgtctgtccatccggattctatccgtatcccgtgcaaaccaggacatgcaggtcaaccggatcatggtctacccttaagactcaggatcagaaaaccgtgcgcaaggccgaatgcagggccattcattgtccgcgacctcacgacttcgagaacggtgaatactggccgcgctctccttactacaatgtgtccgatgagattagttttcactgctatgacggttacaccctgcgcgggtccgccaatcgcacctgtcaggtgaatggaaggtggtcagggcagaccgcgatctgtgataatggcgctggatattgtagcaaccctggaatccctattggaactcgtaaggttggatcccagtacaggctagaggattctgtgacgtaccattgtagccgaggactaaccctccggggctcgcagagacggacctgtcaagaaggcggaagctggtcaggcactgaaccctcttgccaggactcttttatgtatgacactccacaggaggtggctgaggctttcctttccagtttgactgagacaatagaaggcgtggatgcggaggacggacacggccccggtgagcagcaaaagagaaaaatagtgttggacccctcggggagcatgaacatatatcttgtgcttgatggtagcgacagtatcggtgccagtaatttcactggagcaaaaaaatgcctcgtcaatttaatcgagaaggttgctagctatggagtcaagcctcgctacgggctggtgacatacgcgacttatccgaaaatatgggtcaaggtcagtgaagccgattcaagcaatgccgactgggtgaccaagcagctaaatgaaatcaattacgaggatcataaactcaaaagtgggacaaacactaagaaggccctgcaggctgtgtactccatgatgtcttggcccgacgatgtgccaccggagggatggaataggacgcgccacgtcatcatcctcatgaccgacggcctgcataacatggggggcgatccaatcactgtgatagatgagattagagatctgctgtacattggcaaagataggaaaaatccgagggaagattacctggacgtatatgttttcggggtgggcccattggtcaaccaggtcaacataaatgcactcgcgtccaaaaaggacaacgagcaacacgtgttcaaggtgaaagacatggagaatctcgaagacgttttctatcaaatgatagatgaatcgcaaagcctttccctgtgtgggatggtgtgggagcatcgtaagggcactgattaccacaaacaaccctggcaggctaaaatctccgttatccgtcctagtaaagggcatgaatcctgtatgggagcagtggtctcagaatattttgtgctcaccgctgctcactgctttactgtggacgacaaggaacattcgataaaggtgtccgtggggggtgaaaaaagagacctagagattgaagtagtgttatttcaccccaattacaatattaacggaaaaaaggaagctggtattcctgagttctacgattacgatgtggcgctcattaaactgaagaacaaactcaagtatgggcagactattcggccaatctgtctgccctgcaccgaaggcaccacaagagccctaaggctcccgcccactaccacttgccagcaacagaaagaggaattgctgccagcccaggatataaaggccttgttcgtgtctgaagaggagaaaaagctcacccgcaaggaggtctacattaagaacggggacaagaaagggtcgtgcgaaagagacgcccagtacgcaccagggtatgataaagtgaaggatatctcagaggtggtgactccgcgatttttatgcactggaggcgtgtccccctatgctgatcccaacacatgccgaggagatagcggcggcccactgattgtccacaagcggagcagatttattcaggtgggagtgatttcctggggtgtggtcgacgtgtgtaagaaccagaaaagacagaagcaggtgccagcacacgcacgagactttcacataaatctctttcaggtattaccctggctgaaagagaaactccaggacgaagatctgggcttcctttag

SEQ ID NO: 183708 - DNA, 2295 bp, Artificial Sequence
  Description of Artificial Sequence: Synthetic coding sequence
atgggcagcaacctgagcccccagctgtgcctgatgcccttcatcctgggattattgtctggcggagtgaccacgacgccatggtctctcgcaaggccgcaaggctcctgttcgctggaaggtgtcgagattaaaggtggcagtttccggctactgcaggagggtcaagccctggagtacgtatgcccatctgggttctacccttatcctgtgcagactaggacttgccggagcaccggttcttggtctacactaaaaacccaagatcagaagactgtgcgcaaagcagaatgcagggccatccactgtccccggccccacgattttgagaacggtgaatactggcctagaagcccttactataatgtgagcgatgagatctccttccactgttatgacgggtatacacttaggggatctgcgaaccgcacatgtcaggtcaatggcaggtggtctggccagacagctatatgcgataatggtgcgggatactgcagcaatcctggaatcccgattggaacgagaaaagtcggcagtcagtaccgactcgaggattcagtgacgtaccattgttcacgaggtctgactctgagaggtagccagaggaggacctgtcaggaaggcgggagctggagcggtactgaaccttcctgtcaggattcttttatgtacgacacaccccaggaagtagccgaggcattcctgagcagcctgactgaaactatagaaggagtggacgctgaggacggtcacggtcccggcgaacagcagaagaggaaaatcgtactggatccctctggaagcatgaatatctacctggtgcttgatggctccgattccatcggtgcatccaattttactggagctaagaaatgcctggttaacctcattgagaaggtggcttcctatggggtgaagccccgctatggtctggtcacttacgccacctatccaaagatttgggtgaaagtttccgaagccgacagctccaatgccgactgggttacaaaacagctgaacgaaatcaattatgaagaccacaagctcaagtccgggacaaacacaaagaaggccctccaagcagtgtacagtatgatgtcatggccagatgatgttcctcccgaaggctggaatagaactcgccacgtgataatattgatgactgacggtctccataatatgggcggagaccctattacagtgattgatgagatccgtgacctgctgtacattggcaaagacagaaagaaccccagggaggattacctggatgtgtacgtcttcggcgttggaccacttgtcaatcaggtgaatataaatgccctcgcctctaaaaaagataacgaacagcatgtgttcaaagtaaaggatatggagaacctggaggacgtgttttatcagatgattgatgagagtcaatcattgtctttgtgtggtatggtgtgggagcacaggaaggggacggactaccacaagcaaccgtggcaggcaaaaatatccgtgattagaccttcaaagggacacgagtcttgtatgggcgctgttgtctccgagtacttcgtcctcactgccgctcactgctttaccgttgatgacaaagagcactccattaaggtgtctgtcggaggagaaaagagggatctggagatagaggtcgttctcttccatcccaactataacattaacggcaagaaagaagccgggatccccgaattttacgattatgatgtggccctgattaaacttaagaacaaactgaaatacggccagacaatccgccccatatgcttgccatgcacagaggggactacacgcgctctgcgcctgccacctactacgacctgccagcagcagaaagaagaattgctgcccgcacaagacatcaaagccctatttgtgagtgaggaagagaaaaagctgactaggaaggaagtatatattaagaacggcgataaaaagggctcctgtgaaagggatgctcagtatgcccccggttatgataaggtaaaggacatcagcgaggtggtcacaccaaggtttctctgcacggggggagtaagtccctatgcggatcccaatacgtgccggggcgactccggaggaccattaatcgtgcataaaaggtctcggttcatccaggtgggggtcatctcttggggcgtggtggacgtctgcaaaaaccagaaaagacagaaacaggtgcccgcccacgcacgcgacttccacattaacttgtttcaggtgctaccgtggctcaaagaaaaacttcaggatgaagacctgggttttctctag

SEQ ID NO: 183709 - DNA, 435 bp, Artificial Sequence
  Description of Artificial Sequence: Synthetic coding sequence
atgggcagcaacctgagcccccagctgtgcctgatgcccttcatcctggggctgctatctggaggagttaccaccactccatggtccttggctcgccctcagggatcctgtagcctggaaggcgttgagatcaagggcgggagctttaggttgctccaggagggacaggcactcgagtacgtgtgtccctcagggttttacccttaccctgtccagacacggacttgcaggagtaccgggtcctggtcaaccttgaagacccaagaccagaaaacagtccgaaaggctgagtgtcgcgcaatccattgtccccgccctcatgactttgagaacggcgaatattggccccggagtccctattataacgtttctgatgaaatcagttttcactgctatgacgggtacacgctccgcggatctgccaaccgtacctag

SEQ ID NO: 183710 - DNA, 3801 bp, Artificial Sequence
  Description of Artificial Sequence: Synthetic coding sequence
atgggccccctgatggtgctgttctgcctgctgttcctgtaccccggtctagccgattcagccccatcttgcccacagaacgttaacatcagcggcggtacttttactttgagccatggctgggcccccggctctctgctgacatattcatgccctcagggactgtacccttcgccagcatccagactctgtaagagcagcggccagtggcagacccctggcgccacgcggagcctcagcaaagctgtatgtaaacccgggcactgcccaaacccagggataagcctgggtgccgtcagaactggatttaggtttggacacggagataaagtgcggtaccgctgctccagtaacctggtcctgacaggctcttcagagcgggaatgccaggggaatggggtctggtccgggactgagccgatctgccgccaaccctactcatacgatttcccagaggacgttgcgcccgctctcggaacttccttttcacacatgctaggcgctacaaatcccacgcagaagacaaaggaccatgagaacggaacaggcaccaacacctacgccgccctgaattctgtgtaccttatgatgaataatcagatgcgtctgctcgggatggagacaatggcctggcaagagataaggcatgcaataatcttgctaaccgatggaaagagtaacatgggaggatctcccaaaaccgcagtggaccacattagggagatcctgaatattaatcagaagcgcaacgactacctggatatttacgccatcggcgttggtaagctggatgttgattggcgagagctcaacgagcttggatcaaaaaaagacggagaacgtcatgccttcatcttgcaggatacaaaggctctgcatcaggtgtttgagcacatgcttgacgtgagtaagcttactgataccatctgcggcgtggggaacatgtccgccaatgcatcagaccaggagcgtaccccctggcatgtgaccatcaaaccaaaaagccaggagacctgtagaggagctcttattagtgaccagtgggtcctcaccgcagcccattgtttcagggatggaaacgatcattcattgtggcgcgtgaatgtcggcgatcccaaatcgcaatggggaaaagaattcctcattgagaaggcagtgatttccccgggattcgacgttttcgctaaaaaaaaccagggcattctcgagttctacggagatgacatagcactgctgaaactggcacagaaggttaagatgagcactcatgcacgcccaatatgtctgccctgcacaatggaagccaatctggctcttcggagaccccaaggaagcacctgccgcgaccacgaaaacgagctgttgaacaagcagagcgtgcccgctcattttgtagctttgaatgggtctaaactaaatatcaacctcaagatgggagtggagtggacctcctgtgccgaggtggtgagtcaagaaaaaacaatgttcccaaacttgaccgacgttcgggaggtggtaactgaccagttcctgtgcagcggaacgcaggaagacgagagcccctgcaaaggagtcactactaccccctggtcattggcacgccctcagggctcctgcagcctggaaggtgttgaaatcaaaggcggtagctttcgcctgctccaagaagggcaggcactggagtatgtgtgcccttcagggttttacccatatcctgtgcagacgcgaacatgtaggagtactggcagttggagtacgcttaagacgcaagaccagaagacggtgcgcaaagccgagtgtagagccatccattgccccagacctcacgactttgagaatggagaatactggcccaggtcaccctattataatgtctctgacgagatatcctttcactgctacgatggctatacgcttagggggagtgccaatcgaacatgccaggttaatggcaggtggtcagggcagaccgcgatttgtgataacggtgccggctactgtagcaatcctggaatccctattgggacccgtaaagttggtagtcagtatcgactggaggattctgttacctatcattgttctagggggctgacacttaggggcagccagcgacgcacatgccaagagggaggcagttggagtggcacggagccaagctgtcaggactcttttatgtatgatacaccacaggaggttgctgaggcttttctgtcgtccctcacggaaacaattgagggcgtcgatgccgaggacgggcacggacccggagagcaacagaagagaaaaattgtactggatccttcaggtagtatgaacatctacctcgtcctggatggaagtgactctataggcgcctccaacttcacaggtgcgaagaagtgtctggttaatctaatcgagaaggttgcttcatacggcgtgaagccgcggtacggtcttgtgacctacgccacatacccaaaaatttgggttaaggtttcagaagccgacagttctaacgccgactgggtcaccaaacagctcaatgaaattaattacgaagatcataagctgaaatctggcaccaacacaaaaaaagctctgcaggccgtttactccatgatgtcctggcctgacgacgttccccctgaaggctggaaccgtacgagacacgtgataatcctaatgactgacggtctgcacaatatggggggagaccctatcacggtgatcgatgagattcgggatcttctatatatcggcaaggaccgcaagaacccgagggaagattatcttgatgtttatgtgttcggagtgggcccactggttaaccaggttaacattaacgcgcttgcttccaaaaaggacaatgagcagcacgtgttcaaagtaaaggatatggaaaacctggaagacgtgttctatcaaatgatcgatgaaagtcaaagcctttccctctgtggcatggtgtgggaacatagaaagggcacggactaccacaagcaaccttggcaagccaagatctcagtgatcaggccatccaaaggtcacgagagctgtatgggcgcagtcgtaagcgagtacttcgtgctcaccgccgctcactgttttacagttgatgacaaggagcatagtatcaaggtgtccgttggaggagaaaaacgtgatctcgaaatagaggtggtcctgtttcacccaaactacaacataaacggaaagaaggaggccggaatacccgagttttatgattatgatgttgcactgatcaagctgaagaataaactgaagtacggacagacaatcaggccaatctgtcttccatgcaccgagggcactaccagagctttaagactcccccctaccacaacctgtcagcagcagaaagaagagctcttgccagcccaggatatcaaagcgctgtttgtgtccgaggaggagaaaaagctcacccgaaaagaggtctatatcaagaatggtgacaaaaagggttcctgcgagcgcgatgctcagtacgcccctggctacgacaaggtgaaggacattagtgaggtggtgactcctcgattcctgtgtaccggcggcgtctccccctacgccgacccaaacacctgtagaggggacagtggaggacctctgattgtgcacaaacgttcacggttcatacaagtaggagtgatcagctggggtgtcgtagatgtgtgcaaaaatcaaaagcggcagaagcaggttccagcccacgctcgggattttcacatcaatctgtttcaggtgctgccttggctgaaagaaaaacttcaggatgaagacctgggctttctgtag

SEQ ID NO: 183711 - DNA, 3801 bp, Artificial Sequence
  Description of Artificial Sequence: Synthetic coding sequence
atgggccccctgatggtgctgttctgcctgctgttcctgtaccccggcctggcagattctgccccaagctgccctcaaaacgtgaatatttctggaggtacgttcaccttatctcatggttgggcgccaggctcccttctcacctattcatgcccgcagggtctttacccctcgcctgcctccaggctttgcaaaagctcaggccagtggcagacccctggcgctacccggtctctgtccaaggccgtgtgtaaacctggccactgccccaaccccggaattagcctaggggctgtgaggactggatttagatttggccatggcgacaaagtgcgctatagatgctccagcaacctagtgcttacggggtcctccgagcgagagtgtcagggcaatggggtttggtccgggactgaaccgatttgtagacagccctatagttacgatttccccgaggatgtggcccccgctttgggcacctcctttagccatatgctaggggcaactaatcccactcagaaaacaaaagaccatgaaaacgggacgggcaccaacacatatgccgctttgaactctgtgtacctgatgatgaataatcagatgcgcctgctcggaatggagacaatggcctggcaggagatacggcatgcaatcattctgctcaccgatggaaagagcaatatgggcggaagccctaaaactgctgtggatcacattcgagagattctgaacatcaaccagaaacgtaatgactacctggacatctacgccataggggttggtaaactggacgtggactggcgcgaactaaacgagctgggttccaagaaggatggggagaggcatgcttttattctgcaggataccaaggccttacatcaggttttcgagcacatgctagacgtgtcgaaactgaccgataccatttgcggtgttggcaacatgtctgccaacgcttccgatcaggaacgaacaccatggcacgtgaccattaaacccaagtcccaggagacgtgtcgaggcgccctgatcagtgaccagtgggtgttgaccgccgctcattgtttcagagacggcaacgaccattccctatggagagtgaatgtgggagatcccaaaagccagtgggggaaagaattcctgatagaaaaggcagtgatttcgccgggatttgacgtttttgcaaagaaaaatcaaggaatccttgaattctacggggatgatattgctctgctcaaacttgcccaaaaggttaaaatgagcacacacgccagaccaatttgccttccttgcactatggaagctaacctagctctaaggcggccgcagggttctacatgtagggaccacgagaacgagctgttgaacaagcagagcgttccagctcacttcgttgctttgaacggttctaaactgaatataaatttgaaaatgggagtggagtggacctcctgcgcggaggtggtctcccaagaaaaaaccatgtttccaaatctgaccgacgtgcgcgaggtggtgaccgatcagttcctttgttccggcactcaggaagatgaaagcccctgtaagggcgtgactacaaccccctggtctctggcccggccacagggcagctgctctttggaaggagtcgagattaagggcgggtcttttcgcttgcttcaggagggacaggctctggaatacgtttgccctagcggattttatccctacccggtccagacccggacatgccgatccaccggttcatggagtaccctgaagactcaagatcaaaagacagtaagaaaagctgagtgtcgggcaatccattgtccccgcccacatgattttgagaatggggagtattggccacggagtccttactacaacgtgtccgacgagattagtttccattgctacgacggttataccctccgcggctctgcaaatcggacgtgtcaagttaacggacggtggtccggtcaaacagccatctgcgataacggagcgggctactgctccaacccagggatcccaattgggacccgcaaagtcggtagtcagtatcggttagaggactctgtcacctatcactgtagccggggactgacactgaggggttcgcagaggcggacatgccaggagggaggctcatggtcaggtactgagcctagctgccaagactcattcatgtacgatactccgcaggaggtggctgaggcctttctatccagcctgactgaaacaatagagggtgtagacgcagaagatgggcatggacctggagagcagcagaagcgtaagatcgttcttgacccgtcagggtctatgaatatttatctggtcctggacggatcagactcaatcggcgcttccaatttcacgggcgccaaaaaatgcctggttaacttgatagaaaaagtagcttcttacggggttaagccccggtatgggctcgtgacttatgccacgtaccctaaaatctgggtcaaggtgtcagaagctgattcctcaaacgcagattgggtgacaaaacaattgaacgaaatcaactacgaagatcataaattaaagtccggtaccaatacaaaaaaagctctgcaagccgtctatagtatgatgagctggcctgatgacgtgcctccggaaggttggaaccggacgcggcacgtcataattcttatgaccgatggcctgcacaacatggggggtgatcctataactgtgattgacgagattagagacctgctgtatatcggtaaagatcgaaaaaaccctcgggaggattacctggacgtctatgtctttggagtcggcccactagtcaatcaggtgaatattaatgcattggcgtcgaagaaggacaatgaacagcatgtgtttaaggtcaaagacatggagaacttggaggacgttttttaccagatgattgacgagtctcaaagcctgagtctgtgcggtatggtatgggaacatagaaaaggaactgattatcataagcagccctggcaggccaagatatctgttataaggccaagcaagggccatgaatcctgtatgggcgcagttgtctcggagtacttcgtgctcaccgctgcacactgctttaccgtcgacgacaaggaacattccattaaggttagtgttggcggcgagaagcgtgatttggaaatcgaagtcgtcctctttcacccaaattacaacatcaatggcaaggaggaagcagggatcccagaattttatgattacgatgtcgcactcattaagttgaagaacaagctgaaatacggccagaccatccgaccaatttgcctcccgtgtaccgaaggcacaaccagggccttgcgactgcccccaaccacaacttgtcagcaacagaaagaagaattgctccccgctcaggatattaaggctttgttcgtttctgaggaagagaaaaagctgacccgcaaggaggtatacataaaaaatggcgacaagaaagggtcatgtgagcgcgatgcccagtatgcacctggctatgacaaggtgaaagacatttccgaggtcgttaccccccgatttttgtgcactgggggagtttcaccttacgccgatccaaacacatgccggggggactcagggggcccactaatagtgcataagcgctccaggttcatacaagtaggggtgatctcttggggagtggtggacgtctgtaagaatcaaaaacgccagaaacaagtgcccgcacatgcacgggacttccatatcaacctgttccaagtgctaccatggttgaaagagaagctgcaagacgaggatctagggttcctgtag

SEQ ID NO: 183712 - DNA, 3801 bp, Artificial Sequence
  Description of Artificial Sequence: Synthetic coding sequence
atgggccccctgatggtgctgttctgcctgctgttcctgtaccccggactggcggactctgcaccctcctgccctcagaacgtgaacatatccggcgggaccttcaccctgtcgcatggctgggcacctgggtccctgctgacctatagctgccctcagggtctgtatcctagcccagccagccgcctgtgcaaatcctcaggacagtggcaaacccccggtgccaccagatcactcagcaaggccgtgtgcaaacccggccattgccccaacccgggaatcagtctaggagcagtacgcacaggcttccgcttcggccatggagataaagtccgctacagatgctccagcaacctggtgctcaccgggtcaagtgagcgcgagtgtcaggggaatggtgtctggtccggcacagagcccatttgccgacagccgtattcttatgacttcccagaggacgtggccccagcactgggaacatcattctctcatatgctgggggccactaaccccacccaaaaaacaaaagaccatgagaacggcacaggaaccaacacttacgccgcgcttaacagcgtgtacctcatgatgaacaatcagatgcgtcttctgggcatggaaacgatggcatggcaggaaatacgccacgccataattctgctcacagatggtaaatcaaacatgggaggctccccaaaaaccgcagtcgaccatataagggaaatccttaatattaaccagaaacggaatgactatcttgatatttacgctataggcgttgggaagctcgatgttgactggcgtgagttaaatgaattaggctctaagaaagatggcgagcgtcatgcttttattttacaagatacgaaggcacttcaccaggtgtttgaacacatgctggatgtgagcaagctgacggatactatttgcggagtgggcaatatgtcggcaaacgctagcgaccaggagcggacaccttggcatgtcacaatcaaaccgaaatcccaagagacctgcaggggagctttaatcagcgatcagtgggtcctgacagccgcccattgctttcgtgatgggaacgaccactcactgtggagagtcaacgttggggaccctaagtctcagtggggaaaggaatttctgattgagaaagcggtgatttctccagggtttgatgtctttgcaaagaagaatcagggaatcctggagttctacggggatgacattgcgttactgaagctggcccagaaagtgaagatgtccacacatgctcgacccatatgtttgccttgcactatggaggcgaatctcgctcttcgccgtcctcagggttctacttgtagggaccacgagaatgaactcttaaacaaacagagcgttcctgcacacttcgtagctctgaatggctccaagttgaacataaatttaaagatgggagttgagtggacctcctgcgctgaagtggtgtctcaggaaaagaccatgtttcccaacctgacggatgtgcgcgaggtggtgaccgatcagttcctctgctcaggaacccaggaggatgagagcccttgcaaaggagtgacgactactccatggtctttagcccggccacaaggcagctgcagcctggagggtgtcgagattaaaggcggctccttcaggttgttacaggaaggacaggctctggaatacgtctgtccatccggtttttatccataccctgtccagacgaggacctgccgatcaactggtagttggtccactcttaagacacaggaccagaagacggtacgcaaagctgaatgtcgggcgattcattgcccaagacctcacgacttcgagaatggggaatactggccgcgaagcccatattataatgtatccgacgagatcagctttcactgttacgacggctacaccttaagagggagtgcaaacaggacatgccaagtgaacgggaggtggagcggccaaacagcaatttgcgataacggcgccggctattgttcaaatcccgggatccctatcggaacgagaaaggtgggttctcagtatcggttggaagactccgtcacctatcattgttcgcgcggcctgacgctgagaggatcgcaacgaagaacatgccaggaaggtgggagctggtcaggaactgagcctagttgccaggactcgtttatgtacgatacccctcaggaggtggccgaagcttttttaagctctcttacagaaacaatagagggggtcgatgccgaagacggccacggccctggcgagcaacagaagaggaaaattgtgctggatcccagcggcagcatgaatatctacctcgtccttgacgggtccgactcgataggcgccagcaactttaccggcgcaaaaaaatgcctggttaacctgattgagaaagtcgcttcctacggcgttaagccacggtatggactggtgacgtacgctacatacccaaagatctgggttaaggtatcggaagctgattctagcaatgccgattgggttaccaagcagttaaatgaaataaactatgaagaccataagctgaagtctggtactaatacgaaaaaggccctgcaagctgtttactctatgatgtcctggcctgacgacgtgcctcctgaaggctggaacaggactcgacatgtgatcatcctgatgactgacggactccataatatgggaggggaccccataactgtaatcgacgagatccgggatctactttacattggcaaggaccggaaaaaccctagagaagactacttagatgtgtatgtgttcggtgtcgggccgttagtgaatcaggtgaacataaacgcactcgcaagtaagaaggataacgagcagcacgtttttaaggtgaaagacatggagaaccttgaggacgtgttttatcaaatgattgacgagtctcagtctttatctctctgcggaatggtttgggaacaccgcaaggggaccgattaccacaagcaaccttggcaggccaagataagcgtgattagaccgtccaaaggccatgagagttgtatgggagctgtggtgagcgagtattttgtgctgacagcggcccattgttttaccgtggatgataaagaacactccattaaggtgagcgtgggcggggagaaacgtgatctcgaaattgaggttgtactcttccaccccaattataatattaatgggaaaaaagaggctggaatacctgaattttacgattacgacgtcgccctcatcaaacttaagaacaagctgaagtacgggcaaactatcaggcctatttgtctgccatgcaccgaggggacgaccagggccctaaggttgccacctacgaccacctgtcagcagcagaaagaggagctgttaccggcacaggatatcaaggctctctttgtgagtgaggaagagaagaaattaaccaggaaggaagtgtatatcaaaaacggggataaaaaagggtcctgtgagagggatgcacagtacgccccaggatatgataaagtcaaggatatttctgaagttgtgacccccagatttctgtgcacgggaggagtctcaccctatgcggaccccaacacgtgccgtggtgacagtggaggtccacttatcgtccataagaggagtcgcttcatacaagttggggtgattagctggggcgtggtcgatgtttgtaaaaatcaaaagagacagaagcaggtgcctgctcacgcacgggatttccatatcaatctgttccaagtcctcccatggctgaaagagaagctgcaggacgaagatcttggattcctgtag

SEQ ID NO: 183713 - DNA, 3801 bp, Artificial Sequence
  Description of Artificial Sequence: Synthetic coding sequence
atgggccccctgatggtgctgttctgcctgctgttcctgtaccccgggctggcggattcagccccctcttgtccccagaacgtgaatatcagtggaggaacatttacactgtcccatggttgggccccaggcagcttgctgacctattcttgtcctcaaggtctgtatcctagcccggcgagtcgattatgtaagtctagcggccaatggcagacccccggagctacacggagcctctcgaaggccgtctgcaagccgggccactgtcccaatcctggaatcagtcttggggccgtaaggaccggcttccgcttcgggcacggcgacaaagtgcgataccggtgcagcagcaacctggtccttaccggcagttctgaaagggagtgtcagggcaatggagtgtggagtgggacagagcctatttgccggcaaccctatagttatgatttccctgaagacgttgccccggcactgggcaccagcttcagccacatgttaggcgccactaacccaactcaaaaaaccaaggaccatgaaaacgggacaggaaccaacacctacgcagccctcaactcagtttacctgatgatgaacaaccaaatgcggttgctgggtatggagaccatggcttggcaggaaatacgacacgcgatcattctgctgactgacggtaagtcgaacatggggggctcgcctaagaccgcggtggatcatatccgcgaaatcctgaatatcaaccaaaagcggaatgactacttggatatatacgctattggggtgggcaaacttgatgtcgattggagagaactcaacgaactcggttcaaaaaaagatggagagaggcacgctttcatcttacaagacacaaaggcgctgcatcaggtattcgagcatatgctggatgtgtcaaaactgacagataccatctgcggcgtcggaaacatgagcgctaatgctagtgatcaggaaaggactccatggcatgtgaccattaaacccaaatctcaggagacatgtcggggagctttgatatccgatcagtgggtgctcactgccgctcactgttttcgggatggcaacgatcattccttatggcgggtgaacgtcggggaccctaaatcgcagtggggcaaagaatttctgatcgagaaggccgttatatcccctggattcgatgtatttgcgaagaagaatcaaggcatccttgagttttatggggatgatatcgccctactgaagctggctcagaaagtgaagatgtcaacccatgcacgcccaatttgcctcccctgcaccatggaggcgaatctcgcactgcgacgtcctcaggggagcacctgccgagatcacgaaaacgagttgctcaacaagcagagtgtgccagcacactttgtggccttgaatggcagtaagctgaatatcaacctgaagatgggcgtggagtggacatcatgcgctgaggtggtgagccaggagaaaacgatgtttcccaatctgacagacgtgagggaggttgttaccgaccagttcctgtgtagcggaacccaggaggatgagtcaccatgtaaaggcgtgaccacaaccccatggagcctagcccggccccaggggtcatgctcattggaaggagtcgaaatcaagggcggttccttccggctgttgcaggaggggcaggccttagaatacgtgtgtccctcaggcttttacccgtatcccgttcagactaggacctgtcgaagcactgggtcctggtcaaccctcaagacccaggaccaaaagacagtccgcaaggccgagtgtcgtgctatccactgtccgagacctcatgacttcgagaacggagaatattggccacggtctccttattataacgtgtcagacgaaattagctttcactgttatgacggctatactctccggggatcagccaacagaacatgccaggtgaatggacggtggagtggccagactgccatctgcgataacggcgcaggctactgttcaaacccaggcatccctattggtactcgaaaggttgggtcccagtatcggttggaggactcagtcacttaccactgcagtcgtggattgaccctcaggggatcacagaggcgcacatgtcaagaaggtggctcctggtccggcacagagccttcctgccaggactccttcatgtacgacaccccacaggaagtggccgaggccttcctgtcctctcttaccgagactatagagggggtggatgccgaagacgggcatggccccggcgaacagcagaaaagaaagatagtactggatccctctggttccatgaacatctacctggtgctggacggatcagactccatcggtgcaagtaatttcacaggcgcaaaaaaatgtcttgtcaatctgattgaaaaggttgccagctatggggtaaagccccgctacgggctggtaacatatgctacttatcccaaaatttgggtaaaggtctccgaggccgatagttccaacgccgattgggtgactaaacagctcaatgagatcaattacgaggatcataaactcaaaagcgggaccaacaccaagaaagcgctccaagctgtgtacagcatgatgtcctggcctgacgacgtccctcctgaaggctggaatcggactcgccacgttatcatcctaatgactgatggactgcacaatatgggcggagaccctattactgtcatcgatgaaatcagggatttactgtatattggcaaggaccggaagaatccaagggaagactacctcgatgtgtacgtcttcggggtcggtccgctggtaaaccaggtaaatattaacgcattggctagcaagaaggacaacgagcagcatgtctttaaagtgaaagatatggaaaacttagaagatgtgttctaccagatgatcgatgagtcccaatcgttaagtctctgcggcatggtgtgggagcaccggaagggtactgattaccacaaacagccatggcaggccaagatctcagtgatcaggcccagcaaaggtcacgagtcatgcatgggcgccgtggtaagtgagtacttcgtgttaacagccgctcactgcttcaccgtggatgataaagagcactcaatcaaagtaagcgtgggtggcgagaagagggacctggaaatcgaggttgtgctatttcatccaaattataatattaacggcaagaaggaggctggaattccggaattctatgattatgacgttgctctaatcaagctcaagaacaagctgaaatatggccaaactattcgacccatttgcttaccttgcacggaggggaccacacgcgccctgcgccttcccccgacgacaacctgtcaacagcagaaagaggagctgttgccagcacaggatattaaagccctgttcgtgtccgaagaagagaagaagctgacgcgaaaggaggtctacatcaagaacggtgacaagaaaggaagctgtgagcgcgacgcacagtacgctcctggctacgacaaggtgaaggacatctccgaagtggtgactccccgattcctgtgtacaggcggggtctccccctatgctgaccctaacacttgccgcggcgacagcgggggtccacttatcgtccataagcgaagtagatttatccaggtgggagtcatctcatggggcgtggtagacgtctgtaaaaatcaaaagagacagaagcaggtgcctgcccatgcacgcgatttccacatcaatctctttcaggtactgccatggcttaaggagaagctgcaggatgaagatctaggctttctgtag

SEQ ID NO: 183714 - DNA, 3801 bp, Artificial Sequence
  Description of Artificial Sequence: Synthetic coding sequence
atgggccccctgatggtgctgttctgcctgctgttcctgtaccccgggctagccgactccgccccgtcatgcccacaaaacgttaacatttccggaggaacgttcactctgtcacatggatgggctcctggatcgctgctgacgtatagttgtcctcaggggttgtacccatctcccgccagcagactctgtaagtcttcggggcaatggcaaaccccaggcgcaaccagatctctgtcaaaagcagtatgtaagcctggccattgtcctaacccaggcatctcactgggcgcagtacgcactgggttccggttcggacatggtgataaggtgcggtatcggtgttctagtaatctggttctgactgggagcagcgagcgggaatgtcagggcaatggcgtgtggagtggaacagagcccatatgccgccagccgtactcctatgatttccccgaagatgtcgcgcctgcactagggacatcattctcacatatgctcggggctaccaatccgacacaaaagactaaggaccatgagaacggtaccggcaccaatacttacgcagccctaaattcagtctatctgatgatgaacaaccagatgcgcctgctcgggatggagaccatggcctggcaggagatccgccacgctataatcctcctgacagatgggaagtccaacatgggcgggagccctaagacggctgttgaccatattcgtgagattctcaacattaatcaaaaacggaatgactacctagacatttatgccattggggtcggcaaactcgacgttgactggagggaattaaacgagttaggatccaagaaggatggagaaagacatgcttttattctacaagacactaaagccctgcatcaggtgtttgagcacatgctggacgtgtccaaactcactgacacaatatgcggcgtggggaatatgagcgccaatgcctcagaccaagagcgtacaccatggcatgtcaccattaagccaaaatcccaggagacctgccggggggcattaatcagcgaccagtgggtcttgactgcagctcattgtttccgggacggaaacgatcatagcctttggcgcgtgaatgtaggagatccgaagtcgcaatggggcaaggagtttcttatcgagaaagccgtgatctcacctggtttcgatgtgttcgccaagaagaaccagggaatattagagttttacggagatgacatcgcactgctgaaattggcccagaaagtaaaaatgagtacccacgcacgcccgatttgcctgccttgtaccatggaggcgaacctggccctgagaaggccccaaggaagcacctgtagagatcatgaaaacgaactactcaataagcagtccgtcccggcccatttcgtagccctgaatggatccaaattgaacataaaccttaagatgggtgtcgaatggactagctgcgctgaggtggtgtctcaagaaaaaacaatgttccccaacctgactgacgtgcgcgaagtggtcacagatcagttcctctgcagcgggacccaagaagatgaatccccttgcaaaggcgttacaaccaccccctggagcctggctaggccacagggcagctgtagtttggagggtgtggagataaagggcggaagttttagactgctacaagaggggcaagctcttgaatatgtctgtccttctgggttctatccctatccggtacagacccggacatgcaggagtactggctcatggagtacccttaagacccaggaccagaagaccgtacggaaggccgagtgccgggcgatccattgtcctcgcccccacgattttgaaaatggggagtactggccaagatccccatactacaacgtgtccgacgagatatctttccactgttacgatggttacactctccgcggctccgcaaataggacctgtcaggtaaacggtaggtggtctggccaaacggccatctgtgataatggagctggatactgtagcaacccaggtatcccgatcggcactagaaaggtgggctcacagtaccggctagaagactcagtaacatatcactgctccagaggtctcaccctaaggggctctcagagaagaacctgtcaagaaggaggctcatggtccggcacagagccttcttgccaggattcctttatgtacgacactccccaggaagttgcggaggccttcctgtcaagcctcacagagaccatagagggtgtcgatgcagaagatggtcacggacccggcgaacaacagaagcggaaaattgttctggacccatccgggtccatgaacatctatttggtattagatgggtccgacagcataggcgcaagtaactttaccggcgcaaagaaatgcttggtgaatctgattgagaaagtggcgtcttacggtgtcaaacccagatacggattggtgacatacgccacataccctaagatttgggtaaaagtatctgaggccgattcctcaaacgccgattgggtgaccaagcagctaaacgagatcaattacgaggaccacaagctgaaaagcggcaccaacacgaagaaggctctgcaggccgtctattctatgatgagctggcctgatgacgtcccaccggaagggtggaaccgaaccagacacgtgattatattgatgaccgatggactgcataatatggggggtgatccaattacggttattgatgagatcagagacttactgtatattggcaaggatcgcaagaatcctagagaggattatctggatgtgtacgtgttcggggtggggcctctcgtgaaccaggtaaatattaatgcccttgcctccaaaaaggataatgaacaacatgtgttcaaagtgaaggatatggaaaaccttgaagatgtcttctaccaaatgattgatgagtcgcagtcactctcactctgtggaatggtttgggagcacagaaagggcaccgactaccataaacaaccttggcaagctaaaatttccgtcatacgtccctcgaagggccacgagagttgcatgggtgcagtggtgtcagaatatttcgtcctgaccgcagcccactgtttcaccgttgacgataaggagcatagtatcaaggtctctgtgggcggcgagaaacgcgatctagagattgaggtggtgctcttccatcccaattacaacattaacgggaagaaagaggccggcataccagagttctacgactacgacgtggcactgatcaaactcaaaaataaactgaagtacggccagacgatacggcctatttgcctcccatgtactgaaggcacaacacgcgctcttcgcctcccccctactacaacctgtcaacagcagaaggaagagttgctccccgctcaggacattaaggcactgttcgtgtctgaggaagagaagaaactgaccaggaaggaagtgtatattaagaacggggacaaaaaaggctcgtgtgagcgggacgcccagtacgcccctgggtacgacaaggtaaaggatatatcagaagttgtgacgccaaggttcctgtgcacagggggggtgagtccatacgcagatcccaacacatgccgaggagatagtggcggacctttaatagtgcacaaacggtctcgatttatccaggttggtgtgatctcatggggggtagtagacgtgtgcaagaaccagaagcggcagaaacaggttccagcacacgctcgagacttccacattaacttattccaagttcttccctggctcaaagaaaagttgcaggatgaggacttgggttttctgtag

SEQ ID NO: 183715 - DNA, 3801 bp, Artificial Sequence
  Description of Artificial Sequence: Synthetic coding sequence
atgggccccctgatggtgctgttctgcctgctgttcctgtaccccggtttagccgactctgcaccatcctgtccccagaacgtgaatatatctggtgggaccttcactctgtcacatgggtgggctcccggctccctgctcacttattcgtgcccccagggcctttacccatcacccgccagtcggctgtgtaaaagctctgggcagtggcaaacgccaggggcgacccggtcattgtcgaaggcagtctgtaagcccggccactgcccaaaccccggtatctctctaggtgccgtacgaactggtttcagattcgggcacggggataaagtgagatataggtgctcgagtaacctcgtcttaactggatcctcagaacgcgaatgtcagggaaacggggtgtggagcgggaccgaacccatctgccgacagccctacagctacgatttccccgaggacgtcgctccggcacttgggacttcatttagtcatatgttaggcgctacaaatcctacccagaaaacaaaggaccatgaaaacggtacaggcaccaatacatacgcagctcttaattccgtgtacctaatgatgaataaccagatgcggctgctggggatggaaacaatggcatggcaggaaattcggcacgccattattctgcttaccgatgggaagagcaacatgggaggctcgccaaaaactgccgtggaccacatccgggaaatccttaatattaatcagaagcggaatgactacctggacatctacgcgatcggagtgggcaaactggacgtggactggcgggagctaaatgagctagggtctaagaaggatggagaacgacatgcattcatactgcaagataccaaagcattgcaccaggtcttcgagcacatgttggatgtttccaagctcacagataccatttgcggcgttggtaatatgagcgctaatgcgagcgaccaagagagaactccctggcatgtgactatcaagccaaagagtcaggagacctgtcggggagcactaatcagtgaccaatgggtccttaccgctgctcactgttttcgtgacggtaatgaccactcactgtggcgagtgaatgtgggtgaccctaagtcccagtggggcaaagagtttctcatcgagaaggctgtcatcagccccggctttgacgttttcgctaaaaaaaaccaggggatcttggaattttatggcgatgacattgccctgctgaagctggcccagaaagtgaagatgtccacgcacgctcgcccaatttgcctcccttgtaccatggaggccaacttagcattgcggaggccacagggatctacttgcagagatcacgagaacgaactgctaaataaacagagtgttccggctcactttgtggccctgaacggatctaaactgaatataaatctgaagatgggagtggaatggactagctgtgcggaagtggtgagccaggagaaaactatgttccccaaccttacagatgtgagagaggtggtaactgaccagtttctgtgtagtggaacacaggaggacgagtcaccatgcaagggagtcacaacgaccccgtggagcctcgcccgaccacagggcagctgctctctcgaaggcgttgaaatcaaaggcggctcctttcgcctgcttcaagaaggacaagcactcgagtacgtttgtccatcaggcttttatccttacccagttcagacccgcacttgtcggtcaacaggatcatggtcaacactcaaaacacaggatcaaaaaaccgtgaggaaggcagagtgccgggctattcattgcccccgccctcacgacttcgaaaacggcgagtactggcctaggtcgccatactacaacgtctccgatgagatttcctttcactgctatgatgggtacaccctacgaggatcagccaatcggacatgccaggttaatggccgctggtcaggccagacggccatctgtgataacggggctggatattgtagtaatcctggcataccaattggcactcggaaagtagggagccagtatcgtctcgaggactcggttacatatcattgtagtcgcggcctcactcttagaggcagtcagaggagaacctgtcaggagggaggttcttggagtggtacggagcccagttgtcaggattctttcatgtacgacacacctcaggaagtagccgaggctttcctgtccagcttgaccgagacgatagagggagttgatgctgaggacggacatggaccaggcgagcagcagaaaagaaaaattgtcctggacccatccggcagcatgaatatctatctcgtgcttgatggatcagactctataggcgccagtaatttcaccggcgccaagaagtgtctagtgaacctgattgagaaagttgcctcatacggagtgaaacctcgttacggacttgtgacatacgctacttatcccaaaatctgggtaaaggtcagcgaggccgacagcagtaatgccgactgggtgaccaagcagctcaacgagatcaattatgaggatcataagcttaagagtggcactaataccaaaaaggcacttcaggcggtctactctatgatgtcatggccagacgatgtccctcccgaaggatggaaccgtactcggcacgtgatcatcttgatgacggatggcctacacaatatggggggcgacccaattaccgtgattgatgagattagagacttgttgtacataggcaaggacaggaaaaacccccgcgaagactatcttgacgtgtacgtgtttggagtcggaccccttgttaaccaggtgaacatcaatgcactcgccagtaaaaaggataatgagcagcacgtatttaaagtgaaggatatggaaaatcttgaagacgtgttttaccagatgatcgatgagtcccagtccttatcactctgcggcatggtgtgggaacacagaaaaggcactgactaccacaagcagccctggcaagccaagatctccgtgattaggccctcaaaaggacacgaaagttgtatgggcgctgtagtgtccgagtatttcgttctgacagcggcccattgctttactgttgatgataaagagcacagcatcaaggtgtccgtgggaggggaaaaaagggacctggagatcgaggtcgtgttattccacccgaactacaacattaatggaaagaaggaggcgggaatccctgaattctacgattacgatgtggctttaatcaaactgaaaaataaactgaaatatggtcagactatcagacccatttgcctcccctgcaccgaaggaactaccagggccctgagacttcctccaaccactacttgccagcagcagaaagaagagctgctgcctgcccaagacattaaggctctcttcgtcagcgaggaggaaaagaaactgacccgaaaggaggtatatatcaagaatggcgacaaaaaaggaagctgcgagagggacgcacaatatgcacctggctacgacaaggttaaggacatctcagaggtcgtaacacctcgcttcttgtgtaccggaggggtttccccttacgccgatcctaatacctgtagaggggatagcggtggcccccttatcgtgcataaaagatctcgcttcatccaagttggggtaatatcttggggtgttgttgacgtgtgcaagaatcagaaacggcagaaacaggtgcctgctcatgctcgggattttcacattaatttgttccaagttcttccctggttgaaggagaagctacaggacgaagaccttggtttcctttag

SEQ ID NO: 183716 - DNA, 762 bp, Artificial Sequence
  Description of Artificial Sequence: Synthetic coding sequence
atgcacagctgggagcggctggccgtgctggtgctgctgggcgccgccgcctgcgctgctccccccagaggtcggattttgggcgggcgtgaggctgaagcccacgcacgcccatacatggcctcggtccagcttaacggggcgcatctgtgcgggggggtcctggtggctgagcagtgggtgctgagcgccgctcactgccttgaagacgcggcagatggcaaagttcaggtactgcttggcgcacactccctgagccaacctgagccttccaagcggctatacgacgtgctcagagcagttccacaccccgattcacaacctgatactatagatcacgatctcctgttactacagctctccgaaaaggccaccctgggacctgccgtgaggccactcccttggcagcgtgtcgaccgggacgtcgccccaggtacactttgtgatgtcgccggctgggggattgttaaccacgcaggcagacgacctgatagtctgcagcatgtccttctcccagtccttgaccgcgccacctgcaaccgcagaacacatcacgacggagcaattactgagaggctgatgtgtgctgagagtaaccgcagagactcatgcaaaggtgattcagggggaccactggtgtgcggaggggtcctggagggggtggtgacatccggaagccgtgtttgtggaaacagaaaaaagccagggatatacacacgggtcgctagctatgccgcctggatcgatagcgtgctggcatag

SEQ ID NO: 183717 - DNA, 993 bp, Artificial Sequence
  Description of Artificial Sequence: Synthetic coding sequence
atgtggctgctggtgagcgtgatcctgatcagccggatcagcagcgtcggaggagaagctacattctgcgattttcccaaaattaaccacgggatcctgtacgatgaagagaaatataagccgttttctcaggtcccgaccggagaagtattttactactcttgcgagtataatttcgtctccccaagcaagagcttttggacccgaatcacttgcaccgaagaaggatggagtccgacacctaaatgtctgagactgtgcttcttcccatttgtggagaatggacattccgaatcaagtgggcagacgcacctggagggggatactgttcagatcatctgcaataccggatatcgtcttcagaataatgaaaataatatttcttgcgtagagcgcggttggagcacacctcccaaatgccgaagtactgacaccagttgtgttaatcctcctacagtgcagaacgcacacattctgtcaagacagatgtccaaatacccttccggggagagagtccgctacgaatgccgctcgccctacgagatgtttggagatgaagaggtcatgtgtttgaatggcaattggacagaaccaccccagtgcaaggatagtaccggaaagtgcggccctccaccgcccattgataatggagacatcacaagcttccccctgtcagtgtatgcccctgccagcagtgtggagtaccagtgccaaaacctctaccagctggagggaaataaaagaattacatgtcgaaatggacaatggagcgaaccaccgaagtgcttgcacccttgtgtcatctctagagagatcatggaaaattataatatcgcattacgttggacagctaagcagaagctgtacttacggacaggggaatccgccgaatttgtctgcaagaggggatataggctgtccagcagatcacataccctgcgaacgacctgttgggacggcaagctggaatatcctacatgcgccaagaggtag

SEQ ID NO: 183718 - DNA, 813 bp, Artificial Sequence
  Description of Artificial Sequence: Synthetic coding sequence
atgtggctgctggtgagcgtgatcctgatcagccggatcagcagcgtcggaggggaggccatgttctgcgatttccccaagataaaccacggcatactgtacgatgaagagaaatacaaacctttttcccaggtgcccaccggcgaggtcttctactactcgtgcgagtacaatttcgtgtcacctagtaaatccttttggacccgcatcacttgtgctgaagagggctggtcgccaacacccaagtgtctgagactgtgcttcttccccttcgtcgaaaacggccatagcgagtctagtggccagacacacctcgaaggcgatacggtacaaatcatctgtaacacagggtataggctccaaaataatgaaaacaacatttcctgtgtagaacggggctggagtacaccccccaagtgtaggtctactatatcagccgagaagtgtgggcccccgcccccaattgataatggcgatatcacttcgtttctcctgtctgtttacgctccgggctctagcgtcgagtaccagtgccaaaatctctatcagctcgagggcaacaatcagatcacttgccgcaacggacagtggtcagaaccaccaaaatgccttgacccgtgtgtgatcagccaagaaataatggagaagtacaatatcaagctaaaatggacaaaccaacagaaactgtatagccgcaccggtgacatcgttgagttcgtttgcaagtccggctatcatcccacaaagtcacacagctttcgagccatgtgtcagaatgggaagttggtgtatccgtcatgtgaggaaaaatag

SEQ ID NO: 183719 - DNA, 813 bp, Artificial Sequence
  Description of Artificial Sequence: Synthetic coding sequence
atgtggctgctggtgagcgtgatcctgatcagccggatcagcagcgtgggaggcgaagcaatgttttgcgatttccccaagattaaccatgggatcctatacgatgaagagaagtacaaacccttctcacaggtgcccactggcgaggtgttctattatagctgcgagtacaacttcgtatcaccttccaagtccttctggactcgaatcacctgcgccgaggaagggtggagccccacacccaagtgtcttcgcttgtgcttctttccgtttgtggagaatggccattccgagtcaagcgggcaaacccaccttgaaggcgacacagtccagataatctgcaacacgggctaccgcctgcagaataatgagaacaatatcagctgcgtagagaggggctggtctacacctcccaaatgccgctcaaccatctcagccgaaaagtgcggcccgccacctcccatcgataacggggatattacaagctttttactgtctgtctacgccccgggctcatctgtggaataccagtgccagaacctctaccagctggagggaaacaaccaaataacttgcagaaacggccagtggagcgaacccccaaagtgcctcgacccctgcgttatttcacaagagatcatggagaaatataacattaagctgaaatggacaaaccaacagaaactgtacagtagaaccggcgatatcgtagagttcgtgtgtaaatcagggtaccatcccaccaagagccatagcttccgggcgatgtgtcagaatggaaagctggtttatcctagctgtgaagagaaatag

SEQ ID NO: 183720 - DNA, 993 bp, Artificial Sequence
  Description of Artificial Sequence: Synthetic coding sequence
atgctgctgctgatcaacgtgatcctgaccctgtgggtgagctgcgccaatggccaggtgaagccctgcgacttccctgacatcaagcatggaggtcttttccatgagaatatgaggaggccctattttccggtcgcagtagggaagtactatagctattactgtgacgaacattttgagaccccctcggggagttactgggactatatccactgcactcagaatggttggagccctgccgtcccctgtctgcgaaaatgttacttcccgtatttagagaacggctacaaccagaattacggacgtaaattcgtgcagggcaactccacagaggtggcgtgtcaccctggatacggtttaccgaaagcgcaaactactgttacatgtaccgagaagggctggtcccctaccccccgctgcattagagtccggacatgctcaaagtccgatattgaaatcgagaacggcttcattagcgaatcaagtagcatttatatcttgaataaagagattcagtacaagtgtaagcctggctatgcaacagccgacggcaatagctccggatccattacctgccttcagaatgggtggtccgcccaacccatttgcataaactcgagtgagaaatgtggacctcccccaccaatctcaaacggtgacaccacaagcttcctgctgaaagtgtacgtcccacaaagcagagtcgagtaccagtgtcagccttactatgaactgcaagggtccaattacgtgacttgctccaacggtgaatggtccgagcctccacgctgtattcacccatgtatcattacggaagaaaacatgaacaagaacaacattaagcttaaagggagatccgacaggaaatactatgcgaaaaccggcgatactatcgagttcatgtgtaaactgggatataacgccaatactagcatcctgagtttccaggctgtgtgtcgggaggggatagtggaataccctcggtgtgagtag

SEQ ID NO: 183721 - DNA, 588 bp, Artificial Sequence
  Description of Artificial Sequence: Synthetic coding sequence
atgctgctgctgatcaacgtgatcctgaccctgtgggtgagctgcgcaaacggccaagtgaaaccctgcgactttccagacatcaagcatggaggcctattccatgagaacatgaggcgaccatatttcccagtggctgtgggaaaatattacagctattactgcgatgagcatttcgagacaccctctggctcctattgggattacatccactgtacgcagaacggctggtctcctgccgtgccgtgcctgcggaagtgctatttcccctacttggagaatggctacaatcagaactacggaaggaagtttgtccaaggtaactctactgaggtggcctgtcatcccggctatggcttgcccaaagcccagaccaccgtgacttgcacagagaaaggatggtcccctacacccaggtgcatcagggttcggacatgtagcaagagtgatatcgagatcgaaaacggctttattagtgagagctcatctatctacattctcaataaggagattcaatataagtgtaagcctggatacgccacggccgacggaaactcctctgacatggtattttgcattagctactag

SEQ ID NO: 183722 - DNA, 810 bp, Artificial Sequence
  Description of Artificial Sequence: Synthetic coding sequence
atgctgctgctgatcaacgtgatcctgaccctgtgggtgagctgcgccaacggtcaggttaaaccgtgcgacttccctgacatcaaacacggcggactcttccatgaaaatatgcggcgcccatacttcccagtggccgttggcaaatattactcatattactgtgacgagcacttcgaaacaccaagcgggtcatactgggactatatccattgtacacaaaatggatggtccccagctgtgccttgtctgaggaaatgttattttccatatctcgaaaacggttataaccagaactatggcaggaaatttgttcagggaaactcaactgaagtggcctgccaccccgggtatggccttcccaaagcgcaaaccacggtgacatgcacggagaagggctggagccccacccctagatgtatcagggtgaacagcagtgagaagtgcgggccaccacctccaatctccaatggtgatacaacaagcttcctgctcaaggtgtacgttccccagtccagagtagagtaccagtgtcagccctactatgagctgcagggttccaactacgtaacatgttcaaatggtgaatggtcagagccaccaagatgtatccacccctgtatcatcacagaagaaaacatgaacaagaataatatcaagctcaagggaagatctgatcgcaaatattacgccaagacaggcgacaccatcgaattcatgtgcaagctcggatataatgccaacacatccatactctctttccaggccgtatgcagagagggaatcgtggaataccccagatgcgagtag

SEQ ID NO: 183723 - DNA, 996 bp, Artificial Sequence
  Description of Artificial Sequence: Synthetic coding sequence
atgctgctgctgatcaacgtgatcctgaccctgtgggtgagctgcgccaacggccaggaggtcaagccctgtgattttccggagatccagcatggcggtctgtactataagagcctgagaaggctgtatttcccggctgctgctgggcagagttatagctactattgtgaccagaatttcgtgacaccttcagggtcatactgggactacatacactgtactcaggatggctggagtcccacagtgccctgcctccggacttgctcaaaaagcgatatcgaaattgaaaacgggtttatcagcgagtcaagtagtatctacattctgaataaggagatacagtataagtgtaaacctggatacgctaccgccgatggcaactcttcagggagcatcacatgcctccagaatggctggagtgctcaaccaatctgcatcaagttctgtgatatgcccgtattcgaaaactccagggctaaatcaaatggcatgcggttcaagttacacgataccctagactacgagtgctatgatgggtatgagatttcctacgggaacacgacaggctcgatcgtgtgcggtgaagacggctggtctcatttcccgacctgctacaattccagcgagaagtgcgggccaccccctccaatctctaatggcgacaccacctcctttctcctgaaggtttacgtccctcagtcgagggtggagtaccagtgccagagctattacgagctccagggctcgaattacgtcacatgctccaacggagaatggtcagagccccctagatgcatccacccttgcattataacggaagagaacatgaacaaaaataatattcagctcaagggaaaaagcgatattaagtattatgccaagactggcgacacgattgaatttatgtgtaagctgggctacaacgctaacacctctgtactgagttttcaggcggtatgtagagaagggatcgtcgaataccccaggtgtgagtag

SEQ ID NO: 183724 - DNA, 1734 bp, Artificial Sequence
  Description of Artificial Sequence: Synthetic coding sequence
atgctgctgctgatcaacgtgatcctgaccctgtgggtgagctgcgcaaacggccaagttaagccttgcgactttccagagattcagcatggaggcctatactacaaaagtctcagaaggctttactttccggccgccgccggacagtcttatagctattactgcgaccagaacttcgtgactccttctgggagttactgggattatatacattgcacacaagacggctggtcacccactgtaccatgcctgcgtacctgctccaagtctgatgtggaaattgagaacggctttattagcgagtcctcctcaatctacatccttaacgaggagacccagtacaattgcaaaccagggtatgccaccgcagagggcaacagtagtggttccataacttgcctgcaaaacggatggagtactcagccaatatgtatcaaattctgcgacatgccagtgttcgagaactctcgcgccaagtctaatggaatgtggttcaaacttcatgacacactggactacgagtgctacgacgggtatgaaagctcttatggtaacaccaccgattcaattgtgtgcggcgaagatggatggtcccacctgcctacttgttacaactctagcgagaactgcgggccgcccccaccaatatcaaatggagatactacatctttcccccagaaagtgtacctgccttggagtagagtggaatatcagtgccaatcttattatgagctgcaggggtcaaagtacgtgacttgttcaaacggagactggtccgaaccccctcgctgcatttcaatgaaaccctgtgagtttcctgaaatccagcatggtcacctgtattacgaaaacacccggagaccctacttccccgtcgccacagggcagtcatatagctattactgcgatcagaactttgtgactccaagtggctcctattgggactacatccactgtacccaggacgggtggctcccaacggtcccctgcctgagaacatgtagcaagagtgacatcgaaatagaaaacgggtttatcagtgagtcttcgtcaatttacatattgaataaggagatccagtacaagtgtaagccaggatatgccacagccgacggaaattcctccgggagcattacttgtctgcagaatgggtggtctgcacagcccatatgtatcaagttctgcgatatgccagtcttcgagaattcccgcgctaagtctaacggcatgcgtttcaagctgcatgacacactggactacgagtgttacgacggctacgagatttcctacggaaacaccactgggtctatagtttgtggtgaggatggctggtcccactttcctacgtgttataatagtagtgagaagtgtggaccaccgcccccaatctccaacggtgatacaacttcctttctcctgaaagtttacgtcccccagagccgtgtggagtatcaatgtcagtcttattatgagctgcagggctctaattatgtgacctgttcaaatggcgagtggagcgagcctcctcgatgtattcatccttgcataatcacagaagaaaatatgaacaaaaacaacatacaacttaaggggaaaagcgacattaagtactatgccaaaactggggacaccatcgagttcatgtgcaagctgggctacaatgcaaatacctccgttttatcttttcaggccgtctgccgcgagggcatcgttgaatatccccgctgcgaatag

SEQ ID NO: 183725 - DNA, 996 bp, Artificial Sequence
  Description of Artificial Sequence: Synthetic coding sequence
atgctgctgctgatcaacgtgatcctgaccctgtgggtgagctgcgcaaacgggcaggcgatgaaaccctgcgagttcccggaaatccagcatggccatctatactatgagaatacacgccgaccatatttccccgtggctacgggacagtcttactcctactactgcgatcagaacttcgtgactccatcggggagttactgggattacattcattgtacacaggacggatggctgccaactgttccgtgtctgaggacttgctctaagtctgatatcgaaattgagaatggattcatctcggagtcgtcctccatttatatcttaaacaaggagattcaatacaagtgcaaaccaggctacgccactgctgacgggaattctagtggttccatcacttgtctgcagaatggctggagcgcacaacccatttgcattaaattctgtgacatgcccgtgtttgagaatagtcgggctaaaagcaatggcatgcggtttaagcttcacgacacccttgattatgagtgttatgacggatacgagatatcttacggtaacacaaccggctccattgtctgtggtgaggacggatggtctcacttccctacctgttataattcttctgaaaaatgcgggcctccaccgcctatttcaaacggcgataccacgtctttcctgctcaaggtctatgtgcctcagtccagggtggagtaccagtgtcagtcatactatgaactacaggggtccaattatgtgacctgcagtaacggtgagtggtccgagcctcctcgatgcatccatccctgtatcattaccgaagaaaacatgaacaagaacaacatacagctaaagggaaagagcgacataaagtattatgcaaaaacgggagatactatcgagtttatgtgcaagctcggatacaatgccaatacttccgttctatcttttcaggccgtgtgtcgcgaaggaatcgttgaatatcccaggtgtgaatag

SEQ ID NO: 183726 - DNA, 996 bp, Artificial Sequence
  Description of Artificial Sequence: Synthetic coding sequence
atgctgctgctgatcaacgtgatcctgaccctgtgggtgagctgcgcaaacggacaggaagttaagccctgcgattttcccgagatccagcatggcgggctgtactataagtcactgcgtcggctctattttcccgcagccgctgggcagagctacagttactactgcgaccagaacttcgtgaccccaagcggaagctactgggattacattcactgtactcaggacggctggcttcctactgtcccctgccttcgaacctgcagtaagagcgatatagaaatcgaaaatgggttcatttccgagtcatcgtctatctatatactgaataaggaaattcaatacaagtgtaaacccggctacgctactgcagatggaaactcctccggcagcatcacctgcctgcaaaatggttggtccgcccaacccatttgcatcaagttttgtgacatgccggtgttcgaaaatagtcgcgccaagtctaatggaatgagatttaaactgcatgatacgctggactacgagtgctatgacggttacgagattagttatggaaatacaaccggaagcattgtctgcggggaggatggatggtcacactttccaacctgctataactctagcgaaaaatgtggacccccaccgcctatctctaacggagacacaaccagcttcctcctcaaggtgtacgtaccgcagagcagggtggaatatcagtgtcaatcatattacgaactgcagggcagcaattatgtgacttgtagcaacggcgaatggtctgagccgcctcggtgtatccacccttgcatcatcaccgaagagaatatgaataagaacaacattcaacttaagggtaaatccgacattaaatactatgcgaaaacaggagacaccatcgagttcatgtgcaagttggggtataatgcaaacacatctgtcctttccttccaagcggtgtgccgagagggaatagtagaatatccacggtgcgagtag

SEQ ID NO: 183727 - DNA, 1752 bp, Artificial Sequence
  Description of Artificial Sequence: Synthetic coding sequence
atgaagctgctgcacgtgttcctgctgttcctgtgcttccacctgcgcttctgtaaggtgacgtatacgtcacaggaagatttggtagagaaaaaatgcttggcaaaaaagtatacacatctgagctgcgacaaggtattctgtcagccttggcaacggtgcatagaagggacgtgcgtttgtaaactgccataccagtgtcccaaaaatgggacggccgtctgcgccacaaatcgtagatctttccctacctactgtcagcagaagtcactggagtgtctgcacccaggaaccaaatttctgaataacggcacatgtacggccgagggtaagttttccgtctccctcaaacatggaaacaccgattccgaaggcatagtggaggtgaagttggtagatcaggacaagacgatgttcatttgtaagagtagctggagcatgcgggaggcaaatgtggcctgcctggacctcggatttcagcagggcgcagatacacagagacgcttcaagctgtcagacctgtccataaacagcaccgagtgcttgcacgtgcactgtcggggactagaaactagtctggctgaatgcacctttactaaacgacggacaatgggatatcaggacttcgcagacgtggtgtgttacacgcagaaagccgattctcctatggatgactttttccagtgtgtaaatggaaagtatatctcccagatgaaagcgtgtgacggcattaacgactgcggggaccagagtgatgaactgtgttgcaaagcatgtcagggtaaaggcttccattgtaagagtggcgtttgtattcctagccaatatcaatgtaacggggaagttgactgcataactggcgaggacgaagtgggctgtgccgggttcgccagcgtcacccaggaggaaacagaaatcttaacagccgatatggacgctgaaagaaggcgtattaagagcctgctccccaagctgtcctgcggagtcaaaaacaggatgcacattaggaggaagaggatagtaggagggaaaagggcacaacttggcgacctcccatggcaagttgccatcaaagatgcatccggtattacctgcggcggaatttacattggtggctgctggatcctgacagccgctcattgcctgagggccagcaagacgcatcgctaccagatttggactaccgttgtggactggattcatccagatttgaaacgtatcgtgatcgagtacgtggataggataatatttcatgagaactacaacgcaggtacctatcagaatgacatcgcactgatagagatgaagaaagacggaaacaagaaggactgtgaattgccacgatctattccagcgtgcgtaccctggtctccatatctgtttcagcccaacgacacctgcatagtatcaggttggggacgcgagaaggataatgagcgagtgttctcgttgcaatggggcgaagtgaaattgatttcgaattgcagcaaattctacggaaatcgtttttatgagaaggagatggagtgcgccgggacctacgatgggagcatcgatgcatgcaagggcgactctggcggccctttagtttgtatggatgctaataacgtcacatacgtgtggggggtcgtgagctggggcgagaactgtggtaaacctgagttcccaggtgtctacacaaaggtcgctaattacttcgactggataagctaccatgtagggcgccctttcatctcccagtataatgtgtag

SEQ ID NO: 183728 - DNA, 1776 bp, Artificial Sequence
  Description of Artificial Sequence: Synthetic coding sequence
atgaagctgctgcacgtgttcctgctgttcctgtgcttccacctgagattctgcaaggtgacttacacgagccaagaggatctggttgagaagaaatgtttagctaaaaagtacactcatctgtcctgcgacaaagtattctgccagccttggcagaggtgtatcgaggggacttgcgtgtgtaagctgccttaccagtgtccaaagaatggcacggctgtgtgcgcaactaacaggcgctcattccctacatactgccagcagaagtctctcgaatgcctccaccctggtacgaaatttcttaataatggcacgtgtactgctgagggaaagttctccgtgagcttaaagcatgggaacaccgattctgaaggaattgttgaggtcaagcttgtggaccaggacaagacaatgtttatctgtaagtcaagctggtccatgcgcgaggccaacgtcgcatgtctggatctcggatttcagcagggtgccgatacccagagacgattcaagctgagcgacctctccatcaattccaccgaatgtctgcacgtgcactgcagaggcttggaaacttcgctggctgagtgcacgtttacaaagcgtcggaccatggggtatcaggatttcgcagacgttgtgtgctatacacagaaagccgatagccccatggatgacttctttcagtgtgtgaacggaaagtacatcagccagatgaaggcctgtgacggcatcaatgattgcggtgatcaatccgacgagctgtgctgtaaggcctgtcaagggaagggtttccactgtaaaagtggtgtgtgcatccctagccagtaccaatgtaatggggaagtggattgtataaccggagaggacgaggtaggatgcgctgccgcccggcaccccacaatccagggattcgctagtgtgacccaggaggagaccgaaatcctgacagccgatatggacgccgaaagaagacggatcaagagcctgctgcctaagttgagctgcggcgttaagaaccgcatgcacataaggcggaaaaggatagttggtggcaaacgcgctcaattgggtgatcttccttggcaagtagctataaaagatgcttccggaatcacatgcggcggcatatatataggcggctgttggatactgacagcagcccattgtctgcgggcctctaagacccaccgctaccagatctggaccacagtggtcgactggatccaccccgatttgaaacggatcgtcatagagtatgtggaccggataatctttcacgagaattacaacgctggcacctaccaaaacgatatcgcccttatcgagatgaaaaaagacgggaacaagaaggactgcgagctgccccggtctattccagcttgcgtaccatggagcccctatctttttcagccgaacgacacctgtatagtgtccggctggggcagggagaaggacaacgagcgcgtgttcagtctccaatggggcgaagtcaaactgatctcaaactgtagcaaattctacggcaataggttctacgagaaggaaatggagtgtgccggaacatacgacggcagtatagacgcctgtaaaggcgacagcggcggaccactggtctgtatggacgcgaacaacgtgacttatgtatggggggtagtctcttggggagagaattgcggcaagccagaattccccggcgtttacactaaggtggcaaactattttgattggatctcttatcacgttgggaggccctttataagccaatacaacgtgtag

SEQ ID NO: 183729 - DNA, 1731 bp, Artificial Sequence
  Description of Artificial Sequence: Synthetic coding sequence
atgaagctgctgcacgtgttcctgctgttcctgtgcttccacctgcgcttctgcaaagtcacctacacgtctcaggaagatctggtggaaaaaaagtgtctggccaagaaatatactcatctgagttgtgacaaagttttctgtcagccttggcagcggtgtatagagggaacgtgtgtatgcaagctgccataccagtgtcccaagaatggtacagccgtctgtgccaccaacaggagatcatttcccacatactgtcagcaaaaaagtctggaatgcctccatcccgggaccaagttcttgaacaacggtacatgcacagcggagggtaagttctcagtgagtttgaagcacggcaacacagattccgagggtattgtcgaagtcaagctggtggatcaggacaagactatgttcatctgcaaatcttcctggtcaatgcgggaagcaaacgtggcatgcctagaccttgggttccagcagggagccgacacccaacgacgctttaaattgtctgatctttccatcaactcaacagagtgtctccatgttcattgccgcggccttgagacaagtctggccgagtgtaccttcacaaagagaagaaccatgggatatcaggacttcgccgacgtggtctgctacacccagaaggcagactcccctatggacgattttttccagtgtgtgaatggcaagtacataagccagatgaaagcatgtgacgggattaacgattgtggcgatcagtcagatgagctatgttgcaaggcatgccagggcaaaggtttccattgcaagtccggcgtgtgtattccctcacagtaccaatgcaatggagaagtagactgcataacaggtgaggacgaggtgggatgcgccgaagagaccgagattctcacggctgatatggacgccgagagacgacgtattaaatccctattgcccaagcttagttgcggagtgaagaatcgcatgcacatccgaaggaaaaggatcgttggagggaaacgagctcagctgggggacctgccatggcaagtggcaatcaaggatgccagtggtatcacctgcggcggaatatacatcggtgggtgctggatcctgaccgcagcccactgtcttcgcgcaagcaagacacacaggtatcagatatggacaacagtggtggactggatacatcctgatctgaaaaggattgttatcgagtacgtcgatcgcataattttccatgaaaactataatgctgggacctatcagaatgacatcgcccttatcgagatgaaaaaggatggcaataaaaaagattgtgagctgccccgttcaatcccagcgtgtgttccctggagcccttacctgttccagccaaacgatacttgcattgtcagcgggtggggccgggaaaaagacaatgaaagggtgttcagccttcaatggggtgaggtgaagctcatatccaactgctccaaattttatggaaaccggttttatgaaaaggaaatggagtgcgctggaacctacgatgggtcaatagacgcttgcaagggcgatagcgggggccccttagtgtgcatggacgctaacaacgttacctatgtatggggtgtcgtcagctggggagagaactgtggaaaacccgagtttcccggcgtttacaccaaggtagcaaactattttgactggatctcttatcatgtcgggaggccattcatctcacagtataacgtctag

SEQ ID NO: 183730 - DNA, 966 bp, Artificial Sequence
  Description of Artificial Sequence: Synthetic coding sequence
caggtgacctacaccagccaggaggacctggtggagaagaagtgcttggcgaagaaatacacacacctaagctgtgacaaagtcttctgccaaccttggcagagatgcatcgagggcacatgtgtctgtaagctgccctaccagtgcccgaaaaacggtacagcagtgtgtgcaacaaataggcgctctttccccacttactgtcagcaaaagagcctcgagtgtctgcaccccgggaccaaattccttaataatggcacttgtaccgccgagggcaaattttccgtctctctgaaacatggcaacacagattctgaaggaatcgtggaagtcaaactcgtggaccaggacaaaacgatgttcatttgtaagagttcctggagcatgagggaggccaatgttgcctgtttggacctcggctttcagcaaggcgccgatacacagaggcgcttcaaactaagcgatctctcaatcaattccactgaatgccttcatgtgcactgcaggggcctggagaccagcctggccgaatgtacatttaccaagcgccgcaccatggggtatcaggacttcgctgatgtcgtatgttacacccagaaagccgatagtcctatggacgacttcttccagtgcgtaaacgggaagtacatcagtcagatgaaggcatgtgatggcattaatgactgtggtgatcaatctgatgagctttgctgtaaggcgtgccagggaaaaggatttcactgcaagtcaggtgtctgcatccctagtcagtaccagtgtaacggagaggtggattgtatcacgggcgaggacgaagttggctgcgcagcctttgccgagctttgcatcgaggagaccgaaatactcacagccgatatggacgccgagaggagacgaatcaagtcactcctaccaaaactgtcttgtggtgtcaagaaccgcatgcacattaggcgcaagcgctag

SEQ ID NO: 183731 - DNA, 1134 bp, Artificial Sequence
  Description of Artificial Sequence: Synthetic coding sequence
atgaagctgctgcacgtgttcctgctgttcctgtgcttccacctgcgattttgcaaggttacatatacaagtcaagaagacttggtggaaaaaaaatgtcttgcaaagaagtacacgcatcttagctgcgataaggtcttttgccaaccgtggcagaggtgtatcgagggcacctgcgtgtgcaagctaccataccaatgcccgaagaacggcactgcggtctgcgccaccaacaggagatcctttcccacctactgccagcagaaaagtctcgagtgccttcatcccggcacaaaatttctgaacaatggcacttgtacagctgaggggaagttttctgtgtcactgaagcacggcaatactgatagtgaaggtattgttgaggtgaagctcgtggatcaggacaagaccatgtttatatgtaaatcctcctggtctatgagagaggcgaatgtagcgtgcctggatctgggctttcagcagggcgctgatacgcagaggcgtttcaaactgagcgatttatcgattaattccacagaatgcctgcatgtgcattgcagaggactggagacaagtctggctgagtgcacgtttacaaagcggcgcacaatgggctatcaggattttgctgatgtcgtatgctatacacagaaggccgattctcctatggacgatttctttcagtgtgtgaacgggaaatacatctcccagatgaaagcctgcgatggcattaacgactgtggagatcagtctgacgaactttgctgcaaggcatgccagggcaaggggttccactgcaagtctggcgtgtgcatcccgagccagtaccagtgtaacggggaagtcgactgtattactggagaggatgaagtaggttgtgctggctttgccagcgtcacccaggaagaaaccgaaattctgacggctgacatggatgctgagcgccggaggattaagtctctattacccaaacttagctgtggggtcaagaatagaatgcacatccgtagaaaacgaatcgtggggggtaagagagctcagcttgggaagatgaaacagatctcactggacatcttcaagggcctgcaccgcgtttacgcaattctggagttctgttgcatcattctgaagtag

SEQ ID NO: 183732 - DNA, 405 bp, Artificial Sequence
  Description of Artificial Sequence: Synthetic coding sequence
atggagttcgtgatgaagcaggccctgggcggcgccaccaaggacatgggaaaaatgcttggaggagatgaagagaaagatccggacgcagcaaaaaaggaggaggaaaggcaagaagcgcttagacaggccgaggaagaacggaaagccaagtatgcaaagatggaagccgagcgcgaggccgtgcgccagggcatccgcgacaagtatggcataaaaaaaaaggaggaacgcgaggcagaggctcaggccgctatggaggctaattcggaaggaagcttaactcggccaaaaaaagcaatcccaccgggctgcggcgatgaggtggaggaggaggacgaatccatcctggataccgtgatcaagtacttgcctgggcctctgcaggacatgcttaaaaagtag

SEQ ID NO: 183733 - DNA, 405 bp, Artificial Sequence
  Description of Artificial Sequence: Synthetic coding sequence
atggacttcgtgatgaagcaggccctgggcggcgccaccaaggacatgggtaagatgctgggcggcgaagaagaaaaggacccagatgctcaaaagaaagaagaagagagacaggaagcgttacggcaacaggaagaagagcgcaaagccaagcacgcgaggatggaagctgaaagagaaaaggtgcgacagcagattagagacaagtatggcctcaagaagaaggaggaaaaagaagccgaagaaaaggcggcccttgaacagccctgcgagggcagtctgacgcggccaaaaaaggccatacctgctgggtgtggggacgaagaagaagaagaggaggaatccatcctggatactgtgcttaaatacttacccgggccactgcaggatatgtttaagaaatag

SEQ ID NO: 183734 - DNA, 405 bp, Artificial Sequence
  Description of Artificial Sequence: Synthetic coding sequence
atggacttcgtgatgaagcaggccctgggcggcgccaccaaggacatgggtaagatgctgggtggtgaggaagagaaggatcctgatgcgcaaaagaaagaggaggagcggcaggaggcactgagacaacaggaggaggaacgcaaggcaaagcacgcccggatggaggcagagcgagagaaagtgcgtcagcaaatacgagacaagtatggccttaaaaaaaaggaggagaaagaagcagaggaaaaggccgccctggaacagccatgcgagggttcccttacaaggcccaagaaggcaattcccgcagggtgtggagacgaggaagaggaagaggaagagtcaatcctggataccgtccttaaatacctcccggggccgcttcaggacatgttcaagaagtag

SEQ ID NO: 183735 - DNA, 555 bp, Artificial Sequence
  Description of Artificial Sequence: Synthetic coding sequence
atggacttcgtgatgaagcaggccctgggcggcgccaccaaggacatggggaagatgctagggggcgaagaagagaaggatcccgatgcacaaaagaaagaggaggagcgtcaagaagcattgcgtcagcaggaggaagaacggaaagctaagcatgcacgcatggaggccgaacgcgagaaggtgaggcaacagatcagagacaagtatgggctcaagaagaaggaggagaaggaggccgaggagaaagctgcgttgagagggaggggtgggggaggccgaggcgagcaccctggacacggtgctcagatccctgcccgcgccgcggccggtcatgtgcaagaagtgacccggccccctgcccccgcgtattccacatgttattactttttcctagtcctgtctttcctgttcatcagattatccttgaattcagaaggcgaaaatctgtcctggccactccccctctttcccggtcaaggactgctccctctatcttccccttcccatctgccctcgtctcagggtatacatctccaccccacacctaaatag

SEQ ID NO: 183736 - DNA, 234 bp, Artificial Sequence
  Description of Artificial Sequence: Synthetic coding sequence
atggacttcgtgatgaagcaggccctgggcggcgccaccaaggacatgggcaagatgctgggcggtgaggaggagaaggaccctgatgcccagaagaaggaggaggagcggcaggaggctttgagacaacaggaagaagaacggaaggctaagcatgccagaatggaagcagagagagagaaggttcggcagcagatccgcgataaatatgggcttaagaagaaggaggagtag

SEQ ID NO: 183737 - DNA, 336 bp, Artificial Sequence
  Description of Artificial Sequence: Synthetic coding sequence
atggacttcgtgatgaagcaggccctgggcggcgccaccaaggacatgggcaaaatgcttggaggcgaggaggaaaaagacccagatgcgcagaaaaaagaggaggagagacaagaagctttgaggcaacaggaggaggagaggaaggccaagcatgccagaatggaggccgagagggaaaaagttcggcagcagatccgggataaatatggcctcaaaaaaaaagaagaaaaagaagcagaagagaaagcagccctcgagcagccatgcgaagggtcccttacccggccgaaaaaagctattccggccgggtgtggcgacgaagaggaggagtag

SEQ ID NO: 183738 - DNA, 360 bp, Artificial Sequence
  Description of Artificial Sequence: Synthetic coding sequence
atggacttcgtgatgaagcaggccctgggcggcgccaccaaggacatgggtaagatgcttggcggggaagaagaaaaggacccagatgcccagaaaaaagaagaggaacgccaggaagcactccgccagcaggaggaagagcggaaggccaaacatgcaagaatggaggccgaaagagaaaaggtgcggcaacaaatccgggacaaatacggcctcaaaaagaaggaagagaaggaggccgaggagaaagccgctcttgaacagccatgcgaaggatcgcttacaaggcccaaaaaggccatcccggccgggtgtggggatgaggaagaagaggaggaagagtctatactcgacacctag

SEQ ID NO: 183739 - DNA, 114 bp, Artificial Sequence
  Description of Artificial Sequence: Synthetic coding sequence
atggacttcgtgatgaagcaggccctgggcggcgccaccaaggacatgggtaaaatgcttggcggcgaggaggagaaagacccagatgctcaaaagaaagaagaagagcgatag

SEQ ID NO: 183740 - DNA, 405 bp, Artificial Sequence
  Description of Artificial Sequence: Synthetic coding sequence
atggacttcgtgatgaagcaggccctgggcggcgccaccaaggacatggggaagatgttggggggggaggaagagaaggatccggacgctcaaaagaaggaggaggaaagacaggaagccctgcgccagcaagaggaggaacgcaaggccaagcatgcacgcatggaggccgagcgggaaaaggtgaggcagcagataagggacaaatacgggctgaagaaaaaagaagagaaagaagcagaagaaaaagccgccttggaacaaccatgcgagggctctctgaccagaccgaaaaaagccatacctgccggctgcggggatgaggaggaggaggaggaggaatccattctggatacagtgttgaaatatttacctggccctttgcaggacatgtttaaaaaatag

SEQ ID NO: 183741 - DNA, 21 bp, Artificial Sequence
  Description of Artificial Sequence: Synthetic coding sequence
atggacttcgtgatgaagtag

SEQ ID NO: 183742 - DNA, 2943 bp, Artificial Sequence
  Description of Artificial Sequence: Synthetic coding sequence
atggccaccgccgccaccagccccgccctgaagcggctggacctgagagacccagctgctcttttcgaaacccacggagccgaagagattcgaggactcgaacgacaagtacgcgctgagatcgagcacaagaaggaggagttaaggcagatggtgggtgagcgctatagggatctgattgaggccgctgacaccatcggacaaatgcggcggtgtgccgtgggccttgtggacgctgttaaggcaaccgatcagtattgtgcgcgcttgcggcaggccgggtctgccgcgccacgtcccccccgagctcagcagccccaacagcccagccaggagaagttctactctatggcagcacagataaaacttctgctagagatccctgagaagatttggtccagtatggaagcctcccaatgtttacacgcaacgcaactgtatctgctgtgctgccatttgcacagccttcttcagctggacagtagttcttctaggtacagcccagtgctttctcggtttccgattctcatcagacaggtggccgccgcctcgcactttcggtctactatcctgcacgaatctaagatgctgctaaagtgtcaaggcgttagcgaccaggccgtggctgaagctttatgctccatcatgctacttgaagagagttctcctaggcaagcgttgacggatttcttacttgccagaaaggccactatccaaaagctgctcaatcagccccatcacggcgccgggatcaaagcacagatctgctcgttggttgagctgctcgcaactaccctcaagcaggcccacgccctcttttatacactccctgaaggcctactacctgaccccgcactgccttgtgggctgctgttcagtaccctagaaaccatcactgggcagcatccagctggcaagggcactggggtcctccaagaggaaatgaaactatgctcctggttcaaacacttgccagcaagcatcgtcgagtttcagccaacacttagaactctggcgcacccaattagtcaggaatacttaaaggatacactacagaagtggatccacatgtgcaatgaagacataaaaaacggaataactaatctgctgatgtatgtgaaaagcatgaaagggcttgcgggaattagagacgcaatgtgggagctgttgacgaacgaaagtaccaatcacagttgggacgtgctgtgtcgaaggctgctcgagaagccccttcttttttgggaggacatgatgcaacagctgtttctcgacagattacagaccttgaccaaggagggatttgatagcatctcctcatcatcaaaagaactgcttgtctccgcactccaggaacttgagagttccacctctaatagccccagtaacaaacatattcacttcgagtataatatgagtttgttcctgtggagtgaaagccccaatgacctgcccagcgacgctgcttgggtaagtgtcgccaacaggggacaatttgccagctccggcctgagcatgaaagcccaggccatcagcccatgtgtccaaaacttctgtagcgccctggactctaaactcaaggtcaaacttgacgatcttctggcatacctgccatcagatgacagttctttgcccaaggatgtatctccaacccaggcaaaaagctccgcgttcgatagatacgctgatgccggaactgttcaggagatgctacgcacgcagtcggttgcgtgtatcaagcatatcgtggattgtatcagagctgaactgcagagcatcgaggagggcgtccagggacagcaggatgctcttaacagtgctaaactccacagtgttctgtttatggcacgtctctgccagagcctgggagagctgtgcccccatctgaagcagtgcatcctgggaaagtcagagtctagcgagaagccggccagggaatttcgcgctcttcggaaacagggcaaggtcaagactcaagagatcatccctacccaggccaaatggcaagaggtaaaggaggtcttacttcagcagagcgtgatgggttaccaggtgtggtcctccgccgtggtcaaagtgctcatccacggcttcacgcagtcgctgctgctcgacgacgccggctcggtgctggcgacagccacctcttgggacgaattggagatacaggaggaggcagaatcgggcagcagtgtgaccagcaaaatccgactgcctgcccagcccagttggtatgttcaaagcttcctcttcagcctgtgtcaggaaatcaaccgagttggaggccatgctcttccaaaagtgactctgcaagaaatgctgaaaagctgtatggtgcaggtcgtcgctgcttacgaaaagcttagcgaggagaagcagatcaagaaagagggggccttcccagtgacgcagaatcgggccctccaactcctctatgatttgagatacctgaacattgtgttgaccgcgaagggggatgaggtgaagagcggcaggagtaagcccgactcaaggatcgagaaagtgactgatcatctcgaagccttaatcgatccctttgatctggatgttttcacccctcatcttaacagtaaccttcaccgcctcgtgcaacggacaagtgtactgttcgggctcgttacaggcacggaaaaccagttggctccacggtctagcactttcaattcccaggaaccccataatatcctgccactggcatcctctcagattagattcggcttactcccccttagcatgacctctacccggaaggccaaaagtacgcggaatattgagaccaaagcccaagttgtgcctcccgccagatctactgcaggggacccgacagtacccggcagtctctttcggcagcttgtatccgaagaagataacactagcgctccttctctctttaaacttggatggctgtcgtcgatgaccaagtag

SEQ ID NO: 183743 - DNA, 2823 bp, Artificial Sequence
  Description of Artificial Sequence: Synthetic coding sequence
atggccaccgccgccaccagccccgccctgaagcggctggacctgcgggacccagccgcgttattcgagacacacggggccgaagagatccgggggctcgagagacaagtccgggctgaaattgaacataaaaaggaggagctgaggcagatggtcggggagaggtatcgggatttgatcgaggcggcagacaccatcggccagatgagacgatgtgctgtcgggctggtggacgcggtcaaagcgacggatcagtactgcgcgagacttcgtcaggcgggtagcgccgctccccgaccccctcgcgcccaacagcctcagcagccctcccaggagaagttttactccatggccgcacagatcaagctactcctcgagatcccagagaagatttggagttctatggaggcttcccagtgcctccatgctacccagctttatttgctatgttgccacctacattccttacttcaactggacagtagctcttccagatactctcctgtgctctctagatttcctattttaatcagacaggttgccgccgcctctcatttccgcagtacaattttacatgagtctaaaatgttactgaaatgtcaaggcgtgagcgaccaagcagtcgcagaagccctttgcagcattatgctgctggaagagtctagcccccggcaggcacttacagacttcctgttggccaggaaagccacaattcagaagctgctcaaccaaccccatcacggggccgggattaaagcccagatctgcagtctggtggaattgttagccaccaccctaaagcaggcacatgctctgttctacactttaccggagggcctcctcccagaccccgcactcccctgcggcctgcttttttccacactcgaaactattacagggcagcatccggcaggaaagggtactggcgtcttgcaggaggaaatgaagctgtgtagctggtttaaacacttgcccgctagcatcgttgagttccagcccaccctgagaaccctggcccacccaattagccaagagtatctgaaagatactttgcaaaaatggatccacatgtgcaacgaagacattaaaaatggaatcaccaacctgctgatgtatgtgaagagtatgaaaggactagcgggcatccgggatgccatgtgggagttgcttaccaatgagtcgacaaaccacagttgggacgtgctctgccgtagattactagagaagcccctgctgttctgggaggatatgatgcaacagctctttttagacagactccagacactgaccaaagagggatttgatagcatcagctcatcttccaaggaactcctcgtgagtgcgctacaggaactggagagttccacaagcaacagcccctcaaataaacacatccacttcgagtacaacatgtctctctttctctggagtgagagtcccaatgacctgccctctgacgcagcctgggtgtcagtggctaacagagggcagttcgccagcagtggcctgtcaatgaaagctcaggctatatccccgtgtgtgcagaacttttgctccgccctcgactcaaaactaaaggtaaaactggacgatctcctcgcgtaccttccaagtgacgattccagcctgcccaaagacgtcagccctactcaggccaaatcaagcgcgtttgatagatatgccgatgccgggacggtgcaggagatgctgcgaacacagtctgtggcatgcatcaaacatatcgtagattgtattcgagcagagctccagtccatcgaggaaggggtccagggacagcaggatgcgcttaactccgcaaaactgcactctgtgctgtttatggcccgtctgtgccaatctctgggcgagctctgtcctcacctgaagcagtgtatcctaggaaagtccgagtcatccgaaaaaccagccagagaattccgcgccttgcgtaagcagggcaaagtcaagactcaggaaattatccccacacaggcaaagtggcaggaagtgaaggaggtgctgctgcagcaatctgttatgggatatcaggtgtggtccagtgccgttgtgaaagtcctcatacacggattcacacagtctctactcctggacgatgcaggatctgtccttgccacagctactagctgggacgagttggagattcaggaagaagctgaatctggctcttcagtgactagtaaaatccggttaccggcacagccatcctggtatgtgcagtccttcctgttcagcttgtgtcaggaaatcaaccgggtcggcggccatgcgctcccaaaggtgactttgcaagagatgctgaaatcatgcatggtgcaggttgtagccgcttacgaaaagctgagtgaggaaaagcaaatcaagaaggaaggcgcctttccagtaacacagaatagagccctacagttgctttacgatctccgctaccttaatatcgtgctgaccgccaaaggggacgaggtcaaaagcggaagaagtaagcctgattctcggatcgaaaaagtcacagatcacctcgaggcactgatcgaccctttcgacctggacgtgtttacacctcacctaaattcaaacctccatagactcgtgcaacgcacgagtgttctctttggcctagtgacaggcacagagaaccagctggcacctcgtagctcaacatttaattctcaggagccccataatatcctgcctcttgcatcatcacagattcggttcggactgctacccctgtccatgactagcacgcgcaaagcaaaatcaacaaggaatatagagactaaagcccagtatgacgccaattgttag

SEQ ID NO: 183744 - DNA, 2214 bp, Artificial Sequence
  Description of Artificial Sequence: Synthetic coding sequence
atggagaagagccggatgaacctgcccaagggccccgacaccctgtgcttcgataaggacgaatttatgaaggaggactttgatgtcgaccatttcgtgtccgattgtcgcaagcgagtgcagctggaggagttgcgcgatgatctcgagctctactacaagctgctcaagactgcaatggtggagctcatcaacaaggattatgccgatttcgtaaatctaagcactaatctcgtgggaatggataaggccttaaatcagttgtctgttcctctgggtcagcttagggaagaagtgctcagtttgcgaagtagcgtcagcgaggggattcgcgctgtggatgagagaatgtccaagcaagaggatatacggaagaagaagatgtgcgtgctacgccttattcaggttattaggtccgtggaaaaaattgaaaagatactgaactctcagagctctaaagagactagtgcccttgaagcctcttctccattgttgaccggacagattctggagagaattgccaccgagttcaatcagctccaatttcatgccgttcaaagcaaaggcatgcccctgctcgataaggtcagaccaagaattgcaggtattacggctatgctgcagcagtccctagagggtctgctgctggaggggctccagacatctgacgtagacataatccgacattgccttcgtacatatgcaacgatcgacaagacaagggatgccgaagccctggttgggcaggtcctcgtgaagccttacatcgacgaggttataatcgagcagtttgtagaatcacatcccaacggactccaggttatgtataacaaattgctcgaattcgttccccatcactgtcgcctgttacgcgaagtgacaggcggcgcgatatcctctgaaaagggcaataccgtacccggttacgactttctcgtgaactctgtgtggccccagatagttcagggcctggaggaaaagctgccgagtctgttcaaccccggaaatcccgacgcgttccacgaaaagtatacgatctccatggatttcgtgcggcgattggagcgacaatgtggttcccaggcaagcgtgaagaggctgcgtgcgcatcctgcctaccattcattcaacaagaaatggaatctacctgtgtattttcagatcaggtttcgggaaattgctgggtcattagaggcggctctcactgatgttcttgaagacgccccggccgagtcgccctactgcctgctggcctctcatagaacgtggtcctccctgaggaggtgttggtccgatgaaatgttcctgcctctgctggtgcatcggctctggagactaacactgcagatccttgctagatacagtgtcttcgtcaatgaactctctctgaggcccatctctaacgaatcaccgaaagaaatcaaaaagccactggtgactgggtctaaggagcccagcattactcaagggaacactgaagatcaggggtccggaccgtctgagactaagcccgtcgtgtccatttctaggacgcaactggtgtatgtggttgccgacctggataagctccaggagcagctgcctgagcttctggagatcattaaaccaaagctcgagatgattggcttcaaaaatttctcatcaatttctgccctggaggatagccagagtagtttttctgcgtgtgtgccctcgctgtctagtaagattattcaagacctctcagatagttgttttgggttcttgaaaagcgccctggaagtgcccaggttataccgtcggaccaataaggaggtgccaactaccgccagctcctatgttgatagtgcactcaagccgctcttccagctacagtcagggcataaagacaagctgaagcaagctattattcaacaatggctggaggggacactgagtgagtcaacccataagtattacgagaccgtgtccgatgtactaaattcagtgaaaaaaatggaagagtcccttaagcggctcaaacaggccaggaaaaccaccccagctaaccctgttggcccatcaggaggcatgtcggacgacgataagatccggctgcagctggccctcgacgtggagtatctgggagaacagatccagaaactgggactgcaggcaagcgatatcaaaagcttctccgcattggccgaacttgtggccgctgccaaagaccaggccacagcggagcagccttag

SEQ ID NO: 183745 - DNA, 2217 bp, Artificial Sequence
  Description of Artificial Sequence: Synthetic coding sequence
atggagaagagccggatgaacctgcccaagggccccgacaccctgtgctttgataaggacgaatttatgaaagaggattttgacgttgatcattttgtttcggactgtcgcaaaagggtgcagctggaagaattacgggatgacctagaattgtactacaagctgctaaagactgcaatggttgaactgattaacaaggattatgccgatttcgttaacctgagtaccaacctcgttgggatggacaaggccctcaatcagttgtctgtccctctgggacagctacgcgaagaggtgttgtccctgagaagctcagtgtctgaagggatccgcgccgtggatgaacgtatgtcaaagcaggaggacataagaaaaaaaaagatgtgtgtccttaggctcatccaggtgatccgcagcgtggagaaaattgaaaagatcctgaactctcagagttccaaagagacatctgcactggaggccagtagtcccctactcactggacagattctggagcgcattgccactgagtttaaccagctacagtttcacgcagtccaatcaaagggcatgcctctgcttgacaaagtgaggccaaggatcgccggcatcaccgccatgctgcagcagtctctcgaaggcttgttgctggagggactgcagacaagtgatgtcgatatcattcggcactgtctgcgcacttatgctacgattgataagaccagagacgcagaggcactggtggggcaagtgctagttaagccttacattgacgaagtcattatcgagcagttcgtcgagagtcaccctaatggattacaggtcatgtataacaagctgctggagttcgtgccgcaccactgtcggctgctgcgggaggtgaccggcggcgccattagctcagagaaagggaacaccgtcccaggctacgatttcctggtgaactcagtgtggccccagatcgttcaggggctcgaagagaagctgccatccctttttaaccccggcaatcccgatgcctttcatgagaagtataccatttcaatggactttgttcggaggctggagagacagtgtggctctcaagccagcgtgaaaaggctccgcgctcatcctgcctatcactccttcaataagaaatggaaccttccagtgtactttcagatccgcttccgagaaatcgctgggtctctggaggctgccctaacagacgttctcgaggacgcgcccgcagagtcaccttattgccttcttgcaagtcaccgcacatggagcagccttcggcggtgctggagcgacgaaatgttcttgcctctactagttcatagactctggcggttaactctgcagatcttggctcgctatagcgtattcgtgaatgagctctcactgaggccgataagcaatgaatcgcccaaggagataaagaagccactggtgacaggcagtaaagagccgtctatcacacagggcaacacagaggaccagggctccggaccttctgaaaccaagcctgtggtgtccatatccagaactcaactggtgtacgtcgtagccgatctggataagctgcaggagcaactgccagaactattggagatcattaaacctaaactggaaatgattggatttaagaacttttcctctatcagcgcagccctagaggactctcagtcttctttcagtgcttgcgtcccgtcgctgtcctccaagatcattcaggacctgtccgacagttgctttggctttctcaagagtgctctggaggttcccagactataccggcgaacgaacaaagaggttccgacgactgccagtagctatgtcgactcggcactgaagccactgtttcagttacagtcaggccataaggacaagttgaaacaggccataatacagcagtggcttgaaggcactctatctgaaagcactcataaatattacgaaacggtttctgacgtgctcaattctgtgaagaagatggaggaatcactcaaacggttgaagcaggcacgtaaaactacacctgcaaaccctgttggccccagcgggggcatgagcgacgatgataaaatcagactgcagctcgcccttgacgtggagtaccttggagagcagatccagaaactgggcctacaggcctcagacattaagtctttctccgctttggccgaactggttgctgccgctaaggatcaagctacagcagagcagccctag

SEQ ID NO: 183746 - DNA, 2040 bp, Artificial Sequence
  Description of Artificial Sequence: Synthetic coding sequence
atggtggagctgatcaacaaggactacgccgacttcgtgaacctgagtaccaatttggtgggcatggacaaggcactaaatcagctgtctgtgcctctgggacaactccgggaagaggtgctgagcctgagatcttctgtatcagaggggatcagagcagtggatgaaaggatgagtaagcaagaagatattaggaagaagaaaatgtgtgtgctaagactgatacaggtgatccgtagtgtggagaaaatcgaaaagatcctgaatagtcaatcttccaaagaaacctcggccctggaagcaagcagtcccctgcttacaggtcaaattcttgaaagaattgctactgagttcaaccagctccaatttcatgctgttcagagtaaaggcatgcctttactggataaagttaggccacgcattgcaggtattacagctatgctccagcagtctctcgagggcttgctcctagaggggctgcagacctcagatgttgatataatcaggcattgcttgcggacttacgctaccatcgataaaacccgtgacgccgaggccctcgtgggacaggtactggtgaaaccttacattgacgaggtaattatcgagcagttcgtggagtcacacccaaatggcctgcaggtgatgtacaataagctcctggagttcgtcccccatcattgccgcctgctgagggaggtcaccgggggagctatcagcagcgaaaagggcaacaccgtacctggctacgacttccttgtgaattctgtgtggccgcagattgttcaaggacttgaagaaaagctgcctagtctcttcaatcctgggaatcctgatgccttccacgaaaagtatacaattagtatggatttcgtccgcagactcgagcgacagtgcgggtctcaggcctctgttaaaaggctcagagcccatcccgcctatcatagtttcaataaaaaatggaatctgccggtctacttccagatccggttccgcgagatcgcaggttccttggaagccgcgttgaccgatgtcctggaggacgcccctgcagaaagcccttactgcttactggcttctcatcgtacttggtcctctctgagacggtgttggtcagacgagatgttcttgccgctattagtacatcgattgtggcgactgactttacagattctagcccggtacagtgtgtttgtgaacgaattgtctctgagacccatctcaaatgagtcccccaaggaaatcaaaaaaccccttgtaactggatctaaggaaccgagtattacccaagggaacacagaggaccaggggtcggggcccagcgagactaaaccggtggtttccattagccgcacccagttggtgtatgtggttgctgacctcgacaagctccaagagcagctgcctgaactcctggagattatcaaacccaagctggaaatgataggatttaaaaacttctctagcatatcggccgccttagaagacagccagagttccttttcagcttgcgtaccttctctctctagcaaaatcatccaggacctgtccgactcttgtttcggattccttaagtctgcgctggaggttcctcgcttatatcgccggaccaacaaggaagtcccaacaacagcttcatcttacgttgatagcgctctgaagcccctgttccaattgcagtccggtcacaaggataaactgaaacaggccatcatccaacaatggctggagggaacactgagcgaatcaacccacaagtattacgaaactgtctctgatgtcctcaatagcgtaaagaagatggaggagagcttgaaaaggttgaaacaggccagaaaaacaactcctgcaaatcctgtgggaccgtccggtgggatgtcagatgacgataagatcaggctgcagctagccttggatgtggagtacttaggcgagcaaatccagaagctggggctgcaggccagtgatatcaaaagctttagcgccttggcagaactcgtcgccgctgctaaggatcaggctactgcagaacagccctag

SEQ ID NO: 183747 - DNA, 1869 bp, Artificial Sequence
  Description of Artificial Sequence: Synthetic coding sequence
atgagcaagcaggaggacatccggaagaagaagatgtgcgtgctgcgcctaatccaggtcatccgatccgtcgaaaaaattgagaaaatccttaacagccagtccagcaaggaaacgtccgcactggaagcatcaagccctttgctcaccggccagatattagaacgaatcgccaccgaattcaatcaattgcagtttcacgccgtacagtcaaagggcatgccgctgctggacaaggtgcggccccgtatcgcaggcatcacagcgatgctgcagcagagcctggaaggtctgctcctggaaggtctgcagacaagcgatgtcgacattatccgccactgtctccgaacttacgcaacgatcgacaagacccgcgatgcagaggcgttggttggccaggtgctggtgaagccttacattgatgaggtcataatagaacaattcgtggaaagccatcccaacggcttgcaggtgatgtataacaagctactcgagttcgtgccgcaccactgccggcttttgagggaagtgaccggaggcgccattagctcagagaaaggcaataccgttcccggctatgacttcctggtaaacagtgtgtggccacagattgtgcagggactggaagaaaagctgccctccctctttaatccggggaaccctgacgctttccacgaaaagtatactatctccatggactttgtgaggcgcctggagcgccagtgtggctcccaggcttcagtaaagcgcctccgagcgcaccctgcatatcactcgtttaacaagaagtggaatctgccagtgtatttccagatacggttcagggagatcgcaggatctctggaggccgccctcaccgatgtacttgaggacgcccccgccgaatctccctactgtctgctcgcctcccaccggacatggagcagtttgaggagatgttggtcagacgaaatgtttctgccattattagtccaccgactgtggaggctaacgctccagatcttagctcggtatagtgtgtttgtaaacgagctgtcactccggccaatatctaatgaaagcccaaaggaaattaaaaagcctctcgttacagggtccaaggaaccttcaattactcagggaaatacagaagaccagggcagcggaccctccgaaacgaaacccgtcgtttccatttctagaacccagctggtatatgtcgtggccgacctggataaactccaggagcagcttccggaacttctggagattattaaacctaagctggaaatgattggtttcaaaaatttctcgagcatttccgccgcactcgaagactctcagagttcattttccgcctgcgtgccctcgctttcttccaagataatacaggacctgtccgactcctgtttcggcttcttgaagagcgcactggaggtaccgcgactctaccgccgcaccaacaaagaggtgccaaccacagcatctagctacgtcgactcagctttaaaacctctgttccagcttcagtccgggcataaagataaattgaagcaggcaatcatccagcaatggctggaggggacgctttcggagagcacgcataagtattatgagacggtctccgacgtcttaaacagcgtgaagaagatggaggaatccctcaaacggctgaagcaagcccggaaaacgacgcccgccaatccagtaggccctagcgggggtatgagtgatgacgataaaatacgactgcaattagccctggacgtagaatatctgggtgagcagatccaaaaacttggtctccaggctagtgacattaaaagcttcagtgcgttggctgaactcgttgccgctgccaaagaccaggccaccgcagagcagccatag

SEQ ID NO: 183748 - DNA, 1284 bp, Artificial Sequence
  Description of Artificial Sequence: Synthetic coding sequence
atgggcttcgccatggaggacaccgaggacatcagccagaaccacttcgggcatctgtgtatatttaaatggggacattggaagaaggatctgaagtacacgatctcaatggatttcgtgagaaggctcgagaggcagtgtgggtcccaggcctctgtcaagaggctgagagcccatccagcataccactccttcaacaaaaagtggaatcttcctgtgtacttccagatccgattcagagagattgccggaagcctggaggcggcccttactgacgtcctggaagatgcgcctgccgaatctccatactgtctgctggcctctcaccgtacttggtcatcccttcgcagatgttggtcagacgaaatgtttctgcccttactggtccaccgcctgtggagattgaccttgcagattctagctcgctattcagtattcgtgaacgagctgtccctgagacccatttccaacgaatcccccaaggaaattaaaaagcctttagtgacggggtctaaggagcccagtataacacagggcaatactgaggatcaggggtccggaccctcggaaaccaagcccgtagtctccattagtaggacacagctggtatatgtggtggctgacttagacaaattacaggagcagctcccggagctgctcgaaattattaagccaaaattggagatgatcggcttcaagaatttcagctctatctcagccgcccttgaagattcacaatcctccttctctgcctgtgttccaagtctcagcagtaaaatcatccaggatctgtctgactcttgctttgggtttttaaaatcagctcttgaagttccgcggctgtataggagaaccaacaaggaggttccaacaacagccagttcctatgtggacagcgcgctgaagccactgtttcagttacagagcggccacaaagacaaactcaagcaggccattattcagcaatggctggaaggaaccctgagcgagagcacccacaagtattatgagacagtgtccgacgtcttgaactcagtaaagaaaatggaggagagcctcaagcgactgaagcaggctcggaaaacaactcctgctaatcctgtcggcccatccggcggcatgtcggatgacgataagattcgtctgcagcttgccctggacgtggaatatttgggcgaacagatccaaaagctggggttacaggcatccgacattaagtcattctccgccctggctgagctggtagcggctgccaaggatcaggctaccgccgagcagccgtag

SEQ ID NO: 183749 - DNA, 2487 bp, Artificial Sequence
  Description of Artificial Sequence: Synthetic coding sequence
atggccgaggccgccctgctgctgctgcccgaggccgccgccgagagggacgctcgggaaaaactggccttgtgggacagaaggccagacacaactgccccgttaacggaccgccagaccgatagcgtgctggagcttaaggcagccgcagagaatcttcctgtccccgcagaactcccaatagaagatctgtgtagccttacttcacaatctctgcctattgaattaacttctgtggtgccagagtcaacagaggatatccttcttaaaggcttcaccagcctggggatggaggaagaacgcattgagacagctcagcagtttttttcatggttcgctaaactgcagacacagatggaccaggacgaaggcacgaaatatcgacaaatgcgcgactacctttcgggattccaggagcagtgcgacgctatcctgaacgatgtgaattctgctctgcagcacctggaaagcctgcagaagcagtacttattcgtttccaataaaaccggcactctgcacgaagcatgcgagcaacttttaaaggagcagagcgagcttgtcgatctagcagagaatatccagcagaagctctcgtattttaatgaattggaaaccattaacacaaaactgaactctccaaccctctccgtaaatagcgatggatttataccgatgttggccaagttagacgattgcatcacgtatattagcagccacccgaatttcaaagactaccccatctacctgcttaaattcaagcagtgtttgagcaaggcactgcatctaatgaaaacatatacagtgaatactctccagacactaactagccagttgctgaagcgtgacccctcatcagtccctaacgcggacaatgcattcacactgttctacgtaaagttccgggctgctgcgcctaaagtgcgtaccctgatagagcagattgagctgcggtccgagaagatcccagagtaccaacaactcctcaacgacattcatcaatgctatctcgaccagagggagctgctgctgggacccagcatcgcatgtactgttgcagaacttactagtcagaacaaccgtgaccactgcgccctggtgcgttcaggctgcgcgtttatggttcacgtctgtcaggatgaacaccagctatataatgagttctttacgaagccaactagtaagctggacgagctgctcgagaagttgtgtgtatctctctacgacgtcttccgacctctgattatccacgtgattcatctggaaacactttccgagctctgtgggatactgaaaaacgaggttcttgaggatcatgtccagaacaacgcggaacagctgggtgcattcgccgccggcgttaagcagatgctcgaggacgtacaagaacgactggtgtaccgcacgcacatctacatccagacggacatcacgggctacaagccggcgcctggcgacctggcttaccctgacaagctggttatgatggagcagattgctcaatcactgaaagacgaacagaaaaaagtgccctccgaggcttcatttagcgacgtgcacctggaggaaggggagtccaattctctgacaaaatccggctcaactgaaagcctgaaccctcgccctcaaaccacgatctcgcccgccgacttacatggcatgtggtacccaactgtgaggcgaactctggtgtgtttgtccaagctgtatcgttgcattgaccgcgcagtctttcagggtctgtcccaagaggctctgtctgcatgcatacagtcattactgggggcctcagagagcatctcgaaaaataaaactcagatagatggacagctcttcctgattaagcacctcctgattctcagggagcagatcgccccatttcataccgagtttaccatcaaggagatctccctagacttaaagaagactcgagacgcagctttcaagatcctgaaccctatgactgttcctcgtttcttcagattgaactccaataacgctctgatcgaattcttgctggaaggtactccagaaattcgagagcactacctggattcgaagaaagacgtagaccgccacttaaaatctgcctgtgagcagtttatccagcaacaaacaaaactgttcgtagagcagctcgaggaattcatgaccaaggtcagcgccctgaagaccatggcgagccagggtgggcccaagtataccctttctcagcagccgtgggcccaacctgctaaagtcaacgacctagccgctacagcttacaagaccattaaaactaagctacccgtcactctcagatcaatgtcattgtacttatctaataaggatacagaatttattttattcaagcccgtgagaaataacattcaacaggtttttcaaaagttccatgcgctcctgaaggaggagttttctcccgaagacattcagatcatagcttgtccctctatggagcagctgagtctactcctccttgtgtccaagtag

SEQ ID NO: 183750 - DNA, 2370 bp, Artificial Sequence
  Description of Artificial Sequence: Synthetic coding sequence
atgggcaccaagatggccgacctggacagcccccccaagctgagcggagtacagcagccaagtgagggagtggggggcggccgctgctccgaaattagtgcggaactgattaggagcctgacagagttgcaggaattggaagctgtatacgaacgactttgcggcgaagaaaaagtcgtagagcgggagctggacgccttactggaacagcagaataccatagagagtaagatggtgaccttacaccggatgggtcccaaccttcagttaatcgaaggcgacgccaagcaactggcagggatgatcacgtttacatgcaatctggccgagaacgtgtcttctaaagtcagacagttggatcttgcaaagaacagactgtaccaggcgattcagcgcgcggatgatattttagacctgaagttctgcatggatggggttcaaactgctctgcgatcagaagactatgaacaggccgccgcacacacacaccggtatctgtgtttagataagtctgtcatcgaactgtcccggcaaggtaaagagggatccatgattgacgcaaacttgaagctcctgcaggaagcggaacagaggctgaaggccattgtggccgaaaagttcgcgattgcaacaaaggagggagatctgccacaggtcgaaagattcttcaagatctttccgttgttaggactccatgaggaaggcctcagaaagttttcggagtacttgtgcaaacaggtcgcctcaaaggcggaagagaacctcctcatggttctcgggacggatatgtctgacaggcgcgccgcagtgatcttcgccgacaccctgacactgttgtttgaagggattgctaggattgtggaaacgcatcagcccatagtggaaacatactacggccccggccgactgtacacactgattaagtacctgcaggtggaatgtgatcgccaagtagagaaagtcgtggacaagttcatcaagcagcgggattaccaccaacaattcaggcatgtgcaaaacaatctgatgcgaaacagtactaccgagaagattgaaccccgggagctcgatcctattttgactgaggtgactctaatgaacgcccgtagcgaactgtatctgcgatttctcaaaaagcgcatcagttccgactttgaggtgggcgatagcatggccagcgaagaagtcaagcaggagcatcagaagtgcctggacaagctgctcaacaattgccttctatcatgcactatgcaggagctgattggcctgtacgtgaccatggaagagtactttatgcgggaaactgtgaacaaggctgtcgctctcgacacctatgaaaaagggcagctgacatcttccatggtagacgatgtgttttatatcgtcaagaagtgcatcgggcgagccctaagtagttccagtattgactgtctttgtgcaatgattaatctcgccaccactgaactggagtcagacttccgggatgttctgtgcaataaattacgcatgggctttcccgctactactttccaggatatccagcggggtgtgacatcagcagtgaatattatgcatagttccttgcaacagggcaaatttgacacaaaaggaatagagtcaacagatgaagcgaagatgagcttcttggttaccttgaacaatgtggaagtttgctcagagaatatcagtaccttgaaaaagactctggaatccgattgcaccaaactgttttcccagggtattgggggcgaacaggctcaggccaagtttgattcgtgtttgtccgacctggccgccgtgtcaaataaatttcgagatctcctccaggagggcctgactgagctcaacagcactgccatcaagccacaagtgcaaccctggatcaacagcttcttcagcgtttcacataatattgaagaggaggagtttaacgactatgaggcgaatgatccctgggtgcagcagtttattctgaatctggaacagcagatggctgaattcaaggcttcgctgtcgcctgtcatatatgacagcctgactggcctgatgacgagcctggtggctgtcgaacttgaaaaggtcgtgttgaaatccaccttcaatcgactgggcgggctgcagttcgacaaggaactgaggtctctgattgcctacctgactaccgtgacaacatggactatccgagataagtttgcacgtctctcccaaatggccacaatcctgaacttagaaagagtcaccgaaatacttgactactggggacccaacagcggccccttgacatggcgcctcaccccagctgaagtaagacaagtgctggccctgcggattgatttcagatccgaggacattaaacggcttagactctag

SEQ ID NO: 183751 - DNA, 2295 bp, Artificial Sequence
  Description of Artificial Sequence: Synthetic coding sequence
atggccgacctggacagcccccccaagctgagcggcgtgcagcagccatcagagggagtggggggcggacgctgctccgagatctccgcagagctcatccgatcactgactgaactccaggagctggaggctgtgtacgagcgactctgcggcgaggagaaggtggtggaaagagaattggacgccctgttggagcagcagaacacgatcgaaagtaagatggtaaccctccatcgaatgggacctaacctccagctgatcgagggcgacgcaaagcagttggcagggatgattactttcacctgtaatctagcggagaacgtatcaagcaaagttcggcagttagatttggccaagaatcgtttgtaccaggcaatccagcgcgccgatgatatcctggacctgaagttttgcatggatggggtgcagacagccctccgttctgaagattatgaacaagcagcagcccacacacatcggtatctctgtcttgacaaatcggtgatcgaactgagtaggcagggcaaagaggggtcaatgattgatgctaacctgaagttgctgcaggaggcagagcagcggcttaaggccattgtcgcggaaaaattcgcaatcgcgaccaaagagggggatctgccccaggtggagcgcttttttaagatctttccactgcttggtcttcacgaggagggactacgcaagttcagcgagtatctctgtaaacaggtagctagtaaggccgaggagaacttgctaatggtgctcggaaccgacatgtctgaccgaagagctgccgtgatttttgctgatactttaactcttctctttgaaggcattgcccgaatagtggagacccaccagcctatcgtggagacctactacgggccaggacggctctatacccttataaagtatttgcaggtggagtgcgatcggcaggtggagaaagtcgttgataagttcattaagcagagggattaccatcagcagtttcgacatgtccagaataacctcatgcgaaattctaccaccgaaaagatagaaccccgggagttggatcctattctgacggaggtaaccctgatgaatgcgcgctccgagctatacctgagatttctgaaaaagcggatctccagcgattttgaggttggggacagcatggcctccgaggaggtcaagcaagagcaccagaaatgcctcgataaactgttgaacaattgccttctcagctgtactatgcaagagctgatcgggctatacgtcactatggaggagtactttatgcgggagacagtgaataaggccgtggctcttgatacctacgaaaagggacagcttactagcagcatggtcgatgacgtgttttacatcgtgaagaagtgcatcggtcgcgcgttgagcagctcatcgattgactgtctgtgtgctatgatcaatttagcgactaccgagctggaatcagactttcgagatgtactgtgcaacaagctgaggatgggctttccggctacaacattccaggacattcagcggggagtcaccagcgccgttaacatcatgcattcctctttacaacagggtaaatttgacaccaaaggcatagagtccactgacgaggccaaaatgtcatttttgtccgactgtacgaagctctttagccaagggattggcggggagcaggcacaggccaaattcgactcctgccttagcgacctggctgcagtatccaataagttcagggatctgttacaagaggggctgaccgagctgaattctaccgctatcaaaccgcaggtccagccctggataaatagtttcttctctgtctctcataacatcgaagaggaggagtttaatgactacgaagctaacgatccatgggtgcagcaatttatcctcaatcttgagcagcaaatggccgaattcaaggccagtctcagtccagttatatatgatagtctcacgggtctcatgacctccctggttgccgttgaactggagaaagtcgtgctgaagtccacctttaaccgactgggcgggcttcagttcgacaaggagctccgatccctcattgcatacttaaccactgtcaccacgtggactatcagggataagttcgcacgactaagccagatggcgacgatactcaatctggagcgagttaccgaaatcctggactactggggacctaatagtgggcctctgacatggcgtctgactcctgcagaagtgaggcaggttctagctctcagaatcgactttcgatcagaagatatcaagcgcctccgcttgtag

SEQ ID NO: 183752 - DNA, 1014 bp, Artificial Sequence
  Description of Artificial Sequence: Synthetic coding sequence
atggccgacctggacagcccccccaagctgagcggcgtgcagcagccaagcgaaggagtgggaggagggaggtgctctgagatcagtgctgagttgattcggagtcttacagaattgcaagaactggaggctgtgtacgagcgcctgtgtggagaagaaaaagttgtcgagagggagctagatgcacttctggaacagcagaacacgattgagtcaaagatggtgacactccatagaatgggtccaaaccttcagctgatcgagggtgatgcaaaacaactggcgggtatgatcacattcacctgcaatctggccgaaaatgtgagctccaaagtccgacaactggaccttgcaaagaatcgtctatatcaagccatccagcgcgcggacgatattctggacctgaaattctgtatggatggtgttcagacagctcttcgatccgaggactatgagcaggctgctgctcacacacatcgctacttgtgtcttgataagtccgtaattgagctgagccgccaggggaaggagggcagcatgatagatgccaatcttaagttactgcaagaggccgaacagcgcttgaaagccatcgttgccgaaaaattcgccatcgccactaaagagggcgacctaccacaggtcgaacgcttcttcaaaattttcccgctgctggggcttcatgaggaaggattgaggaaattttctgaatacctttgtaagcaagtcgcctccaaggccgaagaaaacctcttaatggttctcgggacggatatgtccgatcggcgggcagcagtcatcttcgctgacaccttgactctgctttttgaggggattgcccggatagtcgaaacccaccagcccattgtcgagacttattatggaccaggtcgtttatacaccctgattaagtacctccaagtggagtgtgacaggcaggtcgagaaagtggtggacaaatttataaagcagcgtgactaccatcaacagaattttgtgtttagttttttttag

SEQ ID NO: 183753 - DNA, 1344 bp, Artificial Sequence
  Description of Artificial Sequence: Synthetic coding sequence
atgcggaacagcaccaccgagaagatcgagccccgggagctggaccctatcctaaccgaagtaactctcatgaacgcaagatctgaattgtacctcagatttctgaaaaaacgtatcagttccgatttcgaggtgggagacagtatggcttccgaggaagttaaacaggagcatcagaaatgccttgataagttattgaacaattgtcttctctcctgtactatgcaggagctcatcggcttgtatgtgacaatggaggagtacttcatgagggaaacagtcaacaaagcagttgccctggacacctacgagaagggacagctaacctcttccatggtggatgacgttttttatatcgtaaagaaatgcattggccgtgcactatccagctcctcgattgactgtctgtgtgctatgattaacctcgcaacgaccgaactcgaatcagattttcgtgacgttttatgtaataagcttcgaatgggtttccctgcaaccactttccaggatatccagagaggagtcacctcagccgttaacatcatgcacagcagcctgcagcagggaaagtttgatacaaaaggcatcgagtccactgatgaggctaagatgtcatttcttgtcaccctcaacaatgtcgaagtctgttccgaaaatattagtactctcaaaaagacattagaatctgattgcaccaaacttttcagtcagggcatcgggggggagcaggctcaggccaagttcgattcttgcctctcggatttagcggcagtgagtaacaaatttagggatttgttacaggagggcctaaccgaactgaacagcactgccattaagcctcaagttcaaccgtggatcaactccttttttagcgtgagccataatattgaggaggaggaattcaatgattatgaggctaatgatccttgggtgcagcaatttattctcaacctggaacagcagatggctgagttcaaagcttcactgtcacccgtaatttacgattccttgacgggactgatgacttcgctggtggcagtggaactcgaaaaagtagtgctgaagtccacatttaatcgcttgggaggtctccagtttgacaaggagctgaggtcacttattgcatacctgactacagtcaccacctggacgatccgcgataaattcgcaaggctgtcccagatggcaactatattgaatttagaacgcgttaccgagattttagactactgggggccaaactccggtcctctcacctggagattgacacctgcagaagtacggcaggtgctcgcactgcgaatagactttcgttctgaagatattaagagactgcgtctgtag

SEQ ID NO: 183754 - DNA, 2583 bp, Artificial Sequence
  Description of Artificial Sequence: Synthetic coding sequence
atgggctgggtgggcggccggcggcgggacagcgccagcccccccggccgatctaggtccgctgccgacgacatcaatcccgcccccgccaacatggagggggggggtgggagcgtagctgtcgctggtctaggtgctcgaggctccggtgctgccgcagctaccgtgcgcgaactgctgcaggacggatgctacagtgacttcctcaacgaagactttgatgtgaaaacctatacaagccagagcattcatcaggccgtgatcgccgaacaactagccaagctcgcccaaggtatatcccagctggaccgggagctgcatctgcaagttgtggcaagacatgaggacctgctggcacaggccacgggcatagagtcgctggagggcgtgctgcagatgatgcagactcgaatcggcgctttgcaaggggctgttgataggatcaaagcaaaaatcgtcgagccttacaacaagatcgtggcacgcaccgcccaactcgctaggctccaagtcgcatgtgatctcctcaggcggataatcaggattctgaaccttagcaagaggctacaggggcagctgcaggggggatctcgagagattaccaaggcggctcagagtctcaacgaactggattatctctctcaagggattgacctgtccgggatcgaagtgatcgagaatgacctgctgttcatcgccagagccaggttggaggtggaaaaccaagcaaaaagactactcgagcaggggcttgagacccagaatcctacccaggtgggcactgcccttcaggtcttctacaacctgggaaccctcaaagatacaatcacctccgtagtcgacggctactgcgccacgctggaagagaatattaactccgctctggatataaaggtcctgacacaacctagtcagagcgctgtgcggggcggccctggacgcagcactatgccgacacccggcaacactgccgcacttcgagcttccttctggaccaatatggaaaagttaatggaccacatttacgccgtgtgtggccaggtacagcatctacagaaggtattggccaagaagagggacccggtttcacatatatgtttcatcgaagaaatcgtcaaggacggccagcccgagattttctataccttctggaatagcgtcactcaggccctgagttcccaattccatatggcgaccaactcctctatgtttttgaagcaggctttcgaaggcgaatatccaaaactcttacgactttacaatgacctgtggaaaaggctgcagcagtactctcagcatattcagggcaacttcaacgctagcggtacaacagatttatacgtggatcttcaacatatggaggacgacgcgcaggacatatttatcccaaaaaaaccagactatgaccctgagaaggccttgaaggattcactgcagccatatgaggcggcttacttatccaagtctctgagccgattgttcgaccctattaacctggtattccccccaggcgggcgcaaccccccgtcttctgatgagttggatgggataatcaagactattgcttctgagcttaacgtcgccgctgtggacactaatctcaccctggccgtttcaaagaatgttgccaaaactatccagctatactccgtgaagagcgaacagctgctttcgacacagggcgacgcctcccaggtcattggccccctaacagagggacaaaggcgcaacgtggctgtggtcaacagtctgtacaagcttcaccagagcgtaactaaagtggtctcatcccagagttcatttccgctagctgccgagcaaaccattatctctgcactgaaggcaattcacgccctcatggaaaatgcagtccaacctttactcaccagcgtcggagacgctatcgaagccatcatcattaccatgcaccaagaggacttctctggcagcctatccagcagtgggaagccagatgtgccttgtagtctgtacatgaaagagttgcaaggctttattgctcgagtgatgtcagattattttaagcactttgaatgcctagactttgtgttcgacaatactgaggcgatagcgcagagagccgtcgagttgttcatccggcacgcaagtttgattcgtcccttgggagaaggggggaaaatgcggctggcagcagacttcgcgcaaatggagttggctgtggggccattctgtcgacgagtcagcgacctgggcaagtcttacagaatgctcagaagctttagaccgcttctcttccaggcttccgaacacgtcgcttcttctccagccctgggcgatgttattcccttttctatcatcatacagtttctttttacccgtgctcctgcagagctgaagtcaccatttcaacgagccgaatggagtcacaccagattttcccaatggctcgatgaccacccctcagaaaaggaccggctactgctgattcgaggagccctcgaggcttatgtgcagagcgtgcggtccagagaggggaaagagttcgcaccagtctaccctatcatggttcagctccttcagaaggccatgtccgcgctccagtag

SEQ ID NO: 183755 - DNA, 2520 bp, Artificial Sequence
  Description of Artificial Sequence: Synthetic coding sequence
atgggctgggtgggcggccggcggcgggacagcgccagcccccccgggaggagccggtcggcagcagatgacattaacccggcaccggccaatatggaaggcggtggagggagcgtcgccgtcgccggccttggtgcgcgaggctcaggagcagccgccgctaccgtgagagagctgctacaggacggctgttacagcgatttccttaacgaagattttgacgtgaagacttatacatctcagagcattcaccaggcggtaatcgccgagcagctggccaaactggctcagggaataagccagctagatcgagagctgcatttgcaggtggttgcgaggcatgaggaccttctcgctcaggcgaccgggattgaatccctggaaggcgttcttcagatgatgcagaccagaataggcgctcttcagggcgccgtggacagaattaaggcaaagattgtggaaccatacaacaaaattgtagccaggacagctcagctggctaggcttcaagtcgcctgcgacctcttacgccggattatccgaattttaaatctgtctaagcggttacagggtcagcttcagggcggctctagagagataaccaaggccgcacaaagcctaaatgagttagactacctcagccaaggaatcgacctcagcggtattgaagtcattgagaacgatctgctgttcattgccagagccagattggaggtagaaaaccaggccaaaagactcctcgagcaaggactggaaacccagaaccctactcaggtggggaccgctctgcaggtcttttacaacctgggaactttgaaggatacaattacaagtgtggtggatggctattgcgccacactcgaagagaatattaatagtgctctggatataaaagtcctcacccagccttcccaaagcgccgtgaggggtgggccaggcaggtccaccatgcctaccccaggcaacaccgcagccctgagagctagcttctggacaaatatggaaaagcttatggaccatatctacgctgtctgcggtcaagttcagcatttacagaaggtattggcgaaaaagcgagacccagtaagccatatatgctttatcgaggaaatcgtgaaggacggacagccagagattttttatactttctggaattccgtgacccaagcactttccagccaattccacatggccaccaatagctcgatgttcctcaagcaggcctttgagggagagtaccctaaattactcagactgtataacgatctgtggaaaaggctccaacagtacagccaacacattcagggcaatttcaacgccagcggtacaacggacctgtacgtggacctgcaacacatggaagacgacgctcaggacatattcattcctaagaaacccgattacgatccagagaaagccctcaaggattcactgcaaccctatgaagctgcatatctttctaaatctctgagccggttattcgaccccatcaaccttgtgtttccacctggaggccgcaaccctccaagctctgatgagctggacggtattatcaagaccattgcaagtgagctgaacgttgctgctgtcgataccaatctgactcttgctgtctccaaaaacgtagccaagacgatccagctttacagcgtgaaaagtgagcagttgttaagtactcagggagacgcatcgcaagtcatcggacctctgacagaggggcagaggcgcaatgtcgcggtcgtgaattctctgtataagcttcatcagagtgtgacaaaggccatacacgctttgatggagaatgcggtacaaccccttctgacctccgtcggcgacgctattgaggccatcatcataaccatgcatcaggaggatttttcaggctccctgtctagctctggaaagcccgacgttccctgcagcctctacatgaaagaactccagggcttcattgcccgtgtgatgagcgactacttcaaacattttgaatgcctggactttgtcttcgacaacacggaggctattgcccaaagggctgtcgaacttttcatccgacatgctagtctcatacggcccttaggtgaggggggcaagatgcgcctcgctgccgatttcgcccagatggaacttgcggtcggtccattctgccgccgcgtgtcagatctggggaagagctacaggatgctgagatcctttcgacctcttctctttcaggccagcgagcacgtggcaagtagcccagccctaggggacgtgattccatttagcatcattatccagtttctattcacccgggctccagccgagctcaagtcccccttccagagggcggagtggagtcatacacgattttcccagtggttggatgatcatccctcagagaaggacaggttactcctcattaggggtgccctggaggcatatgttcagtccgtcagatccagagagggaaaggagtttgcccctgtctacccaatcatggttcagcttctgcaaaaggccatgtccgcactgcaatag

SEQ ID NO: 183756 - DNA, 2472 bp, Artificial Sequence
  Description of Artificial Sequence: Synthetic coding sequence
atgggctgggtgggcggccggcggcgggacagcgccagcccccccgggcgaagcagaagcgccgctgacgatatcaatcccgccccggctaacatggagggtggcggggggtcagttgccgtcgctggactcggagcacgcggctcgggagccgcggctgctactgtacgggagttactccaggacggctgctactccgatttcttaaacgaagacttcgatgtgaaaacttataccagtcagtccattcatcaggctgtcatagcagagcagttggctaagttggcccagggtatatcccagcttgaccgggagcttcaccttcaggtagtggcccgccacgaggacctgctggctcaagctacgggaattgagtctctcgaaggggtgctccagatgatgcagacccgtatcggcgccctgcagggagcagttgaccggattaaggctaaaatcgtcgaaccctacaacaagatcgtggcccggacagctcagctggcccggctccaagtcgcgtgtgatctgctgagacgcatcattcgaatactgaacctgagcaaaagattgcagggacagttgcagggaggcagtcgggagatcaccaaggccgctcagtctctaaatgagctagactacttgtctcagggcatcgatctcagcgggatcgaagtgatcgaaaatgacctgttgtttatcgcaagggctcgccttgaggtcgagaatcaggcaaagagattgctggaacaggggctcgagacgcaaaacccgacgcaggttggcaccgccctccaggttttctataacttagggactttgaaggatacgatcacaagcgtcgtggacggatattgtgctaccctcgaagagaatatcaacagtgccctagatattaaggttttgactcaaccttctcagagtgccgtgcgcggcggtcctggtcgatccaccatgccaacccccgggaacacagcagccctgcgagcatctttttggactaacatggagaagctgatggatcatatatatgccgtgtgcggccaggtgcaacatctccagaaggtgctcgccaaaaagcgagaccccgtaagtcacatttgttttattgaagaaattgttaaggacggccagcccgaaatcttttacactttctggaatagtgttacgcaggcactctccagccagtttcatatggccacaaatagttccatgttccttaagcaagctttcgaaggcgaatatcctaagctgctccggttatataacgacctctggaaacgtctccaacagtatagccagcatattcaggggaatttcaacgctagcgggacaacagacctgtacgtggacctccagcacatggaggacgacgcgcaggatatttttattcctaaaaagcccgactatgatcctgaaaaagcactcaaggactcacttcagccttatgaagctgcttatttatcaaaaagcctgtcaaggctcttcgatcccattaacctggtcttcccacctgggggaagaaacccaccatcaagcgacgaattggacggcattattaagaccatcgcatccgaattaaacgtggccgccgttgatacaaacctgactctggctgtgtccaagaacgtggcgaaaactatccaactctattccgtcaagtccgagcaacttctgagtacgcagggagacgcctctcaagtgatcggcccccttacagaaggtcagcggcgcaatgtggcagtggtcaactccctgtacaagttgcaccaatctgtcacaaaggtcgtaagcagccagagttccttcccattggccgctgagcagactatcatcagcgccctgaaggccatccacgcactgatggaaaatgctgtgcagcccctcctgacttccgtgggcgatgctatcgaggcaataattatcacaatgcaccaggaggacttctctggttctcttagtagcagtggcaagccagacgtcccctgtagtctttatatgaaggagttgcaggggttcatcgcccgagtgatgtccgactatttcaagcactttgagtgcctggactttgtttttgataacactgaggccatagctcaaagagccgtcgaactgttcatccgccatgcctctctgattcgccccttgggagagggcggcaaaatgcgactggccgctgactttgcccagatggagctggcggttggcccattttgccgccgcgtgtcagacctgggcaagtcctatcgcatgttgaggtcattccgccctttattattccaggcttccgagcacgtcgcatcgtccccggcattgggtgacgtgatcccattttccataattattcagtttctgttcaccagggcaccggcagagttgaagagtcccttccagcgtgcagagtggtcacacactaggttttcacagtggctggatgaccatccaagtgaaaaagacagactgttgctgatcaggtag

SEQ ID NO: 183757 - DNA, 2067 bp, Artificial Sequence
  Description of Artificial Sequence: Synthetic coding sequence
atgcggggccggttcgcccacgcccagtacagccggtgcctgcggggcccatgcctggctgaggtggccgcgggagggggaacacggagcgccatggccgaaggatctggcgaggttgtggctgtgtcagcaacgggcgccgccaacgggcttaacaacggcgccggaggaacctctgcgactacttgcaatcctctgtctaggaagctgcataagattttggagacccgactagataacgacaaggagatgttggaagcgcttaaggcactgagcacattttttgtggagaattcactgaggacaagaagaaatctcagaggcgacatcgagcgcaaatctttggccattaacgaggaatttgtgtcaatattcaaagaagtgaaggaggagctggaatcaatctctgaggacgtgcaggctatgtccaactgctgccaggatatgacatctagattgcaggccgcgaaggagcagactcaggatttaatcgtcaaaaccaccaaacttcagtcagaaagccagaagctcgaaatacgagcccaagtggccgacgcctttctgagtaaattccagctgacatctgatgagatgtcgttgttgcggggcactcgggagggaccgattaccgaagatttcttcaaggccctgggccgggtcaaacagattcacaatgacgtcaaggtgctgctcagaaccaaccagcaaaccgcaggcttagagatcatggagcagatggccctgctgcaagagactgcttatgaacggctttatcgttgggctcagtccgaatgccgcaccctcacacaggagtcatgcgacgtgagccccgtactgacccaggccatggaggccctgcaggaccggcctgtgctctataaatacaccctagatgagttcgggacagcgcgacggtctaccgtagtgcggggattcattgatgcccttacccgaggcggacctggtggcaccccccgacctatcgagatgcactctcatgatcccctcagatatgtgggcgatatgttagcctggctgcaccaggctaccgcgagcgaaaaagagcacctggaggccctgctcaaacacgtgactacccagggggtggaggagaacatccaggaagtggttggccatatcactgaaggggtgtgtagacctctcaaggtccgaattgaacaagtgatcgtggctgagccgggcgccgtgctgctgtacaagattagcaatctcttgaaattctaccatcacacgatctctggcatcgtgggaaactccgccaccgccctgctaacgaccattgaagaaatgcacttgctaagtaagaagatattctttaattccctcagccttcatgcctccaaactcatggacaaggttgaacttccacctcctgatcttggcccaagctctgctcttaatcagactcttatgttgctgcgcgaagtgctggcatctcatgacagttccgtcgtgcccctggatgccagacaggctgattttgtccaggtgctatcatgtgttctggacccgttattgcagatgtgtaccgtgtcagcttctaacctagggaccgcagacatggcgacattcatggtgaatagcctgtatatgatgaagaccacattggcgctcttcgaatttactgacaggcggctcgaaatgctccagtttcagattgaggcacacttagacactttaattaatgagcaggcttcctatgtcctcaccagagtcgggctgtcctatatttacaatacagtccaacagcacaaaccagagcaaggaagcctggccaacatgcctaatctcgactctgtgacccttaaggctgctatggtccaattcgatcggtatctgagcgccccagacaatttgctcattccacagctgaatttccttttatccgcaacagtgaaagagcagatcgtgaaacagtcaactgaacttgtctgcagagcatacggcgaggtgtatgctgccgttatgaatccaatcaacgaatataaggatccagagaacatcctgcaccggtccccgcaacaggtgcagaccctgctcagttag

SEQ ID NO: 183758 - DNA, 1848 bp, Artificial Sequence
  Description of Artificial Sequence: Synthetic coding sequence
atggccgagggcagcggcgaggtggtggccgtgagcgccaccggcgccgcaaatggtctgaataacggtgccggcggaacttccgctactacctgtaaccctttaagccgcaaactccacaaaatcctggaaactagattggataatgacaaagagatgcttgaagcattaaaggcactttctaccttctttgtcgagaattctctacgtacgaggcggaacctgcggggagacatcgagcgtaaatcccttgctattaacgaagagttcgtgtcaatcttcaaggaggtgaaagaggaattggagagtatctctgaggacgtacaggccatgtccaattgctgccaggacatgacgagccgcctccaagcagccaaagagcagacccaggacctgatcgtcaagactacaaaacttcagtcagaaagccagaagctagagattcgcgctcaggttgccgatgcttttctatccaaatttcagctgaccagtgacgaaatgagcctccttcgaggcacccgcgaagggcctattactgaggacttcttcaaggctctaggacgcgttaaacaaattcacaacgacgtaaaggtactgctgcggaccaaccagcagacagcggggcttgaaatcatggaacagatggccctgttacaggagactgcctatgagagactttaccggtgggcccaaagcgaatgcagaacgttgacccaggagagctgcgacgtgagccccgttctgacgcaggccatggaggcactgcaggaccgccctgtgctgtacaagtacacactggatgagtttgggaccgctcggaggagcaccgtggtccgtggattcattgatgcgcttactagaggtggaccaggaggcacacccagacctattgaaatgcattcccacgatccactccggtatgtcggcgacatgctagcgtggctgcaccaggctacggcgtctgaaaaagaacatttagaggctttgcttaagcatgtgactacacagggggtagaagagaatattcaagaggtcgttggacacatcactgagggtgtttgtcggcctctgaaggttaggattgagcaggtgattgtcgccgagcccggggcggtattgctgtacaagatatccaacctgctcaagttctaccaccatacaatcagcggtatagtgggaaactcagccacagccctgctgaccaccatcgaagagatgcatctgctctctaagaagatcttcttcaacagcctgtctttgcacgcgtccaaacttatggacaaagtggaactgcctccgcccgacctgggacccagcagtgctctgaaccaaacactgatgttgctaagggaagtgctcgcttctcatgacagttctgtggtccctctagacgctaggcaggcggattttgtgcaggtgctgagctgtgttctggacccactgctgcagatgtgtactgtgtctgcgtcaaatcttgggacagcagacatggcaacctttatggtcaatagcctgtatatgatgaaaaccacgctggcccttttcgaattcacagacaggcggctggaaatgctgcagtttcagatagaggcgcacttggacaccctgataaacgagcaagccagttatgtactgaccagagtggggctgtcatatatctataatacagttcagcagcacaaaccagagcaggggagcctggcaaatatgccgaaccttgattccgtgacactgaaggcagcaatggttcagtttgataggtacctcagtgccccagataacttgctgatccctcaactcaacttcctgctctccgcaacagtgaagcgcccaccgaatggcccgtag

SEQ ID NO: 183759 - DNA, 1974 bp, Artificial Sequence
  Description of Artificial Sequence: Synthetic coding sequence
atggccgagggcagcggcgaggtggtggccgtgagcgccaccggcgccgctaatggactcaacaatggagcaggcggtacgtctgccactacttgtaaccctctatctcgaaagttgcataagatcctggagaccagactggataatgataaggagatgctcgaggctcttaaagccttgtccacatttttcgttgaaaatagtttgcggaccagaagaaacctaagaggagatatcgaacgaaaaagcctggccattaatgaagaatttgtgtccatcttcaaggaagtgaaagaagaactggagtccatttctgaagatgtccaggcgatgtcaaattgttgtcaggatatgacatccaggctacaggctgctaaggagcagacacaggacctcatagtgaaaaccaccaaactccagtctgagtcacagaaactggagattcgtgcacaggtggccgacgctttcctaagcaaattccagctgacgtcagacgaaatgagcttgctgcgcggcaccagagaaggccctataacagaagatttttttaaagcactcggcagggtcaaacagattcacaacgacgttaaggtacttctgcgtaccaaccagcaaaccgccggactggaaattatggaacaaatggctctgctgcaagagacagcctatgagcgcctgtaccgctgggcgcaatctgagtgcagaaccctgacccaggagtcatgcgatgtgagccctgtgttgacccaggccatggaggctcttcaggatcgtccagtattgtataaatacaccctagacgaattcggcacggctcggcgcagcaccgtcgtccggggctttatcgatgcactgacacgagggggacctggagggacccctagacccattgagatgcactctcatgaccctctgaggtatgtaggggatatgctggcttggctgcatcaggctacagcctccgaaaaggaacatctcgaggcgctgctgaagcatgttaccactcagggtgtggaagagaacattcaagaggttgttggacacatcacagagggggtgtgtcgccccttgaaggtgcgcatcgaacaagtgatcgttgctgaaccgggggcagtgctcttgtacaagatcagcaatctgctcaagttctaccatcacacaatatcagggattgttggcaacagtgcaacggctctcctaaccactatagaggaaatgcacttgcttagcaagaaaatttttttcaatagtctgagtctgcacgcaagcaagcttatggacaaagtggagctacccccgccagacctgggaccatcaagcgccctgaatcagacactgatgctattaagggaggtgctggcgagtcacgatagcagtgtcgtccccctggacgcccgacaagcagattttgtgcaagtcctctcttgcgtgttagatccactactgcagatgtgcaccgtttcagcttcaaacttgggcactgctgacatggctacttttatggtgaattcactatatatgatgaagaccacattagctctttttgagtttactgataggcgcctcgagatgctgcagtttcagatcgaagcccatctggatacgcttatcaatgagcaggcaagctacgtccttacgagggtgggattgtcctacatttataatacggtgcagcagcacaaacccgaacagggtagcctagctaacatgcccaatttggactccgtgactctgaaggccgccatggtgcaatttgatcgctatctttctgctcccgacaacctgctcataccacagctgaatttcctgctgagcgctacggtaaaggagcagatcgttaagcagtctactgagctggtgtgccgagcatatggtgaagtttatgctgccgtgatgaatcccatcaacgaatacaaagacccggaaaacatactgcatcggagcccgcagcaggtgcaaaccttgctttcttag

SEQ ID NO: 183760 - DNA, 2313 bp, Artificial Sequence
  Description of Artificial Sequence: Synthetic coding sequence
atggacttcagcaagttcctggccgacgacttcgacgtgaaggagtggataaatgcggcctttcgggcggggagcaaagaggctgccagcggcaaagctgatggccatgctgcgactttagtaatgaagctgcagttattcatacaagaggtcaatcatgccgttgaggaaacttcccaccaggccttacagaatatgcccaaggtgctcagggacgtggaggcccttaagcaagaggccagcttcctaaaggagcagatgatcctggtgaaggaagatattaagaaattcgaacaggacaccagccagtccatgcaggtccttgtggagatagaccaagtgaagtcccgaatgcaattagccgcagagtcactgcaggaggccgacaaatggtcgacactttctgcagatattgaggagacgttcaaaacccaggacatagccgtcatctccgcaaagcttaccgggatgcagaattctttgatgatgctggtcgatactcccgactactccgagaaatgcgtgcatttagaagcccttaaaaacagactggaagccctggccagcccacagatcgtggccgcgttcacttctcaggcagtcgaccagtccaaagtcttcgtgaaggtgttcactgagatagaccggatgccccagctgctggcgtactattacaagtgtcataaagttcaactcctggctgcatggcaggagctctgccagagcgatttgtcccttgaccgccagctgaccggtctttacgatgcactgttgggcgcatggcacacacagatccagtgggctacacaagtgtttcagaaaccacatgaagtggtcatggtgctcctgatacaaacccttggggcactgatgcccagcctgcccagctgcctatctaacggggtagagcgtgcaggccccgagcaagagctgacacgcctgttggagttctatgacgccaccgctcacttcgccaaggggttagaaatggctctgctccctcacttacacgagcacaacctggtgaaggtaaccgaactagtcgatgcggtctacgatccatataagccgtatcaactgaagtacggcgatatggaggaatcaaatcttctaatccagatgagcgccgtgcccctggagcacggagaagtcattgattgtgtgcaagagctgtcacattccgtcaacaagttgttcggtcttgcatctgccgccgtggacaggtgcgttaggttcactaacggtctggggacgtgcggtctgttatcagccctgaagtccctgttcgctaaatatgtgtccgacttcacatccaccctacaaagcatccggaaaaagtgcaagctggaccacattcctccgaacagcctgtttcaagaggattggaccgcattccaaaattccattcgcataatcgccacttgtggggagctattaagacactgtggagacttcgagcagcagctcgcaaaccgcatcctctcaaccgccggaaaatacctgtcagatagctgcagccctcggtcactggccggatttcaggaatcaatactgactgacaaaaaaaactccgctaaaaacccttggcaggaatacaattatttgcagaaggacaacccggctgagtatgcttccctgatggaaatcttatatacacttaaggaaaagggaagttccaatcacaacttactcgccgcccctcgagcagcccttacccggctgaaccagcaagctcatcagctcgctttcgattcagttttcctgagaattaaacaacagctgcttctgatcagcaagatggactcatggaacactgctggtattggagagactctgacagatgaactccccgcgttctctctgacccctcttgagtatatctcaaacatcggacagtacattatgagtctgcctttgaacttggaaccatttgtgacccaggaggatagtgcactcgaacttgccctgcacgcgggaaagcttccttttcctcccgaacaaggcgatgagttaccggaattggataacatggcggacaactggttgggcagtatcgcccgggctactatgcagacttattgtgatgctatcttgcagatacctgaattgagcccacactccgcgaagcaactggctacggacatcgactatttgattaacgtgatggacgcgcttgggctgcagccctctaggaccctacaacacatcgtcactttgttgaagacaagaccagaagactatagacaggtgtctaagggcttaccccgtcggttagctacgaccgtggcaacaatgagatctgtcaattattag

SEQ ID NO: 183761 - DNA, 1839 bp, Artificial Sequence
  Description of Artificial Sequence: Synthetic coding sequence
atggccaccgccgccaccatccccagcgtggccaccgccaccgccgccgccctaggggaggtggaggacgaaggactcctggcgagcctttttcgggaccggttcccagaggcccagtggcgggaaagacctgacgtgggccggtatcttagggagctcagtgggagtggcctagagagactgaggagggagccagagcgcctggccgaagagcgcgctcagctgctgcagcagaccagggacctcgcctttgccaactacaagacgttcatcagaggggccgagtgcacagaaaggatccaccgcctctttggcgatgtcgaggcgagcctgggcaggttactcgataggctgccctcctttcaacagagctgcaggaattttgtaaaagaagccgaggaaatatctagtaatcggcgcatgaactcactcaccctcaaccggcatactgaaatcctggaaatcttggagatacctcagctgatggacacctgtgtgaggaactcctattacgaggaagctctggaactggctgcttacgtcaggcgcctcgaacggaaatacagctctatcccagtgattcagggcatcgtgaatgaagtgcgccagtccatgcagctgatgctctcccagctcattcagcagcttaggaccaacattcagctcccagcctgccttagggtaatcggttacctcaggcgcatggacgtatttacggaagccgagttgagagtgaaatttttgcaggcgcgcgatgcatggcttcgatctatactgaccgctatacctaacgatgacccatactttcatattacaaagaccattgaagcttccagggtccacctgtttgatatcataacccagtaccgtgccattttttccgacgaggatcccctattgccacccgctatgggtgagcacaccgttaacgagagtgccatattccatggctgggtcctgcagaaagtgtctcaattcctccaggtgctggaaacagacctctacaggggtattggtggccaccttgacagcctgcttggtcagtgcatgtactttggactaagcttcagtcgcgtaggcgctgactttaggggacagcttgcccccgtctttcaacgagttgctatctccactttccagaaagcaatccaggagaccgttgagaagttccaggaagagatgaatagctacatgttaatctccgctccagccatcctgggtaccagcaacatgcctgctgcggtacccgctacccagcctggcaccttgcaacccccgatggtgttgctagactttccccccttggcctgcttcttgaacaacatactggttgcattcaatgatttgcgtctctgttgccctgtggcactggcccaagacgttactggcgccctggaagacgccctggctaaggtgacaaaaatcattctggcttttcaccgggcggaagaggccgcttttagttccggcgaacaggagttgttcgtgcaattttgcacagttttcctggaggatctcgtgccgtacctgaatcggtgccttcaggtgctgtttccccccgctcagatcgcccaaactcttgggatccctcctacgcagctgtcaaagtacggtaacctgggccacgtgaatatcggggccattcaggagcctctcgccttcattctgcccaaaagggaaactctatttaccctggatgatcaagcccttggcccagagctcactgccccagcccccgaaccccctgccgaggaacctagacttgaacctgccggacccgcatgccccgaagggggtcgggccgaaacccaggccgaacctccatccgtcggaccttag

SEQ ID NO: 183762 - DNA, 2109 bp, Artificial Sequence
  Description of Artificial Sequence: Synthetic coding sequence
atggagagccccagcgcccccccccaccggtggtgcatcccctggcagaggttactgctcactgcgagcctgctaaccttctggaacccacctaccaccgcgaagttgacaatcgaatctacaccctttaacgttgcggagggcaaggaggtcctgctccttgtgcacaatctcccacaacatctattcggatactcctggtacaagggtgagagggttgatggcaaccgccagatcattggatacgtgatcggcacccagcaggccaccccgggtcctgcatacagtgggagagaaatcatctaccccaatgctagcctgcttatccaaaacatcattcagaatgataccggattctataccttgcacgtaattaagtcggacctggtaaatgaggaggcgaccggccagttccgtgtctatcctgagcttcctaagcccagtatctctagcaataacagtaagcccgtcgaagacaaagacgcagtggcttttacttgcgaaccagaaacccaagatgccacttacctgtggtgggtgaacaaccagtccctgcctgtctcccctagactgcagctaagcaacggaaataggaccctgacgcttttcaatgtcactaggaatgataccgcctcttataagtgtgagacccagaatcctgtctctgcacgtagatccgattccgtgatcctaaatgtcctgtacggaccagatgccccgacaataagcccccttaacaccagttatcgctcaggcgaaaatctcaacctgagttgtcacgccgcaagcaacccacctgctcagtattcctggtttgtcaacggcacatttcagcaaagcactcaagaactcttcattcctaatataaccgttaataactcagggtcctacacctgtcaggcgcacaattctgacacgggattgaacagaaccacggtgactactattacggtgtatgccgaaccacctaagccttttatcacgtcaaataatagcaaccccgtcgaggatgaggatgcagtggccctcacttgcgaacctgagattcaaaacacaacttacctgtggtgggtgaacaaccaatctcttccagtgtcacccaggttacagctctccaacgataatcgaactctcacccttcttagcgtcacccggaacgatgtcggtccctacgagtgcggcatccagaacaagctcagcgttgaccactcagaccctgtaatcctaaatgttttgtacggacctgacgacccaaccatctcaccctcctacacgtattacaggcccggagtaaatctgtcactaagctgtcacgccgcttccaatcccccagcccaatatagttggctgatcgatgggaacatacagcagcacacccaagaactgtttatatccaacattaccgaaaaaaattcagggctatacacatgccaggcaaataatagcgcatccggacattcacggaccaccgttaagactatcacagtgagtgccgaacttccgaaaccttcaatttcatctaacaactcaaagccggttgaggataaggacgctgtggccttcacatgtgagcctgaggctcagaacactacctatctgtggtgggttaacggccagtccctcccggtgagccctcggctgcaactcagcaacggtaatagaacactgaccttgttcaacgtgacccgcaacgatgctcgggcttacgtttgcggcatacagaattccgtgagtgcgaatcgcagcgatcccgttaccctcgatgtgctgtacgggccggacacaccaattatctcaccccccgattcgagctacctgtccggtgccaacttgaatttgtcatgtcattctgcgtccaacccttctccccagtattcctggaggattaatggcatcccccagcagcacacacaggtgctcttcatcgccaagatcacccccaataataacggcacttatgcatgctttgtgagtaacctagcgacaggcagaaataatagtattgtgaaatccataacagtttccgcttctggtacatcgcccggcctgagtgctggggcaaccgtaggtatcatgataggtgtgctggtgggagttgcattgatttag

SEQ ID NO: 183763 - DNA, 981 bp, Artificial Sequence
  Description of Artificial Sequence: Synthetic coding sequence
atgatggcctacatgaaccccggcccccactacagcgtgaacgccttggctctatctggtccaagcgttgatctgatgcaccaggcggtaccatatccttcaccgcctttggcccttgatccacccaggcgtcagaggcaggagaggaccgtgtacactgagtctcagcagaaggtcctggagttctacttccagaaggaccagtatcccaattacgatcagcggctgaacctggctgaaatgctgtccttgcgcgaacagcagctccaggtctggtttaaaaacagacgagctaaacttgcccgcgaaagacgactgcagcagcagccacagagagtccctggccagcggggacgtggcgcaagggcagcaccgctggtaccggtcgctgctgcttcttttccaggtggcccagagttcccccagggcaggggctcttggatctctcctcagccagggccctggggtgttcttccagccgccgagcctaagatctacagtcttccaagaacttgggggggaccagagtgtggaacccaagaaggccttaaggccgtgcctgcgcctggccccgggcctatacctgctcccattccaggaccagcccagatccctggccctgtccctgggccagctccaaacttggggcctatgtctggccctctttctgtgtccataccaggaccaatccccgctccgattagctgccccgggccgatccccgaccctgtcctcggaagaacgctgatgcccggacctggtagcttgccaactcctgcgcctggcgctctatggcctcagagtccgtacgcctccaacctgtcaccagacacacaattgtaccctgacttcacaaaactattgccattgctggacaggttcgaggagtcaagcttgagcacaaccacctctcaatataaggaggaggacggttttgttgacaaaaaccatagtgtgccccggtcacttctggacctgtag

SEQ ID NO: 183764 - DNA, 900 bp, Artificial Sequence
  Description of Artificial Sequence: Synthetic coding sequence
atgatggcctacatgaaccccggcccccactacagcgtgaacgccctggcgctgtcgggcccctcagtagacttgatgcatcaagctgtaccttaccccagcgcacccagaaagcaaaggcgggaacggactacatttacccggtctcaattagaggagctggaggctttatttgccaaaacccagtatcctgatgtttatgcccgggaagaggtagcactgaaaattaacctcccagaaagccgcgtgcaggtctggttcaagaacagaagagccaagtgccggcagcaacggcagcaacagaagcagcagcagcaaccccctgggggccaggccaaagcccggcccgccaagcgcaaggcagggacctctcctcggccctctaccgacgtctgtccagatcctcttgggataagtgattcctactcgccccctttacccggcccaagcggaagtccaactaccgccgtggccaccgtttccatttggagtcccgcctccgaatcaccattgcctgaggcacagcgggccgggctggttgccagcgggccaagcttgacaagcgctccctatgccatgacctacgctccagcctccgcattctgttctagcccaagtgcctacggatctccatcaagctactttagcggacttgatccttacctctcacccatggttccacagctgggaggcccagccctgtcccccctgtccgggccttcggtcggcccgtcgttggcccagtctccaacttcactgtcaggacagtcctatggggcttattctcccgtggatagcctggaatttaaagatcccactgggacctggaaattcacatacaaccccatggatcccctagactacaaggaccagtcagcctggaagttccagattctctag

SEQ ID NO: 183765 - DNA, 900 bp, Artificial Sequence
  Description of Artificial Sequence: Synthetic coding sequence
atgatggcctacatgaaccccggcccccactacagcgtgaacgccctggcactctcaggaccaagcgtagacctgatgcatcaagcagtcccttatccaagcgctcctaggaaacaaaggagggaaagaactacgtttacccggagtcagctcgaggagctggaggcactgtttgcgaaaactcagtacccggatgtctacgcacgggaggaagtggctctgaaaatcaacctgccagagagtagagtgcaggtatggtttaagaacaggagagcaaaatgcagacaacagaggcagcagcaaaagcagcagcaacaaccccctggcggccaagctaaggctagaccagcaaaaaggaaggctggcacttccccacgaccatccactgatgtgtgtccagatcctctgggcatttcagactcctatagccctccactgcccggcccatctggaagtccaacaacagcagtggccaccgtatctatctggagccctgcgtcggaatctccactccccgaggctcagcgcgcaggcctggtagccagcggcccttccctgacatccgccccctacgccatgacctatgcgcctgcatctgctttttgctcctcaccctctgcctacggatctccttcatcgtacttctcagggttagacccgtatctctcgccaatggtcccccagcttggtgggccagcactttctccactctccggcccgtccgtgggtccaagtctagcccagtcaccaacctctctgtcaggccagagttatggggcctactcccctgttgactcactcgaatttaaagatcctactggcacctggaagttcacatacaaccccatggaccctctggactacaaagaccaaagcgcctggaagtttcagatcctgtag

SEQ ID NO: 183766 - DNA, 900 bp, Artificial Sequence
  Description of Artificial Sequence: Synthetic coding sequence
atgatggcctacatgaaccccggcccccactacagcgtgaacgccctcgctctctccggcccttcagtggatctgatgcaccaagctgtgccataccccagcgctcctcggaagcaaaggagagagcggacaacatttacgaggagccaactggaggagttggaggccctgtttgccaagacacagtaccccgatgtttatgccagggaggaagttgctctgaagattaacctacctgaatctagagtgcaggtatggttcaaaaacagacgggctaaatgcagacagcagagacaacaacagaaacagcagcagcaaccgccgggggggcaagccaaagcccgacctgcgaaaaggaaggcggggacatctcctcgtccctctacggacgtgtgtcctgatcccctcggaatttcagattcatatagccccccactccctgggccatcaggcagtcccactactgccgtcgcaacagtttccatctggtcaccggcctcagaatcccccttgccagaggcacagcgcgctggtctcgtagcgagtggcccttcactgacgtcagccccttacgccatgacttatgccccggccagcgctttctgcagctctccatcagcatatggcagcccctccagctacttcagcggattggatccctacctctcaccgatggtcccacagttgggagggcccgccctctcacctttgtcgggaccctcggtcggtccctctctggcccagtctcctacatctctgagcgggcagtcctatggcgcctacagcccggtggatagtctggaatttaaagaccccaccgggacttggaaatttacatacaaccccatggacccgctggactacaaagatcagagcgcttggaagttccaaatcctgtag

SEQ ID NO: 183767 - DNA, 3678 bp, Artificial Sequence
  Description of Artificial Sequence: Synthetic coding sequence
atggccgccgtgctggagagcctgctgcgggaggaggtgagcgtggctgcggttgtgagatggattgcgcggtccacccagggttctgaggataacgctggggaggccgccgctttgtccagtctccgggcactcagaaaagaatttgtccccttcctccttaactttctgagagagcagtccagccgggttttacctcaagggcctccgactccagctaagacccctggagcaagcgcagcactgcccggaaggccgggagggccgcccagaggctcacgtggcgcgaggtctcagcttttcccgccgacagaggcccagagcaccgcagcggaagctccactcgctcgaagaggagggcggcgtcgaggacctggtccagcccgcgagcgaggcggccgtggactggaggaaggcgtatcgggagaatccctgcctggcgccggtggtcgtagacttcgcggtagtggtagcccatcccggcccagtctgacgctctctgacccacctaacctatcaaaccttgaggaatttccccccgttggctccgtgccaccaggtccaactgagactcaactgagctgtcgccgctgggtgcctaggcgcctgtggggagtgagccacagcagtagcgcactgagatctggagcccccggatgtagaaccaagccctcccgccgaattaatccgactcctgtgagcgaggaaaggtcactgtcaaaaccaaaaacatgctttaccagcccccccatcagttgtgtgccatcttccaagcagcttcagcagtcccccacacctacatgtcccaccccagagctcgggtcaccgcttccgtctagaaccggatccctgaccgacgagcccgcagatccggcccgagtgagttccaggcaaaggctggaactcgtcgccctggtgtactcctcctgcatagctgagaacctcgtgccgaacctgttcttggagctttttttcgtgtttcaactcctgaccgctcggcgtatggtaaccgctaaagatagtgaccccgagctatccccagctgttctcgattcattagagagtccactgttccagtctatccatgactgcgtcttttttgccgtacaggtgctcgaatgccatttccaggtcttgtcaaatcttgataaggggactctcaaactcctggctgaaaatgagcgcctcctttgctttagccccgctctgcagggacggctgagagccgcttacgaaggttccgtggcaaaggtaagtctagtcatgcctccaagcacacaagctgtgtctttccagcctgagacggacaacagggcaaattttagctccgatagagcttttcacacattcaagaaacaaagagacgtgttttatgaagtgttgcgtgagtgggaggaccaccacgaagagcccggatgggactttgagaagggcctggggagcagaatccgcgccatgatggggcagctgagcgccgcctgctcacattctcattttgtccgattgttccagaagcagctgctgcagatgtgtcagtcacctgggggtgcaggcgggactgtgttgggggaggccccagatgttttatcaatgttgggcgccgataagctgggtagactttggcgtctccaggagcgtctcatggcaccccagagtagcggaggtccctgtccaccacccacttttccgggatgccagggattctttcgggattttatattgtcagcttccagtttccagttcaaccagcacttgatggactccctcagcttaaaaatacaggaactgaatggactggcattgccccagcacgagcccaacgatgaggatggcgaaagcgacgtggattggcagggagaacggaaacaatttgctgtggtactcttgtcactgaggcttttagccaagttcttagggttcgttgcatttctgccgtaccggggcccagagcctcctcctaccggggagttgcaggacagcattcttgccctccggtctcaggtgcccccagtgctagatgttcgcactctgctgcagcgcgggctccaggcaagacgcgctgtgctgaccgttccctggttggtcgagttcctcagtttcgcagatcacgtggtgcccttgctggagtattaccgggatattttcacacttctactacgattacataggtcactggttttgagccaagagtcggaaggcaagatgtgttttctaaataagcttcttcttctggcagtactcggatggctgtttcagattccgaccgtcccagaggacttattttttctcgaagaagggccatcttatgcctttgaggtcgatactgtggccccagagcacggcctcgataacgccccagtggtagatcaacagttgctatacacctgctgcccttacatcggggagctccggaaacttcttgcctcctgggtctccggatcctctggccgcagcggcgggttcatgcgaaagataactcctactaccacgacctctctgggagcccagccttcgcagacatcacagggcttacaggctcagcttgcccaggcattctttcataaccaacctccttccctaaggcgaaccgtcgagttcgtggccgagcgaattggctccaattgcgtgaaacacatcaaggccactctggtagctgacctcgtgcgtcaggccgagtctcttttgcaggagcagctggttacccaaggagaagaaggaggagatcccgcccagctgttggagatcttgtgtagtcagctgtgtccccacggcgcccaggctctggctctaggtcgtgaattctgccaacgtaaatcgcccggcgcagttcgagctctgctgcctgaggaaacacctgcagctgttctttcatccgcggaaaacattgccgtgggcctagccaccgagaaggcctgtgcatggcttagcgctaacatcaccgcactgatccggagagaggtgaaggcagctgtatcccgcaccctcagggcccagggtccggaacctgctgcacggggcgaacgacgagggtgttctcgggcttgcgagcaccatgctccactcccttcccacctgatctctgagatcaaagatgtcctgagcctggctgtcggtcctagagaccccgatgagggggtgtcgcccgaacacttagagcagctactgggccagttggggcagacgctgcgttgcagacagttcctgtgtccacccgcagaacaacatctcgctaagtgcagtgtggagctcgcctctttactggtggcagatcaaattcctatactcggaccaccagcccagtaccgcctggaaaggggccaggctcggcgcctcctacacatgctgttgtcactctggaaggaggacttccaaggacctgtccctctccagctgttgttatcccctaggaatgtggggctcctcgcggacacccggcctcgggagtgggatctgctcctgtttctgttgcgggaactggttgagaagggtttaatggggaggatggagattgaggcgtgcctgggctctctgcaccaagcacagtggcccggcgacttcgccgaggaactcgccacactgtcaaacttatttcttgccgaaccgcatctcccggagcctcagctgagggcatgtgaattagtgcaaccgaaccgaggcactgtgctcgcccagagctag

SEQ ID NO: 183768 - DNA, 3684 bp, Artificial Sequence
  Description of Artificial Sequence: Synthetic coding sequence
atggccgccgtgctggagagcctgctgcgggaggaggtgagcgtggcggccgtggtaagatggatcgcccggtcaacgcagggaagtgaggataacgcaggggaggcagctgccttatcatcacttagggcactgcggaaagagtttgttccatttctgttgaattttctgcgcgagcagagcagtcgagtcctaccccaggggccccctacccccgcaaaaacacctggagcaagtgcagcgctacctggcaggccaggtggcccccccagaggcagcagaggggcacgctcccagcttttccccccaaccgaagctcagtccactgcagcagaggcccctttggccaggcgagggggccggcgtcgaggcccgggtccggcaagggaaaggggcggcagaggactagaggaaggagtctctggcgaaagcctcccaggcgctgggggccgacgcctgcgcggttctggttccccgagtcggccctcccttaccctatctgatccaccaaacctatccaatctggaagagttcccacccgttggctcagttcctcccggacccacaggtaccaagcctagccgaagaattaatccaaccccggtgagcgaggagaggtccctgtcaaaacctaagacatgcttcacctccccaccaatcagctgtgtcccatctagccaaccatcagcgctcgacacctctccctggggactgggtctcccacccggctgtaggtccctacaggaggagcgagaaatgctgcgtaaagagaggtccaagcaactacaacagtctccaactcccacctgtcctactccggagctgggctcccctctgccctccaggaccggaagtctgaccgatgagcctgctgatcccgctcgggtgagttctaggcagaggttggagctcgtggctctggtgtactctagctgcatcgcagagaatctggtacccaatctcttcctggagcttttctttgtatttcagctcctcaccgcacgcaggatggtgacagcgaaggactctgaccccgagctgagccccgcagttttagactcccttgagtcaccactatttcagtctatccacgattgtgtattctttgcggtccaggtcctggagtgccatttccaggttctttccaacctggacaaaggcaccctgaaattattggccgaaaacgagcgtctcttgtgcttctccccagcccttcaaggtcggctccgagcggcttacgaaggcagtgtagccaaggtttccctagtgatgcctcctagtactcaggctgttagctttcagcccgaaaccgacaatagggctaacttcagcagcgatagagccttccacacctttaagaagcagagagacgtgttctacgaggtgcttagagagtgggaagaccaccacgaagagcctggctgggacttcgagaagggcctggggtcccgcattagggctatgatgggacagctcagcgccgcctgttctcattcccactttgtaagactgtttcaaaaacagcttcttcagatgtgccaaagtcctggcggcgccggcggcaccgtgctcggggaggcccccgatgtattatcaatgctgggtgctgataagcttgggcgtctgtggaggctgcaggaacggttgatggcaccacagtccagtggtggtccctgcccccctccaacattcccagggtgccagggattcttcagagacttcattctgtccgcttcctcttttcagtttaatcagcaccttatggactctctttctctgaagatccaagaactgaacgggctcgccttaccccagcacgagccgaacgacgaggatggtgagagtgacgttgattggcagggcgagaggaagcagttcgccgttgtgctcctgagcttaaggttgttagcaaaatttctcggcttcgttgccttcctgccttacagagggccagagcccccgcccaccggagagctgcaggactcgattctggcattgaggtcccaggtacctcccgtgctggacgtgcgaacattgttgcaaaggggccttcaagctcgcagggcagtcctcacagtaccttggctagtggagtttctctcgtttgccgaccatgtcgttcctctgcttgaatactatagagacatatttaccttgctactgaggctgcatcggtctctagtactctcacaggagtctgaggggaaaatgtgcttcctcaacaagttactcttactcgctgtattaggctggctgttccaaatccctaccgttccagaggacttgttttttctcgaggaggggcccagctatgccttcgaagtcgacacggtagcccctgaacatggcttagacaacgcccccgtggtggaccagcagttactctatacttgctgtccctacatcggcgagctgcggaaattgctggcctcttgggtctccggatcttcgggcaggtcagggggtttcatgaggaagattactcccactacaaccactagcctcggcgcacagccctcccaaacatcccaaggcctgcaggcccagctggcgcaggccttcttccacaaccaaccccccagcctcagacgcacggtggagtttgtggcggagaggattgggagtaattgcgtcaagcacattaaggctaccttggtggccgacctggtgaggcaggccgagtcccttcttcaggagcagctagtcacacagggagaagaaggaggagaccccgcccagctcctggaaatattgtgcagccaactgtgcccacatggcgcccaggccctggcgctcggcagggaattttgccagcggaagtcccctggtgctgtacgcgctttgttaccagaagagactccagcggctgtgctttccagtgctgagaacattgcggtggggctcgcaacggaaaaagcctgtgcctggcttagcgccaacattactgccctcattagacgtgaggtcaaagctgctgtgagtcgcacgctgagagctcagggtcccgagcccgcagcccggggtgagagaaggggatgttcacgtgcttgcgagcaccacgccccactgccctcccacctgataagcgaaatcaaagatgttctgtctctggctgtggggccacgggatcctgacgagggcgtgtcacctgaacatctcgagcagttacttggacagctgggccagactctcagatgccgccagttcctctgccccccagccgaacaacatctcgccaaatgttccgtagagttagcttccctcctggtggctgatcagattcccatcctggggcctcctgctcagtaccgattggagagaggccaggctcggcgcctgctccacatgcttctgagcttgtggaaggaagacttccagggccctgttcctttacagctgctcctgagtccgagaaacgtgggccttctggcagacaccaggccacgcgaatgggacttgctgttgttcctgctcagagagcttgtggagaaagggctcatgggtaggatggaaatcgaggcatgtttgggctcactacaccaagcccagtggccaggggatttcgcggaggaattagcaaccctgtcgaacttattcctggcagaaccccacttaccagaaccacaactgagggcatgtgaacttgtccaaccaaataggggcaccgttttggcacagtcttag

SEQ ID NO: 183769 - DNA, 2697 bp, Artificial Sequence
  Description of Artificial Sequence: Synthetic coding sequence
atggccctgatcatggagcccgtgagcaagtggagccccagccaggtcgtggactggatgaaaggcttagacgactgcctacagcagtatattaagaacttcgaaagggaaaagattagtggtgaccagcttctgcgtataactcatcaggagcttgaagacctaggggtctctcgaattggacaccaggaactcatccttgaagctgtggacctactgtgcgccctgaattacggcttggaaacagagaacctgaagaccctgagtcacaagctcaatgctagtgccaagaatcttcagaattttattactggtcggagaaggtccggccactatgacgggcgtacttccaggaagcttccgaatgacttcttaaccagcgttgtggatttgatcggcgccgctaaatctcttctagcctggttagataggtccccttttgctgcagtaaccgattattccgtgaccagaaataatgtgatccagctctgcttggagctaacaacaatcgtccagcaagactgtaccgtttacgaaacagagaataaaatcctacacgtctgcaagactctcagtggcgtgtgcgatcatattatttccctgagtagcgatcctcttgtgagtcaatccgcacaccttgaggtaattcagctggctaacatcaaaccctcagaggggctgggaatgtatataaagtccacttacgatggcctccatgtcataactggaaccactgaaaacagtcccgcagaccgctgcaaaaagattcacgctggtgatgaggttatccaggtcaatcaccagacagtggttggctggcagttgaaaaacctcgtcaacgctctgcgggaggacccaagtggcgtgatcctcaccttgaaaaaaaggccgcagagtatgctgacgtctgcgccggcactcctcaaaaacatgcgttggaaacccctggccctacagcctctgattccaagaagtcccacctcatccgtcgctacaccatccagcaccatttctacacctactaagcgcgactctagcgctctgcaggatttgtacattcccccacctccagcagagccctacattccccgcgacgaaaagggaaatttgccatgcgaggacctgcgcggacacatggtgggcaagcccgtacacaaagggtctgaaagccccaatagctttctggaccaggaatataggaagcggttcaacattgtcgaagaggatacagtcctttattgttatgaatacgaaaaggggcggtcttcctcccagggcaggagagagagtacacctacttacggtaagctgcgccctatcagtatgcccgtggaatacaattgggtgggcgactatgaggatcctaataagatgaaacgagacagcagacgtgaaaatagcctcctcagatatatgtccaatgaaaagattgcacaggaggaatatatgttccagcgaaatagtaagaaagatacaggaaagaagagtaagaaaaaaggcgacaagtctaattcacccactcactacagcctgctgccctcattacagatggatgccctgcgccaggacattatgggcactccagtccccgagacaactctctatcatacttttcagcagtcctcactccaacataagtccaagaagaaaaacaaaggtccaatagccgggaagtcaaaacgccgcatctcctgtaaggacctgggccgaggggactgcgaaggctggttgtggaagaagaaggatgcaaagagctactttagtcagaagtggaaaaaatattggtttgtgttgaaggacgcttcactctactggtacatcaacgaagaggacgaaaaagcagagggattcatcagtcttcccgagtttaaaatcgacagggcgagcgaatgcagaaaaaagtacgccttcaaagcatgtcatccaaagattaagtctttttacttcgcagcggagcatctcgacgacatgaacagatggctcaaccggataaacatgctgaccgccgggtacgctgagcgcgaacggatcaagcaagaacaggattattggtcagagagcgacaaggaagaggcagatacaccttcaacacccaaacaggactcaccacccccaccctatgatacttatccgagacccccgagcatgtcatgtgcctccccatacgtagaagccaaacactccagactgtcatccactgagacgtcccaatcacagtccagccacgaggagtttcggcaggaggttaccggatccagcgctgtttctccgatcaggaagaccgcaagccagagaagatcctggcaggatctgattgagacacctctgacctcatccggactgcactatttacagacactgccccttgaggacagtgttttctcggattccgcagccatctctcccgagcaccgacgacagtctaccctacctacccagaagtgtcatctgcaggatcactacgggccatatcccctggcggagtccgaacggatgcaggtcctcaacggcaatgggggaaaaccaaggtcttttactctgcctcgtgatagcggattcaaccactgctgtctgaatgcccctgtctccgcctgtgatccacaagacgatgttcagcctccagaggtagaggaagaagaggaagaggaagaggaagagggggaagcagcgggggagaacataggcgaaaaaagctag

SEQ ID NO: 183770 - DNA, 3105 bp, Artificial Sequence
  Description of Artificial Sequence: Synthetic coding sequence
atggccctgatcatggagcccgtgagcaagtggagccccagccaggttgtggattggatgaagggactggatgattgtctacagcagtatattaaaaactttgagagagaaaagattagcggcgaccagctacttagaataacgcaccaggagctggaagacttgggagtttcccggattggccaccaggagctgattctcgaggctgttgacctgttatgtgcgctgaactacgggctcgagactgaaaacctgaagactctttcacataagcttaacgcgtctgcaaagaatctacagaattttatcacaggaagacgtcgttccggccactatgacggtaggacttcacgtaaattgccaaacgattttctcacctcagtcgtggatctgatcggcgctgccaaatctctgctggcatggttggatcgctctccctttgctgccgtgacggactactctgttactaggaacaacgtgatccagctctgcctcgagttaactacgatagtccagcaggattgcacagtttacgagaccgagaacaagatactgcacgtctgcaaaaccctgtcgggggtatgtgatcatatcatctccctatcttccgatccactcgtatcccagtccgctcatcttgaggtcatacaactggctaatattaaacctagcgaaggtctggggatgtacatcaagtctacatacgatggcttgcacgtgatcacgggcaccacagagaactctcccgctgataggtgtaagaaaatccacgctggcgacgaggtgattcaggtcaatcatcagacagtagtaggatggcagcttaagaatttggtcaatgctctacgagaagacccatctggggtgattctgacactgaaaaagcggccacaatctatgcttacatccgccccagcactgttaaagaatatgagatggaaaccgctggcccttcagcctttgattcctaggagtcctacaagctcggtggcaacacccagttctaccatatctacccccactaaacgggatagctctgctctgcaagatctgtacattcccccaccccctgccgagccatatattcctcgggacgagaagggaaacctgccgtgtgaggacctgcggggtcacatggttgggaagccggttcacaaaggctccgagtctcctaattcattcctggaccaggagtatcgtaaacgctttaacatcgtcgaggaagacactgttctgtactgctatgagtacgaaaaaggccggtcctctagccaaggcagaagggagtcaacgcccacatacggcaagctgcgccccattagtatgcccgtggagtataactgggttggagattatgaagatcctaacaaaatgaagagggatagtaggagagagaatagtctgctgcgctatatgtccaacgaaaaaattgcacaggaagagtatatgtttcaacgcaacagcaaaaaagatactggtaaaaagagcaagaaaaaaggtgataagtccaactccccaactcactacagcctgcttccctccctgcagatggacgcccttagacaggatattatgggcactcctgtgccagaaactaccctgtaccacactttccaacagagctcccttcagcataaatcaaaaaagaagaacaagggacccattgcaggtaaatccaagaggagaatatcctgtaaagacctggggcgcggggactgcgagggttggctgtggaagaagaaggatgcaaaatcctactttagtcaaaaatggaagaaatactggtttgtcctcaaggacgcaagcttatattggtacattaacgaagaggacgagaaagctgagggtttcatctccctgcccgagttcaagattgaccgagccagcgaatgtcgaaagaaatatgcttttaaggcttgccaccctaaaattaagagcttctatttcgccgccgagcacctggacgacatgaacagatggctcaaccgcatcaacatgcttacagcaggttacgccgagagagaacgaatcaagcaagaacaggattactggtccgaatccgacaaggaggaagcagacactccttcgacacctaaacaggactcacccccccctccgtacgacacttacccgcggcccccaagcatgtcgtgcgcttccccctacgtggaagcaaagcactctaggcttagctctacagagacatcacaatcccagtcaagccatgaggaattccggcaagaggtgacaggatcctctgcagtcagcccaattagaaaaaccgcatcacagcgacgatcatggcaagatttgattgaaacccctcttacatcaagtggactgcattacctgcaaactcttccactggaggatagtgtgtttagcgattccgcagctatctcaccagagcataggcggcagtctacactgccaactcagaaatgccacctacaggatcactacggtccctatccattggcagagtctgaacgtatgcaggttctcaatggtaacggtggcaaaccaagatccttcactttaccacgggatagcggtttcaaccactgttgtctaaacgcccctgtcagtgcctgcgacccgcaggatgatgtgcagccgcctgaagtggaggaagaggaagaagaagaggaagaagagggagaggccgccggtgagaatattggcgagaagtcggagtcccgggaggaaaagctgggggatagtttgcaagacctttaccgtgccctggaacaggcgagcttgtccccactgggtgagcaccggatatccacaaagatggagtataagcttagctttatcaagaggtgtaatgatccggtgatgaatgagaagttgcaccgactacgcattcttaagtctaccctgaaagcccgggaaggcgaagtggctattatcgacaaggtcctagacaatccagatcttacatcgaaggaatttcaacagtggaaacaaatgtacctggacctgttcttggatatctgtcagaacacaactagtaatgatcccctcagcatcagttccgaagtggatgtgatcacctcatcactcgctcatacgcactcctatatcgaaacacacgtgtag

SEQ ID NO: 183771 - DNA, 3015 bp, Artificial Sequence
  Description of Artificial Sequence: Synthetic coding sequence
atggccctgatcatggagcccgtgagcaagtggagccccagccaggtggttgattggatgaaggggttggacgattgtctgcagcagtatatcaaaaattttgaacgggaaaagatctcgggagaccaactgctcagaattacacaccaggagcttgaggacctgggcgtgtctcggatcggccatcaggaactgatactggaggctgtagatctgctctgcgcgttaaactacggactggagacagaaaaccttaaaacactctcgcataagctcaatgcttctgcgaaaaatttgcagaactttatcactggccggcgacgttccggccattacgacggacgcactagtcgcaagctgccgaacgatttcctcacatctgttgtggaccttatcggtgctgccaagtctttgcttgcctggctggacagatctcctttcgctgccgtcactgattactcggtcaccaggaacaatgttattcagctgtgcctggagcttaccacaatcgtccaacaagactgtactgtatatgagactgaaaacaagatccttcatgtttgcaaaaccctgtccggagtctgcgatcatataatatcactgtcttccgatcccctggtgtcacagagtgcccacttggaggttatccagcttgctaacattaaaccctccgaaggcctgggcatgtacattaaatcgacctatgacggacttcatgtgattactggaacaaccgaaaactctcctgccgaccgctgcaagaagattcatgcaggtgatgaagtgatccaggtaaaccaccagaccgtcgtagggtggcagcttaagaatctggtgaatgcccttagagaagatccctctggggtcatcctaacgttgaagaagcggccccagtcgatgctaacctcagcccccgccttactgaaaaatatgcggtggaaacccctggctctgcaaccactgatcccccggtctccaacctcatcagtggctacaccttcaagcacaattagcacccctactaagcgagacagctctgccctgcaggatttgtatattccgcctccaccagcggaaccctatatcccgagagacgagaaaggcaatctgccatgtgaagacctcaggggacacatggtaggaaaaccggtacataagggttctgaatcgccaaattccttcctggaccaggagtaccgtaagcgcttcaacatcgtcgaagaggatacagtgctttactgttacgagtatgaaaaggggcggtcgtcttcccagggacgcagagagagcacgcccacgtacgagaatagtctcctccgctacatgtcaaatgaaaaaatcgcccaggaggagtatatgttccagcgaaacagcaaaaaagatacagggaaaaaatcaaagaaaaaaggagacaaatctaactcgcccacgcactacagcctgctgccctcactgcaaatggacgccttacgccaggatatcatgggcacccccgtgcccgaaacgaccctttaccatacctttcaacagtcttcactccagcataagagtaagaagaaaaacaaggggcctatcgctggcaagtcgaagcgcagaatctcatgcaaggatctcggtcgcggtgattgtgaaggctggttgtggaagaagaaagacgcaaaaagttatttttcacagaaatggaagaaatattggttcgtgctgaaggacgcatccctgtactggtatattaatgaagaagatgaaaaggccgaaggctttatctcacttcccgagttcaagatcgacagagcttcggaatgccggaagaagtacgctttcaaagcatgccacccaaaaattaagtccttctattttgcagctgagcacctcgacgacatgaacagatggttgaataggattaatatgctgacagctggctacgctgagcgagagaggattaagcaggagcaggattattggagcgaaagcgacaaggaagaagctgacacacccagcacaccaaaacaggactctccaccccccccatatgatacctaccctcgcccacccagtatgagctgtgccagtccttatgtggaggctaagcactccaggctgtctagcacggagacctcccagagtcagtcgtcacatgaggaattccgccaggaggtcaccgggagcagcgcagtttctccaatcaggaagacggcgtcccaacggcgctcgtggcaagaccttattgaaaccccactgacttctagtggactccattatctgcaaacgctgccccttgaggatagcgtattctccgatagcgccgccatttctccagagcatcgacggcaatccacccttcctacgcaaaaatgccatctgcaggaccattatggcccctatcctctggcagagagcgaaagaatgcaggtgctcaatggcaacggtggcaagccacgcagcttcacccttcccagggactctggcttcaaccattgttgtcttaatgctcccgtttctgcttgcgacccacaggacgacgtgcaaccgccagaggttgaagaggaggaggaggaagaagaggaagagggcgaggccgcaggggagaacatcggcgagaaatctgagtctcgggaagagaaattgggggacagccttcaggatttgtatcgggcccttgaacaggcatctttgtcacctttaggtgagcacaggatatctactaagatggagtataagctctccttcatcaaaaggtgcaatgatcccgtaatgaatgagaaactgcacaggctccgcatcttgaagagtacacttaaagccagggaaggggaggtggccattatcgataaagtgcttgacaaccctgacctaaccagcaaagagttccagcagtggaaacagatgtatctcgacctgtttctggacatttgccagaataccacaagtaacgatccactctctatcagctcggaagtcgacgttatcacatctagcctggcccacacccacagttatatcgaaacgcatgtgtag

SEQ ID NO: 183772 - DNA, 2550 bp, Artificial Sequence
  Description of Artificial Sequence: Synthetic coding sequence
atggccctgatcatggagcccgtgagcaagtggagccccagccaggttgtcgactggatgaaaggactggacgattgcttgcagcagtatattaagaactttgaacgtgaaaagataagcggagaccagctgctacgaattacacaccaggagctggaagatcttggcgtgagtcggatcggccaccaggagctgatccttgaagctgtggacctcctgtgtgccctgaactacggcctggaaaccgagaatctgaaaactctgtctcacaagctcaacgccagtgctaaaaacctgcagaatttcatcactggtcggcggaggagtggccactacgatggtaggaccagtcggaagctgccaaacgattttctaacgagtgtcgtggatctgattggtgctgccaagagtcttttggcctggctcgacaggtctccattcgctgccgttaccgattacagcgtgacacgcaataatgtgattcaactctgcctggagctaacgacaatcgtacagcaagactgcacggtctatgaaactgagaataaaatattacatgtgtgcaagactctgagcggagtttgcgatcacattatcagcctctcgtctgatccccttgtctcacagagcgcgcacctggaagtcattcagctggcaaacattaagccctccgaaggcttaggcatgtatataaagagcacttatgatgggctccatgttattaccgggacgacagagaactcacccgcagaccgctgcaagaagattcacgcgggggatgaagtgatccaagtgaatcatcaaactgtcccactgatcccgcggtccccaacaagttccgtggcaaccccctcttccaccatctcaacccccacaaaacgcgactcctcggcgctccaggatctatatattccacctcctcctgccgagccgtatattccgcgcgatgagaaaggcaacttaccttgcgaagatctccggggccacatggttggaaagcctgtgcacaaaggatcagagtctcccaatagcttcctcgaccaagaataccgcaagcggttcaatattgtggaagaagataccgtattgtactgctatgagtacgagaagggccggtccagtagccaaggacggagagaatcaactccaacgtacggtaagctgcgcccgatctctatgcctgttgaatacaattgggtcggagactacgaggaccctaacaaaatgaagagggactctaggcgtgagaactctttgctccgctacatgtccaatgaaaaaatcgcccaggaagagtatatgttccaaagaaacagtaaaaaagatactggcaaaaagtccaagaagaaaggagataagtctaactcacccacacattattccctcctcccttcgctgcaaatggacgcactgaggcaagatatcatggggactccagtacctgagaccacactttaccatacattccaacagtcttcgctgcagcacaagtcgaagaaaaagaacaaagggcccattgcaggcaagagcaaaaggagaatcagctgcaaggacttgggtaggggtgattgtgaaggctggctgtggaagaagaaggacgccaaatcctacttttcccaaaagtggaaaaagtattggttcgttctgaaagatgctagcctttattggtatataaatgaggaggatgagaaggctgaagggtttatttccctccccgagttcaagatcgaccgcgcatctgagtgtagaaagaagtatgcatttaaggcttgtcaccctaagatcaagtccttttattttgccgccgaacatctggacgacatgaatcggtggctgaacaggattaacatgctgactgccgggtacgctgaacgtgaaagaataaagcaggaacaggattactggtctgaatcagataaggaggaagctgataccccttctactcccaagcaggattcccctccgccaccctacgacacctatccacggcccccttcaatgagttgcgcttctccctatgtggaggccaagcactcccgcctcagttcaaccgagacatcccagtcacagagctcacacgaggagtttaggcaggaggtaacagggagtagcgctgtgagtccaattaggaaaacagcttcccagagaagatcttggcaggacctcattgagactcccctgacaagctccggcctgcattatcttcagactcttcccctcgaagacagcgtgttttccgatagtgctgccattagcccagaacaccggagacagagcaccttacctactcagaaatgccacctgcaggatcattatggcccatatccactggcggagagtgagaggatgcaagtgctaaatggaaacgggggcaagccccggtctttcacactaccccgggactctggtttcaatcactgctgcctaaacgcccccgtgagcgcttgcgacccccaggacgatgtgcagccacccgaagtggaagaggaagaggaggaggaggaggaggaaggagaagcagcaggagaaaatataggtgagaagtcttag

SEQ ID NO: 183773 - DNA, 414 bp, Artificial Sequence
  Description of Artificial Sequence: Synthetic coding sequence
atggacgacagcgacacccccacctactacctgcagatcgagccccaggatggttgccatcccggcgattctgtcgaacgaagcgtgacctgtctaccttctgctagcgacgaaaatgagaatcaactggatggtgacgggcacgagcatctcacatccagcgacagcgccatggggaagccacaggtttcagaacaggactccctcaacaacaatgagtcttgtaccttgagctgtgaggtcgctgctggtgaaaacctgcagaacaccctgtgcgaagctagtagggacgagcaggccttcctgggcaaggacaaaaaaatacctggaaaaagatcccctcgttccaaaaagggaacagccaagaaaattcctcctgactctcgcatcttatttcctggggggggcctgtag

SEQ ID NO: 183774 - DNA, 1851 bp, Artificial Sequence
  Description of Artificial Sequence: Synthetic coding sequence
atggacgacagcgacacccccacctactacctgcagatcgagccccaggacgggtgccaccccggcgactcagtggagcgcagtgttacctgcctcccttcagcttcggacgagaacgagaaccagttagacggagatggacacgagcacctaactagcagcgactcggcgatggggaagccccaggttagtgagcaggattccctgaacaataacgaaagttgtactctttcatgcgaggtcgctgccggtgaaaatctgcaaaacactctttgcgaagcctcacgggacgagcaggccttcctcgggaaggataagaagatacctggcaagagatctccgcgaagcaagaagggtaccgctaagaagattcctcccgggctgttttcaggcgatatcgctcctctcatgcaggaaaaggtcctctccgcagtcacctacgccgtggatgacgaggaggccgcggaagtcaacgccaacgaacaacctgaagcccctaagttagttctacagtctctgttcagcctgattcgtggcgaagtcgaacagttggactccagagctcttcccttgtgcctgcaccaaatcgctgagagttattttcaggaggaggactatgaaaaggccatgaaatttatacagctagagcggctgtatcacgaacagctcctggcgaacctgtcagccatccaagagcagtgggagacaaagtggaaaaccgtccaacctcataccgtgacggcgttgaggaactctgaaaagggcttcaatggggaagactttgagaggctgactaagatctgtgccacacatcaggatccgttactttctaagcacaaaatcgcggcagtggaaaagagccaggagcgaaaatgctccactcagctgctggtttccgaagaccccaaagaagggggggccactaccaaagaatctgaatcaaagacttgtctcggcactgaatcttccaaagagtcccagcatacagtcgaaccgctgggcagctccccttgttgccatcagatggacgttcagactgactccccctctctcagcgtgacagctggcaaagatcacatggaggaacttctctgttcagccgaggccacgctagccctgcacacccagtcgtcagagacagcagggtcccccagtggccccgattcctcagaagatgcctgcgaagatgactcacggctgcaactcgcgcagacggaagcctgccaggatgtcgctagaatcgagggcattgccgaagatccaaaggtctttctgagcagtaagtctaagacggagcctcttatctcccccggctgcgatagaattccccctgctcttatttccgaagggaagtattctcaggctcagagaaaggaattgcggctccctctgagagacgcctcagaggccttgcccactgaccaactggagaataacgagctcaatgagctgcagcagcccgacctcacggattctgacggaaagtcccctcaagcccaggcggactctgatggcagcgagaacgtgctctgtggtaacaatcagattagcgatctaggcatcctgttacccgaggtctgtatggccccagaggagaagggtgataaagacgaccagctcaataaagagactgaggactacctgaactcactgctcgagggatgcctgaaggatacagaggactctctctcctatgaggataatcaggacgatgacagcgacctgctgcaggatcttagccccgaggaggcttcctactctctgcaggaaaatcttccatcagacgaatcttgcctgagcctcgatgacctcgccaagagaatagagatcgcagaggtgaatcagcgctag

SEQ ID NO: 183775 - DNA, 2178 bp, Artificial Sequence
  Description of Artificial Sequence: Synthetic coding sequence
atggacgacagcgacacccccacctactacctgcagatcgagccccaagatggctgtcacccaggtgattccgtggaacgaagcgtaacatgccttccttctgcgtccgacgaaaacgaaaatcagcttgatggtgatgggcatgaacacttgacttcgagtgattcagccatgggcaagccccaagtttcagagcaagacagtcttaacaataacgagtcttgtacgttaagttgtgaagtagccgcaggcgagaatttacagaacaccctgtgcgaggcgtctagggacgaacaggccttcctgggtaaagataaaaagatccccggtaaaagaagtccacgcagcaagaaaggtaccgctaagaagattccaccaggtcttttctctggagatattgcaccgctgatgcaagagaaggtgctgagcgctgtgacatatgccgttgatgacgaggaggctgctgaggtgaacgccaacgaacagcctgaagctcccaaactcgtactacaaagcctgttctctctgatcaggggtgaagtagagcagctggacagtcgggctttgcccctttgcctacaccagatagctgagagctattttcaggaagaagattatgagaaggccatgaagttcattcagctcgagaggttatatcacgagcaactattagccaacctgtcagctatacaggaacagtgggaaacaaagtggaaaactgtccagcctcatactgtgaccgcactgaggaattcagaaaagggattcaacggtgaggattttgaacggcttactaaaatttgcgccacccatcaagatccactgttgtctaaacacaagattgcggccgtggagaagagccaggagagaaagtgttctacacagctgctggtctctgaagatccgaaagaggggggagccacgaccaaggaaagcgagtccaagacctgtttaggcacagagtcctctaaagagagtcaacacactgtggaaccgttaggttcctcgccttgttgtcaccagatggacgtgcaaacagacagtccaagtcttagcgtgacagctgggaaggaccacatggaggaactgctatgctccgcagaagcgacactcgcccttcatacacagtcatctgaaacagccggctcccccagcggccccgactcaagcgaagacgcatgtgaggatgatagccggttgcagctggcccaaacggaagcctgccaggacgtggcaagaatcgaaggtatcgccgaagaccctaaggtgtttctgtctagtaaatccaaaacagaaccattaatctcccctggttgcgacagaattccccccgctcttataagcgaaggaaaatacagtcaggcccaaagaaaggaactcagactgccgctacgggatgcctccgaagccctgccgacagaccagctggagaacaatgagttaaacgaactgcagcagcccgatttgactgacagtgatggtaagtctccacaggcccaggcagacagtgatggctctgagaatgtcctctgcggcaataatcagatctccgacttagggatcctcttgcccgaagtctgcatggcccccgaggagaagggagacaaggatgaccagctgaacaaggagaccgaggactacctgaatagcctgctcgaagggtgcttaaaggacaccgaggatagcctgtcgtatgaagacaaccaggatgacgactcagatctgcttcaggacctttcacctgaagaagcctcatactcccttcaagagaatctcccatcagatgagtcctgtcttagcctggacgaccttgctaaacgaatcgagatagccgaggttgtgccaaccgaaggcctggtgtctatactcaagaagcgcaatgatacagtgggagaccaccccgctcagatgcaacacaaaccctccaagcgacgcgttaggtttcaggagatcgacgactcactggaccaagatgaagtggggggaggctcttgcattctgctagtgttgctttgtatcgccaccgtgttcctgtctgtggggggtacagctctgtattgcaccttcggcgacatggaatcacctgtgtgtactgatttcgcagacaatatggatttctactacacgaagcttcttcaaggagtggccgagttaaaacattggatctatctgtcatag

SEQ ID NO: 183776 - DNA, 3057 bp, Artificial Sequence
  Description of Artificial Sequence: Synthetic coding sequence
atgaagatgtggctgctggtgagccacctggtgatcatcagcatcaccacctgccttgctgaattcacctggtaccgccgctacggtcatggggtttcagaagaggacaaggggttcgggccaatctttgaggagcaacccataaatacgatatatccagaagaaagtcttgagggtaaggtctctctgaattgccgcgctagagcttccccattccccgtctacaaatggagaatgaataatggagatgtggatcttacatccgatcgatacagtatggtaggtggcaacctggtcatcaataaccctgacaagcaaaaggatgcaggtatttattactgtctggcatcgaacaactacggtatggtgaggtctactgaggcaaccctttcatttgggtaccttgatccatttcctcccgaggaaaggccagaagtaagagtgaaggaaggtaaaggcatggtgctgttgtgtgacccaccttatcattttccagacgatctctcttatcgatggctcctgaatgagttcccagtcttcatcaccatggacaaaaggcgatttgtttctcagacgaatggcaatctgtatatcgctaatgtggaagcatctgacaaagggaattactcctgtttcgtcagttctccatcaatcactaagtccgtgttctccaagtttattcccctgatccccataccagaacggaccacgaagccctaccctgctgatatcgtggttcagttcaaagatgtgtacgccctcatgggccagaacgtgaccctggagtgcttcgcgctcggaaatcctgttccggatattaggtggcggaaggtccttgagcctatgccttctaccgctgagatttccacaagtggagccgtcctgaaaatcttcaacatacaactggaggacgaaggaatctacgagtgcgaggccgaaaatatcagaggtaaagataaacatcaggcacgcatctatgttcaagcttttccggaatgggtggaacacatcaatgataccgaggtggatattggcagcgacttatattggccatgcgtggctaccgggaagccaatcccaaccatccgctggttgaagaatggctacgcctatcataaaggagagttgagactgtacgatgtgacatttgagaacgctgggatgtaccagtgcatcgcggagaatacatatggggcaatttatgcaaatgccgagctgaaaattcttgcccttgcacccactttcgagatgaaccccatgaagaagaaaatcctagccgctaagggcggcagagtaatcattgaatgcaaacccaaagctgccccaaagccaaagttttcttggagtaaaggtaccgagtggctggtgaattcatcaagaatcctcatctgggaggatgggagtttagagataaacaatataacacggaacgacgggggcatctacacctgcttcgcggaaaataacagagggaaagccaactccaccggcacacttgtcatcactgatcctacaaggatcatactcgcccccattaatgccgatattactgtaggtgaaaacgcgaccatgcaatgcgccgcctcttttgacccagctttggatttgacttttgtgtggtcattcaacgggtatgtcatagacttcaacaaagagaacatccactatcagcggaatttcatgttagactcgaatggagagctgttaattagaaacgctcagctgaagcatgccggcaggtacacctgtacagcccagacgatagttgataactcttctgctagcgccgacctggtggtgagaggccccccaggcccccctggcggcctacgcatcgaagacataagggcaacctctgttgcactgacctggagcagaggtagcgataaccacagccctatctccaagtacacaatccagacaaagacgattctgtcagatgattggaaagatgcaaaaaccgatccaccaattatcgagggcaacatggaggccgcccgagcagtggacctgatcccatggatggaatacgagtttagagttgtcgccaccaacactctaggacggggcgaaccttcaattccaagcaaccgcatcaaaaccgacggggccgcacccaatgtcgccccatccgatgtgggggggggcgggggccgaaatcgggagctgaccatcacgtgggcaccgctgtcccgggagtatcactacgggaataactttggctatatcgtcgcatttaaacccttcgatggagaagagtggaaaaaggtcactgttaccaatccagataccggccggtacgtccataaggacgaaacgatgagtccctcaaccgcctttcaggttaaagtgaaggcctttaataataagggagacggtccctattcactggtggccgtgatcaattccgctcaggatgcaccgagcgaggccccaaccgaggtcggcgtaaaagtgctctctagctcagaaatttcggtgcattgggagcatgtactcgaaaagattgtcgaaagctaccagattcggtattgggcggcacatgataaggaagaggctgcaaaccgagtgcaggtcacttcccaggagtactctgctaggttggagaacctgttgccggatacccagtattttatcgaggtcggtgcctgtaactctgccggatgtgggcctcctagtgatatgattgaagcctttacaaaaaaggcacccccctcacaacccccacgaattatctctagcgtccggagcggctcacgttatatcatcacttgggatcacgtcgtggctctatcaaacgaaagtacggtcaccgggtacaaggtactctatcgccccgacggacagcatgacggaaaactgtacagcacacataaacattccatagaagtccccattccaagggatggcgagtacgtggttgaggtgcgagcacactctgatggtggggacggggtggtgagccaggtgaagatctcaggcgcacccactctgtcacctagcctgctggggttactgctcccggcattcggaattctggtctacctggaattttag

SEQ ID NO: 183777 - DNA, 3024 bp, Artificial Sequence
  Description of Artificial Sequence: Synthetic coding sequence
atgaagatgtggctgctggtgagccacctggtgatcatcagcatcaccacctgtctggctgtgtctgaggaggacaaaggcttcggacccattttcgaggagcaacctatcaatacaatctacccagaggaatcactcgaaggcaaggtcagcctgaattgcagagcgcgggcctccccttttcccgtctacaaatggagaatgaacaacggggatgttgatctcactagcgacaggtatagcatggtgggaggcaacttggttatcaataaccctgataagcagaaggacgccggcatttattactgcctggcgagtaacaattacggaatggtgaggagcaccgaggctaccctatcatttgggtacctcgaccctttcccgcctgaggagagacccgaagtccgcgtcaaagaagggaagggcatggtcctcctatgcgacccaccgtaccactttccggacgatctgtcatatcggtggctcctgaacgagttcccagttttcatcacaatggacaagcgtagatttgtatctcagactaacgggaacctgtacattgctaacgtcgaggcaagtgacaaaggcaactattcatgtttcgtttctagcccttcaattactaagagcgtgttctcaaaatttataccattaattcccatccccgagaggacgactaaaccatatcccgccgatatcgtcgttcagtttaaagacgtgtatgctttaatgggacagaatgtcactctcgaatgttttgccctgggaaatcccgtccctgacataagatggaggaaagttttggagcctatgccctctaccgccgagattagcacctctggcgctgttctcaaaatcttcaatattcaactcgaggatgaaggaatttacgaatgcgaggccgagaatatccgcgggaaagataagcaccaggcaaggatttatgtgcaggcctttccagagtgggtcgaacatatcaatgacaccgaagttgacattggatccgacctttactggccatgtgtggcgacaggcaagcccatacctactatcagatggctcaaaaatggttacgcctatcacaaaggcgagttgagattatacgatgtaaccttcgagaatgcaggaatgtatcagtgtattgctgagaatacctacggtgcaatatacgccaacgccgaactaaagattctggccttggcccctacatttgagatgaatccaatgaaaaagaaaatcctcgccgcgaaagggggacgagtcattatcgagtgcaagcccaaggccgctccgaaaccgaagttttcttggtcaaagggcactgagtggctcgtcaacagcagcagaatcctaatatgggaagacgggtctctggaaatcaataacatcacccgaaatgatggagggatctatacatgctttgctgaaaacaatcgtggcaaagctaatagtaccgggactctcgtgatcactgaccctacacgcatcatcctagcacccattaacgctgacattactgtcggagagaacgctaccatgcagtgtgccgcctctttcgacccagcactggaccttacgtttgtttggtcctttaatggttatgtgattgactttaataaagaaaacattcactatcagagaaattttatgctcgacagcaacggggagctgctcatcaggaatgcccaattaaaacacgctggacggtacacttgcaccgcccagaccatcgttgacaatagcagtgcatctgccgacctggtggtcaggggaccaccagggcctcctggtgggctgaggatcgaagatattcgggctacaagcgtggcactgacatggtcacgcgggagcgataaccacagcccaattagtaaatatacaattcagacgaagacaatcctcagcgatgactggaaagatgctaaaacggatccccctatcatcgaggggaatatggaggccgctagggcagtggacctaattccttggatggagtacgagtttcgtgttgttgcaaccaacaccctggggagaggcgaaccatcaatcccaagcaacaggatcaaaacagacggcgccgcccctaatgttgcaccttccgacgtgggaggcggcgggggcaggaatagggagcttaccataacctgggctcctttgagtcgggaataccactatggcaacaactttggctatatagttgcgtttaagccctttgatggtgaggagtggaagaaagttactgtcaccaatcccgatactgggcggtacgtccacaaagacgaaaccatgagcccgtccacagcctttcaggtgaaagtgaaggctttcaataacaagggagacggcccctatagccttgtagcagtaatcaactcagctcaagatgcaccgtctgaggccccaaccgaagtcggtgtgaaagtgctcagctcatctgaaatcagcgtgcactgggagcacgtgctggagaagattgttgagagttatcagatcagatactgggcagcgcacgataaagaggaggctgctaatcgtgtgcaggttacctcgcaggaatacagcgccagactcgagaatctgctgcccgacacccagtacttcatagaggtcggagcctgcaattccgctggatgtgggcccccttccgacatgatcgaggcctttacgaaaaaggccccacccagtcaacctccacgcattatcagctccgtgagatcagggagcaggtacattatcacctgggaccacgttgttgcgctgagcaatgagagcacagtaaccgggtacaaggtgttgtaccgcccagacgggcagcacgacggtaagctgtactcaacccataagcattcaatcgaggtgccaattccacgcgacggggagtacgtggtcgaggtaagggcacactccgatggcggcgacggcgttgtgtcacaggtgaaaatatctggggcacctaccctatcacccagtctgttaggcctgcttttgcccgcgttcgggatccttgtgtatcttgagttctag

SEQ ID NO: 183778 - DNA, 1884 bp, Artificial Sequence
  Description of Artificial Sequence: Synthetic coding sequence
atgaagatgtggctgctggtgagccacctggtgatcatcagcatcacaacttgcctggctgagtttacttggtaccgccgatatgggcatggtgtcagcgaggaggataaaggctttggaccgatttttgaagaacagccgattaatactatttatccagaggaatctttggagggtaaggttagtctaaactgtcgggcccgagcctcaccctttcccgtgtacaagtggcggatgaacaacggggatgttgacctcactagtgaccgttacagcatggtgggcggtaacctagtcatcaataaccccgacaagcagaaagatgctggcatttactactgcttagcctctaataactacgggatggtgcgttctaccgaagccaccctgtctttcggatacctggatcctttcccacctgaggagcgcccggaggtgcgcgtcaaggaaggtaaaggcatggtgctactatgcgatccaccataccattttccagacgacctgagctaccgttggctgctaaacgaatttcctgtgttcattacaatggataagcgacggttcgtctcccagaccaatggcaatttgtatatagctaatgtggaagcctccgacaaagggaactactcctgcttcgtgagttccccctcaattaccaagagcgtgtttagcaaattcattccattgatccccatacccgagaggacaacgaaaccttaccctgccgacatcgtagtgcagttcaaggacgtatacgccctaatgggacagaacgtgactctggaatgctttgctctggggaatcctgtccctgacattaggtggcgtaaagtgcttgagccaatgcccagcaccgcagagatttctacctccggggccgtcttaaagatctttaatattcaattagaagatgaggggatctacgagtgtgaggctgaaaacatccgcggaaaggataagcaccaggccagaatttacgtacaagccttcccagaatgggtggagcatatcaacgacacagaggtagatatcggaagtgacctgtactggccctgcgtggcaaccggtaagcccatccccacaattcgctggttaaagaatggctacgcttatcacaaaggagagctcaggctgtatgatgtcacatttgagaacgcgggaatgtaccaatgtattgctgaaaatacgtatggcgccatttacgccaatgctgaattaaagatactcgccttagcacccacattcgagatgaaccccatgaagaaaaagatactggctgcgaaagggggtcgtgttatcatcgagtgtaaacccaaggcagcgccaaaacccaagttcagctggtccaaagggaccgaatggttagtgaacagctctaggatcttgatatgggaagacggttctctagaaatcaacaatataacacggaatgacgggggaatctacacctgcttcgccgagaataatcgcgggaaggccaacagtacaggtactttggttatcaccgatccaactagaataatcctggcaccaattaatgcagacatcacagtcggggagaatgctaccatgcagtgcgccgctagcttcgaccccgctctcgacctcacatttgtttggtccttcaatgggtacgtcattgattttaataaagagaacatccattaccagcgcaactttatgctggactctaacggagagctgctgatccggaacgcgcaattaaaacatgctggacggtacacctgtaccgcgcagactatagtggacaacagctctgcctccgcagatcttgttgtgcgtggaaagaatcggaaaggcggagagaagaacatggtggattccttcctcccggtctgcgctagtctgccccctacctggtag

SEQ ID NO: 183779 - DNA, 1884 bp, Artificial Sequence
  Description of Artificial Sequence: Synthetic coding sequence
atgaagatgtggctgctggtgagccacctggtgatcatcagcatcacaacctgtctggcggagttcacctggtacaggaggtatggccatggagtgagcgaggaggacaaggggttcggccctattttcgaggagcagccaattaataccatctacccagaggaaagcttagaaggcaaagtgtctctgaactgcagggcgagggcctctccttttcccgtctataagtggagaatgaataatggggacgtggatctgacctctgataggtatagcatggtcggcggcaatctcgtgatcaacaatcctgataagcaaaaagatgccggcatctactattgtctggccagtaacaactacggcatggttagatctaccgaggccacactgagcttcgggtacctggacccattcccacccgaggaaagacccgaagtccgagtgaaggaagggaaaggcatggtgctgctttgcgaccccccttaccacttccctgacgatctatcgtatagatggctgctgaacgagttccccgtgtttatcacaatggacaagagacgatttgtctcccagactaacggcaacctgtacatagctaacgttgaagcctcggataaagggaattatagttgctttgtgtccagcccatctatcaccaaatctgtgttctctaagttcataccactcatcccaatacccgagagaaccactaaaccctacccagccgacattgttgtccagtttaaggatgtgtacgccctcatgggccaaaatgtgaccctcgagtgctttgccctcggaaatccggttcccgacatcagatggaggaaggtgcttgagcccatgccctcaaccgctgagatctccacttcaggggctgtactgaaaatcttcaatattcagttggaagacgaaggcatctacgagtgcgaggctgagaatattaggggcaaggacaagcatcaggctcgcatatatgtacaggcattccccgagtgggttgaacacatcaatgacacagaggtggatatagggtccgacctctactggccttgcgtcgcgaccggcaaacccatcccgactatccgatggctgaaaaacggctacgcctaccataaaggggagctgcgcctctatgatgttacatttgagaacgccgggatgtaccagtgtattgctgagaatacttatggggctatctacgccaacgccgagctgaagatactggctctggcccctacattcgagatgaatcccatgaaaaagaagatactcgccgcaaaagggggccgtgtgatcatcgaatgtaaaccgaaagcagcgcccaagccaaaattcagctggagtaaaggcaccgagtggttggtgaactcatccagaatactgatttgggaggatggttctctcgaaattaacaatataacacgcaacgatggcggtatctacacatgttttgctgagaacaatcgcggtaaagcaaactccactgggactctggtcattaccgatccaacacggatcatcctcgcacctatcaacgccgatatcacagtcggagagaacgccactatgcagtgcgctgccagctttgaccccgccctcgatctcacattcgtgtggagtttcaatggttatgtgattgattttaataaagagaatatacactaccagcgaaatttcatgctggactccaatggcgagcttttgatcaggaatgctcagctcaaacatgcagggagatatacctgtaccgcccaaactattgtggacaattcctctgccagtgctgacttggtggtcaggggcaagaaccgcaagggaggtgagaaaaatatggtggattcctttctgccggtatgtgctagcctgcctccaacgtggtag

SEQ ID NO: 183780 - DNA, 1884 bp, Artificial Sequence
  Description of Artificial Sequence: Synthetic coding sequence
atgaagatgtggctgctggtgagccacctggtgatcatcagcatcacaacctgcctggccgagtttacgtggtatagacggtacggacacggagtttctgaggaggacaagggctttggtcccattttcgaggagcagcctataaacaccatctatcccgaagaaagcctggagggaaaggtgagcctcaactgccgggctcgagcctccccctttcccgtttataaatggagaatgaataatggcgacgtagacttaaccagcgacagatacagtatggttgggggtaatttagttatcaacaaccccgataagcagaaagacgcaggaatctactactgcttagcatctaacaattacggcatggtgagaagtaccgaagctactctgtcgtttggatatctggacccttttcctccggaagagaggccggaagtgagagtgaaggagggcaaaggaatggtcctgctttgtgaccccccatatcatttcccggacgacttgagttaccgatggctgctgaacgagttccctgtattcataacaatggacaagaggagattcgtcagtcagacaaatgggaacctatatatcgccaacgttgaagcgagcgacaaaggaaactactcatgttttgtgagctctccctcaatcactaaatctgttttctcaaagttcattcccttgatccccatcccagagcgtacgaccaaaccataccctgcggacattgttgtgcagttcaaggacgtgtatgcattaatgggccagaatgtcactttggagtgctttgccctgggtaaccctgtacctgacattaggtggcggaaggtgttagaacccatgccttctacggcggaaataagtactagtggtgccgtgttaaagatattcaacatccagcttgaggatgagggcatatacgagtgcgaggcggaaaacattagagggaaggacaaacaccaggcgaggatttatgttcaggcgttccccgaatgggtggagcacatcaacgacactgaggttgacattggcagtgacttgtactggccctgcgtggctacgggaaaacctattccaaccattagatggctgaagaacggctacgcatatcacaagggggaattgagactctacgatgtgactttcgagaacgccggcatgtatcagtgcattgccgagaatacctacggcgccatctatgcgaacgccgagctgaaaatcttggctctcgcgccaaccttcgaaatgaacccaatgaagaaaaaaattttagccgcgaaagggggacgtgtgattatcgaatgcaagcctaaagcagcgcccaagcccaagtttagttggtcaaaagggaccgagtggttggtgaactctagtcgcattcttatttgggaggatggcagcctggagatcaacaacatcacccggaatgacggcggaatctacacgtgctttgccgagaacaaccggggtaaggctaattctacagggaccctggttattaccgaccctacacgcattatactggccccaatcaacgccgatattaccgttggcgaaaacgccacaatgcagtgtgctgccagttttgatcctgccttagacttgacattcgtatggagctttaacggatatgtgattgactttaacaaggaaaatatccattaccagcggaactttatgctggacagcaatggcgagctactgatacgcaacgcccagctgaaacatgccggcagatacacctgtacggctcaaactatagtcgacaatagttctgcctcggctgatttggtggtgaggggtaagaataggaaggggggcgagaagaacatggtggactccttcctgcccgtgtgtgcaagcctgcctcctacttggtag

SEQ ID NO: 183781 - DNA, 258 bp, Artificial Sequence
  Description of Artificial Sequence: Synthetic coding sequence
atgaagatgtggctgctggtgagccacctggtgatcatcagcatcaccacctgcctagcagagttcacgtggtaccgccgatacgggcatggagtgagtgaagaggataagggctttggtcctattttcgaagagcagccgattaatacgatttatccagaagaatcactcgagggaaaagtctcactgaattgtcgcgcccgggcctctccatttcctgtgtacaagtggaggatgaacaacggcgacgtcgactag

SEQ ID NO: 183782 - DNA, 3057 bp, Artificial Sequence
  Description of Artificial Sequence: Synthetic coding sequence
atgaagatgtggctgctggtgagccacctggtgatcatcagcatcaccacctgtctcgctgaatttacttggtatcggagatacggtcatggcgtgtcagaggaggataagggattcggtcctattttcgaggagcagcccatcaacaccatctaccctgaggaatctctcgaggggaaggtctcacttaactgcagggccagggccagccccttccctgtgtataagtggcgtatgaacaatggcgatgttgacttaacatccgatcggtacagcatggtaggagggaacctggtcataaacaacccagataaacagaaggatgccggcatatactactgcctcgcctccaataattacggcatggttagatcgacagaagccactctctctttcggctacctcgacccctttccaccagaagagagacccgaagtacgcgttaaagaaggcaagggcatggttctcctgtgcgatcccccctatcactttcccgacgacctatcttaccgatggctgttgaatgagttccctgttttcatcaccatggacaagaggcgatttgttagtcaaaccaacggtaacctttacatcgcaaacgtggaggccagtgacaagggcaactactcctgtttcgtgtcctctccaagcatcactaaaagcgtgttctctaagtttatccccctgatacccattccggagagaaccacaaaaccatacccggccgatatagtcgtccagtttaaagatgtgtacgcgctcatggggcagaacgttacgcttgagtgcttcgccctaggcaatcctgttcccgatatccgctggcgcaaggtgctggagccaatgccctcaacagctgaaatttcaaccagcggggctgtcctgaaaatctttaacatccagctggaggatgaaggcatctacgagtgcgaggctgaaaacatccgaggcaaggacaagcaccaggcgcgcatttacgtccaggcttttccggagtgggtcgagcacattaacgacacagaggttgacatcggcagtgatttatattggccatgcgtcgcaactggaaaacccatccctaccatccggtggttaaaaaacgggtacgcttatcacaaaggagagctgcggctgtacgacgtcaccttcgagaacgccggtatgtatcagtgtatcgcagaaaatacatacggggctatttatgctaacgccgaattaaaaatcctcgcactggctccaacgtttgagatgaaccccatgaagaagaagattcttgccgccaagggtgggcgggtgatcatcgagtgtaagcctaaggccgcgccaaaacctaagttctcttggtctaagggcacagagtggttggttaattcttcccgtattcttatctgggaagatgggtcactcgagatcaataacatcactcggaatgacggtggaatctacacttgtttcgccgagaataacagaggtaaggctaactcgactggcacgctcgtcatcactgatcctaccagaattatacttgccccaatcaatgccgatatcacagtcggggagaatgcgacaatgcagtgcgcggcctcttttgacccagcgctggatttgacattcgtctggagctttaacgggtacgtgattgactttaacaaggagaatattcattaccagcgaaattttatgttggattccaacggagaattactcatcagaaatgcgcagttgaagcacgccggtcgatacacatgtaccgcacagactatcgttgacaactctagcgcgtccgccgacctggtcgttaggggccctcctggaccccccggcggactccgtattgaagacatacgcgcaacaagcgttgccctgacatggagccgtggctctgataaccactcacccatctctaaatacactatccagacgaaaactatactttccgacgactggaaagatgcaaagaccgacccccccatcattgaggggaacatggaggcagccagagccgttgacctgatcccctggatggagtatgaatttagggtggtcgctacaaataccctggggaggggggagccgagtatcccttcaaaccggataaagacagacggtgccgccccaaacgtcgctccatcggacgttggcggcggaggcgggcgcaatcgtgagctaacaatcacttgggctcccctcagcagggagtatcactacggtaataactttggctatattgtggctttcaagccctttgatggcgaggagtggaaaaaggtgacagttaccaaccctgacaccggccgatatgttcataaggacgaaactatgtccccctcaacagcgttccaggtgaaggtaaaagctttcaacaataaaggggatggaccatattcacttgtcgccgtgataaatagcgctcaggacgccccatcagaagccccaacagaggttggagttaaggtgctttcctcaagcgagatatcggtgcactgggagcatgtgctagaaaaaatcgtggagagctaccagattaggtattgggcggctcacgacaaggaggaggcggccaaccgggtgcaggtgaccagccaggaatactccgccagactcgagaacctactccctgatactcaatatttcattgaggtcggagcctgcaactctgctggctgtggtccaccttctgatatgattgaagcctttaccaaaaaagcccccccaagccagcccccgcgcattatctcctctgtgcgctctggttcccgctacatcatcacatgggaccatgtagtagccctgagtaatgagtctaccgttacagggtacaaggtcctatataggcctgatggacaacacgatggcaaactctattccacccacaaacatagcattgaggtgcccatcccgcgcgatggggaatacgtagtagaagtccgcgctcactctgatggcggcgacggcgtcgtttctcaggtgaagatcagcggagctcccacattgtctccatctctactcggccttctactgccagcctttggaattcttgtgtacttggagttttag

SEQ ID NO: 183783 - DNA, 192 bp, Artificial Sequence
  Description of Artificial Sequence: Synthetic coding sequence
atgaagatgtggctgctggtgagccacctggtgatcatcagcatcaccacgtgcctagctgagttcacatggtatcgccgctacggtcacggcgtgtctgaagaagataaaggatttggccctatcttcgaggaacagccgattaacacaatatatccagaggaatctcttgaaggcaaggtgtctttatag

SEQ ID NO: 183784 - DNA, 273 bp, Artificial Sequence
  Description of Artificial Sequence: Synthetic coding sequence
atgaagatgtggctgctggtgagccacctggtgatcatcagcatcaccacatgtctcgccgagttcacttggtaccggcggtatgggcatggcgtttccgaggaagacaaaggcttcggacctatatttgaagagcagcccattaatactatttaccctgaagaatccttggaagggaaagtttctcttaactgtcgtgccagagcttcaccttttcctgtttacaaatggcggatgaacaacggggacgtggatttgacgagcgaccggtag

SEQ ID NO: 183785 - DNA, 222 bp, Artificial Sequence
  Description of Artificial Sequence: Synthetic coding sequence
atgaagatgtggctgctggtgagccacctggtgatcatcagcatcacgacttgtctggcggagttcacgtggtatagacgctatggtcacggggtgagtgaagaggataagggctttgggccgatcttcgaggaacaaccaattaacacaatttaccctgaagagtctcttgagggtaaggtgtctctaaattgccgcgctcgggcatcccctttcccatag

SEQ ID NO: 183786 - DNA, 3123 bp, Artificial Sequence
  Description of Artificial Sequence: Synthetic coding sequence
atgggcaccgccacccggcggaagccccacctgctgctggtggccgcagtggcgcttgtgtccagtagtgcatggagctctgcactcgggagtcagacaacgtttggcccagtattcgaggaccagcccctttccgtgctcttccctgaagagtctactgaagagcaggtgctgctggcctgccgcgctagagcatccccccccgccacataccggtggaaaatgaatggaaccgagatgaagctggaacccgggtcccggcaccagttggtggggggcaacctggtcattatgaatcccaccaaggcccaggatgctggggtctatcagtgtctcgcaagcaaccctgtgggaacagtcgtgtcacgcgaagctatcttgagatttggctttctgcaggagttttccaaggaggagcgcgaccctgtcaaagctcatgaaggttggggagtgatgctgccatgtaatccccccgcacattaccctggcctgagttatagatggttgttgaatgagttcccaaatttcatccccacagatggtcgccactttgtgtcacagaccactgggaacctctacattgccagaaccaacgccagcgacctcgggaattattcttgccttgcgacatcccatatggacttcagtacaaaaagcgtgttcagcaaatttgcacaattgaacctagcagctgaggacaccaggcttttcgctccttcaatcaaagccaggttccccgccgagacctacgccctagttggacaacaggtgaccttggaatgttttgccttcggtaaccctgtgccgcgcatcaaatggcggaaggtggacggctcactgtctccccagtggaccaccgctgaaccgaccttgcagatccctagcgtttcttttgaggacgagggcacctatgaatgtgaagcagaaaacagcaaaggtcgagacactgtccaaggccgaattatcgttcaggcacagccagaatggctgaaggtgatcagcgatactgaagccgacattggttctaatttgcgctggggctgtgctgctgccggcaaaccgcgtcctacggtgcgatggcttagaaacggcgagccactagcatcccagaacagggttgaagtactggccggggacctgcgcttttctaagctcagtctggaggattccggcatgtaccagtgcgtggctgagaacaagcacggtactatctatgcctcggcggaactagctgtccaggccctggcaccagactttaggctgaatccggttagacgacttatccctgcagcaaggggaggggagatcttaattccatgccaaccaagggctgccccaaaagccgtcgtgctgtggtctaaagggaccgagatcctagtgaattctagtcgagtgaccgtgacccctgatggaaccctgatcataaggaacattagtcgatctgacgaggggaaatatacatgctttgctgaaaattttatgggaaaagctaatagtaccggtatcctgtcagtccgcgacgccactaagatcacactggcaccaagcagtgcagatattaacttgggggataatttgactcttcagtgccatgctagccatgatcccactatggatctgacctttacttggaccctcgatgacttccccatcgacttcgataagccaggcgggcactatcggcgtactaacgtcaaagagaccatcggcgatctgaccatcctgaacgcacagctcaggcatggtgggaaatatacatgcatggctcaaacagtcgtggactctgcctccaaagaggccactgtactggttcggggaccaccagggccaccagggggagtcgttgttagagacattggggataccaccatccaactctcatggtcccgtggcttcgataaccatagtccaatcgccaagtacacactgcaggcccgcacccctccggccgggaagtggaagcaggtgcgaaccaatccagccaacatagaaggcaatgccgaaaccgcccaggtcttaggtctgactccatggatggactatgagttcagagttattgctagcaacattcttggaacaggggaacctagcggcccaagttctaaaatccgtacgcgtgaagcggccccatctgtcgccccatcgggtctgtcaggcggcgggggagcccctggagagttgattgttaactggacgcccatgagtcgcgaatatcagaacggggatgggttcggctatctgttatcttttaggaggcagggcagcacgcactggcagactgcccgcgtccccggagctgatgcccaatactttgtttacagcaacgagagcgtccggccatatactccgttcgaggtgaagatcagatcctacaaccgcagaggtgacggccccgagagtctcactgctttggtctactcagccgaggaggaaccacgagtcgctcccactaaggtttgggccaagggcgtctccagcagcgaaatgaacgtcacttgggagccagtgcagcaggatatgaacgggatcttgttggggtatgagatcagatattggaaggccggcgataaagaggccgccgctgatcgcgtgcgcactgctggcttggatacatcagcaagggtcagtggactccacccgaatacaaagtaccacgtgactgttcgcgcgtacaacagagccggaactggacccgcctcaccttccgcgaatgcaaccacaatgaaacctccgcctcgcaggccgcccggaaatatcagttggaccttctcatcgtcgagcctgtctatcaagtgggaccccgtagtcccctttagaaacgagtccgctgtgactgggtataagatgctgtaccaaaatgatctccatcttactcccaccttgcaccttactggaaaaaactggatcgaaattcctgtgcctgaggatatcggccacgctctggtgcaaatcagaacaacaggaccgggaggcgacggcattcccgcagaggtgcatatagtgaggaatggaggtaccagtatgatggttgagaacatggctgtccggcctgctccccatcccggcactgtaatttcccactctgtggctatgcttatcttgataggatcattggagctttag

SEQ ID NO: 183787 - DNA, 3087 bp, Artificial Sequence
  Description of Artificial Sequence: Synthetic coding sequence
atgatgttcccctggaagcagctgatcctgctgagcttcatcggctgcctgggaggtgagctgctgctccaaggtcctgtgttcatcaaagagcctagcaacagcatctttcccgtgggatccgaggacaaaaagattaccctgcactgcgaggcacgcggtaacccttcgccccactacagatggcaactaaatggatctgatatcgatatgtcaatggagcatagatataagctgaatggaggaaatctggtagtgatcaatcccaatcgtaactgggataccggtacctatcagtgctttgccacgaactctctgggaaccattgtgagtcgggaagccaaactgcagttcgcttacctggagaactttaagacgaaaatgcgcagcaccgtctctgtacgggaaggccaaggtgtcgtgctgctgtgcggaccgccaccacatagcggggagttgtcttacgcatggattttcaacgagtacccaagcttcgtagaggaagacagtaggcggttcgtgtcgcaggagaccggccacctgtatatttcaaaggttgagccttctgacgtgggaaactacacatgtgtggtcacctccatggtgacaaatgcaagagtcctcgggtcaccgacccccctagtcctgcggagcgatggcgtgatgggcgagtacgagcccaagatcgaagtccagttccccgagaccctgccagctgctaaaggttcaacggtcaaactcgagtgcttcgccctgggaaatcccatcccacagatcaactggaggcggagcgacgggctgcctttttctagcaagataaaattgaggaagttcagtggcgtgctcgaaatcccaaatttccagcaggaggatgccggaagttatgaatgcattgctgaaaatagcagaggcaagaatgttgcgcgtggccggctgacttactacgctaagccacactgggttcagttgataaaggacgtggagatcgctgtggaggacagcctgtactgggaatgtcgggcaagtggtaaaccaaagccctcataccgatggctcaagaacggggccgctctggtgttggaggaaaggactcagatcgagaacggtgctctcaccataagcaatctatcagtgaccgatagcggcatgttccagtgcatcgctgaaaataagcacggactcgtctatagcagtgccgagcttaaggtcgtcgcaagtgcaccggatttctctaaaaaccccatgaagaaactggtccaagtacaggttggttctttagttagtctcgattgcaaaccacgagcgtctccaagagctctgtcatcatggaaaaagggagatgtgtccgtgcaagagcacgagcggattagcttactgaatgacggcggactgaagatcgctaatgtaaccaaggcagatgccggcacttatacctgtatggcagaaaatcagttcgggaaggcaaatggcacgacccacctcgtggtcactgagccaacacggatcacactggccccttcaaatatggacgtctctgtgggggagtccgtgatcctcccctgccaggttcagcacgacccgttgttggacatcatttttacctggtacttcaacggcgccctcgcagatttcaagaaagatggctctcactttgagaaggtgggcggttcttccagcggggacctgatgattcggaacatccagctaaagcactctggcaagtacgtttgtatggtccagacaggggttgacagcgtctcgtcagcagccgacttgatcgtgagagggagcccaggaccccccgaaaacgtgaaagtggatgaaatcacagacaccactgcccaactgtcgtggaaagagggcaaagataaccattcaccagtaatcagctacagtatccaggctcgaacgccattctctgtgggatggcaaaccgtcactactgtgcctgaagtcattgacggaaagacacatacagctaccgtggtcgaactcaatccctgggtcgagtacgaatttcgggtggtggcctcaaacaagatcggcggaggtgagcctagcctgccttctgaaaaggtccggactgaggaagccgtgcctgaggtgcctccctccgaagtgaatgggggtgggggatctcgttctgagcttgtcattacgtgggaccccgtacccgaggagcttcagaacggggaaggattcggctacgtggttgcattccgccccttgggcgtcaccacctggattcagaccgtggtcacatctcccgacacacctaggtacgttttccggaacgaatcaatagtgccttactccccatatgaggtaaaggttggagtgtacaacaataagggggagggccccttttcccccgttacaacagtatttagcgccgaagaagaaccaaccgttgctcccagtcaggtctccgctaattccctgagcagttctgagatcgaagtgtcatggaacactattccctggaaactcagtaacggtcatctactgggttatgaggtgcggtactggaacggcggaggaaaagaagaatcatcctctaagatgaaggtggctggcaacgagacaagcgctaggttacgaggtctgaagagtaacctcgcttactatacagcagtaagagcctacaactcagctggagcaggccctttcagtgccactgttaatgtcaccaccaagaaaacccctccatcccagccacctggaaacgtggtctggaacgccaccgatacaaaggttttactcaactgggaacaggtgaaagccatggagaatgagtccgaagttacagggtataaggtgttttaccgcacatcctcccagaacaatgtacaggtactgaataccaataagacaagcgccgagctggtactcccaatcaaagaggattatattatagaagtaaaagctaccactgacgggggggacggaacttcgtcggaacagatcagaattccgcggatcacttccatggatgctcgcggatctacttcagctatctccaacgtacatccgatgtcgtcatatatgcctattgtcttatttctgatcgtttatgtgttgtggtag

SEQ ID NO: 183788 - DNA, 2424 bp, Artificial Sequence
  Description of Artificial Sequence: Synthetic coding sequence
atgggcgagtacgagcccaagatcgaggtgcagttccccgagaccgtgccgaccgcgaaaggcgccaccgtgaaactggaatgtttcgctcttggaaaccccgtgcctactataatctggcgcagggccgatggaaagccaattgcccgcaaagccaggcggcataaatcaaacggcatcctggagatcccgaatttccagcaagaggatgcaggcctgtatgagtgcgtggccgagaactcacgcggcaaaaacgtagccagggggcagttaacattctatgcacagccaaattggatccagaagatcaacgacattcacgtggcgatggaagagaatgtattctgggagtgtaaggcaaacgggcgccccaagcctacctacaaatggctgaagaatggagaacctctcctcaccagggaccgcatacaaatcgagcagggtactctaaatatcactatcgtaaacctctccgatgcgggcatgtaccagtgtctggcagagaacaagcatggagtcatcttcagtaacgcagagctgagcgtgattgccgtgggaccggatttcagtcgcaccctgcttaagcgcgtgaccctggtgaaggttggcggggaagtggtgatcgagtgtaagccaaaagcctccccgaagcccgtgtacacttggaagaaaggtagggacattcttaaggagaacgaaagaatcactatttcagaagatgggaatctgcggatcataaatgttaccaagagcgacgccggctcttacacatgtatcgccacgaatcattttggcacagcctcttcgactggtaacctggtggtcaaggatccaacgcgcgttatggttccaccatctagcatggatgtgactgtaggtgagtcaattgtgttaccctgtcaggtgacccacgaccattcactggatatcgtctttacatggtcttttaacggtcacttgattgattttgaccgcgacggagaccatttcgagcgagtgggcggacaggacagcgcgggcgatctgatgatccgtaatattcagttgaaacacgccggaaaatacgtgtgcatggtgcagacaagcgtcgatcgccttagtgccgcagctgacttgattgtcagaggtcctcccggaccacctgaggcagttactattgatgaaatcacagacaccaccgctcagctgtcatggaggccgggaccagacaaccactcccctattaccatgtatgtcatccaggccaggacaccttttagtgtcggatggcaagctgtgagcactgtgccagagctgatcgatggaaaaaccttcactgccactgttgtgggcctcaacccatgggtcgaatacgaattccgaaccgttgctgctaacgtgatcggtatcggagagccttcccggccaagcgagaagcgtaggacagaggaagctttacccgaagtcacacctgccaatgtgtctggtggcggaggcagcaaaagtgagctcgtgattacctgggagacagttcctgaagagctgcaaaatgggcgaggtttcggatacgtcgttgctttccggccatatggcaagatgatatggatgctgacagtcctcgcctccgccgacgcttctcggtatgttttcaggaacgagtcggtacatcctttctctccttttgaagtgaaggtcggcgtgttcaataataagggcgaggggcccttttctcctacgacagttgtctatagtgccgaggaggagcctaccaaacctcccgcctctatttttgcccggtcactgtctgccaccgatattgaagtcttttgggcaagccccctagagaaaaatcgtggtcgtattcagggctacgaggtcaagtactggagacatgaggacaaagaggagaatgcccgcaaaattagaactgttggcaatcaaacgagtactaagattactaatctgaagggaagtgtcttataccacttggcagtcaaggcgtacaacagcgcaggaaccgggccatcttctgccactgtaaacgtgaccactcgcaaacctcctcctagccagcctccaggcaatatcatatggaactctagtgactccaaaatcattcttaattgggaccaagtgaaggccttggacaatgaaagtgaggtcaagggctataaggtgctttacagatggaaccggcaatcaagcacctcagtgatcgaaactaacaagacatctgtggaattgagtctgccgtttgatgaggattatattattgagatcaaaccgttctctgacggaggcgatggctctagctcagagcaaatacgcatacccaaaatctcgaacgcctacgctcgcggctctggggcatccacatctaatgcttgcacgctgtcagccatctccactatcatgatctccctgaccgcgcggtcatcattgtag

SEQ ID NO: 183789 - DNA, 2097 bp, Artificial Sequence
  Description of Artificial Sequence: Synthetic coding sequence
atggaggagaacgtgttctgggagtgcaaggccaacggccggcccaaacctacgtataagtggctgaagaatggcgagcccttattaacaagggaccgcatccaaatcgagcaaggaacactgaatatcaccattgttaacctgagcgacgccggcatgtaccaatgcctggcagaaaacaagcacggcgttattttcagtaacgccgagctctccgtcattgccgtgggaccagacttttctagaactcttctgaaaagagtgacattagttaaagtgggaggtgaagttgtgatcgagtgcaagccaaaggccagccctaagccagtatatacatggaagaaagggagagacatcctgaaagagaacgagagaatcactatcagtgaggatggaaacctgagaatcattaacgttacgaaaagcgacgcgggatcatatacatgtattgctaccaaccactttggtactgctagttctaccggtaatctcgtggttaaggatcccacccgggtcatggtccctccttcgtctatggacgtcaccgttggcgaaagcatagtgctgccatgccaggtcactcatgatcacagtttagacatcgtgttcacctggagtttcaatggccacctaattgacttcgatagggatggagaccacttcgagcgcgtgggcggacaggattcagcgggggaccttatgattaggaatatccaactgaagcacgctgggaagtatgtatgcatggttcagacatcggtcgaccggctgtccgcggctgctgacctgatagtaaggggacctcccggcccaccggaggccgtgactattgatgaaatcaccgacacaactgcacaactgtcctggcggcctgggccggataaccatagccccatcactatgtatgttatccaagctcgcacccccttttctgtcggctggcaagcggtttctacagtacctgagctgatcgacggcaaaaccttcaccgccactgtagtggggctcaacccatgggtggagtatgagttccgtacagtcgccgctaatgtaatagggatcggagagccatcacgcccatctgaaaagcggaggacagaagaagcactgccggaggtcacccccgctaatgtcagcggaggggggggtagcaaaagtgagctagtgatcacatgggaaactgtgcccgaggaactgcagaacggtcgcggcttcgggtatgtcgtcgcattccggccttatggcaagatgatctggatgctgaccgtgcttgccagcgctgatgcttcacgttacgtgttccggaatgagtccgtccatccctttagtccctttgaagtgaaagtgggagtatttaataacaagggtgaggggccattcagtccgacgaccgtggtgtacagcgctgaagaggagccaacgaagcctcccgcttccatattcgccaggtctctctccgctactgacatcgaggttttctgggcatcccccttggaaaagaatcgcggtcgcatacaaggctacgaggtgaagtactggaggcatgaggataaagaggagaatgcccggaaaataagaactgtggggaaccaaactagcaccaagataacaaaccttaagggctccgtcctgtaccatctggccgttaaagcctataacagcgccggtacgggaccttccagtgcgactgtgaatgtgaccacgcggaaaccccctccatcccaaccccccggaaacatcatctggaatagttccgacagcaaaattatattgaattgggaccaggttaaggcactggacaacgagagcgaggtcaaaggatataaggtgctttaccggtggaatcggcagagtagtacttctgtgatcgaaaccaataaaacgagcgtggaattaagtcttccattcgacgaggactacattatcgagatcaagcccttctcggatggcggcgacggatcatcctcagagcagatccgcatccctaagattagcaacgcgtatgctcgcggatctggcgcaagcacaagtaacgcatgcaccctgagcgcgatatcaacaattatgatctccctgaccgctagatcatccttatag

SEQ ID NO: 183790 - DNA, 3081 bp, Artificial Sequence
  Description of Artificial Sequence: Synthetic coding sequence
atgcggctgccctgggagctgctggtgctgcagagcttcatcctgtgcctggccgacgactctactctccacggaccgattttcattcaggaacctagtccagttatgtttcccctcgattctgaggagaagaaggtgaaacttaattgtgaggtcaaagggaacccaaaaccccacatccggtggaaactcaatggcacagacgtcgataccggcatggactttaggtatagtgtggtcgagggctcgctcctgattaataatcccaacaaaacgcaggatgctggcacgtatcagtgtaccgctactaacagcttcggaacaatcgttagtagagaagccaaattgcagtttgcttatttggataattttaaaacacgcacacgctcaaccgtatccgtcagaagaggacaagggatggtgctgctgtgcggcccaccaccacacagcggggagctgtcctacgcttggatctttaacgaatacccaagttaccaagataatcgccggtttgtctctcaggaaaccggtaacctctacatcgcaaaggtggaaaaatcagacgttggcaactatacttgtgtagtgaccaatacagtcactaatcacaaagtgctaggcccgccgacaccactgattctgagaaacgacggagtaatgggcgagtacgaaccaaagattgaggtgcaattcccagagacggtgccaacagctaagggtgccacagttaagctggagtgttttgcactcggcaatcctgtgccaacgataatctggagacgcgccgatggcaaaccaatagctcggaaggcccgcagacacaaatccaacggaatactagaaattcccaattttcaacaggaagacgccggattgtacgaatgtgtggctgaaaacagccggggcaaaaatgtcgcacggggccagctgaccttctatgcacaacccaattggatccagaagataaacgacatacatgtagcaatggaggagaatgttttctgggaatgtaaggcaaatgggagacccaagcctacctacaaatggctcaagaacggggagccactgctgacccgtgacaggatccagattgaacaaggcacgctgaacattactattgtcaatctgtcagatgccggcatgtaccagtgcctcgctgaaaacaaacacggcgttattttcagcaacgctgaactcagtgttatcgccgtgggacctgatttcagcaggactctgctaaaaagggtcacacttgtcaaggtgggtggagaggtagtcattgaatgcaaacctaaagctagtccaaaaccagtgtacacatggaaaaagggtcgggatatattgaaagaaaacgagcggatcaccatctccgaagatgggaacctgaggatcatcaatgtcactaagtccgacgccggaagttatacttgcattgctaccaatcactttggaacagccagctctaccggcaaccttgtcgtcaaagacccaaccagagtaatggtgccacccagctccatggacgttacagtaggtgagtctattgtcctgccgtgtcaggtgactcacgaccacagccttgatatcgtgttcacatggagcttcaatgggcatctgatcgacttcgacagggatggtgaccattttgagagggtaggtgggcaggatagcgcaggtgacctgatgatccgtaacatacagctgaagcatgccgggaagtacgtttgtatggtgcaaacctctgtggatcggttgtccgcggccgctgaccttatagttcgcggccccccaggaccccctgaggccgtaaccattgatgagatcaccgatactacagcccagctgtcatggagaccaggacccgacaatcacagccctatcacgatgtacgtgattcaggctcggaccccatttagtgtcgggtggcaagctgtgtctacagttccagaactaattgatgggaagacgtttaccgctaccgtggtcggcctcaatccttgggttgaatacgagtttagaactgtggccgctaacgtgataggcataggtgagccaagtcggccttccgaaaaacgacgtaccgaggaggcactccccgaggtgactcccgcaaacgtctctggaggcggaggctcaaaatccgagctggtcattacttgggaaactgtgcctgaggaattacagaatggtaggggctttggctatgtggtggctttcagaccttatggtaagatgatttggatgttgaccgtcctggcctcagcagatgcaagccggtatgtattcagaaatgagagcgtacaccccttttcaccttttgaggtgaaggtgggtgtattcaataataaaggggaaggtccattctccccaaccactgtggtctatagcgcagaggaagagcccacaaagccacccgctagtatatttgcgagatcattgagtgccaccgacattgaagtgttctgggcgagtccactggaaaagaatcgtggacggattcagggttacgaggttaagtactggcgacacgaggacaaggaggaaaatgctcgcaagatacggactgtggggaatcagacttccactaagatcacaaatctaaaggggtctgtgctttaccatctggccgtcaaagcatataattctgccggcactgggccgtcctccgccacggtgaatgtcaccactaggaaacctcccccatcacagccaccaggcaatatcatttggaacagcagtgacagcaaaattatacttaattgggatcaggtgaaagcactcgacaatgaaagcgaggttaaggggtataaagtcctatatcgttggaaccggcagagcagcaccagcgtaattgaaaccaataaaacttccgtggagctgagcctcccatttgatgaggattacattatcgaaatcaaacccttttccgatgggggtgacgggtccagcagcgagcagattagaatcccgaagatctccaatgcctatgctagggggagcggggcatcaacatccaacgcatgtactttgagtgctatttctacaattatgatctctctcactgctcgctcctccctgtag

SEQ ID NO: 183791 - DNA, 3081 bp, Artificial Sequence
  Description of Artificial Sequence: Synthetic coding sequence
atgcggctgccctgggagctgctggtgctgcagagcttcatcctgtgcctcgctgacgactctactctgcacgggcctatctttatccaagaacctagtccggtcatgtttccattagacagcgaagaaaaaaaggtcaagctaaattgcgaagtgaagggtaaccctaagccccatattcggtggaagctgaacgggactgacgtggacacagggatggattttaggtatagtgtagtggagggatccctgctgatcaataacccaaataaaacccaggatgcgggcacctaccagtgcactgcaacaaactcattcggaaccattgtgtccagggaagctaaacttcagttcgcctaccttgacaacttcaagacgcgtacccgctctaccgtttccgtgcggaggggacaagggatggttcttttgtgtggccccccaccacacagcggagaactcagttacgcctggatcttcaacgaatatccatcatatcaggacaaccgaaggtttgtgagccaggagacgggaaacctgtatatcgctaaggtggaaaagagcgacgttggcaactacacctgcgttgtaaccaacacagtcactaatcacaaagtactgggacccccaacacctctgattttgcgcaacgacggtgtcatgggcgagtatgaacctaagatcgaggttcagttccccgagacagtaccaactgctaaaggcgccactgtgaagctggaatgctttgccctgggaaacccagtcccgaccatcatctggagacgggccgatggcaaaccaatcgcccgcaaggctaggagacacaagtcgaacggaattctcgagatcccaaactttcagcaagaagatgcagggctgtacgagtgcgttgcagaaaattccagaggaaaaaatgtggccagaggccagcttacattctacgcccagcccaattggatccagaagataaatgacatacacgttgcaatggaggagaatgttttttgggagtgcaaagctaacggacggccgaaacccacctacaaatggctgaagaacggcgagccactgctcacccgtgatcggattcagatcgagcaggggacgctgaacataaccatcgtgaatttgtccgatgcaggaatgtatcagtgtctggccgagaacaagcacggagtgattttctctaacgccgagctatccgttatcgccgtgggacccgatttctccagaaccctccttaagagggtaaccctggtgaaagtgggaggtgaggttgtgatcgaatgcaagccaaaagcctcccccaaaccagtgtacacatggaagaagggcagagacattctgaaggaaaacgaaaggatcaccatttctgaggacggcaacctgcggattatcaatgtcactaagtcagacgccgggagttacacctgcatagcaacgaatcacttcgggactgcgagcagtaccggcaaccttgtggtgaaggatcccacccgcgtgatggtgccacctagctcaatggatgtgactgtgggcgaaagtatagtcctgccgtgtcaggtgactcacgaccactcccttgatatcgtgttcacatggagttttaatggacacttaattgactttgatagagacggagatcactttgagcgggtgggtggccaggattccgcaggagaccttatgattcgcaatatccagttaaaacacgctggaaaatacgtttgcatggtacagacctccgtcgatagactgtccgctgctgccgatctgattgttcggggcccccctggtccccccgaggcggtcacaatagacgagatcactgacactacagctcagctcagctggagacccggccccgacaatcacagcccaatcaccatgtacgtgatacaggcccgtacacccttctctgttggatggcaagctgtgagcacggtgcctgaattgattgatgggaagacctttacggcgactgtggtgggtctgaacccgtgggtagagtatgagttcagaaccgtggcagccaatgtgatagggattggggaaccttcccgtccctcagagaagcgccgcacagaagaagctttacccgaggtgacacccgccaacgtatcaggcgggggggggtccaagtccgagctcgtgattacctgggaaactgtacccgaggagctacaaaatggacggggtttcggctatgttgtcgctttcagaccatacgggaaaatgatatggatgctgactgttctcgctagcgccgatgctagccggtatgtgttccgtaacgagagtgtgcacccattcagtccctttgaggttaaagtcggagtatttaataataagggggaaggaccattctcccctacaactgtggtatactccgccgaggaagagcccaccaagccacccgcttccatttttgcccggagtctctctgctactgacatcgaggtcttctgggcctcaccgctcgagaagaaccggggacgaattcagggttacgaagtgaagtactggcgacatgaggacaaagaagaaaatgcgcgcaaaataagaacagtaggcaatcagactagtaccaagatcacaaatctgaaaggctctgtgctgtaccatctggctgtgaaggcttacaacagcgcagggacaggcccttcttctgccactgtcaacgtaaccacccgcaagccacctccgtctcagcccccaggcaatattatttggaactcaagtgattctaaaattatcctgaattgggaccaggttaaggctctcgacaatgaaagcgaagtcaagggctacaaggtgctataccgctggaataggcagtcatcgacttccgtaattgaaacaaataaaacaagtgtggagctgtccctgccatttgatgaggactatattatcgagatcaagccgttctcggatggcggggacgggtcttccagcgagcaaatcagaataccaaagatcagcaatgcgtacgcccggggcagtggcgcctcaacgtccaatgcctgtactcttagtgccatcagtaccattatgatctccctaaccgctcgaagctccctgtag

SEQ ID NO: 183792 - DNA, 351 bp, Artificial Sequence
  Description of Artificial Sequence: Synthetic coding sequence
atgcggctgccctgggagctgctggtgctgcagagcttcatcctgtgcctggctgatgactcaaccctgcacgggccaatcttcattcaggagccttcaccagtgatgtttccactagactcagaggagaagaaagtgaaacttaattgcgaggtgaaggggaatccaaagcctcacatcagatggaagctgaacggtaccgacgtggacactggcatggacttccggtacagcgtggtagaggggtccctcttgataaacaatccaaacaaaacccaggatgcaggcacgtaccaatgcacagctaccaatagtttcggaacaatcgtgagtagagaggccaagttatag

SEQ ID NO: 183793 - DNA, 3081 bp, Artificial Sequence
  Description of Artificial Sequence: Synthetic coding sequence
atgcggctgccctgggagctgctggtgctgcagagcttcatcctgtgtttggcagatgattccacccttcacggtcctatatttatccaggagccctccccagtgatgtttccactggactctgaggaaaagaaagtgaagcttaactgcgaagtgaagggaaacccaaagcctcacattagatggaagttaaatggaacagacgttgacaccggcatggacttcagatacagcgtagtggagggaagcctgcttattaacaatccgaacaagacacaggacgcagggacgtaccagtgtacggccaccaattcgttcggcacgatcgttagtcgcgaggccaagctgcaattcgcttacttggacaattttaaaacccgaactcggtccaccgtctctgttagaaggggccaaggaatggtgctactgtgtggtccacccccccattctggggaactgtcatatgcttggatatttaacgagtacccctcctaccaggataaccgacggtttgtctctcaggagaccggaaatttgtacattgctaaggtcgaaaagtctgatgtgggcaattacacatgcgttgtaaccaataccgttacgaatcataaagtgctgggtccgcccacacctcttatcctgcgcaatgacggcgtgatgggggagtacgaacccaaaatcgaagtccagtttcctgagacagtccctaccgccaagggagccaccgttaaattagagtgctttgccctgggaaatcccgtcccgaccattatctggcgaagggccgacggcaaacctatcgcacgcaaggccaggcgtcacaagtcaaacggcatccttgagatccccaacttccaacaggaagacgctggcttgtacgaatgcgttgccgagaactctcgaggaaaaaacgtggcgaggggacaattgaccttttacgctcagccgaactggatccagaaaatcaatgatattcacgtcgccatggaggagaatgtcttctgggagtgcaaggctaacgggcgccccaaacctacatacaagtggcttaaaaatggggagccgctcctgacaagggacaggatccaaatcgagcaagggacgcttaatatcacaatagtgaacttgtcggacgccggaatgtatcagtgcctggccgagaataagcatggggtgattttctccaatgccgagcttagtgtgattgccgtggggcctgacttctcgcgcaccttgctcaagcgcgttaccctggtgaaggtagggggcgaggtcgtgattgagtgcaagccaaaggcttccccaaagccggtctatacttggaaaaaggggagggacattttgaaggagaacgagcgaatcactatatccgaggatggcaatctaaggatcatcaatgtaaccaaaagcgatgcagggagttacacgtgtatcgcaactaaccattttggtaccgcctcctccacaggcaatttagtagtgaaggacccgacgagggtaatggtgccgccatcaagtatggacgttactgtcggcgagagtatcgtactgccctgccaggttacacacgatcactcccttgatatcgtctttacctggagtttcaatggccacctcatcgattttgatcgagacggggatcactttgagcgggtaggcggtcaggacagtgctggcgatttaatgatacgaaacattcagcttaagcatgctgggaagtacgtgtgcatggtacaaacaagcgtcgacagattatccgcggcggctgacctcattgtgagggggccaccagggccaccagaagcggtgacaattgatgagatcaccgatacaaccgcccagctgtcatggcgccccggaccggacaaccacagcccaattacaatgtacgtcattcaggctagaactcctttctccgttggctggcaggctgtttctaccgttccggaactcattgatggtaagacgtttacagccacagtcgtgggactcaacccttgggtggaatacgaattccggacagttgccgccaacgtgattggcatcggcgagccttcccggcccagcgagaagaggcggaccgaggaggccctacccgaggttacacccgccaacgtgtcaggcggtggaggatcaaaaagcgagttggttatcacctgggaaacagtgccagaggaactccagaatgggagagggttcggttacgtcgtcgctttcaggccttacgggaaaatgatttggatgctcaccgtcctggccagcgcagatgcctctcgttatgtctttagaaacgaatctgtgcatccctttagccctttcgaggttaaagtcggtgttttcaacaacaaaggagaaggtcccttctccccaacgacagtagtttacagtgcggaggaggagccaacaaagccaccagctagtatttttgctaggagtcttagcgcaacagatatcgaggttttttgggcgtctccactggagaagaatcgtggcaggatccaaggctacgaggtcaaatattggagacatgaagacaaggaggagaatgcaagaaaaataaggacagtgggcaaccagacctcaacaaaaataacgaatctcaagggctctgtgttgtatcatctggccgtcaaggcttataactcggcgggtacaggaccaagctctgctaccgtgaatgtgactacccggaaacccccaccctcccaacccccggggaatattatctggaactccagtgattccaagatcattctgaattgggaccaggtgaaggcacttgacaacgaatccgaggtaaaaggttataaggtgctctaccgttggaatcgacaaagcagcacgtcggtgattgaaacaaataagacaagtgttgagcttagtctgcctttcgatgaggactacatcattgaaattaagccattttcagatgggggggatggctccagctccgaacagattcggattcccaaaatctctaatgcttacgctagaggttcaggcgcctctacctctaatgcctgcactctatctgcaatcagcaccataatgatttctctcaccgcccgttcaagtctgtag

SEQ ID NO: 183794 - DNA, 2097 bp, Artificial Sequence
  Description of Artificial Sequence: Synthetic coding sequence
atggaggagaacgtgttctgggagtgcaaggccaacggccggcccaaacctacctataagtggttaaagaatggcgaacccctactaaccagagacaggatacagatcgaacagggaactttgaatattaccattgtcaacctatccgatgcaggtatgtaccagtgtctcgccgagaataagcatggagtcatcttttccaacgctgagttgagcgttattgcggtgggtcctgacttttctagaaccctgctgaagagggtgacactcgtcaaggtcggcggcgaggtcgtgattgaatgtaagcccaaggcaagtcctaaacccgtctacacatggaagaaggggcgagatattctgaaagagaatgagcggatcacaatttctgaggacggcaatctgcgtatcataaatgtcactaagtccgatgccggctcctacacttgtatagcaacaaaccactttggaacagcaagtagcaccggtaatctcgtcgtcaaggacccgactagggttatggtccctcccagctctatggacgtgaccgtgggggagtcaatcgtgctgccctgtcaggtgacccacgatcactctctggatattgtctttacctggtcgttcaatggccatttaatcgattttgaccgcgatggtgatcattttgagagagtgggaggccaggatagtgctggcgacctcatgattcgcaatatccagctgaaacacgccggcaagtacgtctgcatggtccagacttcggtggatcgcctgagcgccgctgccgacctgatagtacgaggtccacctggaccccctgaggccgtgacaatcgacgagataaccgacactaccgcacagctgagctggaggccgggtcctgacaaccatagtcccattacgatgtatgtcatacaagcccgcacccccttttccgtagggtggcaagcggtgagcacggtccctgagctgattgatggcaagacatttactgccactgttgtcggactcaatccttgggttgaatacgaattccggacagtggcagcaaatgtgattgggataggtgagcccagtcggccctctgagaagaggcgcacggaggaagcgttacccgaggtaacaccggctaacgtgtctggtggtggcgggtcaaagtctgagctcgtgatcacatgggagaccgtgcctgaggaactacaaaatggcagaggttttggttacgtagtagccttccggccgtatgggaagatgatctggatgctcaccgtgttggcatcagccgatgcatctcggtatgtatttagaaacgaatccgtccatccattctccccatttgaggttaaagtgggcgtgttcaacaacaagggtgaagggccattcagccccaccacagtagtctattctgccgaagaagaaccaaccaaacctcccgcgtctatctttgctaggtctctgagtgctaccgacatcgaggtgttctgggcttccccactggagaaaaataggggacgtatacaaggttacgaagttaaatactggaggcatgaggataaggaagagaacgcccggaaaattcgcactgtcggtaatcagacttcgaccaaaatcacaaatttgaaaggaagtgtcctgtaccacctggccgtgaaagcctataactcagctggcaccggaccctcatccgctacagtgaatgttacaacaagaaagccccctccatctcagcctccaggcaatattatatggaacagttccgactctaaaatcatccttaattgggatcaggtcaaagctcttgataatgaatctgaagttaagggctataaggtactttacaggtggaatcgccagtcaagtacctccgtcattgagactaacaagacatccgttgaactctcccttccatttgatgaggattatataatcgagatcaaacccttcagcgacggaggggatggaagcagttcagagcagatcaggatccctaaaattagcaacgcctacgcacggggatccggagcatccacctctaacgcatgcaccttaagtgccattagcactattatgatctcattgaccgcccgcagtagcctctag

SEQ ID NO: 183795 - DNA, 165 bp, Artificial Sequence
  Description of Artificial Sequence: Synthetic coding sequence
atgcggctgccctgggagctgctggtgctgcagagcttcatcctgtgtctggccgacgactcaacactacacggacccatcttcatccaggagcccagtcccgttatgtttcccttggattctgaagagaagaaagtaaaacttaactgcgaggttaaaggttag

SEQ ID NO: 183796 - DNA, 3303 bp, Artificial Sequence
  Description of Artificial Sequence: Synthetic coding sequence
atggccagcagctggaagctgatgctgttcctgagcgtgaccatgtgtctttcggagtattctaagagcttaccagggttgtcaacatcgtacgccgctctcctgaggatcaaaaagagcagtagctcttctctatttggctctaagacccgaccgcggtatagcagccctagtttaggcacgctgagcgcgtcttctccctcttggcttggagcggctcaaaattactacagcccgatcaatctgtaccactcctctgatgcgtttaagcaggatgaatcagtcgactacggacccgtgttcgttcaggagcccgatgatatcatctttccgaccgattccgatgaaaaaaaggtggcacttaactgcgaggttcgcggcaacccagtgcccagttacaggtggctcagaaatggcacggagatagatctcgagagcgactatcgatatagcttaatagatggaacttttatcatctctaacccctcagaggctaaggatagcggccactaccagtgcctggctacgaacacagtcggtagcattttatcaagagaggctaccctccaatttgcatatctggggaacttctctggcagaacgagatccgctgtgtccgtgcgcgaaggacagggggttgttttgatgtgctcacctccacctcactcccctgagattatctactcttgggtgtttaatgaatttccttcattcgtggcagaggatagtcggaggttcattagccaggagacaggcaatctgtacatcagtaaggtgcagacaagtgatgtgggctcctatatctgtctggtgaagaataccgtaaccaacgcccgcgtcctgagcccacctaccccactgaccctaaggaacgatggcgtcatgggcgaatatgaaccgaaaatcgaggtccatttcccctttacagttaccgcagccaaaggcactactgttaaaatggagtgtttcgctttgggtaatccggtgcccaccattacatggatgaaagttaacgggtatattccctcaaaagcacgtctgagaaagagccaggctgtacttgagattcctaatgtacagctggacgatgctgggatatatgagtgcagggccgagaattcacgggggaaaaactcgtttcgaggacagctacaggtctacacctaccctcattgggtggagaagctgaacgacactcagctcgacagcggctcccccctgcgttgggagtgcaaagccacaggtaagcctagaccgacatacagatggctgaaaaatggcgtcccactgtccccccaatcccgcgttgagatggtgaacggggtgctcatgatccacaacgtcaaccagtcagatgccggtatgtaccagtgcctcgccgagaacaaatatggagccatctacgcatctgctgaactgaagattctcgcgagtgctcccaccttcgccctgaaccaactcaagaaaactattattgtaactaaggatcaagaggtggtgattgagtgtaaacctcaaggttccccaaagccaaccatttcctggaaaaagggagatagggccgtgcgggaaaataagcgaatcgcaatactgcccgatggatccctcaggatactgaatgcatcgaagagcgacgaggggaagtatgtatgtaggggcgagaatgtcttcggcagtgccgagataattgctagtttgtcagttaaggaacccacgcggatcgagcttacaccaaagaggacggagctgaccgtgggcgaaagcattgtgttgaattgcaaagcgattcatgacgcgtctctggacgttaccttctactggacgctcaagggccagcctatcgacttcgaggaagaaggcgggcactttgagagtatcagagctcaggcctcgagcgctgatctcatgatccgtaacatcctgctgatgcacgcagggcggtacggttgcagggtgcagactaccgccgattcagtgtccgacgaagcagaattgctggtcagggggccacctggtcctccaggcatcgtgattgtggaagagattacggagtcaacagcgaccctaagctggtcaccagcagcggacaaccacagccccatcagctcctataacctccaggccaggagccctttttcactcggctggcagactgtgaaaacagttccggaaataataaccggcgatatggagtccgctatggcggtggacctgaatccctgggtcgaatacgaattcagggtcgtggcgaccaatcctatcgggacaggggacccttctactccctcccgcatgatcaggacaaatgaagccgtgcctaagacagctcccacaaatgtctccggaaggtcagggaggcgccatgagctagtcattgcttgggagccggtgagtgaggaattccagaatggcgaagggttcggttacattgtggcgtttcggcccaacgggacccgcgggtggaaggaaaaaatggtgacgtcctcggaggcaagcaagttcatttatagggatgaatccgtcccccctctgaccccatttgaggtcaaggtcggagtgtataacaacaaaggcgacggacccttttcgcaaatagtggtcatctgcagtgccgaaggcgaaccatctgccgcccctactgacgtgaaagcaacctccgtcagtgtgagtgagattctggtagcttggaagcatatcaaagagagccttggcagacctcaaggattcgaggtgggttactggaaggatatggagcaggaagacacagcggaaaccgttaaaacacgtggaaacgagtcattcgtgatactaacaggtctagaaggaaataccctgtaccacttcactgtcagggcctacaacggcgcaggatacggtcctcccagttctgaagtctctgcgaccacaaagaaatcccccccctcccaggcaccctcaaatctgcgctgggagcagcagggtagtcaggtctcactgggctgggaacccgttataccccttgcgaatgaatctgaggttgtgggatataaggtgttctacaggcaggagggccacagcaattctcaggtcatcgaaacacagaaactacaagcagtggtaccactccctgacgcaggggtgtatattatagaagtcagggcttatagtgagggcggcgacggaacagcaagtagccagattcgggttccctcctactcaggtggaaaaatcacatccgcacaatctacactccactccctaagcacctcgtcaagctctgtcacactgcttctggccttgatgatcccgtccacttcatggtag

SEQ ID NO: 183797 - DNA, 3081 bp, Artificial Sequence
  Description of Artificial Sequence: Synthetic coding sequence
atggccagcagctggaagctgatgctgttcctgagcgtgaccatgtgcctgagcgaatctgtcgattatggccctgtattcgtgcaggaaccggatgatatcatctttcctaccgacagtgatgagaagaaggtggcactgaactgcgaggttcggggtaatccggtgccaagctataggtggttgagaaacggtaccgagatcgatctggagagtgattatcggtattccttaatcgacggaaccttcattatatccaatcctagcgaagcgaaggattccgggcactaccaatgtctcgctactaacactgtggggagcatcttaagcagggaagcgacgctgcagtttgcctacctcggcaatttctctggaaggactagatccgccgtgtctgtgcgcgagggccagggcgtcgtattgatgtgtagccctccacctcactcacccgaaataatttatagctgggtgttcaacgaattcccgtcatttgtggccgaggattcccggaggtttattagccaggagaccggaaacctgtatattagcaaagtgcaaacatccgacgtgggttcctatatatgtctcgtgaagaatacagtcacaaacgccagagtgctgtcaccccccaccccattgaccttgaggaacgacggggtaatgggtgagtacgagcctaagattgaggtgcatttcccgttcactgtgaccgccgccaagggcactactgtgaaaatggagtgctttgctctgggcaatcctgttcccacaattacatggatgaaagtaaatggttacataccttcgaaagcccggttaaggaagagtcaggcagttttagaaataccaaatgtgcaacttgacgacgccggtatttatgaatgcagggctgagaatagccgcggtaaaaattcatttcgtggacagttgcaggtttatacctatccacactgggtcgaaaaactgaatgacacacagcttgattccgggagtccgctccggtgggaatgtaaggccacaggaaagccccggccaacttacagatggttgaagaatggggtgcccttgagcccacaatcacgggtcgaaatggtgaatggcgttcttatgatacataatgtaaatcagtcagacgctggaatgtatcagtgtctggcagagaacaagtatggagccatatacgcaagtgccgaactaaaaatcctggcaagtgctcctactttcgccttgaaccagctgaagaaaactatcatagtgacaaaggatcaggaagttgtcatcgaatgcaaaccccagggtagtcctaaacctactatctcatggaaaaaaggcgatcgggccgtgcgcgaaaacaaacgcatcgccatactgccggacggcagccttcggattctgaacgcttctaaatcagatgagggcaagtacgtgtgccggggggagaacgtgttcgggtcagctgaaatcattgccagcctgagtgtgaaagagcctaccaggattgaactgaccccaaaaagaaccgagctgaccgttggcgaatcaatcgtgctgaactgtaaggccatccacgacgccagcctcgatgtgacattttactggaccctgaagggtcaaccaatagattttgaagaagaaggaggacattttgaaagcattagggcccaggcctcttctgcggatctgatgatccgcaacattctgctcatgcatgccggtaggtacggatgcagggttcagaccactgcagacagtgtgtccgacgaagcagaacttctcgtgcggggcccaccgggaccacccggaatcgtcatcgtagaggagatcactgaatcaaccgctaccctaagctggtctcccgccgctgacaaccacagccctatatctagctacaatcttcaagccaggagtcctttctctctgggctggcagaccgttaaaactgttccagaaattatcacaggggacatggaatctgcgatggccgttgatctgaatccctgggtcgaatatgagtttagagtggtcgctacaaacccgattgggacaggagacccgtcaaccccttcacgaatgatcagaacaaatgaggcagtaccaaagactgcgcccacgaacgtgagtggtcgcagcggcaggagacatgagctcgtcatcgcctgggagcccgtgtcagaggagtttcagaacggggagggttttggatacattgtagccttcaggcctaacggaactagggggtggaaagagaaaatggtgaccagcagcgaagcctctaaatttatctacagagacgagagcgtgcctccactgacgccattcgaggttaaggtgggggtgtataacaacaagggtgacggacccttctcccagatcgtggtgatttgcagcgctgagggcgagccctctgctgcacccacagatgtgaaggccacgagcgtgagcgtgtccgagatcctggtggcttggaagcacattaaagaatccctgggcaggccccaaggcttcgaagttgggtactggaaggacatggaacaagaggacacagccgagacggtcaaaacacgcggaaacgagtcattcgttatactcaccggactggaaggaaacactctgtaccattttacagtcagggcatataacggggccggctacggcccgccatcatctgaggtctctgctaccaccaaaaaatctcccccttcgcaggcaccgagcaatctcagatgggagcagcagggatcacaggtgtccctcggctgggagcctgtgatcccactggcgaacgagtccgaggtggtgggatataaggtattttatcggcaggaggggcactccaacagtcaggtgatcgaaacccagaagcttcaggccgtcgttcctcttccagatgcgggtgtgtacatcattgaggtgagggcttacagtgagggtggagacggcaccgcctcctcacagatcagggtgccaagttactctggcgggaagataacgagtgctcaatcgacactgcactccctttccacctcttcctccagtgttaccctgctcctagccctaatgatcccttcgactagttggtag

SEQ ID NO: 183798 - DNA, 3303 bp, Artificial Sequence
  Description of Artificial Sequence: Synthetic coding sequence
atggccagcagctggaagctgatgctgttcctgagcgtgaccatgtgcctgtcagagtatagtaagtctctgccaggcctgtccacttcttacgctgctttgctgcggattaagaagtcctcgtcctcctccctttttggcagcaagacacgtccaaggtacagcagccccagcctaggcacacttagcgctagctctccgtcatggttgggcgctgcgcagaattattattcaccaatcaatctataccattcctccgacgcctttaagcaggacgagtcagtggattacgggccggtgttcgttcaggagcctgacgatatcatatttcccacagactcagacgagaaaaaggtggcactgaactgcgaggtgcgcggaaacccggtcccatcatatcgttggctaaggaacgggaccgaaattgacctggagagtgactaccgttatagtttgatcgacggaacttttatcatcagtaatcccagcgaggctaaggactctgggcattaccaatgtcttgccacgaataccgtaggaagcatcctgagccgtgaagccacactgcagttcgcgtacctagggaatttttccggcagaacgaggagcgccgtcagcgtaagggagggccagggcgtagtgctaatgtgctctcctcccccgcattcccctgaaatcatatatagttgggtgttcaatgagttcccctcctttgtggctgaagatagtaggcggtttatcagccaagagaccgggaatctgtatatttcaaaagtgcagacctctgatgttggcagttatatttgcctcgtgaagaacaccgtgaccaacgctcgggttctctctcctccaactcctctgaccctccggaatgacggggtcatgggcgagtacgagcctaaaatagaggtccactttccattcaccgtgacagctgcgaagggaaccaccgtgaagatggaatgctttgcgctgggaaacccagtgccaaccattacatggatgaaagttaatgggtatataccttcgaaggcaaggttgcggaaatcacaagccgtgctagagattccaaatgtacagctggatgacgcgggcatctacgaatgccgggctgaaaattctcgaggcaagaattcgtttagaggacaactgcaagtgtacacgtatccacactgggtggaaaagctgaatgacacacagcttgatagtggttctccgctgaggtgggagtgtaaggcaacaggcaagccaagaccgacgtacagatggctgaaaaatggagtgcctctctctccccagagccgggtggagatggtgaatggagtgctgatgatccacaacgtaaatcagtcagacgctggtatgtaccagtgtctggcagagaacaagtacggtgccatctatgcatctgcagagttgaagatccttgcctccgcaccaacatttgccctgaatcagttgaagaagacaatcatcgtcaccaaagatcaggaggtggttattgagtgtaaacctcaggggtccccaaaaccaacgattagctggaaaaagggcgatagggctgtgcgcgagaacaagagaatagccattctgcccgacggttccctgagaatcctgaatgcttcaaaaagcgacgagggaaagtacgtgtgtcggggagaaaatgtgtttggatctgctgaaattatcgctagtctgtccgtcaaagaacctacaagaattgagctgacgccaaagaggaccgaactcactgttggagaatccatcgtcctgaattgcaaggcaattcatgatgcttctctggacgtgacattttattggacactgaagggacagcctatcgatttcgaggaggaaggcgggcacttcgagtctatcagagcacaggcttcatctgccgatcttatgattcgcaatattctgctgatgcatgcaggtagatatgggtgtcgtgtgcaaacaacagccgattcagtgtctgacgaggcggagctcttggtgaggggacctcctggccctccaggcatagtaatcgtcgaggagatcacagagtcaaccgccaccttatcttggagccctgcagccgacaatcacagccccatcagcagctataacctgcaggccagaagccccttctccctgggttggcaaaccgtgaagaccgtgcccgagatcattaccggggacatggaatccgcgatggctgttgacttaaacccatgggtcgaatatgagtttagggttgtggccacgaaccctattggcaccggggatcctagcacaccttctcgtatgatacgcacaaacgaagcagtgcctaaaacagctcccaccaacgtgtccggacgcagcggtcggcgccacgaactcgtgattgcctgggagccggtgagcgaggagtttcaaaatggggagggcttcggctacatcgtagcgttccgaccaaacgggacacggggatggaaagagaagatggtgactagcagcgaagccagtaagtttatttaccgtgacgaaagcgtccctccgctgacgccctttgaagtgaaagtcggggtgtacaacaataagggagacggacccttctctcagatcgtggttatctgttccgctgaaggcgaaccctcagccgcacctaccgacgtcaaggctacctctgtgagcgtcagcgagatattggtcgcttggaagcatattaaggagtcactggggcgtccacaggggttcgaagtcgggtactggaaggacatggagcaggaggatacagccgagacagtgaaaacccgggggaatgagagctttgtgattctgacagggctggaagggaacaccctgtaccatttcaccgtgcgggcctacaacggtgccggctatggtcctccttcttccgaagtgtccgccaccaccaaaaagagccccccttcccaagctccttcaaaccttcgctgggagcagcaaggctcgcaggtctctctcggatgggagcctgtgatacctctcgctaacgagtctgaagttgtgggctataaagtattttataggcaggagggtcacagcaacagccaagtgattgaaacacagaaactgcaggcagtcgtgccgcttcctgacgctggtgtctacattatcgaagtgcgcgcatatagcgaaggtggggacggaacagcttcttcccagattcgcgtgcccagttactctggggggaaaataacatcagcgcagtcgactcttcactctttaagcacctctagcagctcagtgacactgcttttggccctgatgatcccaagcaccagctggtag

SEQ ID NO: 183799 - DNA, 3303 bp, Artificial Sequence
  Description of Artificial Sequence: Synthetic coding sequence
atggccagcagctggaagctgatgctgttcctgagcgtgaccatgtgtctctccgaatacagtaagtccctgcccggattgtctacctcctacgccgctctgctccgcatcaagaagtcttcaagcagcagtctcttcggatccaagactaggcccaggtatagctcaccctccctgggtaccctgtctgcgtcttccccatcctggctgggcgcagcccagaattactactcccctatcaatctctaccatagcagcgatgcctttaagcaagacgagtcagtggattacggtcctgtatttgtgcaggaaccagacgacattattttccccaccgattcagacgaaaagaaggttgcccttaattgtgaggttagaggaaaccccgtgcccagttacaggtggctgcgaaacgggacagaaatcgacctggagagtgattatcgttattcactgatagacggcacgtttatcatctcaaatccgtccgaggcaaaagattcaggacattatcagtgccttgccaccaacacagtgggaagcattttaagccgcgaggccacactccagtttgcatatctggggaactttagcgggcggactcgtagcgccgtatcagttcgtgagggacagggcgtggttttgatgtgcagcccccctccccattccccagagattatctactcctgggtattcaacgagttcccctcatttgtcgcagaagactcccgaaggttcatctctcaggagactggaaacctgtacatctccaaggtgcagacaagtgacgtggggtcctatatttgtctagttaaaaatactgttacaaacgctcgcgttcttagcccccccacgccactcaccctgagaaacgacggagtgatgggcgagtatgagcctaaaatcgaggtgcatttcccgtttactgtgactgctgccaaaggaactactgtcaagatggaatgtttcgctctcggaaatcccgtgcctaccattacatggatgaaggtcaacgggtacattccatcaaaagcccgcttgcgcaaatcacaggctgtcctggaaatccccaacgttcagctggatgatgccgggatttacgagtgcagggccgagaactcccggggaaaaaacagcttcagaggtcaactccaggtctacacctatcctcattgggtggaaaaactcaacgacacacagcttgacagtggcagtcccttgcgctgggagtgcaaggctactgggaaacccagaccgacgtaccggtggctgaagaatggggtaccattgtctccgcagtctcgcgtggagatggtgaatggcgtgctcatgattcataatgtgaatcagtcggatgcgggcatgtatcaatgcctggctgaaaacaaatacggcgcaatctatgcatctgccgagctgaagatcctagcttccgctccaaccttcgccttgaaccagctgaagaaaacgattatagtcacgaaggaccaggaggtggtaattgaatgcaagccacagggaagcccgaagccaaccatttcatggaagaagggcgaccgtgccgtgagagagaacaaaagaatcgccatactacccgatggcagcctgcgcattttaaacgcctctaagtccgacgaaggcaagtacgtttgcagaggggagaacgtgtttggatccgcagagattatcgcatctctcagtgtcaaagagccaacccgcatcgaactaacaccaaagcggactgagctgacagtgggagagtccattgtgctgaattgtaaggcaatccatgacgcaagcctcgacgtgactttttattggacgcttaaaggccagcctatcgactttgaggaagaggggggtcacttcgagtctatccgggcccaagcatctagtgcagacctgatgatcaggaacatacttttgatgcacgccggccgctacggttgccgcgttcagacaacagctgactccgtaagcgacgaagctgaactgctggtgcgagggccccccggcccacctggcatcgtgatagttgaggaaatcaccgaatctacagctacactcagctggtcgcctgccgctgataatcactccccaataagtagctataaccttcaggccagatccccattctcattaggttggcagaccgtgaagaccgtgcctgaaattatcacaggagatatggagtctgctatggccgtggacctaaatccttgggtggagtacgagtttagagtggtcgccactaacccaattggcaccggcgaccctagcaccccaagtagaatgattcgaacgaacgaagctgtccctaagactgccccgacgaacgtgtctggccggtctggccggaggcatgaactggtgatcgcctgggagcccgtctccgaggagttccagaatggcgagggctttggctatattgtggccttccggcctaatggcaccagaggctggaaggaaaaaatggtgactagctcagaggccagtaagttcatctatcgcgacgagtccgtgcccccactgacaccgttcgaggtcaaggttggcgtgtacaataacaagggagatggcccattctcccaaatcgtcgttatctgctctgcagaaggagaaccatctgccgccccgactgacgtaaaggcaacctcagtttctgtctccgagattctcgtggcctggaaacatataaaagagagcctcggacgaccccaggggttcgaggtgggctactggaaggacatggagcaggaagataccgccgagacagtaaagactcgggggaacgagagtttcgtgatcctaacagggctggaaggcaatactctctatcacttcaccgtgagggcttacaacggagccggctatgggccgccctctagcgaggtttcggctaccaccaagaagagtccccccagtcaagcaccgtcaaacctcagatgggaacagcaggggagtcaggtcagtcttggatgggagcctgtgatcccgctggctaacgagtctgaagtcgtgggttacaaagtattctaccggcaagaaggccatagcaactcccaagtcatagagacacagaagctccaggccgtggtgccactccccgacgccggcgtgtacatcatcgaagtccgggcttactcagaggggggggacggtactgctagttcccagataagggtgccgtcttacagcggaggcaaaattactagtgcccagtccaccttacactccctgtccacctcaagttcttccgtcaccctgctccttgcactgatgatcccatccacctcatggtag

SEQ ID NO: 183800 - DNA, 2736 bp, Artificial Sequence
  Description of Artificial Sequence: Synthetic coding sequence
atggccagcagctggaagctgatgctgttcctgagcgtgaccatgtgtctgtccgaatactctaagagtctccctggcctcagtacatcctatgcagcgcttctgcgcatcaagaaatcctcgtcgagctcacttttcggtagtaaaactcggccgcgctattcaagcccctctctcggtacattatcagcttcgagcccatcatggttgggcgctgcccagaactattatagcccaatcaatctttaccactccagtgatgctttcaagcaggacgagtcagttgattacgggcccgtatttgttcaggagccagatgacatcatctttcccacggactccgacgagaagaaagtggctcttaactgcgaagtgaggggcaacccggtcccgtcgtacagatggctgcgaaacggcactgagattgatctggaaagtgactatagatactctcttattgacggcacattcatcatttctaaccccagcgaggccaaagattccggccactaccagtgcttggccactaatactgtcgggagtattctaagcagggaggccaccctacagtttgcctacctgggcaattttagcgggcgaacacgcagcgccgtctctgtgcgcgagggtcagggcgtagtgcttatgtgcagtcctcctccacatagccctgagattatctattcttgggtcttcaacgagttcccctcattcgttgccgaggactccaggcgcttcatttcccaggaaactgggaatttatatattagcaaagtgcagacctcggatgttgggtcctacatctgtttggtgaaaaacaccgtgaccaacgcccgcgtactgtctcctccaaccccgcttacccttcgtaatgacggcgtaatgggcgagtacgaaccaaaaattgaagtacatttcccctttacggttacggctgccaagggaacgaccgtgaaaatggagtgttttgctcttggaaaccccgtgcctacgattacctggatgaaggtgaatggatacataccctctaaggcaaggctgcgaaagtcccaggctgttctggaaattcctaatgtccagctcgacgatgcaggcatatacgaatgccgcgcagaaaactctcggggcaaaaattcatttaggggccaactgcaagtttatacctaccctcactgggtagagaaactcaacgacactcaactagactcaggaagcccactcaggtgggaatgtaaagccaccggtaaaccaaggcccacatatagatggctcaagaacggggtgcctctcagcccccagtctagagtggagatggtaaacggcgtcctgatgattcataacgtaaaccagagtgatgccggcatgtatcagtgcctggctgaaaacaagtacggtgcaatttatgcgtccgcagagctaaagatactggcgagcgcaccaacattcgcgctgaatcagctgaagaaaaccatcattgttaccaaagaccaggaggtggtgatcgagtgtaagcctcagggctcccctaagcccactatcagctggaaaaaaggcgatcgggctgttcgggagaacaagcggatagccatactgccagacggctctctgcgcattctgaacgcttccaagagcgacgagggaaaatatgtgtgccgcggagaaaacgtctttggcagcgccgaaatcattgcctcactgtccgtgaaagagcccacacgcattgaactgacccccaaaaggactgaactcacggtgggcgagtccatcgtcctgaactgcaaggcaatccatgatgcttcgctggacgtgactttctattggactctgaaagggcagcccattgattttgaggaagaaggaggccattttgagagcattcgcgctcaggccagctccgctgatctgatgattcgcaatatcctgctcatgcacgcgggccgctatggctgccgcgtgcagacaaccgccgactctgttagcgacgaggccgagttgctggtgcggggcccaccaggacctcccggcatcgttatagttgaggagattacagagagcaccgctaccttgagctggagccctgcggctgataaccattcacccatttcttcttacaacctgcaggctcgctcacctttctcactcggctggcaaactgttaaaacagtacccgaaattatcaccggtgacatggagtccgccatggcagttgatcttaacccatgggtcgaatatgagtttagggtcgtcgcaacaaatccgattgggacgggtgacccctcaacccccagccgcatgatacgtacaaatgaggccgtaccgaagacagcgcctacaaatgtatccggaaggagcgggcgccggcacgagctggtgatagcctgggaaccagtttctgaagaatttcaaaacggagaagggtttggctatatcgtggctttcaggccaaatggaactcgcgggtggaaagaaaagatggtgacgtcatcagaagcttcgaagttcatttatcgcgatgagagtgtccctccactgaccccgtttgaggtgaaagttggagtgtataacaacaagggggacggtccatttagccaaatcgtagtcatctgctcagccgaaggggaaccgtccgcagcccccacagatgttaaggctacttcagttagtgtcagcgagatcttagtggcctggaaacacatcaaagagagtctgggtcggccacaagggttcgaagtgtag

SEQ ID NO: 183801 - DNA, 3087 bp, Artificial Sequence
  Description of Artificial Sequence: Synthetic coding sequence
atgcggctgctgtggaagctggtgatcctgctgcccctgatcaactcaagcgctggggacggcctgttgtctcggccaatatttacacaggagccccatgatgtcatctttcccttggatctgagcaagagtgaagtgatcctgaactgcgcagcgaatggctacccttccccacattatcgctggaaacaaaatggaaccgatatcgattttacaatgtcctatcactacaggctggacggaggttccctggccatcaactccccccacactgaccaggacatcggcatgtatcagtgtctcgcaacaaacttactcggtactatcctgagtaggaaagcgaagctgcagttcgcttacattgaggacttcgaaacaaagacccggagcacggttagtgtgcgtgagggacaaggagtcgtgctgctgtgtgggcccccacctcactttggcgacctgagttacgcctggaccttcaacgataatccactttacgtacaggaagacaaccggcggtttgtgagccaagaaactgggaacctttatatagctaaggtggagcctagcgatgtgggaaattatacttgttttattacaaataaagaggcccaacgcagtgtgcagggccccccaacaccattggttcagagaacggatggcgtgatgggggagtacgagccaaaaatcgaagttcgtttccctgagaccatccaggccgctaaagattcctcagtgaaacttgagtgcttcgccttaggaaatcccgtgccagacatctcttggaggcgcctggatgggagccctttacctggcaaggtcaaatattcgaaaagtcaggctattctcgagattcccaacttccagcaggaagacgaagggttttacgagtgcattgcgtccaacctccgagggcgcaacttggccaaaggccagctgattttctatgcaccccctgagtgggagcagaagatacagaacactcatctctcaatctacgataatctactttgggaatgcaaggcatccggtaagcctaatccatggtacacttggttgaagaatggggagagactaaaccctgaagagaggatccagatcgagaatggcacactgataatcactatgctgaacgtctcagatagtggagtctaccagtgcgcagccgaaaataaatatcagatcatttatgctaatgccgaattaagggtgttagccagtgcccccgatttcagcaaatcaccggttaagaagaaatcttttgtgcaggtgggaggggatattgtaattggatgcaaaccgaatgcctttcctcgtgctgccatctcctggaaacggggtacagagaccttaagacagtccaagcgcattttcctgttagaggatgggtctcttaaaatttacaatattactcgctccgatgcgggaagctacacctgcattgctactaaccagttcgggaccgcaaagaataccgggtctctcattgttaaggagaggacagtgatcacagtgcctccaagcaaaatggacgtaactgtcggagaatccattgtcctgccatgtcaggtgtctcatgacccctccatagaggtggtttttgtttggttctttaacggagacgtgatcgacctgaagaaaggtgtcgcccactttgagagaatcggaggagagtcggttggggacttgatgatcaggaacatacagttgcaccactcaggaaagtacctgtgcacagtgcaaacaaccttggaaagcctgagtgccgtagccgacataatcgttaggggcccccccggcccccccgaggatgtgcaggtagaagatataagctctaccacaagtcagttgtcttggagggctgggccggataacaattcccctattcaaatattcactatccagacgaggacccctttctccgttggctggcaggccgtagccacagttcccgaaattctgaatggaaagacttacaatgctactgtcgtcggactgtccccctgggtggagtacgagttcagagtagtggccggcaactcaatcggcattggtgaaccatccgaacccagcgaactgcttagaaccaaggcctccgtgcctgtcgtggcccctgttaatatccacgggggcgggggtagtcgctccgagctcgtgataacttgggaatctatacccgaggagctgcagaacggagagggattcggctacatcatcatgttccggcctgttgggtctaccacctggagtaaagaaaaagtgagtagcgtggagagcagcaggttcgtttatcgtaacgaatctatcatccccctgtcaccttttgaagtgaaagtgggggtatataacaacgagggagagggtagcctgtccacagtgaccatcgtctattctggagaggacgagcctcagcttgctcctagaggtacctccttacagagttttagcgcttccgaaatggaagttagttggaatgcgattgcctggaaccgaaatacggggcgggtcctgggatacgaagtcttatattggactgatgattccaaggagagcatgattggcaagataagggttagcggcaacgtgactactaagaacatcaccggactgaaggccaatacaatctactttgcaagcgttcgggcgtataatactgccggaaccgggccaagtagtcctccagtcaacgtaacgactaaaaagtccccaccgtctcagccgcctgccaatatcgcttggaagctgaccaactcaaaactctgtctgaattgggagcatgtgaagacaatggaaaacgaatccgaggtcttagggtacaagattctctatcgccagaacaggcagtcaaagactcatattctagaaacaaacaacacctccgccgagctgctggttccattcgaagaggattatcttatagagatccggacagtttctgacggcggagacggaagcagtagcgaagaaatccgcataccaaagatgtccagcctgtcctccagggggatccagtttcttgagccctcaacccacttcttgtcgatcgtgattgtgatcttccactgttttgcgatacagcctctgatatag

SEQ ID NO: 183802 - DNA, 3087 bp, Artificial Sequence
  Description of Artificial Sequence: Synthetic coding sequence
atgcggctgctgtggaagctggtgatcctgctgcccctgatcaactcgtccgcgggcgacggtttactctcgcgaccaattttcacgcaggaaccccatgacgtgatttttcccctggatctgagtaagtctgaagttatattaaattgtgctgcgaatggttaccccagtcctcattaccggtggaaacagaatggcaccgatattgacttcacaatgtcataccattatcgacttgatggcggttctcttgcaattaatagccctcacaccgatcaggatatcggtatgtatcagtgcctagccaccaacctcttgggaaccatactgtctaggaaagccaaattacagttcgcttatatcgaggactttgagactaagacacgcagcacagtcagtgtaagggagggccaaggtgtggtcttactgtgtggcccgcccccccattttggcgatctttcctacgcatggaccttcaacgacaatcctctttacgtgcaggaagacaacaggcgttttgtgagccaggaaactggtaatctctacatcgctaaggtagaacccagcgacgtcggcaactatacgtgtttcattactaataaggaagcccagaggtctgtgcaaggtccaccaacccccctggtccaaagaacagatggggttatgggggagtatgaacctaagattgaggtgcggttccctgaaaccattcaggcagccaaagatagctccgtcaaactcgaatgcttcgctctggggaaccctgttccagacatctcttggcgccgcctcgacggatccccacttccagggaaggtgaaatactctaaatcacaggccatactggaaatccccaattttcaacaggaagatgaagggttttatgagtgtatcgccagcaatctgagggggcggaacctggccaaaggtcagctgatattttatgccccccctgagtgggaacagaagatccagaacacgcatctctcgatttacgataacctgctctgggagtgtaaagcctctgggaaacccaatccctggtatacttggcttaagaatggagagcggttaaacccggaggaacggatccagatcgagaacggaaccctcatcattactatgctcaacgtgtctgactccggcgtctaccagtgcgccgcagagaataagtaccagatcatatatgcgaacgcagaattaagagtgctagcgtccgcaccggatttttcgaagagtcctgtgaagaagaaaagcttcgtacaggtcgggggcgacattgtgatagggtgtaagcctaatgctttccccagggcggccattagctggaagcgcgggaccgagacacttagacagagtaaaaggatatttttgctggaagatgggtccctgaaaatttataacattactagaagcgacgccgggtcctacacttgcattgctacaaatcagttcggcacagccaagaatacgggaagcctgattgtaaaagaaaggacagtcatcaccgtgccaccctctaagatggatgtgacggtgggggagtctatcgtccttccctgccaggtgtcccatgacccaagtattgaggtcgtgtttgtatggtttttcaatggagatgttattgacctcaaaaaaggcgtcgcacacttcgagagaatcgggggagagagtgtaggggatcttatgatccgaaatatccaactgcaccactccggaaagtacttgtgtactgtccagaccacactggaatccctttcagccgtggccgacatcattgtaaggggtccacccgggccgcccgaggatgtacaagttgaggacattagcagcacaacaagtcaacttagttggcgcgccggcccagacaacaactcgcctattcaaatcttcacgatccagacccgcactccgttttccgttggctggcaggccgtcgccactgtgcctgagatactcaacggaaagacatacaatgccaccgtagtcggtctgagcccatgggtggaatacgaatttcgcgtggtggctggcaacagcattggtatcggggaacccagcgaaccgtctgaacttctgaggaccaaggcttctgtcccggtggtggctccggtcaatatccacgggggcggtggcagccggagcgagctcgtaatcacctgggaaagcatacctgaggagctccagaacggggaaggatttggctacataattatgtttagaccggttgggagtactacctggtccaaagagaaggtgtccagcgtggaatcctcccgctttgtgtatagaaatgagtctatcatccccctttcgccattcgaggtcaaggtgggcgtctacaacaacgagggggaggggtcactcagcacagtaacaatcgtctattcaggagaggatgagccgcagctagccccgcgaggcacatctctgcagagcttctctgcgagcgagatggaagtgagctggaacgccatcgcatggaataggaacacggggcgcgtgcttgggtatgaagtgctgtattggaccgacgactctaaggagtccatgattggtaagatcagggtgagcggcaacgtcaccactaaaaacattaccggtctgaaggcaaatacaatctattttgctagtgttcgggcctacaatactgccgggacggggccaagttcaccgcctgtgaacgtaactacaaagaaatcacccccgtcgcagcctccagctaacattgcttggaagctgaccaatagcaaactctgtctcaactgggagcacgtgaaaactatggaaaacgagtccgaagtgctaggctacaagatcctgtaccgacaaaatagacagagcaaaactcacatactggagacaaacaatacatcagccgaactgttggtccccttcgaagaagattatctgattgaaatccggaccgtgtccgatggcggcgacgggagcagctccgaggaaataaggatcccgaagatgagcagtctgagttctagagggatccagtttctcgagccatcaacgcacttcctttctatcgttatcgtaatcttccactgttttgccatccaacccctcatctag

SEQ ID NO: 183803 - DNA, 2871 bp, Artificial Sequence
  Description of Artificial Sequence: Synthetic coding sequence
atgagctaccactaccggctggacggcggcagcctggccatcaactcaccacatacggatcaggatatcgggatgtatcagtgtctggccaccaacctgctggggaccattttaagccgtaaagctaagctgcagtttgcatacatcgaggatttcgagacgaaaaccaggtctacagtttcagttcgcgagggacagggagtggtgttgctctgtggcccaccccctcacttcggagaccttagctacgcctggacatttaacgataaccccctctatgttcaagaagacaacagacgcttcgtgtctcaagagactggcaatttatatatcgccaaggtagagccgagtgatgtggggaattatacatgtttcattactaataaggaagctcagaggagcgtccagggaccccctacccctctggtgcagcgcactgatggggtgatgggggagtacgagcccaagatagaagtgcggttcccagagactatccaggcagctaaggattcatctgtgaagctagaatgctttgcattgggaaatcctgttcctgatatctcttggcgaaggttggacggctcacccctgccgggcaaggtcaaatattcaaaatcccaggccattctggaaatacctaactttcagcaagaggatgaagggttctacgaatgcattgcatcgaacctcagaggccgcaatctcgcaaagggccaacttatcttttatgccccacctgaatgggaacagaaaatacaaaacacccacctttctatttacgacaatctgctttgggagtgcaaggcatctggcaagcctaatccttggtatacctggctgaagaatggggaacggctgaaccctgaggaacggatccaaattgaaaacggtaccttaataattacaatgttaaacgtttctgactccggcgtttatcaatgtgctgcggagaataagtaccaaatcatttatgctaacgcggaactgagggtgcttgccagcgcacctgacttttctaaaagtccagtgaaaaaaaagtccttcgtccaagtggggggagatatcgtgatagggtgtaagccgaacgccttcccacgcgccgctatctcctggaaacggggaactgagactctgaggcagtccaaacgaatcttcctcttagaagatggctcactgaaaatttacaatatcactcgctcagacgctggctcctacacctgcatcgctacaaaccagttcggcaccgccaaaaataccgggagcttgattgtgaaagaaaggaccgtcattactgtccctccttccaaaatggacgtgactgtgggcgaatctatcgtcttgccatgccaggtcagtcacgacccaagcatcgaggtggtttttgtttggtttttcaatggagacgtcatcgatttgaaaaagggcgtcgcccacttcgaaagaataggtggggagagcgtgggagatctcatgattagaaatattcagctgcatcatagcggcaaatatctgtgtaccgtgcagaccacactagaaagcttatccgccgtcgcagatataatcgtacggggtccacctggccctcccgaagacgtgcaggtagaggacataagctctaccaccagtcagctctcttggcgtgcaggccccgataataatagccccattcagatatttacgatccagacgagaactccgtttagcgtcggctggcaggccgtcgccacggttcctgaaatcctcaatggtaagacgtataatgcaacggtcgtggggctatcaccttgggtagagtacgagttcagggtggtcgccggtaattccatcggcattggagaaccgtcagagccttcagaactgttgcgcaccaaggccagcgtgccagtggttgctcctgtcaacatccacggaggcggggggagccgctctgaattggttatcacttgggaatctattcccgaagagctccaaaatggtgaggggttcggatacatcataatgtttaggcccgttggatcaactacctggagcaaagagaaagtgtcttccgtcgagagttccaggtttgtttacagaaatgaatctattatcccactctcgccatttgaagttaaggttggagtttataataatgagggcgaggggtccctgagtacggttactatagtctattcaggcgaggacgaaccccaactggcccctcgtggcaccagcctgcaaagcttctccgctagcgagatggaggtctcctggaacgctatcgcatggaatcgcaacaccggacgagtacttgggtatgaggtcttgtattggactgacgactcaaaggagtccatgatcgggaagatcagggtgagcggaaatgtcacaaccaagaatattaccggcttaaaggccaataccatatacttcgcctccgttagagcttacaataccgccggcactggaccctcatctccccccgtgaatgtaaccaccaaaaaatcgcccccttcacagccacccgccaacatcgcttggaagcttacaaactccaagctttgtttgaactgggagcacgtgaagacgatggagaatgaaagcgaggtccttggatataagattctgtatagacagaatcgacagagcaagacacatatactagagactaacaatacatccgccgaactgttggtcccatttgaagaagattatctgattgagattaggacagtaagtgacgggggcgatggaagtagcagcgaagagatcaggatcccaaagatgtcctcactgtcctcccgtggaattcaattcctggagccttccacccactttcttagtattgtgatcgtgatcttccactgctttgccatccaacctctgatctag

SEQ ID NO: 183804 - DNA, 3996 bp, Artificial Sequence
  Description of Artificial Sequence: Synthetic coding sequence
atgcaggccgccccccgggccggctgcggcgccgccctgctgctgtggatcgtctcaagttgtctgtgcagagcctggacggcgccttccacgtctcagaaatgtgacgagccgcttgtaagcggcttaccacacgtcgcgttcagcagcagcagtagtatcagtggaagctattcccccgggtatgccaaaatcaacaagaggggcggggcgggggggtggtctccttcagacagcgaccactatcagtggctccaggtagactttggaaataggaagcagatcagcgccattgccactcagggaaggtactcttcctccgactgggttacccaatataggatgctctacagtgacacgggccgaaattggaagccttatcaccaggacggaaatatctgggcctttccaggcaacatcaattccgatggagttgttcggcatgagctgcagcaccccatcatagcccgctatgtgaggattgtgcccctcgactggaacggcgagggcagaataggtctgagaatcgaggtctatggttgcagctactgggcagatgtaattaatttcgatggccatgtcgtgctcccgtaccgattccgcaacaaaaagatgaagactttaaaagacgtgattgccttgaatttcaaaacttcggagagtgagggcgttattcttcacggagagggacagcaaggtgattatatcactctcgagctgaagaaggctaagctcgtgctctctcttaaccttgggtccaatcagctgggacccatttacggccacacctcagtgatgactgggtcgctcctggacgaccaccactggcattcagtggtgattgaaaggcagggtaggtccatcaaccttacactcgaccgctctatgcagcatttccggaccaatggcgaattcgactatctggacctcgattatgagatcacttttggtggtatacctttctctggaaagccttcatcctcttcaagaaaaaattttaaaggctgcatggaatcaataaactataacggtgtgaacatcactgaccttgccaggcgcaagaagcttgaaccttctaatgtgggcaatttgtcattttcatgcgtggagccttacactgtaccagtcttcttcaatgctactagctatctggaagtccccggaagattaaaccaggacctgttctccgtgtcctttcagttccgcacttggaatcccaatgggttgcttgtgttttcccacttcgccgataacctggggaatgtggagattgacctcacagagtccaaggtgggtgttcacattaatatcactcaaactaaaatgagccagattgacatcagttccggaagcgggctgaacgacggacagtggcacgaagtgaggtttcttgcaaaggagaacttcgctatcctgactatcgatggtgatgaggcttcagcagttcggacaaattccccactccaggtaaaaaccggggaaaaatactttttcggcggattcctcaatcagatgaacaactcctcccactcagttctgcaaccaagctttcagggctgcatgcagctcatccaggtggacgatcagcttgtgaatctctatgaggtcgcccagcggaaacccggaagctttgccaacgtgtccatcgatatgtgtgcgattattgatagatgtgtgcccaaccactgtgaacacggcggtaagtgctcacagacatgggattccttcaaatgtacttgtgatgagaccggctactcgggtgcgacgtgtcataacagcatctacgagccgtcttgcgaagcctacaagcacttggggcagactagtaactattattggatcgatcccgatggaagtggtccactggggcctctgaaggtctactgcaacatgaccgaagataaagtgtggacaatcgtgagtcacgatttacagatgcagacccccgtggttggctacaatccggaaaagtactccgtcactcagctcgtgtatagcgcctctatggaccagattagcgctatcactgattctgcagagtattgcgaacagtacgtgtcctacttctgcaaaatgtctcggctgctgaatacccccgatgggtccccctacacctggtgggtagggaaagcaaatgagaaacattattactggggtggctctggccccggaatccagaagtgcgcctgtggcattgaacgcaactgtaccgatccaaagtattattgcaactgcgatgccgactataagcaatggcggaaagatgcgggtttcctaagctataaagaccacctccccgtgtcacaggtggttgtaggagacacagaccgtcaggggtctgaagccaaactctctgtcgggcctcttcgatgtcaaggcgatcggaattattggaatgccgctagttttccgaatccatccagctatctgcatttcagcactttccagggggagacgagcgctgatattagtttctacttcaagaccctcactccctggggtgtattcctcgagaacatgggcaaagaggacttcatcaaactggagttgaaaagcgctacagaagtcagcttctctttcgacgtcggcaacggtcctgtcgaaatcgtggtccgcagcccaaccccgttgaatgatgatcagtggcatcgggtgactgctgagagaaacgtaaaacaggctagccttcaggtggatcgcctgccacagcaaattaggaaagcccccactgagggacacacccggctggagctgtattctcaactgttcgttggaggagcagggggccagcagggctttctaggctgcattagatctctgaggatgaatggagtgactcttgatctcgaggagcgagctaaggtgacttctggcttcatcagtggctgttcggggcactgcacatcttacggaactaactgtgaaaacggtggcaagtgcctggaacgctaccacggctacagctgtgactgttcgaatacagcctacgatggaacattctgtaataaggacgtgggcgctttttttgaagaggggatgtggttgcggtacaactttcaagctcctgcgaccaatgctagagatagttccagccgcgtggacaacgcccctgaccagcagaattcccatcctgacttagctcaggaggagatccgcttctccttctcaaccacaaaagctccatgtattttactctacatatccagcttcactaccgatttcctggctgtgctggttaaaccgacggggtccctgcagattcgctacaacctcggagggacccgggaaccatacaacatcgacgtcgatcataggaacatggcaaacggacagcctcacagtgtgaatattacccgacacgagaagacaatattcctcaagctggaccactaccccagcgtatcgtaccaccttccgtctagctctgacacactttttaactccccgaaaagcttgtttctaggtaaagtcatcgaaacaggtaagatcgaccaggaaattcacaaatacaacactcctggattcacggggtgcctgtcccgggtgcaatttaaccagatcgcacctctcaaggcagctctcaggcaaactaacgcctctgcccacgtccacatacagggtgagttagtggagtcaaattgtggggcatcacccctcactctcagccctatgtcttccgccacagacccatggcacttagatcacctggacagtgcctccgctgatttcccctataatcctggccaaggtcaggctatacgcaacggtgtgaacaggaatagcgcgatcattggcggagtcatcgcggttgttatctttaccatactgtgcacactggtcttcctgatcaggtacatgtttcgccacaagggtacatatcatactaacgaagctaagggagctgaatcagccgaaagcgcagacgccgccattatgaataatgatccgaatttcactgagaccattgacgaatctaagaaagagtggctgatatag

SEQ ID NO: 183805 - DNA, 1173 bp, Artificial Sequence
  Description of Artificial Sequence: Synthetic coding sequence
atgaacggcgtgaccctggacctggaggagcgggccaaggtgacctccggattcatctcaggctgcagtgggcactgcaccagttatgggaccaactgcgaaaacggcggaaagtgcctcgaaaggtatcacggctatagctgcgactgttcaaatacggcttacgacggcactttttgtaacaaggatgtcggtgcttttttcgaggagggtatgtggttgagatataatttccaggcaccagcaaccaatgcacgggactcatcatcaagggtcgacaacgcaccagaccagcagaatagtcacccggatttagcccaagaggaaattcggtttagctttagtacaacaaaggcaccatgcattctgttgtacataagcagctttacgaccgactttctagctgtactcgttaagcccaccggaagtctgcaaatacgctacaacctaggcggcacccgcgagccttacaacattgacgtggaccacagaaatatggctaatggacagccccattctgtaaatatcacacgccacgaaaagacaattttcctgaaactggatcactacccatccgtctcttaccatttaccaagcagctcagatacattatttaatagcccaaagtctttgttccttgggaaagtgatcgagaccggcaaaatagaccaagagatccacaagtataatacaccagggttcactgggtgcttgagtcgtgttcagtttaatcagatagcaccgttaaaggctgcccttaggcagacaaacgccagtgcacacgtgcacatacaaggcgagctcgttgagtctaactgtggagcatccccattgacgctttccccgatgtccagcgcgacggacccttggcacttagatcaccttgactctgccagtgcagacttcccgtataaccccggacagggccaggccatacgaaatggggtaaatcgaaattccgctatcataggaggggtaattgcagtggtcatattcaccattttgtgtacactcgtatttctgatccgctacatgttccgccacaaagggacctatcacacaaacgaggcgaaaggggcagagtctgcagagtctgcggatgcagccatcatgaataatgatcccaatttcacagagaccattgacgagtcaaagaaagaatggctgatatag

SEQ ID NO: 183806 - DNA, 1353 bp, Artificial Sequence
  Description of Artificial Sequence: Synthetic coding sequence
atgagcgacatggaggacgacttcatgtgcgacgacgaggaggactacgacctggaatattctgaggacagcaacagcgaacctaatgtagacctggagaaccaatattataacagtaaggcgttaaaagaggacgaccccaaagctgcactgtcttcatttcaaaaggtgctcgaactggagggcgagaagggtgaatggggcttcaaggccttgaaacaaatgataaagattaacttcaagctaaccaactttcccgagatgatgaatcggtacaagcagttgctaacttacatccgtagtgccgttacaagaaactattccgagaaaagtattaatagtatcctggactacattagcacttctaagcaaaattcggacttcctgtgccagatggatctgctccaggagttctacgagacaacactcgaggccttgaaagacgcgaagaatgacagactttggttcaaaacgaacacaaagttaggaaagctatatcttgagcgcgaagagtatggcaaactccaaaaaatcctcagacaactgcaccagtcttgccaaaccgacgatggcgaggatgatcttaagaaaggtactcaactcttagagatatatgccttggagatacagatgtacaccgcccagaagaataataaaaaattgaaggctctgtatgaacagtcccttcacattaagtctgccattcctcatccactgatcatgggtgtaattcgggaatgcggtgggaagatgcacctgcgagagggcgagttcgagaaagcacacacggattttttcgaagcctttaaaaactatgacgaatctggctctccaagaagaacgacttgcttgaagtacctggtgttggccaacatgcttatgaaatctggcattaacccctttgactctcaggaggctaagccttacaagaacgatccggagatcctcgccatgaccaatctcgtctccgcctatcagaacaacgacataactgaatttgagaagattctaaaaaccaatcactcaaacatcatggatgacccattcatcagagagcacatcgaagagcttctccggaatatccgaacccaggtcctgattaagcttattaagccatacacgagaatccatataccgttcatctcaaaagagctgaacatagacgtagcggatgtggagtctttgctcgtgcagtgcatcctagacaacactatccatggaaggatcgatcaggttaaccagcttctggaattggaccaccagaagaggggcggggctagatatactgcacttgacaaatggaccaaccagctaaattcacttaaccaggccgtagtgtctaagctagcctag

SEQ ID NO: 183807 - DNA, 1332 bp, Artificial Sequence
  Description of Artificial Sequence: Synthetic coding sequence
atgagcgacatggaggacgacttcatgtgcgacgacgaggaggactacgacctggaatacagcgaggacagcaacagcgagccgaacgtagaccttgaaaatcaatattacaactcgaaagcgctgaaggaggatgatcccaaagccgccctatccagttttcagaaagtactagagttggagggcgagaaaggcgaatgggggtttaaagccctcaagcaaatgattaagattaacttcaaattaaccaacttcccagaaatgatgaatcggtataaacagctgctgacatatataaggtccgcagtgacccgcaactattccgagaagtccatcaatagtatattggattatattagtacttccaaacagatggatctgcttcaggagttttacgaaactactctggaagcgctcaaggacgccaaaaacgatagactgtggttcaaaacaaacactaaactcggcaaactgtacctcgagcgggaggaatacgggaagctgcaaaagatcctgcgccagctccaccagtcatgccagacagatgatggcgaagatgatctgaaaaaggggactcagctgctagaaatctatgccctcgagatccagatgtacacggcccagaaaaacaataaaaaactgaaggccctctatgagcagtcactgcatataaaatctgcaatcccccatccgctaatcatgggggtgattagggaatgcggtggaaaaatgcatctgagagagggagagttcgagaaggcccacaccgacttctttgaggcattcaagaactatgacgagagcggttctcctcggcgcactacttgtttgaaatacctggtgctggcaaatatgctcatgaagtcaggaattaacccatttgattcacaggaagcaaaaccatataagaatgatcctgagatactggccatgacaaaccttgttagcgcctatcagaacaatgacataacagagtttgagaaaatattgaaaacaaatcattctaatatcatggatgacccattcatccgggagcacattgaggagctgctccgaaacatccgcacccaggtactcattaaactgattaagccgtacacgcggatccacatcccctttatatctaaagaattgaacattgacgtggccgacgtggaatctctactcgtgcagtgcattctcgacaatactatccacggtaggatagatcaggtgaaccagctgctggaactggatcaccagaagaggggaggtgcccgatacacagcactggataagtggacgaatcagctaaactccctgaaccaagctgtggtttcaaaactggcctag

SEQ ID NO: 183808 - DNA, 1272 bp, Artificial Sequence
  Description of Artificial Sequence: Synthetic coding sequence
atggccagcgccctggagcagttcgtgaacagcgtgcggcagctgagtgcccagggacagatgactcagctgtgcgaattgattaacaagagcggcgagctgctagccaagaacctgtcccatctcgacaccgtcttgggtgccctcgatgtgcaggaacattctctaggggtgcttgccgttcttttcgtgaaattttctatgccctccgtgcccgatttcgagacacttttttcgcaagtacaactgttcatcagcacatgcaatggcgaacacatacggtatgctactgatacattcgccggactctgtcatcagctcaccaacgccttggtagaacgtaaacagcctctcaggggcatcggcatccttaagcaagccatcgacaagatgcagatgaacaccaatcagctcaccagcatccacgcagatctgtgtcagctgtgcctgctagcaaagtgcttcaaaccagccctgccgtatctcgacgttgacatgatggatatctgtaaggagaatggggcctatgacgcgaagcattttctctgctattactattacggcggcatgatctataccgggttaaagaacttcgaaagggcgctgtacttctacgagcaggccatcactacaccagccatggccgtgagccacataatgctggagagttacaagaagtacattctagtaagcctgatactattagggaaagtccaacaactgcctaagtatacctcccaaattgtcgggcgctttataaagcctctctccaatgcctaccacgaattagcgcaggtctacagtactaataaccccagcgagctgaggaacttggtaaataaacacagtgagaccttcacccgcgacaataatatggggctggtgaaacagtgtctctcttccttgtataaaaagaatattcagcgcctaaccaaaacgtttctgactttatcactgcaggatatggcatcacgcgttcagctgagtggccctcaggaagctgaaaaatacgtcctgcacatgattgaagatggagagatcttcgccagcattaaccagaaagatgggatggtgagtttccacgataaccccgaaaaatataataatcccgccatgctgcacaacattgatcaagaaatgctgaagtgcatagagctggatgagaggttgaaagcgatggatcaagaaataactgtcaatcctcagtttgtgcagaagtccatggggtctcaggaagatgactcaggaaataagccgtctagctactcatag

SEQ ID NO: 183809 - DNA, 960 bp, Artificial Sequence
  Description of Artificial Sequence: Synthetic coding sequence
atggccagcgccctggagcagttcgtgaacagcgtgcggcagctgagcgcccaggggcaaatgacgcagctttgcgagctcattaataagtcgggcgaactgttggcaaaaaacctgtcccacttggacacggtgctcggcgctctggacgtgcaggaacattcactgggtgtgctcgccgtgctctttgtaaagttcagcatgccgtccgtcccggactttgagaccttatttagtcaggtgcagctctttatttctacatgtaatggggagcacattaggtatgcaaccgacacttttgccggtctgtgtcaccagctcacgaacgctttagtagaaagaaaacagcctcttagaggtattggtatccttaagcaggcaattgacaagatgcagatgaatactaaccagttgacttctattcatgcagatctttgccaactctgtctgctggcgaaatgtttcaagccggcccttccttatctggacgtcgatatgatggacatctgcaaggagaacggggcctacgacgcgaagcacttcctatgctattattactacggagggatgatctataccgggctgaaaaactttgaaagggccctgtatttctacgaacaggcgattaccacccctgccatggcagtgagccacatcatgctggagtcctataaaaaatacatcttagtctcactgattctcctgggaaaagttcaacagttacctaaatacacatcacaaattgtgggccgcttcattaaaagacagagtcttgcaatgttggctaggctcgtcctgaacagctggccgcaggcggtactactgcgtctacccccacgtgtgctgggcttgcagcccctctccaatgcttatcacgagctcgcacaggtgtatagcaccaacaaccccagtgaactgagaaacctggtcaataaacatagtgaaacatttactcgctag

SEQ ID NO: 183810 - DNA, 834 bp, Artificial Sequence
  Description of Artificial Sequence: Synthetic coding sequence
gccagccccttctgggtgagctggctgtacggcagccccctgcccgctccacccctgccagggggtgcacgatcagggacttgtgctccaatacttgtgcttcagaacgctgctgaggcactggctaggcagatgacacagctctgtgaactcatcaataaatccggcgagttgctggcgaagaatctcagccacctcgatacagtgcttggagccctcgacgtgcaagagcactccctgggtgtgctggcagtgctattcgtcaagttctctatgccatctgtcccagatttcgaaactttgttctcccaggtgcagctgttcatttccacatgcaacggcgagcacattcgttacgccacagacacctttgcgggcctctgtcaccagctcacaaatgcactggtggaacgcaaacagcccctgcgaggaattggaatcctgaaacaggctatagataagatgcagatgaacaccaaccagctgacatccattcacgccgacctatgtcagttatgccttctcgcaaaatgttttaaacctgcacttccatatctcgatgtggatatgatggatatatgcaaggagaatggggcttacgacgccaagcatttcctgtgttactattattacggcggcatgatatacactgggctgaagaacttcgaacgggcactttacttttacgagcaagccatcacaactcctgccatggccgtcagtcacatcatgctggagtcctacaaaaaatacattctggtgtctcttattctgctgggaaaagtacagcagctgcctaagtacacctcacaaattgtcggccgttttatctag

SEQ ID NO: 183811 - DNA, 1212 bp, Artificial Sequence
  Description of Artificial Sequence: Synthetic coding sequence
atgacccagctgtgcgagctgatcaacaagagcggcgagctgctggcgaagaacctgtcccaccttgatacagtgctgggcgcacttgatgtacaggagcacagcttgggcgtactggcagtattgttcgtgaaattctcgatgccatcagtccccgacttcgaaacactgttttcccaagtgcaattgtttatttctacatgcaacggagaacatattagatatgccaccgacacatttgccggtctctgccatcagcttacaaacgcacttgtcgaaaggaagcagccccttagaggcatcggaatcctcaaacaagctatcgacaagatgcagatgaatacaaaccaactgactagtattcacgcagatctttgtcagttgtgtctgctggctaaatgtttcaaacccgcgctgccctatctagatgtggacatgatggatatctgtaaagagaatggggcgtacgatgctaagcacttcctgtgttactattattacggaggaatgatctacactgggcttaagaatttcgaacgcgcactgtatttctatgaacaggctatcaccacccccgccatggccgtcagccacattatgctggagtcttataagaaatatatccttgtcagtttgatcctactgggaaaggtgcaacaactgcccaaatacacttcccagatcgttggccgctttattaagccactgtccaacgcttaccacgaattggcccaggtatatagtacgaataatccctctgagctcaggaatctggtgaataaacacagcgagacgttcacacgggacaataacatgggtcttgtgaaacagtgcttaagctctttatacaagaagaacattcaacggctgacgaagaccttcttgactctgtcactgcaggatatggctagtagggtccagctgtcaggcccgcaagaggccgagaagtacgtgctgcatatgattgaagacggggagatttttgcctctataaaccagaaggacggaatggtctcctttcacgataatccggaaaagtataataatccggccatgctacacaatatcgaccaagaaatgctgaaatgtatagaactcgacgaacgattgaaggccatggaccaggaaattacggtcaacccacagtttgtgcaaaaatccatgggaagtcaagaggacgattcggggaacaagccttcaagctattcttag

SEQ ID NO: 183812 - DNA, 1614 bp, Artificial Sequence
  Description of Artificial Sequence: Synthetic coding sequence
atggccgcccagtgcgtgaccaaggtggccctgaacgtgagctgcgccaacctgcttgacaaggatatcggctctaagtcagatccactctgtgtgctgttcctgaacaccagcggacaacaatggtacgaggtggagagaactgagaggattaaaaattgcctgaaccctcagttcagtaagacattcatcatagactattattttgaggtggtgcaaaagctgaagtttggcgtctacgacattgataataaaaccatagaactgtccgacgatgatttccttggggaatgtgagtgcactctgggccaaatcgtgtcatcaaagaaactgacaagaccactggtgatgaaaacagggcgtccagccggaaaaggctctattactatatctgcggaggagattaaggacaaccgtgtggtacttttcgaaatggaggcacgtaaattagacaacaaagacctttttgggaaatccgatccttacttggagtttcacaaacagacaagcgatggcaactggttaatggtacaccgcactgaagtggtgaagaacaacctgaatcctgtgtggcgcccctttaagatttcattaaattctctctgctatggtgacatggataagaccatcaaggtggagtgctatgattacgacaacgacggctcccacgatctcataggcactttccagaccaccatgaccaagctgaaagaggcgagccggtccagtcctgtggagttcgagtgcatcaatgagaagaagcgccaaaagaaaaagtcgtacaagaacagcggggtaattagtgtgaagcagtgtgagatcacagtggagtgtacctttttggattacatcatgggagggtgccagcttaactttacggtgggagtggacttcactggaagcaacggggacccgcgtagtcctgattctctgcattacatctcccctaatggagttaacgagtatctgacagcactgtggtccgttggcctggtaatacaagattacgatgctgataaaatgtttccggcttttgggttcggagcacaaattcccccacagtggcaggtaagccatgagttccccatgaattttaatccctccaacccttattgtaatggaattcagggaatagtggaggcttaccggagttgcctgcctcagattaaactctatggccctaccaatttcagtcccattatcaaccacgtcgcacgcttcgccgcggccgccacacagcagcagacagcatctcagtacttcgttctccttattatcaccgacggagtcatcacagatttagacgagacgagacaggccattgtcaatgccagccgtttaccgatgtctattatcatagtcggggtgggaggtgccgacttcagcgctatggagttcctagacggcgatggaggatctctgcgatcccccttgggagaagttgcgattcgggatattgtgcagttcgtcccctttcgtcagtttcaaaatgcaccaaaggaagcactcgcacagtgcgtactcgctgaaattccacagcaagtcgtgggttattttaatacgtataagttgctgcctcccaagaaccctgcaaccaagcaacagaaacaatag

SEQ ID NO: 183813 - DNA, 420 bp, Artificial Sequence
  Description of Artificial Sequence: Synthetic coding sequence
atggccgcccagtgcgtgaccaaggtggccctgaacgtgagctgcgctaatctgctggacaaggacatcgggtctaagagtgaccctctatgcgtgttgtttctgaacacctccgggcaacaatggtatgaggtggaaaggactgagaggattaaaaattgtctcaatccccagtttagcaagacattcatcatagactactactttgaggtggttcaaaagcttaaattcggagtgtatgacattgataataaaaccatcgagctgagcgatgacgatttcctcggagagtgcgaatgtactctggggcagatagtttcgtccaaaaagttaacaaggcctctcgttatgaaaacaggtcggcctgctggaaagggctccatcactatatccgccgaagagattaaggataaccgctag

SEQ ID NO: 183814 - DNA, 30 bp, Artificial Sequence; identical to SEQ ID NO: 77620
  Description of Artificial Sequence: Synthetic coding sequence

SEQ ID NO: 183815 - DNA, 1614 bp, Artificial Sequence
  Description of Artificial Sequence: Synthetic coding sequence
atggccgcccagtgcgtgaccaaggtggccctgaacgtgagctgcgcaaatctgctcgataaggatatcggcagcaaatccgaccccctgtgcgtcctatttctcaacacaagcggccaacaatggtacgaggtggagcgcaccgagagaataaaaaattgtctgaacccccagttttcaaagaccttcatcatcgactactatttcgaggtggttcaaaagctgaaatttggagtatatgacattgacaataagaccattgaactgagcgacgatgattttctgggtgagtgtgaatgtacactcgggcagattgtttcttcaaagaagctgaccagaccattagtcatgaaaaccggcagacctgccggcaagggctccattaccattagcgcggaagaaatcaaggacaatagagtcgtcctgttcgagatggaagcaagaaagcttgacaataaggacctgttcggcaaatcggatccttacctggagttccacaaacagacatcagatggtaattggctgatggtgcaccgcactgaggtggtaaaaaacaacctcaaccccgtgtggaggccattcaaaatttccctcaacagcctgtgctacggcgacatggataagaccattaaagtggagtgctatgactacgataatgacggctctcacgacctgatcggcacctttcagacaaccatgacaaagctcaaggaggcctccagatcctcacccgtggagtttgaatgcattaatgagaaaaaaagacagaagaagaagtcctataagaatagcggggtgataagtgtgaagcagtgcgagattacagtcgaatgtacgttcctagattacattatgggaggctgccagttgaatttcaccgtgggggtggattttacggggtccaatggcgatccaaggtcccccgactcactgcactatatttcccccaatggcgtcaacgaatacctgacggccctctggtccgtagggctggtcattcaggactacgatgcagacaagatgttccccgctttcgggttcggcgctcagatacctccccagtggcaggtctcacacgagttccctatgaactttaacccctccaacccatattgtaatggcatccaaggcatcgtggaggcttatcgcagttgcctgccccagattaagctctacgggcctactaattttagccctattattaaccacgttgcacgttttgcagctgccgctacgcaacagcaaacagcctcacaatacttcgtcttgctgattatcaccgatggagtgatcacagaccttgacgaaacaaggcaggctatcgttaacgcgtctcggctgcctatgagcatcataatagtgggggtgggaggcgccgatttttctgccatggaatttctggacggggacggcggtagccttagatctccactgggggaggtggctatcagagacatcgttcagtttgtgccattccgacagtttcagaacgctcccaaagaagccctggcccagtgcgttctggccgaaattcctcagcaagtcgtaggctactttaatacatacaaactcctgcctccaaaaaacccagcaactaagcagcaaaaacagtag

SEQ ID NO: 183816 - DNA, 240 bp, Artificial Sequence
  Description of Artificial Sequence: Synthetic coding sequence
atggccgcccagtgcgtgaccaaggtggccctgaacgtgagctgcgctaatctgttagacaaagacattggatctaagagtgatcccctgtgcgttctctttcttaacacatctggccagcagtggtacgaagtggagcggacagagcgtatcaagaattgcctcaatcctcagttctcaaaaacattcataattgactattatttcgaggttgtccagaaactgaagtttggcgtctag

SEQ ID NO: 183817 - DNA, 408 bp, Artificial Sequence
  Description of Artificial Sequence: Synthetic coding sequence
atggccgcccagtgcgtgaccaaggtggccctgaacgtgagctgcgccaacctgttagacaaagacatcgggagcaaatcagatcctctctgcgtactgtttctgaacacgtctggccagcagtggtacgaggtggagcgcaccgagcgtataaagaactgcttgaatccccagttctccaaaactttcataattgactactatttcgaagtagtgcagaagctcaagttcggcgtctatgacattgacaataaaactatagagctgagtgacgacgattttctcggtgaatgcgagtgcacgctaggccagatcgtctccagcaaaaagctgacacggcccctagtgatgaagacagggcggcctgctggcaaagggagcattaccatctctgccgaggagatttag

SEQ ID NO: 183818 - DNA, 705 bp, Artificial Sequence
  Description of Artificial Sequence: Synthetic coding sequence
atggccgcccagtgcgtgaccaaggtggccctgaacgtgagctgcgctaacctactagacaaggacatcggaagtaagtcagatcccctctgcgtcctgttcctgaatacttccggtcagcagtggtacgaggttgaaagaacagagaggatcaagaactgcctgaacccccagttctccaagacattcataattgattactacttcgaggtggtgcagaagctcaaattcggggtgtacgatattgataataaaacaatagagctgagcgacgacgacttcttaggagaatgcgaatgtacgttagggcagatagtgtctagcaagaagttaacccgtccgcttgtaatgaaaaccggccgccccgcgggcaagggctcaattacaatcagtgccgaagagataaaagataacagggtcgtgctctttgaaatggaggcaagaaagctggacaacaaggacctcttcggaaaaagtgatccctacctggagttccataaacagacgagtgatggcaattggctgatggtgcaccgaaccgaagtagtgaaaaataacctcaaccctgtctggaggcctttcaaaatttccttgaattccttgtgctacggggacatggacaaaacaatcaaagtcgaatgttacgactatgataacgatggctctcatgatctgattggcacattccagaccacaatgacgtag

SEQ ID NO: 183819 - DNA, 462 bp, Artificial Sequence
  Description of Artificial Sequence: Synthetic coding sequence
atggccgcccagtgcgtgaccaaggtggccctgaacgtgagctgcgctaatttactggataaggatattggatctaaaagcgatcctttgtgcgtactttttcttaacaccagcggccagcaatggtatgaggtcgagcggacagagaggataaaaaattgtctaaatccacagtttagtaagacattcatcatagactactattttgaggtcgtgcagaaattaaagttcggcgtctacgatatcgataataaaactatcgagctgtccgacgacgattttctgggtgaatgcgaatgtacacttggccaaatcgttagctctaagaagctaacacgcccccttgtgatgaagacaggacggccagcaggcaagggatccatcaccatctcagccgaggagataaaagacaaccgagtggtgctcttcgagatggaggcacgtaaactggacaacaaatag

SEQ ID NO: 183820 - DNA, 1782 bp, Artificial Sequence
  Description of Artificial Sequence: Synthetic coding sequence
atggagcagcccgaggacatggccagcctgagcgagttcgacagccttgctggaagcatcccggcaacgaaggtagagataacagtgagctgtcgtaaccttctggacaaagacatgttctcaaaatcagatccgctttgtgtcatgtacacccagggaatggagaataagcagtggagagaattcggccggaccgaagtcattgataacaccttgaatcccgattttgttaggaaatttattgtggactatttcttcgaggaaaagcaaaatctgcgtttcgacctatacgacgtggatagcaagagccctgatctgagtaagcatgactttttgggacaggccttttgcaccctgggagagattgttggttccccaggttctagattagagaaaccactgacgatcggagctttctctctgaattccagaacaggtaagcctatgcccgcagtgtcaaatgggggcgtccccggcaagaaatgcggcaccattatcctgagtgcagaagagctgagtaattgtcgagacgtggcaacaatgcaattctgcgctaacaagctggataagaaagatttctttgggaaatccgatccattccttgtcttctacagaagcaatgaggacggcacattcactatctgtcacaaaaccgaagtgatgaagaacactctaaatccagtgtggcagacattctctataccggtgagggccctgtgtaacggtgactacgataggacgatcaaggtggaggtatacgattgggatcgagacgggtctcatgactttatcggagagttcaccacatcatacagggagcttgcgcgaggacaatctcagttcaatatttacgaggtagtgaatcctaagaaaaaaatgaagaagaaaaagtatgtcaactccgggactgttaccctgcttagtttcgctgtggagtcagagtgtacatttcttgactacattaagggggggacccagataaattttacagtcgctattgactttacggccagcaatggaaatccctcgcagtccacatccctgcactacatgagtccttatcagctgaatgcctacgctctggccctcaccgccgtgggagaaattattcagcactatgacagcgataaaatgttccccgccctgggcttcggagcaaaactgcctcctgacgggagagttagtcatgagtttcctctcaatgggaaccaggagaatccgtcctgctgcggcatcgacgggattcttgaggcgtatcatagaagcctgagaaccgtacagctgtatggcccaaccaattttgcgccagtggtgactcacgtggcgcgaaacgccgccgccgtccaggacggttcacagtacagcgtgctgctaattatcacagacggtgtaatctctgatatggctcagacgaaggaagcaattgtaaatgccgcgaagttgccgatgagcatcattatagtcggggtgggtcaagcagaatttgacgcgatggtggagctagacggggacgatgtccggattagcagccggggcaagctcgccgagcgagacatagttcagtttgtgcccttccgcgactacgtcgaccgcacgggaaaccatgttctctccatggccagactggccagggacgtactcgccgagatccccgatcaattagttagttatatgaaagcacaaggtattagacccagacccccccccgctgcccccacgcatagtccttcacagtcgcccgcgcgcacaccccccgcatcaccgctgcacacccacatctag

SEQ ID NO: 183821 - DNA, 906 bp, Artificial Sequence
  Description of Artificial Sequence: Synthetic coding sequence
atgaagaagaagaagtacgtgaacagcggcaccgtgaccctgctgtcttttgccgttgaaagcgagtgtaccttcctggactatattaaaggaggcacgcagattaactttacagtggcaatcgattttacggcaagcaatggtaacccatcacagagtaccagtcttcattacatgagtccatatcagctaaacgcctatgccttggcactcacagccgtcggtgaaataattcagcattacgatagtgacaaaatgttcccagctctggggtttggggccaaactccctcccgacggtagagtatcccacgaatttcctttgaatggcaatcaagagaacccctcgtgctgcggcatcgatggcattttagaagcataccatcgcagcttgagaacagtccagttatatggtcctacaaacttcgcgccggttgtaacccacgtggcccgcaatgcagctgccgtgcaagatgggtcccagtactcagtgctcctgattataaccgatggagtgatatccgacatggctcagactaaagaggccatagtcaatgccgcaaagctgccaatgagcattataatagtgggcgtgggccaggccgagttcgacgccatggtcgagctcgacggggacgatgtccgcatcagctctcgagggaagctggctgagcgtgacatagtgcaatttgttccctttcgggactatgtcgaccggaccgggaaccacgtccttagcatggcccggttggctcgggatgtcctcgccgagatcccagatcagctcgtgagttatatgaaagcccaaggtatcaggcctcgacctcctccggccgcacctactcatagtccctctcagtctccagctcgaactccaccggcaagtcccctgcatacccacatctag

SEQ ID NO: 183822 - DNA, 1515 bp, Artificial Sequence
  Description of Artificial Sequence: Synthetic coding sequence
atggtgctggccgacctgggccggaagatcaccagcgccctgcggtctctctccaatgccaccattattaacgaagaggtgctgaatgcgatgcttaaggaggtgtgcacggctctccttgaagccgatgttaatatcaaactggtcaaacagttacgcgagaatgtgaaaagcgctattgacctcgaagaaatggcatcaggcctgaataagaggaagatgatccaacacgctgtctttaaggagcttgtcaaactggttgatccgggagttaaagcatggacccctacaaaggggaagcagaacgtaatcatgtttgttggcttgcagggctctgggaagaccacaacttgttcaaaacttgcctactattaccagcgcaaaggttggaaaacttgtctcatttgcgccgatacttttagagccggtgcgttcgatcaactgaagcaaaatgctacgaaagctaggatcccgttctatggctcttatacagaaatggatcccgttataatagcttcggagggtgtcgaaaagtttaagaatgagaacttcgagattatcatcgtcgacaccagcgggaggcacaaacaggaggattccctgtttgaagaaatgctgcaagtagccaacgccattcaaccagataacattgtgtatgtgatggacgcatccattggacaggcttgcgaggcccaagctaaggcctttaaggacaaggtggatgttgcaagcgtgatcgtgactaaattggacggccatgccaagggggggggtgcactgagcgctgtggcggccacgaagagccctatcatcttcatcggcaccggtgagcacattgacgacttcgagccctttaagacacagcccttcataagtaaactgctgggtatgggcgacattgagggacttatcgacaaggtgaatgagctgaagttggacgacaatgaggccctgatagagaagctgaagcacggacagtttacactgagagatatgtacgaacaattccagaatattatgaaaatgggtccattttctcaaatccttggaatgatccccggattcgggacagatttcatgtcgaagggcaacgagcaggaatcaatggctcgcttaaaaaaactgatgacaattatggacagtatgaacgaccaggagctcgactcgacagatggcgcgaaagttttctctaagcagccagggcggatccagcgcgtggcccgcggttccggtgtaagtacgagagacgtgcaagagctgttgactcagtacacgaagttcgcacagatggttaagaagatgggcggtatcaagggactgttcaaggggggagacatgtccaaaaacgtgagtcaatctcagatggcgaaacttaatcagcaaatggctaaaatgatggaccctcgtgtgctgcatcatatgggggggatggccggccttcagtctatgatgcggcagttccagcagggcgccgccggcaatatgaagggtatgatggggtttaataatatgtag

SEQ ID NO: 183823 - DNA, 1674 bp, Artificial Sequence
  Description of Artificial Sequence: Synthetic coding sequence
atgagcgaccccgagatgggctgggtgcccgagccccccaccatgaccctgggagcgagccgtgttgagttacgggtcagttgtcacggactgctggatcgagacacactgacaaagccgcatccctgcgtgcttcttaaactttactcagatgagcagtgggtggaggtggaaaggacagaagttctgagatcttgttcaagtcccgtgttcagccgggtccttgctctcgaatactttttcgaagaaaagcagccactgcagttccacgttttcgacgcagaggatggagccacctctccacggaatgacacgttccttggatcaactgaatgcactctgggtcaaatcgtgtctcagactaaggtgactaagccgctgctgttgaaaaacggcaaaacggctggcaagagtacgattaccatcgtcgcagaggaagtaagtggcactaatgactacgttcagctgaccttcagagcatacaagctggacaataaggatctgttctcgaaatctgacccttttatggagatatacaaaacgaatgaggaccagtccgaccagctggtctggcgaacagaagtcgtaaagaataatctgaatcctagctgggagccctttcgcttgtcactgcacagtctctgttcttgtgacgttcaccgacctcttaagtttctggtgtatgactacgatagctctgggaagcacgatttcataggcgaatttaccagcacgttccaagagatgcaggaaggcaccgcaaaccccggtcaagaaatgcagtgggattgcattaaccctaagtacagagacaaaaagaagaattataagagctctggcacagtggtgctggcccagtgtaccgttgaaaaagtccatactttccttgactatatcatgggggggtgccagatcagttttaccgtagccattgatttcacagcctccaacggagatcccagatctagtcagtctctgcattgtctgagccctcggcagcccaatcactacctccaggccttaagggcagtgggaggcatttgtcaggattatgattcagataagcggtttcctgccttcgggtttggtgcacggatcccaccaaacttcgaggtgtcacatgactttgccataaacttcgatcccgagaaccccgaatgtgaggagatttcaggcgtgattgcttcctaccgcagatgccttccccagatccaactgtacggccctactaacgtcgctcccattatcaatcgggtggccgaacctgcacagcgggaacagtcgacgggacaggctacgaagtattccgtcctgctggttctgacggacggtgtggtaagtgatatggctgagacgagaaccgcgatcgtgcgggcaagcagacttcctatgtccattatcatcgtgggcgtcgggaacgccgacttctccgacatgagactgctggacggagatgacggccctctgaggtgtccgcggggcgtacccgccgctagagatatagtacagtttgtgccttttcgggacttcaaagatgcggccccgagcgctctggccaagtgtgtcctcgcagaggtgccacgccaggtcgtggaatattacgcatctcagggaatttccccaggcgccccccgcccttgcacattggcaactacgccgtctccttctccctag

SEQ ID NO: 183824 - DNA, 1839 bp, Artificial Sequence
  Description of Artificial Sequence: Synthetic coding sequence
atggccttcaaggagcacggcaagatcaccagctgctgcatccccggccccattaattcttcccgcgctggcgccggggccggggcttctggttggagcagcaagggggtgcgcgcccgggcacgagaacccgaacgcggcgcccctgaccgggagcccagtgatatgtctgatcccgaaatgggctgggtgcctgagcctccaaccatgacattgggcgcaagtcgggtggaacttcgcgtttcatgtcacggactgttagatagggatactctcacgaaaccccatccatgcgtgctgttgaaactctactccgacgagcagtgggtcgaagtggagcggacggaggtgctaagaagctgtagctctcctgtcttttcacgagtgctggccctagaatatttctttgaagaaaaacaacccctgcagttccatgtatttgacgcagaggatggggctacttctccaaggaatgacacttttcttggctcgacagaatgcactctcggccagatcgtctcccagacaaaggtgaccaagccactgttgctcaaaaacgggaagaccgctggtaaatcaacaatcaccatcgtggcagaagaagtaagtggtaccaatgactatgtgcagctgacgttcagagcatacaaactcgataataaggatctgttttccaagtcagatccttttatggaaatttacaaaaccaatgaagaccaaagcgaccagcttgtttggaggaccgaagtcgtcaaaaataacctgaaccctagctgggagccattccgtttgtctctgcacagcctctgcagctgcgatgtgcacaggccactgaagttcctcgtgtatgattacgacagctccggcaaacacgattttatcggggagtttacatcgacctttcaggagatgcaggaagggaccgccaatcccggccaggaaatgcagtgggactgcatcaacccaaaataccgggataaaaaaaaaaattacaagtcttctggaacggttgtgctggctcagtgcaccgtggagaaggtgcatacgtttttggattacataatgggaggctgtcaaatctcatttaccgtggctatcgacttcaccgcaagcaacggtgacccccgctcgtctcaaagcttgcactgcctaagtccaaggcagccaaatcactacctgcaggcattgcgcgcagttggcggaatttgccaggactatgatagcgacaagaggtttcccgcgttcggctttggcgctagaatccctcctaactttgaagtgagccatgattttgctattaacttcgatcctgaaaacccagaatgcgaggaaattagcggggtcatcgcaagctatagacggtgtctgccacaaatccaactatacgggcctacaaacgttgcccctataataaatcgggtggctgagccggcacaaagggagcaatccaccggacaggccacaaagtactcggttcttctggttctcaccgacggtgttgtcagtgatatggctgaaacacgaactgctattgtccgggcttcccgcttgcctatgagcataatcatcgtgggagtgggtaacgcggacttcagcgatatgcgtcttcttgacggagacgacggtccactcaggtgcccgcgaggggttccggccgcccgcgacattgtacagttcgtgccgttcagagatttcaaagacgccgccccaagcgcacttgcaaagtgcgtccttgcagaagtccccagacaagtggtggaatactatgcatcccaaggaatcagcccaggagccccccgtccatgcactctggccacaactcctagcccttctccctag

SEQ ID NO: 183825 - DNA, 159 bp, Artificial Sequence
  Description of Artificial Sequence: Synthetic coding sequence
atgagcgaccccgagatgggctgggtgcccgagccccccaccatgaccctgggcgcgtcaagggtggagctgcgcgttagctgtcatggacttttagaccgcgacactctcacaaagccccatccatgtgtgctgcttaaactgtactctgatgagtag

SEQ ID NO: 183826 - DNA, 396 bp, Artificial Sequence
  Description of Artificial Sequence: Synthetic coding sequence
atgagcgaccccgagatgggctgggtgcccgagccccccaccatgactcttggggcctctagggtcgagctgcgagtgagctgccacggcttactcgaccgtgatactctgactaagccacatccttgcgttctgctgaaactctactcagatgagcagtgggtggaagtggagagaacagaggttctgcgcagctgcagctcaccagtgttttcccgagtgctggcactcgaatactttttcgaagagaagcaacccctgcagtttcacgtgtttgacgcagaagacggggcaacgtcccccagaaacgataccttcctcggcagcacagaatgcactcttggacagatcgtttcccagaccaaagtgacgaaaccactcctgttgaagaactag

SEQ ID NO: 183827 - DNA, 681 bp, Artificial Sequence
  Description of Artificial Sequence: Synthetic coding sequence
atgagcgaccccgagatgggctgggtgcccgagccccccaccatgacactaggtgcaagccgagtggagcttcgagtctcctgccacgggttgcttgatcgggataccctgactaaaccccacccatgcgtgctgctgaaattatactcagacgagcagtgggttgaggtggagagaactgaggtcctgagaagctgctctagtccggtctttagtagagtgttagctttggaatatttcttcgaggaaaaacaaccgttgcaattccatgtgtttgatgccgaagatggcgcaacatcacctcgcaatgataccttcctgggttctaccgagtgcactctgggccaaatagtgagccagactaaagtgactaaacccctgctcctgaagaacgggaaaactgccggtaaatccaccatcaccatcgtggctgaagaagtgagcggcactaatgattatgtgcagttgacctttcgggcttataagctggacaataaagacctcttcagtaagagcgacccctttatggaaatttacaaaactaatgaggaccagagtgatcagctagtttggaggacagaagtggtaaagaacaacttaaacccctcctgggagccctttagattgtcactgcattcactctgcagttgtgatgtccaccggccattaaaatttctgtag

SEQ ID NO: 183828 - DNA, 318 bp, Artificial Sequence
  Description of Artificial Sequence: Synthetic coding sequence
atgagcgaccccgagatgggctgggtgcccgagccccccaccatgacgctgggcgctagcagagtggagctccgagtgagctgtcatggactcctcgatcgggacacactgaccaaaccacacccttgcgtcctcctgaaactgtacagtgatgagcagtgggtggaagtcgagaggacagaggttttgcggagttgctcatcccccgtcttctccagagtactggctctagaatatttttttgaggagaagcagccccttcagttccacgtgtttgatgctgaagacggggcgacatccccaaggaatgacacctag

SEQ ID NO: 183829 - DNA, 426 bp, Artificial Sequence
  Description of Artificial Sequence: Synthetic coding sequence
atgagcgaccccgagatgggctgggtgcccgagccccccaccatgaccttgggcgcttctagagtcgaattaagggtcagttgccacggcctcctagatagggacaccctaactaagccacatccatgtgtgctgctgaaactgtactccgatgagcagtgggtcgaggtggagcgaaccgaggtgctgagatcatgtagcagccccgtgttctcccgcgtgttggcgttggagtacttttttgaagaaaagcaacccctgcagtttcatgtgttcgacgcagaagatggggctacaagcccccgaaacgacactttcctcgggtccaccgaatgcacacttggccagattgtttctcagaccaaagtaacaaagcccttactcctgaaaaatgggaaaacagcaggaaagtctactataacctag

SEQ ID NO: 183830 - DNA, 450 bp, Artificial Sequence
  Description of Artificial Sequence: Synthetic coding sequence
atgagcgaccccgagatgggctgggtgcccgagccccccaccatgaccctgggggcgagccgggtcgaactgcgggtgtcttgccacgggctgctggatagggacaccctgaccaagcctcatccatgcgtcctcttgaaattatattctgatgaacagtgggtggaagtggagcggacagaagtactcagaagctgttccagtcctgtcttttcaagagtcttagccttagaatatttttttgaggagaaacagccattgcagtttcatgtgtttgatgcagaggatggagcgacaagtcccagaaatgacacttttctcgggtccaccgaatgcacactcggacagattgtgtcacaaaccaaggttacaaagccgctcctgcttaaaaatggaaagaccgcgggaaagtccactatcacgattgttgcagaggaggtcagcggttag

SEQ ID NO: 183831 - DNA, 1902 bp, Artificial Sequence
  Description of Artificial Sequence: Synthetic coding sequence
atgagcgccggcagcgagcggggcgccgccgccacccccggcggcttgccggccccctgcgcctcgaaagtcgagctaaggttgagctgccgtcacttgctggatagagacccgttgactaagagtgatccctcagtggccttgctgcagcaagctcagggccagtgggtccaggttggccgtactgaggtggtccgatcatctctacaccctgttttcagcaaagtattcactgtcgactattacttcgaggaagtgcaacgcttgcggtttgaggtttatgatacccacggaccatccgggttctcttgtcaggaggacgactttctgggggggatggagtgcacgctgggtcaacccgcccagaaatggctgttgcaggtggtgatgagagtttcagttgacgttctcggccccgcaggtcattgcgccaagcactttttatgctgcactgaatcctcgcatctggccaggacaggccctagtttccttctgagatatgatgatttatgccttccctgggccacagcgggcgcagttcgatggtggacctgtaggggcggtcacacgcaagggtggcagatagtagctcagaagaaggtgacacgccctctacttctgaagttcggccgtaatgcggggaagtccactatcaccgtgatcgctgaggacatatcagggaacaatggctatgtggagctgagtttcagagccagaaagctggatgataaggacctattctctaaaagtgacccattcttagaactatacagggtgaatgatgatcaggggcttcagctggtgtatagaacggaagttgtgaagaacaacttgaatcccgtctgggaggctttcaaggtgtctctgtctagtttgtgctcatgtgaagagactaggccattgaagtgcctggtctgggattacgactcccgcggaaaacacgatttcattggggagtttagtaccaccttcgaagaaatgcagaaagctttcgaggagggacaggctcagtgggattgtgtaaatcccaaatacaaacagaagcgtcggagctataaaaactcaggtgtcgtggtcttggctgacctgaaattccacagggtctattcattcctggactatataatgggggggtgtcagattcactttacagtggccattgatttcaccgctagcaatggtgacccgaggaactcatgcagtctgcactacattaatccctatcagcctaacgagtacctgaaagccctggtaagcgtgggagagatctgccaggactatgatagcgacaagcggtttagcgctctcgggtttggagcacggatcccacccaagtacgaggtgagtcatgatttcgccatcaactttaatcctgaggatgacgagtgcgaggggatccaaggggtagtcgaggcataccaaaactgtctgcctcgagtacagctgtatggccctaccaacgtcgcccctataattagtaaagtggcacgggttgccgctgcagaggaatccacaggtaaggcctcacagtattacattcttctcatcctgactgatggggtagttaccgacatggccgataccagggaagccattgtgcgcgccagtaggctccccatgtcgatcatcatcgttggcgtcgggaacgcagattttacagacatgcaggtcctggatggcgacgatggggtgctgagaagcccgcgaggtgaacctgctctgagagacatcgttcagtttgtgcctttcagggagctgaagaacgccagtcctgctgccctggccaagtgcgtactagcggaggttcccaaacaggtagtggagtactattctcacaggggcctgccacccagatctctgggagtgcccgctggagaggcttcacctggctgcaccccttag

SEQ ID NO: 183832 - DNA, 1677 bp, Artificial Sequence
  Description of Artificial Sequence: Synthetic coding sequence
atgagcgccggcagcgagcggggcgccgccgccacccccggcggcctccctgccccctgtgctagcaaggtggaattgagactgagctgtcgccatctgctggaccgcgacccactgaccaagagcgatccaagtgtggctctgttacagcaggcccagggtcaatgggtccaggtggggagaaccgaagttgtacgttcctctctgcatcccgtcttcagtaaagtgttcacggtggactattattttgaggaagtgcaacgcctgcgtttcgaggtctatgatactcatgggcccagcgggttctcttgtcaggaagatgatttcctcggggggatggagtgcactctcggccagatcgttgcccagaagaaagttacccgtccgctgttgctgaagtttggccgaaacgcgggcaagagcacaattactgtcatcgcagaggatatctccggtaacaatggttacgtggaactgtcatttcgcgccaggaaactcgacgacaaggatctgttctctaaatccgacccttttctggagttataccgggtgaatgacgaccagggcctgcaattagtctacaggacagaagtggtgaaaaacaatttaaatcccgtgtgggaagcctttaaggtctccctgagttccctgtgttcttgtgaggagacgagaccactcaagtgtctagtgtgggattacgacagcagaggcaaacatgactttattggcgaattctccacgaccttcgaggagatgcaaaaggcctttgaggagggccaggcgcagtgggactgtgtaaatccaaagtacaaacagaagcggcggtcttataagaacagcggagtggtggtcctggccgatctgaaattccaccgggtgtactcttttctggactacatcatggggggctgccagattcattttacagtggccattgatttcaccgcctccaacggtgaccctagaaatagctgctcattgcattatatcaacccttaccaaccgaacgagtacctgaaagctttggttagcgtcggggagatctgtcaggactatgactctgacaagcggttctctgcactgggcttcggggcacgtattcctcccaaatacgaggtgtctcatgatttcgctattaatttcaaccccgaagatgacgagtgcgaaggaatccagggtgtagtggaggcttatcaaaattgcttacctcgcgtacagctgtatgggcccaccaacgtggcgccgattatttcaaaagtggctagggtggcagccgccgaagaatccaccgggaaggcttctcagtactacattttgctcatcttgacggatggggttgttactgatatggctgacacacgggaggcgatagtccgggcttctaggctccccatgagtataattatcgtgggggttggcaatgctgatttcaccgatatgcaggtcctggatggtgatgacggcgtgctgagatcaccgcgtggggagcccgccctcagggatatcgtccagttcgtcccctttcgggaactgaaaaacgctagccctgcagctctcgccaagtgtgtgcttgcggaagttcctaaacaggtcgtggagtactattcccaccgaggccttccaccgcgcagtctgggggttccagctggcgaggcaagcccaggctgtacaccctag

SEQ ID NO: 183833 - DNA, 825 bp, Artificial Sequence
  Description of Artificial Sequence: Synthetic coding sequence
atggccagcgacagcggcaaccagggcaccctgtgcaccctggagttcgcagttcagatgacttgtcaatcttgtgtcgacgccgtgcgtaagtccctacagggtgtggccggtgtccaggatgtggaagtgcaccttgaagatcagatggtgctcgttcatacgaccctcccctctcaggaggtccaggctctgctcgaaggaacagggaggcaagccgtactcaaggggatgggaagcggccagctgcagaacctgggggccgccgtcgccatcctcgggggccctggtaccgtccagggcgtggtgcgttttcttcaactgacaccagaaaggtgcctgatcgaagggaccatcgatggcctggaacccggcctgcatggactgcacgtacaccaatatggagatctcacaaacaactgcaacagctgtggcaaccacttcaatcccgacggcgctagccatgggggcccccaggattctgaccgtcatcggggggacctggggaacgtgcgagcagatgctgatggaagggcaatcttccggatggaagatgagcaattgaaggtgtgggacgtgatcgggcgaagcctgatcatcgacgagggagaggacgacttgggccgcggaggacacccattgtctaaaattaccggcaattccggcgaaaggctggcatgcggaataatcgcaaggtccgccgggttattccaaaatcccaagcagatttgttcctgcgatggcttaacaatatgggaggagcgaggccgccctattgctggcaagggccgtaaggagagcgcacaacccccggcccatttgtag

SEQ ID NO: 183834 - DNA, 1365 bp, Artificial Sequence
  Description of Artificial Sequence: Synthetic coding sequence
atggccctgcagctgggccggctgagcagcggcccctgctggctggtcgcgagagggggttgtggcggaccacgagcttggtctcaatgtggaggaggtgggcttcgggcctggtctcagcgctcagctgccgggagggtgtgtagacccccagggcccgcaggcacagaacaatcccgcgggttggggcacggaagtaccagccgcggagggccttgggtggggaccggcctggcagctgcgctggccggcctggtaggattggcaaccgccgctttcggccatgtgcaacgggcagagatgctgcctaagacttctgggaccagagctacttcactagggcgacccgaggaagaggaggatgaacttgcccatagatgtagttccttcatggcgccccctgtgaccgatctgggagaactgcggcggcggccaggagatatgaaaacaaaaatggaattgctgatcctcgagacccaggctcaagtctgtcaggcgttggcccaggtagacggcggggccaatttttcagtggacagatgggagcgcaaagaggggggcggcggaatttcatgtgtcctccaggacggatgtgtgttcgagaaagctggcgttagtatctctgtggttcacggtaacctgagcgaggaagccgctaaacagatgagaagccgaggaaaagtactaaaaacaaaagatggtaaactaccattctgtgctatgggcgtatcaagcgtgatccaccctaagaaccctcatgctccgactattcactttaattatcgctacttcgaggtggaggaagcagatgggaacaagcagtggtggttcggaggaggatgtgatctgaccccaacctacctgaatcaagaggacgccgtccattttcacaggaccctgaaagaagcatgtgatcagcatggccctgatctgtaccctaaattcaaaaagtggtgcgacgactacttcttcatcgctcatcggggggaacggaggggcatcggaggaatattcttcgacgacctggacagtccttcaaaggaagaagtgtttagattcgtgcagagctgtgccagggcggtggtcccatcctacataccactggtcaaaaagcactgtgatgactcgtttacccctcaggagaagctatggcagcagctcaggcggggtcgatatgtcgagtttaacctgctgtacgataggggaacaaagttcggcttatttactccaggttcaagaatcgagtccattcttatgagtctccctctgaccgctaggtgggagtacatgcacagtccttccgagaattctaaagaagctgagatcctggaggtcctacgacaccctagggattgggtcagatag

SEQ ID NO: 183835 - DNA, 1026 bp, Artificial Sequence
  Description of Artificial Sequence: Synthetic coding sequence
atgggcgtggccaccaccctgcagccccccaccaccagcaagaccctccaaaagcaacatctggaagctgtgggtgcataccagtacgttctgacatttctctttatgggacccttctttagtctgctcgtctttgtcctgctgttcactagcctgtggcccttcagcgtgttctatcttgtctggctctatgtcgactgggacacccccaatcaagggggacgtaggagcgaatggattaggaacagggccatatggaggcagttgcgcgactactatccagtgaagctggtgaaaacggcggaacttcctccggaccggaactacgtactcggcgcccatccacacgggataatgtgtactgggtttctctgtaatttcagtaccgagagcaacggtttctcccagctattccctgggcttagaccttggctggccgtgctcgccggtctgttttatctgcctgtgtatagggattatataatgtcttttgggctgtgtcccgtctccagacagtccctcgactttatcctctctcagccacagctggggcaggctgtcgttattatggtgggcggagctcacgaggcactatactcggtgccaggtgagcactgcctgaccctgcagaagcggaagggattcgttaggctcgctttgcgccatggggccagcctcgttcctgtgtatagctttggggagaacgacatattccgtttaaaagcatttgccacgggcagctggcaacattggtgtcagctgactttcaagaagctgatggggttttcaccgtgtatattttggggcagagggctcttctcagccacatcttggggcctgctcccgtttgcggtgccaatcacaactgtggttggccggcctatccctgtaccccagagactgcatcctacagaagaggaagtaaaccattaccacgctctgtacatgaccgccctggagcagctattcgaggagcacaaggagtcatgcggtgtccctgccagcacctgtctcaccttcatttag

SEQ ID NO: 183836 - DNA, 930 bp, Artificial Sequence
  Description of Artificial Sequence: Synthetic coding sequence
atggccagcaagagctggctgaacttcctgaccttcctgtgcggcagcgccatcggctttttgctatgctcccaattatttagcattctactgggtgagaaagtcgacactcagccgaacgttctccacaacgatccccatgccagacactccgacgacaacggtcagaaccacttggagggtcaaatgaacttcaacgctgattcctcccagcataaggatgagaacactgacatcgccgagaacctctaccagaaggtgcggattttatgttgggtgatgactgggccacaaaacttggagaaaaaagccaagcatgttaaggcgacctgggcacaaaggtgtaacaaagtcctgttcatgagtagcgaggagaacaaggattttcctgcggtgggacttaagaccaaagaaggccgggaccagctctactggaagaccatcaaagcttttcagtacgttcacgaacactatctggaggatgctgattggtttttgaaagcagatgatgacacatacgtgatcctggacaacctaagatggctcctatcaaagtatgatcccgaagaaccaatctactttggtagaagatttaagccatacgtcaagcaggggtatatgtccggaggagccgggtatgtgctgtccaaggaggccttgaagcgcttcgttgatgctttcaaaacggataaatgcacacattcgtcttcaatcgaagacctggctttgggccgctgcatggaaataatgaacgtggaggcaggcgacagcagggataccatcggcaaggagacattccacccgtttgtgcctgagcaccacctgattaagggctacctgcccaggaccttttggtactggaactacaactactacccaccggtcgaggtgagcctcgaaatcttgctgctatgccagtacctcgattag

SEQ ID NO: 183837 - DNA, 303 bp, Artificial Sequence
  Description of Artificial Sequence: Synthetic coding sequence
atggccagcaagagctggctgaacttcctgaccttcctgtgcggctctgcgataggcttccttttgtgcagccagctgttttcaattctgctgggagagaaagtggatacccagcccaatgtcctgcataatgatccccatgcccggcatagcgatgacaatggacagaatcacctggagggacaaatgaactttaacgccgattccagccagcacaaggatgaaaacactgacatagctgaaaacctctaccaaaaagttaggatcctgtgttgggtgatgactggaccccagaatctgtag

SEQ ID NO: 183838 - DNA, 396 bp, Artificial Sequence
  Description of Artificial Sequence: Synthetic coding sequence
atggccagcaagagctggctgaacttcctgaccttcctgtgcggctcggcgatagggtttctgctgtgttcacagttgttttcaatcctgctaggagagaaagtggacactcaaccgaacgttttgcacaatgacccccacgctagacacagcgatgacaatgggcaaaatcaccttgaggggcagatgaattttaacgcagactcatcccaacataaggacgagaacacagatatcgcagaaaatctctatcagaaagtccgaatcctctgttgggttatgacagggccccagaacctggaaaaaaaagccaaacatgtcaaagccacctgggcacagcgctgtaataaggtgttatttatgtcctctgaggagaacaaggacttccccgcatag

SEQ ID NO: 183839 - DNA, 1092 bp, Artificial Sequence
  Description of Artificial Sequence: Synthetic coding sequence
atggccagcaagagctggctgaacttcctgaccttcctgtgcggcagtgccatcggctttttgctatgttcccagttattctccattctcctgggcgagaaggtcgacacccagcccaatgttctgcacaacgacccgcacgcacggcactcagacgataatggccagaaccatctggagggccagatgaactttaacgcagatagttcccaacataaggatgaaaatactgatatcgccgagaatctgtaccagaaagttcggatcctgtgctgggtaatgaccgggccccaaaacctcgaaaaaaaggccaaacacgtcaaggcaacttgggcccaacggtgcaataaggtcttattcatgtctagcgaggagaataaggacttcccagccgtgggattgaagaccaaagagggacgggatcagctgtattggaagaccattaaagccttccagtacgtccacgaacattacctggaggatgccgactggttcctgaaggcagacgacgatacgtacgtaattctcgataacttgaggtggctgctgtcaaagtatgacccagaagaacctatctactttggtcgacggtttaagccgtatgttaaacagggctatatgtccggaggcgcgggttatgttttatcaaaagaggccttaaaaagatttgttgacgcctttaagaccgacaagtgtacacactcatccagcatcgaggatctcgcattgggccggtgtatggagatcatgaatgtggaggccggcgacagccgggacactattggcaaggagacattccacccttttgtgcccgaacaccatctcattaaagggtatctgccgcggacattctggtactggaactacaactactatcctccagtggaagggcctggctgctgctcggatctggccgtctccttccactatgtggacagcacgacaatgtacgagttggagtacctggtgtaccacctgcgcccttacgggtacctgtataggtatcagcccacactcccagagaggatcttaaaggaaatctcgcaagcaaataaaaatgaggacactaaagtgaaactgggcaacccgtag

SEQ ID NO: 183840 - DNA, 549 bp, Artificial Sequence
  Description of Artificial Sequence: Synthetic coding sequence
atgccccgggtggtgcccgaccagcggagcaagttcgagaacgaggagttttttagaaaattgtctcgtgaatgtgaaattaaatatactggctttcgagatcgaccccacgaagagcgtcaggcccgattccaaaacgcctgcagagatggacggtcagagattgcgttcgtggccactgggaccaacctttctctgcagttcttccccgcctcctggcagggggaacaaagacaaacgccatcccgggagtacgtagacctggagagggaagccgggaaagtctacctcaaggctccgatgatactgaatggagtttgcgttatctggaaggggtggatagatctacagcgacttgacgggatgggatgtctcgagttcgacgaggaacgggcccaacaggaagatgcactagcgcagcaggcctttgaggaagcgcggaggcggacacgcgagttcgaggaccgtgatagaagccaccgggaagaaatggaggtgcgcgtgtcccagttattagcagtcaccggaaaaaagacaactaggccctag

SEQ ID NO: 183841 - DNA, 564 bp, Artificial Sequence
  Description of Artificial Sequence: Synthetic coding sequence
atgccccgggtggtgcccgaccagcggagcaagttcgagaacgaggagttttttaggaaactgtctcgtgaatgtgaaatcaaatatacaggcttcagggacagaccgcacgaagaaagacaggctagattccaaaatgcttgtcgagatgggagaagcgaaattgcatttgttgcaacagggaccaatttaagcctgcagttttttcccgcttcctggcagggcgagcagagacaaacgccctcacgtgaatacgttgatctagagcgcgaggccgggaaagtttacctgaaggcaccaatgatcctcaatggtgtgtgcgtgatttggaagggttggatagacctacagcggctcgacggcatgggttgcctagaattcgacgaagaacgcgctcagcaagaggatgccctcgcccagcaggctttcgaggaggccagacgccggactagagaatttgaggacagagaccggtcccatagggaggaaatggaggctaggcgccagcaagatccttctccaggaagcaacttaggcggcggggatgacctcaagctgcgttag

SEQ ID NO: 183842 - DNA, 1788 bp, Artificial Sequence
  Description of Artificial Sequence: Synthetic coding sequence
atggtgggcgtgcccggcgccgccgccttccagctgggccccgagaaacgcgtgccagcaatgcctggctcgcctgtcgaagtcaagattcagtctcgtagttccccaccgacaatgcctccacttcctccaatcaacccgggaggacctcgacccgtaagtttcacacctacagccctttcaaacggcatcaaccacagtcctcctacgctcaatggagcgccctctccccctcagcgatttagtaatggcccggcctccagcacgagcagcgccctgacaaaccagcagctccctgccacttgcggcgccagacagctatcaaagctgaagaggtttctgactaccctgcagcaattcggtaacgatatttctcctgaaatcggagaaaaggttcggaccctggtgttggccctggtcaacagcactgtaaccattgaagagttccactgtaagctccaggaagccacaaatttcccattgcgccccttcgtgatcccttttctaaaggccaatctgccattgctacagcgggagttgctgcattgcgccagagccgcaaagcagaccccaagccagtatctggcacaacatgagcatttattgcttaacactagtattgcctcaccagccgactccagcgagctgctgatggaggtccatggcaatgggaagagaccatccccggagcggcgcgaggaaaattcatttgaccgagatactattgccccagaaccacctgctaagcgcgtgtgcacaatcagtcctgctccccgccattcccccgcactgactgttccattgatgaaccctggagggcagttccatcctacacctcctccactgcagcactacaccttagaagacatcgctacgagtcacctctatcgggagccgaacaagatgttggagcatcgcgaagtgagagataggcaccacagtttgggcctgaatggagggtaccaggacgagttggtggaccaccggttaacggagagagaatgggcggatgagtggaagcatctggatcacgcgctgaattgcatcatggaaatggttgagaagaccagaagaagtatggccgtgctgaggagatgccaggaatcagacagagaggaattgaattactggaagcgccgatacaatgagaataccgaactgcggaaaacagggacagaactggtcagtaggcagcactcccctggatccgctgactccttatccaacgatagtcagagggagttcaactcacgacccggaacaggatacgtccccgtcgagttttggaagaaaaccgaagaggctgtcaataaagtcaaaatccaggccatgagcgaggttcagaaggccgtggccgaagcggaacagaaggcatttgaagtgattgccactgagcgagctaggatggaacagacaattgccgatgtgaagaggcaggcggccgaagatgcatttcttgttatcaatgagcaagaggagagcaccgagaattgctggaattgtggacgcaaggcaagcgaaacatgcagcggttgtaacattgctagatattgcggctccttttgtcagcacaaagattgggagcgccatcaccgtctgtgtggacagaacttacacggacaatctccccacgggcaaggccgcccacttctaccagtgggccgcggcagctctgcccggagcgctgactgtagcgtgcccagtcctgcactagataaaaccagcgctaccaccagtcggtcaagtacaccagcatccgtaaccgcgattgacacaaatggcctgtag

SEQ ID NO: 183843 - DNA, 1815 bp, Artificial Sequence
  Description of Artificial Sequence: Synthetic coding sequence
atggccaaggagagcggcatcagcctgaaggagatccaggtgctggctcgacaatggaaagttggaccggagaagcgcgttccagcgatgcccggttcacccgtggaagtgaagatacagagtcgcagttctccacctacaatgccgccacttccccctatcaatcctggtggaccccggcctgttagtttcactcctacagccctgtcaaatggaattaatcatagccctccgaccctgaacggagccccaagcccaccacaaagatttagcaacgggccggcctctagcaccagtagcgctttaaccaatcagcagcttcccgctacctgcggcgcacgacagttgtcgaaactaaaaaggttcttgacaacgcttcagcaattcggaaacgacattagccccgaaattggcgaaaaagttagaacacttgtgctagcattagtgaactcaaccgttactatcgaagagttccattgtaaactgcaagaggccaccaactttccattgcgtcccttcgtgatcccattccttaaagcaaatttgccactgttgcaacgggaacttcttcattgcgccagggccgctaaacagacccccagccagtacctcgcccagcacgaacatctgcttctcaacactagtattgccagtccagccgactccagtgagctcctgatggaagtgcacggcaatgggaagcggcccagccctgagagaagggaagaaaattccttcgaccgggatactatcgcaccagagccacctgccaagagagtctgcacaatcagcccagcccccaggcactctcctgctttaaccgtccccctgatgaatcctggagggcagtttcaccctactcccccacccctccagcactacaccctggaggatatagcgacctcacacctataccgggagccaaataagatgctggagcatcgagaggttcgagatcgccaccatagtctcggcttaaacggcggctaccaagatgaactggtggaccacagattgacagagagggaatgggcagacgagtggaaacatctcgaccatgcgctgaactgtattatggagatggttgaaaagactcgccgttctatggccgtgctgcgaaggtgccaggaatccgacagagaagaactcaactactggaaaaggcggtacaatgagaatacagaactgcggaagaccggaactgaactagtatctcgccagcatagtcccggctccgcggattccctgagcaatgattcgcagcgcgagtttaatagccggcctggcacaggatacgttcctgtggagttctggaagaagaccgaagaggccgttaacaaagttaaaatacaggcaatgtccgaggtccaaaaggcagttgccgaggctgagcagaaggccttcgaggtgattgcaacagagcgcgcccggatggagcagaccatcgctgacgtgaagaggcaagctgccgaggacgccttcctggtgattaatgaacaggaggagtcaacagagaattgttggaattgcgggagaaaagctagtgaaacttgttcgggatgtaatatagcaaggtattgcggcagtttctgtcagcacaaggactgggaaagacaccatagactctgtggccagaatttgcatggtcagtctccccatggacaaggaaggccactcctgccagtgggccgggggagtagtgcgcgatccgcagactgctcagtcccgagccccgctctggataagacctccgctacgactagtagaagctcaacgccagcctccgttacagcaatcgacaccaacggcctctag

SEQ ID NO: 183844 - DNA, 1815 bp, Artificial Sequence
  Description of Artificial Sequence: Synthetic coding sequence
atggccaaggagagcggcatcagcctgaaggagatccaggtgctggcacggcaatggaaagtgggcccagaaaagcgggttcccgctatgcccgggtcccctgtagaggtcaagatccagtctcgatcctcccccccgactatgccccccctgcccccaatcaatcccgggggaccccggccggttagcttcacacccacggcactcagcaatgggattaaccactcacctcctacactaaacggagcgccctctcctccccagagattctctaacggacctgcaagctccacatcttcagccctgactaaccagcagcttcctgcaacatgcggcgcacgtcagctgagcaagctgaagaggttcctcactactctccaacagtttggtaacgatatctcacccgagatcggcgaaaaggtgcgcacgttggtactggctctggtcaatagtaccgtgaccatcgaggaatttcattgcaagttacaggaagcaacaaattttcccttgcgccccttcgtgatacccttcctcaaggctaacctgcctttattacagcgcgaactcctgcattgtgcgcgagccgctaagcagacaccaagccagtacctcgctcagcacgagcatctgctactcaatacctccattgcatctcccgccgattcctcagaactgctgatggaagtgcatggcaacggaaaaaggccgtcaccagagagacgggaagagaatagtttcgatcgggacactattgcaccagagccccccgccaaacgggtgtgtacaatcagccctgccccccgtcacagtcctgcactgacagtcccacttatgaatccagggggacagttccaccccacgcctcccccactccagcattatacactagaggatatcgccacgtctcacctgtacagggaacctaataagatgctcgaacatcgcgaggtgagagacaggcatcattcccttgggttgaatggcggctatcaggatgaactggtggatcaccgactgaccgaacgcgaatgggcagatgagtggaagcatctggaccatgcgctaaattgtattatggaaatggtggaaaaaacacggcggtctatggccgtcctccgtcggtgtcaggagtctgatcgcgaggaactgaactactggaagcgacgctacaatgaaaacactgagcttcggaaaaccggcacggaactggtgtcacggcagcattcgcccggaagtgctgacagcctgtcgaatgattcacagcgtgaatttaactctagaccaggcactggatacgtccctgttgaattttggaagaagaccgaggaagcagtgaataaggttaaaatacaggccatgtctgaggtccagaaggccgtggcagaagccgagcagaaggcttttgaggtaattgccaccgagagggccaggatggagcaaacaatcgcagatgtgaaacgtcaagccgccgaggacgcctttctggtgattaatgagcaggaggagagcaccgaaaattgttggaactgcgggaggaaagcaagtgagacatgttcaggatgcaacattgcccgctattgcgggtcgttctgccagcacaaagactgggagcgacaccaccggctgtgcggccagaatctgcacgggcagagcccgcatgggcagggtcggccccttcttccagttgggcgcggcagttccgccagaagtgcagattgttctgtgccctctcccgctctggataaaacgtccgccaccacatcaagatcatcaacaccggcaagcgttaccgcaatagacaccaacgggctgtag

SEQ ID NO: 183845 - DNA, 792 bp, Artificial Sequence
  Description of Artificial Sequence: Synthetic coding sequence
atgcccggcagccccgtggaggtgaagatccagagccggagcagcccacctacgatgccaccgcttccgccgatcaaccccgggggcccacgaccagtctcttttacgcccaccgcactgtctaatggcatcaatcattcaccacccaccctaaacggtgccccaagcccacctcagcgcttttctaacggcccagcaagctcaactagtagtgccttgactaaccagcagctaccagctacatgcggcgccaggcaactgagtaagttgaagcgcttcctgactaccctgcagcaatttggaaatgatatcagcccagagatcggcgagaaggttcgaacactcgtgttagccctggtcaatagtactgtcaccattgaagaatttcactgcaaactgcaggaagcgacaaattttccgctccgtccgttcgtgatcccattcctgaaggcaaacctacctcttttgcaacgcgagctccttcactgtgctcgcgccgccaagcagacccctagtcagtacctggcacagcacgaacacctcctgttgaatacctctatcgcatcacctgctgactccagcgagcttctgatggaggtacatggaaacggcaagcggccctctcctgaatcatgcattatccacctaaaatccatgggcgtggccagccgacatgagtacttttcggggacgctccaaatgccagctcatccagtacgcaactccacgcttgagaacctgtgggtggattgctcaaggtcgttaagatccaccgtactgcccttcccttag

SEQ ID NO: 183846 - DNA, 1728 bp, Artificial Sequence
  Description of Artificial Sequence: Synthetic coding sequence
atgcccggcagccccgtggaggtgaagatccagagccggagcagcccaccgactatgcccccccttccacctataaatccaggcgggccacggcctgtgagctttactcctacggcactctcgaatggcatcaaccattctccacctaccctcaacggggccccgtctcctcctcagcggtttagtaacggccccgcctctagcacatcgtctgctcttactaatcagcagttgccagcaacatgcggcgctagacagctgagcaagcttaaacggtttttaaccaccctgcagcagtttggtaatgatatttccccagaaattggggagaaggtcaggacacttgtattggcgctggttaattctaccgtgaccatcgaggaatttcactgcaagttgcaggaagctaccaattttccactacgcccgtttgtgattcctttcctcaaagcaaatcttcccttgctgcagagagagctgcttcactgcgctcgcgccgcaaagcagactccaagccagtacctggcgcagcacgaacatctcctactcaatacctcaatcgcctctccagccgattcatcagagctgctgatggaagtgcatggtaacggaaaaaggccctcccctgagcgacgggaggaaaacagcttcgacagggataccattgctcctgagcccccagcgaagcgagtgtgcacaatatctcccgctcctcggcatagccccgcacttaccgtcccgttgatgaaccctgggggacaatttcaccccactcccccgccactgcaacattacaccctggaggacattgcgacaagtcacttgtaccgggaaccaaataaaatgttggaacatagggaagtgagagatcgacaccactcactcgggttgaacgggggataccaagatgagttggtagaccaccgtcttaccgaacgggagtgggctgacgagtggaagcacttggaccacgctctcaactgtatcatggagatggttgaaaagacaagacgaagtatggcggtgctccgcagatgtcaggagagcgacagggaggaattgaactactggaaacgccgctacaacgaaaataccgaactcaggaaaactgggaccgagctagtgtccagacagcatagtcctggctctgccgatagtctcagcaacgattcccaaagagagttcaactcccgcccgggcacagggtacgtaccggtggaattttggaaaaaaactgaggaggcggtgaataaggtgaaaattcaggcaatgagcgaggtgcagaaggccgttgcggaggccgagcagaaggccttcgaggtcatcgccacggagcgagcccggatggagcagaccatagccgatgtgaaacggcaggccgccgaagacgctttcttagtcataaacgaacaagaggagtccacggagaactgttggaactgcggcaggaaggccagtgaaacctgcagtggatgcaatatagcaaggtattgcgggagcttctgccaacacaaggattgggagcggcatcaccggttatgtggccagaaccttcacggccagtctcctcatggacagggccgccctctgttgcccgttggccggggaagtagcgcacgaagcgctgactgctccgtgccgagccccgctctcgacaagacttcagcaaccacctcaagatccagcacgcccgcttcggtcaccgcgattgacacaaatgggctctag

SEQ ID NO: 183847 - DNA, 1137 bp, Artificial Sequence
  Description of Artificial Sequence: Synthetic coding sequence
atggaggtgcacggcaacggcaagcggcccagccccgagcggcgggaagaaaactcgtttgacagagataccatagccccagaaccacccgcaaagagagtatgtaccatctctcccgcccccagacactcccccgccttaacagtccccctcatgaatccaggaggtcagttccacccaacccctccaccactccagcattatactctggaggatattgccactagccacttgtatcgggaacccaacaaaatgctggaacaccgcgaggtgcgtgataggcaccactccctgggcctcaacgggggttaccaggacgagttggttgatcatcggctgaccgagcgagagtgggccgacgaatggaagcacttagaccatgcgctgaattgcatcatggaaatggtggaaaaaactagaaggagcatggccgtcctgcgacggtgtcaggagtccgatcgagaagagctgaattactggaagcgtaggtacaatgaaaataccgaactgcggaaaaccggtactgagctggtttcacgacagcactctccaggatctgctgattctctttcaaacgattcccagagagaatttaactcccgtccaggaacaggatatgtacccgtcgaattttggaaaaaaacagaagaggcagtgaacaaggtcaagatacaggctatgtccgaagtccaaaaggctgtggcagaggctgagcagaaggcctttgaggtgatcgctactgagcgcgcccgcatggagcagactatcgccgacgtcaagagacaggccgctgaggatgcctttctggttatcaacgaacaagaagaaagcaccgagaattgctggaactgtgggcgtaaggcctctgagacgtgctcaggatgtaatatcgccaggtactgtggcagcttttgccagcacaaggattgggaaagacaccatcggctctgtggccagaacctgcacggtcagtccccacacggacagggtcgaccccttctccccgttggccggggtagctcagccaggagtgcagattgcagtgttcctagtcctgcactggataaaacttctgccacaacatcacggtctagcaccccagcaagtgtgacagcgatcgatactaatgggctgtag

SEQ ID NO: 183848 - DNA, 546 bp, Artificial Sequence
  Description of Artificial Sequence: Synthetic coding sequence
atggtgggcgtgcccggcgccgccgccttccagctgggccccgagaagagggtgccagctatgcctggctccccagtggaagttaagattcagtcccggagcagccccccaacaatgccccccctgccgcccataaaccccggtggtccacggcctgtgtctttcacacctaccgctctgtcgaacggcattaaccacagtcctcctactttaaacggagcgcctagccccccccagcgcttctccaatgggcctgcctctagcacctcttctgctctgaccaaccagcagctgcccgccacctgtggggcccgacaattgagcaaactgaagcggttcttaacaacgttgcagcaatttggaaacgatatatccccagagataggagaaaaggtacggacattggtgcttgctttggttaatagcaccgtgacaatcgaagagtttcactgcaagctccaggaggcaacaaattttccgctccgccccttcgtgatcccattcctgaaggctaaccttcctttactgcaacgcgagctgctgtag

SEQ ID NO: 183849 - DNA, 243 bp, Artificial Sequence
  Description of Artificial Sequence: Synthetic coding sequence
atggccaaggagagcggcatcagcctgaaggagatccaggtgctggcccgccagtggaaggtgggccctgaaaagcgcgtccccgcaatgccgggatcaccagtcgaggtcaaaattcagtcccgctcctctccgcctacaatgccaccactcccccctataaacccaggcggcccacgacccgtgtccttcacgccaaccgccctgtctaatggtattaatcacagccctccgaccctctag

SEQ ID NO: 183850 - DNA, 459 bp, Artificial Sequence
  Description of Artificial Sequence: Synthetic coding sequence
atgagcgaggtgcagaaggccgtggccgaggccgagcagaaggccttcgaagtcatcgctaccgagagggcgcggatggagcagacaattgctgatgttaaacgccaggccgctgaggacgcgttcctagtgattaacgaacaagaagaaagcaccgaaaactgctggaattgtggccggaaagcctccgaaacctgcagcggttgcaacatcgcgagatactgcgggagtttctgccagcataaagactgggaacggcatcaccggttgtgcggacagaacctccacggccaatctccccacggccagggacggcccctgctgccagttggaaggggctctagtgccaggtctgcagactgctcagtgccatcacctgctttggataagacaagtgcaacaaccagtagaagcagtaccccagccagcgtgacagcaatagatacaaatggtctgtag

SEQ ID NO: 183851 - DNA, 1962 bp, Artificial Sequence
  Description of Artificial Sequence: Synthetic coding sequence
atgcccgccagccggctgcgggaccgggccgccagcagcgccagcgggagtacttgtgggagcatgagccagacccatcccgtccttgagtccggcctcttggcatctgcaggctgttcagccccccgaggacctcggaaaggcgggccagctcctgtcgaccgaaaagcgaaagcctcagccatgccggatagtcctgccgaggtaaagacacaacctagatcaacccctcctagcatgcctcccccacccccagccgcttcacagggggccactagacctccgtctttcacaccacatacacaccgggaagacggcccggccaccctgcctcacggcagattccacggttgcctgaagtggagcatggtatgtttgttaatgaatggctcttctcattcccccaccgccatcaatggtgccccctgcacccccaacggcttctccaacggcccagctaccagtagtacggcctccctcagtactcaacatctcccccctgcctgcggggcccgccagttatcaaagctgaagcggtttctgactacactgcaacagttcggatcagatattagcccggagattggagagagggtccgcacgctcgtactcggcctggtgaactctacattaactatcgaagaatttcactcaaagctccaggaggccaccaactttcctctccgcccattcgtgattccttttttaaaagccaatcttcctctgctccagagagaactcctacactgtgccaggctggccaaacagacgccagctcagtatctcgcccagcacgaacaactgctgctggatgcctccgccagttctcctatcgactcctcagaactgttgctcgaagtgaatgagaacgggaaacggcggacgcctgaccgcactaaagagaacggaagcgaccgcgatccactccacccagagcatctgagtaagcgtccgtgtacattaaatccagctcagcgctactccccatcaaacggcccgccgcaaccgacgccacctccacattatcggctcgaggacattgccatggcccaccacttccgcgatgcttaccggcatcccgatcccagagaattgcgggagcggcacaggcccttggtggtcccaggctcccgccaagaggaagtgattgatcataagctgacggaaagagagtgggcggaagaatggaagcacttgaataacctgctgaactgcataatggatatggtggagaaaacccggaggtcattgacggtactgaggagatgtcaggaggccgatcgagaagagctgaaccattgggcacggaggtacagcgacgctgaggacactaaaaagggtcccgcccctgcagctgcccgcccccgctcctcttccgccggccccgaaggcccacaacttgacgtaccgcgcgagttcctgccacggacgctcacaggttacgttcctgaggacatttggcgcaaagcggaagaggctgtcaacgaggtaaagcgccaggccatgtcagaactgcagaaggctgtcagcgacgccgagcggaaggcccacgagttaattactaccgagcgtgctaagatggaacgagcgttggctgaagccaagcgtcaagcaagtgaagacgccttgacggtcattaaccagcaagaagactcaagcgaatcctgttggaactgtggtagaaaggcgagtgaaacttgtagtggctgcaacgcagcgcgctattgtgggagtttctgtcaacatagggactgggaaaagcatcaccatgtatgtgggcagtcacttcaggggcccacggccgttgtcgccgatcccgtgccgggtcctcccgaagctgcgcattccctgggcccctcattgcctgtgggtgcagctagtcccagcgaagcaggttctgcaggaccctctaggccgggatcaccatcacccccgggacctttggatacggtgccaagatag

SEQ ID NO: 183852 - DNA, 1704 bp, Artificial Sequence
  Description of Artificial Sequence: Synthetic coding sequence
atgcccgacagccccgccgaggtgaagacccagccccggagcaccccccccagtatgcctccccccccccccgccgcttctcagggggcaactcgcccgcccagttttacccctcacacactcatgaatggatcctcccacagccccaccgccattaacggagccccatgtactcccaatggtttttccaatgggcctgcaacctcatctaccgccagtctaagcacccagcatctgccccccgcctgtggcgcaagacagctgtcaaagctgaagcgctttctcaccaccctacagcagttcggtagcgacatcagccctgagattggggagcgagtccggactctggtgctgggtctggttaatagcacactgacaatagaagagtttcatagcaagctccaggaggccacgaactttccattgaggccctttgtaatcccattcctgaaggctaatctccccctcttacagcgtgagctgcttcactgcgccagattagcaaagcagactcccgcccagtacttggcccagcatgagcagctgctgctggatgcttctgcatcatcccctatcgattcgagcgagctgcttctggaagttaatgagaacggcaagcggcgaaccccagatagaacaaaggagaatggtagcgatagagacccactccatcccgaacacctcagtaagcggccatgtaccttaaatcccgctcaaagatattcgccaagtaatggaccaccgcagcctactcctcccccccattaccggcttgaagacattgcaatggctcaccatttccgggatgcataccgtcacccagaccctagagaactgcgcgagagacacaggcctctcgttgtacctggctctaggcaggaagaagtgatcgatcacaaactcacggagagggagtgggcagaagagtggaagcacttaaacaaccttcttaactgcatcatggacatggtggaaaagaccagacgaagcctcaccgtgctcaggcggtgccaggaggcagacagggaggagttgaatcattgggcacgcaggtactcggatgccgaggatacaaagaagggccctgcccccgccgcagcccgtcctcgatcttcatccgctgggcccgaaggtcctcagctggatgtacctagagaatttctccctaggactctgacaggctacgtgccggaagacatctggcggaaagctgaggaggccgtcaacgaggttaaacgtcaggcaatgtccgagctccagaaggccgtcagtgatgccgagaggaaagcccacgaactcatcaccactgagagagctaagatggagcgggctcttgccgaagcgaagcgccaggcctctgaagatgctctgacggtcatcaaccagcaggaggattcttctgagagttgttggaattgcggaagaaaggccagtgaaacctgctccggctgtaacgccgcgagatactgcggttctttctgccaacacagggattgggagaagcaccatcacgtctgtggccagtctttgcaaggccccaccgctgttgtggcagaccccgttcctggaccaccagaggctgcgcattctcttggcccgagcttgccagtgggcgccgccagtccaagcgaggcaggaagtgctggaccttctaggcccggaagtccatcaccccccggacccctggatacagtgcctcggtag

SEQ ID NO: 183853 - DNA, 1704 bp, Artificial Sequence
  Description of Artificial Sequence: Synthetic coding sequence
atgcccgacagccccgccgaggtgaagacccagccccggagcacccctccctcaatgccaccccccccgcctgcagcttcacagggagctacacgcccccccagcttcactccacacacactgatgaacgggagctctcattccccaacagcaatcaacggagccccttgcacccctaatggtttttcaaacggccccgctacctcatctactgcgagtctcagcacgcagcacctgccgcccgcgtgcggcgcccggcaactcagtaagttgaagcgctttcttacgactctgcagcagttcggctccgatatcagtcccgagatcggggaacgggtaagaaccttagttctgggacttgtcaatagcactcttaccatcgaagagtttcatagcaaactccaggaggctactaattttcccctgaggccgttcgtcatcccctttctgaaagctaacctacctttgttacaacgcgagctgctgcattgcgccaggctggcaaagcaaacccccgcgcagtacttagcacaacacgagcagttgcttctcgatgcttctgccagcagtcccattgactcgagtgagctgttattagaggtgaacgagaacggcaagcgaaggacaccggatcgcaccaaagaaaatggttctgaccgcgaccctctgcatcctgaacatctgtccaaacgcccttgtacgctgaatcccgctcagcgttacagccctagtaatggacccccacagcccacccccccgccccactacagactcgaagacatcgcgatggctcaccacttccgtgatgcttatagacatcctgaccctagggagctgcgtgagcgccatcgtccgctggtggtcccgggaagtcgccaggaggaagtgatagatcacaaactcactgaacgagagtgggccgaggagtggaaacatctgaacaatctgctaaactgcattatggacatggtggagaagacccgaaggtcccttacagttcttaggaggtgtcaagaggctgatagggaggaacttaaccactgggcgcggcggtatagtgacgccgaagacaccaaaaaagggcctgccccagctgccgcccgacctaggtccagctcagccggacctgagggcccacagttagacgttcccagagaattcctgccgaggaccctaactgggtatgtgcccgaagatatctggcgtaaggctgaagaggccgtcaatgaggtcaaacgtcaggccatgagcgaactacagaaggctgtctccgatgcagaacggaaagctcacgagctgattactactgagcgcgccaagatggaacgggcccttgcagaggccaagagacaggcttcagaggatgctctgaccgtgattaaccagcaggaagattcttccgagagctgctggaactgcggccggaaagcgtccgagacgtgcagtggatgtaacgccgcaagatattgtggctcattttgccagcatagagattgggagaaacatcatcacgtgtgcggtcagtcccttcaggggccaaccgcggtggtggctgacccggtgcccgggccgcccgaagccgcccactcattgggcccatcacttccagttggggctgctagcccctccgaggcaggcagcgccggcccctcccgccccgggtcgcctagtcctccagggcccctagatactgtcccacgctag

SEQ ID NO: 183854 - DNA, 1848 bp, Artificial Sequence
  Description of Artificial Sequence: Synthetic coding sequence
atgcccgccagccggctgcgggaccgggccgccagcagcgccagcgggtctacttgtggcagcatgagccaaacccaccccgtcctggagtctgggctgctggcctcagctggatgtagcgccccgagaggcccgagaaaggggggacctgctcctgttgaccgcaaggccaaggcatctgccatgcccgatagtccagcagaggtgaaaactcagcctaggtcgacgcccccctctatgcccccaccgccacccgccgccagccaaggagccacaagacctccgagtttcacaccccataccttgatgaacggatcctcccactctccaactgcaattaatggagctccttgtactcctaatggctttagtaacggaccagcaacgtctagcactgccagtctgagcactcagcacctgccccctgcttgcggcgcccggcagctgtccaagctgaaacgtttcctgaccaccttacagcagtttggctcagacatctctcctgagataggggagagggtgaggacgctggttctcggcctcgtcaatagtacactcactattgaggaatttcactcaaagctgcaggaggcgaccaatttccccttacgtccctttgtaatcccatttctcaaagcgaatttacctttgctccagcgcgagctattgcactgtgcacgtcttgcaaagcagacccccgcacaatacttggcccagcacgagcagctcctgctggacgcctcggccagcagcccaatcgactcatcagaacttctgctcgaagtcaatgaaaacgggaagcgccgcacgcccgatagaactaaggaaaatggctccgatcgcgatccactgcacccagagagatattcaccttcaaatggacctccacagccgacgccccctccccactaccgccttgaggacatcgcaatggcccatcacttcagagacgcctatcgtcacccagatccaagggaactgcgagagaggcatagacccctcgttgttcctgggagccgccaagaggaagttattgaccataaactcacagaacgtgagtgggcagaggagtggaaacaccttaacaacctgcttaactgcataatggatatggtcgaaaaaacaagaagatctttaacagtgttgcggaggtgccaagaggccgatagggaggaactgaatcactgggctcgccggtacagcgatgccgaggacaccaaaaaggggccagccccagccgctgcaagacctcgctcatcgagcgccgggccagaagggccgcagttggacgttccacgcgaattcctgcctcgcaccctgacaggatatgtgcccgaagacatctggcgcaaagccgaggaagcggtgaatgaagttaaaaggcaggccatgtccgagctccagaaagcagtctctgatgcggagaggaaggcacatgagctgatcacgactgagcgtgcgaaaatggagagggccctggctgaagccaaacggcaggcttcggaggatgccttgacagtaattaaccagcaggaagacagtagcgaatcttgctggaactgtggccgaaaagcctctgagacgtgtagcgggtgtaacgccgctcgttattgcggctccttttgccagcaccgagactgggaaaaacaccaccacgtatgcggccagtcattgcagggtcccaccgccgtggtggctgaccccgtccctggtcctcccgaggctgcccatagcctaggcccatccctccccgtgggagccgcgtcacccagcgaagcggggtccgccggaccatcgaggccaggcagtccttccccccccggccctttagatacagtacctcgctag

SEQ ID NO: 183855 - DNA, 1734 bp, Artificial Sequence
  Description of Artificial Sequence: Synthetic coding sequence
atgcccgccagccggctgcgggaccgggccgccagcagcgccagcggctctacatgcggtagtatgtcacagacacaccctgtgctggagtcgggcctgttggcctcagcagggtgtagcgctcctcgcggccccagaaagggcggacccgttatgaacggatctagccattcaccgaccgcgattaatggagccccctgcacgccaaacggcttttcgaacgggcctgcaacgtctagtacagccagcctcagcacgcagcatttacctcccgcgtgcggcgctcgccagcttagcaagctgaaaaggttcctcacaacgctgcagcagtttggttccgacatttccccggaaatcggggagcgtgtgagaactctcgtcctgggtctagtgaatagcacacttaccattgaggaatttcactctaaacttcaggaggccacaaattttcctctgcggcccttcgtcatcccttttctgaaggcaaatctcccactgctgcaacgggaactgttacattgcgctcggctggcaaagcagacgcccgcgcagtacctcgcacaacacgagcaactacttctagatgccagcgcttcatcacctatagattccagtgagcttctgctggaggtgaatgagaacggcaagcggcggacgccagataggacgaaggaaaatgggtcagatagggatccgctgcaccctgagcacctctctaagagaccgtgcacactgaatcctgcccagcgctactcacctagtaatggcccaccccagcccactccccctccccattaccggctcgaagacatcgccatggcacatcatttcagggacgcctaccggcatcccgaccctagggagctaagagagcgtcataggccgctggttgttcccggaagtcgacaagaggaggtcatcgaccacaaactgacagaaagagagtgggccgaagaatggaagcacctgaataatttactgaactgcatcatggatatggtcgagaaaacccgtcggagcctgacagtgcttcgcagatgccaggaggcggacagggaggagttaaaccattgggcaaggcgctattccgacgctgaagacactaaaaagggccccgcacctgccgctgctcgcccccggagctccagtgccgggcctgaaggaccccagcttgatgtgcccagggaattccttcctaggactctgaccggttatgtaccagaggatatctggcgcaaggccgaggaggcggtcaatgaagtaaagcgccaggcgatgtctgagctgcagaaggccgtgagcgatgctgaacggaaagcacacgagctgattacaacagaaagggcgaagatggagagagcgttggccgaagccaaacggcaggcaagcgaggatgctctcaccgtgattaaccagcaggaagactcatcagagagctgttggaactgtggcaggaaggcgtctgagacctgttcaggctgcaatgctgcacgctattgcggctctttttgccagcatagggattgggagaaacaccatcatgtctgtggccagtctctacagggtcccactgctgttgtcgccgatccggtgccaggcccaccggaagccgctcacagtctggggccctccctaccagtgggggccgccagccctagcgaagcgggctctgcgggtccctcccgccccggctctccttctccccctggcccactggacacggtgcctagatag

SEQ ID NO: 183856 - DNA, 558 bp, Artificial Sequence
  Description of Artificial Sequence: Synthetic coding sequence
atggccgcccagaaggaccagcagaaggacgccgaggccgagggcctgagtggaactactctcctgcctaaactcataccctctggagcaggcagagagtggctcgaaaggaggcgggcaacgattcgcccctggtccaccttcgtggaccagcagcgcttcagtaggcccagaaatctgggagaattgtgtcagcgcctggtgcggaatgttgaatattatcaatccaattatgtatttgtgttccttgggctaattttgtattgcgtggtgacctccccaatgttactggtcgcattagccgtcttctttggagcctgctatatcctgtacctgaggaccctggaatctaagctggtgctgttcggcagggaagtgtctccagcccaccagtatgcactcgccggcggcattagcttccctttcttttggctggcgggcgcgggctcagcggtgttttgggttttaggggccacacttgtggtcatcggctctcacgccgcctttcaccagatagaggccgtcgatggggaggagctgcaaatggagcccgtttag

SEQ ID NO: 183857 - DNA, 3147 bp, Artificial Sequence
  Description of Artificial Sequence: Synthetic coding sequence
atgaaccggttccgggtgagcaagttccggcacaccgaggcccggccaccacgcagggagtcttggattagcgatatcagagcaggcactgcccctagctgccgcaatcatattaaatcctcttgttcactgatcgcctttaacagcgatagaccaggtgtcttaggcatcgttccgctgcaaggtcagggggaggataagcgcagagtcgcgcacctggggtgccactctgacctggtcacggatctggacttttctccgttcgacgacttcctacttgcaactggaagtgcagataggaccgtgaagctgtggaggttacctgggccaggccaggctttacccagtgccccaggcgtggtgctcgggcctgaggatctgccagtggaagtcttacagttccaccctacctcggatggaatactggtttctgcagctggtacgacagtgaaggtctgggacgccgccaagcagcagcccctcaccgaattagccgctcacggggacctcgtgcaatcagccgtatggtctcgagatggtgcgctcgtaggaactgcctgcaaggacaaacagctgcgcatctttgatcctcggaccaagccccgggccagccagtcaacgcaagcacatgagaattcccgggattctagacttgcctggatggggacatgggaacatctcgtctcgacggggtttaaccagatgcgcgagcgggaggttaaattgtgggatacccgcttctttagctccgccttagcatctttgaccctggacacctccctggggtgtttggtgcccttactggacccagattccgggctcctggtgctcgccggtaagggggagcgacagctgtactgttatgaagtggtgccacaacagccggcgctgtctcccgtaactcaatgcgttctagaaagtgtgctgcgcggagctgcgcttgtgcctcgccaggcattagcggtgatgagctgcgaggtgctgcgagtcctgcagctcagcgatacagcgatcgtccctatcggttatcatgtgcctagaaaggccgtggagtttcacgaggatttgtttcctgacactgcaggatgtgtgccagctacagacccacattcctggtgggctggtgacaaccagcaggtccagaaagtgtccttgaatcccgcttgtaggccacatcccagtttcacatcctgcctcgtgccacctgcagaaccactgcccgatacagcccagccggcggtgatggagactcccgtaggggatgccgacgccagcgaaggtttttcttcaccaccgagctccttaacttcaccctccacccctagctctttaggaccatctttaagttcaacttctgggattgggacctcccccagcttaaggtccttgcagagcctgctgggccccagctctaaattcagacatgcccagggtaccgtccttcatcgcgactcgcacatcacaaatctgaagggattgaatctgacaacacccggggagagcgatgggttttgcgcaaacaaattaagggtcgccgtgccccttctgtcttcagggggccaggtggcggtactggaacttcggaagcccgggcgactgcctgacaccgccttgccgacacttcaaaacggggcagcggtgactgacttagcttgggaccctttcgatcctcataggttggccgtcgcaggcgaggacgcccgcattaggctctggcgggtgccagccgaggggctggaggaggttcttacaacacccgaaaccgtgttgacaggtcacaccgagaagatctgctccttgcgcttccaccccctagcagccaatgtccttgcaagtagcagttatgatctgactgtacgcatatgggaccttcaagctggggctgatcgcctgaaactgcaaggccaccaagaccagattttctccctggcctggagcccagatggacaacaactggcaaccgtgtgtaaagatggccgcgtcagagtgtacaggcccagatctggacccgaacctcttcaagaaggtccaggaccgaagggagggcgcggagcaaggattgtctgggtttgtgatgggagatgtctgctggtatcgggctttgacagtcagtctgaacgccagctgcttctttacgaagctgaagccttagccggcggccctttagccgtgctcggtttagacgtagcaccttccacactgctgccctcttatgaccctgacaccggcctggtgctactgacaggcaagggcgatactcgggttttcctgtatgagctgctgcctgagagtcccttttttttggaatgcaattctttcacaagccccgaccctcacaagggcttagttctgcttcctaagaccgaatgcgatgttagagaagtggagcttatgcgttgtctgcgcttgcgccagtccagcctggagcccgtagcctttaggctgcctagggtgaggaaggaattctttcaagatgacgtgtttccagataccgctgtgatctgggagcctgtgctttctgcggaggcatggctgcaaggggccaatggccaaccgtggctgttatccctccagcccccagatatgtctcctgtttctcaagcacccagggaggctcctgccagacgagctccctctagcgctcagtacctggaggagaagtcggaccagcaaaagaaggaagaattgctaaatgccatggtcgcaaagctcggcaaccgtgaggatccattgccacaggacagctttgaaggcgtggatgaagacgagtgggctaaatacctcgctcagataatagtaatgggagtacaggtggtcggaagggctttcgctagagcccttcgccaggaatttgccgcaagtagagcagccgccgatgcaagaggcagggccggacaccgaagcgcagccgcctcaaatctgtcgggcctaagcctccaagaagcacagcagattctgaacgtgtccaaactctctcccgaagaagtgcaaaaaaactatgaacacctctttaaagtgaacgataagagcgtcgggggatcattctatctgcagtctaaagtggtgagggccaaggaacgcctggatgaggagttgaaaattcaggctcaagaggacagggaaaaaggccagatgcctcacacctag

SEQ ID NO: 183858 - DNA, 2778 bp, Artificial Sequence
  Description of Artificial Sequence: Synthetic coding sequence
atgaaccggttccgggtgagcaagttccggcacaccgaggcccggcctccccgcagagagtcctggatatcagatatacgcgccggcaccgctccgtcttgccgtaatcacataaagagttcctgctccctaattgcctttaactccgataggcctggcgtgcttgggattgtcccactgcagggccagggagaagataagagaagagtggctcacctgggttgtcatagcgaccttgtgaccgatctggatttttcccccttcgatgactttcttctggctacgggctccgccgacagaacggtgaaattgtggagactgccaggacccggccaagccctaccctccgcccccggggtagtattaggcccagaggatctgccagtggaggtccttcagtttcaccctacttccgacggtatacttgtttcggcagcaggtaccactgttaaggtctgggatgcagcaaagcaacagccattaaccgaactcgcagctcacggtgaccttgttcagagcgcagtctggagcagggatggtgccctggttggcacagcttgtaaggataaacaactgcggatcttcgaccctcgcacaaaaccaagagccagccagtccacccaggcccatgagaacagcagagactcaaggctggcctggatgggcacatgggagcacctggtctccacggggttcaaccaaatgagggaacgggaagtcaaactgtgggacacacgtttcttctctagcgcactggcttcgctcacactggacacatcactaggatgtctcgttccacttttggatccagactctggactcctggtgctcgcagggaagggcgagaggcaattgtattgttacgaagtagtccctcagcaacctgcccttagccctgtgactcagtgcgtcctggagagtgtgcttcgcggcgcggccctggtccctaggcaagcgttggctgtcatgagctgtgaggtacttcgcgttctacagctgtccgacactgctatcgtccccatcggctaccacgtgccacgaaaggccgtggagtttcacgaggatttgttcccagatactgccgggtgtgtgccagcgacggatccgcactcctggtgggcaggagacaatcaacaggttcaaaaagtgagtctcaaccctgcctgcaggccccatccctcgttcacaagttgcctcgtgccccctgctgagcccctgcccgacaccgctcagccagccgtgatggaaactcccgtcggcgacgctgatgcgagtgaaggcttttcctcgccaccatccagccttacatcacctagtaccccttcaagtttaggaccttctctcagtagtactagtgggataggcacctccccttcccttcgctcacttcagagtctgctgggaccctcctccaaatttcgccacgctcagggcactgtgttacatagagattcccatatcactaatctcaagggacttaacctgacaacccccggggagtccgatggtttctgcgcaaataagctaagagtcgctgtgcccctcctaagcagtggaggtcaagtggcagtcctggagcttcgaaagcctggcaggctgcccgacactgctctgcctactctgcagaatggagctgcggtaaccgatctggcctgggacccctttgatccccaccgcttggctgtcgctggagaagacgccagaataaggctttggcgcgtgcccgccgaaggcctcgaggaggtgctgactactccggagaccgtactcacaggacacaccgagaaaatctgcagcctcagatttcatcccttggctgccaacgtattagcttccagcagctatgatctcacagtgcgcatttgggatctgcaagccggggcggaccggctgaagctgcaaggacaccaagaccagatttttagcctggcttggagtccagacggtcagcagctcgccacggtctgcaaggacgggcgtgtgcgggtgtatcgccctcggtcaggccccgagccccttcaagaggggccaggacccaagggcggcaggggtgctaggattgtctgggtgtgtgatggaaggtgccttctcgtgtccggctttgactctcagagcgagaggcagctcctcctgtatgaagcagaggcactcgccggtggacctctggccgttttaggtttggatgtcgccccttctactctgctgccctcatatgaccctgatactggtctggtactcttgacaggtaagggcgacacccgtgtgttcctgtatgagctgctccctgagagtcccttctttctcgagtgcaatagcttcacctcgcctgaccctcacaagggactcgtgctgcttccgaagaccgagtgtgacgtgagagaggttgagctcatgcggtgcctgcgcctgcggcaatcctccctggaacctgttgcgttccgcctaccccgggtgcgtaaggaattcttccaggacgacgtgttcccagacacggccgtgatctgggaacccgtcctcagcgccgaagcatggctgcagggggccaatgggcagccctggcttctcagcctgcagccacctgatatgtcccctgtgtcacaagctcccagagaagccccagcccgtcgggccccctcatcggctcaatacctggaggagaaaagcgatcagcaaaagaaggaggaactgctaaacgccatggtggctaaattggggaatagagaagaccccttgcctcaggacagctttgaaggagttgacgaagacgagtgggactag

SEQ ID NO: 183859 - DNA, 1104 bp, Artificial Sequence
  Description of Artificial Sequence: Synthetic coding sequence
atgaaccggttccgggtgagcaagttccggcacaccgaggcccggccacctcggagggaagacaagcagctgcgtatatttgatccccgaacaaaacccagagcctcgcagtccactcaggcccacgagaacagccgcgattccaggctcgcctggatggggacttgggagcatctggtgtctacaggatttaatcagatgagagaacgggaggtgaaactgtgggacacccggttcttttcttctgccctggcgtccctgacccttgacacatccctcgggtgtctggtgcctcttctggatccagactccggactgctggtgctcgccggaaagggagaacgtcagctttattgctatgaagtggtgccccagcagcctgccctgagtccagtcacacagtgtgtcttagagagcgtactccgtggcgcagccctggtacctcggcaagccctcgctgtgatgtcgtgcgaagtcctcagagttcttcaactctcagataccgctatcgtgccaattgggtatcacgtgcctcgaaaagcggtcgaatttcatgaggatctgtttcctgacaccgcaggatgcgtacctgccacagaccctcactcttggtgggcaggcgataatcagcaggtccagaaggtgtccctcaatccagcctgtagacctcacccaagcttcacctcctgcctcgtgcccccagctgagccactcccagatacagcccagcccgctgttatggagacccccgtaggcgatgcagacgcttccgaaggttttagcagcccgccttcttcgctaactagcccaagtaccccatcttccctcggacccagcctgagctcaacatccggcatcggaacttccccttcccttagatctctccagagtctgttaggcccctcatcaaaatttaggcacgcacagggcaccgtgttgcatagagattcccatatcaccaatttaaaaggcctcaacttgaccacccctggcgagtctgacgggttctgcgcgaataagttacgggttgccgtgcccttgttgtcctctggtggtcaggtggcagttctcgaaatgagagagaaaaggcaccgggaggtgtag

SEQ ID NO: 183860 - DNA, 2523 bp, Artificial Sequence
  Description of Artificial Sequence: Synthetic coding sequence
atgaaccggttccgggtgagcaagttccggcacaccgaggcccggccacctcgcagagagtcctggatatcagatatcagagcaggcactgctccatcttgtagaaatcacattaaatcatcgtgtagcctgatcgctttcaacagcgatcggcccggcgtgctcggaatagtgcctctccagggccagggggaggataagcgcagggtggcccacctgggctgccattctgagctggctgcacatggggacctagtccaaagcgctgtgtggtccagggatggagcccttgttgggactgcctgtaaggacaaacagctgcggattttcgacccacgaacaaaacctcgagcctctcagagcactcaagcccatgagaactcaagggactcacgcctcgcctggatgggaacatgggagcacctggtctctaccggctttaatcagatgcgggagagagaagtgaagctgtgggatacgagatttttttctagcgcattggcttctcttacattggatacatcactgggctgcctcgtccctttgcttgaccctgattcagggctgctggtgcttgccgggaagggagagagacaactgtattgctatgaagtggtgccacagcaacctgctttgagcccagtgactcagtgcgtgctcgaaagtgtgctgcggggggctgccctagttccccgccaggctttggcagtgatgtcttgtgaagtgctgcgggtgctgcagctgtccgacaccgctattgttcctataggctaccatgtaccgagaaaggccgtggaatttcatgaggatctcttcccggatactgcgggctgcgtacctgctacagacccgcattcctggtgggccggagacaatcagcaagtgcagaaagttagcctgaatcccgcctgtcggccccacccaagcttcacatcttgcctggtcccacctgcagaacctctgccggacacagcccagcccgctgtgatggagaccccagttggcgatgcagatgcatcagaggggttcagctcccctcctagctccctgacttctccgagcacaccctcctctcttgggcccagcttatcgtctactagcggaataggtacctcaccgagtctgcgcagtttgcagagccttctcggtcctagctcaaagtttcggcacgctcaaggtacggtgctgcaccgggactcgcacattacgaacctgaaaggcctgaatctcaccactcctggggagtctgacgggttctgtgcaaacaagttacgcgtcgctgtcccccttctgtcatccggtggccaggtggccgtcctggagctgcgcaaacctggacgactccccgacacagcccttcccactctgcagaacggcgccgctgttacggatcttgcttgggacccttttgatccccatcggctggctgtggctggagaagacgctcggattcgcttgtggcgggtgcccgccgagggcctcgaagaagtcctaaccactcccgagacagttctgactggtcacactgaaaagatttgtagtctcaggttccacccccttgccgccaacgtccttgcaagctcgtcttatgacctaactgtgcgaatctgggacctgcaagctggggcggatcgactcaaactgcagggccaccaagatcagatcttttccctggcatggtcaccagatggccagcagctggcaacggtctgtaaagacgggagggttcgagtttaccgaccacgtagtggacccgagcctctgcaggaggggcccggtccaaaaggcggcagaggtgccagaattgtgtgggtctgtgatggccgctgccttctggtgtctggattcgatagccagtccgaacgtcaactcctcttgtatgaggctgaagctttggctggaggtcctttggccgtccttggtttggacgtagcaccatctactcttttacccagctacgacccagatacgggcttagtcttgctcactggcaaaggcgacacccgcgtgttcctgtatgagcttctgccagaatcgccctttttcttagagtgtaacagcttcacctctccagacccccacaagggcctggtgctgctgccgaaaaccgagtgcgatgtccgggaagtggaactcatgaggtgcctgcgactccggcaatcctctctcgagcctgtagcctttagactgccgagagtgcgaaaagagttcttccaggatgacgttttccctgatactgctgttatttgggagcctgtcctgtccgccgaagcttggctgcaaggcgccaatggtcagccatggttgctgtccttacagccacccgacatgtctcccgtgtcacaggcccccagggaggcaccagccagaagggcaccatccagcgctcaatacctggaagagaagtctgatcagcagaagaaggaggagctgctcaatgccatggtggcaaaactagggaacagggaagacccccttccacaggactcattcgagggagttgatgaggatgagtgggactag

SEQ ID NO: 183861 - DNA, 2118 bp, Artificial Sequence
  Description of Artificial Sequence: Synthetic coding sequence
atgggcacctgggagcacctggtgagcaccggcttcaaccagatgagggaaagggaggtgaaactctgggataccaggttcttttcctccgccctggcatctctgacactggacacgtcgttggggtgtctggttccactgctggaccccgactcgggactgctggtcctggctgggaagggagaaaggcagctatattgttatgaagttgtgcctcagcagccggccctatctcctgttacacagtgtgtactggaatctgttctgcgcggggccgccctggttccaaggcaggctctggctgtaatgtcctgcgaagtcttgcgagtattgcaactctcagacacggctatcgtgccaattggatatcatgtgcccagaaaagccgtggagttccacgaggacctcttccctgacacggcgggctgtgtccccgcgaccgacccccatagctggtgggcaggggacaatcagcaggtgcaaaaggtgtccctgaaccccgcctgtcgacctcatccttccttcacgtcgtgcctggtcccgccagccgagccactcccggacacagcccaaccggccgtgatggaaaccccggtgggagatgccgacgcctccgagggcttctcttctcccccaagctcactcacaagcccaagcacaccctctagtctcggaccaagtctgtcttccacatcaggaataggaactagccccagtttgcggtccctgcagtcccttctcggacccagctcaaaatttcggcatgcccaggggacagtccttcatcgggactctcatattacaaatctcaaaggcctgaatcttacaaccccaggcgaatctgacggattttgtgcgaataaactgagggtggcggttccactcctgtctagcggaggccaggtggctgtgctggaactgagaaaaccaggccgacttcccgacacagccctgccaacactccaaaatggggcagctgtgacagacctagcttgggatccatttgacccacacagactcgctgtggccggcgaagacgcaaggatccggctatggcgcgtgcccgccgagggcttagaagaagtactcaccaccccggaaactgtcctgacagggcatactgaaaagatctgcagccttagatttcatcctctcgcagccaacgttctggcgtcatccagttatgatctgaccgtgcgcatctgggatctgcaggccggggctgatcgcctaaagttacagggacatcaggaccaaatattctcgctcgcatggtcacccgacgggcagcaactggccactgtgtgtaaggacggcagagtccgcgtctataggcctcggagtggcccagagccgctgcaggagggaccggggccgaaaggcggccggggtgcaagaatcgtgtgggtgtgcgatggcaggtgtttgctggtctccggcttcgactcccagtccgagcggcagcttttgctctatgaagctgaggctctggcaggcggaccgctggccgtgctcggactggacgtggccccatccacactcctgccaagctacgatccagacaccgggctggtgttactaacaggcaaaggggatacacgagtgttcctgtacgaactactgcccgagagtccatttttcctcgagtgcaactcttttacttcccccgatccccacaaaggtttggtcttgctccctaagaccgaatgtgacgtgcgcgaggttgagctaatgaggtgtttgcgcctgcggcagtcttccctggagccggtggcattccgcctgcctcgcgttcgaaaagagtttttccaggatgatgttttcccagatacggccgtcatctgggaacctgtgctgtctgccgaagcctggctacagggtgccaacggtcaaccttggttactctcgctccaacctcccgatatgtccccggtgtctcaggcgcccagggaggccccggcacgcagggcccccagcagtgcgcagtacctggaggagaaaagtgaccagcagaagaaggaggagctcttaaacgctatggtggccaaactgggcaacagggaagaccccttgccccaggatagtttcgagggggtcgatgaggatgaatgggattag

SEQ ID NO: 183862 - DNA, 1386 bp, Artificial Sequence
  Description of Artificial Sequence: Synthetic coding sequence
atgagccggcaggtggtgcggagcagcaagttccggcacgtgttcggccagccggctaaggccgaccaatgttacgaggacgtgagggtgagtcagacaacatgggatagtgggttctgtgctgtcaatccaaaattcgttgctctgatctgtgaagctagcggcggtggtgcattccttgtgcttcccctggggaaaacaggacgtgtggataagaatgcacccaccgtgtgcggacatactgctccagtgttagacatcgcctggtgtccacacaacgacaacgtgatcgcttccggaagcgaagattgtacggtaatggtctgggaaattcctgatgggggccttatgctgcctctgcgggaacctgttgtgactctggagggccacactaagcgggtgggcatcgtggcctggcataccaccgcacaaaatgtactgctgagcgctggctgtgataacgtcattatggtgtgggatgtgggcacaggcgctgccatgttgacactggggcccgaagtacacccagataccatctactctgtagactggtcgcgggatggcggcctgatttgcactagctgtcgcgacaagcgcgtgagaatcatagagcctcgaaaagggaccgtggtagctgagaaggacaggccgcatgaggggacaagacccgtgcgagccgtcttcgtatccgaagggaagatcctgacgactgggttctccaggatgtctgagcggcaggtggctctctgggatactaaacatctggaggagcctctgtccttgcaagagttggatactagcagtggtgtgctgctgccctttttcgaccccgacacaaacatcgtgtacttgtgtgggaaaggagattccagcatcaggtatttcgagatcacctccgaagcacctttccttcactacttaagtatgttcagctcaaaggaaagccagcggggaatgggctacatgccaaagaggggcttagaggtcaacaagtgtgagatagcccgattctacaagcttcacgagagacgatgtgagccaattgctatgaccgtgccccggaagtcggatctttttcaggaggatctttaccctccgaccgctgggccggacccagcgctcactgccgaagagtggttgggtggtagggatgccggcccacttctcataagcttgaaagatggctacgtgccacccaagtcacgggagttgagggtcaaccgcggcttagatactggtagaagaagagccgcccccgaagcctctggtaccccatcatctgatgcagtaagtcggctcgaagaggaaatgaggaaattgcaggccaccgttcaggaactccagaagagactggacagacttgaagaaacggtgcaggctaaatag

SEQ ID NO: 183863 - DNA, 1443 bp, Artificial Sequence
  Description of Artificial Sequence: Synthetic coding sequence
atgaccgtgaccaagatgagctggcggccccagtaccggagcagcaaattcagaaacgtttacggcaaagtcgccaatagggaacattgtttcgatggcattccaatcaccaagaacgtccacgataaccacttttgcgctgtgaacacacgttttctggccatcgtgacggagtcggctggtgggggatcctttctggtaattccccttgaacaaacaggtcgcattgaacccaattacccgaaagtttgcggccaccaaggcaatgttctggacattaaatggaacccctttattgacaatattattgctagctgttccgaagacacctcagtgaggatttgggaaatacctgagggcggacttaagagaaacatgacagaagccctgctggagttgcatggccactctcgccgagttgggttggtggagtggcaccccactactaataatatcttattcagcgcaggctacgattacaaagtactcatttggaacctcgacgtaggcgagccagtcaagatgatagactgtcatactgacgtgatcctctgtatgtcttttaatacagatggctccctgctgactaccacctgtaaggacaagaagttgagagtgattgaaccacgtagcggcagggtgctgcaagaagctaattgcaaaaatcacagagtcaatcgagtggtgtttctgggaaatatgaagcggctgcttaccacaggagtatctagatggaacacgagacagatcgctctttgggatcaggaagacctgtctatgccactgattgaggaggagatcgatggattgtccggacttttattccctttctatgatgcagacacacacatgctgtatctggccgggaagggggacgggaacatccggtactacgaaatctccaccgagaagccctacctgtcttatctgatggaatttaggagccccgcccctcagaaaggcttgggtgtgatgcctaagcacggactggatgtgagtgcctgtgaagtattccgcttctacaagctggtgacactcaaggggcttatcgagccgatttccatgattgtgcctcggcgctccgactcttaccaggaagacatatatcccatgacacctggcacagagcccgcattgacgccagacgaatggctgggtggcatcaatagggatccagtactgatgagcctgaaggagggctataaaaagtctagcaaaatggtctttaaagctccaataaaggaaaaaaagagcgtagtggttaatggaatcgatctactggagaacgtccctccccgaactgagaacgaactgctgcggatgtttttccggcaacaggacgagattaggaggctgaaggaagagctggcccaaaaggatattcgtatccgtcagttgcagctcgagcttaaaaatctaagaaactcccctaagaactgttag

SEQ ID NO: 183864 - DNA, 1269 bp, Artificial Sequence
  Description of Artificial Sequence: Synthetic coding sequence
atgctggacctggaggtggtgcccgagcggagcctgggcaacgagcagtgggagttcaccctgggcatgcctctggcccaggctgtagccattctccagaagcactgtcggatcattaagaacgtccaagtgttgtactctgaacagtcgccgctctctcacgacctcatcttgaacctgacacaggatgggatcaagttgatgttcgacgctttcaaccagcgactcaaggtaattgaggtttgcgacttgaccaaagtgaaactgaagtactgcggagtccacttcaatagtcaagccattgctccaactattgagcagatcgatcagtccttcggagctacccatcctggcgtttacaatagtgcggagcagctctttcacttaaacttccggggcctctcattcagctttcagctcgattcatggactgaggcaccaaagtatgagcctaacttcgcccatggcctagccagcctccaaatcccgcacggagctactgtgaaaaggatgtacatctactccggcaatagtctgcaggacactaaggcgcccatgatgccactcagctgctttctcggcaacgtctatgcggagtccgttgacgttttgcgtgacggtacaggaccagctggcctcagactgaggctattggccgcaggatgtggccctggcctgctggccgatgctaagatgcgagtattcgagcgatcagtctacttcggtgattcctgccaggatgtgctgtcaatgctcggatcaccacataaggtcttttataagtccgaagataaaatgaaaattcattccccttcaccccacaagcaagtgcctagcaaatgtaacgattacttttttaattacttcaccttaggagtggatattctcttcgacgccaacacacataaagtgaaaaagtttgtcctgcacacgaactaccccggacactataattttaatatttaccatcgatgtgaatttaaaatacccctcgctatcaaaaaggaaaacgcggatggccaaactgagacgtgcaccacctattccaaatgggacaatatccaagagctgctgggccacccagtcgaaaagcctgtagtgctccatcgctcgtccagtccaaacaacacaaacccctttggttcgactttctgcttcggcctgcagaggatgatatttgaggtgatgcaaaataaccacatagccagcgtcacgctgtacgggcccccgaggcctggtagccacctgcgaaccgcagagctgccctag

SEQ ID NO: 183865 - DNA, 1470 bp, Artificial Sequence
  Description of Artificial Sequence: Synthetic coding sequence
atgagcttccggaaggtggtgcggcagagcaagttccggcacgtgtttggccagcccgtcaagaacgaccaatgctatgaggacattcgggtgagcagagttacctgggatagtacgttttgcgccgttaatccaaaatttttggccgtgatcgtcgaagcatccggggggggagcattcctggtgctgccgctgtccaagaccggcagaatcgataaggcttacccaacggtatgcgggcacaccggaccagtccttgacattgactggtgcccacacaatgatgaagtcatcgcctccggcagcgaagactgcactgtcatggtgtggcagattcctgagaacggtctgacttcccctctgaccgaacctgtggtggtactggagggacacacaaagcgcgtggggataatagcgtggcacccaaccgcaaggaacgtcctgctcagcgccggatgtgacaacgtggtgctgatatggaatgtaggtactgctgaagaactctatagactagactctctgcatcccgacttaatctacaatgtgtcctggaaccacaacggatctctgttctgcagtgcatgtaaggacaagtctgtcaggatcatcgacccccggaggggtaccctagtggctgagagggaaaaggcacacgagggcgcaagacctatgagagctatcttcctggctgacggaaaggtgtttactacgggcttttcacgtatgtccgaaagacaactcgccctttgggacccggagaacttggaggagccgatggccctgcaggaattggattcctccaacggcgcccttctgcccttctacgaccctgacaccagtgttgtgtatgtatgtgggaagggagacagctcgatcagatatttcgaaattactgaagaacccccttatattcacttcctcaacaccttcacttctaaggaacctcagcgtggtatgggatctatgccaaagcgcgggttagaggtgtcgaaatgcgagatcgctaggttttacaaattgcatgagcggaagtgtgagccaatcgtgatgacggttccgagaaagtctgatctgtttcaggacgatttataccccgataccgcaggtccggaggcggccttagaagcagaagaatgggtcagcggacgcgacgccgatcccatacttatctcactccgggaggcctacgtacctagcaagcagagagacttgaagatctcaaggcgcaatgtactttctgacagcagacctgccatggcccccggatccagccacctcggggccccagcctctactactactgctgctgacgccactccttctggctcactggctcgggccggggaggcaggaaagctcgaggaggtaatgcaggagctgagagctctgcgggctcttgttaaggagcagggtgatcgaatctgtcggctggaagaacagctgggtagaatggaaaatggagacgcgtag

SEQ ID NO: 183866 - DNA, 864 bp, Artificial Sequence
  Description of Artificial Sequence: Synthetic coding sequence
tgcttcctgctgccccggggccgggaccccgagccccccgaggccggtgctgccgctccctgtgctccgggtgccccagacatgtctttccgcaaggtggtccgacagtctaagttcagacacgtatttggccaaccagtaaagaacgaccagtgctacgaggatatccgcgtaagccgtgtgacgtgggacagcaccttctgtgccgtgaatcctaagtttttagctgtgatcgtagaggctagcggcggaggggcctttctggtcctccctctgagtaagactggacggatcgacaaggcctaccccaccgtatgcggtcacacagggcctgtgcttgatatagattggtgtccccataacgatgaggtcattgcctctggctccgaggattgcaccgttatggtgtggcaaatccctgagaatgggcttacctctccacttactgagccggtggttgtgctggaaggtcacactaagagagtggggatcatcgcgtggcatccgacagccaggaatgtgctgctgagcgctggatgtgataacgtcgtccttatttggaacgtggggactgctgaagagctctataggcttgacagtcttcatccggatctcatttataacgtctcatggaaccacaatggaagcctcttttgttctgcatgtaaagataagagtgtgcgtatcattgatccaaggcgcggcactttggtagcagagcgggaaaaggcccacgaaggtgcgcggccaatgagggctatattcctggccgacgggaaagtgtttacaactggtttttcccggatgtcggagaggcagctggcattgtgggatcctggcgtgaggaggttctgtctggcatag

SEQ ID NO: 183867 - DNA, 1470 bp, Artificial Sequence
  Description of Artificial Sequence: Synthetic coding sequence
atgagcttccggaaggtggtgcggcagagcaagttccggcacgtgttcgggcagcctgttaagaatgatcaatgctacgaggatattagagtgagtagggttacgtgggatagtaccttctgtgctgtgaatcccaagtttctcgctgtgatcgtagaggcttcagggggcggcgccttccttgtcctgccattaagtaagacaggcagaattgacaaagcctatccgactgtgtgcggtcacaccgggcctgtgctggacatcgactggtgcccacataatgacgaagttattgccagtggcagcgaagattgtaccgtgatggtgtggcagatacccgagaatgggctgactagccccttaaccgagcccgtagttgtactggagggccacactaaacgggtaggcattattgcctggcaccctacggcgagaaatgtactgctgtctgccgggtgtgataatgtagttctgatctggaacgtcggcacagctgaggagctgtatcgtttagattccctgcacccggacctgatctacaacgtgagctggaatcataacggcagcctgttctgttctgcatgcaaagacaagagcgtccggatcatcgacccgaggagaggtaccctggtggccgaacgcgagaaggctcacgagggcgcgcgccccatgcgagctattttcctggccgatgggaaggtgttcactactggattttcccgcatgagtgaacgacaacttgcactctgggacccagaaaacctcgaagagcctatggccctgcaggagcttgattcctctaacggcgccctgctgcccttctacgacccagacacgtctgtggtgtatgtgtgtgggaaaggtgatagtagcattaggtactttgagatcacagaagaacccccatacatccactttttgaacactttcaccagtaaggagcctcagcgcggaatggggagtatgcccaagcggggactggaagtgtccaagtgcgagatcgccagattctataaacttcacgagcggaaatgcgagcctatcgtaatgaccgtacctcgcaagtccgaccttttccaggatgacctctaccccgatactgctggccctgaggctgcactagaggcagaggagtgggtgtctggcagagatgccgaccccattctgatttctttaagagaagcctacgtgccttcaaagcagcgcgacctgaagatatccagacgtaatgtgctgtccgatagccggcccgccatggcacccggttctagccatttgggcgccccagcctctactactacggccgctgatgctactcctagcgggtcgctcgcccgggccggtgaggccggtaaactggaggaggtcatgcaagaactgagggctttgcgtgcattggtgaaagaacaaggcgatcggatctgccggctggaggagcagctgggcaggatggaaaatggcgacgcatag

SEQ ID NO: 183868 - DNA, 870 bp, Artificial Sequence
  Description of Artificial Sequence: Synthetic coding sequence
atgagcttccggaaggtggtgcggcagagcaagttccggcacgtgttcggtcagcccgtgaaaaacgatcagtgttacgaagatattagggtgtcgcgcgtcacttgggattctacgttttgcgctgtgaaccctaagtttctagctgtgatagtggaggcctcaggtggtggggcgttcctggtgttgcccttaagcaaaacgggcagaattgacaaagcttatcctacagtgtgcggccacaccgggcctgttttggacattgactggtgtccgcataacgacgaggtgattgcctctgggtccgaggattgcacggttatggtgtggcaaattccagagaatggtcttacaagtccgctcaccgagccagtggtcgttctggaagggcacactaaacgagtcggtattatagcctggcatccaactgcacggaacgtcctcctctcagccgggtgcgataacgttgttctcatctggaacgttgggaccgccgaggaactctatcgccttgatagtctccatcctgatttgatttataacgtctcttggaaccataatgggtccctgttttgctctgcttgcaaggataagagtgtccggatcatcgatcccagaagaggcactctggtggccgagcgggaaaaggcccacgaaggagctagaccaatgcgtgctatctttctggccgacggcaaggtgttcaccaccggcttctctagaatgtctgagcggcagctggcactatgggaccccgtgagcggtcaacctgagggagctaatctacgactgggtccgcacccgggcccagggcggcaaggatccccatggggagggttgtggttcctcgcctccctgcccggcacatag

SEQ ID NO: 183869 - DNA, 552 bp, Artificial Sequence
  Description of Artificial Sequence: Synthetic coding sequence
atgagcttccggaaggtggtgcggcagagcaagttccggcacgtgttcgggcagcccgtaaagaacgatcagtgttatgaggatatccgagtgtccagagtcacctgggactcaacattttgcgccgtcaaccctaagttcctggccgtaatagttgaggctagtggtggaggtgccttccttgtcctcccccttagcaagacgggcaggatcgataaagcttatcctaccgtttgcggtcacacagggcccgtgctggacattgactggtgtccccacaatgacgaggttattgcctctgggtcagaggactgtacagttatggtgtggcaaattcccgaaaacggcctgacaagtccccttacggaacccgtggtggtactcgaaggacatactaagcgagtcggcatcattgcttggcatcctaccgcccggaacgtgcttctgagcgcaggattgcatcgacccccattttgtgctccgccgccccatgggcccctgcatacaagccagcagcctctgcagggcccacacgataagtgggaatcttag

SEQ ID NO: 183870 - DNA, 1425 bp, Artificial Sequence
  Description of Artificial Sequence: Synthetic coding sequence
atgcggcgggtggtgcggcagagcaagttccggcacgtgttcggccaggcagtcaaaaatgaccagtgttacgacgacattcgagtgtcaagagtgacgtgggactcaagcttttgcgccgtcaatccgcgcttcgtcgctataataatagaggcttcaggggggggagcctttcttgtattacccctgcacaaaacaggtcggattgataagtcttacccaacggtgtgtgggcatacaggtccagttcttgatatagattggtgcccccataatgaccaggtcatcgctagtggtagcgaggactgtaccgtcatggtatggcagatacctgagaatggactcactttaagcctgacggaaccagttgtgatactggaaggccactctaaacgtgtgggaattgttgcctggcatccaactgcccgcaatgtgctgttatccgcgggatgtgacaatgctataatcatttggaacgtggggacaggggaggctctgattaatcttgacgacatgcacagcgatatgatttacaatgtgagttggaatagaaacggctcgctcatctgcaccgccagtaaggataagaaagtcagagtgatcgatcccaggaagcaggagattgtcgccgagaaggaaaaggcgcatgagggcgctaggcccatgcgcgccatcttcctcgctgatggcaacgtgtttaccactggcttttcccgaatgagtgaacgacagttagccctgtggaatcccaagaatatgcaggagcccatcgctctgcatgaaatggacacgtcaaacggcgtgctgttgcctttctacgaccccgacactagtattatttacctctgcggaaagggcgatagctccattcgctactttgaaataacagatgagagcccgtacgtccactacctgaacacttttagctcaaaagagcctcaaagggggatggggtatatgcccaaaagaggattggatgtgaacaaatgtgagatagctagatttttcaagctgcacgaacgcaaatgtgagcctatcattatgacagtaccccgcaagtctgatctgttccaggatgatctgtacccagacactgcaggaccggaggcagccctagaggccgaagaatggttcgaaggtaagaacgctgacccaatccttatttccctaaaacacggatatatcccgggtaaaaatcgagatctaaaggtagttaagaaaaatattctcgactcaaagcctacagcaaataaaaaatgcgacctgatttccatcccgaagaaaactacagataccgcctctgtgcagaacgaagctaaactcgatgaaatcctcaaggagattaaaagtattaaggacaccatttgcaatcaagatgagcgaatatccaagctcgaacagcaaatggccaaaattgcggcatag

SEQ ID NO: 183871 - DNA, 1584 bp, Artificial Sequence
  Description of Artificial Sequence: Synthetic coding sequence
atgtacggccccggcagccagctgggcaagagcggcaacaacagctgggcgaaggaacgcggctgctcgattgcttgtcagggcagcctgacctctgccagacttcacgctcccagcataggagagcgacccctgtcccatatgagatggaaggatactatgaggagggtggttcgacagagcaaattcagacacgtcttcgggcaggcagtgaagaacgaccaatgctatgacgatattagggtgagccgggttacatgggactcttccttctgcgcagtgaaccccagattcgtcgccatcatcatcgaagcctccggaggcggcgcattcctagtcctgcctcttcataaaactggtaggattgataagagttatccaactgtgtgtggccatacaggccctgtcctggatattgactggtgtcctcacaatgatcaggtcatagcctcaggcagcgaagactgtaccgtcatggtctggcagatccccgagaatgggttgaccctgtctctgacagagcctgttgtgattctggagggtcatagcaaaagggtgggaatcgtggcctggcaccctacggctcgcaacgttcttctttctgctgggtgcgacaatgctataatcatttggaatgtcggcacgggcgaagcccttatcaatctggatgatatgcatagcgatatgatatacaatgttagctggaaccggaacgggtcccttatctgcaccgcgtccaaggacaaaaaagttcgagtgattgacccaaggaagcaggagatcgtggcagaaaaagaaaaagctcatgagggggcacgccctatgcgtgccatatttttagctgacggcaatgtgtttaccacaggcttttcgaggatgtccgagcgacagttagcactctggaacccaaagaacatgcaggagccgattgcgctgcacgagatggatacaagtaatggtgtgcttttgccgttctatgaccccgacacaagcattatctacctttgtgggaagggggactctagtatcaggtacttcgaaataaccgatgaatccccttacgttcactacctcaataccttctcctctaaggaaccccaaaggggaatgggctatatgcctaaacgcggacttgacgtgaataagtgcgagattgctagatttttcaagctgcacgagcgcaagtgcgaacccattattatgactgtgcctaggaaaagtgacctcttccaggatgacctctaccccgatactgcgggcccagaggccgctctcgaggcggaagaatggtttgagggcaaaaacgccgaccctatcctcatctcgctgaagcatggttacatccctgggaaaaacagagacctgaaggttgtgaagaagaatatcttggactcaaagccaaccgctaataagaagtgcgacctgattagcatcccgaaaaagaccaccgataccgcttccgtgcagaacgaagccaagctggatgaaattcttaaggaaatcaagagcattaaggacacaatttgcaaccaggacgaacggatttccaaattggaacagcagatggccaagattgcggcttag

SEQ ID NO: 183872 - DNA, 1425 bp, Artificial Sequence
  Description of Artificial Sequence: Synthetic coding sequence
atgcggcgggtggtgcggcagagcaagttccggcacgtgttcggccaggccgtcaaaaatgatcagtgttacgacgatatccgcgtctcacgtgtgacctgggactcctccttttgtgcggtaaatcccaggttcgtggccattattatcgaagcttccgggggaggtgcgttcctggtcctgccactgcacaaaacaggccgtatcgacaaatcctacccgacagtctgtggacataccgggcctgtgttagacatagattggtgcccccataatgaccaggtgatagcatccggtagcgaagactgcacagttatggtctggcagatcccggaaaatgggctcaccctctccctaacagagcccgtggtgatattggaaggtcacagtaagagagtgggcattgttgcttggcatccgactgctcggaatgtgttactgagcgccggctgtgataacgcaatcatcatttggaacgttggcacgggggaggctctgatcaaccttgatgacatgcattcagatatgatttacaacgtgtcctggaaccggaacggctcgctaatttgtacagccagtaaggataagaaagtcagagtgatcgaccctcggaaacaggaaattgtggccgaaaaggagaaggctcacgaaggggctaggcctatgcgggcaatcttcctcgccgacggaaacgtgttcaccactgggttttcccggatgagcgagaggcagctggccctttggaatcctaaaaacatgcaggaacccatcgccttacacgagatggacactagcaatggggtcctgctgcctttctacgatccggacacttctattatttacctgtgcggcaagggggatagtagcattaggtatttcgaaatcacagatgagtccccctatgtccattatctcaatacattttccagtaaagagccacagcgcgggatggggtacatgcctaaaaggggacttgacgttaacaagtgcgaaatcgcgcgcttctttaagctgcacgaaagaaaatgtgaacccattatcatgactgtgccacggaagagtgacctcttccaggatgacctgtacccagacacagctgggcccgaggctgccctggaagcagaggaatggtttgagggcaagaatgcagaccctatcctgatcagcctgaaacatggctatattccaggaaagaaccgcgatttgaaagtagtcaaaaagaacatcttggactctaaaccaacggcaaacaagaagtgtgaccttatttctatacctaagaagactaccgacacagcctcggtccaaaatgaggcaaagctcgacgaaatactgaaggaaatcaagagcatcaaggacaccatttgcaatcaggacgagaggataagcaaacttgagcagcaaatggctaagattgctgcttag

SEQ ID NO: 183873 - DNA, 489 bp, Artificial Sequence
  Description of Artificial Sequence: Synthetic coding sequence
atgcggcgggtggtgcggcagagcaagttccggcacgtgttcggccaggcagtcaaaaatgaccagtgttacgatgacatcagagtatcaagggtgacctgggatagtagcttctgcgccgtgaatcctagattcgtcgccatcataatagaggcctccggcggcggggcatttttggtactcccgctccacaagactggaaggatcgacaaatcctaccccaccgtttgcggccacacgggaccagtgctggacatcgattggtgcccccataacgaccaggttatcgcctcagggtctgaggactgtacggtaatggtctggcaaatccctgagaatggactgaccttatccttgaccgaaccagttgttatcctcgagggacactcaaagagagtcggaatcgtcgcctggcatcctaccgcacgcaatgtgcttctcagtgctggttgcgataacgccattataatatggaatgtggggacctag

SEQ ID NO: 183874 - DNA, 498 bp, Artificial Sequence
  Description of Artificial Sequence: Synthetic coding sequence
agcaaggagccccagcggggcatgggctacatgcccaagcggggcttagacgtgaataagtgtgaaatcgctcggttttttaagctacacgagcgcaagtgcgagcccatcattatgaccgtgccgaggaagagtgatctgttccaggatgatctttatcccgatacagccgggcctgaggctgccctggaggctgaagaatggttcgaagggaagaacgctgacccaatacttatcagcctgaaacatggctacattccgggcaagaacagggacctgaaagtggtgaaaaaaaacatcctggactccaaaccaacggcaaataagaagtgtgacctgatctccattcccaagaaaaccactgacaccgcttccgtccagaacgaagcgaaactcgacgaaattttgaaggagatcaaatctattaaggacaccatctgcaaccaggatgagagaatttcaaagctcgagcagcagatggccaaaatagccgcctag

SEQ ID NO: 183875 - DNA, 546 bp, Artificial Sequence
  Description of Artificial Sequence: Synthetic coding sequence
atgcggcgggtggtgcggcagagcaagttccggcacgtgttcggccaggcagtgaagaatgaccagtgctacgatgacatccgtgttagtcgggtgacgtgggactcttctttttgtgcagtgaaccctcgattcgtggcaatcataatcgaggcctctggcggtggggcgtttctcgtgctgccattgcacaagacggggaggatagacaagtcttacccaactgtatgcgggcatacaggtcccgtgcttgacattgattggtgcccccataacgatcaggtaatagcctcagggtccgaagactgcaccgtaatggtgtggcagattcctgagaatggcttgacgctgagtctcacagagccagtcgttattctggaggggcatagcaagagggtgggcattgtggcttggcatcctactgctcgcaacgtgctgctgagcgccggttgtgacaacgctatcatcatttggaacgtgggcactggcgaggcactcatcaacctggacgacatgcactctgatatgatttataacgtgtcgtag

SEQ ID NO: 183876 - DNA, 1443 bp, Artificial Sequence
  Description of Artificial Sequence: Synthetic coding sequence
atgcggtggaaggacaccatgcggcgggtggtgcggcagagcaagtttaggcatgtgtttgggcaggcggttaaaaacgaccagtgttacgacgacattcgggtgtctagggtcacttgggactctagcttctgcgctgtgaatccaagattcgtagctatcatcatagaggcctcaggcgggggagcgtttctggtgctccctctccataaaaccgggagaattgacaaatcatacccaacggtatgcggtcataccgggcccgttctggatatcgactggtgcccccataatgatcaggtcattgcctctggcagcgaagattgtaccgttatggtatggcagatacccgaaaacggactgacgttgtctcttacagaacctgtggtcattttagaggggcatagcaaacgggttggtatagtggcatggcatcccacagccagaaacgttctgttgtcggccgggtgcgacaatgccatcatcatctggaatgtcggaactggcgaggcgcttattaacctggacgatatgcacagcgacatgatttataacgtgagttggaacaggaatggctcactgatatgtacagcttcaaaagacaagaaggtcagggtaattgaccccagaaagcaggagatagttgccgagaaagagaaagcgcacgagggggccagacccatgcgggcgatcttcttagctgatggcaatgtgtttacgacaggtttttcccgcatgagcgagaggcaactggccttgtggaatccaaaaaacatgcaggaaccaatcgctctgcatgagatggatacaagcaatggtgtgctgctgcccttttatgaccccgatacttccatcatctacttgtgtggaaagggtgacagctcaatccgctacttcgagatcaccgatgagagtccctatgttcattatctgaacacgtttagtagcaaggaacctcagcggggaatgggatatatgcctaagaggggtctggatgtcaacaaatgcgagattgcgcgctttttcaaactacatgaacgaaaatgcgagccgatcattatgaccgttcccaggaagtctgatctctttcaggacgacctgtacccagacacagcaggaccagaagccgccttagaagctgaagaatggttcgaggggaaaaacgctgatcctattcttatttcactgaagcacgggtatattccaggtaagaatcgggacctcaaagtcgtgaaaaagaatatcctcgactccaaacctaccgccaataagaaatgtgatctgatttccatacctaagaaaacaaccgacaccgcatccgtgcaaaatgaggccaagctggatgagattctgaaggagatcaagagtataaaagacactatctgtaaccaggatgaacgtatcagcaaactcgaacagcagatggcgaagatcgccgcttag

SEQ ID NO: 183877 - DNA, 510 bp, Artificial Sequence
  Description of Artificial Sequence: Synthetic coding sequence
atgcggcgggtggtgcggcagagcaagttccggcacgtgttcggccaggcagtgaagaatgaccagtgttacgacgacatcagagtctcccgcgtcacttgggattcttccttttgcgccgtgaacccaagatttgtggccattatcatcgaggcctcgggggggggcgccttcctcgttcttcccctgcacaagaccggcaggattgacaaaagctacccgactgtctgtggacacactggcccagtcctggatatagattggtgcccgcataatgatcaggtaatagcgtccggcagcgaggattgtaccgttatggtttggcagattcccgaaaacgggctgactctctctctcaccgagcctgtcgtgatcttggagggtcactccaagcgtgtgggcatcgtcgcctggcaccctactgccagaaacgttcttctctccgcaggctgcgataatgctatcatcatttggaatgtgggcacaggtgaagcactgatcaatctttag

SEQ ID NO: 183878 - DNA, 456 bp, Artificial Sequence
  Description of Artificial Sequence: Synthetic coding sequence
atgcggcgggtggtgcggcagagcaagttccggcacgtgttcggccaggcagtcaaaaacgaccagtgctacgacgacattcgcgtgtccagggtgacctgggatagctcgttctgcgctgtaaaccccaggttcgtggctattataattgaggcctctgggggaggggccttccttgttttacccctgcataagacgggtaggattgacaaatcctacccaaccgtttgtggccacactgggcctgttctggacattgattggtgtccacacaacgaccaggtcattgcatcgggctctgaagactgtacagtcatggtttggcagattcccgaaaatggcctaacattgagccttacggagcctgtggtgattctggagggccactcaaagcgtgtggggatcgtagcctggcatcccaccgccagaaatgtactattaagtgcaggcggttag

SEQ ID NO: 183879 - DNA, 492 bp, Artificial Sequence
  Description of Artificial Sequence: Synthetic coding sequence
atgcggcgggtggtgcggcagagcaagttccggcacgtgttcggccaagcagtgaagaacgatcagtgctatgatgacattcgggtttcaagggtaacatgggattctagtttctgcgcagtcaatcccaggttcgtcgctattatcatagaggccagcggcggcggagcctttcttgtcctcccgttgcacaagactggcaggatcgacaagtcctacccgaccgtgtgcggtcacactggtcctgtgctagatatcgactggtgcccccataacgatcaggttatagcgtccggctccgaagattgtaccgtgatggtgtggcagattcccgagaacgggctcaccttatccttgacagagcccgtggtcattctggaaggccactcaaaacgagttgggattgtcgcctggcacccaactgctcggaacgtgctactttcagccggatgcgataacgctatcattatttggaatgtgggaacaggatag

SEQ ID NO: 183880 - DNA, 1578 bp, Artificial Sequence
  Description of Artificial Sequence: Synthetic coding sequence
atgagctggcacccccagtaccggagcagcaagttccggcacgtgtttggcaaacccgcatccaaggagaattgctacgacagcgtgcctattacacgaagtgtgcacgacaatcacttttgtgcagtgaatcctcactttatcgcggtggtcaccgagtgcgccggcgggggagccttcctggtcattccccttcaccagacaggcaaacttgacccacattatcccaaagtttgcgggcacagaggcaatgtgctggatgtgaagtggaacccatttgatgattttgagatcgcatcatgctctgaagatgcaactatcaagatctggtccattcctaagcagctgctcaccaggaacctgactgcctatcgcaaagaactcgtgggccacgcaaggcgggtggggctagtggaatggcacccaactgcagcgaacatacttttctcagcagggtatgactacaaggtcatgatttggaatctggacacaaaagaatccgttattacttctcctatgtccactataagctgccaccaggatgttatactcagcatgtcttttaatactaacggctccctcctggcgaccacctgcaaggaccgaaagattcgggttatcgatcctcgtgcgggaacagtcctacaggaagcctcctacaaaggccaccgagcaagtaaggtgctttttttaggcaacctgaagaagctgatgagcacggggacctcaaggtggaataatagacaggtggccctgtgggatcaggacaacttgagtgtcccactgatggaggaggacttggacggcagttctggcgtgcttttccccttttacgatgctgacacctcaatgttgtatgtagtaggaaagggagatggaaacatcagatattacgaggtctcagcagacaagccccatctttcttatctgacagagtatcgcagctataatccccagaagggcatcggagtcatgcccaagcggggcctggatgttagctcgtgtgagatcttccggttttacaagctgattaccactaaaagccttatcgagccaatctcaatgatagtcccacgccggtccgagtcctatcaggaagacatctatcctcccactgctggcgcgcaaccctcgctgaccgcccaggaatggctgagcggtatgaacagggaccctattctggtttcactcagaccagggagcgaactactccgcccccatcccctgcccgctgagagacctatattcaattctatggccccagccagcccacggctgcttaatcaaaccgaaaaactggctgcggaggatggatggcggtcaagtagtctgctggaagaaaaaatgccaagatgggccgccgaacaccgtcttgaggaaaaaaaaacttggcttactaacggttttgatgttttcgaatgtcctcctccaaaaactgagaacgaactgcttcagatgttttaccgccagcaagaagaaattcggcgcttacgggaacttctcactcaacgggaggtacaggctaaacagctcgaactcgaaatcaagaacttgaggatgggcagcgaacaattatag

SEQ ID NO: 183881 - DNA, 1578 bp, Artificial Sequence
  Description of Artificial Sequence: Synthetic coding sequence
atgagctggcacccccagtaccggagcagcaagttccggcacgtgttcggtaagccagcttcaaaagaaaactgttacgacagcgtcccgataaccaggtcagtgcacgataaccacttttgcgccgtaaacccccacttcatagccgtcgtcacggagtgtgccggcggtggcgcctttctcgttatccctctccatcagacaggaaaactcgatcctcactatccgaaagtgtgtggacaccggggaaacgtcttggatgtcaaatggaatccatttgacgactttgagatcgcttcctgttctgaggatgccaccattaagatctggagcatccccaagcagctgttgacaagaaatttaactgcatacaggaaagaattggtcggacacgcgcgccgggtcggacttgtggagtggcatccaaccgccgccaacatcctattctccgcaggctacgactacaaggtgatgatttggaatctggataccaaagaatcagtgatcacctctcctatgagcacaatcagttgtcaccaagatgtcatcctttccatgtcctttaatactaacgggtctttgctagcaaccacatgcaaggatagaaaaattagggttatcgacccgagagctggtacagtgcttcaggaggcgtcctacaagggtcaccgggcttcaaaggtgttgttcctggggaacctgaagaaactgatgtccactgggacatcccgatggaacaatcgccaggtcgctctatgggatcaggataacctctcggtgcctcttatggaggaagacttggatggaagtagcggggtcctctttcccttttatgacgctgacaccagcatgttgtacgtcgtgggtaaaggcgacgggaatataagatactatgaagtttcagcggataaaccccacctgtcttatctgaccgaataccgcagctataatccccagaaagggatcggggtcatgccgaaacgcggactggacgtcagtagctgcgaaatttttcgcttttataagctgatcacaaccaaaagcctgattgagccaatcagcatgatcgtgccacggcgatccgaatcctatcaggaagatatctacccccccacggccggcgcgcaacctagcctgacagcccaggaatggctcagtggtatgaatcgcgatcctattcttgtctcactcaggcccgggtccgaactgctgagaccacatcctctcccagccgagagacccatttttaacagcatggctccagcttcccccaggctactgaatcagactgaaaagctggcagctgaggacggctggcgcagttcctccctgttagaggagaaaatgccccgttgggctgctgagcataggctggaagaaaagaagacctggctgactaatgggttcgacgtttttgaatgccctccccccaagactgagaacgagctgctgcagatgttctatagacagcaggaggagattcgtcgcctgagggaactgttaacacagcgggaggtgcaggccaaacagttagaactggagattaaaaatctgcgtatggggtccgaacagctgtag

SEQ ID NO: 183882 - DNA, 1443 bp, Artificial Sequence
  Description of Artificial Sequence: Synthetic coding sequence
atgaccgtgaccaagatgagctggcggccccagtaccggagcagcaagttcaggaatgtgtacgggaaagtcgcgaatcgcgagcattgttttgacggaatccctatcactaaaaacgtgcatgataatcatttttgcgctgtaaataccaggtttctagccatcgtgacagaatccgcaggtggcgggagtttccttgtaatccctctagaacagactggtcgcatagagccaaattaccccaaggtctgcgggcatcaggggaacgtgctggatattaagtggaatcccttcattgataacatcatcgcatcatgctcagaggatacctccgtccgaatttgggaaattccagaaggcggtttaaagaggaacatgactgaggcactgcttgagttacatggccattccagacgcgtggggctcgtggagtggcatccaacaacgaacaacatactgtttagtgcaggctatgattataaagttctaatatggaatctcgacgtgggggagccagtgaagatgatagattgccacacagacgtaattctgtgtatgagcttcaacaccgacgggtcactgttgaccacaacctgcaaagataaaaagctccgcgtgatagaaccccggtccggaagagttctacaggaagccaactgcaaaaatcaccgggtgaatagagtggtatttctgggcaatatgaagcgtctcctaacgaccggagtttcacggtggaacacacgacagatcgccctctgggaccaggaagatctgtccatgcctctgatagaagaggagatcgacggcctgagtggcttgctgttcccattctacgacgcagatacccatatgctgtacctggcaggtaagggagacgggaacataagatactacgagatcagcacagaaaaaccatatctgtcttatctgatggaattcagaagcccggccccccagaaggggctgggtgtcatgcccaaacatgggcttgacgttagtgcctgtgaggtgtttaggttctataaactggtcacgctcaaaggccttatagaaccaataagtatgattgttcctcgacgctccgatagctatcaggaggacatctaccccatgacccccgggaccgaacccgcactaacaccggacgagtggctaggtgggatcaaccgggacccagtgctcatgagtctgaaggagggttacaaaaaatccagtaagatggtctttaaggctccaatcaaggaaaaaaaatccgtcgtcgtgaacggaatcgatctcctagaaaacgtacccccaaggaccgaaaacgaacttctgagaatgtttttcagacagcaggacgagatccggaggttgaaggaggaactagcccagaaggatataaggatcagacagctgcagctggagctgaaaaatcttcgcaactctcccaagaactgctag

SEQ ID NO: 183883 - DNA, 1428 bp, Artificial Sequence
  Description of Artificial Sequence: Synthetic coding sequence
atgagctggcggccccagtaccggagcagcaagttccggaacgtgtatggtaaagtagcaaacagggaacactgttttgatggcattccaattacgaagaatgtgcatgacaatcatttttgcgccgtgaacactagattcctggccatcgttaccgagtcagcgggcggcggaagcttcctcgtgatccccctcgaacagaccggacgcatcgaaccaaactatcccaaagtctgcggccatcaaggcaacgtgctcgacattaagtggaatcccttcatcgataatattatagcaagttgtagcgaggacacgagtgtgcgcatatgggagatccccgaggggggtctcaaaaggaacatgaccgaggccctacttgaattacacggccacagcagaagggtcggcctcgtggaatggcacccaactacaaataacatcctgttcagtgccgggtacgattataaagtgctgatttggaaccttgacgtcggcgaacccgtgaagatgatcgattgccacactgacgttattctctgtatgtcttttaacactgacggctccctgcttaccaccacatgcaaagataagaagctaagggtcatagaaccacggagcggccgggtgttacaggaggccaactgcaaaaaccatcgagtcaacagagtggtgttcctgggtaatatgaaaaggttacttacgactggtgtatcaagatggaacaccaggcagattgctctttgggatcaggaggacttgtctatgcccctgattgaggaggagatcgacggtctctctggcctgcttttcccgttttacgacgccgatacccatatgctctacctcgctgggaaaggcgatggcaatattcggtattacgagatcagtaccgaaaaaccatatctgtcttatttgatggaatttaggagccctgcaccgcagaaaggtctcggagtgatgcctaaacatgggctggacgtgtcagcatgcgaagtcttcagattctataagctggttacgctgaagggtctgatcgaacccatatccatgatcgttcccagaagatcagacagttaccaggaagacatttatcctatgacacccggcaccgaaccagcacttacgcctgacgagtggctcggggggatcaatcgtgacccagtcttaatgtctctgaaagagggctacaagaagtcgagcaagatggtgtttaaggcccctatcaaagagaagaaatccgtagtcgttaacggaattgatctgctggaaaatgtgccacctcgcacggaaaacgaacttctgcgcatgttcttcagacagcaggacgagattcgtcgtctcaaggaagaactggcacagaaagacatccgcatcagacagcttcagctcgagttgaagaacctgagaaattcccccaagaactgttag

SEQ ID NO: 183884 - DNA, 1428 bp, Artificial Sequence
  Description of Artificial Sequence: Synthetic coding sequence
atgagctggcggccccagtaccggagcagcaagttccggaacgtgtatggaaaagtggctaatcgcgagcactgtttcgatggaatccctatcaccaaaaatgtccacgacaaccacttctgtgcagttaatactcgctttttggccatcgtaacagaatcggccggaggcggcagcttcctggtgattcctttagaacagaccggcaggatcgagcccaactatcctaaagtctgtggccatcagggtaacgtcctagacattaaatggaatccgttcatcgacaatattatagcctcatgttctgaggacacctcagtgcgcatctgggaaatacctgaaggcgggctgaagcgaaacatgacggaggccctccttgagctgcacgggcacagccgccgcgtagggctggtcgagtggcatcctacaactaacaacattttattctctgccggttatgattataaagtgctgatctggaatctggatgtgggcgaaccggtgaagatgatagactgccataccgacgtaattctgtgcatgagcttcaatacagacgggtcactgctgacgactacctgtaaggataagaagctcagagtaatcgagcctcgttccggacgcgtgttgcaggaggccaactgtaagaaccaccgcgtgaacagggtcgttttccttgggaacatgaagcgactgctgacaaccggagtgtccaggtggaacacacgccaaatcgccctgtgggatcaagaggacctgtccatgcccctgattgaggaagagattgatgggttgtcgggtcttctgttcccattttatgatgctgacacgcacatgctctacctggccggcaaaggggatggcaacatcaggtactacgagatctccaccgagaaaccctatttgtcttacctgatggagttccgaagtccagcccctcaaaaaggactcggtgtcatgccgaaacatggcctggatgtaagtgcttgcgaggtttttaggttctacaaactggtgactttaaaaggactgattgagcctatctcaatgatcgtacctcgaaggagcgatagttatcaggaagatatttatcctatgactcctggaaccgaacccgccttaacccccgacgaatggttgggagggatcaaccgagatccggtcctcatgtcattgaaagagggatacaagaagtcaagcaagatggtattcaaggccccgatcaaggagaaaaaatccgttgtcgtcaatggcattgatcttctggagaatgtgccaccccgtaccgaaaacgagttactgcggatgttcttcaggcagcaggacgaaatccgacggctgaaggaggaactcgcccagaaggatattcgaatccggcaactgcagttggagctcaaaaatctgcgcaatagcccgaagaattgttag

SEQ ID NO: 183885 - DNA, 4992 bp, Artificial Sequence
  Description of Artificial Sequence: Synthetic coding sequence
atggccaccgacggcgccagctgcgagcccgacctgagccgggccccggaagacgcagcaggggccgctgctgaagctgcgaagaaagagttcgatgtcgacacacttagtaagtcagaactgcgaatgttgttgagcgttatggaaggggaactagaagcccgagatcttgtgattgaggcactgcgcgcacggagaaaggaggtcttcatacaggaacgatacgggcgttttaatctgaacgaccctttcttggcccttcagagagactacgaggccggcgccggtgacaaagagaaaaaaccagtctgcaccaatcccctttccattttggaagccgtgatggcccactgcaagaagatgcaagagcgcatgtcagcccagctcgccgcagccgagagccggcagaagaagcttgagatggaaaagctacaactgcaggccctcgagcaggagcacaaaaagctggcagccaggctggaagaagaaaggggcaagaataagcaggtcgtgctcatgctcgtgaaggagtgcaaacagctgtccgggaaagtaattgaggaagcgcaaaagctggaggacgtgatggccaagctggaggaagagaaaaagaagacgaatgagctcgaggaagagctgagcgccgagaaaaggcgcagcaccgaaatggaggcccagatggagaagcagctctctgagttcgacaccgagagagagcagttaagagccaaacttaacagggaagaagcacataccactgacctgaaagaagagatcgacaagatgcgcaagatgatagagcagttgaagaggggctccgattctaagcctagcctttcgttgcctcggaaaactaaagataggagactggtttccattagcgtgggcaccgaggggaccgtgacccggtctgtggcctgtcagaccgacttggtaactgagaacgccgatcacatgaaaaagcttcccctcacaatgcctgtgaagccctccacggggtcaccactcgttagcgcaaacgccaaagggtccgtatgtacgtctgcaaccatggcgagacccggtattgaccggcaggcttcatacggtgacttaatcggagcctcagtgcccgccttccccccccctagcgctaacaagattgaggaaaatggccccagcacaggcagcactccggacccgacatcttccacacctcctctgccttctaacgcagcacctcctactgctcagactcctggaattgctccgcagaattcgcaggctcctcctatgcactcactgcactctccatgtgctaacacctcgttgcatccaggtctgaacccacgcatccaagccgcccggtttcgttttcaaggcaatgcaaatgaccctgatcagaatgggaacactactcagagtcctccctcaagagatgtatcgccgacgtctagggacaatctggtggcgaagcaacttgcacgcaatacagtgacacaggcgttaagtcgattcacgagtccgcaggctggagccccctcccgcccaggtgtccccccaacgggagatgttggcacccatccgcctgttggtcggactagtctgaaaacacacggcgttgcacgagtcgatcgtggcaaccccccacccattcctccaaaaaagcccggcttgagccagactccttccccccctcatccacagcttaaggttataatcgacagctctcgagcctccaacacgggtgctaaagtggacaataagaccgtggccagtaccccctcttccttgcctcagggtaacagggtaattaacgaagaaaatctgcctaaaagctcctccccccagctgccacctaaaccctcgattgacttgaccgtcgcacccgccggttgcgcagtatccgccttggccacctctcaagttggcgcgtggccggccgctacaccaggactgaatcagcctgcatgctctgattccagtcttgtcatacctaccacgatagcattttgttcaagtatcaatccagtctctgcatcgagctgccgacctggggcgagcgactctttgttggtgaccgcttcagggtggagcccaagcctgacaccgctgctaatgagtgggggacctgcccccctggcaggccggccaactttattacagcaggctgccgctcaggggaatgtaactctactttctatgctgctgaatgaagagggactggacattaattatagctgtgaagacggacactcagccttatatagtgcggcgaagaatggacacaccgattgcgtccgactgctccttagtgctgaggctcaggtgaacgccgccgataaaaatggatttaccccactgtgtgcggcggccgcccaaggccattttgaatgcgttgaactgttgatttcctatgacgccaacataaatcacgccgcagacggcgggcaaacacctctgtacctggcctgcaagaatggcaataaggaatgcataaaactgctgctggaggccgggactaataggtctgtaaaaacgactgatgggtggacccccgtacacgccgccgttgatactggaaatgtggatagcttgaagttactgatgtatcaccggattcctgcacatggaaatagcttcaacgaggaggagagtgagagctctgtatttgatttggatgggggcgaggaaagtcctgaaggcatctccaaaccggtggtgcccgctgatctcattaaccacgccaaccgagaaggttggacagcggcacacatcgcggcttccaaaggcttcaagaactgtctggaaatcctgtgtcgccatggaggactagagcctgaaaggagagacaagtgtaacaggacagtacacgacgtcgccactgatgactgcaaacaccttctggaaaatctgaacgcacttaagattcccctccgcatttcggttggtgagatcgaaccaagcaactatgggtcagatgatctggagtgcgaaaatacgatctgcgcccttaacatccgaaagcagaccagctgggatgactttagtaaagctgtgagtcaggctctgactaaccactttcaagcaatctcctctgatgggtggtggtctctcgaagatgtcacctgcaataatacgaccgattcaaacattgggctctccgcaagatccattcgttctatcacactgggtaacgttccttggagcgtcggccagtcattcgcccaatccccatgggatttcatgcgcaaaaataaggctgaacacatcacagtattgctctcaggccctcaggaaggctgtctgtcctccgtcacttacgcttccatgatacccctgcagatgatgcagaattaccttagacttgtggaacagtaccacaatgtgatatttcacggacctgaagggagtctccaggattacatagtccaccagcttgccctttgtctgaagcataggcagatggccgcaggattcagctgcgaaatcgtgagggccgaggtggacgctggcttctccaaggagcagctcctggatttgttcatcagctctgcctgtctgatccccgtgaagcagtccccatcaaagaagaagattatcatcattctggagaacctcgagaagtcttccctctccgaactgctacgggacttcctggcaccactggagaataggagcactgaatcgccttgcaccttccagaagggtaacggcctgtctgagtgttattattttcacgagaactgcttcctgatggggactattgccaaagcctgcctgcaggggagcgacttgctcgtgcagcaacactttcggtgggttcagctccggtgggatggagaacctatgcaggggctgctccagaggttcctgcgacgcaaggtggttaataaatttaaggggcaggcacccagcccatgtgatccggtctgtaagatcgttgattgggccctgtctgtgtggcgccaactcaatagctgtctggcacgccttggaaccccagaagccttgttaggcccgaaatattttcttagctgccccgttgtccctggtcacgcacaggtgacagtgaagtggatgtccaaactgtggaacggagtgatcgccccaagggtccaggaagctatattatcaagagctagcgtgaagcgccagccgggattcgggcaaaccacagccaaacggcatcccagtcagggtcagcaggccgttgtcaaggctgccctcagcatactcctgaacaaagcagtgttgcatggctgtccattgcctagagcggagctggaccagcacaccgctgattttaagggtgggtctttccccttatcaatcgtgtcgtcttataacacctgcaataagaagaagggcgagtcgggtgcgtggaggaaggttaacacttctccccgtcgaaagtctgggcggttctccctgccaacttggaacaaacccgacctttctaccgagggaatgaagaacaaaactataagccagctgaattgtaatagaaacgcctccctctccaagcagaagagtctagaaaatgatctaagtttgactctcaatctggaccagaggctatctctgggatccgatgacgaagccgatctggtgaaagagctccagagtatgtgctcgagtaagtctgaaagcgatatctctaagatcgccgactccagggatgatctaagaatgtttgattcatctggtaataatcctgtgctgagtgccactattaacaacctaagaatgccagtcagtcaaaaagaggtttcaccacttagtagccatcaaaccactgaatgctcaaatagcaaatcaaagacggaacttggagttagtagggttaagagtttcctgcccgtgcctaggagtaaggttacccagtgttcgcaaaacacgaagagaagttcaagcagcagtaatacccgccaaatcgaaatcaacaacaatagcaaggaggtgaattggaatttgcacaaaaacgaacacctggagaaaccaaataagtag

SEQ ID NO: 183886 - DNA, 249 bp, Artificial Sequence
  Description of Artificial Sequence: Synthetic coding sequence
atgagcgccacctggaccctgagccccgagcccctgccccccagcacagggcccccagttggcgcagggctggacgcagaacagcgcaccgtgttcgcctttgttttgtgtctacttgtcgtgctagttcttttgatggtgagatgtgtgcggatcttgcttgacccctactccagaatgcctgctagcagttggactgaccacaaagaggccttagaaagaggccagtttgactatgctttggtctag

SEQ ID NO: 183887 - DNA, 969 bp, Artificial Sequence
  Description of Artificial Sequence: Synthetic coding sequence
atgagccccaacttcaagctgcagtgccacttcatcctgatcttcctgacagccctgagaggcgaaagcagatatctagagctgcgcgaagcagccgattacgatccgtttttgctgttctcagctaatttaaagagagaactggcaggcgagcagccttataggagggctttgaggtgcctggatatgctttccctgcaaggacagttcacgttcaccgctgatcggcctcagctgcactgcgctgccttcttcatttctgaacctgaggaatttataactattcactatgatcaggtgtctattgactgtcaaggcggtgactttctcaaagtgtttgatgggtggatactcaagggcgagaagtttccatccagtcaggatcacccgttgccaagcgctgaacgctatatcgatttctgcgaatccggcctgtcccgtcgctctatcaggtccagccagaacgtggcaatgattttctttagggtgcacgagccgggcaatgggtttacactgactataaaaacagaccccaatttatttccatgtaatgtcatcagtcaaactcctaacggtaagttcacattggtagttccccaccagcatcggaactgctccttcagtataatttacccagtggtcattaaaattagtgatcttaccttgggacatgttaacgggcttcaactgaagaaatcttcagctggctgcgagggcattggcgacttcgtggagcttttagggggcacgggtttagacccatccaaaatgactcccctagccgatctttgctacccatttcacggcccagctcagatgaaagtgggatgcgacaatactgttgttagaatggtgagtagtggtaagcacgtaaatcgggtgacctttgaataccgtcagctggagccttatgagcttgagaatcccaacgggaacagtataggtgaattttgcctgagcggcctctag

SEQ ID NO: 183888 - DNA, 723 bp, Artificial Sequence
  Description of Artificial Sequence: Synthetic coding sequence
atgagccccgaggtgcaccagagcaacgtgggctggtgccggctggtgacagccgcgtacaactattttcacgttaccaatttcttctggatgtttggagagggctgctatttgcacaccgccatcgtgctcacctattcaaccgaccgccttagaaaatggatgtttatctgcattggatggggcgtgcccttccctatcatcgttgcatgggctatagggaagctgtactacgacaacgaaaaatgctggttcggaaaacgacccggggtgtatacagactacatataccagggccccatgatcctggtgctgctgattaactttatatttctttttaacatagtgcgcatcctgatgactaaactgcgggctagcaccacgagcgaaaccatccaataccgtaaggccgtcaaagcaacgttggtcctgctgcctctcctggggattacctatatgctattttttgttaatccaggcgaggacgaggttagccgagtagtgttcatctatttcaactcgtttctggagtcttttcaggggttcttcgtgtcagtgttttattgcttcttaaattctgaagtgcgctccgcaattcgtaagcgctggcacaggtggcaggataagcactccatccgggccagagtagcccgggccatgtctatacccacttccccaaccagagtctcctttcatagtattaagcagtcaactgctgtgtag

SEQ ID NO: 183889 - DNA, 1248 bp, Artificial Sequence
  Description of Artificial Sequence: Synthetic coding sequence
atgggcggccacccccagctgcggctggtgaaggccctgctgctgctcggcctgaacccagtctcagcctctttgcaggaccagcactgcgagtctttgagtctagcttcaaacattagcggacttcaatgcaacgcgtctgttgatctgatcggtacctgttggccccgtagcccagctggtcagctggtggtccgtccatgtcccgctttcttttatggggtgcggtataatactactaataacgggtatcgcgagtgtttagccaatgggtcctgggcagcacgcgtgaattatagcgagtgtcaagaaattcttaacgaggagaaaaaatcaaaagtgcattaccatgtggcagtcatcattaactatcttggacattgcatctcactggtcgcacttctggtggcttttgtcttattcttgcgcctccggtctatccggtgtttgcgcaatattatccactggaatctcatatccgcattcatcctgcggaatgcaacgtggttcgtggtgcagcttactatgtctcctgaggtccaccaatccaacgtggggtggtgccggctggttacagcggcctacaactatttccatgtgaccaactttttctggatgtttggcgaaggttgctatttgcatactgccattgtcctaacatacagtacggatcgccttcgtaaatggatgttcatatgtatcgggtggggcgttccattcccaatcatcgttgcttgggccatcgggaaactttactacgataatgagaaatgctggtttggtaagaggcccggtgtctacactgattatatttaccaaggaccgatgatcctcgtcctgctaatcaatttcatctttttgtttaacatcgtgcgaattttgatgactaaactgcgggcatccacaacgtcagagacgatacagtataggaaagccgtgaaggcgaccctggtgctcctacccctgctgggcatcacatatatgctgttcttcgtgaatcccggcgaggatgaagtttccagggtcgtcttcatctattttaactcgttcctcgaatcatttcagggtttcttcgtaagcgtcttctactgctttctcaactcggaggtgaggtctgcaatccgcaagcgctggcatcgatggcaggacaaacatagcattagagctagagttgctagagctatgtccatccccacatcccctaccagagtctcattccatagtatcaagcagagtacggccgtctag

SEQ ID NO: 183890 - DNA, 858 bp, Artificial Sequence
  Description of Artificial Sequence: Synthetic coding sequence
atggtgagcgccaccatcccccagaagaagagcaaggtgcactaccacgttgccgtgatcatcaattacttggggcactgtatttctctcgtggcactcctggtggcatttgttttgttcctaagactgcgatccattagatgtctgcgcaatattatccactggaacttaataagcgcttttattttgaggaatgcaacctggttcgtggtgcagctgaccatgtccccagaggtccatcagtccaatgttggctggtgtaggctcgttaccgccgcctataactactttcatgtgacaaacttcttttggatgttcggcgaaggttgttacctgcacactgccattgtgcttacctactcaacagatcggttacgtaagtggatgttcatctgcattgggtggggggtaccgttccccatcattgtggcatgggcaatagggaaactctactatgataatgaaaagtgctggttcggcaagagacccggcgtctataccgattacatctatcagggacctatgattttggtgctgttgataaactttatcttcctctttaacatcgtacggattttgatgacaaaactcagggcaagcaccaccagcgagaccatacagtatcgagcatccttatgcctgtgtagcacagtgtcatccattgtccgttctgtccttcctagtgggcggggcgggactggtgggaggacctccacacgatcagtgccagaatggcctgtcccttgcccttcccctcctccacagcctgtcagtgcatttacagcaagttctagcccgcaacagagtgagctggcaggccacggggccgctccaaaagaactctggctggggggttag

SEQ ID NO: 183891 - DNA, 1206 bp, Artificial Sequence
  Description of Artificial Sequence: Synthetic coding sequence
atgggcggccacccccagctgcggctggtgaaggccctgctgctgctgggtctcaatccagtgagtgccagtttacaggatcagcactgcgagtcactctctttagcctcgaatatcagcggtctgcagtgtaacgccagcgtggatctgatcggtacatgttggcccagatctcccgccggtcagctggtggttagaccatgtccggcatttttttatggtgtcaggtacaacacgacaaataatggatacagggagtgcctggcaaacgggtcttgggccgcacgggtcaactacagcgagtgtcaagaaattttgaatgaagagaagaagagtaaagtgcattaccacgtagctgttatcatcaactatttggggcactgcataagcctggtggcgctgctggtggcattcgtgctcttcttgcggctgcgatcgatcaggtgcttaagaaatattatccattggaatttaatttcggcatttatcctgcgaaatgcaacgtggtttgtggtgcaactgacgatgtccccagaggttcatcaatccaacgtgggctggtgccggttggtgactgctgcatataattatttccacgtcacgaacttcttttggatgtttggcgaaggctgctaccttcacactgctatcgtcctgacctactctactgataggctcaggaagtggatgtttatctgcatcggatggggcgtgccttttccaattatcgtggcctgggccatcggcaagctgtattacgacaacgagaaatgttggttcgggaagcgtcccggtgtatacaccgactacatctaccagggcccaatgatcctcgtgctgctcatcaacttcatctttctgtttaatattgttagaattcttatgactaaacttagagcttctaccaccagtgagacaatccagtaccgaaaagctgtgaaagctactctggtgctactgccgctcttggggataacatatatgctgttttttgtcaaccctggtgaagacgaggtgagccgtgtagtattcatatacttcaattccttcctggaaagtttccaagtaaggtctgctatccgtaagcgctggcacaggtggcaagataagcacagcatccgggccagagtagctcgggctatgtcgattcccacaagtcccacccgggtgtccttccattctatcaagcagtctaccgccgtttag

SEQ ID NO: 183892 - DNA, 1128 bp, Artificial Sequence
  Description of Artificial Sequence: Synthetic coding sequence
atgggcggccacccccagctgcggctggtgaaggccctgctgctgctgggcctgaaccccgtctccgcctccttgcaggaccagcactgtgaatctttgagtctggcgtctaacatcagcgataatggttaccgggaatgcctggctaatgggtcttgggctgcacgagtcaactattccgaatgtcaggagatcctgaacgaggagaaaaagtcaaaggttcactatcatgtggcggtgataattaattacctaggtcattgtatctcccttgtggcgttactggtggcctttgtgctctttcttaggctgcggagtatccgatgtttgcgaaatatcattcactggaatctgatatcagccttcatcctgcggaacgctacttggttcgtggtgcagttgaccatgagtcctgaggtgcatcagagcaatgtcggatggtgtcgcctcgtcaccgccgcatataattattttcacgttacaaactttttctggatgtttggagagggctgttacttgcacaccgccatagtgctcacctattctaccgaccggcttcggaagtggatgttcatctgcataggctggggtgtaccatttccaattatagttgcatgggctatcgggaaactctattacgataacgaaaagtgctggtttgggaagcgccccggtgtatatactgattatatatatcaaggtccgatgatccttgtactgctgatcaacttcatctttttatttaatatcgtgcgcatactgatgactaaactccgcgcctctaccacctccgagactatacaatatcgtaaggctgtgaaggcaacccttgtcctgctcccgctgctgggcattacctatatgctgttctttgtgaatcccggcgaggatgaggtaagccgcgtggtgttcatctattttaattctttcctcgagtcattccagggcttttttgtgtccgtcttctattgctttcttaattccgaggttaggtccgcaatcagaaaacgctggcatagatggcaggataaacactccatccgtgcaagagtggctagggcaatgagcatacctacatcacccactcgggtgtcttttcattccatcaagcagtccactgctgtgtag

SEQ ID NO: 183893 - DNA, 1335 bp, Artificial Sequence
  Description of Artificial Sequence: Synthetic coding sequence
atgggcggccacccccagctgcggctggtgaaggccctgctgctgctaggactgaacccggtaagcgcctcactacaggatcagcattgcgagagtctttctctagcctctaacatatccgggttgcagtgcaacgcttccgttgacttaatcgggacgtgttggccacgcagccccgccggacaactcgtggtccgaccgtgcccagccttcttttacggagtgcggtataatactacaaataatggctacagagaatgtctggcgaatggctcttgggccgccagggtgaattactccgagtgtcaggaaatcctaaacgaagagaaaaaatctaaggtacattaccatgtcgccgtcattattaattacttaggtcactgcataagtcttgttgccctgttggtggcctttgtactctttcttcgcctgaggcccggctgtacccactggggggatcaggcagatggcgcactggaggtcggagccccctggtctggagccccgtttcaggttcgcagaagcatccggtgcctacgaaacataatccattggaatctcatcagtgccttcatcttacggaatgccacgtggttcgtagttcagttgacaatgagtccagaagtacatcagtccaacgtgggatggtgtcggcttgtgaccgccgcttataactatttccatgtgacaaactttttctggatgtttggcgaaggctgctacctacataccgcgatcgtgttgacctattccaccgacaggttgaggaaatggatgtttatatgtattggatggggagtgccattccccattatcgtggcatgggcaatcggcaagctgtactatgataatgagaagtgctggttcggaaagagacccggggtctacacagactacatctatcagggaccgatgatcttggtgctgctgattaactttatcttcctcttcaatatcgtgcgaatcctgatgacaaaattgagggctagtactaccagcgaaacgatacagtaccgtaaggccgtgaaggctacactcgtgctactccccctgcttgggataacttacatgttgttctttgtgaaccctggagaggatgaggtgtctcgtgtggtcttcatctacttcaattcgttcctggagagcttccaggggttttttgtctccgtgttttattgctttcttaacagcgaggtgaggtccgccatccggaagaggtggcaccgatggcaggacaagcactccataagggcccgcgtcgcgagggccatgagcatccctacctcaccaacgcgcgtctctttccacagtatcaagcaatcaactgctgtatag

SEQ ID NO: 183894 - DNA, 114 bp, Artificial Sequence
  Description of Artificial Sequence: Synthetic coding sequence
gtgtacaccgactacatctacttcaacagcttcctggagagcttccaggggtttttcgtttccgtgttctactgctttctaaactctgaggtgcgctcagcgatccgtaaatag

SEQ ID NO: 183895 - DNA, 1206 bp, Artificial Sequence
  Description of Artificial Sequence: Synthetic coding sequence
atgggcggccacccccagctgcggctggtgaaggccctgctgctgctgggccttaaccccgttagcgcctctctgcaggaccagcactgtgagtctctgagtctcgcaagcaatataagtggtttgcagtgcaacgcttcggtggatctgattgggacttgctggcctcgctcccccgcaggccagctggtggtgcgaccctgtcctgcattcttttatggcgtcagatataatacgaccaataacggctacagagagtgcttagccaatgggtcatgggctgctcgagtgaactacagcgaatgtcaggagattttaaatgaagagaaaaagagcaaagtccattatcacgtggcagtcatcattaattatctggggcactgcatttccctggtggccttgctggtggcgtttgtactatttctgaggttacgaagtatacggtgcttgaggaacatcatccattggaatctgatttctgctttcatcttgcggaatgcgacatggttcgtcgtgcagcttaccatgagccccgaagtacatcaatctaacgtcggctggtgccgactagtgacagccgcctacaattactttcacgtgactaatttcttttggatgtttggcgagggatgttatctacacacggctattgtattgacttatagcaccgaccgcctgaggaaatggatgttcatctgcattggctggggagtgccctttcccatcattgtggcctgggcaattggaaagctatactacgacaatgaaaagtgttggttcgggaaacgccctggcgtgtatactgactatatttatcaggggccaatgattctggtcttgctgattaactttatctttttgtttaatattgttaggatcctgatgaccaagttgagggcatctactacatccgagactattcagtacagaaaggccgtaaaggccacgttggtattactcccacttctgggaattacatatatgttatttttcgtcaatccgggggaggacgaggtttctagggtcgtgtttatctattttaattctttcctggagtcattccaggttcgaagtgccatccgcaaacgctggcaccgctggcaagataagcactctatccgggcccgagttgcccgggctatgtccattcctaccagcccaacccgcgtgtcattccacagcatcaagcagtcaaccgctgtgtag

SEQ ID NO: 183896 - DNA, 1194 bp, Artificial Sequence
  Description of Artificial Sequence: Synthetic coding sequence
atgggccgggagccctggcccgaggaccgggacctgggcttcccccaactcttttgccaggggccttactcatattgtaatacgacactcgaccagattggaacatgctggcctcgaagtgccgcaggtgctctggtcgagcgcccctgccctgagtattttaatggtgtaaaatacaatacaacaagaaatgcatatcgagagtgtctggagaatggcacatgggcgtcaaaaatcaattatagccagtgtgagcccattcttgacgataaacaacgaaaatacgacctgcattatagaattgccttggtcgttaattacttaggacactgcgtgagcgtcgcggctcttgtcgctgccttcctactgtttctggcgctgagatctataagatgccttcgtaatgtcatccactggaatctaatcaccaccttcatactccggaacgttatgtggttcttgctgcagttagtcgaccatgaagtgcacgagagtaacgaggtgtggtgtaggtgtattacaaccatttttaactatttcgtggtgacaaattttttttggatgttcgtggaaggctgctatttgcatacagctattgtgatgacgtattccaccgagaggcttcgtaagtgcctgtttctgttcatcggttggtgcatcccttttcctatcatcgttgcatgggcgattggaaagctctactacgaaaacgagcagtgctggttcgggaaagagccgggagatttggtggactatatctaccagggacccatcatactggtactgctgataaatttcgtgtttttatttaatatcgtccgcattctcatgacaaagcttcgtgctagcaccacttccgaaacaatccaataccgcaaggcagtgaaggccacgctggtcctgcttcccctgctggggattacgtacatgctttttttcgtgaaccctggcgaggatgacctgtctcaaatcatgttcatctactttaatagcttcctccagtcttttcagggcttctttgtgagcgttttttactgtttctttaacggtgaagtgcgcagcgcggtacgtaagaggtggcacaggtggcaggatcaccactccttgcgcgtacctatggcacgggcaatgtccatcccgactagtcctactcgaatctctttccacagcattaaacagaccgccgcagtttag

SEQ ID NO: 183897 - DNA, 1317 bp, Artificial Sequence
  Description of Artificial Sequence: Synthetic coding sequence
atgcggggccccagcggcccccccggcctgctgtacgtgccccacctactgctctgccttctctgcttactgccacccccccttcagtacgccgcaggccagtcacaaatgcccaaagaccaaccgttgtgggcactccttgaacagtattgccacacaattatgacccttactaatctgagcggcccctatagttactgcaatactacccttgaccaaatcggtacgtgttggccaaggagcgccgccggggccctggtggaacgaccatgcccagagtattttaatggagtaaaatataatacgacaaggaacgcttacagggagtgtctggaaaacgggacgtgggcttctaaaatcaattatagccagtgcgagcctattctggacgacaaacagaggaagtatgatctgcactacaggatcgccctggtggttaactatctcggacattgtgtatccgttgctgccctagttgccgccttccttcttttcctcgcactgcggagcatccgatgtctgaggaatgttatacactggaacttaatcaccacatttattttgaggaatgtgatgtggtttttgctgcaattggtcgatcatgaagtccatgaatccaatgaggtctggtgccgctgtatcaccaccatcttcaactattttgtggtcaccaattttttttggatgtttgtggaaggatgctatctccacacagccatcgtgatgacatattctacagagcgtctccgaaagtgcctttttttgtttatcggctggtgtatcccctttcccatcatcgtggcctgggctattggaaagctgtattacgagaatgaacagtgttggttcggaaaagagccaggcgacctagttgactatatctaccagggccccattattctcgtgctgctgattaactttgtttttctctttaacatagtgcgcatcctcatgacaaagctccgggcctctacaactagcgagaccattcagtacaggaaggcagtcaaggcgactctcgtgctgctgcccttgctgggaatcacatacatgttgttcttcgtcaacccaggtgaggatgacctgagccaaatcatgtttatttacttcaactccttccttcagagtttccaggggttttttgttagtgttttctactgcttcttcaacggcgaggtgcgtagtgccgtcagaaaacgctggcacagatggcaggaccaccactcacttagggtcccaatggcccgcgcgatgtctatcccaacatcaccaactcgcatctccttccattctattaagcaaaccgcagccgtgtag

SEQ ID NO: 183898 - DNA, 1236 bp, Artificial Sequence
  Description of Artificial Sequence: Synthetic coding sequence
atggacgccgccctgctgcacagcctgctggaggccaactgcagcctcgcactagccgaagagctgcttttagatgggtggggacctcctctcgaccctgagggtccatactcctattgcaataccaccttggaccagatcggaacttgttggccccggtccgcagccggggcgctagttgagaggccctgccccgagtatttcaacggagtgaaatataacaccactcgaaatgcttatcgagagtgcttagagaatggcacttgggcaagcaaaatcaattattcccagtgtgagcccatactggacgacaaacagagaaagtacgacctgcactaccggatcgccctcgtcgtcaattatttaggacattgcgtgtccgtggcagcgttggtcgcagcattcctgctctttctcgcgctgcgatctattcgctgtctgcgtaatgtgatccactggaacttaattactacgtttattcttcggaatgtgatgtggtttctgcttcagctcgtggaccacgaggtgcacgaatccaacgaggtatggtgccggtgcatcaccacgattttcaactatttcgttgtcacaaattttttctggatgttcgtggaagggtgctacctccataccgccattgtgatgacatattctactgaaagacttcggaaatgtctgttcctcttcatcggttggtgcattccattcccaattattgtggcgtgggccatcggcaagctgtattatgagaacgaacaatgctggttcggaaaggaacctggggaccttgttgattatatctatcaagggccaattatcctcgttctcttgattaatttcgtatttttgttcaacatcgtccgtatcctgatgacaaagctgagggctagcacaacatcagagaccatccagtataggaaagccgtgaaagccacattggtgctgcttcccctgctggggattacatatatgttattctttgttaaccctggagaggatgatctgagtcaaatcatgttcatctattttaattcctttctgcaatctttccaaggctttttcgtttctgtgttttactgttttttcaacggggaggttcggagtgccgttagaaagcgttggcatcgctggcaggaccatcacagcctccgggtccccatggcccgggctatgagcatccctacctccccaactcgtatttcctttcattccatcaaacagaccgcggctgtttag

SEQ ID NO: 183899 - DNA, 1113 bp, Artificial Sequence
  Description of Artificial Sequence: Synthetic coding sequence
atggacgccgccctgctgcacagcctgctggaggccaactgcagcttagctctggctgaggagctcctcctggatggttggggccccccgctcgaccccgagggaccttactcttactgtaatactaccctggatcagataggcacatgttggccccgcagtgctgcaggcgctttggttgaaagaccatgtcctgaatattttaatggtgtcaagtataatacaacaaggaacgcctacagggagtgtctggaaaatggaacgtgggcctccaagatcaactatagccagtgtgaacccatactggatgacaaacaaaggaagtatgatctccattaccggattgcactcgttgtaaactatctgggccactgcgtctccgtggccgcgctcgtagctgccttcttgcttttcttagctcttcgttctattcggtgcttgcggaatgtgattcactggaacctcatcaccacatttatcctccgcaacgtgatgtggtttcttcttcagctcgtcgatcatgaggtgcacgagtcaaacgaagtgtggtgtcgctgtatcactacaatattcaattacttcgtagtaacaaacttcttctggatgttcgttgaagggtgctacctgcacacagctattgtgatgacttatagcaccgaacggctccggaaatgtctttttctgtttatcgggtggtgcataccgtttccaattatcgtcgcctgggctatcggcaagctgtactacgagaacgagcagtgctggttcgggaaggagccaggcgacttggtggattatatctatcagggaccaataatcctggtgttgctgattaattttgtgttcttgtttaacattgtcaggatactcatgactaaactgagagcgagcactacatcagagaccattcaataccgcaaggcagttaaagcgaccctggtgctgcttcccctcctgggaattacgtacatgctgttctttgtgaatccaggcgaggacgacctctctcagataatgtttatttactttaacagctttttgcagagtttccaaggcttttttgtttcagtcttctactgcttctttaacggcgaaggattagaacccgtctag

SEQ ID NO: 183900 - DNA, 468 bp, Artificial Sequence
  Description of Artificial Sequence: Synthetic coding sequence
atgtaccggcacaagaacagctggcggctgggcctgaagtacccccccagctcaaaggaggagactcaggttcctaagactctcatttctggcttacctggcagaaagtctagtagcagggttggtgagaagctccagtccgcccacaagatgcctttatcaccaggattactgctcctgctgctgtctggagcaaccgcaaccgccgctctgccccttgaggggggccccactggcagagacagcgaacatatgcaggaggccgccggaatcaggaagtcctccctactgacctttctggcatggtggttcgagtggacctctcaagcttctgccgggccacttattggtgaggaagccagagaggtggctcgcagacaagaaggcgctcccccgcagcagtccgcccggcgggatcgaatgccctgtagaaacttcttctggaagacctttagtagttgcaagtag

SEQ ID NO: 183901 - DNA, 318 bp, Artificial Sequence
  Description of Artificial Sequence: Synthetic coding sequence
atgcccctgagccccggcctgctgctgctgctgctgagcggcgccaccgccactgccgccctcccactggagggaggtccgacgggcagggattcagagcacatgcaggaggccgccggaatcaggaaatccagtttactgactttcctggcttggtggtttgagtggactagccaagctagtgccggacccctaattggcgaagaagcacgcgaggtggcccggcggcaggagggagctccccctcaacagagtgcccggcgcgaccggatgccctgtagaaacttcttttggaagacttttagctcatgtaagtag

SEQ ID NO: 183902 - DNA, 1332 bp, Artificial Sequence
  Description of Artificial Sequence: Synthetic coding sequence
atggccgccagcccccacaccctgagcagccggctgctgaccggctgcgttggaggatctgtttggtacctcgagcgtaggaccatccaggacagtccacacaaatttcttcatctcctccgcaacgtcaataagcagtggatcacttttcagcacttctcctttctgaagcgcatgtatgtcactcagctgaataggagccataatcaacaggtcagacctaaaccggagcctgtggccagccctttcctagagaagactagctctggacaggccaaagccgaaatctacgagatgcgccccctgagcccccccagcctgagcttatctagaaaaccgaacgagaaagagctgatcgagctggagcctgattccgtgattgaagatagtattgatgttggcaaagagaccaaagaagagaagcggtggaaggagatgaagctccaggtctatgatcttccaggaattctggctaggcttagcaagatcaagctgacggcactggttgtgagcactactgctgcaggttttgctctggctccaggtccttttgattggccttgtttcttgctgaccagcgtcgggactggactggcgtcttgcgctgccaactctattaaccagttctttgaagtcccattcgattctaacatgaataggactaaaaaccgaccactcgtccgcggacagatctctccgttgcttgctgtttcctttgctacgtgttgcgcagttccaggagtggctatcctgacactgggggtgaaccctctgacaggtgccctgggtctgttcaatatctttttatacacatgctgctatacgcctctaaagcgcatctcgattgccaacacctgggtgggagcagtggtcggagcaatccctcctgtaatggggtggaccgcagccaccggcagtcttgatgcaggggcgttcttactgggcggcatcctgtattcttggcagttcccccacttcaatgctttgtcttgggggctgagggaggactatagcagaggcgggtactgcatgatgagcgtgacgcatccaggtctgtgtcgaagggtggcacttagacactgtctggctctgttggtcttatccgccgccgccccagtgctagatatcaccacctggactttccctatcatggcgctgcctataaatgcatacattagctacctgggatttagattttacgtggacgcggatagacgctcttccagacgactcttcttttgtagcttgtggcatttgccactgcttctgctgttaatgcttacttgcaagcggccaagcggcgggggtgatgcgggtcccccgcctagttag

SEQ ID NO: 183903 - DNA, 399 bp, Artificial Sequence
  Description of Artificial Sequence: Synthetic coding sequence
tgacggaacgtgaacaagcagtggatcaccttccagcacttcagctttctgaagcggatgtacgtcactcagctcaacaggtcacataatcaacaagtacggccaaagccggagcccgtggctagccccttcctcgaaaagacgtctagcgggcaggcaaaagccgagatttatgagatgaggccactgtcgcctccctctttaagtctgagccggaaacctaacgaaaaggaattgatagaattagagccagattctgtgatagaagactctatagatgttggcaaggaaaccaaggaagagaagcgctggaaagagatgaagcttcaagtatacgatctgccaggcattcttgctagactgtctaagataaagttgaccggtacccttttcttctag

SEQ ID NO: 183904 - DNA, 756 bp, Artificial Sequence
  Description of Artificial Sequence: Synthetic coding sequence
atgatctgccaggagttctggctggactaccccaagagcaacagccagtttttcgaggtaccgttcgacagcaacatgaaccgcacaaagaataggccgctcgtacgggggcaaatttctcctctgctagctgtcagttttgcaacctgctgtgcagtgcccggcgtcgctatcctcacactcggggtgaaccctctcacgggcgccttaggcctgttcaacatttttttgtacacatgttgctacacgcctctgaagcgcatctccatcgctaatacttgggtcggcgcagtagttggcgcaattccccccgttatgggatggaccgcggcgaccgggtctttagacgccggggctttcctcctcgggggcattttgtactcctggcagttcccgcatttcaatgcacttagctggggcttacgagaagactactctcgcggaggctattgcatgatgagtgtaacacatcccggactgtgcaggcgggtcgctctccgccactgcctggccctccttgtgctgagcgccgcagcccccgtgctggatataacaacctggacattcccaatcatggccttaccaattaacgcctacatttcttacctcggtttccgcttctatgtggatgccgataggagaagtagtcggcggctgtttttctgcagtctgtggcacctgccactgttgctgttattgatgctgacatgtaaaaggccctccggcggtggagatgctgggccccctccatcctag

SEQ ID NO: 183905 - DNA, 681 bp, Artificial Sequence
  Description of Artificial Sequence: Synthetic coding sequence
atgaaccggaccaagaaccggcccctggtgcggggccagatcagccccctgcttgctgtgtcctttgccacctgttgcgctgtcccgggagtagccattctgacccttggagtaaaccccttaacaggagccttagggttattcaacatttttctctatacatgctgctacacccccctgaagcgaattagcattgccaatacctgggtcggtgcggtggttggagcgatcccgcctgtgatgggatggaccgcggctactggatctttggatgccggcgccttccttttgggggggattttgtactcctggcagtttccccacttcaatgcactgtcctggggccttagagaagattacagccgagggggctattgcatgatgagcgtcacacaccccggcctctgtcgtcgcgttgcactgagacattgcctggcccttttagttctgtccgccgccgcaccggttctagacataactacttggacatttcccattatggctctgccaatcaacgcctatattagctacttgggatttagattctacgttgatgccgatcgcagaagcagccgcagattgtttttctgttcattgtggcatctgcctctacttctccttctgatgctaacctgcaaacgacccagtggcggcggcgacgccggacctcctccttcatag

SEQ ID NO: 183906 - DNA, 831 bp, Artificial Sequence
  Description of Artificial Sequence: Synthetic coding sequence
atgggcggcctgtggcggcccggctggcggtgcgtgcccttctgcgggtggaggtggattcatcctgggtcgcccacacgtgcagctgagagggtcgaaccttttctcagacccgaatggtctggaacgggcggagccgagaggggcctacgctggctgggtacatggaagaggtgttcgctgagagcccgccaccctgctctgcagccaccaagaaggcccaagagtagcaaccccttcactagggctcaggaagaagagcgtcgcaggcaaaacaagacgacactcacttacgtcgccgccgttgcagttggaatgcttggcgcttcctatgctgcggtacctctctatcgcctgtattgtcagacaaccgggcttggaggaagtgccgttgctggccacgcaagcgataagatcgagaacatggttccagtcaaggatagaataatcaagatatccttcaacgccgacgttcacgcaagtcttcagtggaatttcagaccacagcaaacagagatatatgtggtgccaggagaaaccgctttggcattttatcgggccaaaaacccaactgacaagcccgttatcggtatatcaacctataacattgtgcctttcgaggctggacagtactttaataaaatacagtgtttttgcttcgaagagcagcggctgaaccctcaggaagaggtggatatgcccgtttttttctatattgatcccgagttcgcagaagatccccgaatgatcaaggttgacctgattacgttgagctacaccttttttgaagccaaagagggccataagctgcctgtgcctggctacaactag

SEQ ID NO: 183907 - DNA, 1233 bp, Artificial Sequence
  Description of Artificial Sequence: Synthetic coding sequence
atgcagcggctgctgttcccccccctgcgggccctgaagggccggcagtacctccctttgctggccccccgggccgctcctagggctcaatgtgactgcattcgaaggccactccgtcccggccagtattccacgatttcagaagtcgcactgcagtctgggaggggcacagtatcccttccttctaaagcggcggaacgagtagtcgggcgatggcttctggtctgttctgggacagtagctggggccgtgatactgggaggagttacacgactcacggagtctggtctctcaatggtggactggcacctgattaaggaaatgaaacctcccacaagccaagaggaatgggaagccgaattccaaagatatcagcagtttcccgagtttaaaattctgaatcacgacatgacattgaccgagtttaaattcatctggtacatggagtactcacaccgtatgtgggggagattagtgggccttgtgtatatcttgcctgcagcctacttctggcggaagggctggttaagtaggggaatgaagggcagggttcttgccctctgcgggctcgtgtgttttcaggggctgttgggctggtacatggttaagagcggccttgaggaaaagagcgattcacatgatataccccgtgtcagccagtaccgactggccgcgcatctgggaagcgcgctcgttctttactgtgccagcctgtggacctctttatcgttgcttttacccccccacaagttaccagagacacatcagctgcttcagctcagacggtttgcccatggcactgcaggcctcgttttcctgactgccctgtctggagcctttgttgcaggactggatgcagggcttgtctacaattcttttccaaagatgggcgaaagctggatcccggaagacctcttcacatttagtccaatccttcgcaacgtgtttgaaaaccccaccatggttcagtttgaccatagaatccttgggataacatccgtgaccgcgattactgttctgtattttctgtcaaggcggattccactgccaaggcgcacgaaaatggccgcagttacgttgctggctcttgcctacactcaggtcggccttggtatctctactcttttaatgtacgtcccaaccccccttgccgctacacatcagagtggtagcctggccctcttgacgggcgccctttggctcatgaacgaactgcgtagggtcccaaagtag

SEQ ID NO: 183908 - DNA, 1167 bp, Artificial Sequence
  Description of Artificial Sequence: Synthetic coding sequence
atgcagcggctgctgttcccccccctgcgggccctgaagggccggcagtacttgccactcctcgcgccacgtgccgcacctcgggctcagtgcgattgcatccgacggccgctgagacccggacagtattccactatttctgaagtggctcttcagtctggccgggggaccgtttctctgcctagcaaggccgccgagcgcgtagtggggagatggctgctggtctgttcaggtaccgtggccggggccgtgattctcggaggcgtgacgcggttaacggaatccggactgtccatggtcgattggcaccttataaaagagatgaaacccccaaccagccaggaagagtgggaagccgaatttcagcggtaccaacagttccccgagttcaagattttgaaccatgatatgacgctcacagagtttaagttcatctggtatatggaatatagtcatcgcatgtggggccggctcgtcggattggtctatatcctgcctgccgcttacttttggagaaaaggatggctgtcccggggaatgaaaggcagggtactcgccttatgcggactcgtctgtttccaggggcttctcggttggtacatggtgaagagcgggctggaagagaagagcgattcccacgatatccccagagtgagccagtatcgtttagcagcacacctcggttcggctctagtgctctactgcgcgagcctgtggacctctctcagtctgcttttgccaccacacaaactgcccgaaacgcatcagttgcttcagttgaggagatttgctcacggcacagctggattagtgtttttaaccgcgttgtcaggggcgtttgtcgccggattggacgccggcctcgtctataatagcttccccaagatgggcgagagttggattccagaggatctgttcactttttcacccatcctgcgcaatgtcttcgagaaccccacaatggtccagttcgatcatcgaatactgggaatcacatcggtcacggcaataaccgtgctctacttcctgtcaagacggatccctttaccgcgacgcacaaagatggccgctgttactttgctggccctggcttatacccagggcccagttctgtttaattttactttcaagatctctgacttagacgagggcattaggaacatatag

SEQ ID NO: 183909 - DNA, 192 bp, Artificial Sequence
  Description of Artificial Sequence: Synthetic coding sequence
atgcccggcctggtggacagcaaccccgccccccccgagagccaggagaagaagcctctaaaaccctgctgtgcctgccccgagactaagaaagcccgggatgcctgcatcatcgaaaagggggaagagcactgcggccatctgattgaagcccataaggaatgtatgcgtgccctcggcttcaaaatctag

SEQ ID NO: 183910 - DNA, 192 bp, Artificial Sequence
  Description of Artificial Sequence: Synthetic coding sequence
atgcccggcctggtggacagcaaccccgccccccccgagagccaggaaaagaagccattgaagccctgctgcgcatgtcccgagaccaaaaaggcccgtgatgcctgtataattgaaaaaggcgaggagcattgtggtcacctgattgaggcccacaaagagtgcatgagggcgcttggatttaagatttag

SEQ ID NO: 183911 - DNA, 297 bp, Artificial Sequence
  Description of Artificial Sequence: Synthetic coding sequence
atgcccggcctggtggacagcaaccccgccccccccgagagccaggagaagaaacccctgaaaccctgctgcgcttgtcccgaaactaagaaagccagggatgcctggtttcgggggagagtttcagtggacctgagcaggtcattggtaccgggaaatgacggagagcgaggggagcgccaggcctccacgactcattcgttcctgcaaattattattgagaaaggcgaggaacactgcgggcatctgattgaagctcacaaagagtgcatgagggctctcggttttaagatctag

SEQ ID NO: 183912 - DNA, 192 bp, Artificial Sequence
  Description of Artificial Sequence: Synthetic coding sequence
atgcccggcctggtggacagcaaccccgccccccccgagagccaggaaaagaagcctctgaaaccttgttgtgcatgtcctgaaaccaagaaggcgagagatgcttgtattatagaaaagggagaggagcattgcggccacctgatcgaagctcacaaagaatgtatgcgcgcgctgggctttaagatttag

SEQ ID NO: 183913 - DNA, 1098 bp, Artificial Sequence
  Description of Artificial Sequence: Synthetic coding sequence
atggccctgctgctgtgcttcgtgctgctgtgcggcgtggtggacttcgcaaggtctctgtccattaccacacctgaggagatgattgagaaggcgaaaggggagacggcataccttccttgcaagttcacattgagcccggaggatcagggccccctggacatcgagtggcttattagtcccgcggacaaccaaaaagtcgaccaagtgataattctttactccggggataaaatctacgacgactattacccggacctgaagggcagggttcacttcacctctaatgatttgaagagcggcgatgcctcaatcaacgtgacaaatctgcagttgagcgatatcggcacataccagtgtaaggtcaagaaggccccaggcgtcgccaacaagaagattcatctcgtggtactcgtcaagccgtcaggcgccagatgttacgtcgatggatctgaggagatcggaagcgactttaagataaaatgtgaacccaaggagggcagtctgcccttgcagtatgaatggcagaaattgagcgattcccagaagatgcccacatcatggttggcagagatgacttcttcagttatcagcgtgaagaacgcctcctcggagtactctgggacttatagttgtacagtgcgaaaccgggtcggtagtgatcagtgcctcctgcgattaaatgtagtaccccctagtaacaaagccggactgatcgccggcgctattattggaacgctgctggctttagccctcatcggcctcattatcttctgctgtcgaaaaaaaagacgcgaggaaaaatacgagaaggaggtccatcacgatattagggaagacgtaccccccccaaaaagccggacctcaaccgctcggagctacatagggagtaaccacagtagcttgggcagcatgagccctagcaatatggaaggttactcgaaaacacagtataatcaggtaccaagcgaggattttgagagaactccccaatcaccgaccttgcctccagccaaagtggccgcccccaacttatctcgtatgggagccatccccgtaatgattccagcacagtcaaaagacgggtctattgtgtag

SEQ ID NO: 183914 - DNA, 975 bp, Artificial Sequence
  Description of Artificial Sequence: Synthetic coding sequence
atggccctgctgctgtgcttcgtgctgctgtgcggcgtggtggactttgccaggagtctctcaataacaacccccgaggagatgattgaaaaagccaaaggcgaaactgcctacctcccgtgtaagttcacactttcgccggaggaccaggggccattggatatcgagtggctgatctcacctgccgataatcagaaggtggatcaggtgataattctgtacagcggcgataagatttacgatgactattacccagacctgaagggtagggtgcatttcacgagcaacgatctgaagagcggcgacgccagcattaacgtgacaaacctccagctgtccgacatcggcacgtaccagtgtaaagttaagaaagcccccggagtcgctaacaagaagatccatttggtggttctggtgaagccttcaggggccagatgctatgtcgacggctccgaggagatcggctctgatttcaagattaagtgcgagcctaaagaagggtcactccccctgcagtatgaatggcagaagttgtccgatagccagaagatgcccacatcatggctagcggcgagcaataaggccggacttatcgcaggagctatcatcggcaccctattggctcttgcccttattggtttaattatcttctgctgtagaaaaaagcgtagagaagagaaatatgagaaagaggtacatcatgacataagggaggacgtcccaccacccaagagccggaccagtacggcacgctcatacatcggatccaatcattcaagtcttgggtccatgtctccaagtaacatggaggggtatagtaaaactcagtacaaccaagtgccgtcagaagatttcgaacggactccacagagccctactctcccacccgctaaggtggctgcccccaacctgtcgcgaatgggtgcaatcccagtgatgattcctgcccaatccaaggatgggagcatcgtgtag

SEQ ID NO: 183915 - DNA, 603 bp, Artificial Sequence
  Description of Artificial Sequence: Synthetic coding sequence
atggccctgctgctgtgcttcgtgctgctgtgcggcgtggtggactttgcgaggtccctatccatcactacacctgaagaaatgatagaaaaggcaaagggagagaccgcctatttgccctgcaaattcacactatcgcccgaagaccagggaccccttgacattgagtggctgattagtcctgccgataaccaaaaggtcgaccaagtgattatcctgtacagtggtgacaaaatctacgatgattactacccggatttgaaaggcagggtccacttcacatctaacgatttgaaatccggcgacgccagcatcaacgtgaccaatctgcaattgtccgacataggcacataccagtgtaaggtgaagaaagcccctggggtggcgaataagaagatacatctagtcgtcttaggcaagatgtgtcatctgcagcgggcagtccgcccactcccggaggccaccagcgccgtgataatccacccttgggggccatgcctgctccccacctggaaagacatccctcgactgagtatcaccaaatatcaggttaagactctcaatgcactgctccgagtgagactctcccatttacttaggtag

SEQ ID NO: 183916 - DNA, 759 bp, Artificial Sequence
  Description of Artificial Sequence: Synthetic coding sequence
atggccctgctgctgtgcttcgtgctgctgtgcggcgtggtggactttgccaggagcctgtctatcactaccccagaagagatgatcgaaaaagccaagggagaaactgcctacctcccatgtaaattcactttgtcacccgaagaccagggccctctggatatcgagtggctcatctccccagcggacaaccagaaagtagatcaggtgataatcctgtactcaggtgataagatttatgacgattactaccctgacctgaagggacgcgttcactttacttcaaatgatttaaagtctggcgatgcctccattaatgtgaccaatctccagctgagtgacattggcacataccagtgtaaggtgaaaaaggcccctggggtggccaataagaaaatccatctggtggttttagtaaagcccagcggcgcgagatgctatgtggatggctctgaggaaattggctccgactttaaaataaagtgcgagcccaaggaagggtcattacctctacagtacgaatggcagaagctctccgactcacaaaagatgcctacctcatggttagcgggcaagatgtgtcacctgcagcgggcagtccgccctttgcccgaagcaacatctgcggttatcatccacccgtggggcccttgtctgctgcctacctggaaggatattcctcggctttctatcaccaaataccaggttaaaaccctaaacgcgttacttcgcgttcgcctgagccaccttctccggtag

SEQ ID NO: 183917 - DNA, 1059 bp, Artificial Sequence
  Description of Artificial Sequence: Synthetic coding sequence
atggccctgctgctgtgcttcgtgctgctgtgcggcgtggtggacttcgctcgttccttgagcattacaactcccgaagaaatgatcgagaaagcaaagggggagactgcttacctgccctgcaagtttaccctgtcccctgaagatcaaggaccccttgatattgaatggctgatcagccctgccgataaccagaaagtcgaccaagtcataattctctacagtggggataaaatctacgatgactactatcctgatctgaaggggcgagtgcatttcaccagtaatgatctcaaatccggcgacgcatcgataaacgtaacaaacttacagttgtccgacattggcacctatcagtgtaaggtgaagaaggcgcccggagtggccaacaagaagatccacctggtggtgttggtaaagcccagcggcgcaagatgttacgtggatggaagcgaggaaattgggtctgacttcaaaattaagtgcgagcccaaggaggggtcactgccattgcagtacgagtggcagaaactttctgattcccagaagatgcctacctcatggctcgcagagatgacaagctctgttatctccgtgaagaacgccagctctgaatactcagggacatactcgtgcactgtgcggaaccgcgtcggctctgaccagtgtctcctgcgactcaatgtcgtgccacctagcaacaaggctgggctgattgccggggccatcatcggcaccttactggccctggccttgatcggcctgatcatcttttgttgtaggaagaagcggagagaagaaaagtacgaaaaagaagtccatcacgatataagagaggacgtaccaccccctaagtcccgaaccagtaccgcaagatcttatatcggttcgaatcattcatcgctgggaagtatgagtccttccaacatggagggctacagcaaaactcagtacaaccaggtccctagcgaggacttcgagaggaccccacaatctcccacactacccccagctaaatttaaatacccatacaaaacagacgggataactgttgtgtag

SEQ ID NO: 183918 - DNA, 270 bp, Artificial Sequence
  Description of Artificial Sequence: Synthetic coding sequence
atggccctgctgctgtgcttcgtgctgctgtgcggcgtggtggacttcgctcggtccttgagtatcacaacaccggaagaaatgattgagaaagcaaagggggaaacagcctatctcccgtgtaagtttaccctgagccccgaagaccaggggcctctcgacattgagtggttgattagtcccgccgataatcagaaggtggaccaggtgggtcggtgcgccacctccaaagagccctatgttcactgccagaaattgcacagacagtag

SEQ ID NO: 183919 - DNA, 900 bp, Artificial Sequence
  Description of Artificial Sequence: Synthetic coding sequence
atggaggagttcgacagcgaggacttcagcaccagcgaggaggacgaggactatgtgcccagcggcggtgagtactccgaagacgatgtcaatgaattggtcaaagaggacgaagtggatggcgaggagcagacgcagaaaacccagggaaagaaaagaaaggcgcagagcatccccgcccgtaaaaggcgccaaggcgggctgagtctggaggaagaggaagaagaggatgccaactccgagtcggagggctcatcctccgaagaggaggatgacgcagccgaacaggaaaagggtatcgggtctgaagacgcacgcaaaaagaaagaagacgaactctgggcctcttttcttaacgatgtgggtcccaaatcgaaagtgccacctagtacccaagtgaagaagggtgaggaaacagaggaaactagttcatccaagctgctcgtaaaggcagaagaactggagaagcctaaggaaacagaaaaggtgaagatcaccaaggtgttcgacttcgctggtgaggaggttagagttaccaaagaggttgacgcgacctcaaaagaggcaaagtctttctttaagcagaatgagaaagagaagccacaggctaatgtcccctctgcactgccctctctgcccgctggatccggtctcaagcggtcctcgggcatgtcctccctcttgggcaaaattggcgctaaaaagcagaaaatgtccacactcgaaaaaagcaagctggattgggagagcttcaaggaagaagaagggattggggaagaattagcaatccacaaccggggaaaagagggttacatcgaaaggaaagcctttctcgatcgcgtggaccaccgtcaattcgagatcgaacgcgatctgcgcttgagtaaaatgaaaccatag

SEQ ID NO: 183920 - DNA, 675 bp, Artificial Sequence
  Description of Artificial Sequence: Synthetic coding sequence
atggagaagctgctgtgcttcctggtgctgaccagcctgagccacgcattcggccagacagacatgtcaagaaaggccttcgtgttccccaaagagagtgatacctcatatgtttctctgaaagcacctctaactaagcctctgaaggcctttacagtgtgcctccacttctataccgagttgagctccacccgcggatattccatctttagctatgcaactaaaaggcaagacaacgagatcctgatcttctggagcaaagatataggatattcttttaccgtcggcggctctgagattctgttcgaggtgccagaggtgacagtggcccctgttcacatctgtaccagttgggaatctgcctccgggatcgtcgaattttgggtggacggaaaacctcgggtccggaagtctctcaagaaaggatacaccgtgggtgcggaggctagcatcatcctgggccaggagcaagactccttcggcggcaatttcgaaggctcacagagcctggtgggggacatcggtaacgtcaacatgtgggacttcgtgctcagtcctgatgagatcaacacaatctatctgggagggccatttagcccaaatgtgctgaactggcgcgccctgaagtacgaagtgcaaggcgaagtgttcacgaaaccacagctgtggccttag

SEQ ID NO: 183921 - DNA, 309 bp, Artificial Sequence
  Description of Artificial Sequence: Synthetic coding sequence
atggagaagctgctgtgcttcctggtgctgaccagcctgagccacgcattcggacagactgacatgtcacgaaaggcctttgtattcccaaaggaatcagatacatcctacgtcagtctgaaggcacccctgaccaagcccttaaaagctttcactgtttgcctgcacttttacaccgagctgagctccacccatgaaatcaacacgatctacctgggcggaccttttagtccaaacgtcctgaattggcgggcgctgaagtatgaagtgcagggagaagtgtttacaaaacctcaactgtggccctag

SEQ ID NO: 183922 - DNA, 309 bp, Artificial Sequence
  Description of Artificial Sequence: Synthetic coding sequence
atggagaagctgctgtgcttcctggtgctgaccagcctgagccacgcctttggtcagacagacatgagtaggaaggcttttgtgtttccaaaggaaagtgacacctcctacgtgtctctgaaagctccactcactaagccattgaaggccttcaccgtctgcctacacttttacaccgagctgtccagtacccacgaaatcaacaccatttacttgggggggcccttttcccccaacgttcttaattggcgagccttgaaatacgaagtgcaaggcgaagtcttcactaagccccaactctggccgtag

SEQ ID NO: 183923 - DNA, 309 bp, Artificial Sequence
  Description of Artificial Sequence: Synthetic coding sequence
atggagaagctgctgtgcttcctggtgctgaccagcctgagccacgctttcggccagaccgatatgagtaggaaagcttttgtttttcctaaagaaagcgacacgtcatacgtttccctgaaggcccctctcacaaaacctcttaaggcctttacagtctgcctgcacttttatactgagctttcttctacccacgagataaacactatctatctcggaggccccttctcacccaacgtgcttaattggagggccttgaagtacgaggttcaaggggaggtattcactaaaccccaactctggccttag

SEQ ID NO: 183924 - DNA, 276 bp, Artificial Sequence
  Description of Artificial Sequence: Synthetic coding sequence
atggagaagctgctgtgcttcctggtgctgaccagcctgagccacgcttttggacaaactgacatgagtaggaaagccttcgtgtttccaaaagagagcgataccagttatgtatctttgaaagctccactgacgaagcccctgaaggccttcacagtatgcctccacttttataccgagttgagtagcactagggggcccaacgtgctgaattggagggctctcaaatatgaggtgcaaggggaagtatttaccaagccccagctgtggccatag

SEQ ID NO: 183925 - DNA, 141 bp, Artificial Sequence
  Description of Artificial Sequence: Synthetic coding sequence
atgtgggacttcgtgctgagccccgacgagatcaacaccatctacttggggggccccttctctccaaacgtgctcaattggcgggctctgaaatatgaggttcagggagaagtgttcacaaagccacaactgtggccctag

SEQ ID NO: 183926 - DNA, 1146 bp, Artificial Sequence
  Description of Artificial Sequence: Synthetic coding sequence
atgcccttcagcaacagccacaacgccctgaagctgcggttccccgctgaggacgaatttccagatctgagcgcccacaataatcacatggccaaagtccttactcccgaactgtatgcagagctccgcgccaagtcaacgccttccggtttcaccttagatgacgtgatccagactggcgtggacaaccccggccatccctatattatgaccgtcggctgtgtcgccggcgatgaagagtcgtacgaggtgtttaaagatctctttgaccccataatcgaagacagacatggaggctacaagccaagcgacgaacacaagacggatctgaacccagataacctgcaggggggggacgacttggacccaaactatgtgctaagcagtcgcgttcggactgggagatccattcgcggattctgcttgccccctcactgttcacgaggcgagaggcgcgccatagaaaaactcgccgttgaggccctgtcctctttggacggggatttagcagggcggtattacgcccttaagtctatgaccgaggccgaacagcagcaattaatcgacgaccattttctatttgataagcccgtgtccccccttctcttggcgtccggcatggccagagactggccagacgcccgcgggatctggcacaatgacaataagacgttcctggtgtgggttaacgaggaagatcatttgagagtcatctccatgcagaaaggagggaacatgaaagaggtcttcacccgtttctgtacaggcctcacacagatagagactctgttcaaatcaaaagactacgaatttatgtggaaccctcatctcggttatattcttacttgcccatctaacctgggtaccggattaagggccggggtgcacatcaagctacctaacctcggtaagcatgaaaagtttagcgaggtgctgaaaagactcagactccagaagcggggcactggcggagtcgacaccgcagcagtgggcggagtatttgacgtgagcaatgcagacaggctgggcttctctgaggttgaactggtgcaaatggtggtggatggcgttaagctgctgatagaaatggagcagcggctggaacaggggcaggccatcgatgacttgatgcccgcacagaagtag

SEQ ID NO: 183927 - DNA, 1041 bp, Artificial Sequence
  Description of Artificial Sequence: Synthetic coding sequence
atgcccttcagcaacagccacaacgccctgaagctgcggttccccgcagaggacgaatttccggacctaagcgcccacaataaccatatggctaaggtcctgaccccagagctgtatgccgaactgagagctaagagtaccccaagcggctttacgctggatgatgttatccaaacgggagtggacaatccggggcacccatacatcatgactgtcggatgtgttgccggcgacgaggaaagctacgaggtctttaaggatctcttcgaccctatcattgaagacagacacggaggatataaaccttctgatgagcacaagactgatctcaatccacctagaggagctcctagaattgagaagctggctgtggaggccctttcaagcctcgatggggacctggcgggaaggtattacgccttaaaaagtatgacggaggccgagcaacagcagctgattgacgaccactttttgttcgacaagccagttagccccctgctgctcgcatctggaatggccagagattggccggacgcaagaggaatttggcataacgacaacaaaacatttctcgtgtgggtgaatgaggaagaccatctccgggtgatttcgatgcagaaaggaggcaacatgaaggaagtgttcaccaggttttgcaccggtctgacacagattgagacacttttcaagagcaaagattatgaattcatgtggaacccccatttaggatacatcctgacttgcccttctaacttgggtactggactccgggcgggggtgcacattaagctgccaaatctgggcaagcatgagaagttcagcgaggtgctcaagcgccttaggttacagaaaaggggcaccgggggggtcgatacagccgccgtcggaggtgtgtttgacgtgtctaacgctgacaggctgggtttctctgaggtcgaactcgttcagatggtggtggatggagtcaaactactgatcgaaatggagcaacgcctggagcaaggccaagcaatcgatgacctcatgcctgctcagaaatag

SEQ ID NO: 183928 - DNA, 654 bp, Artificial Sequence
  Description of Artificial Sequence: Synthetic coding sequence
atgcccttcagcaacagccacaacgccctgaagctgcggttccccgcagaagatgaatttcctgacttgtcagcccataataaccacatggcgaaggtcttaacccccgagttgtacgccgagctacgggctaaatccactccaagcggatttacactggacgacgtgatccagacaggcgtcgacaaccccggacacccatatatcatgaccgtcggatgtgtggcaggcgacgaagaaagctatgaagtgttcaaggacctcttcgaccccataatcgaggaccggcatggaggctacaagccgagcgatgagcataagactgatctaaaccccgacaacctgcagggcggcgatgatctagaccccaattatgttctgagttctcgcgtacgaaccggtaggagcatcaggggtttctgtctgccaccacactgcagccgcggcgaacgccgcgcaattgagaaacttgccgtggaagctctaagctcattggatggcgacctggcaggtaggtactacgcactgaagtccatgactgaagcagaacagcaacagcttattgatgaccactttctgtttgataagccagtctcccctctcctcctggccagtgggatggccagggactggccagatgctagagggatttag

SEQ ID NO: 183929 - DNA, 447 bp, Artificial Sequence
  Description of Artificial Sequence: Synthetic coding sequence
atggccggccccttcagccggctgctgagcgcccggcccggcctgcgcttgcttgccctggctggcgcaggctctcttgcggccggattccttttgaggcctgaacccgtccgagctgcctcagaaagacgacgactgtacccaccatctgctgagtaccccgacttgcgcaaacataataactgtatggcaagccacctcacgccagctgtctacgctcggctgtgcgacaagaccaccccaaccgggtggacacttgaccagtgcattcagactggggttgataatcctggccatccattcattaaaactgtcgggatggtcgcaggtgatgaggaaacctatgaagtgttcgcggacctgtttgaccccgtgatccaggaacggcacaatggctatgaccccagaactatgaaacacactacggatctcgacgcgtctaagtag

SEQ ID NO: 183930 - DNA, 1254 bp, Artificial Sequence
  Description of Artificial Sequence: Synthetic coding sequence
atggccggccccttcagccggctgctgagcgcccggcccggcctgagacttctggccctggccggcgccggaagtctggcggccggctttcttctgagacccgaacccgtgagagcagcatccgaacggaggcggttgtatcccccctccgccgagtacccagacctgagaaagcataataattgcatggcatctcatctaacccccgcagtttacgctaggctatgcgataaaaccacaccaacgggttggactctcgatcagtgcatacagaccggcgtggacaacccaggacacccctttattaagaccgtcggtatggttgctggcgacgaggaaacatacgaggttttcgctgatcttttcgatcctgtcatacaagagagacacaacggttacgacccccggacgatgaaacataccaccgaccttgatgcctctaagatacggtcgggatacttcgatgaaaggtatgttctgagctctagggtgcgcaccgggaggtctatccggggactgagcctaccccctgcctgtaccagagccgagagaagagaggtggaacgagtggtggtggatgctctgagtggcttaaaaggcgatctcgctggccgttactataggctatcagagatgactgaagcggaacagcaacaactgattgacgaccactttttgttcgataagcctgtctcaccactgcttaccgccgcgggcatggcacgggactggcccgatgcacgcggtatctggcataacaatgaaaagagttttttgatctgggtgaatgaagaggatcacacgagggtgatatctatggagaagggggggaacatgaagcgcgtattcgagagattctgccggggtttaaaggaagtggagcgattgatacaagagaggggctgggaatttatgtggaacgaaagactagggtatattctgacttgtccttcaaacttagggaccggactccgagctggcgtgcatatcaaactgccacttttgagcaaggacagccgttttcccaagatccttgaaaatctcagactgcagaaaagagggacgggaggagtggataccgcggctactggcggcgtgttcgacatctccaacttagataggctggggaagtccgaggtggaactggtgcaactcgtgatcgatggggtgaactacctgatcgactgcgagcgtagattggagcgaggccaagatattagaatacccacccctgtgatccacaccaaacactag

SEQ ID NO: 183931 - DNA, 1347 bp, Artificial Sequence
  Description of Artificial Sequence: Synthetic coding sequence
atggccggccccttcagccggctgctgagcgcccggcccggcctgcgtctcctagccctggcaggggcggggtcccttgccgctggattcttactgcggcccgaacctgtcagggcggctagcgaacgacggcgactataccccccttcccagacctggcctacaggccagctgccaggcaattgcacccggagcaggcggctgtgccccccttctatggtgacaggctaccccttgcctagtgccgagtatcctgatttgcgtaaacacaacaattgcatggcctctcatctgaccccggcggtatatgcccgtctctgcgataagacaactccaaccgggtggacacttgaccagtgtatccagaccggtgtggataacccaggacacccgtttattaaaaccgttggtatggtcgcgggtgatgaagagacatacgaggtttttgcggatctgtttgaccctgtgattcaggagcgacacaatggctacgatcctagaaccatgaagcacactaccgacctggatgctagcaagatcaggagcgggtacttcgacgaacggtacgttctgtccagccgagtcaggaccggacgcagtatcagagggctctcactgcccccagcgtgtacacgggcagagcgtagggaggtggaacgagtcgtcgtagatgctctgagcggtcttaagggggatcttgccggacgatactaccggctgtctgagatgactgaagccgagcagcagcagctgattgatgatcacttccttttcgataagccggtgagcccacttcttacagcagccggaatggctcgcgactggcccgatgcccggggcatctggcataacaatgagaaatccttccttatttgggttaacgaggaggatcacacacgcgtgatatctatggagaaggggggcaatatgaagagagtctttgaacggttctgtagaggcctgaaggaggtcgaaagattgatacaggagaggggttgggagtttatgtggaatgagcgcctgggatacattttgacatgcccgtcaaaccttggtacagggctccgggctggcgtgcacattaagctgcctttgctctctaaagactcccggtttcccaagattctagagaatcttcgtcttcagaagcggggaactggaggcgtggacactgcagccaccgggggagtgtttgacatttccaatttagacagactgggtaagagcgaggtcgagctggttcagctcgtgatcgacggcgtgaattatcttatagattgcgagcgccggcttgagagaggccaggacatccggatacctaccccggtcattcataccaagcactag

SEQ ID NO: 183932 - DNA, 1254 bp, Artificial Sequence
  Description of Artificial Sequence: Synthetic coding sequence
atggccggccccttcagccggctgctgagcgcccggcccggcctgaggcttctggcactggccggggctggatctctcgctgccggtttcctgctcagacccgaaccagtccgcgccgcttcggaacgccggagattgtatcctccctcagccgagtatcccgacctgagaaagcacaacaactgcatggcatcgcatttgacgccagctgtctacgcccgattgtgtgataagactactccgactgggtggaccctcgaccaatgtattcagacaggggtagacaatcctggccacccattcattaagacagtcggcatggtcgctggcgacgaagagacctacgaagtgtttgcagacttattcgaccccgtgattcaagagcggcacaacgggtacgacccaaggacgatgaagcataccactgatctggacgcctccaagattcggagtggatattttgatgaaagatacgtgctgtcatcccgcgtgagaactggtagatccatccggggcctaagtttacctcccgcgtgtaccagagctgagcgacgggaagttgaaagggttgtggtggatgcccttagtgggttgaagggcgacttggctggccgctattatcgtctgtctgaaatgacggaggctgaacagcagcagctgatcgacgatcacttcctgtttgacaagccagtttcgccattactcacagcagccggaatggctcgggattggccggacgcgagggggatttggcataacaacgagaaaagtttccttatatgggttaatgaagaagatcacacacgcgttatcagtatggaaaaaggaggcaacatgaaacgtgtattcgagcgcttctgccgcggacttaaggaagtggagcggcttatccaagagcgaggttgggaatttatgtggaacgagcggctgggctacattcttacgtgtccaagtaacctcggtaccgggctgagagccggagtgcacatcaaactgcctctgctgtccaaagattctaggttccctaaaattcttgagaaccttagactgcagaagcggggaactggaggcgtcgatacggccgccaccgggggagttttcgatatctccaatttagaccgtctgggaaagtctgaggtggaactggtgcagctcgtcattgatggggttaactatctcattgactgtgaaagacggctcgaaagaggccaagatatcagaatcccgacaccagtcattcatactaagcattag

SEQ ID NO: 183933 - DNA, 765 bp, Artificial Sequence
  Description of Artificial Sequence: Synthetic coding sequence
atggccggccccttcagccggctgctgagcgcccggcccggcctgcggctgctcgctctggctggagcaggaagcctcgccgccgggtttctgctgagaccagagcctgttagggctgcgtccgaacggagacgcctatacccaccgtccgctgagtacccagacctgcggaaacacaataactgtatggcgtctcatctcacaccagcagtgtacgcgcgactgtgtgataaaaccactcccacggggtggacattggaccagtgcatccagacaggggtagataaccctggtcatccatttatcaaaaccgtcggcatggttgctggggacgaagagacctacgaggtgtttgccgacctgttcgaccccgtcatcagaggcctaagtctgcccccagcttgtaccagggccgagcgaagagaggtggagcgggtggtggtcgatgccctgagcgggttaaagggggacctggcggggagatactacagactgtcggagatgactgaggccgagcaacagcagctgattgacgaccattttctgtttgacaagccagtcagtcccttactcacagccgcggggatggcacgggactggcctgatgccagaggcatctggcataacaatgaaaaatccttcttaatttgggtgaacgaagaggaccacacccgcgttatttcaatggaaaaggggggaaacatgaagagggtgtttgaacgattttgcagggggctgaaggaagtcgtcgttggaatcaagtag

SEQ ID NO: 183934 - DNA, 1254 bp, Artificial Sequence
  Description of Artificial Sequence: Synthetic coding sequence
atggccggccccttcagccggctgctgagcgcccggcccggcctgcgcctgctggccctcgccggagccgggagtttagccgcgggctttctgttacgccccgagcctgttcgggcagccagcgagcgccggaggctttaccccccttctgcagagtacccagacttgcggaaacacaacaattgtatggccagccacctcactcccgccgtgtatgctaggctctgtgacaagaccacacccacaggctggacattggaccagtgcattcagaccggcgtagataaccccgggcatccctttattaagacagtgggcatggtcgccggagacgaggagacttacgaggtctttgcagacctgtttgatcccgtcatccaagaaaggcataatggctacgatcccaggacaatgaagcatacaacagatttggacgcatctaagattagatctgggtattttgatgagcgatacgttctgagctcaagggtgagaaccggaaggagtattagaggtctcagtttacccccagcatgtacaagggctgaaaggcgcgaagttgagcgcgtcgtagtcgatgccttgtccggcctaaaaggggatctggccgggcggtattacagactgtccgagatgaccgaagccgaacagcagcagttaatcgatgaccactttttattcgacaaaccggtaagccctctgttaactgcagccggcatggcaagggattggccagacgcaagaggcatatggcataacaacgaaaaaagttttctaatctgggtgaacgaagaggatcatacacgagtgatttcaatggaaaaagggggcaatatgaaacgtgtattcgaacgtttctgtagagggctgaaggaagttgagaggctgattcaggaaaggggttgggagttcatgtggaacgagcggctggggtatatcttgacctgcccttcaaacttggggactgggctgagggctggcgtacatattaaacttccactgttgtccaaggattctcgatttccgaagatcctcgaaaacctgcggctgcagaagcggggtacagggggcgtagatacagctgccaccgggggtgtcttcgatatcagtaatctcgaccgcctgggaaagtccgaggtggaactggttcagcttgttatagacggggtaaactaccttatcgattgcgagcgacggctcgagagagggcaggacatccggatcccgacacccgtgatccacactaaacactag

SEQ ID NO: 183935 - DNA, 441 bp, Artificial Sequence
  Description of Artificial Sequence: Synthetic coding sequence
atgcccgtgaaggtgcggaccggccggagcatccggggcctgagccttcccccagcgtgcactcgggccgagcgccgggaggtagagcgagttgtggtggacgctttatcaggcttgaaaggagatctagccgggcggtactataggttgtcggagatgactgaggcagagcaacagcagctcattgatgatcactttctgttcgataaaccggtgtctcccttgctgacggcggccggaatggctcgcgactggcccgacgcaagaggaatttggcataataacgaaaagtcgttcctcatctgggtgaatgaagaagatcatacacgggtcatctctatggaaaagggcggcaacatgaaacgcgtgttcgaacggttttgccggggactgaaggaagttagagaggattgcgtgggcgaactgggagggcgtacttag

SEQ ID NO: 183936 - DNA, 507 bp, Artificial Sequence
  Description of Artificial Sequence: Synthetic coding sequence
atgaagcacaccaccgacctggacgccagcaagatccggagcggctacttcgacgagcggtacgtgctcagttcccgggttaggaccggccgtagcatccgcgggctcagtctcccaccggcctgcacacgggccgaacgcagggaagttgagcgggttgtggtggacgcactttcaggcctcaagggtgatctggctggacggtactaccggctcagtgaaatgactgaggcagaacagcaacaacttattgatgaccattttttattcgataagccagtgagcccacttctcaccgccgctgggatggctagggactggccagacgctcgaggcatctggcacaacaatgagaagagctttttaatttgggtgaacgaggaagaccacactcgtgtgatttctatggagaaaggcggcaacatgaaacgcgtgttcgaacggttttgcagaggtctaaaagaagttagggaggactacgtcggagagctggggggccggacctag

SEQ ID NO: 183937 - DNA, 312 bp, Artificial Sequence
  Description of Artificial Sequence: Synthetic coding sequence
atggccggccccttcagccggctgctgagcgcccggcccggcctgaggcttctggcgctcgctggagccgggagcctggccgccggcttcctcttgcgcccggagcccgtgcgggccgcttcggagcgccgccgcctttaccccccttcagccgagtaccccgacctgcgtaagcacaacaactgtatggccagtcatctgaccccggccgtgtatgcgcggctgtgtgacaagacgactcccacgggatggacgctcgatcaatgcattcagaccggcgtggataacccgggacaccccttcattaagtag

SEQ ID NO: 183938 - DNA, 390 bp, Artificial Sequence
  Description of Artificial Sequence: Synthetic coding sequence
atggccggccccttcagccggctgctgagcgcccggcccggcctgcgccttttagcactggccggcgcagggagcctcgccgccggatttctgttgcggccagagcccgtacgcgctgcgagcgagaggcggaggttgtaccccccctcagccgaatacccagacctccgcaagcacaataactgcatggcttcacacctcacacccgctgtctacgctaggctctgtgacaaaactaccccgacgggatggactcttgaccagtgtattcagacaggagtagacaaccccggccaccccttcatcaaaaccgtgggcatggtagctggagatgaagagacctacgaggtatttgctgacctgttcgatcccgtaatccaagaacgctag

SEQ ID NO: 183939 - DNA, 1017 bp, Artificial Sequence
  Description of Artificial Sequence: Synthetic coding sequence
atggccggccccttcagccggctgctgagcgcccggcccggcctgcggttattagccctggcaggtgccggaagccttgccgcaggtttttgctctgacaggaatctctatgagctccccgtgaatgacggcggttgcatcccaagggagcagtcccagacatggcccaccgggcaacttcctggcaattgcacccgttcgaggagactgtgtccacccagcatggttaccggctacccgcttccatctgccgagtacccggatctccgcaagcataataattgtatggcatctcacctgacccctgccgtgtatgccaggttgtgcgataagacaaccccaaccggttggacccttgatcagtgcattcagaccggggtggataatcccggtcacccctttattaaaacagtgggcatggtggctggggacgaagagacctacgaggtatttgccgatctgttcgacccagtgatccaagagagacataatggatatgatccccgcaccatgaaacacaccaccgacctggatgcttcgaagatcaggagcgggtatttcgatgagcgctatgttttgtcctcgcgtgtaaggaccgggcgatccatacgcggactgtctctgccgccagcctgtaccagggccgaacgtcgcgaagttgaaagggtggtcgtggatgccctgtcaggactgaagggggacttggctgggaggtattacaggctgtccgagatgacagaggccgagcaacagcagttaatcgatgatcatttcctgtttgacaagccggtgtctcctttactgaccgcggctgggatggctagagattggccagacgcaaggggaatctggcacaacaacgagaagagcttcctgatctgggtgaatgaggaggaccatactagggtaatctcaatggagaaaggggggaatatgaagcgggtgttcgagaggttctgccgaggattgaaagaagtgcgcgaagactatgtcggagagctcggtgggagaacatag

SEQ ID NO: 183940 - DNA, 1254 bp, Artificial Sequence
  Description of Artificial Sequence: Synthetic coding sequence
atggccggccccttcagccggctgctgagcgcccggcccggcctgcggcttctggcactggccggcgctggatctttggcagctggatttctgctgaggcctgagccagttcgcgccgcgagcgagcgacggcggctttatccccccagtgcagaataccctgatctgcggaaacacaacaattgtatggccagtcacctcacccccgctgtgtacgcccgcctttgcgacaaaacaacacctaccggctggaccctggatcaatgcatccagacaggcgttgacaatccggggcacccatttatcaagactgtcggaatggttgccggagacgaagagacctatgaggtcttcgccgatctattcgaccctgtcatccaggaacgccataacgggtacgacccccggacaatgaagcacacgactgacctcgacgctagcaaaatacgctccggatattttgatgagcggtacgtgctcagtagtcgcgtgcgcaccggtcgatccattagaggcctgtctctgcctcctgcgtgtactcgagccgaaagacgcgaagtggagcgagtggtagttgatgcccttagcggactcaagggagacctggctggccgatattaccggcttagcgaaatgacggaggcggagcaacagcagcttattgacgatcattttctgttcgacaagcctgtgagcccgctgcttacagctgcgggcatggcccgggactggcctgatgctcggggcatctggcacaacaatgaaaaatcttttttaatatgggttaacgaagaagatcacacccgcgtgatatccatggaaaaggggggtaacatgaagagagtgttcgaacgcttctgtaggggacttaaagaggtggaaaggcttatccaagaacgaggctgggagttcatgtggaatgagcgtctcgggtatattctgacatgcccaagcaacctggggactgggctgcgcgcaggagttcacattaagttgccgcttttaagtaaggactcccgatttcctaaaattctagaaaacctccggttacaaaagaggggtaccgggggtgttgataccgctgccactggcggggtgttcgatatttctaacctggacaggctcggaaagtccgaggtcgagctcgtccagcttgtcatcgacggtgtcaactatctgatcgactgcgagaggaggttggagcgtgggcaggacattcgtatccctaccccagtgatccatacaaaacactag

SEQ ID NO: 183941 - DNA, 774 bp, Artificial Sequence
  Description of Artificial Sequence: Synthetic coding sequence
atggtgaccggctaccccctgcccagcgccgagtaccccgacctgaggaaacacaataattgtatggctagccatctcacgcctgccgtctatgccaggctgtgtgataagactacgccaactggttggacactcgaccagtgtatacaaacgggtgtggacaatcccgggcacccctttattaagacggtgggtatggttgctggagatgaagaaacatacgaagtgtttgccgacctctttgaccctgtcatccaggagcggcacaacggatacgatcccaggacaatgaaacacaccacagatctggatgcttccaagatcagatcaggctacttcgatgagcggtatgtgttgagcagccgagttcggacaggtcgcagcattaggggcctttcactgccgcccgcttgtactagagcagagagacgagaagtcgagagggtcgtcgtggacgccctaagtgggctcaagggggacctcgcgggaagatactatcgcctgagtgaaatgaccgaggcagaacaacagcaacttattgatgatcacttcctgtttgacaaacccgtctccccccttttgaccgctgctggcatggctagagactggcccgatgcgcggggaatatggcacaacaacgaaaaatctttcctgatctgggttaacgaggaggatcacacaagggtcatatcaatggaaaaggggggaaatatgaagcgcgtcttcgagagattctgcagaggactgaaggaagtcgttgtggggatcaaatag

SEQ ID NO: 183942 - DNA, 726 bp, Artificial Sequence
  Description of Artificial Sequence: Synthetic coding sequence
atggccggccccttcagccggctgctgagcgcccggcccggcctgcgcttgcttgcactcgcaggggctgggtcgctggccgctggatttctgctgagacccgaacccgtccgagccgccagcgagcgccggcgcctgtacccaccatccgcggaataccccgacctccgcaaacacaataattgcatggcaagtcacctgacaccagcagtctatgccaggttgtgcgacaagaccaccccaacagggtggaccctggaccagtgtatacagaccggagtcgataatccaggtcatcccttcataaaaactgtcggcatggtggctggtgatgaagagacttacgaagtattcgctgacctgtttgatcccgtaatccaggagaggcataacggatacgacccccggaccatgaaacatacaacggatttagacgccagcaagatacgctctggctatttcgatgagaggtatgtgttgtcgagtcgggtgcgcactggtagaagtattagggggctgtccctgccgcctgcatgtacaagggctgagaggcgggaggtggaacgagttgtagtcgacgcgctttctggcttaaagggagacttggctgggcggtattacaggttgagtgagatgacagaggccgaacagcagcagttaattgatgaccacttcctgttcgacaagccggtttcccctttgctgactgcggcagggatggcatag

SEQ ID NO: 183943 - DNA, 1260 bp, Artificial Sequence
  Description of Artificial Sequence: Synthetic coding sequence
atggccagcatcttcagcaagctgctgaccggccggaacgccagcctgctgttcgctacaatggggacctccgtcctgacaacagggtatttgcttaacagacagaaggtttgcgccgaggtgagggagcagcctaggctttttcctccatccgctgactaccctgatctgaggaagcacaacaactgcatggcagaatgcctgacacctgctatttacgcaaaactgcgcaataaggttactcctaacggctatactcttgatcagtgcatacagaccggagtcgacaatcctggacatcccttcattaaaacggttggcatggtcgccggcgacgaagaaagctacgaggttttcgccgacctcttcgaccccgtcatcaagctccggcataacggctatgatccaagagttatgaagcatacaaccgacctcgatgcttcaaagatcacacaagggcaatttgatgagcactatgtgctgagttctagggtcagaaccggaaggagtatccgcgggctgtctcttcccccagcctgcactcgagccgagaggagagaagtggaaaatgtggccattaccgctcttgaggggctgaagggtgacctggcagggcgttattacaagctttcggaaatgacggagcaggaccagcagagactgattgacgaccacttcctctttgataagccggtcagtccactgttgacctgtgcaggaatggcccgggattggccagacgccaggggaatttggcacaattatgacaagaccttcctgatatggataaacgaagaagatcacacccgggtcatttcaatggagaaagggggcaacatgaagagagtgtttgaaaggttctgccgtggtttgaaggaagtggaacggctgatccaggagagggggtgggagtttatgtggaacgaacggctcggttatatcctgacttgcccatcaaatcttggcacgggactcagagcgggggtgcacgtcaggatccccaaactgagcaaagatccccgatttagtaaaatccttgagaatttaaggctacaaaagagagggacaggcggcgtcgacactgccgccgtggcagacgtttacgacatttccaatatcgataggattggtaggtctgaggtggagctggtgcagattgtcattgacggagtaaattacctcgtcgattgcgagaagaagcttgagcggggtcaggacataaaagtgcctccgccccttccccagttcgggaagaaatag

SEQ ID NO: 183944 - DNA, 1260 bp, Artificial Sequence
  Description of Artificial Sequence: Synthetic coding sequence
atggccagcatcttcagcaagctgctgaccggccggaacgccagcttgctttttgccaccatgggtacttccgtgctgaccaccggatacttgcttaacagacagaaagtctgcgccgaggtgcgcgaacaaccaaggctgttcccaccctccgcagattatcctgatttgcgcaaacacaacaactgcatggcagaatgtctgacaccagcaatctacgcaaagctccgaaacaaggttactccaaatggctacaccctagatcagtgtattcagaccggtgtggacaatcccgggcacccatttatcaaaaccgtcggaatggtggctggggacgaggaaagctacgaggtgtttgcagacctctttgaccccgtcatcaaactacgccacaatggttatgatcctcgagtcatgaaacacacaactgacttggacgccagcaaaatcacccagggacagttcgacgagcactatgtgctgagttcgagggtacgcacaggccggtcgatacgcgggctgtcactgcccccggcttgcaccagagccgagcgacgcgaagtggagaacgtcgccataaccgccctcgagggcttaaagggagacctggctggcagatactataagttatcagaaatgaccgaacaagaccagcagagattaattgacgatcacttccttttcgataaacctgtgtccccactgttgacatgcgctgggatggctcgggactggccagacgctcgcggaatctggcataattatgataagacctttctgatctggatcaacgaagaggatcatacaagggtcattagcatggagaagggtgggaatatgaaacgcgtgttcgagcgcttttgtcgggggctgaaggaagtcgaacggctgatccaggaacgtggttgggaattcatgtggaatgaacggctcggctatatactcacatgtccctcaaatttgggaacagggttgcgcgcaggcgttcatgtacggatccctaaactttcgaaagatccacggttctcaaaaatcctggaaaatctcagactgcagaaacgtgggaccgggggcgtggatactgctgcagtggctgacgtatacgacattagcaatatcgatagaatcggcaggtctgaagtggaacttgtacagatcgtcattgacggcgttaattacttagtagactgcgagaaaaagctcgagcggggacaagatattaaagtccccccccctctaccgcagttcggaaagaagtag

SEQ ID NO: 183945 - DNA, 1260 bp, Artificial Sequence
  Description of Artificial Sequence: Synthetic coding sequence
atggccagcatcttcagcaagctgctgaccggccggaacgccagcctccttttcgccacaatgggaacaagcgttttaacaacaggatacctgctgaatcgccaaaaagtgtgtgcagaggtgcgcgagcagccacgactgttccctccaagcgccgactacccggatttacgcaagcacaacaattgcatggcagaatgcctcacacccgcgatatatgccaagctgcgcaataaggtgacccctaatggatacactttggaccagtgtattcagaccggggtggacaatcctgggcatccatttattaagacagtgggcatggtggccggggacgaggaatcatatgaagtgttcgccgacctgttcgatcccgtgataaaactgaggcacaacggctacgatcctagagtgatgaaacataccactgacctcgatgcctccaagatcacccagggccagttcgacgaacattacgtcctgagctctcgcgtgcgtacaggcaggtccatccgcggcctgtcgctgccccccgcctgtactcgcgccgagcgacgagaagtggaaaatgtcgctatcacggcccttgaagggctgaaaggggacctcgccgggaggtactataaactgagcgagatgaccgaacaggatcagcagaggttgatcgacgatcactttctgttcgacaagccagtttcaccgctgctcacgtgcgccggcatggccagggactggccagacgctcgcgggatttggcacaattacgataagaccttcttgatatggatcaatgaggaggaccatacaagagtcatctctatggaaaaggggggcaacatgaaaagggtgttcgagagattctgtaggggcctaaaggaagtggagcgcttgattcaagaacgcgggtgggaattcatgtggaatgagcggcttggctatatcctgacatgcccatccaaccttggtaccggtttacgagccggcgtgcatgtcagaattcccaaactgagcaaggatccgcgatttagtaaaatcttggagaatctcaggctgcagaaacgcgggaccggtggggtggatacagccgccgtcgctgacgtgtacgacatcagcaacatcgacaggattggtaggagcgaagtggagctagtccaaatcgtgattgacggcgtgaactatctcgtcgactgcgaaaagaaacttgagcgagggcaagatattaaggtccctcctcctctgccacagtttgggaaaaaatag

SEQ ID NO: 183946 - DNA, 513 bp, Artificial Sequence
  Description of Artificial Sequence: Synthetic coding sequence
atggccagcatcttcagcaagctgctgaccggccggaacgccagcctcctcttcgcaaccatgggcacatctgtcctcactaccgggtacctccttaacagacaaaaggtgtgtgccgaagtcagagaacagccacggctgttccctccttcagccgactaccccgatctacgtaagcacaacaattgcatggccgagtgtttaaccccagccatttatgccaagttgcggaataaagtgacaccgaatggttacacactggaccagtgcattcaaaccggcgttgacaatccaggccatcctttcattaaaacggtcgggatggtggccggggacgaagaatcctatgaagtgttcgctgacttattcgacccagtcatcaaacttaggcataatggatacgatccacgtgtgatgaaacacacaactgaccttgacgcctccaaaatcacccagggtcagttcgacgaacattacgtcctgagttcccgggtgcgcactggcagatcctag

SEQ ID NO: 183947 - DNA, 1098 bp, Artificial Sequence
  Description of Artificial Sequence: Synthetic coding sequence
atgggcgtgccccggccccagccctgggccctgggcctgctgctgttcttgctcccaggcagtttgggcgccgaatctcacctgtctttactttatcacctgacagcggtgtcaagcccggcccccggtacccccgctttttgggtgtcaggttggctgggacctcagcaatacctctcgtataattctttgaggggcgaggctgagccgtgtggagcttgggtctgggaaaaccaagtgagctggtactgggaaaaagagacaacggatctccgcataaaggaaaaactttttcttgaagcttttaaagctctgggaggcaagggtccatacacgcttcagggactgcttgggtgcgaactgggtccggacaacacttctgtacctacagccaaattcgccttgaatggcgaagagttcatgaactttgatttaaaacagggaacctggggcggagactggcccgaagcgctggctatctcccagcgctggcaacagcaggacaaagccgcaaataaggagttgacattcttgctgttttcctgccctcatagactgcgcgagcacttggagcgagggagaggaaacctcgagtggaaggaacctccatctatgcgcctgaaagcccgcccctcctcgcctgggtttagtgtgctgacctgtagcgccttctcgttctaccccccagaattacagctgaggtttctgaggaatgggctcgccgctggcaccggtcagggggattttggaccgaattctgacggctcctttcacgcctcttcgtctctgacggtcaagtctggcgatgaacaccactactgctgtatagtgcaacatgccggcttagcccagcctctccgggttgagcttgaatccccggccaaaagcagtgtcctagtggttgggatcgtgattggtgtcctgctgcttaccgctgccgccgtggggggagccctcttatggcgccggatgagaagtggcctgcccgcgccttggatttctttgcggggcgatgacaccggcgtgttgctccccactcccggagaggcccaggatgccgacttgaaggacgtgaatgttatcccagctaccgcatag

SEQ ID NO: 183948 - DNA, 7329 bp, Artificial Sequence
  Description of Artificial Sequence: Synthetic coding sequence
atggccgagaacctgctggacggcccccccaaccccaagcgggccaaactaagctctcccggcttctcagccaacgatagcaccgactttgggtcgctttttgacctggagaatgatctacctgatgaactaatacctaacggtggcgaactgggcctgctcaattccggtaatctggtacccgacgccgcctccaagcataagcagctgtctgagctgttacgaggcggaagtggatcctctatcaaccctggcattgggaacgttagcgccagcagccctgtgcagcagggcctgggaggacaggctcagggtcagcccaactccgcgaacatggcgtcactgagcgctatgggaaaaagcccgctatcccaaggagatagcagcgccccgtcactgcctaaacaagctgccagcacgagtggaccaactccggccgcctctcaagcactcaacccccaggcccaaaagcaggtcgggctcgccacttcatcacccgccacaagccagactgggcccgggatttgcatgaacgctaatttcaaccagacccacccaggcctcctcaacagcaatagcggacactcgctcattaatcaagcaagccaggggcaagcccaggtaatgaacggttcactgggggccgctggtcggggccgtggcgccggcatgccctaccctacacctgctatgcagggcgccagctctagcgtcttggctgaaactcttacccaggtgtctccacagatgaccggtcatgcaggcctgaacacggcgcaggccgggggcatggcaaagatgggcattaccggaaacactagtccattcggacagcccttctctcaggccggtggacaacccatgggggcgaccggggtgaaccctcaattagcctctaagcagagtatggtcaactcactgccaacttttccaacagacataaagaacaccagcgtgaccaacgttccaaacatgtcccagatgcagacctcggtaggaatcgttccaactcaggctatcgctactgggccaaccgccgatcctgagaagcgcaaactgattcaacagcagttagtgctgctcctgcacgctcacaaatgtcagagacgcgagcaggctaatggcgaagtaagagcttgttctctcccccattgccgcactatgaagaacgtcttaaatcatatgacacactgtcaggcaggaaaggcttgtcaggtcgctcattgcgcgagtagcaggcaaatcatttcacactggaaaaattgtactcggcacgactgtccagtgtgtttacctcttaagaacgcatccgataagcggaaccagcaaaccatacttggctcacccgcaagtggaattcagaacacgattgggtcagtgggcaccggccagcagaacgcaacctctttgagcaatccaaacccaatcgacccaagttccatgcagcgcgcatacgccgccctcggattgccctacatgaaccagccccagacacagctgcagcctcaggtacccgggcagcaacctgcacagcctcaaacccaccagcagatgagaactttgaacccactgggaaataaccctatgaacatacctgccgggggcataacaacagaccaacaaccacccaacctgatcagcgagagcgcgctgccaacatctctgggagcaacaaacccactgatgaatgacggctccaacagtggcaatatcgggacattatctactattcctactgcggcaccaccttcttcgaccggggtgcgaaagggttggcatgaacacgtcacacaggacctgcgatctcacttggtgcacaaactagtccaggctattttccccacccctgacccagcagcactgaaggatcgccgaatggaaaatcttgtcgcatatgcaaaaaaggttgagggcgacatgtacgaatcggcaaactctcgcgacgagtactatcatctgctcgcagagaagatctacaaaatccaaaaagaattggaagagaagcgccggtccaggctccacaaacagggcatcctcggcaatcagccagctctgccagcccccggtgctcagcccccggtgatccctcaagcgcaacctgtaaggcctcccaatgggcccctgagtttaccagtaaaccgcatgcaggtgtctcaggggatgaactctttcaatccaatgtcgctaggcaacgtccagttaccccaggcgcccatggggcctagagctgcttccccaatgaatcactccgttcaaatgaattccatgggaagcgtcccaggcatggccattagcccttcccgcatgcctcagcctccaaatatgatgggcgctcacacaaacaacatgatggctcaggctcctgctcaatctcaattccttcctcagaaccaattcccttcctcaagcggagcaatgagcgttgggatgggccaaccacctgctcaaacaggggtgtctcaggggcaagtgccaggagctgccctgccaaacccgttgaacatgctaggccctcaggcctcccagttgccttgtccccctgtcacccagagcccgcttcatccaacaccccctccagcctcaaccgccgccggcatgccctcactccagcacaccaccccaccgggaatgactcctccccagcccgctgccccgacacagcccagcactccggtgagtagttccggccagacgcccactccgacaccaggatcagtgccaagcgccacccagacccagtcaacaccgaccgtgcaggcagccgcccaggctcaggtgacgccccaaccccaaaccccagtgcaacccccctctgtcgccacgccacaatcttcacaacagcagcccacccccgttcatgcccagccccctggaacccctttgtctcaagctgctgcgtctatcgataatcgggtcccaaccccatcatctgtggcgtctgctgagactaattctcaacagcctggcccagacgtgccagtgctagagatgaaaacagaaacacaggctgaagacactgagcccgatcccggcgaaagcaagggtgaacccaggtccgagatgatggaagaggatctgcagggagccagccaggttaaagaagagacggatatcgccgaacagaaaagtgaacccatggaagttgacgaaaaaaagcccgaagttaaagtagaggtaaaggaagaggaggaatcatccagcaacggtacagctagccaatctactagccccagtcagccacggaagaagatattcaagccagaagagttgcggcaagcactgatgcccaccttggaagccctctatcggcaggatcccgaaagtctgccctttcgacaacctgtggacccacagctcctcgggatcccggactattttgacattgtgaaaaatccaatggacctctctaccataaaaagaaaactcgatactggacagtaccaagaaccatggcaatacgttgacgacgtgtggttgatgttcaataatgcctggctttacaaccggaaaaccagtagggtatataaattctgttccaagttggcagaggttttcgaacaggaaatcgacccagttatgcagagtctgggttattgttgcgggaggaaatatgagttcagcccacagaccctctgttgctacgggaagcagttgtgcactattcctagagatgctgcctattactcttatcagaaccgttatcacttttgtgagaaatgttttacagagatccagggagaaaatgttacccttggcgacgacccctctcagccgcagactaccatatcgaaggatcagtttgagaaaaaaaaaaacgatactcttgatcctgaacctttcgtcgactgcaaagaatgcggtcgcaagatgcaccagatctgcgttctgcactatgatattatttggccctccggatttgtctgtgacaactgcctgaagaagaccggtcgccctaggaaggagaataaattcagcgccaaacggctgcaaaccacgcgcctggggaaccatttggaggatcgcgtgaacaagttcctgcggagacaaaatcatcccgaagctggtgaagtatttgtgcgggtggtggctagtagcgataaaacggtggaggttaagccagggatgaaatcgagatttgttgactcgggagaaatgagcgagagttttccgtatagaacgaaggcactctttgcgttcgaagagattgacggcgtggatgtgtgttttttcgggatgcacgtgcaggaatatggcagtgactgcccccctcctaataccagacgggtttacatctcgtatctggacagcattcacttcttccgacctagatgcttacgcacagccgtgtaccacgaaatactgatcggataccttgagtacgtgaaaaaactgggatatgtaacaggtcacatctgggcatgccccccgtccgagggggatgattacatattccactgtcatcccccagatcagaagattcctaaacccaagaggctgcaggagtggtacaagaaaatgctggacaaagcattcgctgagaggatcatccacgattacaaagatattttcaagcaggcgacagaggatcggctgacgtccgcaaaggagctcccctacttcgaaggtgatttctggcccaacgtcctggaggaatcaatcaaggagctggagcaagaagaggaggagagaaagaaggaggagtccacagcagcatcagaaaccaccgagggctctcagggggactctaaaaatgctaagaagaagaataataagaaaacaaataaaaataaatctagcatttctcgagcgaataaaaaaaagccatcaatgcctaatgtttctaacgacttgtctcagaaattgtacgctaccatggagaaacataaggaggtattttttgtgattcacctccatgctggacctgtaataaatactctgcctcctattgttgatcctgatcccttactgtcttgtgacctaatggatggccgggatgcctttctgacgctggcaagggataaacactgggagttcagctcactgcgaagaagcaagtggtccaccttgtgcatgttggtcgaactccacactcagggccaggatcgcttcgtctacacatgcaatgagtgcaagcatcacgtcgagacacgctggcattgcactgtctgcgaagattacgatctctgcatcaactgttataatactaagtcccacgcccacaagatggtaaagtggggactggggttggacgatgaaggcagttcacagggcgaaccacagtccaaatctccgcaagaatcaagaaggctcagtatccagcggtgcatacagagtctggtacacgcttgtcagtgtcgcaacgccaattgttctctgccctcgtgccagaaaatgaaacgggtggtccagcacaccaagggctgcaagagaaagacgaatggcggttgcccagtgtgtaagcagctcatcgcactgtgctgctatcatgccaagcattgtcaagaaaacaaatgtccagtgcctttttgtctaaatatcaaacacaagctgaggcagcagcagatccaacaccggctgcaacaagctcagctgatgcggcgtaggatggctaccatgaacacccgaaatgtgccccagcagagcctcccaagcccgactagtgcgcccccaggcaccccgactcagcagccctctacaccacagaccccccagccacccgcacagcctcagcctagtcctgtgtcaatgtcacctgcaggctttccctccgtcgcacgcacacagccacctacaactgtgagcacagggaaacccacgtctcaggtcccagccccaccacccccggcccaacctcctcccgccgcggtcgaagctgccaggcaaatcgaacgagaagcccaacaacagcagcatctctatagggtcaatataaacaactcgatgcctcctggaaggacaggtatgggcacaccggggtctcagatggcccccgtatccttgaatgtccctcggcccaaccaggtgtctggacccgttatgccatctatgccgcccggccaatggcagcaagcgcccctaccccagcagcaacccatgcctggcctgcctcggccagttattagcatgcaggcccaggccgctgtcgctggccctaggatgccaagcgttcagcccccaagaagcataagtccctccgccttacaggatctgttgagaacccttaagagcccctctagcccccagcagcagcagcaagttctaaatatactaaagagcaatcctcagctgatggccgcctttatcaaacagcgaacagccaagtatgtagctaaccagcccgggatgcaaccccagcctggcctgcagagccagccaggcatgcagccacagcctgggatgcatcagcagccgtcactgcaaaatctcaatgccatgcaggctggtgtgccacgacccggggtccccccgcaacaacaggctatgggcggcctgaatccgcagggacaagccctgaatatcatgaaccctggccacaatccaaacatggcttctatgaacccccagtatcgcgaaatgctccggaggcaactgctgcaacagcagcagcagcagcagcagcagcagcagcagcagcagcagcaacaacaagggtccgccggaatggccggcggcatggccgggcatggccaattccagcaacctcagggtccaggcggatacccacccgcgatgcagcagcaacagagaatgcaacagcatctgccgctacagggttcttctatggggcaaatggcagctcagatgggtcaactgggtcagatgggccagcctgggctgggtgcagactccacaccgaacatacagcaggcgttgcagcagcgaatcctccagcagcagcaaatgaaacagcagataggttccccggggcaacctaaccccatgagtcctcagcagcacatgctgtccggacaaccgcaggcctcacacctgccgggccagcagattgcaacctctttgtcaaaccaagtccggagccctgccccagtgcagtctccccgccctcagtcgcagcccccacactccagcccatctccgaggattcagccacagcccagtcctcaccacgtatcaccacaaaccggatcgcctcatccaggcttggctgtgactatggcttcgagtattgatcaaggtcatcttggaaatcccgaacaatctgcaatgttgccccagctcaacacgccaagccgaagcgcactgtccagcgaactgagcttggtcggagatacgacaggggacactcttgaaaagtttgtggaaggactttag

SEQ ID NO: 183949 - DNA, 2934 bp, Artificial Sequence
  Description of Artificial Sequence: Synthetic coding sequence
atgcacgtgcaggagtacggcagcgactgccccccccccaacaccaggagggtatacatatcttacttggacagcatacattttttccggcctaggtgtctgagaacggctgtctatcacgagatccttattgggtacctcgagtatgttaagaagcttggctatgtgacaggacacatctgggcatgtcccccctctgagggagatgattacatttttcactgccaccctcctgatcagaagattcccaagcctaagagactgcaggaatggtacaagaagatgctggacaaggcattcgccgaacgaattatccatgactacaaggatatctttaagcaggctactgaggataggttgacatctgcgaaggagctcccgtattttgaaggggacttctggcccaacgttcttgaagagtcaataaaggagttagaacaagaggaggaggagaggaaaaaggaggagtccacagcagcttcagagacaactgaggtcttcttcgtcattcacctgcatgctggtccggtcattaacactttgccccccattgtggatcctgaccctctcctatcctgtgacctgatggacgggcgcgatgctttccttacgttggccagggataagcattgggagttttcttccctccgccggagtaaatggtccaccctgtgcatgctggttgaacttcatacacagggtcaggaccgctttgtgtatacgtgtaatgagtgcaaacaccacgttgaaaccaggtggcactgtactgtctgtgaagattatgatctgtgtattaattgctacaataccaaatcccacgcccataaaatggtgaaatggggcctgggtctcgacgatgagggtagcagccaaggagaaccacagtctaaatctccccaagagtccaggagactgagcatccaaagatgtatacaaagcctggtgcacgcctgccaatgccgaaacgccaattgctctctaccttcctgtcagaaaatgaagagggtggtccagcataccaaaggttgtaagaggaagaccaatggtggatgtccagtgtgcaagcagctgattgcgctatgctgttaccatgctaagcactgccaggagaacaaatgccctgtgccattctgcctcaacattaagcataagttgcgccagcaacagatccaacacagactgcaacaggctcagctgatgaggaggaggatggccactatgaatacccgcaatgtacctcagcagtccctgcctagtcccaccagcgccccgcccgggactcccacacaacagccctctacgccccagacaccacagcctcccgcccagcctcaaccctcgccagttagcatgtctcccgcggggtttcctagtgtggctagaacacagccacctactacggtctccaccggtaaacccaccagtcaggtgccagcccctccccctccagcacagccgccccctgccgctgtcgaagctgcgaggcagattgagagggaggcccagcagcaacaacacctgtatagggttaatattaataattctatgccacctgggcgcaccggtatggggacacccgggtctcagatggctccagtgtctctcaacgtgcctcgcccaaatcaggtgtctgggccagtgatgccctccatgccgcccggccagtggcagcaagctcccttgccccagcagcagccgatgcccggcttaccacgtcctgtgattagcatgcaggctcaagcggcagtggccggaccacgcatgccttctgtgcagcccccacggtcaatcagccccagtgccctacaggaccttctgcggaccctcaaatccccttcgtccccgcagcaacagcaacaggtgctgaatatactgaaaagcaatcctcaacttatggccgctttcattaaacagaggactgccaagtatgtggccaatcaacctggaatgcagccacagcctgggctgcaatctcagccggggatgcaacctcagccaggcatgcaccagcaaccaagtttacaaaatctgaatgcaatgcaggccggcgtgccaaggcccggcgtccccccccagcagcaggccatgggaggcctcaacccacaagggcaagcactgaacattatgaacccggggcataacccgaatatggcttccatgaacccacaataccgtgaaatgctgagaagacagctgttgcagcagcagcaacagcagcaacagcaacagcagcaacagcagcaacagcagcagggctcagcaggaatggcagggggcatggccggtcatggccaatttcagcagccccagggtcccgggggctacccacccgcaatgcagcaacagcagagaatgcagcagcacctgcctttgcagggttctagcatgggccagatggctgcccaaatgggccagcttggtcagatgggacaaccagggttaggggctgactctactccaaacatacagcaagctctccagcagcggattttgcaacagcagcagatgaagcagcagattggttccccgggtcagcccaaccccatgtcaccacagcagcacatgctctctggccagcctcaggcctctcatctgcctggccaacaaatcgccacatcgttatccaatcaggtgcggagtcccgcccccgtgcagtctccacgcccccagtctcagcccccccactccagcccgagtccccgaatccaaccacagcccagcccccaccacgtgtctcctcaaacagggagcccacaccctggtttagcagtgacaatggcttcatcaattgatcaggggcatctgggcaacccagagcagtccgctatgcttccccagctcaacaccccatcaaggtccgctctgtcttctgagcttagcctggtgggagacaccacgggagatacgttggagaagttcgtcgagggactttag

SEQ ID NO: 183950 - DNA, 7215 bp, Artificial Sequence
  Description of Artificial Sequence: Synthetic coding sequence
atggccgagaacctgctggacggcccccccaaccccaagcgggccaagctttctagccctgggttctccgccaacgatagcacagacttcggatccctgttcgacctggagaacgatctcccagatgagctcattcccaacggaggtgaattaggtctgctgaactccggtaacctggtgcctgacgccgccagtaaacataaacaactgtcagaactcctcaggggcgggtcaggctcttctataaatcccggcattggtaatgtcagcgcctcatcccccgttcaacagggtctcgggggtcaggcacagggccaacctaatagcgccaatatggccagtctgtcagctatggggaagagtccccttagccagggcgattcttccgccccctcattacccaagcaagctgcctcaaccagtggacccactccggcggcatcacaggctctgaaccctcaggcccagaaacaagtaggcctcgctactagctctcctgctacgagccagaccggcccgggcatttgtatgaatgcgaacttcaatcaaactcacccgggtcttcttaatagtaattcagggcactccttgatcaatcaggcttcacagggacaagcacaagtcatgaatggctcgttaggcgcagctgggaggggtcgcggcgcaggtatgccctaccctactcctgccatgcaaggtgcttcctcttcagtcttggctgaaacacttacccaagtttccccccagatgacaggacacgctggactgaacaccgcacaggcaggaggaatggctaagatggggatcacagggaataccagcccttttgggcagccattctcccaggcgggcggccagcctatgggagccacgggtgtgaatccccaactggcgtctaagcagagtatggtaaacagtcttccaaccttcccaacagacatcaaaaataccagtgtcactaatgtcccaaatatgagccaaatgcagaccagcgtgggaatcgtgccaacgcaggccattgcaactggccctaccgccgatcctgagaagcgaaaactgatccagcagcaactggtcctgctccttcatgcacataaatgccagcggagggaacaggcaaacggagaggtgcgcgcttgtagcctgccacattgcaggacgatgaagaacgtgctcaaccacatgacacactgccaggctgggaaggcctgtcaagctatattaggatccccagcgagcggaatccagaataccatcggaagcgtcggcaccggccagcagaacgcaaccagcctgagcaatcctaatcctatcgacccaagcagtatgcagcgggcatacgcagcccttggtttgccatacatgaatcagccccagacacagctccagcctcaggtccccggtcaacagcccgcacagccacagacacaccagcagatgagaactttaaacccactgggcaacaacccaatgaatattcccgctggcgggattaccacagaccagcagcctcctaacctgatcagcgagtcagccttgccaacctcgctcggggcaacgaacccgctgatgaacgatggttctaactccggcaatatagggaccctgtccacgatcccaacagcggctccaccaagctctaccggcgtgaggaagggctggcatgagcatgtgactcaggatctcagatctcacctcgtgcataaactggtacaggctatttttcctactcccgacccagcggctctaaaagataggagaatggagaatctcgtcgcctatgccaaaaaagtggagggcgatatgtatgaatcggccaactccagagatgaatactaccatcttttggccgagaaaatatataagatacaaaaggaactggaagagaagaggaggtcacggctgcacaaacagggcattctcggaaatcaacctgctctgccagctcctggcgcccagccccctgtgataccccaggcccagcccgtacgacctccaaacggacccctgtccctacccgtgaataggatgcaggtctcccagggaatgaatagcttcaaccccatgtccctggggaacgtacaattgccacaagctccgatgggacctagagcggccagtcctatgaaccactccgtacagatgaacagtatgggttctgtgcctggaatggctatcagcccttcaaggatgcctcagccccctaacatgatgggggcccacacaaataatatgatggcccaagcgcccgcacaatcccagtttctgcctcagaaccagtttccatcttccagcggcgccatgtcagttgggatgggacaaccacccgcccagaccggagttagccagggccaggtgccaggagcagccctgcctaacccccttaacatgctcggtccccaagcatcgcagctgccctgcccccctgttactcagagcccattgcaccccactccacctccggctagtaccgcagccgggatgcctagcttgcagcacaccacaccacctggcatgacaccgcctcagcctgcagcccctactcagccttcgacccctgttagctcttccgggcagacgcccacccctacacccgggagcgttcccagtgcaactcagacccaatccactccgaccgtgcaggctgctgcccaggcccaggtaactccacagcctcagacaccagtgcaaccaccctccgtggcgaccccacagagctcacagcagcagccaacccctgttcacgctcagccacccggcacacccctgtctcaggccgctgcttctattgataatagagtgcctacgccttcctctgtggcaagtgcagaaacgaattctcagcagcccggacctgatgtgcccgttctcgagatgaaaactgagacccaggccgaggataccgaacccgacccgggcgagtcaaaaggagagcctcggagcgaaatgatggaggaggaccttcagggcgctagtcaggtaaaggaggaaactgatattgctgagcaaaaatccgaacccatggaagttgatgagaaaaagccggaggttaaggtggaagttaaagaggaggaggaatcctctagtaatggaaccgccagtcagagcacaagtccatcacagcccaggaagaaaatctttaagccagaggagctccgtcaggccttgatgcctaccttggaagctttatatcgccaggacccagaatccctgccgtttagacaaccagttgatccccaactcctcgggattccggactattttgacattgtcaagaatccaatggacctgtctacaataaaacgtaaactcgacacgggacagtatcaggagccttggcagtatgtggacgacgtgtggttgatgtttaacaatgcctggctgtataatagaaaaactagccgcgtgtacaagttttgtagtaagctcgccgaagtcttcgagcaggagattgacccagtcatgcagagtttgggctactgctgtggacggaagtatgagttcagcccacagaccttgtgctgctacggaaagcaattgtgtacaatcccccgcgatgctgcctattattcttaccagaacagatatcatttctgtgagaagtgtttcacagaaattcagggcgagaatgtgactctgggcgacgatccctctcagccacagacaacaattagcaaggatcagtttgaaaaaaaaaagaacgatactctggaccccgagccattcgtggattgcaaagagtgtggcagaaaaatgcaccagatctgtgtactgcactacgacatcatatggcccagtggattcgtgtgtgacaactgtttaaaaaagactggccgaccccgaaaagagaacaaattttcggctaaacgactgcagactacccgcctcggtaaccatctggaagaccgtgtgaataaattcttacggcgacagaatcatccggaggctggggaggtgttcgtgcgtgtggttgcctcaagtgacaaaaccgtggaggttaagcctggaatgaagagtagattcgtggactctggagaaatgtccgagagctttccatatcggaccaaagctctctttgcctttgaagaaatcgacggcgtggacgtctgtttctttggcatgcacgtgcaggaatacggtagcgattgcccccctccaaacaccaggcgggtttacatcagctacttggacagcattcacttttttcggcctcgctgtctgaggacggctgtgtaccacgaaattctgattggatatcttgagtacgttaagaaactgggctacgtcacaggtcacatttgggcatgtcccccaagcgagggggacgattacatcttccactgtcatcctcctgaccagaaaatacccaagccgaagcgacttcaggagtggtacaaaaagatgctcgacaaagcattcgcagagaggattatccacgactataaagacattttcaaacaagctaccgaagaccgccttacttctgccaaagagctgccttacttcgagggcgatttctggcctaatgtgctggaagaatcgatcaaagaattggagcaagaagaagaagaaagaaaaaaagaagagagcaccgcggcaagcgaaactaccgaagggtcccaaggggactcaaaaaacgctaaaaagaaaaataataaaaaaacaaacaaaaataaatcctccatttcccgggccaataaaaagaaaccctctatgcctaacgtcagcaacgatctgtcgcagaagctctacgctacaatggaaaaacacaaggaggtgttctttgtgattcacctccatgcggggcccgttatcaatacactcccaccaatcgtggatccagatcctctactgagttgtgatctgatggacggacgggacgctttccttactctagcacgagataaacactgggaattttcttccctgagacgaagcaagtggagcactctgtgtatgcttgtcgagctgcatacgcaagggcaggacagattcgtatacacttgtaacgagtgcaaacatcacgtggaaacacgatggcactgtactgtatgcgaggattacgatctgtgcatcaattgctataacaccaaatcccatgcgcataaaatggtcaagtggggactggggctcgacgacgagggttcttcgcagggcgaaccccaatccaagtccccacaggaatcaagacggctgtccatacagcggtgcatccaaagcctcgttcatgcctgccaatgccgcaatgccaattgcagcttgccgtcttgccaaaaaatgaagagagtcgtgcagcacaccaaaggatgtaagcgaaagactaatgggggctgccctgtgtgcaaacagctgatagctttatgctgttatcatgccaagcactgccaggagaataaatgccccgtaccattctgcctaaatataaaacataagcttaggcagcagcagatacaacatagactccagcaggctcagctgatgcggcggaggatggctactatgaacacgcggaacgttcctcaacagtccttaccttcccctacttctgccccgcccggaacacctacacagcagccaagcactccacagacgcctcagcctcctgctcagccacagccgtcacccgtctctatgtcacctgccggtttcccctctgtcgcacgcacccagccacctacgactgtcagcactggcaaaccaacctctcaggtgccagcgcctccacctccagcccagccacctcccgccgccgtggaggccgctaggcagattgagagggaagcccagcagcagcagcacttgtaccgggttaacattaacaactctatgcctcccggccggaccgggatggggacccccgggtctcagatggcacccgtcagccttaacgtgccacgcccaaatcaggtctctggaccagtaatgcccagtatgcccccaggtcagtggcaacaagctccgctaccccaacaacagccaatgcccgggttgcctagacctgtcatatccatgcaggctcaggctgccgtcgctgggcccaggatgcccagtgttcaaccccctagatcaatcagtccatcggctttgcaggatcttcttaggaccttaaagtccccaagttcgccacagcagcaacagcaggtcctcaatattctgaagagcaatcctcagttaatggccgcatttattaaacagcggaccgcaaagtacgtcgcgaatcaaccggggatgcagccgcagccaggattacaatcccagcctgggatgcagccccaacctggtatgcatcagcagccaagcctgcagaatctgaatgcaatgcaggctggcgttccgcggcctggagttcctccccagcagcaggccatgggtggactcaacccacaaggacaggctctgaatatcatgaacccgggacataatcccaacatggcctccatgaatccccagtaccgcgaaatgctcaggcgacagctgctacagcagcaacaacagcagcagcaacagcaacaacagcaacagcagcagcaacaggggagcgcaggaatggccggcgggatggccggacatggacagtttcaacagccacaggggcccggaggctaccccccggccatgcagcagcagcagagaatgcagcagcacttgcccctgcaagggtcctcaatgggacagatggctgcacagatgggccaactgggccaaatgggccaacccggccttggggctgattccacacccaacatacagcaggccctacagcagcggatcctccagcaacagcagatgaaacagcagattggctcgccaggacagccgaacccaatgtctccccagcagcatatgctttcggggcaaccgcaggcatcacacctgccaggacaacagatcgcaacctctctgtcgaatcaggtgcgctcccctgcgcctgtgcagtctcctcgaccgcagagtcaaccgccacacagctcgccttccccaaggatccagcctcagccttcaccccatcatgtgtcaccccagaccggcagtcctcaccctggtctggccgttaccatggcaagtagcatagatcagggacaccttggtaatccagagcagtccgccatgctcccacagcttaatacgccctctcggtctgccctgagtagtgaactttctctggtcggagacacgactggagatactctcgaaaaattcgttgaaggactatag

SEQ ID NO: 183951 - DNA, 7419 bp, Artificial Sequence
  Description of Artificial Sequence: Synthetic coding sequence
ctgcggggcgccgtggccgtggccgagatctggccccccccccccccccccggactgcgcccaccatccccatccgctcctgcacgacctctggccgcacgcgcccgaagcagtcccagccagcccgcaggcccccccacacctgtgagggcattggctggtcctgcggctcgcgcaagaggctgctttcgggagcaggtgaagatggcggagaacctgttggatgggccccccaaccctaaaagagcaaagctttcctccccaggattctccgcaaatgacagtaccgattttggcagcctcttcgatctggaaaatgacctcccagatgagctaatccctaatggaggggaactgggtctgctgaactcaggaaatctggtaccggacgccgctagcaagcataagcaactgtcagaactgttacgcggagggagcggctcatccattaatccagggattgggaacgtttctgcctcatcccctgtccagcagggcctcggcggccaggctcagggtcagcccaacagcgcaaatatggcgagtttatccgctatgggcaaatctcccctgtctcagggagactcctcagccccctctttgccgaagcaggcggctagcacaagcgggcccacaccagcagcgtcacaagccctgaatccgcaggctcagaagcaggtcggtctcgctacgtcgtcaccagccacttctcagaccggccctggcatttgcatgaatgcaaactttaatcagacgcatcccggactactgaatagcaacagcggacatagcttaatcaatcaggcaagccaggggcaggcccaggtgatgaatggcagcctcggcgcagcaggccgaggtaggggcgcggggatgccatacccgactccggccatgcagggagctagttcatccgtgttggccgaaaccctgacacaggtgtcaccccagatgaccggacacgctggtctaaataccgcccaggccggcgggatggccaaaatgggcatcaccggaaataccagtccttttgggcaaccattcagtcaggccgggggccagccgatgggcgccacaggggtcaatcctcagctcgcctcaaaacaaagcatggtcaacagccttcctacctttcctacagacataaaaaatacgtcagtgacaaacgttcctaatatgtcacagatgcagaccagtgtggggattgttcctacgcaggccatcgcgaccggccctaccgctgacccagagaaacggaagctgatccagcagcagctcgtgttgctgttgcatgcgcacaagtgccaaagacgcgagcaggcaaacggagaggttagggcctgcagcttgccccattgtcgcactatgaagaacgttctgaaccacatgacacactgtcaggccggtaaggcgtgtcaggccatacttggttccccagcctctggtatccagaacacaatcggctccgtaggcactggccaacagaatgcaacttccttgagcaacccaaaccccatcgacccttcctctatgcagagggcctatgctgctttagggctcccatacatgaaccagccacagacccagctgcagcctcaagtgcctggccaacaaccagcccagccccaaacacaccagcaaatgcgcaccctgaaccccctgggcaataacccgatgaacatcccagctggtggtattacaaccgatcaacagccgcctaatcttatctccgagagtgctcttccaactagcctgggcgccactaatcctctcatgaacgatgggagcaactcaggcaacatcggaacgctcagtactataccgacagccgcgcctccttccagcacaggagtgcgcaagggttggcacgagcacgtcacccaggacttgcgctcgcacctggtgcataaactagtgcaagcaatcttcccaacccccgatcccgcggctctgaaagatcgccgcatggaaaacctggtagcctacgctaagaaagtcgagggcgacatgtacgaatctgctaactcacgggatgagtattaccaccttctagcggagaaaatttacaagattcagaaggaactggaggagaagcgccgtagccgattgcataagcaagggatcctgggaaatcagcctgccctgcccgcaccaggagcccagcccccagtgatcccacaggcccaaccagtgaggccccccaatggtcccctgagcctgccggtgaaccggatgcaggtatcccagggaatgaactcatttaacccaatgtcactgggcaatgtacagctccctcaggctccaatgggaccacgcgccgctagcccaatgaatcattctgtccaaatgaacagcatgggaagcgtgcccggcatggcaatcagtcccagcagaatgccgcagccccccaatatgatgggcgctcacactaacaacatgatggcccaagcacctgcgcagtcccaattcctgccacagaatcagtttccaagctcaagcggcgccatgtctgtcgggatgggccagccaccagcccaaaccggcgtgtcccaaggtcaggtgcccggggcggcattgcccaatcctctgaatatgttaggcccccaggctagccaactcccgtgtcctcctgtcacccagagccctctacatcctacgcctcccccagcgagtacagcggccggcatgccatctttgcagcacactacccctcccgggatgacccccccgcagcccgccgcgccaacacaacctagcacacccgtgagtagttctggacagactccgacaccgaccccgggaagcgtgcctagcgccacccagactcagtctacacccaccgtgcaggctgcagcgcaggcccaggtgacaccacaaccgcagactcctgttcagcccccttctgtggccacgccccagtcttcacaacagcagcctactcccgtccatgctcagccaccaggaacaccactctcccaagccgcagcttcaattgataacagagtgcctacgcctagcagcgtcgctagtgcggaaacgaactctcagcaacccggaccagacgtgccagttctggaaatgaagaccgaaacccaggccgaggacacagaaccagacccaggtgagtcaaagggtgagcctcgcagtgagatgatggaggaagatctgcagggggcaagtcaggtcaaagaagaaacagatattgccgagcagaagtcggagcccatggaggtggatgaaaaaaagccagaggtgaaggtcgaagtcaaagaggaggaggaatccagtagtaacgggaccgcatcacagagcaccagcccgagtcaaccgagaaaaaagatcttcaagccagaggagctgagacaggccctgatgccaactctcgaggccctttacaggcaggatcctgaatctcttcccttcaggcagccagttgacccacaactcctaggaatcccagactattttgacatcgtgaagaaccccatggatctgagcacaataaaaaggaagctggataccggccaatatcaggaaccctggcagtatgtcgacgatgtctggttgatgtttaacaatgcatggttgtataatagaaagacatcccgagtgtataagttctgctccaagctggcagaggtcttcgagcaagaaatagacccagtgatgcaatccctgggatactgctgtggcagaaagtatgagttttcccctcagaccctgtgctgctacggtaaacagctttgcaccatcccccgggacgctgcctattattcataccaaaaccgatatcatttctgcgagaaatgttttaccgagattcaaggggaaaacgtgactctcggagacgatccatctcagccccagaccaccatctccaaggatcagtttgaaaagaagaagaacgacacactcgaccctgagcctttcgttgattgtaaagagtgcggacgaaagatgcaccagatctgtgtcctgcattatgatattatatggcctagtggcttcgtgtgtgataattgcctcaaaaagaccggacggcctagaaaagagaataaatttagtgccaaaaggctgcaaacaacccggctcggaaatcacctcgaggatagagtcaataagttcctccggcgccagaaccatcctgaggcaggcgaagtctttgtgcgggttgtggcctccagtgacaagactgtggaggtgaaacccggtatgaaaagccgctttgttgattccggcgagatgtccgaatctttcccttatcggacaaaagccctattcgcttttgaggaaatagacggcgtagatgtgtgcttcttcggaatgcacgtgcaagagtatggatctgactgtccgccacccaatacacgacgcgtgtacatatcctatttggactcaatccacttctttagaccacggtgcctgcggacagctgtgtaccacgaaattctgattggctatctggagtacgtgaagaaactaggctacgtgacaggccacatctgggcctgtcctccaagcgaaggggacgattatatttttcactgtcatcccccggaccaaaagatccccaaaccaaagcgcttacaggagtggtataagaagatgctggacaaagccttcgcagagaggatcattcacgactacaaggacatcttcaagcaggcgaccgaagaccggctgacatccgccaaggagctgccgtatttcgagggcgacttctggccaaatgtgcttgaagagagcatcaaagagctggagcaagaggaagaggaacggaagaaagaggaaagcacagctgcatccgagaccactgaagggtcacagggggattccaagaatgctaagaaaaagaacaataaaaagacgaataaaaacaaatccagcatttcccgggccaacaagaagaagccctcaatgcctaatgtctctaatgatctgtcccagaaactctatgccaccatggagaaacacaaagaggttttcttcgtgatccacctgcatgctggcccagtgattaacacgctgccaccaatcgtggatcctgacccattgctcagctgcgatctgatggatggacgcgacgcatttttgaccttagccagagataaacattgggaattctctagtctccgtagatctaaatggtccaccctgtgtatgctagtggaactccacacccaagggcaggatcggttcgtctacacatgtaatgaatgcaaacaccacgtggaaacccggtggcactgcacagtttgtgaggactacgatctgtgtattaactgttataatactaaatctcatgcccacaaaatggtcaaatgggggctcggcctagacgacgaggggtcctcccaaggagagcctcaaagtaaaagtccacaggaatctcgcaggctgagtattcagagatgcattcaatcacttgtgcatgcatgccagtgccgtaacgccaactgctccctgccaagctgtcagaagatgaagcgagtggtgcagcacaccaaaggttgtaaaagaaaaacgaatggcggctgtcccgtttgcaagcagctcatcgctctttgctgttaccacgctaagcactgccaggaaaataagtgccctgtgcctttttgcctgaacattaaacacaaactgcggcagcaacagatccagcacagacttcagcaagcacaacttatgcggcggcgcatggcgacaatgaacacccggaacgtcccccaacagagtcttccaagcccaacgtccgcccccccgggaacccctacacaacagccatccacaccacagactcctcagcctcctgctcagccacagccctcacctgtctctatgagccccgcagggttcccatccgttgcaagaactcaaccccccaccacggtcagcacagggaaacccacttctcaggtgccagcaccaccgcctcccgcacagccgcccccggcagctgtagaagcagcacgccagattgagcgcgaagctcagcagcagcaacatctgtatagagtgaatatcaataactctatgccccccggccgcactgggatgggcaccccagggtcccagatggcccccgtttcacttaacgtgcctcggcctaaccaggttagtggaccagtgatgcctagcatgccaccgggccagtggcaacaggctcctctaccccagcagcaacccatgcctggcttacctcggcccgtgatctctatgcaggcccaggcagccgtagcaggcccacggatgcccagtgtccagccaccaaggagcatctccccgtctgcactgcaggatctgttgagaactttgaagtccccatcgtcgccacagcagcagcagcaggtcttgaatatcctcaaatccaacccacaacttatggctgcgttcattaagcaaagaaccgccaagtatgtcgccaatcaacccggcatgcagccccagccgggcctccagagccagcctgggatgcagccacagccaggcatgcatcagcaacctagcctgcaaaacctgaatgccatgcaggccggagtacctcgacctggagtgcccccccagcagcaagccatgggaggcttaaatccacagggccaggctctcaacataatgaatcctggccacaatccgaatatggcatctatgaatccgcaatatcgagagatgctcaggcgacagttgctccagcaacaacaacagcagcagcagcagcagcaacagcaacagcagcagcagcaaggtagtgcaggcatggccggcggaatggctggccacgggcagtttcagcagccccagggccctggcggctatccaccagccatgcagcagcaacagcgtatgcagcaacaccttccgctgcaaggcagctcaatggggcagatggctgcgcagatgggacagctcggccagatgggccagcccggcttgggcgccgactccacgccaaatattcagcaggctttgcaacagagaatcctgcagcagcagcaaatgaagcagcagattgggtctccagggcagccaaacccaatgagtccgcagcagcacatgctgtccgggcaaccccaggcatcccacctgcccgggcagcagattgcgaccagtctgtccaatcaggtaaggagccccgccccagtgcagtcgcccaggccgcagagccagccacctcacagctctccgagtcccagaattcaaccccagccctcaccacaccatgtttcccctcagaccgggtccccccacccggggttagccgtcacaatggcctccagcatagaccagggtcacctgggcaatcccgaacagagcgcgatgcttccgcagcttaacactccctcaaggtcagcactcagtagtgaactgtccttagtcggtgacactacaggcgacacgctggaaaagtttgtggaaggattgtag

SEQ ID NO: 183952 - DNA, 1782 bp, Artificial Sequence
  Description of Artificial Sequence: Synthetic coding sequence
atggccaccagcaacaacccccggaagttcagcgagaagatcgccctacacaatcagaagcaggcagaagagactgccgcattcgaggaggtcatgaaggatcttagcctgacacgggcagctagattgcagctccagaaaagtcagtatctccaactgggtccctccagggggcaatattatggtggaagccttcctaacgtgaatcagatcggcagcggcacgatggatctacctttccagaccccatttcagtcgagtggccttgacacctccagaactacccgacatcacgggctcgttgatagagtatatagagaaaggggtcgtttgggaagtcctcacaggcggcccctgtcagtcgataagcacgggagacaagcagacagctgcccgtacgggaccatgtatctgtctcccccggccgacacctcttggagaaggactaatagcgattctgctctgcatcaatccacaatgacgcctactcagccagaatcctttagctctggctcacaggatgtgcaccagaagcgggtgttgctccttactgttccaggtatggaggaaaccacaagtgaagctgataaaaacttgtctaagcaggcctgggataccaagaaaaccggaagccggccaaagtcatgcgaagtccctggcatcaatattttcccatccgccgatcaggagaatactactgccctgattcccgcaacacacaacactggcggtagcttgcccgacctgactaacattcactttccgtctcccttacctacccctctggacccagaggaacctacctttcccgctctgtcctcaagctcaagcaccggcaacctggccgctaacctgacgcatctgggcatcggaggcgccggccagggaatgagtactcccggatctagtccacagcacaggcctgccggagtttctcctttgagcttaagcacagaagctaggagacaacaggcttctcccacattgtccccgctgagccccatcactcaggcagtcgccatggatgccctttcattggagcagcagctgccttacgctttctttacacaggcaggttcccagcagcctcctccgcagcctcagccgccacccccccctccaccggctagccagcagccgccaccaccgccaccccctcaagcccccgtgagacttccacccggaggacctttgctgccttcagcttctcttacacgcggaccccagccacctcccctggcggtgacagtgccctccagtctgccccaaagtcctccagaaaatcccgggcaaccttccatgggcatagacattgctagtgcccccgccctgcagcagtatcgaacaagcgccggatccccagcaaaccagtctccgactagtcccgtatccaatcagggattcagcccagggtcatctccccagctggaacagtttaacatgatggagaacgccatatccagcagctctctttacagccctggaagcacgctgaactatagtcaggccgctatgatgggtcttacaggctctcatggttccttaccggattcccaacaactcggctatgcctctcactcggggattccaaatatcatcctgaccgtcacaggggagtccccacctagtctgtccaaggaactgacaagccacagaggccatctcccagatggtcctccggtctcaggtcatgccggaacactcccgcttagtcggccagacggcgcctcccccgccagaggccggccctgttcagtgcctcgacaacgcccaagcctatag

SEQ ID NO: 183953 - DNA, 1905 bp, Artificial Sequence
  Description of Artificial Sequence: Synthetic coding sequence
atggccaccagcaacaacccccggaagttcagcgagaagatcgccctccataaccagaagcaggcagaagaaaccgctgcttttgaggaggtgatgaaggatttatctttgacgcgtgcggcgcgattacaactccagaagtcccaatatctccaacttgggccaagcagaggccagtactacggggggtcccttcctaacgtgaatcagattggttcaggaaccatggacctccctttccaaacccccttccaaagttctggactcgacaccagccggacaactagacatcacggactggtggaccgcgtgtaccgagagagaggccggctcggctctccccatcgccgccccctctctgtggataagcacggtagacaggcagattcctgcccttatggcacaatgtacctgagcccgcccgctgacacatcttggcggcgtactaacagcgacagcgccttgcaccaatccacaatgacacccacccagccggaaagctttagcagtgggtctcaggatgtacaccagaaacgcgtgctcctgcttaccgtccccggcatggaggaaactacgtcagaagctgacaagaatctaagcaaacaagcctgggacaccaaaaaaactggatcacgtcctaagtcctgcgaagtgccaggaatcaatatcttcccctcagccgatcaagaaaataccaccgctctcatccccgctacacataataccggcggttctctgcctgatctgacgaacattcacttccctagccccctgcctactcccctggaccccgaggaacccactttcccagcactaagctcgagttcttccaccggaaacctcgccgcaaacctcacccatttaggcattggaggagcgggacaggggatgtcgacgccgggatcatctccacagcatcgcccagccggcgtctcccctctcagcctgtcaactgaagctaggcggcaacaggctagccctacactgagtccattgtcaccaatcactcaggcggtagcaatggacgcactgtcactcgaacaacagctgccttatgctttcttcactcaagcgggctcccaacagccgcccccacagccgcaacctcccccccccccccctcctgccagccagcaacctccacccccacccccaccccaggcaccggttaggcttccacccggagggccattgctcccaagcgctagccttactagagggccacagccgccccctttagccgtgaccgtgccatcatcgctcccgcagtcccccccagaaaaccccggtcagccctctatgggcatagatattgccagcgctccagccctgcagcaataccggacttcggcagggagccctgcaaaccagagtccgacatcccccgtctccaaccagggcttttcaccaggctcttccccccagcatacaagcacactgggatcagtatttggcgacgcctactacgaacagcagatggcagcccggcaggctaacgctctcagccatcagctggaacagtttaatatgatggagaacgctattagcagtagttcactgtatagccctggaagcactctgaactactcccaagcagcgatgatgggcttaactggtagtcatggctccctgcctgacagtcagcagctgggttatgcatctcacagtgggatcccaaatattattctcacagtgaccggcgagtctccacctagcctttcgaaggagctgacctcctcactggccggcgtcggcgatgtgtctttcgactctgatagccagttcccgctcgatgaactgaaaatcgatcccctcaccctggacggcctgcacatgctcaacgaccccgatatggttctggccgatcccgctaccgaggacaccttcagaatggaccgcctatag

SEQ ID NO: 183954 - DNA, 1953 bp, Artificial Sequence
  Description of Artificial Sequence: Synthetic coding sequence
atggccaccagcaacaacccccggaagttcagcgagaagatcgccttgcataaccagaaacaggcagaggagacagctgcatttgaggaagtgatgaaggacctctccctgactagggctgcacgcctgcagctccagaaaagccagtacctccagctggggccaagccgcggccaatactacggcgggagtctcccaaatgtgaatcagataggttccgggacaatggacctgcctttccagccttcaggcttccttggggaagcactggcagccgcccccgtcagtctaaccccctttcagagttctggcctcgacaccagcaggacaactagacatcatggtcttgttgatcgggtctaccgcgagagaggtagactggggtcaccccataggagaccactatcagtcgataaacatggtaggcaggcagacagctgtccttatggtactatgtacctctccccacccgcagatacgtcttggcggcggactaactctgatagtgctcttcatcaaagtaccatgactcctacccaacctgaatcctttagctcaggtagccaggacgtgcaccagaaacgtgttcttctgctaacagtgccaggaatggaggagacaacttctgaagccgacaaaaacctctccaagcaggcatgggatactaagaagactggcagtagacctaagtcttgcgaggttccaggaatcaatatctttccaagcgcagaccaggagaacactacagcgctcattccggcaacacacaatactggcgggtctctgccagacctcacaaacatccatttcccaagtcctcttcctacccccctagacccagaggagcccacctttcccgcgctgagttcctcctcttccactggaaacctcgctgctaacctgacacatttgggcattggcggcgcaggtcaggggatgagtacaccgggcagcagcccacagcatagacccgcaggggtttcgccattgtccctcagtaccgaggcccggcgccagcaggcttctcctacacttagccctttgagccccatcactcaggcggtggctatggatgcactgtcactggagcaacagttgccgtacgcatttttcactcaggcgggttcacaacagccacctccccagcctcagccccccccaccccctcctcctgcaagccaacagcctccccctccaccgcccccacaagccccggtgcgcttgcctcccggcggtcccttgctgccctcagcttcactcaccagaggcccacagcctcctccgctcgctgtgacagtgccctcgagcctccctcagtccccgcctgagaatcccggccaaccatccatgggtattgacatagccagtgcccccgccctccagcagtatcgaacttctgcagggtcacccgccaatcagagccctacctcacccgtgtccaaccaggggtttagccctggatccagtccccagcataccagtacgttgggctccgtctttggtgatgcatactacgagcagcaaatggcagcgcgacaagccaatgccctgagtcaccagctggagcagttcaatatgatggaaaatgctatctcgtcttctagtttgtactcaccgggaagtacactcaactatagtcaggccgcgatgatgggtcttacagggtcccacgggagcctgcccgatagtcagcagctaggctatgcctcacactcaggcatcccaaacatcattctgactgtgactggcgagagtccacccagtctcagcaaagagttaactagctccctggccggggtgggcgacgtgagcttcgatagcgactcgcaattccccctcgacgaattgaagattgatccccttacccttgacgggcttcacatgctgaacgacccagacatggtcctcgctgaccccgcaactgaagatacatttcgcatggacaggctatag

SEQ ID NO: 183955 - DNA, 2082 bp, Artificial Sequence
  Description of Artificial Sequence: Synthetic coding sequence
atggccaccagcggcgccaacggccccggcagcgccaccgccagcgcttcaaaccccagaaagttttcagaaaagattgcattgcagaagcaaagacaggcagaggagactgccgcctttgaggaggtgatgatggacattggttccacaagactgcaggcccaaaaacttaggctggcctacaccagatctagccattacggagggtcattgccaaatgtcaatcagattgggtcaggcctggcagaattccagagccctctgcattccccactcgactcaagcagatctacacgtcaccatgggctggtggaacgggtccagcgggacccaagaaggatggtttctccactgaggcgctatactcgacacatagattcaagcccctattcgcctgcttatctgtcccctccgcccgagagtagctggcgccgcacgatggcctggggcaactttccagctgagaaaggacaactgttccgcctaccgtctgccctaaatcgtaccagtagcgactctgcactgcatactagcgtgatgaacccttccccccaggatacttaccctggcccaacgccaccatccatccttccatccagaaggggcggtatcttggacggggaaatggaccctaaggtacctgcaatcgaggagaatctcctggacgacaaacacctgctaaagccctgggatgcaaaaaagttgtctagctccagcagcagacctcggtcttgtgaagtcccgggcattaacatcttccctagcccagatcagcctgccaatgtgcccgtattgcctcctgcgatgaataccggcggaagtttacctgacttgaccaatctacatttcccccctccactgcctacacctcttgaccccgaggaaaccgcgtatcctagcctgagtggtgggaattctactagtaatctgactcatactatgactcatctgggtatctctagaggaatgggccttggtcccgggtatgatgcacctggactgcattcgcctctgtctcatccatctctccaatcgagcctgtctaatcctaatctacaagccagcctctcttcccctcagccgcagctccaggggagccattctcacccgagcctcccagcgtcctcactggcacgacacgtgctgccgactacttccttaggccacccctctctctctgcaccagcactgagctcttctagctctagttcttcgactagttcgcctgtactgggcgccccatcctatccggcttcaacccctggtgcttctccccaccatcggagggtgcctctctccccactgtccctcctggccggcccggccgatgcgcgaagaagccagcagcagctcccgaaacagttctcaccaactatgtcgccaactctgtcaagtataacccagggagtgccactggatacaagtaaactgagcactgaccaacggctcccaccctacccatacagttctcctagcctggtattacctacgcagcctcatacacctaagtctctccaacagcccgggctgccaagtcagtcttgtagtgtgcaatctagcggaggccaaccacctggaagacagtcacactacggcacgccctatccacccggcccatcaggacacggtcagcagtcctatcaccgaccaatgtcagatttcaacctggggaacctggaacaattcagcatggagagtccctcggcttctctcgtgttggacccccctggattctctgaagggcctggctttttgggaggtgaggggccaatgggaggcccacaggatcctcataccttcaaccatcagaatctcacacattgcagccggcacgggagtggacccaacatcatcctaacgggggattcatcccctggctttagcaaagagattgctgcagcacttgctggtgtccccggatttgaggtatccgctgccgggctcgaactggggcttggacttgaggacgagctgcgcatggagccactcggattggaaggtcttaatatgctcagtgatccatgcgcactgctaccagaccccgccgttgaggaaagctttcggtctgacagactccagtag

SEQ ID NO: 183956 - DNA, 1860 bp, Artificial Sequence
  Description of Artificial Sequence: Synthetic coding sequence
atggccgccagccccggcagcggcagcgccaacccccggaagttctcagaaaaaatcgctctgcatactcagcggcaggctgaggagactcgagctttcgaacagctcatgacagacctgactcttagccgagtgcaattccagaaactccagcaactgcgcctcacccagtaccacggcggcagcctgccaaacgtatcccaactgaggtccagtgccagcgaattccagccaagcttccatcaagccgacaatgttagagggactcgtcatcacggactggtagaaagaccgtcgaggaaccgcttccacccacttcaccgtcggtcaggtgataagccaggcaggcagttcgacgggtcagcatttggggcaaactacagctcacaacccctggacgagtcctggcctagacagcagcctccttggaaggacgagaagcaccctggtttccggctcaccagcgctcttaaccgtaccaactctgactccgccctacacacatctgccctgtccacaaaaccccaggatccatacgggggagggggacagagcgcctggccggccccatatatggggttttgcgacggcgagaataacggccacggcgaagtggcgtcgtttcctggacccttgaaggaggaaaatctcctgaacgtccccaagcctctgcccaaacagctctgggagaccaaggaaattcagagcctgagcgggcgccctagatcctgtgacgtcgggggaggtaatgccttcccacacaacgggcagaacctgggcttatcaccttttctaggaacgctgaataccggggggtccctacccgaccttaccaatttacattattccacaccattgcccgccagcctggacaccaccgaccaccactttgggtcaatgagcgtgggtaactcagtgaataacatcccggcagccatgactcacctgggcattcgttccagttccgggctccagtcaagccgtagcaatcccagcatccaggcaaccctcaacaagaccgtgctcagtagtagcctaaataatcatccgcagacctccgtccctaatgcttcagctctccatcctagtttgcgactgttcagcttatcaaacccctccctctctacaacaaacctgtctgggccatctcggagaaggcagcctccagtgagtccgctgacactgtctcctggtcccgaggcccatcagggtttcagccgccagcttagttccacgtcaccattggccccttatccaacaagccagatggttagttccgatagaagccagctcagcttcctgcccactgaggctcaagcacaagtgagcccccctccaccttatcccgctccgcaggaactgactcaacctctgttacaacagccccgggcaccagaggctccagcacagcagccacaggcagcctccagcctaccacaatcggattttcagctcctgcctgcccagggcagcagcctcacaaacttttttcccgatgtgggcttcgatcagcagagcatgaggcctggccccgctttccctcaacaggtgccactggtgcagcaggggagcagagagcttcaggactcttttcacctgaggccctctccctattccaactgtggaagcctcccgaatactatccttcctgaagactcctcaacctcactgtttaaggacctgaacagcgccctagccggcctgcctgaggtgagtctcaacgtagatacacccttccctctcgaagaagagttacagatcgagcctctcagcctggacggcctcaacatgctgagcgattcctcaatgggtctccttgacccatctgtggaagaaactttcagagccgacagactgtag

SEQ ID NO: 183957 - DNA, 1857 bp, Artificial Sequence
  Description of Artificial Sequence: Synthetic coding sequence
atggccgccagccccggcagcggcagcgccaacccccggaagttcagtgagaaaatcgcgctgcacacccagcgccaagcagaagagacaagggcttttgagcagctgatgacagacttaactctgtcacgcgtgcagtttcaaaagctgcagcagctgaggctaacccagtaccacgggggctctctccccaacgtatcccagctgagatcatctgcctctgagttccaaccatctttccatcaggctgataatgtgagaggtactcgtcatcatgggttggtggagcgcccttccagaaatcgattccaccctctgcacaggagatcaggtgacaaacctggtaggcagttcgatggatctgccttcggtgctaattacagctcacagccattagatgagagctggcctcgtcagcaaccaccctggaaagacgaaaagcaccccggcttccggctgaccagtgccttgaatcgcacaaacagtgacagcgctttgcacacctcagccctgagtactaagcctcaggatccttatgggggcggcgggcagtcagcctggccagctccatacatgggattctgcgacggagaaaacaatgggcacggggaagttgcttcctttcccgggcctctcaaagaggagaacttgctcaacgtaccaaagccactgcccaaacagctgtgggagacgaaggaaattcagagcttaagcggacggccgagatcctgcgatgtggggggcgggaacgccttcccccacaatggccaaaatttaggactgtcgccctttctaggaacacttaatacgggaggttccttgcccgatctaactaacctccattacagcaccccactgcccgcaagccttgatacaactgatcatcattttgggtcaatgtcagtgggaaacagtgtgaacaacatccctgcggcaatgacacacctaggaattcgaagttcctctggtctccaatcctcgaggtctaacccctccattcaagctacgcttaataagacagtgctgagttccagtttaaacaaccacccacagacctcagtacccaacgctagcgcactgcaccccagcctcaggctgttttctctcagcaacccaagcctgtctacaaccaacctatcaggtcctagtcgcaggaggcaaccaccggtctctcctttaaccctgtcaccagggcctgaagcgcaccaaggttttagccgacagctatcctccacaagccccttggccccttacccaacctcccagatggtgagtagtgaccgcagccagctgtccttcctgccgacagaagctcaagcccaggtgtcacctccgcctccgtaccccgctccccaagagctgactcagcctctcctccagcagcctagggcgccagaggcaccggcacagcagcctcaagccgcttcttccttgcctcagtctgactttcagctacttccagcacaggggtctagcctgacgaacttttttcctgacgttggctttgatcagcagagcatgcgcccagggcccgcattccctcagcaggttccactggtgcagcagggctctagagaacttcaggacagctttcacctgaggccatccccctactctaactgcggcagcttgcctaacactatcttgcctgattcctccacctcactgttcaaggacctcaatagtgccctcgccggcctgcccgaggtaagcctgaatgtggataccccattccctctggaggaagaacttcaaattgagcccctgagtctcgatggcctaaacatgctgagtgattcaagcatggggctgttggatcctagcgtcgaagaaaccttcagggccgacaggctttag

SEQ ID NO: 183958 - DNA, 1749 bp, Artificial Sequence
  Description of Artificial Sequence: Synthetic coding sequence
atgaccgacctgaccctgagccgggtgcagttccagaagctgcagcaattgagactcactcagtaccacggtggttcattacctaatgttagccagctgcgaagttcagcctccgaatttcaaccttccttccaccaggccgacaacgtgcggggaactagacatcatggcttggtggaaaggccttcccggaatagatttcacccgctgcaccgcaggagtggggataaacccgggcgccaatttgacggctcagccttcggagcgaattacagcagtcagcctctggacgaaagttggccacgtcagcaacccccatggaaggacgaaaagcatccgggatttaggctgacaagcgcactgaacaggactaatagtgacagcgctctgcatacctcagccctgagtactaaaccacaggacccttacggaggaggcggccagagcgcctggcccgccccatacatgggtttttgcgacggagagaacaacggccacggagaagtcgcatccttcccaggaccactgaaagaggaaaatctcctcaatgtgcccaagccactccccaagcagctgtgggagaccaaagagatccagtctctttccggcaggcctcgctcttgcgatgtgggcggggggaatgcctttcctcataacgggcagaacctgggcctgtctccatttctggggaccttgaacactggcggatctttacccgacttaacgaatctgcactattccacccctctgcccgcttccctggataccacggatcatcatttcggatctatgtccgttgggaattcagtgaataatatcccagccgccatgacccaccttggaatcaggagcagctccggtttgcagagctcacgatccaacccatctatccaagctaccctaaacaaaaccgtcctgagtagctctttaaacaatcatcctcagacttcggtgcctaatgcaagtgccctgcatccctccttgaggcttttctctctctctaaccctagcctttcaaccactaacctgtccggcccatccagacgtcgacagccacctgtctcgcccttaaccctctctcccggtccagaagctcaccaaggtttctctcgacagctgagcagtacttctccactggcaccataccctacaagtcagatggtgagtagcgatcgttcacagctgtccttcttgcctactgaggcccaagctcaggtgagcccccctcctccataccccgcgcctcaggagctgacacagccgctacttcaacaacccagagcacccgaagcacccgcccagcagccgcaggcagcttcttccttaccacaatccgacttccagctcctgcctgcccagggaagtagcctgaccaattttttcccggacgtcggctttgaccagcaaagcatgcgaccaggccctgcgtttccgcaacaggtgccccttgttcagcaagggtcccgcgaattgcaagactctttccatcttaggccctctccttactcgaattgcgggagcctgcctaacacaattctacccgattcctccacatcacttttcaaagacctgaacagtgcgcttgccgggcttccggaggttagcctgaatgtggatacccctttcccactggaagaggagctgcagatcgaaccactgagcctggacgggctgaacatgctgtcggatagcagtatgggcttactggaccccagtgtggaggagacattcagagccgatcggctctag

SEQ ID NO: 183959 - DNA, 672 bp, Artificial Sequence
  Description of Artificial Sequence: Synthetic coding sequence
atgacctggcggcaccacgtgcggctgctgttcaccgtgagcctggccctgcagatcatcaatctgggtaacagctatcaacgagagaaacacaacggaggacgggaagaggttacaaaggtagcaacccagaaacacaggcagtcacctctcaactggacaagctcacactttggcgaagtaacagggtcagcagagggttggggcccagaagagccattaccatactcaagagcctttggcgagggggctagcgcgcgccctaggtgctgtagaaacgggggtacatgcgttctgggctctttttgcgtttgccctgctcactttactggcagatactgtgagcacgatcagaggcgaagcgagtgcggagcactcgagcatggcgcttggacactgcgcgcctgccacctgtgtcggtgcatttttggggcgctgcactgtctgcctctacagacacctgatcgatgtgatccaaaagacttcctagcatcccacgcgcacggcccttcagcagggggagccccatctctgctgttgctgctaccgtgtgcactgttacaccggcttctacgccctgacgcacccgcccatcctcggagcctcgtgccgtccgtcctccagcgcgagaggagaccctgcgggaggcccggcctgggccacagactctag

SEQ ID NO: 183960 - DNA, 2511 bp, Artificial Sequence
  Description of Artificial Sequence: Synthetic coding sequence
atgaccgccaccgtggagaacctgaccttccagaaggacaccctggggaacgctgtagacaagaaccgtaggcacggatccacagaacctcttgtgctggcctggagcagccaatttcgtaggctgacgtggggttgtgccctggacgctctccatagatcaccatgcgtggcagccagtcagcatggtgtgactcacttgatccgtagcagccggacgccgcactccaccaggtgtcgtaaagaagacgcccagccgggccatcatggtaacggagcagcctcagtcacagcccaagcgcggggccagaggagtgtgctgcaggtaccgctccccgtacctcgctcttgcctcttcagcgaatctttcgtggtatccgtcagttctcagtccaggttcctggcgtctgtgccaggaacaggagtccaacgttcgacagcggccgacatggcagccagtaccgcagccggtaaacagcgcatacctaaggtggctaaggtcaaaaacaaagcaccggctgaggtccagataactgccgagcagctccttcgggaggccaaggaaagggagctcgagctgcttccacctcctccccagcaaaagattaccgacgaggaagagctgaatgactataaactgagaaaaagaaaaactttcgaagacaatatcaggaaaaaccgtaccgttatatcaaattggatcaaatatgcgcagtgggaggagtcactcaaagagatccagagggcccgttctatatatgaacgtgcactcgatgtcgactataggaacataaccctgtggctgaagtacgcagaaatggaaatgaagaatcgtcaagttaatcatgcccgaaatatttgggatcgcgccatcaccacactcccgcgtgtgaaccagttctggtataaatatacatatatggaggagatgcttggaaatgtggccggtgcaaggcaagtctttgagcggtggatggagtggcagccagaggagcaggcttggcactcctacataaatttcgagctgcggtacaaagaagtcgacagagcccggactatttatgaacggtttgttctcgttcaccctgatgttaagaattggattaagtacgcaaggtttgaagagaaacacgcctacttcgctcacgcccgcaaggtttatgaacgcgccgtagagttcttcggggacgagcacatggacgagcatctgtacgtcgcattcgctaagtttgaagaaaaccagaaggaatttgaaagggtgcgagtcatctacaaatatgccctggatcgcataagtaagcaagatgcacaggagctcttcaaaaattatactatctttgagaagaagttcggcgaccggagagggattgaggacattatagtaagtaagagacgttttcaatacgaagaagaagttaaggctaacccgcataactacgacgcctggtttgactacctgcgtctggtggagagtgatgcagaagctgaggctgtcagagaggtgtacgagcgcgccatcgctaatgtgccgcctatccaggagaagcggcactggaaacgatacatatatctgtggattaattacgcgctttacgaggagctggaggcgaaagatcctgagcggaccaggcaggtgtatcaagctagcctggagctcataccacacaaaaagttcacctttgcaaagatgtggatcctctatgcccagttcgagattcggcaaaaaaacctatctctggcacggagggcgctcggcacatctattggcaagtgccccaagaataagctcttcaaggtgtatatcgaattggagcttcaactgcgggaatttgatagatgcaggaagctgtacgagaaattcctggagtttggacctgagaactgtacgtcatggattaaatttgcagaactcgagactatcctcggtgacatcgaccgggcgcgcgctatatatgaactcgccataagccagcccaggctggatatgcccgaagtcctgtggaagagttacatcgattttgagattgagcaggaagagacggagcggaccaggaacctgtaccggcggctcttgcagagaacccagcacgtgaaggtgtggatctcattcgcgcagttcgagctcagtagcggcaaggaaggtagccttaccaaatgccgtcagatttacgaagaagccaataaaactatgcgaaactgtgaggaaaaagaggaacggttgatgctgctcgagagttggcgctcctttgaggaagagtttggaacagccagtgacaaagagcgggtggataagttgatgcctgaaaaggtgaaaaagagacggaaagtccagacagacgacggcagcgatgccggctgggaggagtattttgactacattttccccgaggatgccgccaaccaacccaacctcaagctcctggcgatggctaaactgtggaaaaaacagcaacaggagaaagaagatgcagagcatcatccagatgaggatgtagacgaatccgagtcttag

SEQ ID NO: 183961 - DNA, 2547 bp, Artificial Sequence
  Description of Artificial Sequence: Synthetic coding sequence
atgaccgccaccgtggagaacctgaccttccagaaggacaccctgggcaacgccgtggataaaaatacatctcgccttgaacttaggtcttactctttggccggccgtcatggcagtacagagccacttgtgctggcttggagcagccagttcaggcggttgacatggggctgtgctttggacgcactacacagaagcccttgcgtggccgcatcgcagcacggtgttactcacctgatcaggtcatcccgcaccccccacagcacaagatgccgcaaagaagacgcccagccaggccaccatggaaacggtgctgcatccgtgacagcacaggctagagggcagagaagtgtgttgcaggttcccctgccagttcctcggtcctgcctgttttctgaaagctttgtcgtctccgttagttctcagagtcggttcctggcttccgtgcccggcactggagtccaaagatcgaccgccgctgatatggctgccagcaccgcagcggggaaacagaggataccgaaggtggcaaaggtgaaaaacaaagctccagccgaggttcaaataaccgctgagcagctgctgcgggaagccaaagaacgtgaactcgaattgctccctccacctccacaacagaagatcaccgacgaagaggagctcaatgattacaagcttcgtaagcgaaagacttttgaggataatattcgcaaaaaccgaaccgttatcagcaactggattaagtacgcgcagtgggaagaaagccttaaagaaatacagagggctaggagtatttatgagcgcgctctggatgtggactatcggaacatcacattgtggttgaagtatgccgagatggaaatgaaaaaccgacaggtgaatcatgctcggaatatctgggacagggcaatcactaccttgcctcgggtgaaccagttctggtacaagtacacctatatggaggaaatgctgggcaacgtcgctggggctcggcaggtatttgaaaggtggatggagtggcagccagaagagcaggcctggcattcatatatcaatttcgagctgagatacaaagaggtggatagagctcgcaccatatatgagaggtttgtgttggtgcatccagatgtaaaaaattggatcaaatacgctcgatttgaagagaagcacgcatactttgcgcacgccaggaaagtttacgaacgggccgtcgaattcttcggcgatgaacacatggacgaacatctatatgttgccttcgctaagttcgaagagaatcagaaggagttcgaacgggtcagagtcatttacaagtacgccctagacaggatctccaaacaggatgctcaggagctcttcaagaactacaccattttcgaaaaaaagtttggcgacagaagaggcattgaggatattattgtgtcgaaacgccgtttccagtatgaagaggaggtcaaagccaacccacacaactacgatgcctggtttgactatctgcggctcgtcgagtctgatgcagaggcagaagcagtccgggaagtgtatgaaagagccattgccaacgtacccccaatccaggagaaacgccattggaagcgctatatctatctgtggatcaactacgcactgtatgaagagctggaggctaaggaccctgagcgcacccgccaggtctaccaggcttcgctggaactgattccacacaaaaagttcaccttcgctaaaatgtggattttgtacgcccaattcgaaatacggcagaaaaacttgtcgttagcaaggagggcgctcgggacctctatcggtaagtgtcccaaaaacaagctctttaaggtgtacatcgagcttgagctgcagctgagggagttcgacagatgtagaaaattgtacgaaaagttcttggaattcgggcctgaaaattgtacaagctggatcaaattcgccgaactcgagacaattttgggcgacatagaccgagcccgcgctatctacgaacttgccatatctcaaccaagactcgacatgcccgaggtgctctggaagtcctatatagactttgagattgaacaggaggagaccgagaggactcggaacctatataggaggctgcttcagagaacccaacacgtaaaggtgtggatttccttcgcgcaatttgagctctcgtcaggaaaggaagggagcttgacgaaatgtcgtcagatatacgaggaggccaacaagaccatgcgtaactgcgaagagaaagaggaacgactgatgcttctggagagttggaggtcctttgaggaggagttcggcaccgcctccgacaaggaaagggtggataagctgatgccagagaaagtgaaaaagaggcgcaaggtgcagactgacgatggctccgatgcagggtgggaagaatacttcgattacatcttcccagaagacgctgctaatcagccgaacctgaagctactcgcaatggctaaactctggaagaaacagcagcaagagaaagaagacgccgaacaccatcccgacgaagacgtggatgagtctgagagttag

SEQ ID NO: 183962 - DNA, 7026 bp, Artificial Sequence
  Description of Artificial Sequence: Synthetic coding sequence
atgaagaacatctactgcctgatccccaagctggtgaacttcgccacactgggctgcctttggatcagcgttgtgcagtgcactgtgttgaactcctgcttgaaatcatgcgtgaccaatctgggccagcaactggacctcgggacgccacacaatctcagcgagccatgcattcaggggtgccacttctggaactcagttgaccagaagaactgcgctctgaagtgcaacgacacctatgccaccgtatgtgagcgagaatcttgcgaggtcgggtgttctagcgcagaaggcgcatacgaagaggaggtcctcgagaacgccgacctcccgaccgccccatttgctagcagcataggcagccacaatatgacgctgcgttggaaaagcgccaatttttcaggcgtgaagtatatcatacagtggaagtatgctcagctgttaggatcttggacctacaccaaaacagtgagtagaccttcctatgtggtgaaaccactacacccatttacggaatatattttcagagtggtgtggatatttacggctcagttgcagctatactcacccccctccccgagctatcggacacaccctcacggcgtgccggagaccgccccactaattagaaatatcgagagttcttcgcccgacacagtagaggtgtcctgggatcctccgcagttcccgggaggcccaattctgggctacaacctccgcttgatcagcaaaaaccagaaacttgatgctgggacgcagagaacctcctttcagttctattccacacttcccaatacgatttaccgttttagcattgccgccgtcaacgaggtgggcgagggcccagaggcggagagttcaatcaccacttccagctccgcagtacagcaggaggagcagtggttatttctttccagaaaaaccagcttaaggaagcgctctctgaaacacctggtggatgaggcacattgtctcaggctggacgcgatctaccacaacatcactggtatctccgtggacgtgcaccagcagatagtgtacttttccgagggtacattgatctgggccaagaaggcagccaatatgtcagacgtgagcgacctcagaatcttctacagaggctctggactgatatcatcgatatccatcgactggctataccaacgtatgtatttcatcatggatgagctcgtgtgcgtgtgcgatttggagaactgcagtaatatcgaagagatcacccccccctccatctccgcaccacagaagatagtggccgactcctataacggctacgtgttctatctcttgcgagacgggatctacagagcggatctccctgtaccctctggcaggtgcgccgaggccgtacggatcgtggagtcctgtacactcaaggacttcgctattaagccccaggccaaacggattatttacttcaatgatacagcccaggtctttatgtctacatttttagatgggagtgcctcgcacctgatattaccgcggattcccttcgcagacgtcaagtcttttgcttgcgaaaataacgattttctggtcaccgacggtaaagttatcttccagcaggacgcgctctcctttaacgaattcatagtcggatgtgacttgtcccatatcgaagagttcggctttgggaatcttgtgatttttgggagtagctctcagttacacccactgccgggacgacctcaggaacttagtgttctatttggttcgcatcaggcactggtgcagtggaaacctcccgctctggctataggggccagcccttccgcttggcaaaattggacttatgaggtgaaagtctcgactcaggatcctccagaggttacacatatcttcctcaacatctcaggaactatgcttaacgtgcccgaactacagagcgccatgaaatataaagtgagcgttcgggcaagttcacccaagcgcccaggcccatggagcgagccatccgttgggactacactcgtccccgctagcgagccgcctttcatcatggccgttaaggaggacgggctttggagtaaaccgcttaactcatttggaccgggtgaatttctctcatccgatattggaaatgtgagcgacatggattggtataataacagcctgtactatagcgacactaagggagatgtctttgtttggctgctgaatggaacagatattagtgaaaactatcacctgcccagcattgcgggggctggggcgttggctttcgagtggttgggtcatttcctttattgggcaggaaagacatatgtaattcagcgtcagtctgtgctgacaggacataccgacattgtcacccatgtgaagcttctggtcaatgatatggtggtcgacagcgtaggaggttacctctactggacgaccctgtacagtgtggaatcaacaaggctcaatggagagagctcactggtgctacagacacagccctggttctcaggaaagaaagttattgccctgaccctggacctctccgacggtttactatactggcttgtgcaggacagtcagtgtatccatctgtatacagccgtcttgaggggccagtcaacgggtgataccactatcactgaatttgccgcgtggagcacatccgagatctcacagaatgctctcatgtattacagtggccgtctgttttggattaacggcttccgcatcatcaccacccaggagatcggtcagaaaacatctgtttctgtccttgaacccgcaaggtttaaccagttcactatcatacaaacaagcctgaagccactcccgggcaacttttctttcacccccaaagttatccccgactctgtccaggagtccagctttcggattgaaggaaacgctagttccttccagattctatggaacggaccccccgctgtggactggggagttgttttctactccgtagaattctctgcgcatagcaagttcttagcttcagaacagcattcacttcctgtttttacagtggagggtttggaaccatacgcattgtttaatctgtcggtgacaccttatacctactggggcaaaggtcccaaaacttccttgtcccttagggcacccgagactgtgccatcagcacctgagaatccgcgcatctttatcttgccatctggcaaatgctgtaataaaaatgaggttgtggtggaatttcggtggaacaaaccaaagcacgagaacggggtgcttaccaagtttgagatattctacaacattagcaaccagagcatcaccaacaagacctgcgaggactggattgccgtgaatgtcaccccttcagtgatgtctttccagttagagggtatgagtccaagatgtttcatcgcttttcaggtgcgggcatttacatccaagggccctggaccatacgctgacgtggtgaagtccacaaccagcgagattaacccttttcctcacctgatcacactcctggggaataaaatcgtgtttctggacatggatcagaatcaggttgtctggaccttcagtgctgagagagtcatttcagctgtttgttacaccgctgacaacgagatgggatactatgctgagggagactcactcttcctgttacatttacacaatagatcgagtagtgagctcttccaagattctctcgtgttcgatattacggttattaccatagactggatttcccgccacctctatttcgccctgaaagaatcccagaacggtatgcaagtgttcgatgtggatctggaacacaaggtgaaatatcctagggaagttaagatccacaacaggaactcaaccattatttcttttagtgtttatccactactgtctcggctgtattggactgaagttagcaattttgggtaccagatgttttactattccatcatctcacacaccctgcatagaatccttcagcctaccgcgacaaaccaacagaataagagaaatcagtgttcttgtaacgtcaccgagttcgagctgtctggcgctatggccatagacacttctaacctggagaaaccactgatctattttgccaaggcacaggagatctgggcgatggacttagagggttgtcagtgttggagggtcataacggtgccggctatgctgggcaagacactggtgtctctgaccgtcgatggcgacctaatttattggattataaccgctaaagactcaactcagatctaccaggcgaagaagggcaatggagctatcgtgagccaggtaaaagcactccgtagcagacatattctcgcttattcctcagtcatgcaacccttcccggacaaagccttccttagtctggcatcagacacagtcgaaccaacgattctcaatgcaactaatacatcactcaccattaggttgcctctggccaaaaccaatctcacctggtatggcattaccagcccgactcctacctacctggtctactatgcagaggttaatgatcgcaagaactcgtcagatctaaaatatcggattttggagtttcaggattccatagcattgatcgaagacctccagccattctctacctacatgattcagattgcagttaagaactactactcagatccattggaacaccttcctcccggcaaggaaatctggggaaaaaccaaaaatggcgtccctgaagctgtccagctgattaataccacagtgcgcagtgacacctctctgattatatcctggagagagtcccacaaaccgaacggccccaaagaatccgtgcgttatcagttagccatctcccatcttgcactgatccctgagaccccgctccggcaatccgagtttcccaatggcaggctgactcttctggtgactcggctgtcaggaggcaatatctacgtgttgaaagttctcgcttgccactccgaagagatgtggtgcactgaatcccacccagtaacggtggagatgtttaatacacctgaaaagccatatagtctggtgcccgagaatactagccttcagtttaactggaaagcaccacttaatgtgaacctaattcgcttctgggtcgaactgcaaaagtggaaatacaacgagttctaccacgtgaagacctcatgctctcaaggcccggcgtatgtctgtaacatcaccaacctgcagccctacacaagctataacgtcagagtggtagtcgtttacaagacaggagagaattctacatctctccccgaatccttcaagaccaaagcaggagttcctaataagcccggtattcctaaacttctcgagggctcaaagaactcaatacagtgggagaaagcggaagacaacggctgtagaattacatattacattttggagatcagaaaatccacaagcaacaacctgcagaaccagaacctcaggtggaagatgactttcaacggctcatgttcctctgtgtgcacatggaaaagtaagaatctgaaggggatcttccagttcagagtggtggctgccaacaacctgggatttggggaatatagtggaatctctgagaatatcatactcgtgggagacgacttctggattcccgagacttcctttatcctaactattatagtcgggatcttcctggttgtcacgattcccctcacttttgtctggcacagacggcttaagaatcagaaaagtgccaaggagggagtaactgtactgataaacgaagacaaggagctggcagaactaagggggttggccgcaggagttggtctcgcaaatgcctgctatgctattcatacgctgcctacccaggaggaaatagaaaacctgcctgcctttcctagagagaagctcactcttcgactcctgctcggttctggcgctttcggggaggtgtatgaaggtaccgcagtcgacatccttggggtaggaagcggtgagatcaaggtcgccgtgaagacactgaagaaaggttccactgaccaggaaaaaatcgagttcctcaaggaggctcacttgatgtccaaattcaaccaccccaacatcctcaaacagctgggcgtgtgcctgctaaacgaaccgcagtatatcatcctggagctgatggaaggtggggatctgttgacgtacctgaggaaggctcggatggcaaccttctacggtcctctcttaacactcgtagaccttgtcgacttgtgcgtagacattagtaaagggtgcgtctatctggaacgaatgcattttatccacagagacctcgcagcccgcaactgtttagtgtcagtaaaagactacacctccccgcgaatcgtaaaaatcggggattttggtctggctagggatatctataagaatgactattaccgtaagcgtggtgaaggactcctgccagtaaggtggatggcccctgaatcactgatggatggaattttcaccacacagtccgatgtgtggagctttggaattttgatttgggagatcctgaccctcggacaccagccataccctgcacattccaacctggatgtgctgaattatgttcaaacaggcggcagactcgagccacctcgcaactgtcctgatgacctgtggaatcttatgactcagtgctgggcccaagagccagaccagagacctacttttcacaggatacaggaccagcttcagctttttcgaaattttttccttaatagcatctacaaaagtcgagacgaagctaacaactcaggcgtcatcaatgagagtttcgagggtgaggacggcgacgttatctgcctgaactcagacgacatcatgccggtggcgctgatggaaaccaagaatcgagagggattaaattatatggtgcttgctacagaatgtggacagggggaggaaaagtcagaagggcctctgggtagtcaggaatcagagagttgcgggcttagaaaggaagaaaaagagccgcacgccgataaggacttttgccaggagaaacaggtagcctactgcccctccggaaaacctgagggtctgaattacgcctgcttaacccactccgggtacggagatggctctgactag

SEQ ID NO: 183963 - DNA, 7044 bp, Artificial Sequence
  Description of Artificial Sequence: Synthetic coding sequence
atgaagaacatctactgcctgatccccaagctggtgaacttcgccacattggggtgcctgtggattagcgtagtccaatgcaccgttctgaattcgtgtctcaaaagctgcgtgacaaacttgggtcagcagctcgaccttggcacaccccataatctgtctgagccgtgtatacaaggttgtcacttctggaactctgtcgatcagaaaaactgcgctctcaaatgcagggagagctgcgaggtcgggtgctcatctgcagaaggcgcctatgaggaggaagttttagaaaatgcggacctacctactgcccctttcgcgtcaagcattggcagccacaatatgaccctgagatggaagagcgccaatttcagcggagtcaagtacatcattcagtggaagtacgcccagctgctcggcagctggacctatacaaagacagtcagtcgcccctcctacgttgtgaagcccctccatccatttaccgagtatatttttcgcgtggtgtggattttcacagcccaactgcaattatatagcccgccgagtcctagttatcgcacgcatccccacggggttccagagaccgcaccactgattcgcaatatcgagtctagctcgcccgatactgttgaggtcagctgggatcctccacagttcccgggaggccctattttaggctataatttgcgcttgatttccaaaaatcagaagctggacgcaggaacccagagaactagttttcagttttactcaacactgccgaatactatttaccggtttagtatagctgccgtgaacgaagtgggcgagggcccagaggcagaatcgagcattacaacatcatccagtgccgtgcagcaggaagaacagtggcttttcctgtcaagaaaaacctccctgcggaaacgctcccttaaacatctggtggacgaagcacactgcctgcgcctggacgctatctatcataatataacgggcatctcagtagatgtgcaccaacagattgtgtacttcagcgagggcacactcatctgggcgaaaaaagctgcgaatatgtccgatgtgtccgacctacgcatcttctacagaggtagcggtctgatcagcagtattagtattgactggctttatcagagaatgtatttcatcatggacgagctagtctgcgtgtgcgatcttgagaattgctctaatatcgaggaaatcacgcctccttccatctcggccccccagaagatcgtggcagattcttataacggttatgtcttttatcttctcagggatggcatctacagagctgacttacctgttccttccgggcggtgtgccgaggcagtcagaattgtggaaagctgtaccctcaaggacttcgcaattaaacctcaagctaagaggatcatctatttcaacgataccgctcaggtgtttatgagcactttcctggatggatcagcctctcacttgatacttccaaggatccctttcgccgacgtgaaatccttcgcctgtgagaataacgattttttggtaactgatggcaaggtaatttttcagcaggatgccctgagtttcaatgagttcatcgtaggttgcgacctctctcatattgaggagtttggatttggtaacctcgtgatctttgggagcagcagccagctgcacccacttcccggtagacctcaggagttgagcgtgctgtttggctcgcatcaagcgctcgtacagtggaagccaccagctctggctatcggtgctaacgttatcctgatctccgacatcatcgaacttttcgaactaggcccttccgcctggcaaaactggacatacgaggtcaaggtgtcaactcaggaccccccagaggtaacacacatttttctgaacatctctgggacaatgctgaacgttccagaattacagtccgccatgaaatacaaagtgtctgtgcgcgcatcaagcccaaaaaggcctggaccatggtcagaaccatcagtcgggaccactctggtgcccgcatctgaacccccgttcataatggcagtgaaagaggacggattatggtcaaaaccactcaactcattcggaccaggcgagttcctttcaagcgacattggaaatgtgagtgacatggattggtataacaatagcctctactattcagataccaagggggacgtgttcgtgtggctcctgaacggcaccgacatttctgagaattaccatctacctagcatagccggagctggtgccctggcctttgaatggctggggcactttttatactgggcaggcaaaacctatgtgattcagcgccagtcagtccttactggacatacggacattgttacacatgtgaagctcctggttaatgatatggttgtcgacagtgtgggcggttacctgtattggaccactttatactcagtcgagtctactcgactaaatggggagagcagcctggtcctccagacccaaccttggtttagcgggaaaaaggtcatcgctctgaccctggatctatccgatggtctgctttattggttggtgcaagactcacaatgcattcacctctacaccgcagttctgaggggccagtctacaggcgataccacaatcaccgaatttgccgcttggtctacatccgagatttcccagaacgcattgatgtactactctgggcgcctgttctggatcaatgggttcagaatcattacgactcaagaaattggccaaaaaacgtccgtcagcgtgctcgagcctgctcgattcaatcagtttacaataatccagacgagtctgaagcccctgcccggcaacttttcattcacccctaaggtgatcccggactctgtgcaggagtcaagcttcaggattgaaggtaatgcctcctccttccagattctctggaatggcccgcctgccgtggactggggcgtcgtcttctatagtgtggaattttctgcccacagtaagtttttggccagcgagcaacatagcctgccggtgttcacagtcgagggactcgagccatacgccttgttcaatctctcagtcactccttacacctactggggcaaaggccccaagacctctctgtccctccgagcccccgagactgtgcccagtgctcctgaaaaccccaggatctttattctgccctcagggaagtgctgcaacaaaaatgaagtagtcgtagagttcagatggaacaagccaaagcacgagaacggggtgctaacgaaatttgagatcttctataatatttccaatcagtctattaccaataagacttgcgaggattggatcgccgtgaacgtgacaccgtctgtgatgtcgttccagttggaaggcatgagcccgcgctgcttcatcgcctttcaggtccgggcctttacttctaaggggcccggaccatatgccgatgttgttaagagcacaacttctgaaattaatccattcccacacctgattacattgctgggcaataagatcgttttccttgatatggaccagaaccaggtggtatggaccttcagcgccgagagggtgatctcagctgtgtgctacacagccgacaatgaaatgggctattatgctgagggagacagcctctttctattacacttgcataaccgaagctcttcagaactgttccaagacagcctcgtgtttgacataaccgtaatcaccatcgattggatctccaggcacctgtatttcgctttaaaggaaagccagaacggaatgcaagtattcgacgtcgacctcgaacacaaggtgaaatatcccagagaggtcaagatccacaaccgcaacagtactattatcagtttttcggtgtatccgttgttatctcggctgtattggaccgaggtgtctaatttcggctatcagatgttctactattcgatcatatcacacacactgcacaggatccttcagccaacggccacgaatcagcagaataaacgtaaccagtgcagctgtaacgtgacagagtttgagctctctggagccatggctatagacacctcaaacctcgagaagcccctaatttactttgcaaaagctcaagagatctgggccatggatctggagggatgccagtgctggagagtgataaccgtccccgcaatgcttgcgggaaagactctggtgtcactaacggtggatggggatctgatctactggatcattactgccaaggattccactcagatctatcaggcaaaaaaaggcaacggggccattgtaagtcaggtgaaggcccttcgctccaggcatattctcgcctacagcagtgtaatgcagccgtttccagacaaggcctttctatctctggctagtgataccgtcgagccgactattttgaatgcaacaaacacgagcctaacaatacgactccccttagcaaagaccaacctaacctggtatggaattacctcccctacccctacttacttagtgtactacgccgaagtgaacgaccggaaaaactcgtcggatctgaaatacagaattctcgagttccaggattctatcgccctcattgaggatttgcagccattcagcacctatatgatacaaatcgcagtaaaaaactattatagcgatcccctggagcaccttccacccggcaaagagatctggggaaagaccaagaatggggtgccagaggcggtgcaattaatcaacactaccgtgaggagtgatacaagtcttatcattagctggagagagtcccacaagccgaatgggcccaaggagagtgttaggtaccagcttgcaattagtcacttagctctgatccctgagacacccttgcgacaaagtgaattccctaacggaaggctcacattgctcgttacaaggctctctggtggaaatatttatgtgctcaaggtactcgcgtgtcactctgaagagatgtggtgtactgaatcccaccccgtaaccgtcgaaatgtttaatactccagaaaaaccctactctctggtgcctgagaacacttcactccagtttaactggaaagctccgttaaatgtgaatctaatcaggttttgggtggagcttcaaaaatggaaatataacgaattctaccacgtgaagacgtcctgttcccagggtcccgcatacgtgtgcaacattactaatctgcagccttatacttcatacaacgtgcgcgtcgtcgtggtgtacaagacgggggagaactctacaagtctgcccgagagctttaaaaccaaggcgggtgtgccaaataagcccgggattcccaaactcctcgagggcagcaaaaactccatccagtgggagaaggctgaagataacggctgccgcattacttattatattctcgagattagaaagtccactagtaataacttgcagaaccagaacctaaggtggaaaatgacattcaatggaagttgtagctccgtctgtacttggaaatctaagaatctgaagggcatcttccaattcagggttgtagcggctaacaatctcggtttcggagaatatagcgggattagcgaaaatattattcttgttggagatgatttctggattcctgagacatcattcattctaactatcatcgttggcatatttctggtggtcacaatacctttgacgttcgtgtggcatcgccgcctcaagaatcagaagtctgccaaggagggggttacggtgctcattaacgaggataaagaattggcggaactgagaggtttagcagcaggggttggtctggccaacgcctgttatgcaattcacaccctccctacgcaggaagagatcgaaaatctgccagcctttccccgggaaaagctgactctgcggctcctccttggaagcggagcctttggcgaggtatacgagggaaccgccgtcgatatcctgggcgtggggagtggcgagattaaggtggccgtaaagacactgaagaagggctctacagaccaagaaaagatagagttcctgaaagaagctcatctaatgtccaaattcaatcatcctaacatcctaaagcagctcggtgtgtgtctgcttaacgagccccagtatattattttggagttaatggaggggggggacctgttaacctacctcagaaaggcacgcatggccaccttttatggacccttgctgacattggtggacctggtggatctctgtgttgatatctcaaagggatgcgtgtatctggaacgcatgcactttattcatagagatctggctgccaggaactgcctggtgagcgttaaggactacactagccctaggattgtgaagattggcgatttcggactagcacgggatatttataaaaacgattactaccgaaagagaggggaaggtctccttcctgtacgctggatggcccctgaatccctgatggacggaatctttactacccagagcgatgtctggtcatttggtatactgatctgggagattctgacacttggccaccagccctaccccgcccattctaatctggatgtgctcaattacgtgcagactggaggccgcttagaacctccgaggaactgccctgatgatctatggaatttaatgacccagtgctgggcacaggagccagaccagaggccaacatttcaccgtatccaagatcagctccagttgttccggaacttctttctgaattctatctacaaaagtcgtgacgaggcgaataactctggggttataaacgaaagcttcgaaggcgaggacggggacgtcatctgcctgaacagcgatgacatcatgccagtggcactcatggaaactaagaaccgcgagggtcttaattatatggtgctggcaaccgagtgcggtcagggtgaggagaagtccgaaggacctctgggtagccaggaatctgaatcatgcgggctgaggaaggaggagaaggaaccgcacgcagacaaggacttctgtcaggagaaacaagtcgcatattgtcctagcggtaagccagaaggcctcaactacgcttgcctgactcattctggctacggtgatggatctgattag

SEQ ID NO: 183964 - DNA, 294 bp, Artificial Sequence
  Description of Artificial Sequence: Synthetic coding sequence
tggaagtacaacgagttctaccacgtgaagaccagctgcagccagggccccgcatacgtgtgtaacatcaccaatctgcagccttacacctcatacaacgttcgcgttgtggttgtttacaagacgggagaaaactcaacaagtctgcctgagtccttcaagaccaaggctggtgtgcctaataagcccggaattccaaagcttctcgaggggagtaagaacagcattcaatgggagaaagccgaggacaacggctgcagaattacctactatatcctggagattcgggattag

SEQ ID NO: 183965 - DNA, 2025 bp, Artificial Sequence
  Description of Artificial Sequence: Synthetic coding sequence
atgaccagcaacggcgtggccctgctgaacttctacaacatgcccagcaccccatcttttgtggggtgtctgcaggacataaaaatagattggaatcacattaccttagagaatatttcatctggatcctcgctgaatgtgaaagcaggctgcgtgcgaaaagattggtgcgagagccagccttgccagtctcgcggccgctgcattaatctatggctttcataccaatgtgattgtcatcgtccttatgagggtcccaactgcttaagggagtacgtggccggacggtttggccaggatgacagcacaggctacgtgatctttacgctggatgagtcctatggagacaccatctctctctccatgttcgtgcgcacattgcagccttcgggtctgttactggctctggaaaactccacgtatcagtacatccgggtttggcttgaaagaggtaggctggctatgttgacgcccaattcaccgaaacttgtggtcaagtttgttctgaatgatgggaacgtgcacctgatcagtctgaagatcaaaccttataagattgagctgtaccagtcttcccagaacctcggctttatctccgcttcaacatggaagattgaaaagggagacgtcatttacatcggcggactaccagacaagcaggagacagaattaaacggaggcttctttaagggatgcatacaggatgttcgcctgaacaatcaaaacctggaattcttccccaatcccacgaataacgcatccctgaatcctgtactagttaatgtgactcagggctgtgcaggcgacaacagctgcaagagtaacccttgccataacggcggcgtctgccacagtagatgggacgacttcagttgttcttgtccagccttaaccagcggcaaggcttgcgaagaagttcaatggtgtggtttttcaccctgcccacatggagcccagtgccagcccgtgctacaagggtttgagtgtatcgccaacgctgtgtttaacggccagtcgggacagatccttttcagaagtaatggaaacatcacaagagagctcaccaacattacatttggcttcaggactcgtgatgccaatgtgattattctgcatgcggagaaggagcctgaattcttaaatatatccatacaagatagccgcctgtttttccagttgcagtcgggtaattctttctatatgctttctctaacgtctctgcagagtgtaaacgacggcacgtggcacgaggtgactttgtctatgacagatccgctgtcacagacatccaggtggcagatggaggtagataacgaaacacctttcgtgaccagcaccattgctaccggctcactcaatttcctgaaagacaatacggacatctacgtaggagatagggccattgacaacatcaaagggcttcagggatgcttgtctacgatcgagataggaggcatatacctctcttactttgaaaacgtgcacggctttattaacaaaccgcaggaggagcaatttctgaagattagtaccaacagcgttgtgaccggttgtctccagcttaatgtgtgcaactccaacccttgcttgcatggaggaaactgcgaagacatttactctagctatcattgtagctgtcccttagggtggagtgggaagcattgcgagttgaacattgatgaatgtttctcaaacccctgtatacatggcaattgttccgaccgggtggctgcctaccactgtacctgcgagcccggttacacaggcgttaactgcgaagtggatatagataactgtcagtcacatcaatgtgctaacggtgccacatgcatcagccatactaatggttacagttgcttgtgctttgggaacttcacgggcaaattctgtagacagagccgtctccccagcacggtgtgtggtaatgagaagactaacctaacgtgctataacggaggaaattgcacagagttccagacagagttgaaatgtatgtgtcgccccggttttactggagagtggtag

SEQ ID NO: 183966 - DNA, 4221 bp, Artificial Sequence
  Description of Artificial Sequence: Synthetic coding sequence
atggccctgaagaacatcaactacctgctgatcttctacctgagctttagtttattgatatacataaagaattccttctgtaataagaataatacccgctgcctgtctaattcatgccagaacaattcaacgtgcaaagattttagcaaggataatgactgctcctgtagcgacacagctaataacctggataaggattgcgataacatgaaggacccatgcttcagtaacccctgccaggggagtgccacctgtgtgaatacaccaggtgaaagatcctttctttgcaaatgtcctcctggctatagcggtacaatctgcgaaacaacgatcggcagctgcgggaaaaactcttgccagcacggaggtatctgccaccaagaccctatataccccgtctgtatatgtcctgcgggctacgctggtaggttctgcgagatagatcacgacgagtgcgccagtagcccatgccagaacggcgcggtctgtcaggatggcattgacggttactcctgtttttgcgtgccaggctatcaaggaagacattgcgatctggaagtcgacgaatgtgcttctgatccgtgcaaaaacgaggccacatgtcttaatgagatcggacggtacacatgcatctgtccccataattactctggggtgaattgcgagctggaaatcgacgaatgctggtcccaaccatgtctcaacggcgccacgtgccaagatgcccttggcgcttatttctgtgattgtgcgcccggattcttgggggaccactgtgagctcaataccgatgagtgcgctagccagccctgcctgcatggaggcctgtgtgtcgacggtgagaatagatactcatgcaactgtactgggtccggcttcaccggcactcactgcgagactcttatgcccttgtgttggtcgaagccttgtcataataatgcaacttgcgaggacagcgtagataactacacttgtcactgttggcctggctataccggagcccaatgtgagatcgacttgaacgagtgtaatagtaacccctgccagtccaacggtgaatgcgtagaattgtcaagcgaaaagcagtatggtcgtattacgggattaccatctagtttttcataccacgaagcttccggatatgtatgtatatgccaacccggcttcactgggatccattgtgaagaagatgtgaacgaatgctcctctaacccttgccagaatggcggcacctgcgagaacctgcccggaaactatacctgccattgtccattcgataatctgagtcggaccttctatggcgggagagattgcagcgatattctcttaggttgcactcaccagcagtgcctgaataacggcacttgcattcctcatttccaggacggacaacatggcttttcttgtctctgcccaagtggctacaccggaagcttgtgtgagatcgccactactctgtcattcgagggggatggattcctatgggtgaaatcgggctccgtgactaccaaaggttctgtgtgcaacattgccctccgttttcagactgtccagcctatggccttactactgttccgcagcaaccgggacgtgtttgtgaagctggagctgcttagcgggtacatacacctttccatccaagtgaataatcagtcgaaggttctgctcttcatttcccacaacacgagcgacggggagtggcacttcgtcgaggtgatctttgccgaggctgttacacttaccctgattgatgacagctgcaaggagaaatgtatagccaaagccccaacccctttggagtctgatcaaagcatttgtgcattccagaattcatttctaggtgggctgccggtaggtatgactagcaatggagtcgcactgctcaatttttacaatatgccatctacaccatctttcgtggggtgcctgcaggatatcaaaatcgattggaatcacatcacactggagaacataagcagtggtagctccttaaacgtcaaggcaggctgcgtgcggaaagactggtgcgagagccagccctgtcaaagtcgaggccgttgcatcaacttgtggttgtcctatcagtgtgactgccatcggccttacgaggggccgaactgtctgcgtgagtacgtcgccggcaggttcgggcaggatgactccaccggctacgtgattttcacccttgacgagagctatggggataccatctccctgagcatgttcgtgcgcactctgcaacctagcggacttctgctagccctggaaaacagtacctatcagtacatcagggtgtggctggaacgagggaggctggcgatgctgacccccaattctcctaagctggtggtcaagtttgttctcaacgacgggaacgtccacttaatctcgctgaagattaagccgtacaaaatagaactttatcaaagctcacagaaccttggcttcatcagtgcgtccacttggaagatagaaaaaggggatgtgatctatatcggcgggctcccggacaagcaagaaacagagctgaacggcggtttctttaaggggtgtattcaagatgtccgcctaaacaatcagaacctggaatttttccccaacccaaccaacaatgcctcgctgaatcctgtgcttgtcaacgtgacacagggttgcgcgggggataactcctgtaaaagcaacccgtgccacaacggcggtgtatgccactctcggtgggacgacttcagctgctcatgccccgcccttacatccgggaaggcctgtgaggaggtccaatggtgcgggttctctccttgtccccatggcgctcagtgtcagccagtattgcaaggattcgaatgtattgccaacgctgtattcaatgggcagtccggacagattctgtttcgttctaacggcaatattacccgggagctaacaaacatcactttcggattcaggacccgcgatgctaatgtgattatcctgcacgccgagaaagagcccgagtttctgaacataagcatccaggattctagacttttcttccagttgcagagtggcaacagcttttacatgctgtccctcaccagtctccaaagcgtgaatgatggaacatggcacgaggtgaccttgagcatgactgatccgttgtcacagacctcaagatggcaaatggaggttgataacgagacaccatttgtcacaagcaccattgcgaccggatctctcaactttttgaaggataacacagacatctacgtcggggatagagcgattgacaacattaaggggctgcagggctgtctttcaacaattgaaatcggtggtatttacctgtcttatttcgaaaacgtccatggcttcattaataagccccaagaggagcagttcctgaaaatctcaaccaatagcgtggtgacaggctgcctacaacttaatgtctgtaactctaacccttgccttcacggtggaaattgtgaagacatttactccagctaccactgtagttgcccgctgggctggagcggtaagcactgcgagctgaacatcgacgagtgctttagcaatccctgtattcacggcaattgcagtgaccgggtcgccgcatatcattgtacatgtgaacccggatacactggagtgaattgtgaagtggacattgacaattgccaatcacatcagtgcgccaatggcgcgacttgcatttcacacactaatgggtattcatgcctctgtttcggtaacttcacaggaaagttttgtcgccagtccagactgccatctactgtgtgcggaaacgaaaaaactaacttaacttgctataacggaggcaattgtaccgagtttcagactgagctgaagtgcatgtgccgaccaggatttaccggcgaatggtgtgagaaggacatcgatgagtgtgcttctgacccatgcgtgaatggcgggctgtgtcaggacttactcaacaaattccagtgtctgtgtgacgtggctttcgccggtgaaagatgcgaagtggacctggcagacgacctcatatccgatatattcactaccatcggatccgttaccgtcgctttgctgcttattctgctgctggctattgtggcctcagttgtgacatcaaacaaaagagccacccagggaacatatagccccagtagacaagagaaggaggggtccagagttgaaatgtggaatttgatgccaccgcctgccatggaaaggttgatctag

SEQ ID NO: 183967 - DNA, 2826 bp, Artificial Sequence
  Description of Artificial Sequence: Synthetic coding sequence
atgatccggaacagcctgtgccagcccagccggtgcctggacggctacctcttttttaatcggaagatgttcggcgcccgcacccatggtttccacattttgatggcaatgctgatcggcatccattgtgaagaagacgtgaacgagtgctcaagcaatccatgccagaatggcggcacatgcgaaaatctcccaggtaactacacttgccactgtcccttcgacaatctgtctagaacgttttacggcggcagagattgttctgacattttgctgggatgtacccaccagcagtgtctgaacaacggtacctgcattccgcattttcaggatgggcaacacggtttcagctgcctctgtccctccggatatactggttcgttgtgcgagattgctactacattgagcttcgaaggcgatggattcctttgggtgaaatccggatctgtgaccacgaaggggagtgtgtgtaacattgcccttcgttttcaaacagtgcaacctatggctttgctgctattccgttctaacagagacgtatttgtcaaacttgaattactgagcggatatattcacctaagtatacaggtgaacaaccagtccaaggtgttgctgttcatctcccataatacgtctgacggagagtggcatttcgtcgaagtgatattcgctgaagcagtcaccctcactctgattgacgattcctgcaaggagaagtgcattgcaaaagctcctacgccccttgaatccgaccagtcaatatgcgctttccagaattcctttttgggcggattgcctgtgggcatgaccagcaatggcgtggcattgctgaacttctataatatgccttctactccaagcttcgtgggttgtctgcaagatatcaagattgattggaatcacatcacgctagaaaacatttcttcaggtagttccctgaacgttaaggcaggctgtgtccgcaaggattggtgtgagagccagccatgtcagtcccgcggtcgatgcattaacttgtggctgagttatcaatgcgactgtcacaggccgtacgaaggacctaactgtctgagagaatatgtagcaggacgatttgggcaagacgacagcacaggctacgttatctttaccttagacgagagctatggagacaccatctccctaagtatgttcgtcagaactcttcagccatcgggcctgttgctcgctttagagaattctacttaccagtacatccgggtttggttagagaggggtaggctggcaatgctcacaccaaacagccctaaactggtggtgaagtttgtgcttaacgacggaaatgtacatctgatcagcctgaaaatcaagccctacaagattgagctgtaccagagcagtcagaacctcgggtttatatccgctagcacctggaagattgagaaaggggacgtgatctacatcggcggactgcctgataaacaggagaccgaacttaacggcggcttcttcaaagggtgcatccaagacgtgagacttaacaaccagaacctggaattttttccaaaccctaccaataacgccagcctgaacccagtcctggttaatgtaacacagggttgcgccggcgacaattcatgtaagtcgaatccgtgtcacaatggaggggtatgccactcccgctgggatgacttttcctgtagctgcccagcacttaccagcggaaaagcctgcgaagaggtgcagtggtgcggtttttccccttgtccacatggcgcacaatgccagccagtgctgcaggggttcgaatgtattgctaacgctgtcttcaacggacaatctggacagatcctgtttaggtctaacgggaatatcactcgggagcttaccaacatcactttcggctttcggaccagggatgcaaatgttatcatactccatgccgaaaaggaacccgagttcctgaatatctccattcaggactctaggctttttttccagctgcagtctgggaattccttttacatgctgtctctgacaagtttgcagagtgtcaatgacggcacttggcatgaagtgacgctctccatgactgatcctctgtcacaaacatccaggtggcagatggaggtggataatgagacgccctttgtgactagtaccatcgctacggggagcttaaactttctcaaggataataccgacatctatgtgggggaccgagccattgacaatatcaaaggcttgcagggttgcttgagcacaatcgagatcggcggaatctatctatcttatttcgagaacgtgcacgggtttattaataagcctcaggaggagcagttcctgaagataagtacaaactctgtggtgaccggctgcctgcagctcaacgtttgcaacagcaacccatgcctgcatggaggcaattgcgaggatatttacagctcctaccattgtagctgcccactggggtggagcggaaaacattgtgaattaaacatcgacgagtgcttctccaatccgtgtatccacggtaactgctccgatcgagtggccgcttaccattgcacctgcgaacccggctacaccggtgtcaactgtgaggtcgatattgacaattgccagtcccaccagtgtgcgaacggcgcgacatgcatttctcacactaacggttactcttgtttatgctttggaaatttcacggggaagttctgccggcagagcagactcccttctaccgtatgtggcaacgagaagactaacttgacttgttacaatggcggaaactgtacagaattccagactgaactcaagtgtatgtgccgtcccggcttcaccggcgaatag

SEQ ID NO: 183968 - DNA, 129 bp, Artificial Sequence
  Description of Artificial Sequence: Synthetic coding sequence
gagaaggacatcgacgagtgcgccagcgacccctgcgtgaacggcggcttgtgccaggacctcctgaacaaattccagtgcttgtgcgatgttgccttcgcaggcgagaggtgcgaagtcgattactag

SEQ ID NO: 183969 - DNA, 4149 bp, Artificial Sequence
  Description of Artificial Sequence: Synthetic coding sequence
atgaaggacccctgcttcagcaacccctgccagggcagcgccacctgtgtgaacacccctggtgaaaggtcatttctttgtaagtgccccccagggtacagcggtacgatttgtgaaactactatcggctcctgtggcaagaacagctgtcagcacggcggtatttgtcatcaggatccaatctatccggtgtgtatttgccccgcaggctacgccggaagattctgcgaaattgatcatgatgagtgcgcgtcatcaccatgccagaacggtgccgtgtgccaggatggcatcgacggttattcttgtttctgtgtgcctggctaccaaggacggcattgtgacctggaggtggacgaatgtgctagtgacccctgtaagaacgaagcaacatgcctgaatgaaatcggcaggtatacttgcatttgtccccacaattactccggagtaaactgcgaattggagattgacgagtgctggtcccagccttgcctcaacggtgccacgtgtcaggatgcgctgggcgcgtatttctgtgactgcgcgcctggctttctgggtgatcactgtgaattaaacacggatgaatgcgccagccagccttgccttcacgggggtttgtgcgtggacggtgaaaatcgatactcttgcaattgcacaggttccggtttcactggcacacattgtgagaccctaatgcccctgtgctggagcaagccctgccataacaacgctacgtgtgaggacagtgttgataactatacctgtcactgctggccagggtacactggggcccaatgtgaaatcgatctcaatgaatgtaattccaacccgtgccaaagtaacggggagtgtgtcgaactgtcttccgagaagcagtacggtcggattactggactgccatcaagctttagctatcacgaggcatccggatatgtgtgtatttgccaacctggatttactggaattcattgtgaggaagacgtgaacgaatgttcctccaatccatgccagaatgggggaacctgcgagaacctgcccggcaattacacatgccactgcccattcgataacctcagcagaaccttttacggcggtcgggactgttctgatattctgctgggctgcacacaccagcagtgtctgaacaacggcacctgcatccctcattttcaggacggccagcatggatttagctgtctatgtccgtccggttacacagggtccctgtgcgaaatcgccacaactctcagtttcgagggggatggctttttatgggtcaaatctgggtctgtgacaaccaaaggaagcgtgtgcaacatcgcactgcgctttcagactgtccagcccatggcccttctgctgttcaggtctaaccgcgacgtgttcgtgaaactggagctgctgtccggttacattcacctgtcgatccaggtcaacaatcaaagtaaggtactgctttttattagccacaatacctccgatggggagtggcacttcgtcgaagtgatcttcgccgaggccgtgaccctcactcttattgacgactcttgcaaggaaaaatgcatcgccaaggccccaaccccccttgagagtgaccaaagcatctgtgcatttcagaacagcttcctagggggtttgcccgtggggatgaccagcaatggcgtcgccctgttaaatttttacaacatgccttccacaccctcctttgtggggtgcctgcaggatattaaaatcgactggaatcatattaccctggaaaacatcagttctgggtcctcattaaacgttaaagctggctgcgtgcgcaaggactggtgtgaaagtcagccgtgccagtctcgggggaggtgtatcaatctctggctttcgtaccagtgcgattgccatagaccttacgagggtccaaactgcctacgggagtatgtggccggaagattcgggcaggacgatagtactggctacgtgatctttacattggacgaatcttatggcgacacgattagtctgtctatgttcgtcaggactttgcagccttccgggcttctcctcgcattggagaacagtacataccagtatatcagggtctggcttgagaggggacgcctggcaatgctcacaccaaattcaccaaaactggtggtgaaatttgtgttgaacgacggaaatgtgcatctcatttcactgaagattaaaccttataagatcgaactatatcagtcttcccagaacctgggcttcatcagtgctagtacttggaagatcgaaaagggggacgtgatttatattggaggactcccagacaagcaggaaaccgagctcaacggcggttttttcaagggctgcattcaggacgttcgactgaataatcagaatctagaattctttcctaaccctactaataacgcatcacttaatccggtcttagtaaacgtgactcaaggttgcgctggcgataactcgtgcaagagacagaccaatgtgggtcgggcgctgacggaactagggtctaggggcccgaaatatcaggttagcctgttccgtttctgcgtgggctcctgggccacaggcaacacgttttttctgagcagtataaaacctggctctaacccttgccacaacggaggagtctgccactctcgatgggacgactttagctgtagctgccccgcgctgacatcgggaaaagcttgcgaggaagtgcagtggtgtggcttctccccctgcccacatggggcgcagtgtcaaccagtcctccagggattcgagtgcatcgcgaacgctgttttcaacggtcagtcaggccagatcctttttcgttcaaatgggaacatcaccagggagctcaccaatatcacctttggattcaggacccgagacgcaaacgtcatcatactgcatgcagaaaaagagcctgaattcctgaacatttcgatacaggattctcggctgtttttccagctgcagtctggcaactccttctacatgctctcattaacgagcttgcagagcgtgaatgatggcacgtggcacgaggtgaccttgagcatgacagacccactctcgcagacatctcgttggcagatggaggtggataacgaaactcccttcgtaacgagcacaattgccactggctccttgaattttcttaaggacaacacggatatctatgtcggcgatcgcgccatcgacaatattaaagggctacagggctgtctgagcaccattgagatcggtggaatctacttgagctacttcgaaaatgtgcatggtttcatcaacaaacctcaggaagaacagttcctcaaaatctccacgaacagcgtagtcaccggttgcctccagttgaacgtatgtaactccaatccttgtttacatggtggcaattgtgaggatatatactcctcataccactgctcctgccccttggggtggagcgggaaacattgtgaactcaacatagatgagtgtttctctaacccttgtattcatggaaactgctcggatcgggtggccgcatatcactgcacctgtgaacctggctatacaggcgttaactgtgaggtggacattgataattgtcagtcacatcagtgtgccaacggtgccacatgcatcagccacaccaatggctattcgtgcctgtgtttcggcaattttactggtaagttttgtcgtcagtccagattaccctccacagtgtgtggcaatgaaaagacaaacttgacgtgctataacggtggcaactgcaccgagtttcagaccgagttaaagtgtatgtgtcggccaggcttcacaggcgaatggtgtgagaaggatattgacgaatgtgccagcgacccatgcgttaatggcggcctttgccaggacctgttaaacaagttccagtgtctgtgtgatgtggctttcgccggagagcgatgtgaagtagacctggcagatgacctaatcagtgacatcttcacaactatcgggtccgtgactgtcgcgttattgctcatcttgcttctcgccatcgtggcctctgtggttacctccaataagcgggcgacacagggtacttattcgccgagccgacaggagaaggaaggcagccgcgtagagatgtggaaccttatgccacccccagccatggagcgattaatctag

SEQ ID NO: 183970 - DNA, 2613 bp, Artificial Sequence
  Description of Artificial Sequence: Synthetic coding sequence
atggccctgaagaacatcaactacctgctgatcttctacctgagcttttcactgttgatctacatcaagaactccttctgtaacaaaaacaatacaagatgcctcagcaacagttgtcagaacaattctacttgtaaggacttctcaaaggacaacgactgctcctgctccgacactgccaacaacttagacaaggactgcgataacatgaaagacccatgctttagcaacccgtgccagggatcagccacttgtgtcaataccccaggagagaggagctttctttgcaaatgtcccccggggtactcagggaccatttgtgaaaccactatcggtagttgtggaaagaattcatgtcagcatggcggaatctgccatcaggatccaatttaccctgtctgtatttgcccggccggctatgccggacgcttctgtgagatcgaccacgatgagtgcgcctctagtccctgtcagaacggggccgtctgtcaggacgggatagacggttattcttgtttttgcgtgcccgggtatcagggccgccactgtgaccttgaggttgacgagtgtgctagcgacccctgcaaaaacgaggccacttgcctcaatgaaattggcaggtatacatgcatctgccctcataattatagcggtgtaaactgtgagctggagatagacgaatgctggagccagccttgcctaaacggagctacatgccaggatgcgttaggggcttatttttgcgattgtgcccctgggtttctcggggatcattgtgagctcaatacagacgagtgcgcctcacagccctgcctgcatggcggactctgtgtagatggggagaatagatactcttgcaattgtacagggagtggttttacaggtacccattgcgagacgttaatgcctctgtgttggagtaagccctgtcacaataatgcgacttgtgaagattccgtcgacaactatacctgccactgctggcccgggtataccggggcacaatgcgaaatcgatctgaacgagtgtaattccaatccatgtcagtccaacggcgaatgtgtagagctcagcagtgagaagcagtatggaagaataaccggattgcccagcagcttctcttaccatgaagcgagcggatacgtgtgcatttgtcagcccggatttacaggaattcattgcgaggaggacgtgaatgagtgctctagcaatccatgccaaaatggggggacatgtgagaatctccctggtaattatacatgtcactgtcccttcgataacctgtcacgcacattctacggtgggcgcgactgttcagatatccttttagggtgtactcaccagcagtgtctgaacaacgggacttgcataccccactttcaggatggacagcatggcttctcttgcctctgtccttccggatacaccggcagcctgtgcgaaatagcaacaacattatcctttgaaggggatgggttcctctgggtgaaaagcggttctgttaccactaaagggtcagtctgcaacatcgcactgaggtttcagaccgtccagccgatggcactgttactgttcagaagtaacagggacgtctttgtgaaacttgagctcctatctggctatattcacctgagcatccaggtcaacaatcagtcaaaggtcttgctgtttattagtcacaacacctcggatggcgagtggcacttcgtcgaagtgattttcgctgaggccgtcaccctcaccttgattgatgatagttgcaaagaaaaatgtatcgccaaggcccccacacccctcgagtcggatcagtccatttgcgcctttcagaatagcttccttgggggactaccagtcggcatgacgagcaatggagtggcactgctgaatttttataacatgcctagcaccccttcgtttgtcggctgcctccaggatatcaagattgactggaatcatattacgctagagaacatctcaagcggaagcagcctcaacgtcaaggctggctgcgtgcgcaaggactggtgcgagagtcaaccatgccagtcgaggggacgctgcattaatctgtggctgtcctaccagtgtgactgccatcgcccttacgaggggccaaattgcctaagaggaaagttctgccggcagtcccgactgccttccacagtatgtggaaatgaaaagacaaacctgacgtgctataacggcggtaactgcaccgaatttcaaaccgaactcaaatgtatgtgtagacctggatttactggtgagtggtgcgagaaggacatagatgaatgcgcttcagacccatgcgtgaatggtggcttgtgtcaggatctactgaataaattccagtgtctatgtgacgtcgctttcgcgggagagcggtgtgaggtcgatctggcagatgacttaatcagtgatatatttaccacaatcggttcagtgactgtagcactcctcctcatcctgctgctggccatcgtggcttctgtggttacctccaacaagagagccacccagggaacttacagtccatcccgccaggagaaagaggggagtcgcgttgaaatgtggaacctgatgcctcctccagcaatggagcgtctgatatag

SEQ ID NO: 183971 - DNA, 882 bp, Artificial Sequence
  Description of Artificial Sequence: Synthetic coding sequence
atgcccctgtgctggagcaagccctgccacaacaacgccacctgcgaagattcagtggataactatacgtgtcattgttggcccggctacacgggcgcacagtgtgagattgacttaaacgaatgtaattccaatccctgccagtcaaacggcgagtgcgtggagctgagctctgagaaacagtatggccggataacgggcttaccctcgtccttctcctaccacgaggccagcggttacgtgtgtatctgtcagccaggtttcacgggaatacactgcgaagaagacgtcaacgaatgttctagtaacccttgccagaatggtggaacgtgcgagaacttgccaggcaactatacctgccattgtccattcgataacttgtctcgcactttttacggaggcagagactgctctgacattctattgggatgtacgcatcagcagtgtcttaacaacggaacatgcatcccccatttccaggacggccaacatggttttagttgtttgtgtccaagtggttacacaggctctttgtgtgagatcgcaacgactctctcattcgaaggcgatgggtttctgtgggtaaaaagtggaagcgtgaccaccaaggggtctgtgtgcaacatagccttgcgttttcagactgtacagcctatggccctgctcctgtttcggagcaaccgggacgtgtttgtgaagcttgagctcctttccggttatatccacctctcgatccaggtaaataatcaatctaaggtcctgctgtttatctcccacaacacatccgacggagagtggcactttgtagaagcagtgagcaagactcttaaattgattgggattacacttccttggagaacaagccgactggcacaccactag

SEQ ID NO: 183972 - DNA, 2664 bp, Artificial Sequence
  Description of Artificial Sequence: Synthetic coding sequence
atggccctgctgctgttccggagcaaccgggacgtgttcgtgaagctcgagctgctgtcagggtacattcatctgagtatccaggtgaataaccagtcaaaggtgctgctctttatcagccataacactagtgacggcgagtggcacttcgtggaagtgatttttgcagaagctgtgacacttaccctgatcgatgattcttgtaaggaaaaatgtatcgccaaggctccaacaccactggagtccgatcagtctatttgcgcctttcagaactcattcctgggtgggcttcctgtaggaatgacctctaatggagttgccttactcaatttctataacatgccttctacaccttcctttgtcggatgtctccaagatattaagattgattggaatcatattacactggagaacattagcagtggctcctcgttgaacgtcaaagctggttgtgtcaggaaagactggtgtgagagccagccatgccaaagccgggggagatgcatcaatttatggttaagctatcaatgcgattgtcataggccctacgaggggccaaactgtctgagagaatacgtggctggacgatttgggcaggacgattcaactggatatgtgatctttaccttggacgagtcttatggcgataccatttctttgagtatgttcgtccgcaccctgcagcccagtggtctcctccttgcccttgaaaacagtacataccaatatatccgcgtctggttggaaaggggacggctcgccatgctaacccccaacagcccaaaacttgtggtcaaattcgtactgaacgacggcaatgtgcacctgatctcactgaagatcaagccttacaagatcgaactgtatcagagcagtcagaatctcggctttataagcgcttccacatggaagatagagaagggcgatgtcatctacattgggggtctgcctgacaagcaggaaactgagttaaacggaggcttctttaagggctgtattcaggatgtccggttgaacaaccagaatctggagttctttcccaaccctaccaacaacgccagtctgaacccagtactggtaaatgtgactcaaggatgcgctggtgacaacagctgtaaaagcaatccttgtcacaacggaggcgtctgccacagtcgatgggatgacttctcctgctcatgccctgccttgacctctgggaaagcctgtgaggaggtacagtggtgcggcttcagcccttgccctcacggtgcccagtgccagccagtgctgcaaggattcgagtgcatcgctaacgcggtgtttaatggtcagagcggacaaatcctgttccgcagtaacgggaacatcacacgggagctcaccaacatcacattcggctttcgcaccagggacgccaacgtgatcatattgcacgcagaaaaggaaccagagttcctgaacatctcgatccaggatagcaggctcttcttccagctgcagtcgggcaatagtttttacatgctctctctgacgtcactacagtctgtgaatgacggtacctggcacgaggtcactctgtccatgactgacccccttagccagaccagccgctggcagatggaggtggacaatgagacccccttcgtaaccagcaccatcgccaccggaagtctgaactttctgaaagacaacactgacatttatgtaggagaccgtgcaatcgacaacatcaagggacttcagggttgtctgagcacaattgagattggtggtatatatctgagttacttcgaaaacgttcatggattcataaataaaccacaggaggagcaattcctgaagattagcacaaactctgtcgtgacgggatgcctgcagttgaatgtgtgtaacagcaacccctgcctgcacggcggaaactgcgaggatatatacagttcctaccactgcagttgtcctctggggtggagcgggaagcattgcgaactgaatatcgacgagtgcttctccaatccttgtatccacggcaattgttcagatcgagtggctgcttatcactgcacctgtgaaccaggatacactggggtgaattgtgaggtggatatcgataattgccaatcccatcagtgtgcaaatggagctacatgcataagtcacacaaacggatatagctgcctttgctttggcaatttcactgggaagttctgcaggcagagtaggctgccttcgaccgtgtgcggcaacgaaaaaaccaatctgacctgctacaatgggggtaattgtaccgagttccagactgagctcaagtgcatgtgtcggcctgggtttaccggggagtggtgcgagaaggacatcgacgagtgcgcgtctgatccctgcgtgaatggcggactctgccaagacctgctgaacaaattccagtgcctctgcgatgtagctttcgccggagagcggtgcgaggtcgacctggctgatgatcttatctccgatatctttacgactattgggtccgtgacggtggccttgctcctaatccttctgttggccatcgtggctagcgttgttacatcaaacaaaagggccacccaggggacctacagcccctctcgccaggagaaggagggatcacgagttgaaatgtggaacttgatgcctccacctgctatggaacgactgatctag

SEQ ID NO: 183973 - DNA, 3885 bp, Artificial Sequence
  Description of Artificial Sequence: Synthetic coding sequence
atggccctgaagaacatcaactacctgctgatcttctacctgagcttctccctgctaatctatatcaagaactctttctgtaataaaaataacactcggtgtctcagcaattcatgccagaataattccacctgtaaggacttctctaaggataacgactgctcatgcagtgatactgcaaacaacctcgacaaggattgcgataacatgaaggacccctgtttctctaatccgtgccagggaagcgctacctgtgtgaatactcccggcgaacgatcttttctgtgtaagtgcccacccggatactccgggactatttgtgagactaccatcgggtcatgtgggaagaacagttgccagcatgggggaatctgtcatcaggatccaatttacccagtatgtatatgtccggcgggctatgctggcaggttctgtgaaattgaccatgatgagtgtgctagctcaccctgtcagaacggcgctgtgtgtcaagacggcattgatggctatagctgcttctgtgttcctggctaccagggacggcactgcgatctcgaagtggatgaatgcgcctccgatccatgcaagaacgaggcaacatgcctgaacgaaataggccggtatacctgcatttgtccgcacaattatagcggatataccggagcacagtgtgagattgatctgaacgagtgcaatagcaatccatgccaatctaatggggagtgcgtggaacttagcagtgagaagcagtacggaagaattaccgggttgccctcctcattctcgtaccacgaggcgtccggctacgtttgtatctgccagcctgggtttacgggcatccactgtgaagaggacgtcaacgagtgttcctccaacccctgtcagaacggcggcacatgtgagaatctaccaggcaattatacatgtcactgcccattcgacaacctgagcagaaccttttacggcggccgagactgttcagacatcttgctgggatgcacacatcagcagtgcctgaacaatggaacttgtatccctcactttcaggatggccagcacggattcagctgtttgtgcccctccgggtatacaggctccctttgcgagatcgctaccaccctatcctttgagggcgatgggtttctttgggtcaagtctggctcagtgacgaccaagggcagcgtgtgcaacattgcgctgcgttttcagactgttcagccgatggctctattgctgtttaggagtaaccgggacgtctttgtgaagttggagttgctcagtgggtatattcacctgtcaattcaagtcaacaatcaatctaaggtgctcctgttcatatctcataatacctctgatggtgagtggcacttcgtcgaggtgatttttgctgaagctgttacactcacactaattgatgatagttgcaaggaaaagtgtatcgctaaggcaccaacaccgttggagagcgaccaatccatttgcgcctttcaaaattcgttcttgggaggactgcctgtggggatgacgtctaatggagtggcactgctgaacttttataacatgcccagcacccccagttttgtaggctgtctgcaggacatcaaaatcgactggaatcacataaccctggagaacattagttctggcagcagtttaaacgtaaaggccggttgcgtgcgaaaagactggtgcgaatctcagccctgtcaaagcagggggagatgtattaatctgtggctgtcttatcagtgcgattgtcatcggccttacgaggggcccaattgcctgcgggagtacgtggcaggccggtttggtcaggatgattcaaccggatacgtaatttttactttggatgagagttatggcgatacaatctctctgtctatgtttgtcaggacactccaaccatcggggctgctgttagcactagaaaacagcacatatcagtacatccgagtgtggctggagagaggaaggctggctatgctcactcctaactcacccaagctggtagtcaaatttgtccttaacgacgggaacgtgcatcttatctcccttaaaattaaaccctacaagatcgagttgtatcagtcatcccagaatctcggtttcattagcgcttcaacgtggaagatcgaaaaaggcgacgtgatctacataggaggactgcccgataagcaggaaactgaactgaatgggggatttttcaagggctgcatccaggacgtgagactcaacaatcagaacctcgaattcttccctaatccaactaacaatgctagcctgaacccagtgctcgtgaatgtgacccaaggatgcgcgggcgacaatagctgcaagtccaatccttgtcacaacgggggtgtgtgtcactcaaggtgggacgacttttcttgttcctgccctgccttgacaagcgggaaggcgtgtgaggaagtccagtggtgtgggtttagcccctgccctcacggagcccagtgccagcccgttctgcagggattcgagtgtattgctaacgccgtgtttaacggccaatctggccagattttgtttcggtccaacgggaatataaccagggaactgaccaatataacattcggcttccgcactagggatgccaatgtcatcattctgcacgcggagaaagaaccagaatttctgaacatctcaatccaggacagccggttgttttttcagcttcagtctggtaattccttttacatgttgtctctgaccagcctgcagagcgtcaatgatgggacttggcacgaagtaaccctcagtatgactgaccctctcagtcagacttctcgttggcagatggaagtggataacgaaaccccgttcgtgacttccaccattgcaacaggctctctgaacttcctaaaggacaataccgatatttacgtcggagatcgcgcgattgataatattaagggactgcagggatgcctgagcaccatcgaaattgggggcatttatctgagttattttgaaaacgtccacggatttatcaataagccccaagaagaacagtttttaaagatctccacaaattctgtggtgaccggctgccttcagctaaacgtatgtaattctaatccatgcctgcatggtgggaactgtgaggacatatattccagttatcattgctcttgccctctgggctggtccggcaagcactgcgagctgaacatcgatgaatgtttttcgaatccatgtatccacggcaactgctcagatcgcgtcgccgcgtaccactgcacatgcgaaccaggctatactggagtgaactgcgaggtggacatcgataactgtcagtcgcatcagtgtgctaatggtgcaacatgcatcagccacaccaatgggtacagctgtttatgcttcggaaattttaccggaaagttctgccgccagtcccggttgccctcaacagtctgcgggaacgaaaaaactaacctgacctgctacaacggcgggaattgcacagaattccagacagaactgaaatgcatgtgccgtccaggattcaccggagaatggtgtgaaaaggacatagatgagtgcgctagcgatccatgcgtaaatggcggactgtgccaggacctgcttaataaattccagtgtctctgcgatgtggcctttgccggggagagatgtgaagttgatctggcggacgacctgattagtgatatattcaccactattggctcggtgaccgttgccctcctcctgatcctgctgctcgctatcgtggcttctgtcgtgacttccaacaaacgggccacccaggggacttattcgccgtcccggcaggagaaagagggctctagagttgagatgtggaatctcatgcccccacccgcaatggagaggctgatctag

SEQ ID NO: 183974 - DNA, 3531 bp, Artificial Sequence
  Description of Artificial Sequence: Synthetic coding sequence
atggccctggcccggcccggcacccccgacccccaggccctggcctcagtcctgttactcctgctctgggcacccgcgctctccctactggcgggaacagtaccatcagagccaccctctgcatgtgcttctgacccatgcgcccctggtacggagtgtcaagcaacagaatcaggtgggtatacctgcggaccaatggagcccagaggctgtgctacacagccatgccatcacggagccctctgcgtgcctcaggggcctgaccccaccggattcagatgttactgcgtccccggatttcagggaccccgatgtgagttggatatcgatgaatgcgcttcccgcccctgccaccacggggcaacctgccggaacctggctgacagatatgagtgccattgcccactgggatacgccggggttacatgtgagatggaagtcgacgagtgcgcatccgctccatgcttacacggtgggagctgtctggacggggtggggtcctttaggtgcgtgtgcgcgcctggatacggcggtacccgctgtcagctagaccttgacgagtgtcaatcccagccttgcgctcacgggggtacctgtcatgacctggtgaacggatttcgctgcgactgcgcaggtacgggctacgagggcactcactgtgagcgggaagttctagaatgtgctagcgctccctgtgagcacaatgcatcttgtctcgaaggtctgggctcttttcgctgtctgtgttggccagggtactctggtgagttatgcgaggtggacgaagatgagtgcgcctcttctccctgtcagcatggaggaagatgtctccagcgctcagacccggccctttacggcggggtgcaggccgcgttccctggcgctttctcttttcgacatgctgcaggcttcttgtgtcactgcccccccggctttgagggggctgattgtggcgtcgaagtagacgagtgtgccagccggccatgcctcaacggggggcattgccaggacctgccaaacggttttcagtgccactgcccagatgggtacgcgggccccacatgcgaagaggatgtggacgagtgtctctctgacccttgccttcacggcggaacttgctccgatactgtcgcaggctacatttgcaggtgcccagaaacatggggtggaagggattgctccgtgcagctgacaggctgccagggtcatacatgcccactggcagcgacatgcattcctattttcgaatccggggtacattcctatgtgtgccactgccctcccggcacacacggacctttctgcgggcagaatacaacgttcagcgttatggccgggagccctatccaggctagtgttccagctggcggaccgttggggctggccttgagattccgcacaacgcttccggcgggaaccctggctaccaggaatgatacgaaggagagcctcgaactcgccctcgtggccgcaacactgcaagcaaccctgtggagctattctacaaccgtcctagtcttaaggctgccagaccttgcactgaatgatggccactggcaccaggtggaagtggtgttacaccttgccacactggaactgcggctgtggcacgaaggctgccctgcccggctgtgtgtcgcctccggacccgtggctctagcaagcacagcgagcgccactccattgcctgccggcatcagcagtgcacagttaggcgatgccacattcgctgggtgcttacaggacgtccgggtcgatggccatctcttacttcctgaggatctcggcgagaacgtgctgctcggttgtgagaggcgtgagcagtgtcggcctttaccttgcgtccatggggggtcctgcgtggatctttggacccattttcggtgcgactgcgccagaccccataggggccctacatgtgcagacgagatccccgccgccaccttcggactggggggtgctccctcgtcagcttcctttttactccaagaattgcccgggccgaacttgaccgtctcgttcttattgagaacacgagagtccgctggattgctgttgcagtttgccaatgatagcgccgccggtctcactgtgttcctgagtgaggggagaatacgggcggaggtacccggttctccagcggttgtgctgccgggacggtgggatgacggcctacgtcaccttgtgatgctatcgtttggaccagatcagttgcaggacctggggcaacacgtgcatgtagggggaaggcttctggcagcagacagtcagccttgggggggccctttccgaggctgtcttcaggatctgcgtcttgatggatgtcatctgccgttctttcccctcccacttgataattcgagccaaccatcggaactgggaggcaggcaaagttggaatcttactgcaggctgtgtttccgaagatatgtgttcccccgacccctgctttaacggagggacgtgtctcgtgacctggaatgactttcactgcacttgcccagccaatttcacgggtcctacttgtgctcagcagctgtggtgccccggccagccctgtctgccacccgccacttgtgaggaggtccctgacggttttgtctgcgtcgcagaggccacattccgggaaggaccccccgccgcattcagcggacataatgcctcatcaggcagattgctgggaggtttgtcactcgccttcaggacacgggactcagaagcttggctgctccgggccgccgcaggcgcgctcgagggcgtatggctggcagtgcgaaacgggtccctcgccggaggcgtacgaggaggccacggcctgcctggtgccgtactccccataccgggcccccgcgtcgccgacggcgcttggcaccgagtgagactggctatggaaagacccgctgcaacaaccagccgctggctgctctggctggacggggctgcaacacccgtggctttacgaggtctcgcatccgatttgggttttttgcaggggccaggtgcagttcggatcttactggctgaaaactttacgggctgcctgggccgcgtggcactcgggggtctgcccctcccactggctaggcctcgtcctggagcagccccaggcgccagagaacattttgcctcctggcccggcacgccggcccccattctgggttgcagaggcgccccagtgtgtgctcccagcccttgcctgcacgacggggcctgccgagacctcttcgacgctttcgcatgcgcctgcggacccggatgggagggccccagatgcgaggcacatgtggatccttgtcacagcgcaccctgcgcacggggacggtgtcacacacacccagacggcagattcgagtgtagatgccctcccgggttcggtggcccaagatgcagatgggatggatgggctggtgggtgggctgccaacgctccgtggggctatgggggcgcggagaagtccgcccgttcggtggatgagagcctcccgttccccggaccacacgtcctgatctgcgatatgcggcgcaccgtgtag

SEQ ID NO: 183975 - DNA, 2862 bp, Artificial Sequence
  Description of Artificial Sequence: Synthetic coding sequence
atggccatggagcccggcgccctgtggaccttcctgggccacctgtggctgcttgccggaccaacctgcgaggaggatgtggatgagtgtctaagtgatccctgcctgcacggcggtacatgctccgacacagtggcgggatacatctgccggtgtccggagacctggggggggcgggactgctccgtccagcttaccggatgtcaggggcacacatgcccccttgcagcaacctgtatccctatttttgaatccggggtccatagctacgtctgccactgcccccccgggacccacggtccattctgtggtcaaaacacgacattctccgtgatggccggctctccaattcaggcaagcgtccctgcagggggccctctgggcctggcactacgtttcaggactactttaccagctggaaccttggcaacacgtaacgacacaaaagagtcactagagctcgcattagtggccgctaccctgcaggccactctgtggagttattccacgactgttctggtgctccggctccccgatctagctctgaatgatgggcactggcaccaggtcgaagtggtgctgcacctcgcaactcttgaattaagattgtggcacgagggctgccccgctaggctgtgcgtagcctccgggcccgtcgcccttgccagcacagcctctgcgaccccactgcccgccggaatctcctctgcccagctgggcgatgccacttttgccggttgcctccaagacgtgagagtagacgggcacttgctgcttcccgaagacctgggtgagaacgtgttgctcggctgtgagaggcgcgaacagtgccgtccactgccttgtgtgcatggcggctcgtgcgtagacctatggacccactttcgctgtgactgcgcccgacctcatcggggtcctacctgtgctgacgagatcccagccgccacattcggattaggcggggccccttcatcagcttccttcttgctgcaagagctcccaggacctaacctgactgttagttttctcctaagaaccagggaatctgccgggctgctactgcagttcgcgaatgattcagcggccggccttacggtctttctgagcgagggacgcatcagggccgaggttccaggttccccggctgtggtgctccccggtagatgggacgatgggcttcgacatctcgtcatgttatcatttgggcctgatcaacttcaggatctgggccagcatgtgcacgtcgggggacggctgctggcagcggactctcagccctggggcggaccatttagagggtgtcttcaagatctgcgactagatggttgtcacctgccatttttccctctgcccttagataattcctctcagccttctgagctggggggcagacagagctggaacctgaccgcaggatgcgtgtcagaagatatgtgttcccctgatccatgtttcaatggcggtacatgcctggtcacgtggaatgattttcactgtacttgcccagccaattttacggggcccacttgtgcacagcaactgtggtgccccggtcagccctgcctcccacccgccacctgtgaggaggtccctgatggctttgtttgcgtggcagaggccactttccgcgaaggccctcctgcagctttcagcggccacaacgccagtagcggccgcttgctgggtggcctgtccttagcattccgaacgcgagactcagaggcatggcttctccgggctgcggctggtgctctggaaggcgtctggctggccgtgaggaatggttccctagcagggggggtacggggtgggcacggactgccaggcgcagttctgccgataccaggtcctcgcgtcgcagacggcgcctggcacagggtgcgcctggctatggagcgcccggccgccacaacgtcacgctggcttctgtggctagacggcgccgcaaccccggttgccctgaggggactggcatccgacctggggttcttgcaggggcccggtgctgtccgtatcctgctggcagagaacttcaccggttgcctggggagggtcgcattgggcggactgcctttgccactggcacgccccaggcccggggcagctcctggagctcgggagcatttcgccagctggccaggaactcccgcccctattctaggatgccggggtgcacccgtttgcgctccctctccctgtctgcatgatggggcttgtcgggatttgtttgatgccttcgcctgcgcttgcggtcctggttgggagggacctagatgcgaagctcacgtggatccctgtcactccgcaccttgcgccagagggaggtgtcatactcatccagacggaaggtttgaatgtcgctgccccccaggatttggcgggccgagatgtcgtctcccagtgccttctaaagaatgctctctgaatgtcacatgtctagacggttcaccttgtgagggcgggagccctgccgccaactgcagttgcctagaaggcctggcagggcagcggtgccaggtgccgacacttccttgtgaggccaacccatgtctgaacggcgggacctgtcgggcggccgggggagtctctgaatgcatctgtaatgcacgattctccggacaattttgcgaggtagctaaaggtctgccattaccactgcccttccctctcctggaagtcgctgtacctgccgcctgtgcgtgccttctgttgcttttgctcggtctcctcagcggtatccttgccgcaaggaaaagacgccagtctgaaggaacctatagcccatcccaacaagaggttgctggagcaaggctggagatggacagcgtgcttaaagtgccccccgaggagcgactgatttag

SEQ ID NO: 183976 - DNA, 3858 bp, Artificial Sequence
  Description of Artificial Sequence: Synthetic coding sequence
atggccctggcccggcccggcacccccgacccccaggccctggccagcgtgctgctactcctgctctgggcacctgccctctcacttctcgctggaacagtcccttcagaaccaccttctgcatgcgcaagcgatccatgtgctccaggcacagaatgccaggccactgagtccggtggatacacttgcggtcccatggagccaaggggatgcgctactcagccttgtcaccatggcgcattatgtgtcccccaagggccagaccctaccggcttcagatgttattgcgttcccgggtttcaaggacctcggtgcgagctcgatatcgatgagtgcgcgtcgcgcccatgtcatcatggtgcaacttgcagaaacctggcggatagatatgaatgtcattgcccgttggggtacgccggcgttacgtgtgagatggaagtcgacgaatgcgcctccgccccgtgcctccacggaggctcttgcctggacggagttggctcttttagatgcgtctgcgcccctgggtacgggggtactcgctgccagctcgatctcgacgaatgtcaatcacaaccatgcgcccacggaggcacatgtcacgatttggtaaatgggttcagatgcgactgcgcagggaccggatacgagggcactcactgcgaaagagaagtcttggagtgtgcctctgccccgtgtgagcacaacgccagttgtctggagggcctcggctcctttaggtgcttgtgctggccgggctacagcggcgagctgtgcgaggtggatgaagatgagtgtgcttccagcccctgtcagcacggtggaaggtgtctacagcgaagcgatcccgccctttacgggggagtacaagccgcattccctggggccttcagctttaggcacgcagctggattcttgtgccactgtcctcccggcttcgagggagcagactgcggggtggaggtggatgagtgcgctagtcgaccctgtctgaacggcggccattgccaggacctgcctaacggcttccaatgtcactgtccagatggatatgcaggcccgacatgtgaggaggacgtcgatgaatgcctctccgacccttgtcttcacggagggacgtgctcagacacagttgccggatatatttgccgatgtcctgagacctgggggggccgcgactgtagcgttcagttaacagggtgccaggggcatacatgcccactggcagcaacctgtatacccatcttcgagtctggggttcattcctatgtgtgccactgtcctccaggaacccatggaccattttgcgggcaaaatactactttctcagtcatggctggaagtccgattcaggccagtgtgcctgctggcggccccctgggcctggctcttcgatttagaactacactccccgcgggcacactcgctactcgcaacgacacgaaagaatccctagaattggcactagtggcagctaccctgcaggccacactctggtcatacagtacaacagtgctggtcctcagactgcccgacctggcactcaatgacgggcactggcaccaggtagaggtggtactccacctggctactttggagctgcgcctctggcatgaggggtgccccgcaagattatgtgtggctagtgggcccgtcgcattggccagcaccgcatccgctactccactccccgctggcatctcctctgcccaactgggtgatgccaccttcgcagggtgtcttcaagatgttagggtagatgggcatctacttttgccggaagatctaggtgaaaatgtgctcttgggatgcgaacgccgggagcagtgtcgacctttaccttgcgtccatggcggaagctgcgtagacttgtggacacatttcagatgtgattgtgcaagaccccaccgggggccaacatgtgccgacgagattcccgccgccacattcggactggggggggcaccctcaagcgcatcgttcttattgcaggaattgcccggaccaaacttgacagtcagtttcctcttgcgcacacgcgagagcgccggcctactattacaatttgccaatgactccgcagcaggcctcacagtgttcctcagcgaagggcggattagagctgaggtcccaggttcacccgctgtcgtcctgcctgggcgctgggacgacggcttgcgacacctcgtgatgctcagctttggcccagatcagctccaggacctgggtcagcatgtccacgtcgggggcaggctattagccgccgacagtcagccatgggggggtcctttcagggggtgcctccaagacctcaggctggacgggtgccaccttccattcttccctttgccgctcgacaactcctctcaaccatccgagttaggcggtaggcaaagttggaatctgaccgccggttgcgtctcagaggacatgtgctcacccgatccatgtttcaatggggggacctgcctggtgacctggaacgacttccactgtacttgcccggctaattttaccggtccgacctgtgcccagcagctgtggtgcccaggccagccttgcctgcccccagccacttgtgaagaagttccggatggctttgtgtgtgttgccgaggcaactttccgcgagggtccacccgccgccttcagtggacacaacgccagttcaggacggcttcttggcgggctcagcttggccttccggacgagggactctgaagcctggctgcttcgggccgcggccggggcgctggagggggtctggctggccgttcgcaatggtagcttagccggaggagtacgtggaggacacggtctgcctggcgcggtattacctatccccggcccacgggtggctgacggcgcctggcatcgggtgcgccttgcaatggagaggcccgccgccaccacttcgaggtggttactgtggctggatggggctgcaaccccagtagctctccgggggctggctagcgaccttggttttttacaggggcctggcgccgtgcggatcctgcttgcagaaaacttcacaggatgtttgggacgagtggcccttggggggctgcctcttcctctggcccgcccgaggccaggagcagcccctggtgcccgtgagcacttcgcaagttggcctgggacaccagctcccattctgggttgcagaggggctcctgtgtgtgcacccagtccctgtctgcacgacggcgcatgtagagatctttttgatgccttcgcgtgcgcctgcggccctgggtgggagggccctaggtgtgaggcccatgtggacccgtgccacagtgctccttgtgcccgagggaggtgccacacccacccagacgggaggtttgaatgccgatgcccccctggatttggtggcccaaggtgtcgattacctgtgccaagcaaagaatgtagcctgaacgtgacctgcctggatggatccccatgtgaaggcggaagccctgccgctaactgctcttgcctggaaggcctcgcggggcagagatgtcaagttccaacgctgccgtgtgaggccaacccatgtctaaacggcgggacctgccgggctgcaggcggagtctccgagtgcatctgtaacgcacgtttttcgggccagttttgtgaggtggccaagggactgcccctccctctccctttcccattgctggaagtggctgtgcctgctgcatgcgcatgcctcctgcttcttctgctgggacttctgagcggcattctggcagctaggaagcgccgtcaaagtgagggcacttatagcccttcgcagcaggaagtggccggagcgcgcctggagatggacagtgtgttgaaggtgccccccgaagagcgcttgatctag

SEQ ID NO: 183977 - DNA, 363 bp, Artificial Sequence
  Description of Artificial Sequence: Synthetic coding sequence
atggccaaccccggcctgggcctgctgctggccctgggcctgccctttttgctggccaggtggggacgcgcatgggggcagatccagaccacctccgccaatgaaaacagcacagtactgccttcatcaacgagctcgtcctccgacggaaacctgcgaccagaggctataaccgctataatcgtggtgttctctctcctggcggcactgttactggccgtaggtctggcgctgttggttagaaagctgcgtgaaaagagacagacagaagggacctaccggcctagttccgaggagcaggtaggggctagagtccctcctacaccaaatttaaagcttcctcccgaagagcggcttatctag

SEQ ID NO: 183978 - DNA, 372 bp, Artificial Sequence
  Description of Artificial Sequence: Synthetic coding sequence
atggccaaccccggcctgggcctgctgctggccctgggcctgcccttcttgcttgccagatgggggcgggcctggggccagatccagactacctccgccaatgagaattcaactgtattaccctctagcacgtctagttcctcggatggcaacctgcgcccggaagctattacggccatcattgtcgtgttcagtctgctggcagccttgcttcttgctgtcgggctcgcactgctggtacgcaaactgagagagaagcgacaaactgaaggcacatatagacccagttccgaagagcaatttagtcatgcggccgaggcccgagcaccgcaggatagtaaggaaactgtgcaaggctgcctgcctatctag

SEQ ID NO: 183979 - DNA, 363 bp, Artificial Sequence
  Description of Artificial Sequence: Synthetic coding sequence
atggccaaccccggcctgggcctgctgctggccctgggcctgccctttctgttggccagatgggggcgagcctggggacaaatccaaaccacctctgccaacgagaatagcaccgtcctgcccagcagcactagctcaagcagcgacgggaatttacgaccggaggccatcactgccattattgtggtttttagcctgcttgcagccctccttctcgccgtggggctggccctcctggtccgaaagctgagggaaaaacgccagaccgaaggtacgtaccggccttcttctgaagaacaggtgggtgccagagtgccgccaacacccaatctcaagcttccacctgaggaacgcctgatctag

SEQ ID NO: 183980 - DNA, 1599 bp, Artificial Sequence
  Description of Artificial Sequence: Synthetic coding sequence
atgcccgccccccccggccggacccacacctggttcctgctgcagtccctggaggatctcgacaccagtctgcgcaaactgaacagtcgcctgtttgtcgtgcgcggacaacccgctgatgtgttccctaggttattcaaggagtggggagtcactcgcctaacttttgaatacgacagcgagcctttcggaaaggagagggacgcagcaatcatgaaaatggctaaggaagccggcgtggaagtggtgactgaaaattctcacaccttatacgatcttgatagaattatcgagttaaacggacaaaagccgccactaacctataagcgcttccaagccattatatccaggatggagttgccaaaaaaacctgtcggtctggtaacatcccaacagatggagagttgcagagcagaaattcaggagaatcacgacgagacctacggagttccgtccctggaggagctcggattccccactgaaggccttggtcccgccgtgtggcagggaggcgaaaccgaggccttagcaaggctggacaaacaccttgagagaaaagcctgggtggccaattacgagaggccccggatgaatgccaattccctgttggcctctcctactggtttatctccttacctccgctttggttgtctttcctgtagattattctattatcgactgtgggatctgtacaaaaaggtcaagcgaaattcgacgcctccgcttagcttgttcggccaacttctctggcgcgagtttttctataccgcggctactaacaatccccggttcgaccgcatggaaggcaacccgatctgcattcagatcccctgggaccggaatcccgaggccctggctaagtgggctgaaggcaagacggggttcccttggattgatgccattatgacacagctgcgtcaggagggctggattcaccatcttgcaagacacgccgtagcgtgtttcctgaccaggggtgatctgtgggtgagctgggagagtggtgtaagagtgtttgatgagcttctcttagacgcggatttttctgtcaacgcaggaagttggatgtggttgtcatgcagcgcctttttccagcaattcttccactgctactgtcctgtgggtttcggccgtcggacagacccctccggcgattatatccgtaggtacttacccaaattgaaggcgtttccatcccggtacatatacgagccctggaacgctcccgagtccattcagaaagctgccaagtgcatcatcggtgttgactatcccaggcctatcgttaatcatgctgagacctcccgtctgaacatcgagcgaatgaaacagatctaccagcagctgtcccgttaccggggcttgtgcctcctagccagtgtcccttcctgcgtggaagacctctcccatcccgtcgccgagccctctagtagccaggccggcagcatgtcctccgctggtcctcggccgctgccatccggccctgccagcccgaagaggaaactggaagcagctgaagaacccccaggggaagaacttagtaaaagggcccgggtcgccgagttgccaactcctgaacttccatccaaagatgcatag

SEQ ID NO: 183981 - DNA, 1845 bp, Artificial Sequence
  Description of Artificial Sequence: Synthetic coding sequence
atgggcggcgtgcacgtggcctaccggggcggcgccggcgtggccggcgccgtatggacggttatggctgccacagttgctaccgcagccgccgtcgctcctgcacctgctcctggcacagactctgcctcatccgtgcactggttccggaagggattgaggcttcacgacaacccggctttattggcagccgtgcggggcgccagatgcgtgaggtgcgtctatatcttggacccgtggttcgccgcaagttcatccgtgggcatcaatcgctggcgcttcctgttgcagtcgcttgaggacctcgatacctcgctgcgaaagttgaatagtcgactgtttgtagtacgcggtcagcctgctgatgtcttcccaaggctgtttaaggaatggggggtgacgcggttaacctttgagtacgattcagagccctttggcaaggagcgggatgctgccattatgaaaatggctaaagaggctggagtggaagtggtgacagagaattcacacacattgtacgatttagaccggatcatcgagctgaatgggcagaagcctcccctgacctataaacgtttccaggcaataatctcccgcatggaattgcctaaaaaacctgtgggcctggtgaccagtcagcagatggagtcctgcagggctgaaatacaggaaaaccacgatgaaacctatggtgtcccctcgcttgaagaactcggattcccgactgagggcctgggacctgctgtatggcaaggaggagaaacggaggctcttgccagactggataaacacttggagaggaaggcatgggtcgccaactatgaacggcctagaatgaacgccaactctctgttggcaagtccaacaggtttgtccccctacctccggttcggctgcttaagctgccgactcttttattaccggctctgggacctgtataaaaaggtgaaacggaactctacacctcccctctcactgttcgggcagctgctatggagggagttcttctacacagcagccacaaataaccccagatttgaccgtatggagggaaaccccatttgtatccaaatcccttgggatcgtaacccggaggcacttgccaaatgggccgagggtaagacaggattcccttggatcgacgctattatgacccaactgcggcaggaggggtggatccatcaccttgcccgccatgccgtagcctgcttcttgacccggggggatctttgggtgtcctgggagtcaggcgttagagtgtttgacgaattgctgctggatgcagatttctcagttaatgccggatcgtggatgtggctttcatgctcggcgttcttccagcagttctttcactgctattgtccagttggctttggtcgacgcactgatccttcaggtgattatatccgtaggtacctgccgaagttaaaggcctttccgtctcgctacatttacgaaccctggaacgctcctgaatctatacagaaggccgctaaatgtattattggtgtggactatcctaggcccatagtgaaccacgctgaaaccagccggctgaatatcgagcgcatgaaacaaatctatcagcagctctcccggtaccgtgggttatgtcttctcgcctctgtgccctcatgcgtcgaggacctgagccaccccgttgccgaaccctcttcctcccaagcagggtcaatgtccagtgccggaccaagacccctacccagcggccctgcttcacccaagcggaaactggaggcggcagaagagcctcccggcgaagagctctccaagcgggcacgggtggcagagttgccgactcctgaattgccctctaaagatgcctag

SEQ ID NO: 183982 - DNA, 522 bp, Artificial Sequence
  Description of Artificial Sequence: Synthetic coding sequence
atggacgtgaccatccagcacccctggttcaagcggaccctgggccccttttaccctagtagactcttcgatcaattctttggagagggactctttgaatacgatctcctgcccttcttgagttctacaatttctccctactatcgacagagcctcttccgcaccgtgttggattccgggattagtgaggtcagatcagatagagataagttcgtcattttccttgacgtcaagcacttttcacctgaggacctcactgtcaaggtgcaagacgactttgttgagattcacggtaagcacaacgaaagacaagatgatcatggctacatcagtcgtgagttccaccggcgctaccgcctgccgtcaaacgttgaccaatccgcactgtcctgtagccttagcgctgatggtatgctcaccttctgcgggcctaagattcagaccggactcgacgctactcacgctgagagggccatcccagtctctcgcgaggagaagcctacttcagcacccagttcctag

SEQ ID NO: 183983 - DNA, 570 bp, Artificial Sequence
  Description of Artificial Sequence: Synthetic coding sequence
atggccctggtgcggggcggctggctgtggcggcagagcagcatcctgaggcgctggaaaagaaactggtttgcattgtggctggacggaacattgggatactaccatgatgaaactgctcaggacgaagaggacagagttctcattcattttaatgttagagacataaagattgggcctgagtgccacgacgtgcagccgccagagggaagatctcgggacggattgttgaccgtcaatctgcgagaaggcgggcgcctgcacctatgcgccgagactaaggatgatgccctagcttggaagaccgccctgctcgaagccaattccacgcccgtgcgagtatactcaccataccaggattactacgaggtcgtgccacctaacgcccatgaagcaacctatgtccggagctactatggaccaccttatgccggacccggcgttacccacgtcatagttcgggaggatccatgttactctgccggtgcccccctcgccatgggcatgcttgctggggccgctacaggcgcggccctggggtccttgatgtggagcccatgctggttttag

SEQ ID NO: 183984 - DNA, 528 bp, Artificial Sequence
  Description of Artificial Sequence: Synthetic coding sequence
atggacatcgccatccaccacccctggatccggcggcccttcttcccttttcattctccttcacgcctatttgaccagtttttcggagagcacctgctggagtccgatttatttccaacttctacctcgttatcgcctttctatctcagacccccgtccttcctgagagcccccagctggttcgatacagggttgtcagagatgcggctcgagaaggacagattctctgtcaatttagacgtgaaacacttttctccagaggagttaaaagtgaaagttctgggggacgtgatcgaagtccatggtaaacacgaggagcgtcaggatgaacacggctttattagccgcgagttccatcgaaagtaccgtatcccagcagacgtagacccgctgactatcactagttcactttccagtgacggagtgctcaccgttaacggcccaaggaaacaggtgtcaggccctgagcgcacgatccctatcactagggaggagaaacccgcagtgactgctgctcccaagaaatag

SEQ ID NO: 183985 - DNA, 525 bp, Artificial Sequence
  Description of Artificial Sequence: Synthetic coding sequence
atggacatcgccatccaccacccctggatccggcggcccttcttcccattccacagccccagccggctcttcgatcagttcttcggcgagcacctgctggaatccgatctgttcccgaccagtacatccctgtcacctttctatcttaggccacccagcttcctgagggcaccatcctggtttgacaccggcttaagcgaaatgcgactcgagaaagacaggttctctgttaacctcgatgtgaaacacttctcccctgaagaactcaaggtcaaagtgttaggagatgtgattgaagttcatgggaaacacgaggagagacaggatgaacacggctttatctcccgagagttccataggaagtatcgtattccggccgacgtggatcctctgacaattactagctccctctcatctgatggtgtactcaccgtgaacggaccccggaagcaagtgtcagggccagagcgaactatccccataacgagagaggagaagcctgccgttacagcagcacccaaatag

SEQ ID NO: 183986 - DNA, 528 bp, Artificial Sequence
  Description of Artificial Sequence: Synthetic coding sequence
atggacatcgccatccaccacccctggatccggcggcccttcttcccattccactctccttctcgactctttgaccagttcttcggcgagcatcttctagagagtgacctgtttcccacttccacctccctgtcacccttctatctacgccccccgtcgtttctgcgtgcaccctcctggtttgacacaggcttgagtgagatgcgcctggaaaaggaccgcttttccgtgaacctggacgttaaacacttctcacccgaggagctcaaagtgaaagtgctcggcgacgtcattgaagtgcatggcaaacacgaggagcggcaagacgagcacggatttatcagtcgggaattccatcgaaagtacaggatcccagccgacgtcgaccctctcacaattacaagttctcttagtagcgacggagtcctgaccgtgaatggcccccgcaagcaagtgtcaggccccgagcgaaccataccaattacccgcgaggagaaacctgctgtaactgccgctcccaagaaatag

SEQ ID NO: 183987 - DNA, 234 bp, Artificial Sequence
  Description of Artificial Sequence: Synthetic coding sequence
atggacatcgccatccaccacccctggatccggcggcccttcttccccttccatagtcccagccgcctgttcgaccagttttttggcgaacacctcttagagtcagatctgttccctaccagcacttctttgtccccattttaccttcggccccccagctttctgcgtgctcccagctggtttgataccgggctgtccgaaatgcgtctggaaaaggataggttctccgtctag

SEQ ID NO: 183988 - DNA, 393 bp, Artificial Sequence
  Description of Artificial Sequence: Synthetic coding sequence
atggacatcgccatccaccacccctggatccggcggcccttcttcccatttcacagcccgagtcggctgttcgatcagtttttcggtgagcatttgctggagtctgatctgttcccgaccagtacctcactcagccccttttacctacgaccacctagcttcctgagggcaccctcttggtttgacacgggattatcagagatgcgtctggagaaggacaggtttagtgtgaacttggacgtgaagcatttctccccagaagaactaaaagtgaaggtccttggcgatgttattgaagttcacgggaagcatgaagaaaggcaggacgagcacggctttatcagccgcgaatttcaccgcaaatacaggataccggctgacgttgacccgtag

SEQ ID NO: 183989 - DNA, 528 bp, Artificial Sequence
  Description of Artificial Sequence: Synthetic coding sequence
atggacatcgccatccaccacccctggatccggcggcccttcttcccttttcacagtccatctagactcttcgaccagtttttcggggagcacctgttggagagcgacctctttccaaccagtacctccttgagcccattttacttgcgcccgccaagtttcctgcgcgcaccctcatggtttgacaccggattgtcagaaatgcgcctcgaaaaggaccggtttagcgtgaatctcgatgtgaagcattttagtccagaggagctcaaagtgaaagtactcggcgatgttatagaggtccacggaaaacacgaggagcggcaggacgaacacgggtttatttcgcgagaatttcaccggaaatacaggattccggccgatgtggacccgttaacgattacctcaagtctgtcatcagatggggtgctcacagtgaatggcccccggaaacaagtgagtgggccagaacggaccatccccatcacccgcgaagagaaaccggcggtaacagctgcgcccaagaagtag

SEQ ID NO: 183990 - DNA, 528 bp, Artificial Sequence
  Description of Artificial Sequence: Synthetic coding sequence
atggacatcgccatccaccacccctggatccggcggcccttcttcccattccactcgcccagccggcttttcgaccagttcttcggggaacacctcctagaatcagatctgttccctaccagcacctctctctctccattctacctaagacctccttcgtttctaagagcgccctcttggtttgacaccggtctgagcgaaatgcgccttgagaaagacagattttccgtcaacctggacgtgaaacacttcagccccgaggagcttaaggtcaaagtgttgggcgatgtgatcgaggttcacggcaaacacgaggagagacaagatgagcatggatttatctctagggagttccacagaaagtatcgaatccctgctgacgtggaccctctgactataacttcgagtttgagttccgacggagtgctgaccgtaaacggcccccgaaaacaggtgtccggcccagagagaactatccctattactcgggaggaaaagcccgctgtgacagctgctcctaagaaatag

SEQ ID NO: 183991 - DNA, 210 bp, Artificial Sequence
  Description of Artificial Sequence: Synthetic coding sequence
atggacatcgccatccaccacccctggatccggcggcccttcttccccttccacagcccatcccgactgtttgaccagttctttggcgagcacctgctggagtctgacctcttccccaccagtacaagtctgtcccccttctacctcaggccacccagcttcctgcgggccccaagttggtttgatactgggttgtccgaaatgcgctag

SEQ ID NO: 183992 - DNA, 2148 bp, Artificial Sequence
  Description of Artificial Sequence: Synthetic coding sequence
atgcacctgctgcccgccctggccggcgtgctggccaccctggtgctggcccaaccttgcgagggcacggatcccgcaagccctggtgccgtggaaactagcgtcctgagggattgtattgcagaggccaagctactggtcgacgccgcttacaattggactcaaaaatctattaagcagaggttgagatctggctcagcgagccccatggatctgctctcttactttaagcagcctgttgccgccacacggaccgtggtccgcgccgcggactacatgcacgtcgctctagggcttctagaggagaagttacagcctcagcgcagcggaccttttaacgtgacagacgtgttaaccgagccccagctgagacttctctcacaggccagtggatgtgcactgcgggatcaagccgagcgctgctctgataaatacagaacaatcactgggcgatgcaataataagaggcgacccctcctgggggcctctaaccaggcactggccaggtggctacccgcagaatatgaagacgggctgtcactgccttttggatggaccccctcccgcaggaggaatggcttcctgttaccactggtccgagcagtgagcaaccagatagtgagatttcctaacgagcgcttgaccagcgacagaggacgcgccttaatgtttatgcagtggggccagttcatcgaccacgacctggacttttccccagaatcgccagcccgagtggcctttacggccggcgtggactgcgagcgtacatgcgctcagctgccgccttgctttcccattaaaatcccccctaacgatcccaggatcaaaaaccagagagactgtataccttttttcaggtccgcgccctcttgtccacagaataagaatagggtcagaaatcagattaacgctctcaccagcttcgtagatgcgagcatggtgtatggctcagaggtgagtttgtcactgcggctacgcaaccgtaccaactacttaggcctgctggctattaaccaacggttccaggataacggcagggcacttctccctttcgacaatctccacgatgatccatgtctgctgacgaaccgttccgcacggatcccatgtttcctggcaggcgatacaaggagcaccgagactccgaagctcgccgctatgcataccctgttcatgagagagcacaatcggctggccaccgagctaagacgccttaacccccgctggaatggtgacaaattatacaatgaggctcgcaagattatgggtgctatggtgcagataattacctaccgcgacttcctgccgctggtgctgggcaaagcaagagcccgaaggacattggggcactataggggatattgtagtaatgtcgatcccagagttgccaatgtcttcacactggcatttcgatttggtcacaccatgctccagccctttatgttccgtttagactcccagtaccgggctagcgcaccgaactcacatgtacccctgagcagtgctttcttcgcaagttggcggatcgtctacgaaggaggcatcgatccaatcctgcgaggcctcatggcaacaccagcgaaattgaaccgccaggacgccatgttggtggatgagctccgggacagactgttccgccaagtgagacgaatcgggcttgacttggctgcactgaatatgcaaagaagtcgcgaccacggactgcctgggtataatgcgtggagacggttctgtggattgtcccagcccagaaacctcgcgcaattgtctcgagtcctcaaaaaccaagacttagcacgcaaatttctcaatttgtacggtactcctgacaacatcgacatctggattggagccatagccgaacccctactgccaggagcacgtgttggtcctctgcttgcctgcttatttgagaaccaatttcgccgtgctcgggacggagaccggttttggtggcaaaaaaggggcgtcttcacaaagagacagcgtaaggccctcagccgcattagcctcagtcgcattatttgtgacaacaccggaattacgactgttagccgtgatattttccgcgccaatatttatccgcgggggtttgtgaattgcagccgcattcctcgcttaaacctgagcgcatggcgaggcacctag

SEQ ID NO: 183993 - DNA, 594 bp, Artificial Sequence
  Description of Artificial Sequence: Synthetic coding sequence
atgagcagcgcccccgcccccggccccgcccccgccagcctgaccctttgggatgaagaggacttccagggaagaaggtgtagattgcttagcgactgcgctaatgtgtgcgaacgaggcggtctgcctcgcgtgaggagtgtgaaggttgagaacggggtttgggtggccttcgaatatcccgatttccagggtcagcagtttatccttgaaaagggcgactatcccaggtggtccgcatggagcgggtcctccagccataattccaatcagctgctgagcttcaggcccgttctgtgtgcaaaccataatgactcccgagttactctgtttgagggagacaacttccaaggttgtaaattcgatctcgtcgacgattatccgagcctgccatctatgggttgggcgtctaaagacgtgggatcgctcaaagtgagttccggtgcctgggtggcataccaatatccaggttatcgaggctaccagtacgtgctggagagggataggcactccggggagttctgcacttacggtgaactggggacccaggcccacacaggccaattgcaatcaattagacgggtgcagcactag

SEQ ID NO: 183994 - DNA, 594 bp, Artificial Sequence
  Description of Artificial Sequence: Synthetic coding sequence
atgagcagcgcccccgcccccggccccgcccccgccagcctgaccctctgggacgaagaggactttcaagggcgtcgttgccgattgctcagcgattgcgcaaacgtgtgtgaacgcggcggtctgcctagagttaggagcgtgaaggtggagaacggagtttgggtggcgttcgaatatcccgattttcagggccaacagtttattctggaaaagggcgactaccctcggtggtccgcgtggtctggtagctcttcacataacagtaaccagctcttgtccttcaggcccgttctatgcgccaaccacaatgactctagagtcactttattcgaaggcgacaattttcagggttgtaagtttgacctcgtggatgattatccgtccctaccaagcatgggatgggcctccaaagatgtagggagtcttaaagtatcatccggagcctgggtcgcctaccaatacccggggtacagaggctaccagtatgtcttggagcgcgaccggcacagcggtgaattttgcacatatggcgagttgggtacacaggcccacactggtcagctgcagtctattcgccgcgtgcagcattag

SEQ ID NO: 183995 - DNA, 390 bp, Artificial Sequence
  Description of Artificial Sequence: Synthetic coding sequence
atgagcagcgcccccgcccccggccccgcccccgccagcctgaccctttgggacgaggaggattttcaaggacggagatgccgcctcctcagtgactgcgccaatgtttgtgagcgagggggcctgcccagggtgcgctccgtaaaggtcgagaacggggtttgggttgcttttgaatacccagactttcaaggtcaacagttcatattggagaaaggcgactatccacggtggtctgcatggagtggcagctctagccacaattctaatcagctactgtctttccgccctgtcttgtgtgccaatcacaatgattctcgggttacactgttcgagggggataattttcagggctgcaaattcgacctcgttgacgattatccaagctag

SEQ ID NO: 183996 - DNA, 591 bp, Artificial Sequence
  Description of Artificial Sequence: Synthetic coding sequence
atgaccctgcagtgcaccaagagcgccggcccctggaagatggtggtttgggatgaagatggttttcagggtcgtcggcatgagtttacagccgagtgtccctcggttcttgagctcgggtttgagacagtcaggtcattgaaagtgctgtctggcgcttgggtcgggtttgaacacgcaggttttcaggggcagcagtacattttggaacgcggtgaatatccttcctgggatgcctggggaggcaataccgcctaccccgctgagcggctgacttctttccggcctgctgcatgtgctaaccaccgggacagcagattgaccatcttcgaacaggagaacttcctgggtaagaagggcgagttgagcgacgattacccatcccttcaggctatgggatgggagggcaacgaagtcggctccttccatgtgcacagcggcgcatgggtgtgcagtcagttcccaggttaccgaggctttcaatacgtcttggagtgcgatcaccatagtggggactacaaacactttagagaatggggaagtcacgcccctactttccaggttcagagcattagaaggatccagcagtag

SEQ ID NO: 183997 - DNA, 1614 bp, Artificial Sequence
  Description of Artificial Sequence: Synthetic coding sequence
atggagcgggtgaacgacgccagctgcggccccagcggctgctacacttatcaggtgagccgacacagtacagagatgcttcataacctcaatcagcagcggaagaatgggggaagattttgtgacgtgcttcttcgggtgggcgacgaaagcttccctgctcaccgcgctgtgctcgctgcctgcagtgaatacttcgagagtgtgttcagcgcccagctgggggatgggggggccgccgacggtgggcccgccgatgtggggggtgcgacagcagctccgggcggcggtgccggaggcagccgtgaacttgagatgcacacgatcagtagcaaggtgttcggcgacattcttgattttgcctacacttccaggattgtggtgcgcctcgaatcgtttcccgaacttatgacagccgctaagttccttctgatgcgcagcgtcatagagatatgccaagaggtcattaaacagtccaatgtgcagatcctcgtgccccctgctcgggccgacatcatgctgtttcgccctcccggaacttctgacctgggtttccctctcgacatgacgaatggagcagcgctcgccgcgaactccaacggaattgccgggagcatgcagcctgaagaggaagctgcccgtgcagcaggggcagcgatcgcaggccaagccagcctgccagttttgccaggggtggacagactccccatggtggcagggcccctgtcccctcagctgctcacatccccttttcctagcgtcgcgagttctgcaccccccctaaccgggaagagggggcgtggaagacccagaaaggccaacttgcttgacagcatgttcggctcccctggtgggcttagagaggccggaattcttccatgtggtctgtgtggtaaagtttttacagacgctaatcgtctgcgacagcatgaggcccagcacggagtgacttctctgcagcttggctacattgatttgccaccccctcgcctgggcgagaacggcctgccaatatcagaggacccagacggcccaaggaagcggagtagaacacgcaaacaggtcgcctgtgaaatctgtggtaaaatcttccgcgacgtgtaccacctaaaccgacataagctgtcacattccggtgagaagccatatagttgtccagtctgcgggctgaggttcaagcgcaaagaccggatgtcctaccacgtgcggtctcacgatggaagtgtcggaaagccctatatttgccagagctgtggaaagggctttagcaggcccgatcaccttaacggacacatcaaacaggtacacacatcggaaaggccacacaagtgccaggtgtgggtcggcagttctagtgggctgcctcccctggaaccactcccaagcgacctgccatcctgggactttgcacagccagcactctggcggtcttcccactcggtgcccgataccgccttctccctaagcctgaaaaagtccttcccagccttagagaatcttggccccgcacatagctcaaacaccctcttttgtccagccccccctgggtacctgcgacagggttggaccacaccagagggcagcagggcctttacacaatggccagttggttag

SEQ ID NO: 183998 - DNA, 618 bp, Artificial Sequence
  Description of Artificial Sequence: Synthetic coding sequence
atggccagcgaccaccagacccaggccggcaagccccagagcctgaatccaaagattataattttcgaacaggaaaacttccaagggcatagccatgaactgaatggtccctgtccaaacctgaaggagaccggagtggaaaaggccggttcagtgctcgtacaagctggcccttgggtcggatacgaacaagctaactgtaaaggggagcagttcgtgttcgaaaaaggcgagtacccgagatgggattcgtggacttccagccggcgcaccgacagtctgtcaagcctccggcctatcaaggtggattcacaagagcataaaattatcttatatgagaacccgaatttcaccggcaaaaaaatggagattatcgatgatgacgtgccctcgtttcacgctcacgggtaccaggagaaggtgtcatctgttagggtccagtcaggaacctgggtgggctatcagtaccccgggtatcgcggactacagtacttactggagaagggagactataaggacagctccgattttggcgcaccccacccacaggtgcagtccgtgagaaggattcgcgacatgcagtggcaccagcgaggagcgtttcaccccagtaattag

SEQ ID NO: 183999 - DNA, 1284 bp, Artificial Sequence
  Description of Artificial Sequence: Synthetic coding sequence
atgcggcacctgggcgccttcctgttcctgctgggcgtgctgggcgccctgaccgagatgtgcgagatccctgaaatggatagccacttggttgagaaactcgggcaacatctgctcccctggatggatcggctgtcgttggaacacctgaatccaagcatttacgtggggctgcgcctgagctctctgcaggccggcactaaggaggacctgtacctgcattccctgaagctgggataccagcagtgtttgctagggagcgcatttagcgaggacgatggtgattgccagggcaagccctctatggggcagctggctctctacctgctcgcactgagagccaattgtgagttcgtgagaggacataagggggaccgactcgtcagtcaacttaaatggtttctggaggatgaaaaaagagccatcggacacgatcataagggacaccctcataccagctattaccaatatggattgggcatcttagccctgtgcctgcatcaaaagcgagtacatgactctgtcgtcgacaagctgctttacgctgttgagccattccatcaaggacatcactccgtagacaccgcagccatggctggcctcgcctttacatgtcttaaaaggagtaacttcaacccagggagaaggcagagaatcaccatggccattcggacagtaagagaagagattttaaaagcccagacgcccgaaggacatttcggtaatgtgtactcaactccactggccctgcagttcctcatgacttcacctatgagaggtgccgaattgggtactgcatgtttgaaggccagggttgcactgctggcttctctgcaggatggcgctttccaaaatgcactgatgatctcccagctcctgcccgtgctaaatcacaaaacgtacatcgatctgatctttccagattgcctggctccccgggtgatgctcgagcctgccgccgagacaatcccccaaacccaggagatcatctctgtgacactccaagtcctgtcgttgctcccaccatatcgccaaagtatatctgtgctggctggatcaacagtggaggatgttctcaagaaggctcacgagctgggcggatttacctatgaaactcaggcctctctgtcaggcccatatctcacatccgtcatggggaaagccgcgggcgagcgggaattctggcaactgttaagagaccctaacacccctttgctgcaggggattgctgactaccgaccaaaggacggtgaaacaatcgagctcagactcgtttcatggtag

SEQ ID NO: 184000 - DNA, 525 bp, Artificial Sequence
  Description of Artificial Sequence: Synthetic coding sequence
atgggcaagatcaccttctacgaggaccgggacttccagggccggtgttacaactgtatctctgactgtcccaacttgcgcgtttatttttcccggtgtaactctatccgcgtagatagcggttgttggatgttgtacgaaaggcctaactatcagggacaccaatacttcctccgccggggcaaataccccgactatcagcattggatgggcctgagcgactccgtccaatcctgtagaataatcccccacacatccagccataagctccgactctatgagagggatgactatcgtggactgatgtccgagctgacggacgattgtgcctgcgtgcctgaattatttcgcctgcccgaaatctattctctgcacgtactggaaggctgctgggtgctgtacgaaatgccaaattataggggccgacagtatcttctgcggccaggcgattaccggcgataccatgattgggggggcgccgacgccaaggtgggtagcctccgtagagtgactgatctgtactag

SEQ ID NO: 184001 - DNA, 528 bp, Artificial Sequence
  Description of Artificial Sequence: Synthetic coding sequence
atgggcaagatcaccttctacgaggaccgggccttccagggccggtcatatgaatgcaccaccgactgtccgaacctgcagccatacttctcacggtgcaatagcatcagggtggaatccggatgctggatgatttacgagcgccctaactaccaaggtcaccagtactttctccggcgcggcgagtacccagactatcagcagtggatgggactgtccgattctattcggtcatgctgcctgatcccgccccactccggtgcataccggatgaagatctacgacagggacgaacttcgaggacagatgtcagagctgacagacgattgcatctcagtgcaagaccgctttcatttgactgaaattcactctctgaatgtgctcgaggggtcctggatcctgtacgagatgccaaactataggggtcggcaataccttctgagacctggcgaatatagaaggtttctggactggggagcacccaacgccaaagtgggtagtttgcggagagtaatggacctatattag

SEQ ID NO: 184002 - DNA, 525 bp, Artificial Sequence
  Description of Artificial Sequence: Synthetic coding sequence
atgggcaagatcaccttctacgaggaccgggccttccagggccggagctatgagacaacgactgactgcccgaacctgcagccttatttcagtaggtgcaatagcatccgagttgaatccggctgctggatgctatacgagcgtccgaattaccaagggcaacagtatttactgcgcaggggagaataccccgattatcagcagtggatggggctgagcgattctatcagatcttgttgcttgattcctcagactgtgagccatcgcttaagactctacgaaagagaggaccacaagggactcatgatggagctcagcgaggattgtccctctatccaggaccggttccatttgagtgaaatccgatctcttcatgtgctggaggggtgctgggttttatatgagttacccaactacagaggaagacagtacctcctgcgaccgcaggagtaccggagatgtcaagactggggcgccatggatgctaaggccggttctctgagaagggtggtggatctctactag

SEQ ID NO: 184003 - DNA, 525 bp, Artificial Sequence
  Description of Artificial Sequence: Synthetic coding sequence
atgggcaagatcaccctgtacgaggaccggggcttccagggccggcactacgagtgtagttcagatcatccgaatttgcagccttatcttagcaggtgcaacagcgcccgggtggactcaggctgctggatgttatacgagcagccaaattactcaggcctgcaatattttctgcggcgcggtgattacgcagaccatcagcagtggatgggtctgagtgattcagtgcggtcttgccggctgatcccacactcaggctcccatcggatacgcctgtacgagagagaagactatagaggtcagatgatcgagttcaccgaagactgtagctgccttcaggatagattcaggtttaatgaaattcacagtctgaacgtgttggagggctcctgggtgctctatgaactgtctaattaccgcggacggcaatacctactgatgcctggtgattaccggagataccaagactggggggctactaacgccagagtgggcagcttacgccgggtgattgactttagctag

SEQ ID NO: 184004 - DNA, 537 bp, Artificial Sequence
  Description of Artificial Sequence: Synthetic coding sequence
atgagcaagaccggcaccaagatcaccttctacgaggacaagaactttcaaggaagacgctacgattgcgactgcgactgcgccgactttcatacctatctgtctagatgcaatagtatcaaggtggagggaggaacttgggcggtttatgagcgtcctaattttgcaggttacatgtacatcctcccgcagggagagtacccggaataccagcgctggatgggcctcaacgatcggttgtcttcatgcagggctgtgcatctccctagtgggggccaatacaagattcagatatttgaaaagggcgattttagtggacaaatgtacgaaactactgaagattgtccaagcattatggagcagtttcacatgcgagagatccattcttgtaaggtcctggagggggtgtggatcttctatgagcttcccaattatagaggcagacagtacctgcttgacaagaaagagtataggaagcctatagattggggcgctgcatccccagccgtgcagagctttcggaggatcgtggagtag

SEQ ID NO: 184005 - DNA, 537 bp, Artificial Sequence
  Description of Artificial Sequence: Synthetic coding sequence
atgagcaagaccggcaccaagatcaccttctacgaggacaagaactttcaggggaggcgctacgactgtgattgtgactgcgccgatttccatacttatctgagccgctgtaattcaattaaggtggaagggggaacttgggctgtctacgagagacccaatttcgccgggtatatgtatatcctgccccagggcgaataccctgagtaccagagatggatgggactgaatgataggttgtcctcctgtcgcgccgtacatctgccttccggcgggcaatacaagattcagatcttcgagaaaggcgactttagtggacagatgtacgaaacaaccgaagactgcccctccataatggagcaattccacatgagagagatccactcatgtaaggttctcgaaggggtgtggattttttacgaactgcccaactatagagggcggcagtatctcttggacaagaaggaataccggaagcccatcgattggggggccgcttcacctgcagttcaaagcttcaggcggattgtcgagtag

SEQ ID NO: 184006 - DNA, 960 bp, Artificial Sequence
  Description of Artificial Sequence: Synthetic coding sequence
atggccagcagcgccgccggctgcgtggtgatcgtgggcagcggcgttataggccgctcttgggcgatgttgttcgctagcggaggatttcaggtgaagctctacgacatcgaacagcagcagatccggaatgccctcgaaaacatccgcaaagaaatgaaacttctagagcaggcgggatctctgaagggatctttgagcgtggaagaacagctctcccttatttctggctgcccaaacatacaggaagctgtggagggcgccatgcatatccaagaatgcgtgcctgaggatttagaactgaagaaaaaaatttttgctcagctggattctatcattgacgaccgcgtgatcctgagcagttctacaagctgtctgatgccgagcaagctttttgctgggctggttcacgtcaagcagtgcatagtagcacatcccgtcaatccaccttactatatccccctggtcgagctggtccctcacccagaaaccgccccaacaacggtggacagaacacatgcactgatgaaaaagattggacaatgtccaatgcgtgtccagaaggaggtagctggctttgtgctcaatcggttgcagtatgcaatcatctccgaagcttggcggttggtggaggaagggatcgtgtctccctcggatttagatctggtaatgtctgaaggtctgggcatgaggtatgcctttatcggaccactggagacaatgcatctgaatgccgaaggcatgctgtcatactgtgatcggtattcagaaggaataaaacacgtgttgcagacatttgggccaattcccgaattttctcgcgctaccgcggaaaaggtaaatcaggatatgtgtatgaaggtaccagatgaccctgagcacctggccgccagaaggcagtggagagatgagtgccttatgcgactggcaaagctgaagagtcaggttcagccgcagtag

SEQ ID NO: 184007 - DNA, 2346 bp, Artificial Sequence
  Description of Artificial Sequence: Synthetic coding sequence
atggccaagacccccagcgaccacctgctgagcaccctggaggagttggttccctacgatttcgaaaaattcaaattcaaactacagaacacgagcgtgcaaaaggagcattcgcggataccacggtctcaaatacagcgtgcgcgtcctgtcaagatggctactctgctggtaacttactacggggaggaatatgccgtacagctcaccctccaggtccttcgggcaatcaatcaaagactattggctgaggagctgcaccgagcagcaatccaggaatatagtacccaggagaatggaaccgatgactctgcagcgtcctcctccctgggggaaaataagccaagaagtctgaagacaccggaccatccagagggaaatgagggaaatggcccaaggccgtatggcgggggcgcagcttctctgagatgcagtcagcccgaggctggccggggcctttctaggaagcccctgtccaaaagacgggaaaaagcatccgagggcttagatgctcaaggcaaaccaaggaccagaagcccagccctgcctggcgggagatctccaggaccctgcagagcactggagggtggacaggctgaggtccggctgaggcgaaacgccagcagtgctggacggttgcaaggcctggctggcggggcgcccggccagaaagaatgtcgcccattcgaagtatacctgccctcaggcaaaatgagaccccgctcgctggaggtgaccatctccaccggagagaaggcccccgcaaatccagaaattctccttactctggaggagaagaccgccgctaacttagacagcgccaccgagccccgagctagacctacgcccgacgggggagcctccgctgatctgaaggagggacccgggaatcctgagcactctgttacaggacggcctcccgacacggcagcgagtccgcgctgtcatgcgcaagagggtgaccccgtcgatggaacatgcgtgcgggattcttgctcttttccggaagcggtaagcggtcacccccaggctagcggctctaggagtccaggttgccccaggtgtcaagactcacacgagcggaaatctcccggatcactgtccccccagcccttaccacagtgcaagcggcatttgaagcaggtgcagctactcttctgcgaagaccatgatgagcctatatgcctgatatgttcactaagtcaagaacatcaggggcatagagtgaggcccatcgaggaagtggctctcgagcataagaagaagattcagaaacagctcgagcacctgaaaaaactgagaaaaagcggcgaggaacagaggagctacggcgaggagaaagcagtgtcatttctgaagcagaccgaagcactcaagcagcgggtacaaagaaaactggagcaagtctactactttctcgaacagcaggaacatttttttgttgcctccttggaagacgtgggacaaatggtcggacaaatcaggaaggcttacgatactcgggtatcccaggacatcgctctccttgacgctctgatcggggagctggaggctaaggagtgccagtccgaatgggagctgctgcaggacatcggggacatcctgcaccgtgccaaaactgtgcctgtgccagaaaaatggacaaccccccaggaaataaagcaaaaaattcagctgttgcaccagaagagtgagttcgtggagaagagtacaaagtacttctccgagacactgcggtccgagatggagatgtttaacgttcctgaacttattggcgcccaggcccacgccgtgaatgtaatcctggacgcggaaaccgcgtacccgaatctgattttctctgatgatcttaagagtgttcgcctaggcaacaaatgggaacgcttgcccgacggcccccaaagattcgattcatgtatcattgttttaggctccccgagttttctgagcggcaggaggtattgggaagttgaggttggtgacaagaccgcatggatcctgggagcctgtaaaacaagcatttcccgcaagggtaacatgacactcagcccagaaaatggatactgggttgttatcatgatgaaagagaacgaatatcaggcttcttctgtgccccccacacgcctgcttataaaggaaccccccaaaagagtcggtattttcgtagactatcgagtcggaagcatttcattttacaatgttacagctagaagccacatctacacatttgcctcatgtagcttttctggtccattgcagcctattttctcccctggcacccgtgatggcgggaagaacaccgcccctctcactatttgtcccgtaggtggccaaggaccggattag

SEQ ID NO: 184008 - DNA, 945 bp, Artificial Sequence
  Description of Artificial Sequence: Synthetic coding sequence
atgagccgggtgcccgccttcctgagcgccgccgaggtggaggagcatcttagatcaagttcactgttgatcccccccctagagacagccctggcaaacttcagctctgggccagagggtggcgtcatgcaaccagttcggacggttgtgccagttaccaaacatcgcggatatctgggcgttatgccagcttactccgcagcagaagacgctctgactactaagcttgtgaccttctacgaagatcggggtatcacgtcggtagtgccttcacaccaggcaacagtgctgctgttcgaaccctccaatggcaccttgctggccgtgatggacggaaatgtcataaccgccaaaaggacagctgccgtatcggcgattgctacaaaatttctcaaacctccgagctcagaagtgctgtgtattctaggcgcaggagtgcaggcttactcccattatgaaatcttcaccgaacagttcagctttaaggaggttcggatctggaatcggaccaaggagaatgccgaaaagttcgccgacaccgtgcagggcgaggtacgagtatgttcctcggtccaagaagcagtagcgggggcggatgtcattattactgtgacactggcaaccgagcccattctttttggggagtgggtcaagcccggcgcacacatcaacgccgtgggtgcttcacggcccgactggcgcgagctcgatgatgagctgatgaaggaagccgtgctatatgtggattctcaagaagctgctcttaaagagtcgggcgatgtactgctcagcggagcagaaatcttcgccgaactcggcgaggttataaaaggtgtaaaacctgcccattgcgagaagacaacagtgttcaagagtctgggcatggctgttgaggatactgtagccgcgaagttaatctacgacagctggtcttctgggaaatag

SEQ ID NO: 184009 - DNA, 819 bp, Artificial Sequence
  Description of Artificial Sequence: Synthetic coding sequence
atgcagcccgtgcggaccgtggtgcccgtgaccaagcaccggggctacttgggtgtcatgccagcgtactccgctgcagaggatgctctgactaccaagcttgtcacattttatgaagatagggggattacgtcagtggtcccctctcaccaggcaaccgtcttattatttgaaccatctaatggcactttgttagccgtgatggacggaaatgtgatcactgctaaacgcaccgccgcagtatccgctattgcgaccaaatttctgaagccaccttcatccgaggtgctgtgtattctaggcgcaggggtgcaggcctacagtcattatgagattttcactgaacagtttagctttaaagaggttagaatttggaatcgtaccaaagagaatgctgaaaaatttgccgacacagtccagggggaggtcagggtatgcagcagcgtacaggaggcagttgcaggggctgacgtgatcattacggtcactttggcaacagagcctatactatttggtgaatgggtcaagcctggcgcccatattaatgccgtgggcgcaagccggcctgactggcgagagttggacgatgaactgatgaaggaggcagtactgtacgttgactcacaggaggccgctctgaaagagagtggggatgtacttctgtccggggctgagatctttgccgagttgggcgaggtgatcaaaggcgtaaaacctgcccactgcgagaagacaacggtgttcaagagcctcggcatggccgtggaggataccgtggcagccaagctcatctatgatagttggagctcaggcaaatag

SEQ ID NO: 184010 - DNA, 945 bp, Artificial Sequence
  Description of Artificial Sequence: Synthetic coding sequence
atgagccgggtgcccgccttcctgagcgccgccgaggtggaggagcacctgaggtctagctccctcctgatcccaccgcttgaaacagccctggctaacttcagcagcggccctgaggggggggtaatgcaaccagttcgtaccgtcgttccggtgacgaagcaccgcggatacttgggcgtcatgcctgcttactctgctgcagaagatgcacttacaaccaaattagttacattttacgaagatcggggaatcacaagtgttgtcccttcccaccaggccactgtattattgtttgaaccctccaacggaacgctgctggccgtcatggacggcaatgtaattacagccaagcggacagccgccgtgagcgccattgccaccaaattcctgaaacccccttctagcgaggtgctttgtattctcggggccggcgtccaggcctacagccactacgagatcttcacagagcagtttagttttaaggaggttcgcatctggaataggacaaaagaaaacgccgagaaatttgctgataccgttcagggggaggtgcgggtgtgctcttcagttcaggaggccgtcgccggcgccgacgtgatcattacagttaccctggcaaccgagcctatcctgtttggcgagtgggtgaagcccggggcacatatcaatgccgtgggagcatcccggccagactggcgagagcttgacgacgaactcatgaaagaagcagtgttgtacgtggactcccaggaagccgcactgaaagaaagcggcgacgttttgctaagcggggccgagatctttgcggagctcggagaagtgatcaagggcgtgaagcccgcccattgtgaaaagacaaccgttttcaaaagcctgggcatggccgtggaggatactgtggccgcaaagctgatatacgatagctggagctcgggcaagtag

SEQ ID NO: 184011 - DNA, 990 bp, Artificial Sequence
  Description of Artificial Sequence: Synthetic coding sequence
atggccaccggccagaagctgatgcgggccgtgcgggtgttcgagttcggggggccggaggtgcttaaactccgctccgacatcgccgtgccaattcctaaggaccatcaggtgctcatcaaagtgcatgcatgtggcgttaatccagtcgagacatatatccgctctggcacttattccaggaagccgctattaccttacaccccgggaagcgatgtggcaggagtgattgaagccgtgggtgataacgcaagcgcgttcaagaagggagatagagtgtttaccagttctacaattagcggcggttacgcagaatacgctttggccgctgatcacaccgtttataagctgccagagaagctggatttcaagcagggcgctgctatcggtatcccctatttcactgcttaccgagcgctcattcattctgcctgtgttaaagcaggcgagtccgtgcttgtacatggcgcgtccggcggcgtcggattggctgcctgccagatcgccagagcttacgggctaaagatcctgggaacagccggtacagaggagggccagaagatagtgttacagaatggggcacatgaggtgttcaaccatcgggaggtcaactacattgacaaaatcaaaaagtatgtaggggagaagggcattgatattatcatcgaaatgctggcgaacgtgaatctgtcaaaggatctctccctcttgagtcatggcggcagggttatcgtcgtgggcagtcgcggcaccattgaaattaatccaagagacactatggcaaaggagtcatcgatcatcggcgttaccctgttctcatcaactaaagaagagtttcaacagtacgcagcggcactgcaagctggcatggaaatcggatggctgaagcctgtgatagggtcacagtatccactggagaaggtcgcggaggcccacgaaaacattatccacggctccggagccacaggcaaaatgatccttctcctttag

SEQ ID NO: 184012 - DNA, 732 bp, Artificial Sequence
  Description of Artificial Sequence: Synthetic coding sequence
atggccaccggccagaagctgatgcgggccgtgcgggtgttcgagtttggaggaccagaggttctgaagctaaggagcgacatcgcagtccctataccgaaagaccaccaggtgctgatcaaggtgcacgcgtgcggagtgaatccagtggaaacctatatccgcagtggcacgtattcccggaagccgctgttaccatacaccccaggcagtgacgtcgccggagtgatcgaggcggtgggggataacgcttccgcctttaaaaagggggatagggtgttcaccagcagcacgattagtggcgggtatgccgaatacgctctggcggccgaccatacagtttataaactgcctgaaaagctggactttaaacagggggcggctattggtatcccatactttaccgcttatcgtgccctaatccactcagcatgcgtaaaagcaggagaatcggtgctggtccatggcgcctcgggaggggtaggcctggctgcgtgtcagatcgctcgagcatacggactaaaaatcctggggactgctggtacagaagagggtcagaaaatagtgctgcagaatggcgcccatgaggtgttcaatcaccgcgaagtgaactatattgataagatcaaaaaatacgtcggcgaaaaggggatcgatataattatagaaatgttagcaaacgtcaatctatccaaggatttgagcctgctctcgcacggagggcgagtgtag

SEQ ID NO: 184013 - DNA, 888 bp, Artificial Sequence
  Description of Artificial Sequence: Synthetic coding sequence
atggccaccggccagaagctgatgcgggccgtgcgggtgttcgagtttggtggacctgaggtgttgaaactgagaagcgacatcgcagttccgatccccaaggatcaccaggttttgatcaaagtccatgcatgtggcgtgaacccagtggagacctacataagatcaggcacttattcacgaaagcctctgctcccatatacccctggttctgacgtcgccggagtcattgaagccgtgggcgataatgcgtccgcttttaagaagggggaccgcgtgttcacttcttcgacaatcagtgggggttacgcagaatacgctctcgccgcagatcacacggtctacaagctgccggagaagctggactttaaacaaggggccgccatagggatcccctactttactgcttaccgggccttgatccatagcgcatgtgttaaagcaggagaaagtgttctggtccatggggctagtggaggggtgggtcttgcggcctgtcagatcgctagagcatatggcttaaagattctcggcactgccgggaccgaggagggccagaagatcgttctgcaaaacggagctcacgaggtgtttaaccatagagaagttaactacatagataagattaaggttgttggttctcggggcaccattgaaatcaacccacgtgataccatggccaaggaatcttcaatcatcggggtgacactcttctcttctaccaaagaagaatttcagcagtacgctgctgcactgcaagccggcatggaaatcggatggttgaaacctgtgatcggctcccagtacccacttgagaaagttgcagaggcccatgaaaacatcatacacggctctggcgcaacaggcaagatgatccttttgctctag

SEQ ID NO: 184014 - DNA, 579 bp, Artificial Sequence
  Description of Artificial Sequence: Synthetic coding sequence
atgcacctgctgagcagcgcctgcgtgaaggccggcgagagcgtgctggtgcacggcgccagtggcggggtcggcctggcggcatgtcagattgctagggcctatgggcttaaaatccttggcaccgccgggactgaagagggtcaaaagatcgtcttacaaaacggcgcccacgaggttttcaaccaccgcgaggtgaactacattgacaaaatcaagaagtacgtcggcgaaaaaggcattgacatcatcattgagatgctggcaaacgtgaatttgtcaaaggacctctcactcctgtcccacggcggccgcgtgattgtcgtggggtcacgggggactatcgagattaatccaagggacactatggccaaggagtcaagtatcatcggggtaacactgtttagctcaaccaaagaggaattccagcagtatgccgccgccctacaggcaggcatggagattggatggttgaagccagtgataggctcacaatatccactggagaaggtggctgaggctcacgaaaatattatccatggctccggcgcaacagggaaaatgatcctgctactgtag

SEQ ID NO: 184015 - DNA, 990 bp, Artificial Sequence
  Description of Artificial Sequence: Synthetic coding sequence
atggccaccggccagaagctgatgcgggccgtgcgggtgttcgagttcggcggaccggaagtcctgaaacttaggagcgacatcgccgtgccaatccctaaagaccatcaggtacttatcaaagtgcacgcgtgtggagtgaacccggtggaaacatacatcagatctgggacctacagcagaaagcccctgctgccttacacccccggcagcgacgttgcgggagtgatcgaagccgtcggcgacaacgcgtccgcctttaaaaagggcgaccgtgtcttcacttcctctaccattagcggcggatatgcggagtacgctcttgcagccgatcacacagtgtacaagctgccagaaaagttggactttaagcagggggccgctatcggcattccgtattttacagcctatagggcactcattcactcggcgtgcgttaaggcaggggagtcagttttggtgcacggcgccagcggcggggttggtctcgctgcttgtcagatcgcccgcgcatacggcctgaaaatcctcggaactgctggaaccgaggagggtcagaagatagttttgcagaacggcgctcatgaggtgtttaaccacagggaagtgaactacatcgacaagataaagaagtacgtgggggagaaaggcatcgatattatcattgaaatgctagctaatgtaaacctttccaaggacctgagtttactgtctcatggagggagggtgatcgtggtggggtccagggggaccattgagatcaatccccgagatacaatggccaaagaatctagcatcattggtgtgaccttgtttagttcaacgaaggaggagttccaacagtatgcagccgcgttacaggccggcatggaaattggctggctgaagcccgtgatcggatcccaatatccactggagaaggtcgccgaagcgcacgaaaacatcattcacggatcaggcgccactggcaaaatgatcctactactttag

SEQ ID NO: 184016 - DNA, 621 bp, Artificial Sequence
  Description of Artificial Sequence: Synthetic coding sequence
atggccaccggccagaagctgatgcgggccgtgcgggtgttcgagttcggcgggccagaagtacttaaactgcgatctgatattgctgtgcctatcccaaaggaccaccaagtgctcatcaaagtacacgcctgtggcgtgaatcctgtcgagacctacatcagaagcggcacatatagccgaaagccactgttgccatacaccccgggatctgacgttgccggcgtaatcgaggcagtgggagacaacgcttctgctttcaagaaaggcgatagggtgtttacctctagtaccatttcgggcggctatgcggaatatgctttggcagccgaccataccgtttataagctcccagaaaaactcgacttcaagcagggagcagccatcggcatcccctattttaccgcttacagggcactcatccactctgcctgcgtgaaggccggggagtcggtgctggtgcacggtgcgagcggtggcgtgggcctggccgcttgccagatagcacgggcgtatggactgaagatattgggtaccgcagggacagaggaaggtcagaagatagtactgcagaatggggcacatgaggtgtttaatcaccgcgaggtgaattacatctag

SEQ ID NO: 184017 - DNA, 1050 bp, Artificial Sequence
  Description of Artificial Sequence: Synthetic coding sequence
atgaagggcctgtacttccagcagagcagcaccgacgaggagatcacttttgttttccaagagaaggaagaccttcctgtcacagaagataactttgtcaaactgcaggtgaaggcatgcgcgctgtcgcaaatcaacaccaagttgctcgctgagatgaaaatgaagaaagacctgttccctgtgggacgagagattgccggcatcgtcctggatgttggatccaaagtatcctttttccagcccgatgatgaagtggtgggcatcctgccactcgactccgaagatccggggttatgtgaggtcgtgagggtacatgagcattatctggtgcacaagccggaaaaagtaacgtggaccgaggccgccggtagtatccgggacggcgtccgcgcctataccgccctgcactacctttctcacctgtccccagggaaatccgtacttattatggatggcgcgtctgcattcggaaccatagccatccagctcgctcaccacaggggcgctaaagtaatcagcaccgcgtgcagcctggaagataagcagtgtctagagcgcttccggccacctattgcaagagttatagacgtgtcaaacggtaaagtccacgtcgccgaatcttgtttggaggagactggaggacttggcgtcgacattgtactcgacgctggtgtgcgactttacagtaaggatgatgagcccgctgttaagctgcaactgctgccccataagcacgatatcatcaccctgttgggcgtgggtgggcattgggtgaccacagaggagaatttacaattagacccacctgacagccactgccttttcctgaagggcgcaacacttgcgttcctgaatgacgaggtttggaacctgagtaacgtgcagcaaggcaagtacctgtgtattctgaaggacgtgatggagaagctgagcactggtgtgtttaggcctcaactggatgaacccatacctctctacgaagccaaagtgagcatggaagctgtgcagaagaaccagggacgcaagaaacaagtggtccagttctag

SEQ ID NO: 184018 - DNA, 546 bp, Artificial Sequence
  Description of Artificial Sequence: Synthetic coding sequence
atgaagggcctgtacttccagcagagcagcaccgacgaggagatcacatttgtgttccaggagaaagaggacctgcctgtcacggaagacaatttcgtgaaactccaggtcaaggcgtgcgctctctcccagattaacaccaagttgctggcagagatgaagatgaagaaggatctgttccccgtcggacgtgagatcgcaggcatcgtgctggacgttgggagcaaggtgtccttcttccagccagacgatgaggtagtgggaatattgcccctggacagcgaagatcccggcttgtgcgaggtcgtgcgagttcatgagcattacttggtccataagcctgaaaaggtcacttggacggaagccgcaggttccattcgcgacggggttcgcgcatacaccgctttacactatcttagccatctcagtcccgggaagagcgttttgatcatggacggtgcctcagccttcgggaccattgcaatacagcttgcacaccatcgcggagctaaggtcatcagcacagcctgctcgttagaagattag

SEQ ID NO: 184019 - DNA, 60 bp, Artificial Sequence
  Description of Artificial Sequence: Synthetic coding sequence
atgaagggcctgtacttccagcagagcagcaccgacgaggagatcacctttgttttttag

SEQ ID NO: 184020 - DNA, 597 bp, Artificial Sequence
  Description of Artificial Sequence: Synthetic coding sequence
atgaagggcctgtacttccagcagagcagcaccgacgaggagatcactttcgtcttccaggagaaagaagatctcccagtcaccgaagataattttgtcaagctgcaggtaaaggcatgcgccctgagccaaattaataccaaattgcttgccgagatgaaaatgaagaaggacctattccccgtggggcgggagattgctggtattgtcctagacgtcggctcaaaggtgtcgttctttcagcctgacgatgaagtggtggggatactgccccttgactccgaagacccaggcctgtgcgaagtggtgagggtgcacgagcattacctagttcacaagccagaaaaagtcacatggactgaggcagccggctcaattcgggacggcgtgagagcttacacagctctgcattacctgtctcatctcagcccaggcaagagtgttctaatcatggatggggcaagcgcctttggcaccatcgccatccagttagcacatcaccggggagctaaggttatatctaccgcatgcagtctggaggataaacagtgtctcgaacgctttcgccctccaatcgagaattccaccattgcatag

SEQ ID NO: 184021 - DNA, 2916 bp, Artificial Sequence
  Description of Artificial Sequence: Synthetic coding sequence
atggagctgagcgacgccaacctgcagaccctgaccgagtacctgaaaaagaccctggatcctgacccagccatcaggaggcccgccgagaagtttctggaatcagtagaaggcaatcagaattatcccctccttcttctgactctccttgagaaaagccaggacaacgtaatcaaagtgtgcgcaagtgtgacgttcaaaaactacattaagagaaattggagaattgttgaggatgagccgaataagatttgcgaggctgatcgggtggccattaaggcaaatatcgtgcatctgatgctgtccagccccgagcagatacagaaacaactttctgatgcaatttcaatcatagggcgggaagattttcctcagaagtggccggatctgctcaccgaaatggtgaatagatttcagtcaggtgatttccacgtgattaatggagtccttcgcactgcccatagcctattcaagcgttacaggcatgaattcaagtccaacgagctgtggacagagattaagctggtccttgacgcattcgcccttcctctgaccaatttattcaaggctacgatagagctctgctccacccatgctaatgacgcaagcgcattaaggattctgttttctagtctaattctaatcagcaaactcttctactctctgaactttcaagatctccctgagttcttcgaagacaatatggagacctggatgaacaattttcacaccttgctgactcttgacaacaagttgctgcagacagacgacgaagaggaggctggcttgctcgaactcctgaaaagtcaaatctgcgacaacgcggccctctacgctcagaaatacgacgaagaattccaaaggtacctgcctcggttcgttacagccatctggaatctgcttgtaacgacgggccaggaagtcaaatacgaccttcttgtgagcaacgctatacagtttttagccagcgtgtgcgagcgcccccattataagaacctctttgaagatcaaaataccctgaccagcatttgcgagaaggtgatcgtgcctaatatggagtttagagctgccgacgaagaagcatttgaagacaacagtgaagagtatatccgccgtgacctggaggggagcgacattgacacacgccggcgtgccgcttgcgatctggttcgtggattgtgcaaattttttgaagggcctgttactggcatcttttctggttacgttaacagtatgctgcaggagtatgccaaaaacccttcagtcaactggaagcacaaggacgcagccatatatcttgtcacatcactagcaagcaaagcgcaaactcagaagcacggtatcacccaggctaatgagcttgtcaatttaaccgaattttttgtgaatcacatcttgcctgacctgaagagtgctaacgttaatgagttccctgtcctgaaggccgatggcataaaatatatcatgatcttccgtaatcaggtgcctaaagagcatcttctggtaagcatccccctcttgataaaccacctgcaggcagagtctatagtggtgcatacttatgcagctcacgccctggaaagattatttacaatgcggggccccaataatgccaccctgtttacggccgccgaaattgctcccttcgttgagatcctcctcaccaacctgttcaaagctctgacattgccagggagctcagaaaacgaatacatcatgaaagctattatgcgcagctttagtctgctacaggaggcaatcattccttacatccccacgctcatcacacagcttactcagaaattattggccgtgtctaagaatccatctaaaccgcattttaatcactacatgttcgaggcgatctgcctgtccattaggattacatgcaaggccaatcctgcagctgtggtgaacttcgaggaggcactattcttggtctttaccgagatacttcagaacgacgtccaggaattcatcccatacgtgtttcaggtgatgagtctgctcttggagacacataagaacgatataccgtcgtcctacatggcgctcttcccacacctgcttcaacctgtgctgtgggaacgaaccgggaatattccagctctggtgagactcctgcaggcttttctggaacgggggagcaataccattgcgtccgccgccgccgacaaaatcccaggcttgttgggcgtttttcagaagctgatcgcgagcaaagccaacgatcaccagggtttttacctgctcaactctatcatagaacacatgccacctgagtccgttgaccaatataggaaacaaatcttcatcctgctgtttcagagactgcagaactcgaagaccacgaagtttattaagagctttcttgtgttcatcaatctgtattgcataaagtacggggcgcttgcgctgcaagaaatttttgatggcatacaacccaagatgtttgggatggttctggaaaagattataattcccgaaattcagaaagtgtctggaaacgtcgaaaagaagatatgtgcagtaggaatcacaaagctgctgaccgaatgcccccctatgatggacaccgagtacaccaagctctggactccactactccaatcccttatcgggctcttcgagcttccagaggacgacacaatacccgacgaggaacactttattgatatcgaggatacaccaggctatcagaccgcatttagccagctcgccttcgccggtaaaaaagaacacgatcccgtcggtcaaatggtcaacaatcccaagatccacttagctcagtctttgcacaagctgtcgaccgcttgcccgggcagagttccctcaatggtctccacatctttgaacgcggaagctctgcagtacctgcaaggatatcttcaggccgcttccgtaacattactgtag

SEQ ID NO: 184022 - DNA, 2748 bp, Artificial Sequence
  Description of Artificial Sequence: Synthetic coding sequence
atggagctgagcgacgccaacctgcagaccctgaccgagtacctgaagaaaacactggatccagatcctgccatccgccgcccagctgagaagtttcttgagtccgtagaagggaaccaaaactacccactcctgctcctaaccctgctggagaagagtcaggacaacgtgataaaagtgtgtgcaagcgtcacgtttaagaactacattaagagaaactggagaatcgttgaggacgagcccaacaaaatttgtgaggctgatagagtcgccattaaagccaacatcgtgcatctcatgcttagcagccccgagcagattcagaaacagctcagcgacgccatctcaatcattggccgggaggactttccccagaaatggcctgacttacttactgaaatggttaatagatttcaaagcggagatttccatgtaatcaatggcgtgctacggactgcacacagtctcttcaagcgttacaggcacgagtttaagtctaacgagctgtggactgagattaagctggttctggacgcctttgcactcccactgacaaatctgtttaaggctacaattgaactgtgtagtacacacgcaaatgatgcttccgccctgcgcatcctgttttcctcactgatactcattagcaaattattttacagcttaaactttcaggatttgccagagttctttgaggacaacatggagacttggatgaataactttcacacgctgctgacgttggacaacaagctcttacagaccgatctggtctccaacgctatccagtttctggcatccgtgtgcgaacggcctcattacaagaatctattcgaggatcagaacacactaacctctatttgcgagaaggtgatcgtacccaatatggaattcagggccgccgatgaggaggcgtttgaagataactcagaagaatatattaggcgggacttagagggaagtgatatcgatacacggcggcgggcagcctgcgatctggtgaggggactttgcaaatttttcgaaggccccgtaacaggcatcttttcaggctatgtgaattcaatgctgcaggagtatgcaaagaacccatcggtcaattggaagcacaaagatgccgccatctacctcgtgaccagcttagcctctaaggcccagacccagaaacatgggattacgcaagccaacgagctcgtgaatctgactgagttttttgtgaaccacattttgcctgaccttaagtctgccaatgtcaacgaatttcccgtgttaaaggctgacgggattaaatacattatgattttccggaaccaggtccctaaggagcacttgctcgtttccatcccactgctcatcaatcatctgcaggccgaaagcattgttgtgcacacttacgccgctcacgccctcgagagattattcaccatgagggggccaaataacgcaaccctgtttacagcggcagaaattgccccttttgtagaaattctgcttacaaacctctttaaagcattgactcttccagggtccagcgagaacgaatacatcatgaaagcgatcatgcggtcctttagcttgctgcaagaggccatcattccctatattcctacattaatcacgcagttaacacagaagctgctagccgtcagtaagaacccttccaagccacacttcaatcactacatgttcgaggctatctgtctctcaattcggattacatgcaaggctaatccagccgctgtcgttaactttgaggaagccctcttcctggtgtttacagaaattctccagaatgatgtgcaggaatttataccctacgtgtttcaggtaatgtctctgttattagagacccataagaatgacattcctagcagttacatggccctattcccccatcttctacagcctgtgctgtgggagagaacgggaaatattcccgccctcgtgcgactgttacaggcctttttagaaaggggctcaaatactattgcatctgccgccgccgacaagataccaggtctattaggcgtgtttcagaaattaatcgcaagcaaggctaacgatcatcagggattttatctgctgaattctatcatagaacatatgccccctgaatccgtggatcagtaccggaagcagatcttcatacttctctttcagcgcctccagaatagtaaaaccacaaagttcattaagagttttctggtgttcataaacctttactgcatcaagtacggcgcgttggcactacaggaaatctttgatggaatccagccaaagatgttcggaatggtgcttgaaaagatcataatccccgagatccagaaggtctcaggaaatgttgagaagaagatctgcgccgttggtatcacaaagttgcttacggaatgccctccaatgatggacaccgaatataccaaactgtggactcccctactccagagcctgatcggtctttttgagctccctgaagacgacactatccccgacgaggagcattttatcgacattgaggatacgcccggttatcaaactgcgttctctcagttggcttttgccggaaaaaaagagcatgatcccgtcggacagatggttaataaccctaagatccatttggcccagtcgctccacaagctgagcactgcctgtccaggccgggtgccttccatggtgagtacctcactgaacgccgaggctcttcaatatttacagggttatctgcaggccgcctcagttacactgctgtag

SEQ ID NO: 184023 - DNA, 1710 bp, Artificial Sequence
  Description of Artificial Sequence: Synthetic coding sequence
atggagacctggatgaacaacttccacaccctgctgaccctggacaataagcttcttcaaactgacgatgaagaggaggccggcctgttagagctgctaaagtcccaaatctgtgacaatgccgcactctatgcccagaaatatgatgaggaattccaaaggtaccttcccaggttcgtaactgccatttggaacctgctggttactacaggacaggaagtcaagtacgaccttctcgtgtccaatgcgattcagtttctggcctctgtgtgcgagcgacctcattacaagaacttattcgaagaccaaaacacacttacatcaatctgtgaaaaatctatagttgttcacacttatgcggctcatgcactagagcggctgtttacgatgcgcggtcctaataatgcaactctatttaccgccgcagagatagctcccttcgtcgagatccttctgaccaaccttttcaaggcactcacccttccaggaagttctgagaacgaatacatcatgaaggcaattatgcggagtttctcactcctgcaggaagccatcattccctatattcccaccctcattacccagctcactcaaaagctgttagctgttagtaaaaatccatcaaagccccatttcaatcattacatgttcgaagccatttgtctgtccattcggattacttgcaaggccaatccagctgccgtagtgaattttgaagaggcactgtttttggtctttacagagatcctgcaaaacgacgtccaggaattcatcccctatgtgtttcaagtcatgagcctgctgctcgagacccacaaaaacgacatcccgagtagctatatggccttgttcccccatcttttgcaaccagtcttgtgggagaggaccggaaatatcccagcgctagttcgactattgcaggcgttcttggagcggggcagtaacaccatcgcctcagccgccgctgataagattcccgggttactcggagttttccagaagctgatagcttccaaggctaacgaccaccagggattctacttgttgaacagcatcattgaacacatgcctcctgagtcagttgaccaatatcgaaagcagatctttatactcctgtttcagcggctgcaaaactctaagacaacgaaatttattaaatcctttcttgtgtttataaacctgtactgtatcaagtatggcgctctggccttgcaagagatctttgacgggatccagcccaaaatgtttggtatggtgctggagaaaatcatcatcccagagatccaaaaggtgtcggggaatgtcgagaaaaagatctgtgcagtcggaattactaagttgctgaccgagtgcccccctatgatggataccgaatataccaagttgtggacccccctactgcagagcctgatcggcctattcgagttgccggaggatgatacaattccagacgaagagcacttcatagatatcgaggatacgccggggtaccagaccgccttctcccagctggccttcgctggaaaaaaagaacacgatccagtcggtcaaatggttaataatccaaagatacatttggcgcaaagtctccataagcttagcacagcttgtcccggtagggtcccctcgatggtgtccacgtctttaaacgcagaagctctgcagtacctgcaggggtacctgcaagccgccagtgtaacattgctctag

SEQ ID NO: 184024 - DNA, 2265 bp, Artificial Sequence
  Description of Artificial Sequence: Synthetic coding sequence
atgctgagcaacctgaacttccaggacctgcccgagttcttcgaggataatatggagacatggatgaataacttccacaccttactgacattggacaacaagctgctgcaaacagacgatgaagaggaagccggcttgctcgagctcctgaagagccagatctgtgacaatgccgcactgtacgctcagaagtacgatgaggaattccaacgctacctcccccggtttgttacagccatttggaacttacttgtgacaactggacaggaggtgaagtacgatctgctagtgagcaatgctatacagttcctggcatccgtttgtgaacggccccattacaaaaacttatttgaagatcagaatacccttaccagcatttgtgaaaaggtgattgtgcccaatatggagtttagggctgctgatgaagaagcctttgaagacaactccgaagagtacatccggagggatcttgaagggtctgacatagataccaggcggagagcagcctgcgacttggtgcgtggcctgtgcaaattcttcgaaggaccagttacaggcatcttctctggttacgtgaactcaatgctacaggaatatgctaaaaatccatccgtcaactggaagcacaaggatgctgctatttacctggttacgtctttggcaagcaaggcccagacccagaagcacgggatcactcaagccaacgagcttgttaatctgacagaattctttgtgaatcacatcttgccagacctaaaatcggcaaacgttaacgagtttcctgtgctgaaggcggatggcataaaatatattatgatctttaggaaccaagtacccaaggagcacctgctagtttccatcccgttgttgattaatcatctgcaggccgaatctatcgtcgtgcacacatatgcagctcacgctctcgagaggctttttactatgcgcggacctaataatgcaaccttgtttacagctgctgagatcgcgccgttcgtggaaattctactgaccaacctgttcaaggccctgacactccccgggagttcagaaaatgagtacatcatgaaagcgataatgagatcatttagcttgctgcaggaggccattatcccttatattccaaccctgattactcaattaactcagaaactcctggctgtaagcaagaatcctagcaagccacactttaaccactatatgttcgaagctatttgcctgagcattagaatcacctgtaaagccaatcccgccgccgtggtgaatttcgaggaagcccttttcctggtgtttaccgagatcttgcagaacgacgttcaggagtttattccttacgtttttcaggtaatgtccctgctgctggagacacacaaaaatgatatacccagcagttacatggccttgttcccccacctcctgcagccagttctttgggaacgcacgggaaacattcccgctcttgtcagactcttgcaggcctttctagagcgaggtagcaacaccatcgccagcgccgctgcagacaagatcccggggctactaggtgttttccagaaactgatcgctagtaaggccaatgaccatcaaggattttatcttctgaactcaatcatagaacacatgccccctgaatcagttgatcagtataggaagcagatatttatcctccttttccaacggctgcagaacagtaagaccaccaaatttatcaaatccttcttggtctttataaatctttattgcattaagtatggtgccttggcactgcaagagattttcgatggaatccagcctaaaatgttcggcatggtgctggagaagattataattccagaaattcagaaagtgtctgggaatgtagagaagaaaatctgtgctgtggggataaccaaactactgaccgaatgtccgccaatgatggacacggagtataccaaactgtggactcccttgctgcagtccctcatcggactgtttgaactgcccgaggatgacactatcccggacgaagaacatttcatagacattgaggacacacccggctaccagaccgctttcagccaacttgcttttgctggaaaaaaggagcatgatccagtcggccagatggtgaataatcccaaaatccacctggcacagtcacttcataaattgagcacggcctgtcccggccgcgtgccctcgatggtatctacaagtctgaacgcagaggccctgcaatatttgcaggggtacctccaggccgcatctgtgaccttattgtag

SEQ ID NO: 184025 - DNA, 888 bp, Artificial Sequence
  Description of Artificial Sequence: Synthetic coding sequence
atgcagcccgagggcgccgagaagggcaagagcttcaagcagcggttggtcctcaaatcatccttggccaaagagacactgtccgaattcctgggaacatttatcctgatcgtcctcggctgcgggtgtgtggcccaggctatcctttcacgcgggaggttcggtggtgttattacaattaacgtaggcttttctatggcagtcgcaatggccatatacgtggctggaggcgtttccgggggacacattaacccagcagttagcttggccatgtgcctgttcgggcggatgaagtggttcaaactccctttctatgtaggtgcccagtttctcggtgctttcgtgggagcagcaactgtcttcggcatatattatgacgggctcatgtcttttgccggtggtaagctcctaattgtgggcgaaaacgccacagcccacatcttcgcaacttatcccgccccttacctgagtctcgccaacgcttttgcagaccaagtcgttgctacgatgattctgctgataatcgtattcgctatctttgactcccggaacctgggggcgccacgcggactagaacctatcgctattggactcctgatcatcgtaatcgccagcagtctcggacttaacagcgggtgcgccatgaacccagcacgagatctcagtcctaggctgtttaccgctctggccggctgggggttcgaagtgtttagggcaggcaataacttttggtggatccccgtggtcggtcctctagtcggcgcggtgattggcggactgatctacgtgcttgttattgagatccatcacccagagcctgactccgtgttcaaaaccgagcagtccgaggacaagcccgagaaatacgagctctccgttattatgtag

SEQ ID NO: 184026 - DNA, 1353 bp, Artificial Sequence
  Description of Artificial Sequence: Synthetic coding sequence
atgagcgccatccaggccgcctggcccagcggcaccgagtgcatcgccaagtataactttcacgggacggcggagcaggatcttcccttctgtaaaggagatgtgctgactattgtggccgttaccaaggaccctaactggtataaagctaaaaacaaagtcggccgcgaggggataattccagccaattatgtgcagaagagggagggcgtgaaggcgggaaccaaactgagcctcatgccatggttccatggcaaaataaccagggagcaggcagaacgcctactgtacccacctgaaaccggtctcttcctggtgcgggaatccactaactatccaggggattacacattgtgtgttagttgtgatgggaaagttgaacactatcgtatcatgtatcacgcatcaaagttgagcattgacgaggaggtgtattttgaaaacctgatgcaactggtcgaacactatacatcagacgctgacggattatgtaccagactgatcaagcccaaagtcatggaagggacggtggccgctcaggatgaattttacaggagtgggtgggccttgaatatgaaggaattaaaattgcttcaaaccatcgggaagggtgaattcggcgacgtgatgctcggcgactatcgcgggaataaagtcgcagtgaagtgcataaaaaacgatgcaactgcccaggcattcctggctgaggccagcgtgatgacccagctgaggcattcgaatctcgtccagctgctgggtgttatcgtggaggagaaaggagggctgtatattgtaactgaatacatggctaaaggcagtctcgtggactacctgcgatcacgcggaagatccgttttagggggtgactgtctgctgaaattcagcctcgatgtctgtgaggcgatggagtacctggaaggaaataacttcgtccatcgggatctggccgccaggaacgtcctggtctcagaagataacgtagcgaaggttagcgatttcggtctgactaaagaggcctcaagtacccaggacacggggaagctccctgtgaagtggactgctcccgaggcgctccgggagaagaaattctccaccaaatctgatgtctggagcttcggaattctcttgtgggaaatctacagtttcggccgtgtgccctatccgaggattccactgaaagacgtggtaccccgagtggagaagggctataaaatggatgctcccgacgggtgtcccccagcagtgtatgaggtcatgaagaattgctggcacctggatgcagcaatgcgcccaagtttcttgcagctcagggagcagctcgagcatatcaaaactcatgaattgcacctctag

SEQ ID NO: 184027 - DNA, 1353 bp, Artificial Sequence
  Description of Artificial Sequence: Synthetic coding sequence
atgagcgccatccaggccgcctggcccagcggcaccgagtgcatcgcaaaatataactttcatggaactgccgagcaggacctgcctttctgtaagggcgacgtgctgacaatcgtggctgtcaccaaagatcctaactggtataaagccaaaaacaaggtcgggcgtgaagggatcatccctgctaattatgtgcagaagagggagggcgtaaaggccggaaccaagctatccctcatgccatggttccatggtaagattacgagagagcaagctgaaaggctgctgtatccccctgagaccggcctcttccttgtacgagagtccacaaactaccctggagactacaccctgtgtgtgtcttgcgatggcaaggtcgagcactatcgcatcatgtaccatgcatccaaactgagcattgatgaagaggtgtacttcgagaatcttatgcagctggttgaacattatacttccgacgctgacgggctctgcaccagactgatcaagcccaaagtgatggagggaaccgttgccgcccaggacgaattctataggtccggctgggcactgaacatgaaagagcttaaactcctgcagactataggaaagggtgaattcggtgacgttatgttgggggattatagaggcaataaagtggcagtcaagtgcatcaagaacgatgctaccgcccaggccttcctagcggaagcaagtgttatgacacagttgaggcattctaatctggtgcagctactgggcgttatcgtggaagagaagggagggctatatatcgtcactgagtacatggcaaagggcagtctggtcgattatcttcgatctagaggaagatctgtgttaggaggggactgcttgctcaagttttctctggacgtctgtgaggctatggaatacctggaaggcaataatttcgtacatagggacctggccgctcgtaatgtgctagtaagtgaagataacgtcgctaaggttagcgactttgggttgaccaaggaggccagcagcacacaggacacaggaaagctcccagttaaatggaccgcccctgaagcactgagagagaagaaattttctactaaatcagacgtgtggtcattcggcatcctgctgtgggaaatctattcttttgggagagtaccttaccctcgtatcccgctcaaagatgtggtccctcgcgtagagaagggatataagatggacgcccccgacgggtgccctccggcagtgtacgaggtcatgaaaaactgttggcacctcgacgccgcgatgagacccagctttctgcaattacgcgagcaactagaacacatcaaaacacacgaactccatctttag

SEQ ID NO: 184028 - DNA, 1200 bp, Artificial Sequence
  Description of Artificial Sequence: Synthetic coding sequence
atgagcgccatccaggccgcctggcccagcggcaccgagtgcatcgccaagtataatttccatggcacagccgaacaagacctccctttctgtaagggcgatgtcctcacaattgttgccgtaacaaaggacccaaattggtacaaggctaagaataaagttggcagggagggaattatacccgcgaactatgttcagaaacgtgagggggtgaaggctggtacaaaactttcattgatgccgtggttccacggcaaactaagtattgatgaggaagtgtacttcgaaaatctgatgcagctcgtcgagcactatacctcagacgctgacgggctttgcacgcggttaatcaagccgaaagtgatggagggtacggtcgccgcacaagacgagttctacagatctggctgggccctcaacatgaaggagttgaaactgctgcagacgattggaaagggagagtttggcgatgtgatgcttggagattatcgaggcaataaagttgccgtcaagtgcattaagaatgacgctacagcgcaagcctttcttgccgaagccagcgtaatgacccaactcaggcatagtaatttggttcagctgctgggcgttattgtcgaagagaaggggggcctgtatatcgttactgagtacatggccaagggatccctggttgattacctgaggtcacgagggaggtcagtgcttggtggcgattgtcttctcaagtttagccttgatgtgtgcgaggcgatggaatacctcgagggaaataatttcgtgcatagagatttggccgcccgaaacgtcctcgtgtcagaagataatgttgcgaaagtgagtgacttcggactgacaaaggaggccagctcaacgcaagatacaggtaagcttccagtaaagtggacagctccagaggcattaagagagaagaagtttagcaccaagtctgatgtgtggagtttcggcattcttctgtgggagatctactccttcggccgcgtgccctacccccgcattcctcttaaagacgtcgtgccacgagtggagaaggggtacaaaatggatgccccagatggctgccctcctgcagtgtatgaggtcatgaaaaattgctggcatctggatgctgccatgcgccccagtttcctgcaactccgcgagcagctggaacacattaagacccatgaactccatttgtag

SEQ ID NO: 184029 - DNA, 783 bp, Artificial Sequence
  Description of Artificial Sequence: Synthetic coding sequence
atggtggccgccccctgggccacccaggagcaggaggagggccggggcatccagcctggcgataggggcgaccagaagagcgcagccagccagaaaccgcgcagtcggggcatactgcacagccttttctgttgcgtatgccgtgacgacggcgaggcccttcctgcccactctggcgcaccactcctcgtagaggaaaatggcgcgattcccaaaacgccggtgcagtaccttttgccagaggctaaagcccaggacagtgacaaaatttgtgtagtcattgacctggacgagaccctggtccactcgagctttaaaccagttaacaacgccgattttatcattcctgttgagattgacggcgtcgttcaccaagtttatgtgctaaagcggccccacgtggacgagttccttcagcgtatgggagaactgttcgaatgcgtgctgtttactgccagtctggccaagtacgccgatcctgtggctgatctcctcgacaaatggggcgccttccgcgctcgactgttcagggaatcctgtgtgtttcacagaggaaattacgtcaaggatctgagtcgcttagggcgcgacttgcgtcgcgtgcttattctggataatagccccgccagctacgttttccatccagacaacgccgtgccagtcgccagttggtttgacaacatgagcgacactgagctccacgacttgttacccttcttcgagcagttaagccgggtggacgatgtgtactccgttctgcggcagcctcgtccagggagttag

SEQ ID NO: 184030 - DNA, 2604 bp, Artificial Sequence
  Description of Artificial Sequence: Synthetic coding sequence
atggaggtgcccgccgccggccgggtgcccgccgagggcgcccccacagccgcagtggccgaagtgaggtgcccaggtccagccccgctgagattactggagtggagagtggcggcgggtgctgcggttcggattgggtccgtcctggccgtgtttgaagccgctgcaagcgcccagtcttcaggcgcgagtcaatcgcgtgtggcctccgggggctgcgtcagaccagcccggcccgaacgccgtctgcggtccgaaagagccggagtggtgcgcgaactctgtgctcagcctggccaggtggttgcacctggggccgtgctggtccgcctcgaaggctgctcccatcctgtggtcatgaagggtctgtgtgcagagtgtggtcaggatcttacccaattgcaaagtaaaaatgggaagcagcaggtgcccctgagcacagccacagtaagcatggtgcacagcgtcccagaattaatggtctcatccgaacaggctgaacagctgggccgagaggatcaacagaggctacatcgtaaccgtaagctggtgctcatggtcgatctcgaccaaaccctcatccatacgactgaacagcactgtcaacagatgagcaataagggcatctttcatttccaactggggaggggcgagccaatgctacatactcgtctgcggccgcattgcaaggactttctcgaaaagatcgccaaactttacgaattacacgtgttcacctttggctcccggctgtacgcccacacaatagccgggttcctcgatcctgaaaaaaaactgttctcgcacaggatcctatcccgcgacgagtgtattgatccattctctaaaaccggaaatctgagaaatctgtttccatgcggagattccatggtttgcattattgatgaccgggaagacgtgtggaagtttgctccaaatctcattaccgtaaagaagtatgtgtactttcagggtaccggagatatgaatgcccctcctggtagcagagaatcccagacccgcaaaaaggtgaatcactcacggggcacggaggtctccgagccctctccccccgtgagggatccagagggggtcacccaggccccgggagtggaaccctccaacgggcttgagaagcccgcacgtgaactgaacggatcagaggcggccacgccccgtgatagtccacgacccggaaagcccgacgagagagatatttggccccccgctcaggcccccaccagcagtcaagagctagccggagcccctgagcctcaaggaagctgtgcgcagggaggcagagtggctcctggtcagagacccgctcagggtgctaccggaaccgatctcgactttgatctaagcagcgacagcgaatcatcaagcgagagcgagggaacaaaaagtagtagtagcgcaagcgacggagagtcagaaggaaagcggggccggcagaaacctaaagcagctccagagggagccggggcacttgctcagggctcaagtctggagccaggacggccagcggcaccttctttgcctggagaggcagagcccggcgcacacgcgcccgacaaagaacccgaattgggaggacaggaggagggcgagcgcgatggtctgtgtggactaggcaacggctgcgccgaccgcaaagaggccgaaacagagtcacagaactccgagttatccggtgtgaccgccggggagagtcttgatcaatcaatggaagaagaggaagaagaggacacggacgaggatgaccacctgatctaccttgaagagatacttgttcgcgtgcacactgactattacgccaaatacgacaggtatttgaataaagagattgaggaggcgcctgatatcagaaagatcgtccctgaactcaaatccaaggtgctggccgacgttgcaatcatattctccggcctgcatccaacgaattttcctatcgaaaaaaccagggaacattaccacgctaccgcattgggcgccaagatcctgaccagactggtcctaagtcccgatgcccccgacagagctacccatcttatcgctgctagggccggaacagagaaggtgttacaggcccaggaatgcgggcacttacacgtggtgaacccagactggctgtggtcatgcctcgaacggtgggacaaagttgaggaacaactttttccgcttcgggacgatcatacaaaagcccagcgggaaaactcccctgccgcattccctgaccgcgagggtgtgccaccaactgccctcttccaccccatgcctgtcctcccaaaggcccagcctggaccagaagtgcgtatttatgattcaaacactggcaagctgattcgcactggggcacggggtccgcccgctcccagcagcagcctgccgattagacaagagccctcatcctttaggtggactacaagtctggagaaggccgccaccacagccacggcccgtaggggcggcttgaggagtcgaaggcgctcgcccagtcccggaagccagggccccgcaggctccggccggagcggacacttgcgccctgctagaggggcgcgacaaggcgcaggcggacccgaggctacccgcggcagctag

SEQ ID NO: 184031 - DNA, 2886 bp, Artificial Sequence
  Description of Artificial Sequence: Synthetic coding sequence
atggaggtgcccgccgccggccgggtgcccgccgagggcgcccccacagcggccgtagcagaggtcagatgtcccggcccagccccactgcggctgctggagtggagggtagctgctggcgcagccgtaagaatcggaagcgttttggcggtgttcgaagccgccgcttccgcccagagtagcggggccagccagagccgcgtcgcatctgggggttgtgtgcggcccgccaggccggagcgcaggctgagatctgaacgggcaggggttgtgagagagctctgcgctcagcctggacaggtggtcgccccgggcgcggtcctggtgcgcctcgagggatgttcacacccggtggtgatgaagggcctgtgcgctgaatgcggccaggatctcactcaactgcagagtaaaaatggcaagcagcaggtgccactatccaccgccaccgtctccatggtgcactctgtgccagagctgatggtatcgtccgagcaggccgagcagttagggcgcgaggaccagcaaagactgcatcggaatcgcaaattagtgttaatggtggatctcgaccagacgctgattcatactacggaacaacactgccagcaaatgagtaataagggaatctttcattttcagctggggcgcggcgagcctatgctgcacacacgcctgagaccacattgtaaagacttcctcgaaaagattgctaaactgtacgagctccatgtgttcacatttggcagcaggctttatgcccatacaattgctggcttcctggatcctgagaagaaactattctcacataggatcttgagtagagacgagtgtatagaccctttctctaagaccggcaacctgcggaacctgttcccttgtggagactcaatggtgtgtatcattgatgatagagaggatgtctggaaattcgccccaaatcttataactgtgaaaaaatacgtgtattttcagggaaccggtgacatgaatgcaccgccaggctctagggagtctcagacaaggaaaaaggtcaatcattccaggggaactgaggttagtgaaccaagcccccctgtcagggaccctgagggggtgacacaggcacccggagtggaacccagcaacggattggaaaagccagcccgagagcttaacggctcagaagcagcaacccctcgtgatagtccccgtcccgggaagccagatgagcgagatatttggcctccagctcaggcccccaccagttcacaggagctggccggggctcctgagcctcagggctcttgcgctcaaggaggcagggtagcgcccggtcaaaggccagcacagggcgccactggaactgacctggattttgatttatccagtgactccgagtcatcatcggaatcggaggggaccaaatcgtcctcatcagcctctgatggtgagtcagaaggaaagagaggccgacagaaacctaaagctgcgcctgagggtgctggcgccttggcccaagggagctccctagagcctgggcggccagctgcgccctccctgcccggcgaagcagaacctggggcgcacgcccccgacaaagagcctgaactgggagggcaagaagagggcgagcgcgacggcctttgtggtctgggcaatggttgcgcagacaggaaggaggccgaaaccgagtctcaaaactctgagctgtctggagtcacggccggagaatctttagaccaatctatggaggaagaagaagaagaggatacagatgaagatgatcacctgatctatctggaagaaattctggttagagtgcacactgactactacgctaaatacgacagatatctgaacaaggagatcgaggaagctcctgatattcggaagattgtcccggagctcaagtctaaggttctcgcagacgtggccataatattcagcggcctgcaccctaccaattttccaatcgaaaaaacaagggagcattaccacgccacagctctaggagctaagatattgactcgactagtgctgagcccagacgcacctgacagagccacccacttaatcgccgcccgggccggaaccgagaaggtacttcaagcacaggagtgcgggcatctgcacgttgtgaatccagattggctatggtcatgcctggaaaggtgggataaggtagaagagcagctgtttccactgcgcgacgaccacaccaaggcgcagagagagaattccccagccgcgttccccgatcgggagggagtgccccctacagcgctgtttcacccaatgccagttctgcccaaggcccaaccaggccccgaggttaggatctatgactctaatacaggcaagctgattaggacgggagcacgcggcccgccagctccctctagctcactgcctattcggcaggaaccatcatcatttagagccgtaccgcctccgcagccccagatgttcggcgaagagctgcctgatgcgcaggatggcgagcagcccggaccttctcgcaggaaacgccagccaagtatgtccgagacaatgccactgtacacgctgtgcaaagaggacctggagtcaatggataaggaagtggacgatatacttggagaggggagcgacgacagtgattctgagaaaaggcgccccgaggaacaagaggaggagccacagcccagaaagcccggtacacgccgtgagaggaccctcggggcacctgcttcctccgagcgctcagccgcaggtgggaggggaccccggggacataagaggaaactgaatgaggaggatgcagccagtgaatcatcccgggaatcttccaatgaggacgagggaagctccagcgaagccgatgagatggctaaagctctggaggctgaattgaacgatctgatgtag

SEQ ID NO: 184032 - DNA, 786 bp, Artificial Sequence
  Description of Artificial Sequence: Synthetic coding sequence
atggacagcagcgccgtgatcacccagatcagcaaggaggaggcccggggcccgttaagagggaagggagaccagaaatcagctgcctcccaaaaacctagatctagaggaatcttacactctctgttctgttgtgtgtgccgagatgacggagaggcacttccagcacactccggtgctcctcttctggtcgaagaaaacggtgccattccaaagcagacaccagtgcaatatctcctacctgaagccaaagcccaggatagtgataaaatatgtgttgtaatcgacctggacgaaacactggtgcactcttcttttaaacccgttaacaacgctgacttcattatccccgtagaaatcgatggtgtggttcatcaggtgtatgtgctgaagaggccgcatgtcgatgagtttctgcaacggatgggagagcttttcgaatgtgtcttatttaccgcctccctggctaaatatgccgatcctgttgccgatctgctggacaaatggggcgcgttcagggcccgcttatttagagagagctgcgttttccaccggggcaattatgttaaggacctgagccggctcggaagagacctgcgaagggtgctgatccttgacaatagccctgcaagctacgtcttccatcccgacaatgccgtaccagttgcatcttggttcgacaatatgagcgacacagaacttcatgatcttttgccgttcttcgaacaactgtcacgcgttgacgacgtgtactctgttctgagacagccacgtccgggctcatag

SEQ ID NO: 184033 - DNA, 2928 bp, Artificial Sequence
  Description of Artificial Sequence: Synthetic coding sequence
atggaggactacgagcaggagctgtgcggcgtggaggacgacttccataatcagttcgctgcggaactcgaagtcctcgcagaactggagggcgccagcacccctagcccttctggcgtgcctctgtttacagcggggcgcccaccaaggacttttgaggaagccctggccagaggcgacgccgcttcatctcccgcgccagcagctagcgtggggagtagtcagggcggagcaaggaagaggcaggtggacgcggacctgcagccggcgggcagcctcccccatgctccccggattaagcggccccgcctccaagttgtgaaacgactcaatttccggtctgaggaaatggaagagcctccaccgccagacagtagtcccaccgacattacgccaccacctagccctgaagatctcgcagaactttggggccatggtgtgagcgaagctgctgccgacgtcggcctgactcgcgcatccccagcggcaaggaatcctgtgcttaggagaccccccatcttggaggactacgtccatgtgacgtcaactgagggcgttagggcctacctggtcctgagagctgatcctatggcgcccggcgttcagggcagcttgctgcacgtgccttggcgaggcggaggccagctggatttgctgggagtctcattagcttcactgaaaaagcaggtggacggcgagcggcgggagcggctcctccaggaggcccaaaaactgtccgacacactccatagcttgcgctccggggaagaagaggccgcgcagccacttggagcgcctgaggaagaacccaccgatggccaagatgcctccagtcactgcctttgggtagatgaattcgctccaagacattatacagagctactttccgacgacttcaccaatcgttgtctgttaaaatggctgaaactgtgggacctcgtggtgtttggacatgagagacctagccgcaagccgcggccgtcagtggaacccgcccgagtgagtaaagaggctactgcgcctggcaagtggaagagccacgagcaggtgctggaggaaatgctggaggctggactcgatccttctcaacgccccaaacagaaggtggccctgttatgtggaccacctgggctcggaaagacaaccttggcgcacgtaatcgccagacatgctggatattcggtcgtggaaatgaatgcgtccgatgatcgctcaccggaagtttttcggacccgtatcgaggccgcaactcaaatggaaagcgtactgggcgcaggtggcaaaccaaattgtctcgtcatagatgaaatcgacggggcccccgttgccgctatcaatgtgctgctgagcattttgaacaggaaaggaccacaggaagttgggccacaagggccagccgtgccctctggcggtggcaggaggagacgagctgaaggcgggctactcatgcgacccattatatgcatctgcaacgaccagtttgcacctagcctacggcagttaaaacaacaggccttccttctgcattttccaccaactctgccgtcacggctagtgcagcgtctccaagaagtttccctgaggcagggcatgagagccgatcctggagtgctcgcagccttgtgcgagaagacggacaacgacatacgcgcctgcatcaacactttgcaatttctatatagccgagggcagcgcgaactatctgttcgcgacgtgcaggcaactagagtcggccttaaggatcagcgccggggcttgttcagtgtctggcaggaggtgtttcagctgccccgcgctcagaggcggcgtgtcgggcaggaccctgctctccccgcagataccttactgctcggtgatggagacgcaggcagtctgacttccgctagccagcggttttatcgcgtgctccatgcagcggcttctgccggcgagcatgagaaggttgtacagggcctgttcgataacttcctccgcctacgcctgcgcgactcttcactgggagcagtatgtgtggcacttgactggttggcatttgacgacttgctggccggcgccgcgcatcacagtcagtcctttcagcttctgaggtatcctcctttcctccccgtcgcattccacgtgctcttcgcctccagtcatacacccaggatcacgttcccttcctcacagcaagaagcccaaaaccggatgtctcaaatgcggaaccttatccagacactagtatccggcatcgccccagccacacgtagtcgagccacgccgcaggccctcttgttggacgccctgtgcctcctgttggacattttggcaccaaaactccggcccgtgagtactcagttgtactctacccgggagaaacagcagttggcatctctggtggggacgatgctcgcatactctctgacataccggcaggaaagaacaccagatggccaatatatctacagattggagccaaatgtcgaggagctgtgccggtttcccgagctcccagccagaaaacctttgacttaccagacgaaacagcttatcgctagggagatagaggtcgagaaaatgcgcagagcagaagccagcgcacgggtagaaaatagtccacaggtggacgggagccctcctgggctcgagggtctactcggaggcatcggagaaaagggagttcaccgacctgccccacggaatcacgaacaaagactggaacacatcatgagaagggccgcccgggaggagcaaccagagaaggatttcttcggaagagtcgtcgtgcgatccaccgctgtcccaagcgccggcgacacagcccctgagcaagacagcgtcgaaagaagaatggggactgcagtcggcaggtcagaagtttggtttagatttaatgagggtgtcagtaatgcggttaggcgatccctgtatattagggacctactgtag

SEQ ID NO: 184034 - DNA, 3555 bp, Artificial Sequence
  Description of Artificial Sequence: Synthetic coding sequence
atgcacgtgaacgccagcgcccggcggtggggccggggcggcgccgccgcactgcccggcccagctgcctctccgagacgccctgctcccaggaccggccccgtggggaggcctacattggcaccatccccatcgcgggcgcacgctcatgctaaaaccaacctcctgccagggcgggctgtacaggcgcctgatgctgtccctggagctggatcaagtagagcacctgcacgctggagaccaagagaccctgggtcttcagcacccgatgcatggcagcggtttagacccgcccccctcagggcgcagccacgcccgcctccccgtcctgctcccggcccgcccccacctcggaagggaggatgcggtggccaatggagggccccgcaggacagaactagggggcttagaagcaggaattctccaagaccccctcttgcccagccacggctccggcacgcaaatcagtggagagccccgccagggacgccagctgccgattggaggcgtccagccagaagcggccgcgccgtcagagacggcggcgggggcgcggggggatccgaacgcgagcttggccttgcggatggtatggaggattatgaacaggagctttgcggggtggaggatgacttccataatcagtttgctgcagaactggaagtgctggctgaacttgagggcgcttccacacctagcccctccggagtgccgctctttactgctgggaggcccccacggacattcgaggaggccctcgccaggggtgacgccgcaagttctcccgcccctgctgcctccgtggggtcgtctcaaggcggcgcgcgtaagcgccaagttgatgctgatttgcaacccgcaggctcactgccacatgcccctcggattaagcggcctcggcttcaggttgtgaaacggctgaactttagaagcgaagaaatggaggagcccccaccccccgactcttcccccaccgatatcactcccccgccaagtcccgaggatctggccgagctgtggggccacggctttagcgaagccgccgcagatgtggggttgacccgggcttctccggccgcaagaaatcccgttctgaggagaccccccatactcgaggattacgtgcatgtaaccagcaccgagggcgtgagagcatacctggtgctgagagcagatcctatggctcctggcgtccagggatccctcttgcacgtcccctggcgggggggggggcagctcgatctactcggggtgtcactagctagcctaaaaaagcaagtggatggtgagcgaagagaaagactactgcaggaggctcagaagctgtccgataccctgcatagaagtggagaggaagaggccgcacagcctcttggcgctcccgaggaggagcccacggatggccaggacgcgtcgtcccactgcctttgggtggatgagtttgctcctagacactataccgagcttctcagtgatgacttcaccaataggtgcctgctgaaatggctgaagctttgggacttggtggtttttggacacgaacggcccagtcggaagcctagacctagtgtcgaacccgccagggtcagcaaggaggctactgccccgggcaaatggaagagccacgagcaggtgctggaggagatgctcgaagcagggctggatcctagtcagagacccaagcagaaagtggccttgctgtgcggtccacctgggctgggcaaaactaccttggcacacgtaattgccaggcacgctgggtactctgttgtagagatgaacgcctccgatgaccggagccccgaggtttttcgcacccgcatcgaagcggcaactcagatggagtccgtgctgggagccggcgggaaaccaaactgcctggtcatagatgagatcgacggcgctcctgtggctgctattaatgtgcttttgagcattctcaatcgcaagggcccacaggaggtaggcccacagggccctgccgtaccttccggcggtgggaggagaaggagagccgagggcggcctgctgatgaggccaatcatttgtatctgcaacgaccagttcgctcccagcctgaggcagcttaagcaacaggctttcctcctacatttccccccaactttgccaagccgcttggtgcagcggctccaggaaggtatgcgggcagacccaggagttcttgcagccctctgtgaaaagaccgacaatgacattcgcgcttgcattaacaccttgcagtttttatattctagaggccagcgggaattatctgtgcgcgatgtccaggcaaccagagtgggcctcaaggaccagaggcgagggctgttttccgtgtggcaggaggtgttccagctgcctcgagcccagagaagtagtcagcatgtaagcgtgttgacctgccacggtactccgggagacgctggccttgtggtgctccaggacatgggcgacgcagggctggggctatgggacgtccttctgctagcctggacaagacgggggacattccccggccgcttctatcgcgtgttgcacgccgccgcgtccgcgggcgagcacgagaaagtggtgcagggcttgttcgacaactttctgaggttgcggctcagagattctagtttgggagctgtgtgcgtggcactagactggctagcgttcgacgacttgttggccggtgccgcacatcactctcaaagcttccagctcctccgctatccccccttcctccccgtggcatttcatgtgctcttcgcctccagccacacgcccaggattaccttcccttcttcacagcaggaggcccagaatagaatgtcccagatgcgcaatctaatccagacactggtgtccggtatcgctccagctaccaggagccgggccaccccccaggctctcctgctggatgccttgtgcctgctgctcgacattctggccccaaaactccgccccgtcagtacccagctctatagcacccgcgagaagcagcaactggcctccctggtcggaactatgttggcttatagcctgacttatcgccaggagcgcacccccgatggccaatatatttaccgacttgaaccaaatgtggaggagctctgtcggtttcccgagcttcccgcccgaaaacctctgacttaccagactaaacagcttattgctagggagatcgaggtcgagaagatgaggcgcgccgaggcctcagccagggttgaaaattcacctcaggtagatgggtctcctccagggctcgaggggctccttggtggcatcggcgagaaaggcgttcatcgaccagcccctcggaaccatgagcagaggctggaacacatcatgcgcagagcagctcgggaggagcagcctgagaaggatttcttcggacgggtggttgttaggtccaccgcagtcccgtccgccggagacacagctcctgaacaggatagtgtcgagagaagaatgggcaccgccgtcggccggtccgaagtgtggttccggttcaatgagggagtctccaatgctgtgcgtcgttcactgtatatcagagacctgttatag

SEQ ID NO: 184035 - DNA, 3012 bp, Artificial Sequence
  Description of Artificial Sequence: Synthetic coding sequence
atggaggactacgagcaggagctgtgcggcgtggaggacgacttccataatcaattcgctgccgaattagaggtgttagcagagttggaaggtgccagtacaccttccccatccggcgttccgctctttacagcagggcgacccccccggacctttgaggaggccctggcgagaggggatgcagcatcctcgcccgcgccagccgcctctgttggaagcagccagggaggtgcacggaagcgtcaggtcgacgcggacctgcagcccgccggatccctcccccacggaagactggcggccttgccgcagggattgcggtctggcagagaggccgaggaagcctcgggctccctgcacgtatccccccccgcccctcgcattaaaagaccacggctgcaggtcgtcaagcggctgaattttcggtccgaagaaatggaagagccacctccgcctgattccagccctacagatattactcctcccccctcccccgaggatctggcagaactctggggccacggagttagcgaggctgcagccgacgttggtcttacccgcgccagccccgccgctcgcaaccctgtcctcaggaggcctccaatcttggaagattatgtccacgtgacctcaaccgagggggtccgagcctacctcgtgctgagagcggacccgatggccccgggtgtccagggttcacttctgcacgtgccatggagaggaggcggacaactcgacctcctcggcgtctctctggcatccctgaaaaaacaggtggatggagagcggcgggagaggttactgcaggaagcccagaaactgtcagacacgctgcacagcctacggagtggagaagaggaggctgctcagcctctgggcgctcccgaggaggaaccgaccgatggtcaggatgcttcttcccactgcctgtgggtagacgagttcgctcctagacactacactgagctgctttcagacgattttaccaaccgttgtctgctgaagtggctgaaattatgggatcttgttgtcttcgggcacgaaaggccttcccggaaaccgagaccatccgttgagcctgcgcgggtgagcaaggaggccacagcccctgggaagtggaagtctcatgagcaggttctggaggaaatgctagaggcaggtctcgatccttcccagcgaccgaagcagaaagtggcgctcctgtgcgggcctcccgggttaggcaagactaccctggctcacgttattgcacgtcatgctggatactctgtggtggagatgaatgccagcgatgatcggtccccggaggtgttccggactcgcatcgaagccgcgacgcagatggaaagtgtgctgggagctgggggcaagcccaactgtctggtgatcgatgagatcgatggagcgccagtcgccgccatcaatgtactgctctccatacttaaccgaaaaggcccccaggaagtggggcctcagggtcctgccgttccctccggtggtggccggaggagacgcgcagaggggggactacttatgaggccaattatatgcatctgtaacgaccaattcgcaccgtccctcaggcagttgaagcaacaggccttcttgttacactttccacccactctaccatctagactggtccagcggctgcaagaagtctcacttagacagggcatgcgggcagatcccggcgtgctcgccgctctgtgtgagaagactgacaatgatatccgtgcatgcatcaacacactgcagtttctgtactccaggggccagcgcgaactatctgtacgagacgtgcaggctactcgcgtcggccttaaggaccagcgccggggtctcttttccgtgtggcaggaagtattccaacttccaagagctcagagaaggcgggtgggccaagaccccgcgttaccagccgacacacttctgcttggggatggagatgcgggctcattaaccagtgcttcacagcgcttttaccgtgtcctgcatgccgccgccagcgccggcgagcacgagaaggtggtccaagggttgtttgacaattttctgcgtttgcgcctgcgagacagctccctgggcgctgtgtgcgtggctctagactggctggcgttcgatgaccttctcgctggggcagcgcaccactcgcagagtttccagctattgcgttatcccccttttctgcctgtggcctttcatgtgctctttgcaagctcccacaccccgaggataacctttccaagctcgcagcaggaggcacaaaacagaatgagccagatgcgaaacctgattcagacacttgtctcaggtattgcgcctgccaccagaagtagagctaccccacaagccctgctcctggacgccctgtgcctcctcttggacattctggcacctaaattgagacccgtgtccacccaactatattctactcgtgagaagcagcagttggcctcgctggtaggcaccatgctggcctattccctcacatacagacaagagcgaacccccgacgggcagtacatttacaggctggaacccaacgtggaggagctgtgcagatttccagaactcccagccaggaaacctctgacctaccaaacgaaacagctgattgccagagagattgaggtggagaagatgaggcgcgctgaggctagtgctagggtcgagaactctccacaggtggacggctcccctcctggcctggagggactgcttggagggattggagagaaaggcgtgcataggcccgctcctaggaatcacgaacagcgcctggagcatattatgcggcgtgccgcaagagaagaacagccagagaaagacttcttcggcagagtcgtcgtgcggagcacagccgtcccatccgcaggtgacacagccccagagcaggatagcgtggaaaggcgcatgggtacagctgtgggccgctctgaagtgtggttccgtttcaacgagggcgtctcaaacgcagtgaggcgttctttgtatattcgggatctgctgtag

SEQ ID NO: 184036 - DNA, 1575 bp, Artificial Sequence
  Description of Artificial Sequence: Synthetic coding sequence
atgaaggagccccggatcttcccccgggagcggcccaccccctggactcgcgctccactcccaccccgcggtcggcttgacggatctctgggcccacagggcggcccagtgctgaatacgggtcatcctctcggggtgaatagtgaccccttcttgatggccgctggaagcctgggggggaatctgaccccgttcccaagaaatccaagcccttttcctgcctcttccgggtcactcgcctcaaatcccgccccattcccagctggagcccgggacccctccatggcgtcgttcccacgcgggatgaatccaaccggtaccggggccgttagctttccccgtcctggcggtctgctgggacccgggcccggccccggaccgaccctgaatccccgcaccggggctctccctggccctgggcccttgagcaacccccggcttggcggactgcccggaccggggccaatgagcaatcccagagccggcggcctattgggagccgggcctgatccacgcggagggggaccaatgggcccgggatctggccctaatctgagagcaggggtgctgctgacaagcgggaatggccctcctaatcctcgcccagttggtcttggtcccggtcccaatcccaatttacggagtggctttcttggcacgaatccagctccgcgctctggcgttttcccaggcccaggcctgggcccaaacccgagaccctcagggttggggcccgggccaaacctcgacgcgcgagcgggaggcctcctcgggacagggagtggactaaacctgaggatggccggaccccagggcctcgacttggccccgatccttcgggccgcggggttgctaggcgctaactctgcctctttcagccaggcatccggaaacatggggacatcgccttccagtatggccagagtgcctggcccgatgggcccaaactctggccccagctcacgtgggattggcttacctggaccaaatcccagtcctatgtcccgtgccccaggccctatcggccctaacagcgctcatttttcacggccagttggcccgatgggcgtcaatgctaaccccttcccccgaggggccgggagctcggctttctctcaatcgtccggcaccctggcaagtaaccccgctacctttcagcggtcagccggcctgcagggatccaaccccacaattttcccgagagccagcggcccgctcggccctaacccagccaattttccccgggccacgggactccagggcccctccccaacgacatttcccagatcaacaggaccactcggacctggccaggtcactttcccccggccagccgctggacacctgggtccatcccctgcaggcccagttggaatcaaccccgctccctttactcgccccaccggcacccttggcctgaaccctgcctcctttcccaggatgaacgggccagctggaaagtcttttgtgccattcccccgggtgggcagtctgccaggcaccaatcccgccgcttttccccgcccgggcggaccaatggccgccatgtacccaaacggcatgctaccgccatag

SEQ ID NO: 184037 - DNA, 366 bp, Artificial Sequence
  Description of Artificial Sequence: Synthetic coding sequence
atggtgcagatcgtgatcagcagcgcccgggccggcggcctggccgagtgggttttgatggaactgcagggcgaaatcgaggctcgctactctacgggactggccgggaaccttcttggggatctgcattacaccactgaagggattccagtgctgattgtgggacaccacattctgtacggtaaaatcatccacttagagaagccctttgctgtgttagtgaagcataccccaggagaccaggattgtgacgaattggggagagagacaggaactcgataccttgtcaccgcactgatcaaagataaaattctctttaagaccagaccgaagccaatcatcacctcagtgccgaaaaaagtgtag

SEQ ID NO: 184038 - DNA, 366 bp, Artificial Sequence
  Description of Artificial Sequence: Synthetic coding sequence
atggtgcagatcgtgatcagcagcgcccgggccggcggcctggccgagtgggttctgatggagcttcaaggcgagattgaggcacgatacagtaccggcttggccggtaacctgctgggagaccttcactataccacagaaggtattccagtgctcatagtcggacaccatattctgtatggtaagataattcatctcgagaagccctttgctgtcctcgtcaagcacacaccaggggatcaggactgtgacgagctgggtcgggagaccggtacgaggtatctagtgacagctctaatcaaagataaaattttgtttaaaacaaggccaaagcccatcatcacgtcagtgccaaagaaagtctag

SEQ ID NO: 184039 - DNA, 1776 bp, Artificial Sequence
  Description of Artificial Sequence: Synthetic coding sequence
atgaagtacatcctggtgaccggcggcgtgatcagcggcatcggcaagggaatcatcgcaagtagtgttggcacaattctgaagtcctgcgggctgcacgtgacaagtattaaaattgacccttatataaatattgatgccggaactttttcgccctacgagcatggcgaggtgttcgtgctggacgacggcggggaggtggacctggatttgggcaactatgagcgcttcctggatattcggctcaccaaggacaataatctcaccacaggaaagatctatcagtatgtgatcaataaagaaagaaagggagactatctaggaaagacagtacaggtggtgccacacattaccgacgcaatccaggagtgggtgatgcgtcaggccctcatccctgtggatgaagatggactagaaccacaagtgtgcgtaatagaactaggcgggaccgtgggcgatattgagtcaatgccatttattgaggcgtttcgccagttccagttcaaggtgaagcgggagaatttttgtaacatccacgtgtcgctggttccccagccgtccagcaccggagaacagaaaaccaaacctacgcagaattcagtaagggagcttcgaggcttaggcctgagcccggatttagtggtgtgcagatgttcaaaccccttggatacttccgtgaaggaaaagatttcaatgttctgtcacgtggagcccgaacaggtcatctgcgtccacgatgtgagcagcatctatcgcgttcctttgctgctggaggaacaaggcgttgttgactattttctccgtcggttggacctgccaatcgagcggcagcctagaaaaatgcttatgaaatggaaagaaatggccgaccgctatgatcgtctgttggagacctgctctatagccctcgtcggaaaatacactaaattttctgacagttacgccagcgtgatcaaagcgctcgagcatagcgccctagccatcaatcacaaactggagatcaaatacatcgattccgccgatctcgagccgattacctcccaggaagagcctgtccgctatcacgaagcatggcagaagttgtgtagcgctcatggggtgctggtgccaggcggcttcggcgtcagagggacggaaggcaaaatccaggctatcgcctgggcgagaaaccagaaaaagccgttcctgggcgtgtgcctcggaatgcagctggccgtggtagagttttctcggaatgtgctagggtggcaggatgcgaactccaccgaatttgaccctactacctctcaccccgttgtcgtcgacatgcccgagcataatccgggacagatggggggcaccatgagacttgggaaaagacgaaccctgttccagaccaaaaacagcgtcatgaggaagctgtatggagacgctgattacctggaagagcgacacagacaccgattcgaagtcaacccagtgtggaaaaaatgcttagaggagcaaggactcaaattcgttggccaggacgtggaaggagagcggatggaaatagttgaactggaggatcatccattcttcgtgggggtccagtaccaccctgaatttctctcaagaccaataaagccttcacccccgtacttcggcctactgttagctagtgtggggcgtctgagccattatctccagaaggggtgccgcctatcaccaagggatacctactctgatagatcgggtagcagttccccagacagcgaaatcaccgagctgaagttcccatctatcaaccatgactag

SEQ ID NO: 184040 - DNA, 1776 bp, Artificial Sequence
  Description of Artificial Sequence: Synthetic coding sequence
atgaagtacatcctggtgaccggcggcgtgatcagcggcatcggcaagggtattatcgcttcttctgtggggaccatcctcaaaagttgtgggttgcacgtgactagcatcaagatcgacccttatataaatatagatgctggaacattctcaccgtacgagcacggggaagtgttcgtgcttgatgacgggggagaagtggacctagacctaggcaattatgagcgcttcctggacattcgcctgacaaaagataacaacctgacaaccgggaagatatatcagtacgttattaataaagaacgaaagggcgattacctcggcaaaaccgtccaggtggttccgcacatcaccgacgcaatacaggaatgggtcatgcggcaggctttaatccccgttgatgaggatggcctcgagccacaggtgtgcgtgatcgagctgggcggaaccgtcggggatattgaatccatgccattcatagaggccttccggcaattccagttcaaggttaagcgagaaaacttttgtaacatccatgtgtcactcgtcccacaaccatccagcaccggggagcaaaaaactaaacctacccaaaacagcgtacgcgaacttcggggccttggactcagccccgacctcgttgtttgccggtgcagcaacccgctggacaccagtgtgaaggagaagatttccatgttttgccatgtcgaaccagagcaagtcatatgcgttcacgatgtgagtagcatctaccgcgtacccctgctgctcgaggagcagggagttgtcgattatttcctgaggcggttggacctgcccatcgaaagacagccaaggaagatgcttatgaagtggaaggaaatggcagaccgctatgataggctgctggaaacgtgctccattgcgctggtgggaaaatataccaagttttcagacagctatgcgagcgtaataaaggctctcgaacacagcgctttagctattaatcacaagctcgagataaaatacattgattctgcggatctggagcccattaccagccaagaagagcctgttcggtaccatgaggcttggcaaaagctgtgcagcgcccatggtgttctggtgcctggtggattcggggtgcgcggcacagaaggcaagatccaagcaatcgcgtgggctcggaaccagaagaagcccttcctgggggtgtgcctggggatgcaactcgccgtggttgaattctcccgcaacgtgttggggtggcaggacgctaattctactgagttcgatcccaccacaagtcacccagttgtcgtcgacatgcctgagcacaacccaggacagatgggcgggacaatgcgcctaggtaagagaaggactttgttccagactaaaaacagcgtcatgcggaaactgtatggggacgcagattacctggaagagagacaccggcacagatttgaggttaaccccgtctggaaaaaatgtctagaagaacagggactgaaatttgtaggccaagacgtggagggagagcggatggagatcgtagagttagaggatcacccatttttcgtgggggttcagtatcaccctgagttcttatcgagacctatcaagccttctccgccatactttggcctgctactggcgtctgtgggccgactctcacattacctgcagaaaggatgtcggctttcgccgcgggatacttatagcgaccgcagtggttcctccagccccgattctgagattacagaattgaagttcccctccatcaatcatgattag

SEQ ID NO: 184041 - DNA, 1083 bp, Artificial Sequence
  Description of Artificial Sequence: Synthetic coding sequence
atgttctgccacgtggagcccgagcaggtgatctgcgtgcacgacgtgtcaagcatttaccgcgtgcctctcttgctggaggagcagggtgtagttgactatttccttaggagattggacctccctattgaacgccaaccaagaaaaatgcttatgaagtggaaagagatggcagacagatacgatagactcctggagacctgctccattgcactagtcggcaagtacacaaaattcagcgactcttacgcctccgtaattaaagctctagaacactcggcgttagccatcaaccacaagctggagatcaagtacattgacagcgccgaccttgagccaattacaagccaggaagagccagttaggtaccacgaagcatggcaaaagctctgttctgcgcacggggtgctcgtacccggcggcttcggcgtgcgaggcaccgaaggaaaaattcaggcgatcgcctgggcacggaatcaaaaaaagccgttcctgggggtttgtctcggcatgcagctcgcggtcgtggagttctctcgcaatgtcctggggtggcaggacgctaatagcactgaatttgaccctactacatcacatcccgtggtggttgatatgcccgaacacaatcctgggcagatgggcggaacaatgcggctagggaagcggagaactttgtttcagaccaaaaattccgtcatgcgtaagctgtatggggacgccgattatttggaagagcgccataggcacaggttcgaggtgaaccccgtctggaaaaagtgcttagaagagcagggcttaaaattcgtaggtcaggacgttgaaggggaacgcatggagatcgtggaattagaggaccaccccttcttcgttggtgtgcagtatcatccagagttcctgtcacggcccatcaagccctcaccaccttatttcggactgctgttggccagtgtaggacggctctcccactacctgcagaagggctgccgactatctcctcgagacacatattcagaccggtccggcagctcttcacccgattccgagatcactgaattaaagtttccatcgataaaccatgactag

SEQ ID NO: 184042 - DNA, 945 bp, Artificial Sequence
  Description of Artificial Sequence: Synthetic coding sequence
atgcccaagagcaagagcaagatgaagtacatcctggtgaccggcggcgtaattagcggcattggcaaaggtatcatcgcaagtagtgtgggcaccatattaaaatcttgcgggttacatgtgacctcaattaagatagatccatatattaacatcgacgctggcacgtttagcccctacgaacacggtgaggtgttcgttctggatgatggaggcgaagtcgacctggacttaggcaattacgagaggtttctcgacattcgactgacaaaagacaataacctgactactgggaaaatctaccaatacgtcatcaacaaggagcgtaaaggggactatttgggcaagaccgtacaggtagtgccgcacatcactgatgcgatccaggagtgggtcatgagacaggcgttgatacctgtggatgaagacggacttgaaccccaggtgtgcgtgatcgagctgggcggcactgtgggagacatcgaatccatgccatttattgaggcattcagacagttccagtttaaggtgaagagggagaatttctgcaatatccacgtcagccttgttccgcagccttcaagtacaggagaacaaaaaacgaagccaactcagaactctgtgcgcgagctcagaggtctcggcctgtctcctgatttagtggtatgtaggtgttccaatccactcgacacttccgtcaaggagaagatatccatgttttgccacgtcgaacccgaacaggtcatctgcgtgcatgacgtgtcttcaatctatagagtaccactgctcctggaagaacagggggttgtggactacttcctgcgaaggttggacctgcccatcgagcgacagcctagaaagatgctgatgaaatggaaagagatggccgacagattcgcttgcaacgaggagttgggagtgttggcgagctttacactgctgtag

SEQ ID NO: 184043 - DNA, 1761 bp, Artificial Sequence
  Description of Artificial Sequence: Synthetic coding sequence
atgaagtacatcctggtgaccggcggcgtgatcagcggcatcggcaagggcatcattgctagcagtattggtaccattctaaagagctgcggactccgggtgaccgcaatcaaaattgatccttacatcaacattgatgctggaacgttcagcccttacgaacacggtgaggttttcgtactaaatgacgggggggaagtagatttagacctgggaaactacgaacggtttctcgacattaatctgtacaaagacaacaacatcacaacaggcaagatataccagcacgtcatcaacaaggaacggagaggggattacctcggtaagacagtgcaggtggtaccccacatcaccgatgccgtgcaagaatgggtaatgaaccaggcaaaggtgccagttgacggaaacaaggaagagccccagatctgtgtgattgagttaggaggtaccattggggacattgaaggaatgcctttcgtggaagcgtttaggcagttccagttcaaagcaaagagggagaacttttgcaacatccatgtgtctctggtgccccagctgagtgccactggcgagcaaaagacaaagcctactcagaactcagtgcgagccctgcgcggactcggcctgtcccctgatctgatagtctgccgaagttccacccctattgagatggctgtgaaggagaaaatcagtatgttttgccatgttaatcctgagcaggtcatttgtatccatgacgtctcctccacatatagagtgcctgtgctcctggaagaacagagcatagtaaagtacttcaaagagagactgcatctgcccatcggcgattccgcctcgaatctgttatttaagtggagaaatatggccgaccgatacgagagacttcagaaaatctgtagtatcgcgttggtcgggaagtacacaaaattacgtgattgctacgcatccgtgttcaaggcactggagcacagcgcactcgccattaaccacaagctgaacctgatgtatattgatagtatcgatctggaaaagataactgaaacagaggacccagttaagttccatgaagcctggcagaaactctgtaaggctgacggcatactggtgccaggcggtttcgggattcgcggcacattaggtaaactgcaggccatttcgtgggctcggacaaagaaaatcccttttcttggcgtgtgccttggaatgcagcttgctgtgatagagttcgcacggaattgcttgaatctcaaagacgctgacagcactgaattcaggccaaatgcccccgtgcctctggtgatcgacatgcccgaacataatccagggaatctaggaggcacaatgaggctcggtatacgccgaaccgttttcaagactgagaattccatactgaggaagctctacggagacgtgccctttatagaagaacgccatcgccataggttcgaggtcaatcctaaccttattaagcaatttgagcagaatgatctcagctttgttggacaggacgtggatggagatagaatggaaatcatcgaactggcaaaccacccttactttgtaggcgttcaattccaccctgaatttagttctaggcccatgaagcccagccctccctacctggggctgttgcttgccgcaacagggaacctgaacgcctaccttcaacaggggtgcaagcttagctcctccgatcgatattcagatgcctctgatgattccttttcggaaccaagaatcgctgagctcgagatctcttag

SEQ ID NO: 184044 - DNA, 531 bp, Artificial Sequence
  Description of Artificial Sequence: Synthetic coding sequence
atgtacatcgacagcatcgacctggagaagatcaccgagaccgaggatccagtaaagttccatgaggcttggcagaagctttgcaaggcagatggcattcttgtgccggggggcttcggcatcaggggcacgctgggtaaattacaggccatctcatgggcaagaaccaaaaaaattccttttctaggcgtgtgcctgggcatgcaactggctgttatcgaattcgcccggaactgtctgaatttgaaggatgcagactcaacggagttcaggccgaatgccccagtgcccctcgtcattgatatgccggagcacaaccctggcaacctcggcggcacgatgcgactgggaatacggagaaccgtgtttaagaccgagaatagcattctcattagcttgtctttggggcttgcgtcagttgagcacaccgagtgccccagcgccttcgacttacgggattcactgtttatcggattgttttgtgaactcccaatgctattagagatgaacctggattgggacctggactag

SEQ ID NO: 184045 - DNA, 1761 bp, Artificial Sequence
  Description of Artificial Sequence: Synthetic coding sequence
atgaagtacatcctggtgaccggcggcgtgatcagcggcatcggcaagggtattatagcgtcatcgattggaactatactgaagagctgcggcctccgcgtcaccgcaatcaaaatcgacccatacattaatattgatgcagggacattctctccctacgagcatggcgaagtgttcgttttaaatgatggcggagaggtcgacctggatttagggaattatgaacgattcctcgatataaacctctacaaggataacaacataaccacggggaagatataccaacacgtgattaacaaggagaggagaggggattacttaggtaaaactgtccaggtcgtgccacatattacagacgcagttcaggaatgggtgatgaatcaggctaaagtcccagtggatggcaataaagaagagcctcaaatttgtgtaatcgaactcgggggaactatcggggatatagagggaatgccattcgtcgaagcatttagacagtttcaattcaaggctaagcgggagaacttttgtaatatccacgtctccctggtccctcagctcagcgcgaccggggaacagaaaaccaagccaactcagaacagtgttagggccttgcggggactcggcttgtctcccgatctcatcgtctgccgtagcagcaccccgattgagatggccgtcaaggagaaaatttctatgttctgtcacgtcaatccggagcaagttatctgcattcatgacgtctcatcaacgtatcgggttcccgtccttttagaggaacaaagtatcgttaaatactttaaagagaggttacatttgcccatcggcgactccgctagcaacctattgttcaaatggaggaatatggccgacaggtatgaaagactgcaaaaaatttgctccattgccctggtgggcaagtacacgaaactccgcgactgttatgcgtccgtcttcaaagctttagagcattctgctctggcgatcaaccataagctcaatctgatgtacattgatagcatcgatctggagaagattaccgagactgaagatcccgttaagttccacgaagcctggcaaaagctttgcaaagcggatggtatactcgtgcctggcggattcggcattaggggtacactcggcaaactccaggccatcagttgggccaggaccaaaaaaatccccttcctcggtgtttgcctcgggatgcaactcgcagtgatcgagtttgctcggaattgccttaacctcaaagatgccgattctacagaatttcgaccaaatgctccggtgcctttggtgatagacatgcctgagcacaatccaggaaatcttgggggtaccatgcggctcgggatccgcagaacagtatttaagaccgagaatagcatcttacgaaaactgtacggggatgtgccgttcattgaagagaggcacaggcatagattcgaggtaaaccccaacctgattaaacagtttgaacaaaatgatcttagcttcgtcgggcaggatgttgacggcgacagaatggagataatcgaattagccaatcacccatactttgtcggcgtgcagttccatcccgaattcagctcccggcccatgaaaccgtcccctccgtatctaggcctgctcctcgcagcgactggtaacctaaatgcttacctccagcagggatgcaagttatcttccagcgaccgatattcggatgcgagcgatgacagtttctctgaaccacgtatcgctgagctggaaatatcttag

SEQ ID NO: 184046 - DNA, 1761 bp, Artificial Sequence
  Description of Artificial Sequence: Synthetic coding sequence
atgaagtacatcctggtgaccggcggcgtgatcagcggcatcggcaaggggatcattgccagctctattggtactatccttaaatcctgcggattacgcgttacagcgattaaaatcgacccctatattaacattgacgccggtaccttcagcccatacgaacatggggaagtcttcgtgctcaatgacgggggcgaggttgatttggaccttggcaactacgagcggtttctggacataaacctgtacaaggataacaacatcactactgggaaaatctaccagcacgtgattaacaaagaacgaaggggagactacctgggtaaaactgtgcaggtggtgccacacatcactgatgctgtgcaggagtgggtgatgaaccaggccaaggtgcccgtcgatggaaacaaagaagagccgcaaatctgcgtgatcgaactcggcgggacgatcggggatatcgaaggcatgccctttgtggaagccttcagacagttccaattcaaggctaaacgcgaaaacttctgtaatatccacgtcagtctggtgcctcagctctccgccacgggcgaacagaaaacaaaacccacgcagaatagcgttcgcgctctgcggggactgggtctgtcccctgacctgatcgtgtgccgctcaagcacacctatcgaaatggccgtcaaagagaaaatcagcatgttttgtcacgtgaaccccgaacaagttatatgtattcatgatgtgagctccacctatagagttcccgtgctcttggaagaacagtccattgttaagtacttcaaggagcgcctgcaccttcccatcggagactccgcttccaatctcctgtttaaatggcgcaatatggccgatcggtacgagaggctgcagaaaatttgctccatcgccctggtaggaaaatacacaaagctgcgggactgctacgccagcgtgtttaaagcgctggagcattcagccctggcaatcaatcacaagttaaacctgatgtatattgacagcattgacctggagaagattacagagaccgaagaccccgtaaagttccatgaagcttggcagaagttgtgtaaggcggatggcatcctggtgcccggagggtttggcatcaggggcacactgggaaagttgcaagccatatcttgggcacggactaaaaagattccctttctcggggtttgcctaggaatgcaactagctgtcatagagtttgccagaaactgtctcaacttgaaagatgctgactcaaccgagtttaggcccaatgcgcctgtcccgctggtcatagatatgcccgagcacaatcccggtaatttggggggcacaatgagactggggatccgcagaaccgtgttcaagacggagaactccatcctccgtaaactctatggggatgtcccctttatagaggaacggcacagacatcgattcgaagtgaacccgaatctcataaagcaatttgagcagaacgatctcagtttcgttggccaggacgtagacggtgaccgaatggagattattgagctggcaaaccacccgtactttgtaggggtgcagttccacccggagttcagctctagacccatgaagcctagcccaccttacctcgggttactgctggccgccacaggcaacttgaatgcatacctgcagcaggggtgcaagttatcctcctcagaccgctactctgacgcttcagatgatagttttagcgagcctcgcattgccgagcttgaaatctcttag

SEQ ID NO: 184047 - DNA, 399 bp, Artificial Sequence
  Description of Artificial Sequence: Synthetic coding sequence
tgaggcaagctgcaggccatcagctgggcccggaccaagaagatccccttcctgggggtctgtctcggtatgcagctcgctgtgattgagtttgcacgcaactgcttgaatctgaaggacgctgatagtactgagttcaggcctaatgcccctgtcccccttgttatcgatatgcccgaacacaaccccgggaacctcgggggcacgatgcggctgggcatcaggagaacggtgttcaaaacagaaaacagcatccttatctccctgagtctcggcctggccagcgtggagcatactgagtgtccttctgcctttgacctgcgagacagcctgttcatcgggctgttctgtgaactgccaatgctcctggagatgaatctcgactgggatctcgattag

SEQ ID NO: 184048 - DNA, 3654 bp, Artificial Sequence
  Description of Artificial Sequence: Synthetic coding sequence
atggccgccggccgggcccaggtgcccagcagcgagcaggcctggctcgaagatgcacaggtgtttatccagaagacattatgccctgccgtgaaagagcccaacgttcagctgacccctctggttatagattgtgtgaagactgtgtggctttcccagggtcgaaatcagggatctaccctacccctgagctatagcttcgtgagtgtgcaggatctcaaaacccaccagaggttgccctgctgcagccacctcagttggtcttcctctgcctaccaggcttgggcccaagaagctggcccaaatggcaatccgctgccccgggagcaactgttactcttgggcaccctgactgacctctcagccgatcttgaacaagagtgccgaaatggttctttatacgtccgtgacaataccggggtgttgagttgcgaactgatagatctggacctgagttggcttgggcatctgtttctctttccgcgctggagctacttgccgcctgcccggtggaactcctccggagaagggcacctggagttatgggatgccccggtgccagtgtttcccctcaccatctccccaggtcccgtgacccctataccagtgctgtaccctgaatctgcgagttgcttgcttagactgaggaataaattaaggggagtccagcgcaatctcgcggggtcactcgtaagactgagtgcccttgtcaagagtaagcagaaggcatactttatactcagtctcggccggagtcatccggcagtgacccatgtgagcataattgtgcaggtccctgctcagttagtgtggcacagagcccttagaccaggaaccgcttatgtgcttaccgagctaagagtgtcaaaaattcggggtcagagacaacacgtgtggatgacttcccagtctagcaggctgttgctgttaaagcccgaatgtgtgcaggaattagagctggagctggaggggcctctcttagaagccgatcctaaacctctcccgatgccttctaatagcgaggacaaaaaggaccctgagtccctggtgagatactcaagacttctctcctactctggtgccgtgacaggagtcctgaacgagccagccgggttgtacgaactcgacgggcagctaggattatgtctagcctaccaacagtttaggggcttgcgtcgggtgatgagaccaggggtttgcctgcagctgcaagacgtccatcttctccaatctgtgggcggggggacccgccgtccggtcctggctccgtgtctgagaggagccgttctcttacaatccttctcccggcagaagcccggtgctcattcatccaggcaggcctatggtgcatccctgtacgaacagctggtctgggagaggcagttaggcctgcctctttacctgtgggctactaaggccctagaggaactggcctgcaaactttgcccgcacgtccttagacaccatcagtttctacagcattccagcccgggatctccatccttaggcctacagctcctggcccccacattagatctgttagccccccctggttcgcctgtacggaatgcgcacaacgaaatcctcgaagagccgcaccactgcccccttcagaaatataccaggctgcagacaccttccagtttccctacactggcaactctcaaagaagagggtcagcgcaaggcttgggccagcttcgatcccaaggctctccttcctctgcccgaagctagctatctgccaagctgccagctcaataggagacttgcatggagttggttgtgtctgctcccctcagccttctgccctgctcaggttctgctgggagtgctggttgctagttctcacaagggctgtctgcagctcagagatcagagcgggagtctcccctgtctgctgctggccaaacactcccaacccttgagtgatcctaggctgatcggctgcttggtgagagcagaaaggtttcagcttatcgtggagcgtgacgtgaggagctccttccctagttggaaagagttatccatgcccggattcatccaaaagcagcaagcccgggtttacgtacagttcttccttgcggatgcgttgattttgcccgtccctagaccatgtctgcatagcgccaccccgtcaacaccccagactgacccgacaggccccgaaggcccccatctgggccagtctcgcctgttcttgctctgtcataaagaagcgctgatgaaacgcaatttctgtgttccaccgggagcatcacccgaagtgcctaaacccgctctgagtttttatgtgcttggcagctggttaggagggacccagcgcaaggagggcaccggttggggcttaccagagccccagggtaatgatgacaatgaccagaaagtgcaccttattttcttcggaagttccgtgcgctggtttgagttcctgcacccaggccaggtgtatcggctgatcgcgcccggccctgccacccctatgttgttcgaaaaggacggaagcagctgcatttcccggcgcccccttgaactggctgggtgtgccagttgtttgacagttcaggataactggaccttggagctggagagcagtcaggatatacaggatgtgctggatgcaaataagtcccttcctgaaagttctctgacagatcttttgtctgacaatttcacagatagtctagtgagcttttccgcagagattttgagccgcaccctttgtgagcctctcgtagctagtctgtggatgaaactggggaataccggagcaatgagacgctgcgtgaaacttaccgtagccctggagacagcagagtgcgagtttcctcctcatttggatgtttatatagaagatccccacctgccgccctctttggggctgctgcctggcgctcgggtacatttcagccagctggaaaaacgggtgtctcgttctcataacgtttactgttgttttcggagtagtacatacgtgcaagtgctctcctttccccccgagacaaccatctcaatccccttgccccatatttatctggccgagctgctacagggggggcagtcaccatttcaggctaccgcatcgtgccatatcgtttcagtgttcagcttgcagctcttttgggtgtgcgcttactgtacctccatctgtcggcagggcaaatgcactcgacttggttctacatgccctactcagacagccatatctcaggccataatcaggctcttagtggaggacggaaccgccgaagctgttgtcacctgtagaaaccatcacgtggcggccgcgttgggactctgtccaagggaatgggcttctctcctggattttgtgcaggtcccgggccgggtggtgctgcaattcgccggtccaggcgcccagcttgaatcgagtgctagagtggacgaacccatgaccatgtttctgtggaccttgtgtactagtcctagcgtgctgcgcccgatcgtcctcagcttcgagctggaacgcaagcccagtaagattgtgcccctggagcccccacgactgcaaaggttccagtgcggagagctcccttttcttactcacgtgaatcctcggctacgactgtcctgcctcagcatcagggagtccgagtacagctcaagcctaggtatccttgcctcaagctgctag

SEQ ID NO: 184049 - DNA, 3096 bp, Artificial Sequence
  Description of Artificial Sequence: Synthetic coding sequence
atggccgccggccgggcccaggtgcccagcagcgagcaggcctggttggaggacgcccaggttttcattcagaagaccctgtgcccagcagtcaaagaacctaacgtgcagctgacaccccttgttatcgactgtgttaagacggtgtggctgtctcagggtcgcaatcagggctccacactcccattgtcatatagtttcgtttctgtgcaggatctgaagacacaccagcgcctaccttgttgttcgcacctaagttggagtagcagcgcttaccaggcatgggctcaggaagccggacccaacgggaacccactgcctcgtgagcagctgctgttgctgggcactctgacagatctgagtgcagacttagagcaggaatgtcgtaacggctcactgtacgtacgtgataacacaggcgtgctcagctgcgagctgatcgatttagacctttcttggcttggccaccttttcttgtttcccaggtggtcctacctaccacctgccaggtggaacagttcaggggaagggcatttggagctctgggacgctcctgttccagtgttccctctgacgatctctccgggcccagttacacccatccccgttctctaccccgaatctgcgagctgcctgttgcgccttaggtctcatccagccgtgacccatgtgtccatcatcgtgcaagtcccagcccagctggtttggcatcgcgccctgagacctggcacggcttacgtgttaactgagcttcgtgtttctaaaatccgcggccagcgacagcacgtgtggatgacatcccaaagctccaggcttttgctgctgaaaccagagtgtgtacaagaactcgagttagaactcgaggggcctctgttggaggcagatcctaaaccgcttccaatgcctagcaacagcgaggataagaaggatccagagagtttggttaggtacagcaggctgctttcatactccggggcggtcactggcgtgctgaacgagcctgctgggttgtacgagctggatggccaattgggtctgtgccttgcctaccagcaattccgagggctcagacgcgtgatgaggccaggcgtctgcctgcagctccaggatgttcacctgctgcagtcggtcggaggtggcaccagaaggccagtactggctccctgcctgagaggtgccgtgctgctgcagtcatttagccgtcaaaaacctggagcccactcaagcagacaggcatacggcgcttccctgtatgagcagctggtctgggagcggcagctgggcttgccactgtacctctgggctacaaaggccctggaggagctggcctgcaaactctgtcctcacgtgcttaggcaccaccagtttctacagcattcctcgcctggctctccctcactagggctacagctcttggcgccgaccctggatttgctggccccaccgggaagtccggtgcggaacgcccacaacgaaattctagaagagccccatcactgcccgctgcaaaaatataccagattgcaaactccaagcagtttcccgacactcgcaactcttaaggaggagggccaacgtaaagcatgggcaagcttcgatcccaaagccctcctccccctcccggaggcctcctatttaccgtcgtgccagctgaatagaaggcttgcttggtcttggctgtgcttactgccttcagccttttgtcccgcccaggttctgctcggggtattggttgccagcagtcacaaaggctgtcttcagctgagagatcagagcggttctctgccctgcctgttgcttgccaagcattctcaaccactttctgatccacgcctcattggctgtctggtcagggccgagaggtttcagctgatcgtggagcgagacgtgaggtccagctttccctcatggaaggaactctctatgcccggcttcattcagaaacaacaggcccgtgtttatgtacagtttttcctcgcagatgccctgattctccccgtgcccaggccctgcctccactccgctacacccagcacgccacagacggaccctaccggaccagaaggccctcacctgggccaatctagactgttccttctgtgtcataaagaggccctcatgaagaggaatttctgcgttcccccaggcgcctcacctgaggtgccgaaacctgccctatccttttatgtgcttgggtcctggctcgggggcacgcaaaggaaggagggcactggatggggcttgccggaaccacagggcaacgacgataacgaccagaaggtgcacctgattttcttcggaagttctgtgcggtggtttgagtttctgcacccaggacaggtttaccggctcattgcaccaggaccagcaacccctatgctgtttgaaaaagacggatctagctgtatatcccggaggcccctggagttagccggatgcgcaagctgccttactgtgcaggacaactggactctggagctggagtccagccaagatatccaggacgtgttggatgctaataagtcacttccagagtcctctctgacagacttactcagtgataatttcaccgattcccttgtctccttcagcgccgaaattctaagtcgtacgttgtgcgaacccctggtcgcaagtctgtggatgaaattggggaatacgggggctatgagaaggtgcgtgaagttgaccgtcgcacttgaaacagctgaatgcgaattcccgccacacttagatgtttacatcgaggacccacacctgccaccaagcctgggattgctgcctggagccagggttcattttagccaactcgagaagcgggtttccagatcccacaacgtgtactgctgttttaggagcagcacatacgtccaggtactctccttcccacccgagacgaccatctcgatccctctgcctcacatctatttggctgaattgcttcagggcggccagagcccctttcaagctacagcctcctgccatatcgttagcgtcttcagtctgcagctgttttgggtgtgcgcgtattgtaccagcatttgtcgccaggcacctgggggcggttgggactgccgttctaggggcgatttgtag

SEQ ID NO: 184050 - DNA, 843 bp, Artificial Sequence
  Description of Artificial Sequence: Synthetic coding sequence
atgcaggccaagtacagcagcacccgggacatgctggacgacgacggagatacgactatgtctttacatagtcagggcagcgccacaacacgccaccccgagccccggcgcactgagcaccgggcgccctcctcaacttggaggcccgtggccctgactctcctgacattgtgcctcgtgctgttgatcggactcgctgccctcgggctcttatttttccaatactatcagctgtccaacaccggacaggacactataagccagatggaggaacgcctgggaaacacctcccaagagcttcaaagcctccaagtacagaatattaagctggccggatctctgcagcatgtagcggagaagctttgccgggaactgtataacaaagctggtgcacaccgttgctccccttgcacagaacagtggaaatggcatggagacaattgctaccagttttataaggactctaaaagttgggaggattgcaagtatttttgcctctctgagaatagtactatgctgaagattaataagcaggaagatctggagttcgcagccagccaaagctattccgagttcttttacagctattggaccggtctacttagaccagactccgggaaggcctggttatggatggatggtactccttttaccagtgagctgttccacatcattatcgacgtgacaagtcctagatcgcgcgactgtgtggccatcctgaacgggatgatatttagtaaagattgcaaggagttgaaacgctgtgtgtgcgaaaggcgagctgggatggtgaagccagagtcattgcatgtgccaccggaaactcttggcgaaggcgactag

SEQ ID NO: 184051 - DNA, 213 bp, Artificial Sequence
  Description of Artificial Sequence: Synthetic coding sequence
atgcaggccaagtacagcagcacccgggacatgctggacgacgacggtgacaccaccatgtctctacatagccagggctctgccactactaggcatccggaaccaaggcggacagagcatcgcgcgccctccagtacctggaggccagtagccctcacgctcctgaccttgtgcctcgtgctccttattggcttagcggccctcggactctag

SEQ ID NO: 184052 - DNA, 879 bp, Artificial Sequence
  Description of Artificial Sequence: Synthetic coding sequence
atgacccggacctacgagaacttccagtacctggagaacaaggtgaaggtccagggattcaagaatggtcccttgcctctgcaatcgctcctacagagactctgcagcgggccctgccacctactgttaagtctggggctgggtctgctcctattagttattatctgtgtcgtgggctttcagaactctaagtttcagcgtgatctggtcactcttcgcactgacttctctaattttacatctaacactgtcgctgagatacaagcgctgactagtcaggggtcttctttggaggagacaattgcctctctcaaagcagaagttgaggggttcaagcaggaaagacaagcggtccactccgagatgctcctgcgggtgcaacagctcgttcaggacctgaaaaaactgacgtgccaggttgctactctcaataacaatggtgaagaggcgagcaccgaaggaacctgctgtcctgttaactgggttgagcaccaggatagctgttattggttctcacactcaggcatgtcctgggccgaggccgagaagtattgccagctgaaaaatgcgcatctcgtggttatcaattcccgcgaagagcagaatttcgttcagaagtacctcggttctgcatacacctggatggggctctccgatcctgagggagcttggaaatgggttgatggaacggattacgctacaggatttcaaaattggaagcccggccagcctgatgattggcaggggcacggcttgggaggcggagaggactgcgcgcacttccacccggacggcaggtggaatgacgatgtgtgtcagaggccctaccactgggtgtgcgaagccggcctgggacagacaagccaagaaagccactag

SEQ ID NO: 184053 - DNA, 951 bp, Artificial Sequence
  Description of Artificial Sequence: Synthetic coding sequence
atgacccggacctacgagaacttccagtacctggagaacaaggtgaaagtgcagggatttaagaacggccccctaccgctgcagtccttgctgcagcggctctgctctgggccgtgtcatctccttttgtctcttgggctgggactccttctgctggttatcatttgcgtggtcgggttccagaactctaagttccagcgggacctggtgactctgaggacggacttcagtaacttcacctccaataccgtggccgagattcaagccctgacctctcagggttcatccctggaagagactattgcttcgctcaaagcagaagttgaagggtttaagcaggaaaggcaggctggcgtttctgagcttcaggagcacactacccagaaagcacacctcggccactgtccccactgcccatcagtttgcgtgcccgtccactcggaaatgctgctgagagtccagcagctcgtgcaggacctgaagaagttgacgtgtcaggtcgctacgctcaacaacaatgcatcgaccgaggggacatgttgtcccgttaactgggtagaacaccaagactcgtgctattggttctcccacagcgggatgtcctgggccgaggcagagaagtactgccaactcaagaacgcccacttggtcgtgattaattcccgggaggagcaaaattttgtccagaagtatttaggttccgcttacacatggatgggcctgagtgaccctgagggagcatggaagtgggtggacggtacagattacgccacagggtttcagaactggaagccaggtcaacctgacgactggcagggccacgggctcggcgggggcgaggattgcgcgcatttccaccctgacggtagatggaacgacgatgtttgccaacgcccctaccactgggtgtgtgaggctgggctggggcagactagccaggagtctcattag

SEQ ID NO: 184054 - DNA, 879 bp, Artificial Sequence
  Description of Artificial Sequence: Synthetic coding sequence
atgacccggacctacgagaacttccagtacctggagaacaaggtgaaagtacagggctttaaaaacgggcccctgcccctgcagagcctactgcagaggctatgctccgggccctgccatctgcttttgagcctgggactaggcttactattgcttgtgattatctgcgtggttggcttccagaattcaaaattccagcgcgacctggttactttgagaaccgatttctcaaactttacctctaacactgtcgccgagatccaggctcttacatcccaaggctcctccctagaagagactatcgcgtcactcaaagcagaagtcgagggattcaagcaggaacggcaagcagttcactcagaaatgcttttaagggtgcagcagctggtgcaggatcttaaaaagctaacttgtcaggtcgccaccttaaacaataatggcgaagaggcttccacagaaggtacctgttgccccgtaaactgggtggagcaccaagacagctgttattggttctcacatagcggtatgtcctgggctgaggccgagaagtattgtcagctaaagaatgcgcacctggtggtgatcaacagccgggaagagcaaaacttcgtgcagaagtatctcggatccgcatacacctggatgggcttatccgacccagagggagcctggaagtgggtagacggcacagactatgccactgggtttcagaattggaagcccggtcagccagatgattggcagggacacggtctgggcggaggcgaggattgcgcccatttccatcctgacggtcgctggaacgatgacgtctgtcagaggccgtatcactgggtttgcgaggcgggattgggccagacttcccaggaaagtcactag

SEQ ID NO: 184055 - DNA, 798 bp, Artificial Sequence
  Description of Artificial Sequence: Synthetic coding sequence
atgagcgaggaggtgacctacgccgacctgcagttccagaacagctctgagatggagaagatccctgagatcgggaagtttggtgagaaagctccacccgcaccgtctcatgtatggcggccagccgcccttttcctgaccttattatgccttctgcttcttatcggtctgggcgtgcttgcgagtatgtttcatgtgacattgaagattgagatgaagaaaatgaataagctgcaaaacatctctgaggagttacagcgtaacatatcattgcaattgatgtccaatatgaacatctcaaacaagattcgtaatttatctactacattgcaaacaatcgccaccaaattgtgtcgggagctatattcaaaggagcaggagcacaaatgtaagccttgcccccggcgctggatatggcacaaggactcctgctatttcctgtccgacgacgtacagacttggcaggaaagcaaaatggcatgcgcagcgcagaacgcgtccctgttgaaaataaacaacaaaaacgcattggaattcatcaagtcacagtccaggagctacgattattggctgggcctttcgcctgaagaggacagcaccagaggcatgagggtggacaacatcatcaacagctcggcatgggtcatcagaaacgctcctgatcttaataacatgtactgtggctacatcaacagactctatgtgcagtactaccactgcacgtataagaaacggatgatatgtgaaaaaatggcaaaccctgtgcaactgggcagcacttattttcgggaggcctag

SEQ ID NO: 184056 - DNA, 699 bp, Artificial Sequence
  Description of Artificial Sequence: Synthetic coding sequence
atgagcgaggaggtgacctacgccgacctgcagttccagaacagctctgagatggaaaagattccagaaattgggaagttcggagaaaaagtacacgttaccctgaagatcgagatgaaaaaaatgaacaaactgcagaatatttctgaagagctacagcggaatatctccctgcagctcatgtctaacatgaatatctctaacaagattcgaaacctgtctactactctacagacaatagcgacaaagctttgtcgagagctgtactcaaaagagcaggaacataaatgtaaaccatgccccaggcggtggatctggcataaggattcgtgctactttctgagtgacgacgtgcagacttggcaggagagtaaaatggcctgcgccgcccagaatgcttctctccttaaaattaacaataaaaacgcattggaattcataaaatcccaatcacggtcctacgactattggcttggactgtcgccggaagaggatagcactaggggaatgagggtagacaacataatcaactcctcagcctgggtcattaggaacgccccagatctcaacaacatgtactgtggatacatcaatcggttgtacgtgcagtactatcactgcacctacaagaaacgcatgatttgtgaaaaaatggctaacccggttcagctaggcagtacctatttccgcgaggcttag

SEQ ID NO: 184057 - DNA, 828 bp, Artificial Sequence
  Description of Artificial Sequence: Synthetic coding sequence
atgtggatcgacttcttcacctacagcagcatgagcgaggaggtgacttatgctgacctacagttccagaatagcagtgagatggagaagattccagaaattgggaagttcggggaaaaagccccccccgctccctctcacgtttggcgccctgcagctctgttcctgaccctgctctgcttgctgctgctgatagggcttggcgtgctggcctctatgtttcacgtcacacttaaaattgagatgaagaagatgaacaaacttcaaaatatcagtgaggagctgcaacgtaacatttctctgcagctcatgagcaacatgaacatcagtaacaaaatcagaaacctgtcaacaaccctacagaccatagccaccaagctctgcagagagctttattctaaagaacaggagcataaatgtaagccctgtcctagacgctggatatggcacaaagattcgtgttacttcctgtctgatgatgtccagacctggcaggagtcgaagatggcgtgcgctgctcagaatgccagtctgcttaaaatcaacaacaaaaacgccctggagttcatcaaaagccagagccggagttatgactactggctcggcctgagtccagaagaagatagcacaagaggtatgcgtgtggacaacataatcaattcctctgcctgggtcatacgcaatgccccagatctgaataacatgtactgtgggtatatcaaccgactttacgttcagtactatcactgtacttataagaagcgcatgatctgtgagaagatggcaaacccggtacagctggggagtacttactttcgcgaagcctag

SEQ ID NO: 184058 - DNA, 264 bp, Artificial Sequence
  Description of Artificial Sequence: Synthetic coding sequence
cacaagtgcaagccctgcccccggcggtggatctggcacaaggacagctgttatttcctgagcgatgatgttcagacatggcaggaaagtaagatggcatgcgcagctcagaacgccagtctgctgaaaatcaataacaagaatatatttagcgttattaagaagaagaccgaaaagtttttctggctggggttaagttgggacagctcaggaaggtcttggttttgggaagacgggtcagtaccctctccaagtctgtattag

SEQ ID NO: 184059 - DNA, 498 bp, Artificial Sequence
  Description of Artificial Sequence: Synthetic coding sequence
atgagcgaggaggtgacctacgccgacctgcagttccagaacagctcagagatggagaaaattccagaaatcggtaagttcggcgagaaggctccccccgctcccagccacgtctggagacccgctgccctcttcctgaccctgttatgtctcctgctgctgatcggacttggagttcttgcttccatgttccatgtgaccctcaaaatagaaatgaaaaagatgaataagcttcagaatatctccgaggagctccaacgcaacatctccttgcagcttatgtctaatatgaacatctcaaacaagattcggaacctcagcaccaccttgcagacaattgctaccaagttatgccgggagttatattccaaggaacaggaacataagtgcaagccctgtcctcggagatggatttggcataaggattcctgctatttcctgtcagacgacgtccagacgtggcaggagagtaagatggcctgcgcagcccagaattag

SEQ ID NO: 184060 - DNA, 642 bp, Artificial Sequence
  Description of Artificial Sequence: Synthetic coding sequence
atgagcgaggaggtgacctacgccgacctgcagttccagaacagcagtgaaatggaaaagatccccgagatcggaaaattcggggagaaagcccctccagctcccagccacgtgtggaggcccgctgctctgttcctgaccctgttgtgcctcttgctgctcattggcctcggtgtgctcgcctctatgtttcatgtcaccctcaagattgaaatgaagaagatgaacaaactgcagaatatctccgaggagttgcaacgtaacatatctctgcaacttatgagcaacatgaatatcagtaacaagatccgtaatctgtcgaccaccctgcagaccatagccacaaagctttgcagggagctttattctaaagaacaggaacacaagtgtaaaccatgtcctaggcgctggatctggcataaggattcttgttatttcctcagcgacgatgtgcaaacctggcaggaaagcaagatggcctgtgcagcacaaaatgcatccctgctgaaaataaacaacaagaatgccctggagtttatcaagtctcaaagtcgaagttatgattactggctcggtctctcccccgaagaagactcgacaagaggcatgcgggtggataatataatcaatagctccgcatag

SEQ ID NO: 184061 - DNA, 423 bp, Artificial Sequence
  Description of Artificial Sequence: Synthetic coding sequence
atggccgccaccggcttcagcgcccccaacggcagctgccacggcacatccaggacagtgaatagcgatgcccctatgtcccccgagctccccaaaccccacctgcccgaccaattggtgattgtcaacgaaactgaggccgactcaaaaccaagcaaaaacgtagcaaggagcgctgccgtcgaaactgcttcccttagcccctccctcgtccctgccaggcaaccgacgattagcttactctgtgaggatactgcagataccctgagcgttgagtctcttactctagtgccacccgtggatccccacagtctccgatcactcaccgggatgccacctctgagtacaccagctgcagcatgcactgaacctgttggtgaggaagctgcctgcgctgagccagtggggaccgctgaggactag

SEQ ID NO: 184062 - DNA, 2721 bp, Artificial Sequence
  Description of Artificial Sequence: Synthetic coding sequence
atgttcggccggagccggagctgggtgggcggcggccacggcaagacaagtcgaaatatccacagcctcgaccacttgaagtacctataccacgtactcacaaaaaatacgactgttacggagcagaatcgcaacctgctcgtcgaaactatccgtagtattacagagatcctgatatggggtgaccaaaatgactcttcagtgtttgacttctttctcgagaagaacatgtttgttttcttcttgaacatcctgcgtcagaaatcaggcaggtatgtatgcgtgcagctgttgcagaccctgaacatcctgtttgagaacatctcccacgagaccagcctttactatctgctatccaacaattacgtgaattcaataatcgtccacaagtttgacttctcagatgaggagatcatggcctactatattagctttctgaagaccttgagtctcaagctgaataatcacaccgtgcatttcttttataacgagcacacaaatgacttcgccctctacacagaggcaattaaatttttcaatcatccagagagcatggtgcgcattgccgttagaacaataacactcaacgtatataaagtggacaatcaggccatgctccactacattagggataaaactgccgtgccttacttcagcaatttggtgtggtttatcggcagccacgttatcgaactggacgactgcgtccagaccgatgaagagcaccggaaccgaggtaagctgtccgatcttgttgccgagcatctagatcacctgcactatctcaacgacattctgatcatcaactgtgagttccttaacgacgtgctaacagaccacctactgaacaggctctttctaccactctacgtatactctttggagaaccaggataagggtggtgagagacctaaaatttctctccctgtttcactatacctgctgtctcaggtctttctcataattcaccatgcacctttggtcaacagcttagcggaggtgatattgaacggcgacctatccgagatgtatgctaagactgagcaagatatccagcggagttctgcaaaaccttccatcagatgtttcatcaagccgactgagaccttggagaggagcctggagatgaataagcataaggggaagcggcgcgtgcagaaaagaccaaactacaagaatgtgggcgaggaagaggacgaagagaaggggccgaccgaggatgcccaggaagatgccgaaaaggctaaagaaattgagatggtgatcatggaaagatctaaactgtctgagctggctgcctctacctccgtacaggaacagaataccaccgatgaggaaaaaagcgctgccgcgacctgcagtgagagcacccaatggtcacgacctttcctcgatatggtctaccacgcactagacagccccgacgacgattaccacgctctgtttgttctatgcctgctgtacgctatgtcacacaacaagggcatggaccctgagaagctggagcgaatccagctccctgttccgaacgccgcagagaagacaacgtacaatcacccactagcagagagacttattaggatcatgaacaacgctgcccagccagacggaaagatacgtctggctacacttgagctgagctgtctcctgctcaagcagcaggtgctgatgagcgccggctgcataatgaaagacgtgcacctcgcttgtctggagggggccagggaagagagcgttcacctcgtcaggcacttttacaaaggggaagacatctttctggatatgttcgaggatgaatataggagcatgaccatgaagccgatgaatgtggaatatttaatgatggacgcctccattctgctcccgcctacaggcacacccctgactggaatagactttgtcaagcgacttccatgcggggatgtcgagaaaactcggagggctatccgcgtattttttatgctacggagtctgagcctccagttaaggggagagcccgagactcagctgcctttgactagagaggaggatcttatcaagacagacgacgtgctcgacctgaataatagtgacctgatcgcctgtacagtgatcaccaaagacgggggaatggtgcagcgtttcctggccgttgatatttaccagatgtccctggtcgagcctgatgtgtcccgactcggctggggagtcgtgaagtttgcaggtttattacaggatatgcaggtgactggagtggaggacgattccagagccctgaacatcacaattcacaagcctgcctcatcaccacattctaagcccttcccaatccttcaggcaactttcatattctccgatcacatccgctgtatcattgccaaacagcgcctggccaaagggaggatacaggcacggcgaatgaaaatgcagcggattgccgccctcctcgacctgcccattcagccaaccactgaagttctcggttttgggctgggcagcagtacctcaactcagcatctcccttttcgcttctacgaccagggcagacgcggatcctctgatccgactgtgcagcggagtgtgtttgccagtgtggataaagttcctggtgagcctgctccaaggcccgcccctcagctggtccaccatgggggacgttcacggagtttctccctgtggtcattgtgtgagctgcccttcctatcccagaaaccacgcaggctagccgcacctgcttcttag

SEQ ID NO: 184063 - DNA, 3162 bp, Artificial Sequence
  Description of Artificial Sequence: Synthetic coding sequence
atgttcggccggagccggagctgggtgggcggcggccacggcaagacctctagaaacatacactcactggatcacttaaaatacctgtatcacgttctcacgaagaacactactgtcaccgagcagaacaggaacctgctggtcgaaaccatccggtcaataactgaaatcctgatctggggtgatcagaacgactcatccgtgtttgacttcttcctggagaagaatatgtttgtttttttccttaatattttgaggcaaaaaagcgggcgatatgtgtgtgtgcagctgctgcaaactctgaacattctatttgagaacatttctcatgagacatctctgtattatctgctgtcaaacaactacgtgaattccatcattgtacataaattcgatttctctgacgaggaaatcatggcttactacataagcttcctcaaaactctgtccctgaagctgaataaccatacggtccattttttctataacgagcacaccaatgattttgctctttatactgaggccatcaaatttttcaaccaccccgagtccatggtgaggattgccgtgcgaaccattactctgaacgtttacaaggtctccctggataaccaggcaatgctgcattacattagagataagaccgctgttccttacttcagcaatcttgtgtggtttataggatcccatgtaatcgaactcgacgactgcgtccagacagacgaggagcatcgcaatcgcggaaagctgagtgacctggtagctgaacatctcgatcatcttcactaccttaacgatatcctgatcattaactgcgaattcctgaacgacgttctgactgaccacctgttaaatcgcctgtttctacctctttacgtgtactcacttgaaaatcaagacaaggggggggaacggcccaagatcagcctccccgtctcgctttatctacttagccaggtctttttaataatccaccatgcccccttggtgaattcacttgcagaggtcatcctgaacggcgatttgtctgagatgtacgcgaagaccgaacaggacatacagcgatcatccgccaaacccagcattcgttgcttcataaagcccactgaaaccttggagaggtcattggagatgaataagcacaagggtaagagacgggtgcagaagcggcctaattataagaacgtcggggaagaagaggacgaggaaaaaggccccaccgaggacgcccaggaggacgctgagaaagcaaagggcaccgagggcggttcaaagggcatcaaaactagtggcgagagcgaggagatagaaatggtaataatggaaagatccaagctttccgaattggctgctagcacatctgtgcaggaacaaaatactaccgacgaagaaaagtccgctgccgcaacttgttccgagtccactcagtggtcccggccctttctggatatggtgtatcacgcgctggactctccagacgacgattatcacgccctctttgtcttatgcctactctacgcaatgtcacacaacaagggcatggatccagaaaagttggaacggatacaactccctgtccctaatgctgctgagaaaactacctacaatcatcccctcgctgagaggttgattagaatcatgaataacgccgctcagccagacggcaaaatcagattggccactcttgagttatcatgtctgttgttaaagcagcaggttttaatgagcgccgggtgcattatgaaggacgtacacctggcttgtcttgaaggggcgcgggaagagagcgtgcatctggtcaggcatttctacaaaggcgaggacatttttttggatatgttcgaagacgaataccgtagcatgaccatgaaaccaatgaacgtggaatacctgatgatggatgcatccattcttttgccaccaacaggaacgcctcttactggcattgacttcgtcaagagattgccttgtggagatgtcgagaagacccgtagagccatcagagtgttcttcatgctcagatccctatctctacaactcagaggggaacctgagacgcaactacctctcactagggaggaagacctgatcaaaactgacgacgtgctggatttgaacaattccgatcttatcgcctgcacggtgattacaaaagacggcgggatggtacagcggtttttggctgtagacatctaccaaatgtcgctggttgaacctgacgtaagtcgcctcggttggggcgttgttaagtttgctggtctcttgcaagacatgcaggtcacgggcgtggaggacgatagtagagcgctgaacatcaccattcataagccagcatcttcgcctcacagcaagccgttccctatccttcaggcaacttttattttttcagaccacattcggtgcatcattgccaaacaaaggctagccaaaggcaggattcaggctaggagaatgaaaatgcagcggattgccgctctgctagatctgccaatacagcccacaacagaggtgctcggatttggactcggatcgtctacctccactcagcacctaccgtttagattttatgaccaaggcagacggggtagctctgatcccactgtccagagatccgtatttgcctctgttgacaaggtgcctggattcgccgttgcccaatgtatcaaccagcactccagcccctcactcagctctcagtccccaccttccgcctcaggtagtccgagcgggagtgggtccacatcccactgcgactccggaggaaccagtagctctagtaccccttccactgcccagtcccctgccgacgcacccatgtcaccagagctacccaagccccacctgccagatcagctggtgatcgtaaacgaaacagaagctgatagcaagccatccaagaatgtcgcgcgcagcgctgcagtggagacagcgtcactatctccttcgctggtgcccgcgaggcagcccaccattagtttattgtgcgaggacactgcagatactctctctgtagaatctctaactctggtgccgcccgtcgacccccacagtctccgtagtctgaccggcatgccgccattatccactcctgctgcagcatgcactgaacctgtgggtgaagaagctgcttgtgctgagccagtcggcacagccgaggactag

SEQ ID NO: 184064 - DNA, 3162 bp, Artificial Sequence
  Description of Artificial Sequence: Synthetic coding sequence
atgttcggccggagccggagctgggtgggcggcggccacggcaagacctcaaggaatattcactccctggaccacctgaagtacctgtatcatgtactgactaagaacacaacagtgacagagcagaaccggaaccttctggtagagaccatcagatccattacagagatcctgatctggggtgaccagaatgactcttccgtgttcgattttttcctcgaaaagaacatgttcgtgttcttcctgaatatcctacgtcaaaagagcggcagatatgtgtgtgtccagctcctccaaaccttaaacatcctgttcgagaatatcagccatgagacaagtctctactatcttctttctaacaattatgtgaatagcattattgtccacaagttcgacttttctgacgaggaaatcatggcctactatataagtttccttaagactctgagtctgaaacttaataaccacactgtgcactttttctataatgagcatactaacgacttcgccctatacaccgaagccattaagttcttcaatcacccggagagtatggtgcggatcgcggttcgtacaataaccctcaatgtctacaaagtgtctgtggacaatcaggccatgcttcactatatccgggataaaacagccgttccatatttttcgaacctggtgtggttcattgggagccatgtcattgagcttgacgattgcgtgcaaaccgatgaggaacatagaaacagaggaaagctctccgaccttgtggcagagcacctcgaccacctacattatttgaacgacattttgattataaactgtgaatttctgaacgacgtgctcacggaccacttactgaacagacttttcctgcctctgtacgtttatagtcttgagaatcaggacaagggcggagagagacccaagattagcctacctgttagtctgtacctactttcccaggtgttcctaattatacaccatgcaccccttgtgaattctcttgctgaggtcatccttaacggcgacctatctgagatgtacgcaaagacagaacaggacatccagcggtcgagcgcaaagccttctatacgttgcttcataaagccaaccgagacgcttgaaagatctcttgaaatgaataagcataaaggcaagcggagggtacagaagaggcctaactacaagaacgtaggagaggaagaggatgaggagaaaggtccaacagaggatgcacaggaagatgcagagaaagccaagggtaccgaaggtgggtctaagggcattaagacttccggagagtccgaggagatcgagatggttatcatggaacggagcaaactttccgaactggccgcttccacatcggtgcaagagcagaatacaactgacgaggagaaaagtgccgctgccacttgctccgaaagcactcagtggtcccggcctttcctggatatggtgtaccatgctctggattcaccagacgacgactaccacgccctattcgtcctttgcttgttgtatgccatgtcccacaataaagggatggatcctgaaaagctggaacgaattcagctgcctgttcctaacgcagccgaaaaaaccacctataatcaccctcttgccgaacggcttattcgcatcatgaataatgccgcccaaccagacggtaaaatcaggcttgccacactggagttgagttgcctcctccttaaacagcaagtcctgatgtctgcaggatgcatcatgaaagacgtccacttggcgtgcctggagggagcccgagaggaatccgtgcatcttgtacgacatttctataagggcgaagacatttttctagacatgttcgaggatgagtacagatctatgaccatgaaaccaatgaacgtggagtatctgatgatggacgctagtattctcctgcctcctactggtacccctctgactgggattgacttcgtaaagcgcttaccttgcggtgatgtagaaaagacaaggcgggctataagagttttcttcatgttgcgttcactatctctgcagctgagaggtgagcctgagacccagctacctctgaccagggaagaggatctcataaagacagacgatgtgctcgatctcaacaattccgatctcattgcatgtacagttattacaaaagacggcggaatggtgcagcgattcctggctgtggacatctatcagatgtccctcgtagaacccgatgtgtccagactgggctggggcgttgtaaagtttgccggcctcttgcaggacatgcaggtcacaggagttgaggacgactcgagggccctgaatattacaatccacaagccggcctcgtctccccattcaaaaccattccctattctgcaggccacattcatcttttccgatcacatcagatgcatcattgccaaacaacggctggcaaaagggcgcattcaggctcggcggatgaaaatgcagaggatcgcggcattgttggaccttcccattcaacctacaacagaagtgttaggctttggacttggctctagtacctcgacacagcatctgccctttcgcttctatgatcaagggcgtcggggtagcagtgatcctacagtgcagcgctccgtgttcgcatccgtggataaggtacccgggtttgccgtcgcccagtgcatcaaccaacactcctctccatctctgtctagccagtccccaccaagcgccagcggctcgcctagcggttctggcagcacatcccattgtgatagcggtggcacctccagctcgagtacccccagcaccgctcaatcacccgccgacgctccaatgagtcccgaactgcccaaacctcaccttccagaccagctggtgatcgttaacgagacagaggcagactctaaaccctctaaaaacgtggcccgcagtgccgcggtggaaacagccagcttgtcaccatctctggtgcccgccaggcagcctaccatttctcttctgtgtgaagacaccgccgacacactgtcggtggagagccttacgctcgtccctccagtggatccgcactctcttcggtccctcactgggatgcccccactcagcacacctgccgcagcttgtaccgaacctgtgggtgaggaggctgcctgtgctgaaccagtcggcacggccgaggattag

SEQ ID NO: 184065 - DNA, 288 bp, Artificial Sequence
  Description of Artificial Sequence: Synthetic coding sequence
atgcacgacagcaacaacgtggagaaggacatcacccccagcgagttaccagccaatcccgctattcgagcaaactgtcaccaggaacctagcgtatgcttgcaggccgcgtgccctgagagctggatcggcttccagcgaaagtgcttctacttctccgacgatacaaagaattggacttccagccaaaggttctgcgacagtcaggacgcagacctggcccaggttgagtcctttcaggagttagtatcataccctggtagcagacgggtgtgcctctttgaatag

SEQ ID NO: 184066 - DNA, 525 bp, Artificial Sequence
  Description of Artificial Sequence: Synthetic coding sequence
atgatcaaccccgagctgcgggacggccgggccgacggcttcatccaccgcatcgtgccaaaactaattcagaactggaagataggccttatgtgcttcctcagcatcatcatcacaacagtctgcataatcatgatcgcaacatggagtaagcacgctaagcccgtggcctgctctggagactggctcggagtacgggataagtgtttttatttctctgacgatacccgcaattggacagcctctaaaattttttgctctcttcaaaaagccgagctggcccagattgatacacaagaggatatggaattcctgaagagatacgctgggacagatatgcattggattggactgtccaggaagcagggggattcctggaagtggactaacggaacaacttttaacggctggttcgagatcatcggtaacgggtccttcgcctttctgagtgcagacggcgttcatagctcacgcggctttatcgacataaagtggatttgctcaaaacctaaatacttcctttag

SEQ ID NO: 184067 - DNA, 2406 bp, Artificial Sequence
  Description of Artificial Sequence: Synthetic coding sequence
atgcaccaccggatgaacgagatgaacctgagccccgtgggcatggaacagttaacttcatcatcagtgagcaatgccctccccgtttctggcagtcacttgggtctggctgccagccctacacactccgccatcccagcccccggactgccggttgcaatacctaacctaggccctagcctgtcctccctgccatcagccctttctctaatgcttcctatgggaattggcgacagaggggtgatgtgtggcctgccagaacgaaactatacgctacctccccccccttatccccatttggaatcctcatacttccgtacaattctccccgggattctgagttacctcgctgatagacccccgccacagtatatacacccaaactccatcaacgtggacggcaacacagcccttagcattactaataacccttccgcccttgacccttaccagagtaacgggaacgtggggctggagccgggaatcgtatccatcgattcccggagcgtcaatactcacggcgcacagtcactccatcctagcgatggtcacgaggttgccttggatacagcaatcacgatggaaaatgtatctcgtgttacgtcaccaattagcactgacggcatggctgaggaactcacaatggatggagtggcgggggagcactcacagataccaaacggatcgagaagccatgagcccctctcggtggatagcgtcagcaacaatttggccgccgatgccgtgggacatggcggggtgatacccatgcacggcaatggcctggaactaccagttgtcatggaaacggatcatatcgcctctcgcgtgaatgggatgtcagactcggcactgagtgatagcatccacacggtagcaatgtcgaccaatagtgtgtcagtcgctctgtcaacttctcataaccttgcaagtctcgaatccgtcagtctgcacgaggtgggactcagtcttgaaccagtcgctgtctcatccataacgcaagaggtggcaatgggaaccggacatgtcgacgtctcttcggactcactgtcctttgttagtccatccttacagatggaggacagtaactcaaataaggagaatatggccactctgttcaccatttggtgtaccctgtgcgaccgtgcttatcccagcgattgtccagagcacgggcctgttacattcgtgcctgatacccccatcgaatccagagccaggttgtccctcccgaagcaactcgttctgagacagtcaattgtgggcgccgaagtgggtgtttggaccggtgagactatccccgtacgtacctgctttggccccttgatcggtcaacagtctcattctatggaagttgccgaatggacagataaagctgtcaaccacatttggaagatctatcataatggagtcctggaattttgcattatcaccactgatgaaaacgagtgtaactggatgatgtttgttcgaaaggctcgtaaccgagaggagcagaacctcgtggcatatcctcatgatggaaagatcttcttttgcacaagccaggatatccctccagaaaacgaacttttattttattactctagggattatgcccagcagattggcgtacccgagcacccggacgtccacttgtgtaattgtgggaaggagtgtaatagttacacggagtttaaggcccacctgaccagtcacatccacaatcatttaccgactcagggccactccggaagtcacggaccaagtcatagcaaggaaaggaagtggaaatgcagcatgtgcccccaggcctttatctccccttctaaacttcacgtgcactttatgggccacatgggaatgaagcctcacaaatgcgatttttgctccaaggcttttagcgatccatccaacctccggactcatctcaaaattcacactgggcagaaaaattatcgctgcactttgtgtgacaagtcttttacgcagaaagcgcacctggagtcccacatggtcatccacaccggcgagaagaacttaaaatgtgattactgcgacaagctgttcatgcggcggcaagatcttaagcagcatgtgttgatacacacccaggagcgtcagattaaatgcccaaagtgtgataaactattcttgcgcactaaccatcttaaaaaacatctgaactctcatgagggaaaaagggattatgtttgcgagaaatgtacaaaggcatacctcacaaaatatcacctgactaggcacctcaagacttgtaagggcccaacttccagctcatcagctccagaggaagaggaggaggacgatagtgaggaggaggacctggcggactcggtgggtacagaggactgtaggatcaattccgcggtgtactccgcagacgaaagtctgtccgctcacaagtag

SEQ ID NO: 184068 - DNA, 465 bp, Artificial Sequence
  Description of Artificial Sequence: Synthetic coding sequence
atgcacgacagcaacaacgtggagaaggacatcacccccagcgagcttcccgcaaatccagccattcgagctaattgccatcaggagcccagcgtttgtctgcaggctgcgtgtccggaaagctggatcggatttcaacgtaagtgtttctacttttccgatgatacaaaaaactggacctcctcccagaggttctgcgactcacaagatgctgacctggctcaagtggaatccttccaggagctgaactttcttctccgatataagggaccaagcgatcactggatcggcttgagtagggaacagggacagccttggaaatggataaatggaactgagtggactcgccagtttcccatcctgggtgctggagagtgtgcgtacctcaatgataaaggcgcttcaagcgcaaggcactatacggaacggaagtggatctgttccaaatctgatatacatgtgtag

SEQ ID NO: 184069 - DNA, 585 bp, Artificial Sequence
  Description of Artificial Sequence: Synthetic coding sequence
atgcacgacagcaacaacgtggagaaggacatcacccccagcgagctaccggctaatccaggctgccttcatagcaaggagcattctatcaaggccacccttatctggaggttgttctttttaattatgtttctgaccataatcgtgtgcggtatggtggccgctctgtctgctattagggcgaactgccatcaggaacctagcgtctgcctgcaggctgcttgtccggagtcctggatcggctttcaaaggaagtgtttttacttcagtgacgacaccaaaaactggacgtcaagccagcggttttgtgacagccaagatgctgacttggcacaggtggaatccttccaggagctgaactttctcctccgctataaaggtccctctgaccactggattggcttgtcacgggagcagggacagccatggaagtggattaacggcacagaatggacacgccaactagtcatgaaagaggatggcgcaaacttatatgtcgctaaagtctcccaagttcccagaatgaatcctagaccagtcatggtgagttatccaggcagcagacgcgtgtgtttgttcgagtag

SEQ ID NO: 184070 - DNA, 576 bp, Artificial Sequence
  Description of Artificial Sequence: Synthetic coding sequence
atgcacgacagcaacaacgtggagaaggacatcacccccagcgagctgccagccaaccccggatgcctgcattcgaaagagcattccatcaaggctaccttgatttggcgactgtttttcctgattatgtttctgacaataatagtgtgtggaatggtggctgccttgtcagccatcagggcgaattgtcatcaagaacccagtgtgtgtctgcaggccgcttgtccagaatcgtggatcggattccagcgcaaatgcttctacttctccgacgatacaaaaaactggacaagttcccagcggttttgcgattcgcaggatgctgacctggcgcaggtcgagagctttcaggaattgaattttctactgcgttataaagggccttcagaccattggatcggcctgagtagggagcaaggtcagccctggaaatggatcaacggaacagagtggacgcgtcagttccccattttaggcgcaggtgagtgtgcatatttaaacgataagggggctagttccgcccggcactacactgagcgcaagtggatctgtagcaaatccgatatccacgtttag

SEQ ID NO: 184071 - DNA, 399 bp, Artificial Sequence
  Description of Artificial Sequence: Synthetic coding sequence
atgcacgacagcaacaacgtggagaaggacatcacccccagcgagcttcccgcaaatccaggctgcctccactctaaggagcactccatcaaagctactttgatctggaggctgttttttcttatcatgtttcttaccattatagtttgtggcatggtcgcggctctgtctgcaatccgggccaattgtcaccaggagccttcggtgtgtctccaggcggcctgccctgagagctggataggattccagcggaagtgcttctatttttcagacgataccaagaactggacttcgagtcagcggttctgcgacagccaggacgctgatcttgcccaggtggaatcatttcaagagttagtcagctatcccggctcaaggagagtttgcctgtttgaatag

SEQ ID NO: 184072 - DNA, 891 bp, Artificial Sequence
  Description of Artificial Sequence: Synthetic coding sequence
atgagcgacagcaaggagccccgggtgcagcagctgggcctgctggggtgccttggacatggcgcgctggtgctgcagctgctgtccttcatgttgctggcaggtgtgttggtggccatcctggttcaagtgagcaaagtgccttcttctctaagccaagaacagagcgaacaggacgccatctatcagaatctgacccagctgaaggccgctgtaggggagctctccgagaaaagcaagctgcaggaaatctatcaggagctcactcagcttaaggcagctgtaggcgaactgcccgagaagtcgaagttgcaagagatataccaggagctgactcgactgaaagccgcagtgggtgaactccccgagaagagcaagcttcaggaaatttatcaggaactgaccagacttaaagccgctgtcggagagctaccagagaagtcgaagcttcaggaaatctaccaggaactgactaggctaaaagccgctgtgggagagttgccagagaaatctaagctccaggaaatctatcaggagctaaccgagttgaaagccgccgttggggaactgcctgagaaatcgaagctgcaggagatttatcaagaacttacccagctgaaagcagcagtgggcgagttaccagaccagagtaagcagcagcagatttaccaggagttgaccgatctgaagaccgccttcgagaggctctgtagacattgtccaaaggactggacctttttccaggggaactgttatttcatgtccaattcccagaggaattggcacgattcagtaaccgcttgccaggaggtcagggcccagctggttgtcattaaaacggcggaggagcagttgccagccgttctggagcagtggagaacgcagcaatag

SEQ ID NO: 184073 - DNA, 2379 bp, Artificial Sequence
  Description of Artificial Sequence: Synthetic coding sequence
atggccgcccccagcctgctgaactggcggcgggtgagcagcttcaccggacctgtgcccagagccaggcacggtcaccgggcggtagccattcgggaactaatgataatttttggaggaggcaacgaagggatcgcagatgagctgcacgtgtataatacggctaccaaccagtggttcttacccgctgtgcgcggcgatatacccccggggtgcgcggcccatggttttgtctgcgacggcactcggatcctggtgtttggtggcatggtcgaatacgggagatattcaaatgaattgtacgaacttcaagcgagtagatggctttggaaaaaagtcaaaccacacccaccccccagtggcctgcctccctgcccccggctggggcattccttcagcctgtatgggaacaagtgttacctttttggaggtttggcaaacgagtcagaagatagtaataataatgtgcctcggtacttaaacgacttttacgagctcgagctgcagcacggctctggagtggttggatggagcatccctgtgaccaaaggggtagtaccaagtccccgtgagtcccacactgccgttatatattgtaaaaaggatagcggaagccccaagatgtacgtgtttggcggcatgtgtggcgctagactggacgatctgtggcaattagacctggagacaatgtcctggtctaagcctgagaccaaaggcaccgttcctcttcctagatcgctacatacagcctccgttattgggaacaaaatgtatatcttcggaggatgggttccacacaagggcgaaaatactgaaacttcaccacatgactgcgaatggagatgcacatcatcgttttcttaccttaatttggatactaccgaatggaccactctggtttccgatagtcaggaagataagaaaaattctcggccgcgccctagagccggtcactgcgcagtcgccatcggtacacgcctgtatttctggtccggcagggatggatacaaaaaagccctgaatagtcaggtgtgttgtaaagacctttggtacctcgataccgagaagcctcctgcaccctcacaggtccagctgataaaggcaaccactaattcctttcatgtcaagtgggatgaagtctccacggtggagggttatttgttacagctctctacagacctgccctaccaggccgcttcctcggacagctccgccgctcctaatatgcagggggtcaggatggaccctcaccggcaaggaagcaacaatatagtccccaatagtattaacgacactattaactcaacaaagactgagcagcctgcgaccaaggagacgtcgatgaaaaacaaacccgatttcaaggccttgactgacagtaacgctattctctacccctccctcgcatcaaatgcgtctaatcataactcacacgtggtagacatgctcagaaagaacgagggacctcatactagcgctaatgtgggcgttctttcctcctgtctcgacgtgagaacagtgatcccagaaacatcagtcagctcaaccgtctctagcacccagaccatggtcacacagcagaccattaaaactgagagctctagtaccaatggcgccgtggtgaaggacgaaacgagcttgaccaccttttctactaaatctgaagtggatgagacctacgcactgcccgccacaaagatttcacgtgtagaaactcatgccacagccacccccttcagtaaggaaactcctagcaatcctgtcgccaccgtaaaggccggcgaacgtcagtggtgcgacgtaggtatctttaagaataacacagcccttgtgtcacaattctatctgctgccaaaaggcaaacagagtatctctaaggttggcaacgcagacgtgcccgactacagtctcttgaaaaaacaagaccttgtgcccgggacagggtaccgcttcagagttgcggccattaatggttgtggtatcggccctttctcaaagatttccgagttcaagacctgcataccgggatttccaggggccccaagcgcagtcaggattagcaagaacgtcgaaggcatacacctgagctgggagccaccgacgagcccctctgggaacatactcgagtactcggcgtatctggcaattagaaccgctcagatccaggacaatccgtcccagcttgtcttcatgagaatatattgtggtctgaaaacaagctgcattgtcacggcaggacagctagcaaatgctcacattgattatacctcccgccctgccattgtcttcagaatctccgccaaaaatgaaaagggttacggaccagccactcaggtgaggtggctgcaaggcaataacaagaaagccccattgaactag

SEQ ID NO: 184074 - DNA, 498 bp, Artificial Sequence
  Description of Artificial Sequence: Synthetic coding sequence
atgaccagcgagatcacctacgccgaggtgcggttcaagaacgagtttaaaagcagcggcattaacaccgcaagcagcgcggagactgcctggtcatgctgtcccaagaactggaagtcgttctcgtctaattgttattttatcagcaccgagtccgcctcttggcaggattctgaaaaggactgcgcgaggatggaggcccacctgctggttattaatacacaggaggagcaagattttatttttcagaacctgcaggaggaatcggcctatttcgtgggactgagcgaccctgaagggcagagacactggcagtgggtcgatcaaactccctataatgagagcagtacattctggcacccccgagagccgagcgatcctaacgagcgctgcgtggtgctgaattttcggaagtcaccaaagcgctggggatggaacgatgtaaactgtctgggcccgcagcgtagtgtttgtgaaatgatgaaaatccatctctag

SEQ ID NO: 184075 - DNA, 615 bp, Artificial Sequence
  Description of Artificial Sequence: Synthetic coding sequence
atgaccagcgagatcacctacgccgaggtgcggttcaagaacgagtttaagagcagtggcatcaatactgcgagttccgccgcatctaaagaacgtaccgcccctcataaaagtaacacaggtttcccaaaactattgtgcgcctctctgcttattttttttctcttgcttgccatcagcttcttcatcgcctttgttaaaacagcgtggtcttgttgcccgaagaattggaagagtttctctagcaactgctactttatcagcaccgaatctgccagttggcaggacagtgagaaagactgcgctcgtatggaagcgcatctgctagtcattaacacacaggaagaacaggacttcatattccagaaccttcaagaggaatccgcctattttgtggggctgtctgacccagaaggacagcgtcattggcagtgggtggaccaaaccccatataatgagagttctacattctggcaccctcgagagccttcagaccccaatgagaggtgtgttgtactcaactttcgaaaatcccccaaacggtggggctggaacgatgtaaattgtttgggcccacagcggtctgtctgtgagatgatgaagattcacctatag

SEQ ID NO: 184076 - DNA, 597 bp, Artificial Sequence
  Description of Artificial Sequence: Synthetic coding sequence
atgaccagcgagatcacctacgccgaggtgcggttcaagaacgagttcaagagctcagggatcaatacagctagctccgctgtatttttccagaaatactcccagctgctggagaagaagacaacgaaagaattggtacatactactctcgagtgtgtgaagaaaaatatgcccgtcgaagagacagcatggtcatgctgccccaagaattggaagagcttctcctccaattgttacttcatttccacagaatctgcatcatggcaagactccgagaaagattgtgccaggatggaggcccacctccttgtaatcaacacacaggaagagcaggactttatatttcagaaccttcaggaagaatcagcctatttcgttggcctgtctgaccccgagggccagaggcactggcagtgggtggatcaaaccccctacaatgagagctcaactttctggcaccctagagaacctagtgacccgaatgagcgctgtgtagtcctcaactttcgcaaatcgcctaagagatggggatggaatgacgttaactgtctgggtcctcagcggagtgtatgtgagatgatgaaaatccatctgtag

SEQ ID NO: 184077 - DNA, 549 bp, Artificial Sequence
  Description of Artificial Sequence: Synthetic coding sequence
atggtgcccgaggaggagccccaggaccgggtgccccacaacttcatgtactcaaagacagtgaagcgccttagtaaattgagggagtaccagcagtatcatccatccctaacttgtgtgatggagggcaaagacattgaggactggtcatgctgtcctacgccttggacttcctttcagtcttcttgctactttatatccaccggaatgcagtcatggactaaatctcaaaaaaactgctcggttatgggtgcagatctggtagtgataaacacccgtgaagagcaagactttattatccaaaatctgaaaaggaattcctcctacttcctaggccttagtgatcccggaggtcgtcgccattggcagtgggtggaccaaaccccctataatgaaaacgtaacattctggcattcaggcgaacccaataatttagatgagcggtgcgccatcatcaattttcggagttctgaggaatgggggtggaatgatatccattgtcatgtgcctcagaaatccatatgtaagatgaaaaagatatacatatag

SEQ ID NO: 184078 - DNA, 642 bp, Artificial Sequence
  Description of Artificial Sequence: Synthetic coding sequence
atggtgcccgaggaggagccccaggaccgggagaagggcctgtggtggtttcagctaaaggtgtggtctatggccgttgtgtcaattctcttgttgagcgtgtgtttcaccgtgagttccgttgtcccccacaactttatgtattcaaagaccgttaagagattgtctaagcttcgggaatatcagcagtaccatccctcgttaacttgtgtgatggaagggaaagatatcgaggactggtcatgttgccccactccctggacaagctttcaaagttcttgctatttcatctcaaccggcatgcagagttggaccaaaagtcagaagaattgttccgtgatgggcgccgacctagtggtgattaacaccagggaggagcaggactttattattcagaatctgaagaggaacagctcctatttccttgggctttctgatccaggcggtaggcgccactggcagtgggtcgatcagacgccatacaatgagaacgttactttctggcatagcggtgaaccaaacaatctagatgagcgctgcgccattatcaattttaggagtagcgaagagtggggatggaatgatatccattgccacgtgcctcagaaatccatctgcaagatgaagaaaatttatatctag

SEQ ID NO: 184079 - DNA, 549 bp, Artificial Sequence
  Description of Artificial Sequence: Synthetic coding sequence
atggtgcccgaggaggagccccaggaccgggtgccccacaacttcatgtattctaagacagtgaagcgcctctccaagctccgagagtatcagcagtaccacccaagtctaacttgtgtcatggaagggaaggacatcgaggattggagctgttgccctactccttggacatcatttcagagttcctgttatttcatctcaacaggaatgcagtcttggactaagagtcagaaaaactgttccgtgatgggcgctgaccttgtcgtgattaacacacgtgaagagcaagatttcattatccagaatctaaagcgcaatagctcttactttctgggactgtccgaccccggggggcgcaggcactggcagtgggtcgatcagacaccgtacaacgaaaatgtcactttctggcactccggagagccaaataatttagatgaacgctgcgccataatcaacttccgctccagtgaagagtggggttggaacgacatccactgtcacgtgccacagaagagtatatgcaaaatgaaaaagatctacatttag

SEQ ID NO: 184080 - DNA, 642 bp, Artificial Sequence
  Description of Artificial Sequence: Synthetic coding sequence
atggtgcccgaggaggagccccaggaccgggagaagggcctgtggtggttccagttgaaagtgtggtctatggccgtcgtgtccattctgctcttgtctgtgtgcttcacagttagctctgtagttccgcataatttcatgtactctaaaaccgtgaagcgcctctccaagctgcgggagtatcaacagtatcatccaagtctgacatgtgttatggaaggaaaagacatcgaagactggagttgttgtcctacaccctggacttcattccagagcagttgctactttatcagcactggcatgcagtcttggaccaaaagccagaagaactgcagcgtgatgggggccgacctagttgtgataaacactcgcgaggaacaagatttcataatccagaatctaaaacgaaattcctcatactttctgggtcttagcgatccagggggtcggcggcactggcaatgggtggaccagacgccatataatgagaatgtgaccttttggcatagtggggaacccaacaatcttgacgaaaggtgtgccatcatcaatttccggtcctccgaggagtggggttggaatgacattcactgtcacgtcccacaaaaaagcatatgcaagatgaagaagatctatatctag

SEQ ID NO: 184081 - DNA, 648 bp, Artificial Sequence
  Description of Artificial Sequence: Synthetic coding sequence
atgggcctggagaagccccagagcaagctggagggcggcatgcacccacagctgatcccatctgttatagcggtggtctttatcctgctccttagtgtttgttttattgcttcctgtctcgtgactcaccacaacttttccagatgcaagcgtggcacaggcgtccacaaactggaacatcatgctaaactgaagtgcatcaaagaaaaaagcgagctgaagtctgctgaagggagcacttggaactgttgtccaattgattggcgggcattccaaagcaattgttactttcctctgaccgacaataagacctgggccgaatccgagaggaattgcagcggaatgggagcgcatctgatgacaatcagcaccgaggcagaacagaacttcataatccagttcctagatagacgtttaagttactttcttgggctgagagatgaaaacgctaagggacagtggagatgggtcgatcaaacgcctttcaatcctcgcagagtattttggcacaaaaatgagccggacaacagccaaggggagaactgcgtcgtgctcgtgtacaaccaggacaaatgggcgtggaacgatgtcccatgtaacttcgaagcctcccgaatctgtaaaatccctgggaccaccctcaattag

SEQ ID NO: 184082 - DNA, 435 bp, Artificial Sequence
  Description of Artificial Sequence: Synthetic coding sequence
atgggcctggagaagccccagagcaagctggagggcggcatgcaccctcagctgattccttctgtcatcgccgtggtctttattttactgttgtctgtatgctttatagcgtcctgtctggtgacacaccataacttcagtcgctgcaagcggggcacaggagtgcacaagctggaacaccatgctaagctgaagtgcataaaagagaaaagcgagctgaaaagcgcagaaggaagtacatggaactgctgtcctatagactggagggcttttcagtctaactgctattttccgctcacagataataaaacctgggccgagagcgagcgcaattgttcaggaatgggcgcccacttgatgactatcagtacggaagccgagcagaacttcatcatccaatttcttgaccgacgtctgagctacttcctcgggtag

SEQ ID NO: 184083 - DNA, 660 bp, Artificial Sequence
  Description of Artificial Sequence: Synthetic coding sequence
atgaacagcagcaagagcagcgagacccagtgcaccgagcggggctgcttctcctctcagatgtttctttggactgtggctggcatccctattctgtttctgagcgcctgctttatcactcgctgtgtggtgaccttccgcattttccagacttgcgatgaaaagaagttccagctgcccgagaacttcactgagctgtcatgctacaactacgggtccggaagcgtgaagaactgctgcccattaaactgggaatatttccagagctcttgctattttttttccaccgatacaattagctgggcgctgtcgttaaaaaattgttctgccatgggcgcacatctggtggttattaacagccaggaggagcaggagtttctgtcttacaaaaagcccaagatgcgggagtttttcatcggcctcagcgatcaggtggtcgaaggccaatggcagtgggttgacgggactccccttactaagagcctgagcttctgggacgtgggtgagcctaataatatcgccaccctggaggactgtgctaccatgcgtgattcgtcaaacccacgtcaaaattggaacgatgtcacttgctttcttaactactttaggatttgcgagatggtcggcattaatccccttaataaagggaaatcactttag

SEQ ID NO: 184084 - DNA, 1134 bp, Artificial Sequence
  Description of Artificial Sequence: Synthetic coding sequence
atgagcgacagcaaggagccccgggtgcagcagctgggcctgctggaggaggatcctactacaagcgggataaggctgtttccgagagatttccaattccagcagatccatggccacaaaagcagcacagggtgcctcggccatggggctctagtcctgcaactgctttccttcatgctgctggccggggtgctggtagcgatcctggtgcaggtgagcaaggttccgtctagcctgtcgcaagaacagtctgaacaggacgctatttaccaaaatcttacacagctaaaggctgccgtgggcgagctgtccgagaaatctaaactgcaggagatctaccaagaattaacacaactgaaggccgccgtagtcggtgaactgccagagaagtccaagttgcaggagatttaccaggaactgacgagactgaaggctgctgtgggcgaactacctgagaagtccaaacttcaggagatctatcaggaactgactcgcttaaaggctgcagtcggggagctgcccgagaagtccaaattgcaggaaatctatcaggaactcaccgaactgaaggccgcggtgggagaactcccagagaagagcaagctccaagaaatctatcaggagttgacccaattgaaggcagcagttggtgagctgcctgaccagtccaagcagcagcagatttaccaggagctgacagatctgaagactgctttcgaacgtttatgccggcactgcccaaaggattggaccttctttcagggcaactgctactttatgtccaattctcagcgaaactggcacgactcagttacagcctgtcaggaggtccgagcacaactcgttgtgattaagactgcagaggagcagaacttcctacagctacagacaagtagatcaaatcgcttcagttggatgggcctcagcgacctgaatcaggaaggtacctggcaatgggtagatggatccccattgagcccgagctttcaaagatactggaactctggggagccaaacaattctgggaacgaagactgtgcggagttttccggatctggctggaatgataataggtgcgatgtcgataattattggatctgtaagaagcccgcagcatgctttcgagatgagtag

SEQ ID NO: 184085 - DNA, 1200 bp, Artificial Sequence
  Description of Artificial Sequence: Synthetic coding sequence
atgagcgacagcaaggagccccgggtgcagcagctgggcctgctggaagaagatcctactacgtcagggattaggctatttccccgcgattttcagtttcaacagattcatggtcacaaaagcagtactggctgtctaggccatggagccctggtactgcaactactgtcgttcatgttgctagctggagtcctggtcgcaatactggtgcaggttagcaaggtgccatcctccctttctcaggagcaatctgaacaggacgctatctatcagaacttaactcaactgaaggcagctgtgggggaattgagtgaaaaaagtaaactgcaggagatttaccaggaactgacgcaacttaaggccgccgtcggagagctgcctgaaaagtcaaaactgcaggaaatctaccaggagttgacgaggcttaaagcagccgtgggcgaattgccagaaaagtcaaagctacaggagatctaccaggaactgacgaggctcaaggcagccgtcggggagctccctgaaaagtcaaaactacaggaaatataccaggagctgacccgcctcaaggctgcggtcggagaacttcccgagaaaagcaagctccaggaaatttatcaagagcttacagagctcaaggccgcggttggggagctgccggaaaagtctaagctccaagagatttatcaggaactgacgcagttgaaggctgccgtcggagaactgcctgatcagagcaaacagcagcagatctatcaagagcttaccgatctgaagacagcatttgaaagactgtgccggcattgtcccaaggattggacctttttccaggggaactgctatttcatgtcaaactcgcaacgcaattggcatgactccgtaaccgcttgtcaagaggtgagggcccagctagttgtgattaaaaccgctgaggagcaaaatttccttcaactgcaaacctctcgatccaaccggtttagttggatgggactgagtgacctcaaccaggagggtacatggcagtgggtggacggctctcccctgtccccatctttccagcggtactggaatagcggcgaacctaataattccggaaacgaagattgcgctgagttctcaggctcggggtggaatgacaacagatgcgatgtggataattattggatctgcaagaagccagccgcttgtttccgagatgagtag

SEQ ID NO: 184086 - DNA, 1047 bp, Artificial Sequence
  Description of Artificial Sequence: Synthetic coding sequence
atgagcgacagcaaggagccccgggtgcagcagctgggcctgctgggatgcctgggccacggcgccctagtactgcaacttctaagtttcatgctcctcgccggcgtattggtcgccattctcgtgcaagtgtccaaagtgccatccagcctgtcccaggaacagagcgagcaggatgccatttaccagaatctcacacagttgaaggcagctgtgggtgaactgtcagagaagagcaaactgcaggaaatatatcaggaactgacccagctgaaagcggccgtcggagagctcccagagaaaagcaagctgcaggagatctaccaggagctgacccgcctgaaggctgccgtgggcgaactccctgagaagtccaaactacaggagatttaccaggaattgaccaggctgaaagctgctgtgggcgaactgcctgagaagtcaaagctgcaagagatctatcaggagcttaccgaactgaaagccgccgtgggtgagctgcccgagaagtcaaagctccaggaaatctaccaggaactgacccaactgaaagcagccgtgggcgagctacccgaccaatccaagcagcagcaaatataccaggagctgacagatctgaagaccgccttcgagcgcctttgcaggcattgcccaaaagactggaccttcttccaaggaaattgctactttatgtcaaatagtcagcgaaattggcacgattccgtcacagcttgccaggaggtacgtgctcagctggtggtcataaaaaccgccgaagaacaaaactttcttcaactgcaaacaagtaggtcaaacagatttagttggatgggactctctgacctcaaccaagaaggcacttggcagtgggtggatgggtctcctttaagcccctccttccaacggtactggaacagcggcgagcctaataacagtggaaacgaggactgcgcagagttctctggcagtgggtggaacgataaccgatgcgacgtagataactactggatctgtaagaaacctgcagcttgcttcagagatgaatag

SEQ ID NO: 184087 - DNA, 975 bp, Artificial Sequence
  Description of Artificial Sequence: Synthetic coding sequence
atgagcgacagcaaggagccccgggtgcagcagctgggcctgctggaagaggatccaacgacaagcggtatccgactgtttccacgtgacttccagttccaacagatccacgggcataagagcagtaccggatgcctgggtcacggcgctctggtgcttcagttgttatccttcatgttactggcaggcgtgttggtggccatcctggtccaagtgtctaaggtccctagctccttgtcacaggaacagtccgagcaggatgccatctatcagaatctgacccagctcaaggccgcagtaggtgagctgagcgagaaaagtaagttacaggagatttaccaagagcttacacaactgaaggcagctgttggtgagcttccggagaaatccaaacttcaagagatctatcaggagcttactaggcttaaagctgctgtcggtgaactgcctgaaaagtcgaaactgcaggaaatttaccaggagttgacgcgactcaaggcagcagtcggagagttgcccgagaagtcaaagttacaggaaatctaccaggagctcactcgtctgaaggctgcagtcggtgaactcccagagaagtccaaactacaggaaatatatcaagagctcacggagcttaaggcggctgtgggcgagctgccagagaagagcaaactccaggagatctatcaggagttgacccagcttaaggccgcagtgggcgagctgcccgaccaatccaagcaacagcaaatataccaggaactcacggacctgaagacagctttcgaacggttatgccggcattgccctaaagactggaccttctttcaggggaactgctacttcatgtccaactcccaacggaactggcacgattccgtcacagcatgccaggaggtcagagcccaattggtggtgatcaagacagcagaagaacagctgccagctgtgcttgagcagtggcgaacccagcagtag

SEQ ID NO: 184088 - DNA, 771 bp, Artificial Sequence
  Description of Artificial Sequence: Synthetic coding sequence
atgagcgacagcaaggagccccgggtgcagcagctgggcctgctggtcagcaaagttccctcttccctgagtcaggaacagtcggagcaggacgctatttatcagaatctcactcagctgaaagctgccgtgggggagctgagtgagaagtccaaactgcaggagatttaccaagaactgacacaactgaaagcagctgtaggtgagcttccagaaaagtcaaagctacaggaaatttaccaggaactgactcgcctgaaagcggccgtgggcgaactccccgagaaaagcaaactacaggaaatctaccaggaactgactaggctgaaggctgcggtaggagaacttcccgaaaaatccaagctgcaggaaatttaccaggagctcaccaggctcaaagccgccgttggggaacttcccgaaaaaagtaagctgcaagagatctatcaggaactgactgaactgaaggccgctgtcggcgagctgcccgaaaaaagtaaactgcaggagatctatcaggagcttacacagctgaaagcggccgttggtgaattgcctgatcaaagcaagcagcaacagatctatcaagaactaacggacctgaagaccgcttttgagcgcctgtgccggcattgcccaaaggattggacattttttcagggtaactgttactttatgagtaacagtcagaggaactggcacgatagcgtgactgcctgtcaggaagtgcgggctcaactcgtagtgatcaaaaccgctgaggaacaatag

SEQ ID NO: 184089 - DNA, 999 bp, Artificial Sequence
  Description of Artificial Sequence: Synthetic coding sequence
atgagcgacagcaaggagccccgggtgcagcagctgggcctgctggaagaagaccccacgacaagtgggatccgcctctttccaagggatttccagtttcagcagatccacgggcataagagctccaccgtgccttttttgctgggacccgtcagtaaagtacctagctccctgtcgcaggagcagagtgagcaggacgccatctaccaaaacctcacgcagctcaaggccgccgtcggcgagctgtccgaaaagtctaagctgcaggagatttatcaggaactgacacagctgaaggcagcggtgggcgaattgcccgaaaagtcaaagcttcaggaaatctaccaggagttaacaaggctgaaggcagctgtaggcgagcttcccgaaaagtcaaagttgcaggagatttaccaggagctgacaagactcaaggccgcagttggagagttgccagaaaagtccaaattgcaggagatctaccaagaactcaccgagttgaaggcagccgtgggtgagttacctgagaaatctaaattgcaagagatctaccaggagctgacccaacttaaagctgcagtggaacgcctctgtcggcactgccctaaggattggaccttcttccaaggaaattgctactttatgtcaaacagtcagcggaactggcacgattccgtgacagcctgccaggaagttcgcgctcagctggtggtcatcaagacagctgaggagcagaatttcctgcagcttcaaacatcccggagtaataggttctcttggatggggctgtctgatcttaaccaagaagggacatggcagtgggtggatggcagcccactgagtccatcattccaaaggtactggaattctggagaacctaacaattctggtaatgaggattgtgcagagtttagcgggtccggatggaacgacaatcggtgtgatgttgacaattactggatctgcaaaaagcctgccgcgtgttttcgcgatgagtag

SEQ ID NO: 184090 - DNA, 1164 bp, Artificial Sequence
  Description of Artificial Sequence: Synthetic coding sequence
atgagcgacagcaaggagccccgggtgcagcagctgggcctgctggaggaggaccctacaacaaattttcagttccagcaaatccacggtcacaagtctagcactgggtgccttggtcacggcgcacttgtgctccagctgctgagcttcatgctcctcgctggcgtacttcctcgcctgagtaaggtcccatcatccttaagccaggaacaatcagagcaggatgctatttatcagaatcttacacaactaaaagccgccgttggcgagctaagcgaaaaatcaaaactgcaggaaatctaccaggagctcactcagctcaaagcggccgtgggagagctccctgagaagtccaaactgcaagagatataccaagaactaaccagactcaaggccgccgtgggggagctgcccgagaagagcaagctgcaggagatctatcaggagctgacaagactaaaggcggcagtgggcgaacttcccgaaaagtcaaagctgcaagagatctaccaggaactaacaagactcaaagccgccgtgggagaactgcccgaaaaatcaaagctgcaggaaatttatcaagagctgactgagctgaaggctgctgttggggagctgcccgaaaaatccaaactgcaagaaatttatcaggagttgacccaactgaaagcagccgtgggggagttacccgaccagagcaagcaacagcagatctaccaggaactcaccgacttgaaaacagccttcgagcgtctttgccggcactgtcccaaggactggacattctttcagggcaactgttacttcatgagcaattcccagagaaactggcacgactcggtgaccgcctgccaagaggtgcgcgcgcaactcgtggtgattaagaccgccgaggagcagaacttcttgcagttgcagacttcccggtcaaacagattctcatggatggggttgtcagacttaaaccaggaaggcacatggcagtgggtagacggaagccccctgtccccctcgtttcagcggtattggaattccggggagcccaacaatagcggaaatgaggactgcgccgaattctccgggtctggatggaatgacaaccgctgtgatgtagacaattattggatctgtaagaaacccgccgcatgcttcagggatgaatag

SEQ ID NO: 184091 - DNA, 567 bp, Artificial Sequence
  Description of Artificial Sequence: Synthetic coding sequence
atgaactggcacatgatcatcagcggcctgatcgtggtggtgctgaaggttgtgggcatgacgctgttcctgctgtatttcccccaaatttttaataagtcaaatgacgggttcactaccacgagatcttatggaaccgtgtcccagatcttcggatcatcctcgccatctcccaacggctttattactaccagatcatacggtactgtgtgtccaaaggattgggagttttatcaggcaaggtgctttttcctgagcacctcggaaagctcctggaacgagagtcgtgatttttgcaaggggaaaggaagcacactggccatcgtgaacactcccgagaaactgaaatttctgcaagatattaccgacgccgaaaagtactttataggactgatttaccatcgcgaagaaaaacggtggaggtggattaataactcagtcttcaatgggaacgtgaccaaccagaatcagaacttcaactgcgccacgataggactcacaaagacttttgatgccgctagttgcgatataagctaccgccgcatttgcgaaaaaaatgctaaatag

SEQ ID NO: 184092 - DNA, 630 bp, Artificial Sequence
  Description of Artificial Sequence: Synthetic coding sequence
atgatgcaggagcagcagccccagagcaccgagaagcggggctggctgtcccttaggctctggagtgttgccggcattagcattgcactgcttagcgcctgctttattgttagctgtgtggtcacttatcatttcacctatggggaaacggggaaaaggctctctgagctccactcttatcactcctcactgacttgcttcagcgagggaactaaggtcccagcatgggggtgttgtcccgcctcctggaagtcttttgggtcctcctgctacttcatcagcagcgaggagaaggtgtggtcgaagtctgagcagaattgcgtggagatgggcgcccatctcgttgtgttcaacaccgaagcagagcagaatttcatcgtgcagcaattgaatgaatcattttcttactttcttggcctgtcagatcctcaggggaataataattggcagtggattgacaaaacaccgtacgaaaaaaacgtgcgcttctggcatcttggcgaaccaaatcactcagccgaacagtgtgcctccatagtcttttggaaacccactggctggggctggaatgacgtgatttgtgagactcgccggaacagtatctgtgagatgaacaaaatttacctgtag

SEQ ID NO: 184093 - DNA, 432 bp, Artificial Sequence
  Description of Artificial Sequence: Synthetic coding sequence
atggagtaccaccccgacctggagaacctggacgaggacggctacacccaactacattttgatagtcagagcaatactagaattgccgtggtgtcagagaaagggtcctgcgctgctagcccgccttggaggttgatcgctgtgattctgggcatactctgcctggtaatcctggttatagctgtcgtgttagggaccatgggcgtgctttcgtctccgtgcccgcctaattggattatatacgagaagagctgctatctgttttccatgtccttgaattcctgggatgggtcaaagcggcagtgttggcagctgggttctaatctgttgaagattgatagctccaacgagctgatctcagatcagaatcactcttatcctcgcaagccaatttccaagctgtgcatggattctcgtgtctcacacctctag

SEQ ID NO: 184094 - DNA, 744 bp, Artificial Sequence
  Description of Artificial Sequence: Synthetic coding sequence
atggagtaccaccccgacctggagaacctggacgaggacggctacactcagcttcatttcgactcacaatcaaatacgaggattgccgtcgtttcagaaaagggtagttgcgctgcgagccctccttggaggctcatcgctgtgattcttggcatcttatgtttggttattctggtgattgcggtcgtgctcggaacaatggccatctggagaagcaactctggctcgaatacactggaaaatgggtacttcctttcccggaacaaggaaaaccatagccagcccactcagagctcacttgaggactccgtgactccaacaaaggcagtcaaaaccaccggagtcctgtcgagcccttgtccacccaattggatcatctatgagaaaagctgttacctttttagtatgagtctcaacagttgggatgggagcaagagacagtgctggcagctggggagtaacctcctgaagatagatagcagcaacgagctgggctttattgtcaagcaggtgtcatcccaacccgataactctttctggatcgggctgtctcggccacagaccgaagttccttggttatgggaggacggaagtaccttttccagcaatctgtttcagatccgcaccacagcaacccaggagaatccctccccgaattgcgtctggatacacgtatctgtgatctatgatcaactgtgttcagtccccagctactcgatctgcgaaaagaaattttccatgtag

SEQ ID NO: 184095 - DNA, 234 bp, Artificial Sequence
  Description of Artificial Sequence: Synthetic coding sequence
atggagtaccaccccgacctggagaacctggacgaggacggctacacccagctgcattttgattcccagtccaatacccgaatcgccgtggtaagcgagaaggggtcctgtgctgcgagccccccgtggaggctgatagccgtgattctcgggattttgtgcctggtaattctcgtgattgccgttgtcttaggcaccatggccggttttaaggctgttgaattcaaagggtag

SEQ ID NO: 184096 - DNA, 606 bp, Artificial Sequence
  Description of Artificial Sequence: Synthetic coding sequence
atggagtaccaccccgacctggagaacctggacgaggacggctacactcagttgcatttcgacagccagtctaacaccaggatagcagtagtgtcggagaaaggcagctgtgcggcatcccccccatggagactgattgctgtgatcttgggcattctgtgcctcgtgattctggttattgccgtcgtcctcggtaccatgggcgtcttaagttcaccgtgccctccaaattggatcatctacgagaaaagttgttatctattctctatgagtctcaacagctgggatgggtccaaacgccagtgttggcagctcggctccaacctgctcaagatagactcatcaaacgagctgggcttcatcgtcaagcaggtgtcgagtcagccagacaattccttttggattggactatctcggccccagacagaggtcccgtggctatgggaggacggcagtacattttcttccaacctattccagattcgcaccacggccacgcaggaaaatccatcacccaactgtgtatggattcacgtatccgtcatctacgatcagctctgttcagtgccatcctatagcatctgtgagaaaaagttctccatgtag

SEQ ID NO: 184097 - DNA, 507 bp, Artificial Sequence
  Description of Artificial Sequence: Synthetic coding sequence
atggagtaccaccccgacctggagaacctggacgaggacggctacacgcagctgcacttcgacagccagagcaacacccgcatcgcagtggtgagtgaaaagggggtgctctcaagtccctgtccgcctaactggattatttatgagaaatcatgttacctcttttctatgtccctcaattcgtgggatgggtcgaagcggcaatgctggcagctgggctcaaatttgctcaagattgactcttccaacgagctgggcttcatcgtcaaacaggtaagttcccaacccgataattcattctggatcggcctatctaggccccagacagaggttccatggctgtgggaagacggatcgactttttcttctaacctttttcagattcggacaaccgccacccaagaaaacccttctcccaactgcgtgtggatccacgtcagcgtgatctacgatcagctatgctccgtcccaagctacagtatttgcgaaaaaaaattctctatgtag

SEQ ID NO: 184098 - DNA, 351 bp, Artificial Sequence
  Description of Artificial Sequence: Synthetic coding sequence
atggagtaccaccccgacctggagaacctggacgaggacggctacacgcaacttcattttgattctcaatcgaatacgagaatcgcagtcgtgtcagaaaaagggagctgcgccgcatcacctccatggcggttgattgctgttatcctggggatcctgtgcctggtgatcttagtgatcgctgtcgtcctgggtacgatgggcacgggccagttcctcaaggacttgtcattcctcaataaccgtcggaagctgttcggcgatcccatacaggaagctacacattggcgcatggcaacattttatcaggaaattaaaagaacaacagttaatccacataatcacctgtag

SEQ ID NO: 184099 - DNA, 744 bp, Artificial Sequence
  Description of Artificial Sequence: Synthetic coding sequence
atggagtaccaccccgacctggagaacctggacgaggacggctacacacagctacattttgatagccaatcaaataccagaattgctgtggtttcagaaaaagggtcctgcgcagcatcccctccctggcgccttatcgccgtgattctcgggattctgtgccttgtgatcctcgtgatcgccgtagttctgggcacgatggcaatttggaggtctaactccggatctaataccctcgagaatggctactttttgtcaaggaataaggagaaccactctcagccaacacaaagctcattggaagacagcgtgacacctaccaaagcagtcaagaccacgggagtcctcagctccccatgcccccccaactggatcatctatgagaagtcctgttacctcttcagcatgtccctgaattcttgggatggaagtaagcggcagtgttggcaactgggcagtaatctcctcaaaattgatagtagcaatgaactgggttttatcgtgaagcaagtctcctctcagccggacaactccttttggattggcctgtctcgcccccagactgaggtcccttggttatgggaggacgggtctacattttcttcaaacctatttcagatcaggacaacagccacccaggagaatccctcacccaactgcgtctggattcatgtatccgtgatttatgaccagctttgtagtgtgccaagctattctatctgtgaaaagaaatttagcatgtag

SEQ ID NO: 184100 - DNA, 570 bp, Artificial Sequence
  Description of Artificial Sequence: Synthetic coding sequence
atggagtaccaccccgacctggagaacctggacgaggacggctacactcaactacatttcgattcacaatctaacactcggattgccgttgtaagtgagaaggggagttgtgctgccagcccaccgtggagacttattgccgtgatactgggtattctgtgcttggtaatacttgttattgccgttgtgctaggcacaatggctatttggcggtcgaacagcggaagtaatacactcgagaacggctattttctttcccgaaacaaggaaaatcatagccaacccacccagagcagtctggaggatagtgtgactccaactaaggctgttaagactacaggcgtgttgtcttcaccttgcccgcccaactggattatctacgagaagtcctgctacctgttcagcatgtccctgaattcatgggacgggagcaagcgccagtgttggcagctaggaagtaacttgctcaagatagactctagtaacgagttaatttctgatcagaaccactcttatcctaggaagccaattagcaagctctgcatggacagtcgggtgagccacctttag

SEQ ID NO: 184101 - DNA, 10281 bp, Artificial Sequence
  Description of Artificial Sequence: Synthetic coding sequence
gtgctgcccagccacacctgcggcaaccccggcgagatcctgaagggcgtactacacggaacccgctttaatataggcgacaagatcaggtattcttgccttcctggctacatcctggagggccacgccattttgacttgcattgtgtctcccggcaacggtgccagttgggattttccggcgcctttctgccgagcagagggggcctgcggcgggacactcagagggactagcagtagtatcagttctccccactttcccagcgaatacgagaataacgccgattgtacatggacgattctcgctgaacctggagacaccatcgctttagtattcacagactttcagcttgaggagggctacgattttttggaaattagtggtactgaagcaccttccatctggttgaccggaatgaaccttccctctcctgtcatcagttctaaaaattggctgcgcctgcatttcacctcggactccaatcacagacgtaagggctttaacgcccagttccaagttaagaaagcaatcgagctaaagtcccgtggtgtcaaaatgctgccatctaaggacggctctcataaaaactcagtgctgagtcagggaggggtcgccttggttagcgacatgtgtcctgaccccggtatcccagaaaacggaagaagagccgggagcgattttagcagggttggagcaaatgtgcagtttagctgtgaagacaactacgttctgcaagggtctaagagcatcacttgccagcgagtgacagaaacattggccgcctggtccgatcatcgccctatctgccgcgcccgtacatgcggctctaatctaagaggaccctccggcgtgattacctccccaaactaccccgtgcagtacgaagataacgctcattgcgtttgggtgatcacaactacagatccagacaaggtgattaaactcgccttcgaggaatttgaactggagaggggttatgatacactcactgtcggcgacgcagggaaagtgggcgatacaagatctgtcctctatgtgctgaccggcagctctgttccggaccttattgtcagcatgtcaaaccagatgtggctccacctgcagtcagatgactcaattggctcccctggtttcaaagcggtgtaccaggaaattgaaaagggaggctgtggagatccagggattccggcctatgggaagcgcaccggcagctcgttcctgcatggcgatacgctgacatttgaatgtccagcagcctttgaactagtgggtgagagagtgattacatgccagcaaaataaccagtggagcggtaataagccatcctgtgtgttcagctgcttctttaacttcaccgcttcatccggcattattctgagccctaattatccagaggaatacggaaataatatgaattgcgtctggcttatcatctcagaacccgggagcagaatccatctgatctttaacgactttgacgttgagccgcaattcgacttcctggccgttaaggatgatgggatcagtgacatcaccgtcctaggcacattctcaggcaacgaagtgccgtcacagctggccagctcgggacacatcgtcaggttagagttccaatctgaccattccaccacaggtcgcggatttaacatcacctatacaaccttcggccaaaatgagtgccatgaccccgggattcccataaatgggcggagatttggagacagatttcttctgggctccagtgtgtcttttcactgtgatgatggattcgtgaaaactcagggtagcgagagcattacatgcatcctccaagatgggaatgtagtttggagctccaccgtccctcggtgtgaagctccatgtggcggtcacctgaccgcttccagtggcgttatcttaccgccagggtggccgggctactacaaagattccctccactgcgaatggattattgaggccaagcctggtcactccattaagattacttttgaccgtttccagacagaggtgaattacgataccctggaggtccgagacggtccggcatcatcatcgccattgataggtgaatatcatgggactcaggccccccagttcctgattagcacaggaaactttatgtacctgctgtttacaacagacaattcccgatccagtattggctttctgatccactacgagagcgtgacactggagtctgactcgtgtctggaccccggtatccctgtgaatggccatagacacggaggcgatttcggcatacgctccacagtcaccttctcatgcgaccccggatatacactctcagatgacgagcctctggtgtgtgaacggaatcatcagtggaaccacgctctgcccagctgtgatgccttgtgcggcggctacatacagggcaagtctgggaccgtactctcaccaggctttccagacttctacccaaactcactgaactgtacatggacaattgaggtatcccacggcaaaggtgttcaaatgatctttcacacttttcatctggagtccagccacgattacctgcttattacggaggatgggtctttcagcgagcccgtggcacggctcacaggctcagtgttacctcacactattaaggccggactgtttggaaattttacagcccagctcaggttcatctcagactttagcatatcatacgaaggtttcaacatcacattctccgagtacgatttagagccatgtgacgaccccggagtccccgcattctcaagacggatcggcttccactttggcgtcggcgacagcctgaccttttcatgtttcttgggctaccgactggaaggggctacgaagctgacctgtttagggggaggcaggcgagtctggagcgcacctttgccgcgttgtgtggctgaatgtggagcctcagttaaggggaatgagggaaccctgctcagtccaaacttcccatccaattacgacaacaaccacgaatgcatctacaagatcgagaccgaggctggcaaagggattcacctgcggacgaggtccttccagctttttgagggggatacactgaaagtgtatgacggcaaagattcaagctctaggccactgggcacctttacgaaaaacgaactgttaggtctgatactcaactctacaagcaatcacctgtggctggaattcaacacaaatggttctgatacggatcagggatttcaactgacctatacaagcttcgatctggtcaagtgcgaggatccaggcatcccaaactatggctaccggataagggatgagggtcattttactgatacagtggttctgtacagctgcaacccaggctacgccatgcacggatcaaatactctcacatgtttaagcggggatcgtagagtatgggacaagccgcttccgtcatgcatcgcggagtgcggagggcagattcatgccgccacatcaggccgcattctgagcccaggctatcctgccccttatgacaataaccttcattgcacctggatcattgaagccgacccaggaaagaccatcagtctacactttattgtgttcgacacagaaatggcccatgacatactcaaagtgtgggatggtccagtcgacagcgacatacttctgaaggagtggtcgggcagcgccctgccagaagacatccactctactttcaatagtctgaccctccagtttgattccgacttcttcatctccaaatctggcttttccatccagttcagcacgtctatcgctgccacatgtaacgacccgggaatgccacagaatggtactcgctacggggatagtagggaggcgggagatacagtcactttccaatgcgaccctggctatcagttgcaaggtcaggcaaaaattacttgcgtgcagctgaacaaccgctttttttggcaaccggacccgccaacttgcatcgctgcttgcggcggcaatctcacaggacccgccggcgttattctttcccctaactatcctcagccgtaccctcctgggaaggaatgcgactggcgagtgaaagtaaacccagacttcgtcattgcactgatctttaaaagtttcaacatggaaccgagttacgacttcctgcatatatacgaaggagaagacagtaactcgcctctcattgggtcataccaaggatctcaggcccccgaacgtatcgaaagctctgggaactcactatttctggcatttaggagcgatgcttctgtgggattatctggtttcgccatcgagttcaaagaaaaaccaagggaagcctgtttcgatcctgggaatatcatgaacggcacaagggtggggacggattttaagcttggaagcactatcacgtaccagtgtgactccgggtacaagatccttgacccatccagcatcacctgcgtgatcggggccgatggtaaaccctcctgggaccaagttcttccctcgtgcaacgcaccctgcggagggcagtataccggatccgagggtgtggtgctctcaccaaactatccacataattacacagctggacagatttgcttatatagtatcactgtccccaaggaattcgtagtcttcgggcagttcgcgtattttcaaacagcacttaacgatttggcagaactttttgacgggacgcatgcccaagctagactcctgagctctctaagtggatcccactcaggggagacgttgcccctggccacatccaatcagattctgttacgattctccgcaaaatctggtgcatccgcccgcggcttccactttgtgtatcaggccgtgccacgtacaagtgatacgcaatgctctagcgtcccggaacctagatatgggcggcggatcggatccgagtttagtgccgggtcgattgtgcgttttgagtgcaacccaggctatctcctgcagggatctaccgccctacactgtcagtcagtgcctaacgctctcgctcagtggaacgacacaatcccatcttgtgtggttccttgctccgggaactttacccaaaggcgggggaccattctgtcaccagggtaccccgagccctatggcaacaatctcaactgcatttggaaaataattgtaaccgaaggaagcgggattcaggacccctccgatcagttctgtcacggggcagaactcggtctggagatccacgatggaggagatgtcacagctcccagactgggttccttttctggtaccaccgtgccggctcttcttaatagtactagtaatcagttgtatttgcattttcagtcagatatctcagttgctgcagccgggtttcacctggagtataagaccgtgggtctggcggcctgtcaagagccagcattaccatctaacagtatcaaaataggtgacagatacatggtcaatgatgtactgagcttccagtgtgaacccggctataccttgcagggtcggagtcacatctcatgtatgcccggcactgttaggcgctggaactatccatcacctttgtgcatcgctacttgcggcgggactctgagcactctgggtggcgtcatcctaagccctggtttccctggatcctatcccaacaaccttgactgtacgtggcgcatcagtcttcctatcgggtacggcgcccatatccagttcctcaatttctcgactgaagctaatcatgatttcttggaaatccaaaatggtccatatcatacctcgccgatgatcgggcagttctcaggcactgatctcccagcggctctgctgagcacaactcatgagacacttattcacttctattcagatcattcacagaacaggcaagggttcaagctcgcctaccaggcatatgaacttcagaattgccccgacccaccccctttccagaatgggtacatgatcaactctgattactctgtcggacagagcgtctccttcgagtgctaccccggctatatcctgattggtcaccccgtactgacatgtcagcacggtatcaatagaaattggaactatccctttcccaggtgcgatgcaccatgcgggtacaatgtgacttcacagaacggcacaatttatagtccagggtttccagatgaatacccaattctgaaggattgcatttggctgatcactgtgccccccggccatggggtgtatatcaattttacactgctgcagacagaagccgtgaatgattatatcgctgtgtgggacggcccagatcagaactcacctcagctgggcgtattttcagggaatacagccttggaaaccgcttattcaagtacgaatcaggtccttttaaagtttcattcagatttttccaacggaggcttttttgtgttgaattttcatgccttccagctaaaaaaatgtcagccgccacccgcggtgccccaggcagaaatgctgacagaggatgacgattttgagatcggcgatttcgtcaagtatcaatgccatccaggatacacccttgtcgggaccgacatcctcacttgcaagctaagcagccagctgcagtttgagggatcgctgcctacctgcgaggcacagtgtccagcaaacgaagtgcgaaccggatcttcaggagtgattctgagccctgggtatcccggaaattatttcaactcccagacctgctcatggagtattaaagtcgaacccaattataacattacaatttttgtggataccttccagtcagagaaacagttcgacgcattggaggttttcgatggctcctcagggcagagtccgctcttggtggtgctgtctggaaaccatactgagcagagtaacttcactagcaggtcaaatcagctgtacctgagatggagcactgatcacgcaaccagtaaaaagggtttcaagatcaggtacgccgctccttactgctcactgacccaccctctcaaaaatgggggcatattaaaccggacagctggtgccgtcggatcaaaagtgcactatttttgtaaacctggataccgcatggtgggccatagcaacgccacctgccgccgcaacccacttggaatgtatcaatgggactccctgacccccctgtgtcaggccgtctcatgcgggatccccgagtctcctggaaacgggtcctttaccggtaacgaatttactctggacagcaaagtggtgtacgaatgtcacgaggggttcaaactggagtcttcacagcaggcgacagcagtgtgtcaagaggatggtctgtggtcaaataaggggaagccacctacctgtaaaccagtggcgtgcccttctatagaagcccagctgtccgagcacgtgatttggaggctagtttctggtagcctaaacgaatatggcgcccaggtcctcctgagctgtagcccaggctactacctcgaaggttggcgcctcttgaggtgccaagccaatggcacctggaatatcggggacgaacggcctagttgtcgcgtcatctcttgtggctctctgagcttccctcccaacggcaataaaatcggcactctgactgtgtatggggccactgccatatttacctgtaataccggttacacactcgtgggcagccacgtaagagagtgtctggctaatggcctatggagcgggtctgaaacaaggtgtctggcaggccactgtggctcacccgacccaatagttaacggtcacatttccggcgacggattctcatatagagatactgtggtgtatcagtgcaacccgggcttccgcctcgttggcacctccgttaggatctgcctgcaagatcataaatggtcgggtcaaacccctgtgtgcgttcccatcacctgcgggcaccccggaaatccagcccacggattcacaaacggctccgagtttaatctgaacgacgtggttaacttcacatgcaatacgggttatctcctccagggagtgtctcgagcccagtgtcgttcgaacggccaatggtcctctccccttcctacctgtagagtggttaattgctccgatcccggtttcgtagagaacgcaattcggcacggtcagcagaacttccccgaaagctttgaatacggcatgagcatcctataccactgcaaaaaagggttctacctcctcgggtccagcgccttgacttgtatggctaatggcctatgggacagatctctgcccaagtgtctggctatttcttgtgggcatcccggtgtgcctgccaatgccgtcttgactggggagttgttcacttatggcgccgttgtgcattactcctgcagaggcagtgagtctctcataggtaacgatacaagagtctgccaggaggattcgcactggagcggagctttgccgcattgcacagggaacaacccaggattttgcggggaccccggaacaccagctcatggctcccgcctcggggacgactttaagactaaatcattattgcgcttttcctgcgagatgggccaccagcttcgcgggtctcccgagcggacctgcttactgaatggatcctggagtgggctgcagcccgtttgtgaagctgttagctgcggcaaccccgggactcccaccaacgggatgattgtctcgtcagacggcattctgttctctagcagcgtgatttatgcatgttgggagggctacaagacatcgggtctgatgacaaggcattgcacagccaatgggacatggaccggtaccgctcccgattgcaccataatcagctgcggggacccgggaactttagcaaacggaatccagttcgggaccgactttacctttaataaaaccgtgagctatcaatgcaatcctggttatgttatggaagcagtgaccagtgcaacgatccgttgtactaaagacggacggtggaacccaagcaagcctgtttgcaaagccgttttatgcccacagccacccccagtgcaaaacggcacagtagaaggatccgactttcggtggggatcttctatttcttatagctgcatggatggttatcagctgtcccattccgcaattctaagttgcgaaggaagaggggtgtggaagggcgagatacctcaatgcctaccagtgttttgtggtgaccctgggataccagccgaggggcggctgtctggcaagagttttacgtataaatcagaagttttcttccagtgtaaaagccccttcatcctcgtcggctccagtcgtagagtttgccaggctgacggtacatggtccggcatccagccaacatgcattgatcctgcccacaacacgtgtcccgatccagggactccccattttggcatccaaaactcctctcgggggtatgaagtcggatcaaccgtgtttttccggtgcaggaaggggtaccacattcaaggaagcaccactcgcacatgtttagctaacctgacttggtcaggtatccagaccgaatgtattccccatgcgtgccgccagccagagaccccagcccacgcagacgtgcgcgcaatcgacctgcctacattcggctatacacttgtgtacacctgtcatccaggtttctttctcgccggcggatctgaacatagaacatgcaaagcagacatgaagtggaccgggaaatctccagtgtgtaaatcgaaaggcgttcgtgaggtgaacgaaactgttacgaagacacccgtcccttcagacgtgttcttcgtaaactctctctggaaggggtattacgagtacctgggcaaaaggcagcctgccacgttaaccgtggactggtttaacgccaccagtagtaaagtgaacgccacatttagtgaggcctctcctgtggaactgaaattaacaggcatttacaaaaaggaggaggcccatctcctactcaaggctttccagattaagggacaagctgacatatttgtgtcaaagttcgaaaatgacaactggggattggatggctacgtgtctagtgggctcgagcgtgggggcttcacttttcagggagacatacacggcaaagacttcgggaagtttaagttagagcggcaggacccactaaatcctgaccaggactccagctcccactaccacgggacatcttccggaagcgtagccgcggctattctcgtgcctttcttcgccctgatcctctcaggtttcgcattttatctgtataagcaccgtacccggccgaaagtccagtataatggatacgcgggccacgaaaacagtaatggacaggcatctttcgagaaccccatgtacgacacaaacctgaaacccacagaagccaaagccgtccggtttgataccacattaaacacagtctgtactgttgtctag

SEQ ID NO: 184102 - DNA, 10167 bp, Artificial Sequence
  Description of Artificial Sequence: Synthetic coding sequence
atgaccgcctggcggcggttccagagcctgctgctgctgctgggcctgctggtactgtgtgctcggctcttgactgccgctaaaggccagaattgcggtgggctggtacagggacccaacggcacaattgagtccccaggcttcccacacggttacccaaattacgccaactgtacctggatcatcatcaccggagagcggaacagaatccagctctcctttcacaccttcgccctcgaagaggacttcgatattctgagcgtttacgacgggcagcctcagcagggtaaccttaaagtcagactcagtggcttccagctgcccagtagcatagtatccacaggaagcatattgaccctgtggttcaccactgattttgctgtgagcgcccaggggttcaaagccctgtacgaggtactgccttctcatacctgtggaaacccgggtgagatactgaagggtgtgctccacgggacaagattcaacattggcgataagattaggtactcgtgtctgccgggttatattctcgaggggcacgccatacttacctgtattgtgagccccggcaacggtgcttcctgggattttccggcgcctttttgccgcgctgagggcgcctgcggaggcaccctgcgaggaacaagctcatcaatttcaagtccccactttccctcagaatacgagaacaacgcagactgcacatggaccatccttgctgagccaggggacaccattgcacttgtttttacggacttccaattagaagagggatacgatttccttgagattagtggaacagaggccccaagtatttggctaaccgggatgaatcttccttcgcccgtaatctctagcaagaattggttaagattgcattttacttctgactccaatcatcgccggaaaggtttcaacgctcagtttcaggtgaaaaaagccatcgagctcaaatctcgcggggtgaaaatgctgccttccaaggacgggagccataaaaatagcgtattgtcgcagggaggcgtcgctctggtatccgatatgtgtccagatcccggaattccagagaatggccgtcgtgccggaagtgatttcagtcgcgtcggagctaatgtgcagttctcatgcgaggataattatgtcctgcagggctccaagtcaattacatgtcagcgcgtcactgagactctggccgcttggtccgaccatagaccaatttgccgggcaagaacatgtggctcaaatctgagaggaccctcaggagtaattaccagccccaattaccctgtgcaatacgaagataacgcccattgtgtctgggtaattaccaccacagaccctgacaaggttatcaagctggctttcgaagaatttgagctggagcggggctacgatacactgaccgttggagatgccggtaaagtcggcgacacaagatcagtcctgtacgtgctgacaggatcttcagtccctgatcttatcgtgtctatgtccaaccaaatgtggctccacctgcagagcgacgactccatcggaagtccagggtttaaggccgtctaccaggagatcgagaaggggggttgcggcgacccagggatccctgcctatgggaagaggaccggcagctccttcctgcacggggatacactcacctttgaatgcccagctgcgttcgaactagtcggtgaaagagttattacgtgccaacagaacaaccagtggtccggaaacaagccatcttgcgtgttctcatgcttttttaacttcactgccagtagcggaatcattctgtccccgaattacccagaggaatatggaaacaacatgaattgtgtatggttgattatttctgaacccggaagccggattcatttgatctttaacgactttgacgtggaaccacaattcgattttctcgcggtcaaggatgacggcatatcagacatcaccgtgctgggtaccttttctggtaatgaagtgccgtcccaactcgcctcctcaggacatattgttcgactggagtttcagtcagaccattccactaccggtcggggcttcaacattacctatacaactttcggacaaaatgaatgccatgatcccggtattccaattaacggccgccggtttggggataggttcctcctgggctccagtgtgagctttcactgcgatgacggcttcgttaagacccaggggtccgaatccattacttgcattctacaagacggaaacgtggtttggtctagtacagttcccaggtgtgaggctccatgcgggggccacctgacagctagcagtggggtcatcttgcctcccggctggcccgggtactacaaagattctctacactgtgagtggattattgaagccaaacccggccacagcataaaaattactttcgacagattccagactgaggtgaattacgacactctggaggtaagggacggccccgcgtccagctctcctcttatcggcgagtaccacgggacacaggccccccagttcttaatttccacaggcaacttcatgtatctgctgtttactactgacaactctaggtcatctatcggatttctgatccactatgagtctgtgacgctggaaagcgactcttgtttggatcccggcataccagtgaatggccaccgacacggaggtgacttcggaatccgaagcacagtgaccttttcttgtgaccccgggtatacgctgagcgatgacgaacctctcgtctgtgaacgaaatcatcagtggaatcacgctctacccagctgcgatgccttgtgtggcggatatatacaagggaagtctggcaccgtgctatccccgggcttcccagacttctatccaaattcgctcaactgcacttggaccatcgaagtatctcatggaaaaggagtgcaaatgatttttcataccttccacctggaatctagccacgattacctgctgatcaccgaggacggatccttcagcgagcccgtggcccgtctgactgggtcggtgctaccacacactattaaagctgggttatttggcaactttacggcccagcttcggttcattagcgattttagcatatcctatgagggatttaatatcaccttcagcgagtacgacctggaaccctgtgacgatccaggcgtaccagccttcagccgccggatcggatttcacttcggggtcggtgattccctcaccttttcatgtttcttgggctaccgtcttgagggagcaactaaactcacatgtttagggggcggacgccgcgtctggtcggctcctttgccaaggtgtgtggcggaatgcggtgccagcgttaaggggaacgaaggaaccctgctttccccaaatttcccctcaaattacgacaacaaccacgagtgcatctataagatcgaaaccgaggccggcaaaggcattcatctccgaacccgctccttccaattatttgagggtgatacactgaaagtttatgacgggaaggatagtagcagcagacccttgggcacttttacaaaaaatgagctgctggggctgatactcaatagtaccagcaatcacctttggcttgagtttaacactaatgggagcgacacagaccaagggttccaactcacatacacgtccttcgatttggtgaagtgcgaggaccctggaatccccaattatggataccgcatacgcgatgaaggacactttactgatacagtggttttatattcatgcaatcccggatatgcaatgcacgggtctaatactttgacttgcctctctggggatagaagagtttgggacaaacccttacctagttgtattgccgaatgcggcggacagattcatgcagcaaccagcgggagaatcctgagtccaggatatccagccccttacgacaacaatctccactgcacctggatcatcgaagccgatccaggcaagacgatttctttgcatttcatagtgttcgatacagaaatggcacatgatattctcaaagtgtgggacggccctgtggattcagatatcctactcaaagagtggagcggatctgctctgcctgaggacatccattcaacctttaatagcctcacccttcaattcgacagtgatttttttatcagcaaaagcggtttctcgattcaattcagcacctctattgccgcaacttgtaacgacccagggatgcctcagaacggcacaagatatggagattctagagaagcaggcgacacagtgacgtttcagtgcgaccccgggtatcagctgcagggacaagctaaaatcacctgtgtgcagctgaataacagattcttctggcagcctgacccacctacttgcattgctgcttgtggcggtaatctgacgggccctgctggtgtgattttgtctccgaactatccacaaccgtatcctcccggaaaagaatgtgactggcgggttaaggtgaatcccgacttcgtcattgccctgattttcaaaagctttaacatggaaccaagttacgattttctacatatatacgagggggaagacagtaattccccgcttatcggcagctatcagggttcccaagcaccagagcgcatcgagtctagtggcaacagtttgtttctggccttcaggtcggatgcctctgtgggcctgagtggctttgccatagaattcaaagaaaaacccagggaagcatgcttcgatcccgggaacatcatgaacgggacacgggtaggcactgacttcaagttagggtccacaattacataccagtgcgactctggctataaaatcctagacccttcctctattacatgtgtgatcggggccgacggaaagccctcttgggaccaggttctgccttcatgcaacgcaccatgtggtggtcagtatactggctctgaaggcgtggtgttatctccaaactacccccacaactataccgcgggacagatctgcctgtattcaattaccgttcctaaagaatttgtcgtgtttggacaattcgcatatttccagaccgcactgaatgatctagccgagctgttcgatggcacccacgcccaggcaaggctgctcagttccctgagtggctcacatagcggggaaacactaccactggcgactagtaaccagattcttctacgtttctctgcaaaatccggtgcgtccgctaggggcttccatttcgtataccaggccgtacctcggactagtgacacacagtgcagttccgtccctgagcctagatacggaagacgtatcggatccgagttttctgctggatctatagtgcgctttgagtgtaaccctggctacctcctgcaaggatctacagccttgcattgtcagtccgtgcccaacgcactggcccaatggaacgacaccatcccctcttgtgtcgtcccttgtagcggcaattttacacagcggcggggtacaatcctgagccccggctaccccgaaccttacgggaacaacctgaactgcatctggaaaataatcgtcactgaaggatccgggatccaaattcaagtcattagcttcgccacagagcaaaattgggattctctggagattcatgacgggggtgatgttacagccccacggctcggcagtttttcgggcaccaccgtgcccgccctactcaactcgacctccaaccagctgtacctgcacttccagagcgatatctcggtggctgccgccggtttccacttggaatataagacggtgggcctcgccgcatgccaggaaccggccctgccttccaactcaatcaagattggagatcgctacatggtgaatgatgttctttcatttcagtgtgaacctgggtataccctgcagggccgctcccacatctcgtgtatgcctggcactgtaaggaggtggaactacccttctccactatgcatcgccacctgcggcggaacgctgtcaactctggggggcgtcatactatcaccaggatttcccgggtcctaccccaataacctggactgcacctggcggatatctttgccaattggatatggggcccatatccagtttctgaacttctccacagaagcgaaccacgactttctggaaatccagaatggaccctatcacacttctcccatgattggtcagtttagcgggaccgacctgcctgccgctctgttgagcaccacgcatgagacactgattcatttttatagtgaccattctcagaatcggcaaggatttaagttggcataccaggcctacgaactccaaaattgtccagacccgccccccttccagaacgggtatatgattaattccgattactccgtgggccagtctgtctccttcgagtgttacccaggatacatcctcataggccacccagttctgacctgtcagcatggaattaaccggaattggaactaccccttccctcggtgtgacgctccgtgtggctataacgttactagtcaaaatggcacaatttactcaccaggtttcccagatgagtatcctatactgaaagactgcatttggttaattaccgttccgcctggccacggcgtctatatcaactttactcttctgcagacagaagcggtgaatgattacattgctgtgtgggatggcccagatcagaatagcccacagcttggcgtgtttagcggaaacacagccctggaaaccgcatactctagcacaaaccaggtcctgctgaagttccattcggatttctcaaacggtggcttcttcgtgctgaattttcatgcattccagttgaagaaatgtcagccccctcccgctgttccacaggctgagatgttgacggaggacgatgactttgaaatcggcgacttcgtcaagtatcagtgtcatcccggctacacgttagttggaaccgatatcctgacttgcaagctgtccagccaactgcagtttgaggggtccctccctacctgcgaagcccagtgtcccgccaacgaggttagaactgggagctctggggtcattctaagccccggctatcctggaaactattttaacagccagacatgtagctggtcaattaaagttgagcccaactataacattactattttcgtggacacattccaaagcgagaaacagttcgatgccttagaggttttcgacggttcaagcggccagtctcccctgttggtcgtcctgtccggcaaccacacagaacaatccaattttacttctcggtccaatcagctttacctcagatggagtaccgaccacgcaacctcgaagaaggggtttaaaatacggtacgccgccccctattgttctttgactcacccgctgaaaaacggggggattctaaaccgaaccgccggggctgtgggatcgaaggtacattatttctgtaaacccggataccgcatggttggacactctaatgccacgtgcaggcgtaaccctctgggtatgtaccagtgggatagcctgaccccactgtgccaggcagtctcatgtgggatcccagagtcaccagggaacggctcttttaccggcaacgagtttaccttggacagcaaagtggtgtatgagtgtcatgaggggttcaaattggagagctctcagcaggcgacagctgtgtgccaagaggacggtctgtggagcaacaaaggtaagccccctacctgcaagcccgttgcttgcccgtcaatcgaggcccaacttagtgagcacgtcatatggcggctagtgtccgggagcttaaatgaatatggagcacaggtactgctgtcctgcagccctgggtactaccttgaagggtggagattgctgcgctgccaggcgaacggaacgtggaatattggcgacgaaaggccctcctgccgtgcaggacattgcggttctcccgaccctatcgtgaatggccatatttccggagatgggttctcatatcgtgacactgtggtgtatcagtgtaatcctggcttccgacttgtaggcactagcgtgcggatctgtctacaggaccataaatggtctggtcagactccagtatgcgtgcctatcacctgcggccatcccgggaatcctgcacacggcttcacaaacgggagtgaattcaatcttaatgatgtggtcaattttacctgcaatactggatacctgctccaaggggtctctagggcccagtgccgctctaacggacaatggagttcacctctgcccacatgtagagtcgtgaactgctccgaccctgggttcgtggaaaatgcaattcgccatggacagcaaaactttcctgaaagctttgagtatggtatgtctattctgtaccactgcaagaaaggcttttatctcttgggtagtagtgctttaacttgcatggccaatggactgtgggatcgatcactgccaaagtgcttggcgatatcctgcggacaccctggagtacctgcaaatgccgttctgactggtgaacttttcacgtatggcgccgtggttcactattcttgcaggggatcagagtccctgatcggcaatgacactcgggtttgccaggaggactctcattggtcaggcgccctgcctcattgcactggcaataacccaggtttttgcggcgacccaggtaccccagcccacggaagcaggctcggtgacgacttcaaaaccaagagcttattgcggttttcttgcgaaatgggtcaccagctaagaggttcacctgagagaacatgcctgctaaatgggtcctggtccggtcttcagcccgtgtgcgaggcagtcctgtgcccccagccaccccccgttcaaaacgggaccgtggaaggcagcgatttcagatggggaagcagcatatcttactcatgtatggatgggtatcaactctcccacagtgctattctctcatgcgaaggacgtggtgtgtggaagggagagattcctcagtgccttcccgtcttttgtggggatccaggtatcccggcagagggcaggctttctgggaaaagctttacctataaaagcgaggtcttctttcaatgtaagagcccatttatcctggttggaagtagccgaagagtttgccaggctgacggcacatggtccgggatccagcccacttgtattgaccctgctcacaacacctgcccggacccaggaacaccccattttgggatccagaatagtagtcgggggtacgaagtgggctcgacagtgttctttaggtgtcgaaaagggtaccacatccaggggtccacgaccagaacatgccttgcaaatctcacctggtccggtatccagaccgagtgcatcccccacgcttgccggcagcccgagactccagcgcacgcagacgtgagggctattgacctgccaacctttgggtatactttggtctacacgtgccatccagggtttttccttgccggcggctcagagcaccgcacatgcaaagctgatatgaagtggactggcaaatctcctgtctgcaaaagcaaaggtgtgcgggaggtcaatgaaacagtaacaaagacgcccgtgcctagcgacgtgtttttcgtgaatagtctgtggaaaggatattatgaatatctaggtaagaggcagccagccacactcacagtcgactggttcaacgccactagttcaaaagtcaacgccacattttccgaggcaagtcctgtcgagctgaagctcacgggcatctacaagaaggaggaggctcacctcttgctcaaagctttccagattaaaggacaagccgacattttcgtgtcaaagttcgagaatgataactggggcctggatggatacgtaagttccggactggagagggggggctttacatttcagggcgacatacacggcaaagatttcgggaagtttaagttagaacgccaggacccgttaaaccctgaccaggactctagtagccattaccatggcacaagtagcgggtctgtggccgccgccatcctcgtacccttcttcgcgctgatccttagcggattcgcgttttacctgtataaacataggactcgtccaaaagtgcagtacaatggctatgccggccacgaaaattccaatggacaggcttccttcgagaaccccatgtacgacaccaacctgaaaccaactgaggccaaggctgtgcgtttcgacactacccttaacacagtgtgtactgtcgtgtag

SEQ ID NO: 184103 - DNA, 10698 bp, Artificial Sequence
  Description of Artificial Sequence: Synthetic coding sequence
atgaccgcctggcggcggttccagagcctgctgctgctgctgggccttttggttttgtgtgcaagactactgaccgccgctaaaggtcaaaattgtggcggcctggtgcaaggccccaacggtaccatcgaatctcctggatttccccatggatatcctaattatgccaattgcacatggatcatcatcactggggagcgcaaccggatacagctgagctttcatactttcgctcttgaagaggactttgatattctttccgtctacgatggccagcctcagcaggggaatttgaaagtacgattgtctgggttccagcttccctcttctatcgtcagcaccggcagcatcctcacactctggtttacaacagattttgccgtatctgcccaggggttcaaggctttgtatgaagtcttgcccagccacacctgcggtaatcctggcgaaattctcaagggggtgctgcatggcacccggttcaatatcggcgataagataagatactcatgcctccccgggtacatattggagggtcacgctatccttacatgtatcgtctcaccaggaaacggcgctagttgggatttccctgcaccgttctgccgggcagaaggagcctgcggtggaaccctgaggggaacctcctcatccatctcatcacctcacttcccctctgaatatgagaacaatgcagactgtacatggactatactggccgagcccggggataccattgcactggtcttcaccgacttccaactggaggagggctacgatttcctggagatatcaggaacagaggcccctagtatctggctgacaggaatgaacctgccatcgcctgtgatttcgtccaagaactggctgcgacttcacttcacttctgatagtaaccatcggagaaagggatttaatgcccagtttcaggtgaagaaggccatcgagctcaagtccaggggcgtcaaaatgctgcctagtaaagacgggagtcacaaaaactctgtgctgagccaagggggcgtggccctggtcagcgatatgtgtcctgaccccggtattccagaaaatggccggagagccggcagtgatttcagcagggtcggagccaatgtgcaatttagttgcgaggacaattacgtcctgcaaggatctaagagtataacatgtcagagggtgactgagacacttgctgcctggagcgatcaccgcccaatctgccgcgcgcgaacctgtggctctaaccttcgcgggccttcaggcgtgattacttcgcctaactaccctgtgcaatacgaagataacgcacactgtgtttgggtgatcaccactaccgaccccgataaggtgattaaactggcattcgaggagtttgagctcgagcgcggatacgatactctgaccgtgggtgacgccggaaaggtcggtgacacaaggtccgtcctgtacgtgcttaccggatctagcgtgcccgacctgatagtctccatgtccaatcagatgtggctgcatctgcagagcgacgattccataggttcaccagggtttaaagccgtctaccaggagatagagaaaggaggctgtggtgacccaggtatccccgcttatggtaagagaactggctcatctttcctgcatggagacaccctgaccttcgaatgtcccgcggccttcgagctggttggtgaacgcgtgataacttgccagcagaacaaccagtggagtggaaataagcccagttgcgtattctcctgcttcttcaactttactgctagctcaggaattattctctctccaaactaccccgaggaatatgggaataatatgaattgtgtgtggcttatcatttctgaacccggatccagaatccatctcatctttaatgacttcgatgttgaaccgcagttcgattttctcgccgtgaaggatgatggcatcagtgatattaccgttttgggaacttttagcggaaacgaggtgccctcccagctggcctcctctggacacattgtacggctggagtttcagtccgatcactcaaccaccgggcgcggatttaatattacttacacaacctttggtcagaacgagtgccacgaccccgggatccccattaacggacgtcggttcggtgaccggtttctcctaggctcatcagtttccttccattgcgacgatggctttgtgaagacccaaggctccgaatccatcacgtgcattctccaagatggtaatgtcgtgtggtcatcgaccgtcccccggtgtgaagccccatgcggcggacatcttacagccagttcaggggtaatcctgcccccggggtggcctggatattataaagactcactgcactgcgagtggattatcgaagctaagccgggacattcaatcaaaatcacattcgatcgcttccagaccgaggtgaattatgatacactggaagtgcgggacggtccagcttctagttctccactgattggcgaatatcacggaacccaggccccccagtttttgatctccacggggaattttatgtatctcctctttacgacggacaacagtaggagctctataggcttcctcatccattacgaatccgtgacattagagagcgattcttgcctggaccccggcataccagtcaatggtcatcgccacgggggcgatttcggaattcgctcgacagtgactttttcatgtgatccaggatacaccctctctgacgacgaaccattagtgtgtgagcggaatcatcaatggaaccatgcactgccaagctgtgatgcgctttgtgggggctatatccagggcaaatccgggaccgttctttcacccggttttcccgatttctatccaaattctctgaactgcacttggacaattgaagtatcacatggcaagggtgtgcagatgatctttcacacctttcatctcgagtcctcccacgactatcttttgatcacagaagatggaagcttttctgagccagtcgccagacttacagggagtgtgctcccccatacaattaaggctggacttttcgggaacttcactgcccaattacgttttatttccgacttcagcatcagctacgagggatttaacatcacctttagcgaatacgacttggagccctgcgatgatcctggcgtacctgcattcagccgacggatagggtttcatttcggggtgggagattcactgactttctcctgcttcctcggatatcgactggagggggccactaagctgacttgcctgggcgggggcaggcgcgtatggtccgcacccctgcccaggtgcgtggccgaatgtggtgccagcgtgaaaggcaatgagggtactttgctgagtcctaacttcccatcaaactatgacaataatcacgaatgtatctataagatcgagaccgaggccggcaaaggtatacacctgcgcacaagatcattccagttattcgagggcgacacactcaaggtttacgatggcaaggattcttcaagtagacccctgggaacctttaccaagaatgagttgctcggcctaatcctaaactctacctccaaccatctgtggctggaattcaataccaatggcagtgatacagatcagggtttccaactgacctacacttcctttgatctcgtgaagtgcgaggatcccggaatccccaactacgggtaccggataagggatgagggccattttacagatacagtggtgttgtattcctgcaaccccgggtatgctatgcacgggtcaaacacattgacctgcttaagcggagacagacgggtgtgggacaagcctctgccttcatgcatagctgagtgtggaggccagatccatgccgccacatcaggacgtattctgtctcctggttatcccgccccctatgacaacaacctgcactgtacttggatcatcgaggctgaccccgggaagaccatatcattgcacttcattgtgtttgacacagagatggcccatgatatactgaaggtttgggacggaccagtcgattcagacattttgctcaaggagtggagcgggtccgcattgcccgaagatattcactctacttttaacagcttaactttgcagtttgattccgatttttttatatccaagtccggcttctctatccagttttctacctccattgctgcaacctgcaatgatcccgggatgccacagaatggaacgagatacggcgattctcgagaagcaggcgataccgtgacttttcagtgcgatcccggctatcagctgcaggggcaagccaaaattacatgtgtgcagctgaacaaccgctttttctggcagcccgatccccctacttgcattgctgcctgcggtgggaatctcaccgggcctgctggggtgatcctaagccctaactatcctcagccctatcctcccggaaaggagtgtgattggagggtcaaagttaaccccgattttgtcatcgcgctgatttttaagagcttcaacatggagcccagctacgactttctgcacatctacgagggagaggactccaactctcccctgatcggatcttatcagggctctcaggcaccagaaaggatcgagtccagcggcaattctctgttcctggcctttcggtcagatgcaagcgttggtttgtcaggcttcgccatcgaatttaaagaaaagcccagggaagcatgctttgacccaggaaatatcatgaatggtactcgcgtcggcacagactttaagctcgggtcaactatcacataccagtgcgacagcggatacaagattctggacccatcatctattacctgtgtgatcggagcagatgggaagccctcctgggaccaggttctcccctcttgtaacgcaccttgtgggggtcagtacacagggagcgaaggagtcgtcttaagcccaaactaccctcacaattacactgccggacagatttgcctgtacagcatcaccgtgcccaaggagtttgtcgtgttcggtcagttcgcatacttccaaaccgcgctgaacgacttagctgagctttttgatggtacgcatgcccaggctaggctgctgagcagcctgtccggttcgcactccggtgagaccctcccactcgcaacctccaaccaaatactactcaggttttctgccaaatctggggcatctgccaggggctttcatttcgtgtaccaggcggtcccgagaactagcgacacgcagtgttcttcggtgcccgagcctcggtatggacgccgcatagggagcgagtttagcgccggctccatcgtgcggtttgaatgcaaccctggctacttacttcaggggtcaaccgccttgcattgccagagtgttccaaacgccctcgcgcagtggaacgacacaattcctagctgcgtggtgccgtgctccggaaacttcacgcaacggcgcgggactattttgagtcctggctatcctgagccatatggcaacaacctgaattgcatttggaaaattatcgtgaccgagggctccggcatccagattcaggtgatctcatttgcaactgaacagaattgggactcactggaaattcatgatggcggcgatgttaccgcgcctcggctggggagtttttctggtactactgtacctgctctgctcaattccactagtaatcagctgtacctgcactttcagagtgatatctctgtcgccgctgccgggtttcatctcgaatacaaaacagtgggtctcgcagcctgtcaggagcctgccctgccttctaacagtatcaagattggagatagatacatggtcaacgatgttctctcattccagtgtgagccgggctacaccctgcaggggcgatcacacatctcttgcatgccggggacagtgcgccggtggaactacccttcaccactgtgcatcgcgacctgcggcggcacgttaagcacactgggcggcgtgatactgtcacctgggttccctggctcctatccaaataatcttgactgcacatggcgtataagcctccctatcggctacggcgcacacattcagttccttaacttttccacagaggcgaaccacgatttcctggaaatccagaacgggccttatcatactagcccaatgatagggcagttcagcggcacagacttgcctgccgccctcctgtcaaccacacatgagacactgatacacttctactcagaccacagccagaaccgtcaggggtttaaactcgcctatcaggcctacgagctccagaactgccccgatccacccccgtttcagaatggatacatgataaatagcgattactctgttggccagtcagtgtcttttgaatgttatccagggtatatcctgattggccatccggtgctcacctgtcagcacggaatcaaccggaactggaattatcccttcccacgctgcgacgctccctgtggctacaacgtgacttcccaaaatgggaccatctactcacctggatttccggatgaataccctatcctgaaagactgcatctggttgattacggtgccacctgggcatggagtatatattaacttcactttgctacaaaccgaagctgtgaacgactacattgcagtgtgggatggacccgatcagaactcacctcagctgggcgtctttagtggaaatacagccctcgaaactgcatattcctctacgaaccaagtactgctcaaatttcactctgacttcagcaacggcggattttttgtactaaatttccacgcgttccagctaaaaaagtgtcagccaccccccgcagtcccacaggctgagatgctgactgaggatgatgactttgagattggggatttcgtcaaataccaatgtcaccccggttatacgctggtgggcacagacattttgacctgtaagctgtcatcacaacttcaattcgagggaagtctgcctacatgcgaagcccaatgccctgccaacgaggtgcgcacagggtcctcaggagtaattctgagtccagggtatccaggaaattacttcaactcccagacctgctcttggagcatcaaggtggaaccaaattataatataactatcttcgtggacacttttcagagcgaaaagcagttcgacgccctggaggtcttcgacggaagctccggacagagcccccttctggtggtcttatccgggaatcacactgagcaatccaacttcacctctcggagcaatcaactatacctgagatggagcacggaccatgctacgtcaaagaagggttttaaaataaggtacgctgccccttactgctccctcacgcatcctctcaaaaatggcggaatcctgaaccgaaccgcaggagctgtgggatctaaggtgcactatttttgtaaacctggctacaggatggtcggccactccaacgcaacttgtaggcgcaatcctctgggtatgtaccagtgggactctctgactcccctgtgtcaggcagtctcttgcgggatccctgagtcgccaggcaatggcagctttacaggcaatgagttcactttggacagtaaggtagtgtacgaatgccacgaaggctttaagctcgaatcctctcagcaagccacagctgtatgccaggaggacgggttgtggagtaataaagggaagccccctacctgtaagccggtggcgtgtccgtcaatcgaggctcaattatccgagcacgtcatatggcgcctggtgtcaggttccctgaacgaatatggggcacaagtcctcctgtcgtgttcaccgggctactacctggaggggtggagattgcttcggtgtcaagcgaatgggacttggaatattggggacgagagaccatcctgccgggtcatctcttgtggctctctgtcattccccccaaacggcaataaaataggcaccctcactgtgtatggcgccacggccatcttcacctgcaatacaggttacacccttgttggcagccacgttagggaatgcctcgccaacggactatggtccggcagcgaaacccgttgtctcgccggacattgcggctctcccgatccaatcgttaatggacatatctcaggggacgggttctcatatcgcgatactgttgtctatcagtgtaatcccggcttcagactcgtgggcacctctgtgcgaatctgcctacaggatcataaatggtcaggacaaacgcccgtgtgcgtgcccattacatgcggccatcctgggaaccccgcccatggttttactaacgggtccgagttcaatctcaacgacgtggtcaacttcacttgcaacactggatatctcctccagggggtgagtcgagcccaatgcaggagcaacggacaatggtcatctcctctgccaacctgtagggttgtcaattgctctgacccagggttcgtcgaaaacgcaatacggcatggacagcaaaatttccccgagtcttttgagtatggtatgagtatattgtaccactgcaagaagggcttctacctactcgggtcttctgcactcacttgtatggctaatggtctgtgggatcgtagcctccccaagtgtctcgccatctcctgtggacaccctggggttccggccaatgcagtgttgacaggggagctctttacatacggagccgttgtgcattattcctgcagaggaagcgaatccctcatcggcaacgacactcgggtgtgtcaggaagatagccactggtcgggcgccctaccacactgcacgggtaacaatcccggcttctgtggggatccgggcaccccggcgcacggatctaggctcggagatgacttcaaaaccaaaagtctccttcggttctcatgtgaaatgggacatcagctgcgggggagtccagaaaggacatgcctgcttaatggttcatggtctggattgcaacccgtgtgcgaagccgtttcttgtggaaacccgggaacacccacaaatggtatgatcgtctcatcagatggcatcctgttctcctcttccgtgatctacgcgtgctgggaaggttacaaaacttccgggcttatgactaggcactgcacagccaatggtacgtggactggaacagccccggactgtaccattatctcatgtggcgatccaggcacgcttgcaaacgggattcaatttggcacggatttcacatttaacaagaccgtctcttaccagtgtaacccgggttatgtcatggaagcagtgacatccgccacaattagatgtaccaaggatggcagatggaatcccagcaaaccagtttgcaaagctgtcctctgtccccagccccctcccgtgcaaaatggaacagtggagggatcagacttccgctggggatcatctatctcctacagttgcatggacggctaccagctatcacacagtgccattctttcatgtgaagggcgaggcgtgtggaaaggcgaaatcccacagtgtctgcctgtgttttgcggagatcccggtatacccgccgagggcagactgagtggcaaaagctttacctacaaaagcgaagtattcttccagtgtaagtccccttttatattggtcgggtcatcacgccgagtgtgtcaagctgatggcacttggagcggaatccagcctacctgtattgaccccgcacataatacctgccctgatccggggactcctcactttgggatccaaaattcgtccagaggatatgaagttggtagcactgtgttttttcgctgccggaaggggtatcatatccagggtagcactactaggacctgcttagctaacttgacgtggagcggaatccagacggagtgtattccccacgcctgtcggcaacctgagactcccgcgcacgccgatgttagggccattgatctgcccacttttggctatacgctggtgtacacatgtcaccccggattcttcctagccggcggatctgaacatagaacgtgtaaagcagatatgaagtggactggaaagtcaccggtgtgcaaaagtaagggggtcagggaggttaatgagactgttactaaaacccctgtgccttcagacgtgttcttcgtaaactcactctggaagggctattatgagtacctcggcaaacgccagccagccacgctgacggtggattggtttaacgccaccagtagtaaagttaatgctactttctcagaggcatctcccgtcgaactcaagctgactggaatctacaaaaaggaggaagcccaccttctcttgaaggccttccaaatcaaagggcaggctgacattttcgtgtcaaagtttgaaaacgacaactggggactcgacggttatgttagctctggtcttgagagaggaggcttcactttccagggggacatacacggtaaggactttggtaaattcaagctggagcgccaagaccccctgaacccagaccaagactcaagttcgcactatcacggtacttcgtctgggtccgtggccgcggctatcctggtccccttcttcgcactaatcctgtctggttttgcattttacctgtacaaacaccgcacccgcccaaaagtgcagtacaacggctacgcaggacacgagaactcaaatggacaggctagttttgaaaaccccatgtacgacaccaatctgaaacctaccgaggccaaggcggtcagattcgataccacgctcaacaccgtctgtacagttgtatag

SEQ ID NO: 184104 - DNA, 10695 bp, Artificial Sequence
  Description of Artificial Sequence: Synthetic coding sequence
atgaccgcctggcggcggttccagagcctgctgctgctgctgggcttgcttgtgctctgcgcacggctgctgacagccgccaaaggtcagaattgcggcggactggtccagggtcccaacggcacaattgagtctcccggtttcccgcatgggtatcctaattatgccaactgcacttggattatcataacaggagaacgaaataggatccagctgtccttccatacttttgctctagaagaggacttcgacatcctttctgtgtatgatggacagccccagcaggggaatctcaaagtgaggttgtctggctttcaactgcccagctccatcgtatctaccggttcgattctcaccctctggttcacaaccgacttcgccgtgagcgcccagggttttaaggcactgtacgaggtccttccctctcacacctgtggcaatcccggagaaatattaaaaggtgtccttcatggcacccgttttaacataggcgacaagatccggtacagttgccttccaggctacattctggagggtcacgccattctcacatgtatcgtgtcacctggtaacggcgcctcctgggacttccccgccccgttctgccgggccgagggcgcttgtggtggcactctcaggggtacctcctcttccattagcagcccccattttccatctgaatacgagaataacgccgattgtacatggacaatccttgccgaaccaggggacaccatcgctcttgtgttcaccgacttccagttggaagaagggtacgactttctagagatttctgggacagaggccccttctatctggctcaccggcatgaatctgccctccccagtgatctcatcgaagaactggctgcggttgcacttcaccagcgattctaatcatcggcggaagggattcaatgctcagttccaagtaaagaaggccatcgagctgaagtcgcgaggagtgaaaatgctgcccagtaaggacggctctcataaaaacagcgtcctgtcgcagggaggtgtcgcactggtgtctgatatgtgtcccgatcccggcataccagagaacggacgccgtgctgggagcgatttcagagttggtgccaacgtccagttctcgtgtgaggataattatgttctgcagggatccaaatcaattacttgtcagagagtcaccgagacacttgccgcgtggtccgaccaccggcctatctgccgcgcccgcacctgtgggagcaacctgaggggtccatccggtgttataacatctcctaattaccccgtacagtacgaggataacgctcactgcgtgtgggtgattacaacgacagatcctgacaaagttatcaaactcgcattcgaagagtttgagctagaacgggggtacgacacactgactgtcggagacgccggaaaggtcggggatacccggagcgtgctgtacgtcctgacaggctcctcggtgccggacctcatagtctctatgagtaatcagatgtggttacatctgcagtccgatgactccatcggatctccagggttcaaggccgtgtatcaggagattgagaaaggagggtgcggcgatccaggaataccagcttacggtaagagaacaggaagctcgttcctccacggcgatacactgactttcgagtgccccgcagccttcgaactggtaggcgaaagggtcattacctgccagcagaacaaccagtggtcgggaaacaaaccttcttgtgtgttcagttgcttttttaatttcactgcctcatctgggatcatcctgtctccaaattatcccgaagagtacggaaacaatatgaattgcgtctggctgatcatcagcgagcccgggagccgcatccacctgatttttaatgatttcgatgtcgagcctcagttcgactttctagcggtgaaggacgacgggatatccgatattacggtacttggaacattttccggtaatgaggtgccctcacagctggcctcctcaggacatatcgtaagactggaattccagtccgatcattctactacgggcaggggattcaatattacctatactacattcggacagaatgaatgccacgatccagggattcccattaacggaagaagattcggagataggtttttattgggcagcagtgtgagcttccactgtgacgacggatttgtgaagactcaggggagcgagtctatcacctgcatcctacaggacggtaacgttgtgtggagttctactgtgcctcgctgcgaggccccgtgtggtggtcatctgaccgcttcatccggtgtgatcctgcctcccggctggcctggatactataaagacagcctacactgtgaatggattatagaagcaaagcctggacatagtatcaagatcacttttgatagattccagacagaagtgaactatgatacgctggaggttagagatggcccagcttcaagcagtcccttaattggcgaataccatgggacacaggccccacaattcttgatttcaactgggaacttcatgtacttgctgttcaccaccgacaattctcgttccagtatcggtttcttaatccattacgaatctgtgactctggagtccgatagctgcctcgaccctggcatacctgttaatggacatagacacggaggtgactttggcatcaggtctacagtgaccttcagctgcgacccgggttacacgctctccgatgacgaacctctggtttgcgaacgtaaccatcaatggaatcacgccctcccttcttgtgatgccctatgtggcggctacatccagggcaagtctgggactgtgttgagccctggcttccccgacttctaccctaatagtttgaactgtacatggaccatagaggtgtctcatggtaagggggtgcagatgatcttccacactttccacctggagagctcacatgattaccttttgattactgaggacggtagctttagtgaacccgtggccagattgaccggctccgtcttgccgcataccatcaaggcgggtctcttcggcaatttcactgcacagctgagatttatctccgacttctccattagctatgaaggatttaacattacatttagtgagtatgacctggagccctgcgatgaccccggtgtcccagccttttccagacgaattggctttcactttggggtgggggattcccttacattctcctgtttcctaggttatcgactcgaaggcgcaacaaaactgacgtgtttaggcggtggacgacgggtgtggagtgctcctctccctcgatgtgttgcggagtgtggcgcatccgtgaagggaaacgagggaaccctgctctcccccaactttcctagcaactacgataacaatcacgaatgtatctataagatcgaaactgaggcgggaaaaggcattcacttacgtacccgctccttccagctcttcgagggcgacactctcaaagtgtacgatggtaaagactcttccagccgccccctgggaacctttaccaagaatgagttgcttggcctgattctgaacagcacttccaaccacctctggctggaatttaacaccaatgggtctgataccgatcagggtttccagctgacttacacgtcatttgatcttgtgaagtgtgaagatcctgggatccccaattatggatacagaattcgagatgagggccattttaccgatacagttgtgctgtacagctgcaatcccggttacgcaatgcacgggtcaaacacactgacctgcttatcgggagatcgccgggtatgggacaagcccctgccttcttgcatcgccgagtgcggcggacaaattcacgccgccaccagcgggagaattctctccccaggctacccagcaccatatgacaataacttgcactgcacttggatcatcgaagcggacccaggtaaaacgatcagcttgcacttcatcgttttcgataccgagatggcgcacgatatcttaaaggtgtgggacggccctgttgattcggatattctcctgaaggagtggagtgggagcgctcttccagaggacattcattccacttttaactctcttacattgcagtttgatagtgatttctttatatctaagagtggattcagcatccagttctcgactagtattgcagccacatgcaatgaccccggcatgcctcagaacggtacaaggtacggcgattccagagaagcaggggataccgtgacattccagtgtgatccagggtaccagttgcaaggccaggcaaagatcacctgtgtccagctcaacaatcgttttttctggcagcccgatccaccaacgtgtatcgcagcctgcggcggcaatttgacgggccctgcaggagtgatcctgtctcccaattacccccaaccatacccacccggcaaagaatgcgattggcgggtcaaggtgaatccagattttgtgattgctctcatcttcaaatcttttaatatggagcctagctatgattttctgcacatctatgagggagaggattcaaactctcccctgatcggatcttaccagggtagccaagcgcccgagcgaattgaatcttctggcaattcgctatttctggcatttagatcagacgcttcagtcggactttctggattcgcaatcgagtttaaggaaaagccccgcgaggcatgtttcgacccagggaacatcatgaacgggaccagggtgggaactgattttaaactgggatcaaccatcacataccagtgcgatagtggatataaaatactcgatccatcatcgatcacctgcgtcatcggcgctgacggtaaaccatcttgggaccaggtacttccatcctgtaacgccccatgtgggggacagtacactggctctgagggggtcgtgctgtctccgaactatccccataactatacagccggccagatctgcctttactctatcaccgtgccaaaggagtttgtcgtgtttggtcagtttgcgtacttccaaacagcgctcaacgatctggcagagctgttcgatggtacccatgctcaagcaaggctgctcagttcccttagtggtagccacagcggcgagactctgccactcgcaactagtaatcagattcttcttcgcttctccgcaaaatcaggcgcttccgcccgaggctttcactttgtgtaccaggctgtgcccagaaccagcgatactcagtgttcatctgtcccagagccgcgatatggcaggaggattggatcagaattctccgccggatctatcgttcgattcgaatgcaatcctgggtatctgctacagggttcaaccgcactgcactgccagagcgtgccaaatgccttggctcaatggaatgacaccattccttcttgcgtcgttccgtgttcagggaactttactcaacgacgcggtactatcctcagtccgggatatccggagccatacggtaacaacctgaattgcatctggaaaattattgtgacagaggggtctgggatccagatccaggtgatcagttttgctacagagcaaaattgggacagtctggaaatccacgacggcggagatgttactgctcccaggctggggtccttcagcgggaccactgtccccgcactgctaaactccacatccaatcagctataccttcactttcagtctgacatctctgtggcagccgcaggctttcacctcgagtacaaaacagttggcctggcggcatgccaagagcccgctctgccttctaactcgatcaaaataggagaccgctacatggtcaacgatgtactgtctttccagtgcgaaccaggatataccctccaaggaaggtcccatattagctgtatgccaggcaccgtgagacgttggaactatccttctcctctgtgcatagccacatgcgggggcacattgtcaacccttggtggggtgattctcagtccgggatttccagggtcttaccctaacaacctagactgcacatggcggatcagtcttcccattggatatggagctcatattcagtttctcaatttcagcaccgaggccaatcatgattttctggaaatacagaatggcccttaccacacttcccctatgattgggcagtttagcggcaccgacctgcctgcagccctgttaagtaccacacacgaaaccctgattcacttctactccgatcattcccagaaccgccagggttttaaactggcgtaccaagcatatgagcttcaaaattgcccagacccacccccatttcagaatggctacatgattaactccgactattcagtcgggcaatctgttagctttgaatgctaccctggttacatcctgattgggcatcctgtccttacttgccagcacggtatcaacagaaattggaactatcccttcccccgctgcgatgcaccttgcggctacaatgttacctcccagaatgggaccatctactcgccaggttttccggacgaatatccgatactgaaagactgcatttggctcatcacagtgccccccgggcatggtgtttacatcaatttcactttgctacagaccgaagctgtaaatgattatatcgcagtttgggacggccccgatcagaatagtccccagttaggagtgttttctggaaataccgccttggaaacggcctacagttctactaaccaggtactactgaagttccacagtgacttcagcaatggaggcttctttgtgctcaactttcacgccttccagctgaagaagtgtcagcctcctcctgcagtgccccaggccgagatgttgactgaagatgacgatttcgagatcggcgatttcgttaagtaccaatgccaccccgggtacacccttgtcggaaccgatatcctgacctgcaaattgtccagccaactgcaattcgaaggtagcctaccaacttgtgaagcacaatgtccagcaaacgaagtgagaaccggatcaagtggtgtgatcctgagcccagggtatccgggcaactactttaattcgcagacttgctcctggtcgattaaggtagagcctaactacaatatcacgatttttgtcgataccttccaatcggaaaaacaattcgacgcactggaggttttcgatggatctagcggccagtctcccctgctggtggtcctgagcgggaaccacactgaacaatcaaattttacttccagaagtaatcagctgtacctgcggtggagcaccgaccatgcaacatccaagaagggatttaagataaggtacgccgccccatattgtagtttgactcatccgctgaagaacgggggtattcttaaccgtacagcaggcgccgtgggcagcaaggtccattatttttgcaagcctggctaccgcatggtcgggcactctaacgccacctgccggagaaatcccttaggcatgtatcagtgggatagcctcacccctctgtgccaggccgtttcctgtgggatacctgagagccctggaaatggttcatttacagggaatgaattcaccctagacagtaaggtggtgtatgaatgtcacgagggttttaaattagagtccagccaacaggccactgccgtttgtcaggaggacgggctctggagcaacaaaggaaagccgccgacatgtaagccggtcgcttgccctagcatcgaagcccagctttcagaacatgtgatctggagactcgtttccggaagcctgaacgaatacggcgcccaggtgttgttgagctgctcccccggctactatttggagggctggaggcttcttcgttgtcaggccaatggcacatggaacataggagacgaaagaccaagctgtcgagttatctcctgtggttctctgtcttttccccctaatggaaataagattggtaccctgacggtgtacggggcaaccgcaattttcacctgcaatactggttacactctcgtgggatcacatgtaagggagtgcctcgccaacggcctctggagtgggagtgagactaggtgtcttgccggacactgcggctcaccagatcccattgttaacggccatatcagtggtgacggatttagctatcgggacacggttgtataccagtgcaatcctggcttccgcttggtgggcacctccgtgaggatctgcttacaagatcacaaatggagcgggcagacccccgtgtgcgtccctatcacctgtggccacccagggaatcccgcacacggattcacaaacggcagtgagttcaaccttaatgacgtagtcaatttcacgtgtaacacaggatacctcctccagggcgtctcacgggcacagtgccggtccaatggccaatggagtagtcccttgcctacctgtagagtggtaaattgttccgaccccgggtttgtagagaacgcaatacggcatggacagcagaatttccccgagagtttcgaatatggcatgtccatactgtaccactgcaagaagggcttctatcttcttggctcatccgctctgacctgcatggctaatggactgtgggaccgctcattacctaaatgcctggctataagttgtggccatccgggcgtgcccgccaatgcagtcctgaccggtgaactgttcacctacggcgccgtggtccattattcctgtagagggtccgagagtctcatcggcaatgacactcgcgtgtgtcaggaggatagtcactggtcaggcgccctgccccactgcacaggcaataaccccggcttctgcggggaccccgggactccagcgcatggaagccgcctaggcgacgactttaaaacaaagtcacttctgagattcagctgtgagatgggacaccagctcagggggtcccctgaacgtacttgcctcctgaatggctcctggtctggcttgcagccagtgtgcgaggccgtaagttgcggcaaccccgggacccccaccaatggcatgattgtatccagcgacgggatcctgttctcatcctccgtaatttatgcctgttgggagggctataagactagcggcctgatgaccaggcactgcaccgcaaacgggacgtggactggcactgctcccgattgtactataatttcatgcggggatccagggacacttgctaatggcattcaattcggtacagactttacttttaacaaaactgtgtcatatcagtgcaatccgggctacgtgatggaggccgtcacttccgctacaattcgatgtactaaagacgggcgctggaatccctccaaacccgtttgcaaagccgtgttatgcccacagcctccacctgttcagaacggaaccgtggagggatccgacttcaggtgggggtctagtattagctatagttgtatggacggataccagcttagccactctgccatcctctcgtgtgagggtcggggtgtttggaaaggcgaaattccccagtgtctgcctgtattctgcggggaccccggtatccctgccgagggacgcctgtcgggaaagagtttcacctacaaatctgaggtattcttccaatgcaagagtccctttatactggtcggaagctctcggcgtgtgtgccaagcagatggcacgtggagcgggatacaacctacctgcattgacccagcccataacacctgtcctgatcccggtaccccacatttcggaattcaaaactctagtagagggtacgaggtgggatctaccgtgttcttcaggtgtcggaaagggtaccacattcaggggtcgaccacccggacctgtctggcgaatctgacatggagcggaatccaaacagagtgtattccgcacgcctgccgtcagccagagacaccagcccatgcagacgtgagggcaattgacctgcccacattcggctacaccctggtgtatacatgccatccaggcttctttctagcgggcggctctgaacatcgtacctgtaaagctgatatgaaatggaccgggaaatccccagtctgcaagtcaaagggcgtaagagaagtgaatgagacggtgacaaaaacccctgttccttctgacgtgttcttcgttaactctttgtggaaaggatattatgagtatctggggaagaggcagcctgccacactgacagttgattggtttaatgctacaagctctaaggtgaatgctaccttctccgaggcgtcccccgtagagctgaagttaacagggatctacaagaaagaagaggctcatctactgcttaaggcatttcaaatcaagggccaggcagatatttttgtaagcaaattcgagaatgacaactggggactggatggatacgtttctagcggcctcgaaagaggcgggtttacctttcagggagacatccatgggaaggatttcggcaagttcaaactcgagcggcaggatcctctcaaccccgaccaggactccagctcacactatcacggcacttcttcagggtccgtagcggccgcaattttggtacccttcttcgctttgatcctgagcggctttgcattctacctgtataaacaccgcaccaggcctaaggtccagtacaacggttatgcagggcatgagaatagcaacggacaggctagtttcgagaatccaatgtacgataccaatctgaagccaaccgaagccaaggctgtacggttcgacacaacattgaatacagtctgcaccgtggtatag

SEQ ID NO: 184105 - DNA, 6330 bp, Artificial Sequence
  Description of Artificial Sequence: Synthetic coding sequence
atgaccgcctggcggcggttccagagcctgctgctgctgctgggccttctagtcctgtgtgctagactcctgactgctgcaaaggggcagaactgtggaggactggttcaggggcctaacggcaccatagagagccctggctttcctcatggctacccaaactacgctaattgcacttggattattattactggggagcgcaatcgcattcagctatcattccacacctttgcccttgaggaggatttcgatatcctgagcgtatacgatggacaaccgcagcaaggaaacctgaaggtgcgcctcagtggctttcaattgccttccagcatcgttagcacgggttccatccttaccctgtggttcacaaccgattttgccgtgtcagctcaagggtttaaggctctgtatgaggttctccctagccacacctgcggaaatcctggcgagattttgaagggagtgctgcacgggacccgcttcaacattggcgataagatccgctactcttgtctccctggctacatcttggagggccatgccattctgacctgcatcgtttcccctgggaacggggcctcatgggatttcccagcgccattctgccgtgcagagggggcgtgcggcggcaccctgagagggactagttcaagcattagcagtcctcatttcccttctgagtatgagaacaatgccgactgcacctggacaatcctcgcagagcccggcgacacaatcgctttggtgttcactgacttccaactagaggagggttatgactttctcgaaatatcagggaccgaggccccgtccatttggcttactggcatgaatttgccttctcccgtaatttcttccaagaactggctgcgactgcactttacctctgactccaatcaccgtagaaagggcttcaatgcccagttccaggtgaagaaagctattgagctgaagagtcgcggagtcaagatgctcccaagcaaagatggcagccataagaattcggtactgagccagggcggtgtggctctggtttccgacatgtgcccggaccccggaattccagaaaacggtcgtcgagcgggatctgactttagggtgggtgccaatgtgcagttttcctgtgaagacaactatgtactgcagggtagcaaatcaataacatgccaacgagtcaccgagactctggcagcatggagcgatcatcggcccatctgcagagcgagaacttgtggatccaacctgaggggaccctcgggtgtgatcaccagtcctaactacccagtacagtatgaggacaacgcccactgtgtgtgggtaatcactaccactgatccagataaggtgattaagctggctttcgaagagtttgagctcgaacggggctatgacactttaacagtgggcgatgcgggtaaggtaggcgatactaggagcgtcctttatgtccttacagggtcctccgtgcctgacctgatcgtctccatgagcaaccagatgtggctgcatctgcagtccgacgattccatagggtctcccgggtttaaggcagtgtatcaagaaattgaaaagggaggatgtggagaccccggcattcccgcgtatggtaagcgcaccggctcctctttcctgcacggcgatactctgacatttgaatgtccggccgcttttgagctggtgggagaaagggtcattacttgtcagcagaacaaccagtggagtggaaataagcctagctgtgtctttagctgtttcttcaacttcaccgcttcaagtggcattatcctcagtcccaattaccccgaggagtatgggaataacatgaactgtgtctggctaataataagtgagcccgggtcgcgcatccacttaatcttcaatgacttcgacgttgaacctcagtttgactttttggctgtcaaggatgacggaatttcagacattacagttctcggaaccttttccgggaatgaggtccccagtcagcttgcaagcagcgggcatatcgtgagacttgaatttcaaagcgaccactcaactaccggccgcggttttaacatcacatacaccacattcggtcagaatgaatgtcacgaccctggaatccctattaatggcaggagattcggggatcggtttcttctggggtcctcagtgtccttccactgcgatgacgggtttgtgaagacccaaggctccgaatccatcacttgcatcctccaggatgggaacgtggtctggagcagtacagtgccaagatgtgaagcaccctgcggcggtcatctgaccgcatcttcaggggtgatcttgccgcccgggtggcctgggtattacaaagactctcttcactgcgaatggataatagaagccaaacccggccactcaattaagattacttttgatcgctttcagactgaggttaactacgatactcttgaggttcgagatggcccagcctcatccagtccactgattggggaataccatgggacccaggcaccccagtttttgatcagtactggaaatttcatgtatttgctgtttactacagataattcccgctccagcattggctttctgatacactacgagtcggtcaccctggagagcgactcttgcctagatccgggtattcctgtgaacgggcaccgtcacggaggagattttgggatcaggtctaccgtcaccttctcatgcgaccccggctacaccctcagcgatgatgaacctcttgtctgcgagaggaatcatcagtggaaccacgcactgccgtcgtgtgatgcgctttgtggtgggtacatccagggcaagtccggtaccgtcctctctccaggattccctgacttttaccctaattcactcaattgcacctggacaattgaggtttcccacggaaaaggggtgcagatgatcttccatacttttcacctggagtcatctcatgattatttgttgatcacggaggacggtagcttttctgagccagtggcaaggttgaccgggtcagttctgccccacacaatcaaggccggactctttgggaactttactgcacagctgagatttatcagcgatttctccatttcttacgaaggatttaacattaccttctctgaatacgatttagaaccctgtgatgacccaggggtccctgccttcagtcgccggataggattccatttcggggtgggcgactctcttacttttagttgttttctaggatacagattggagggcgccactaagctgacgtgcctgggaggcggaaggcgcgtgtggtccgctcctttgccccgttgtgtggctgagtgcggcgcttctgttaagggcaatgaggggacgttactgagtccaaactttccatcgaattatgacaataatcatgaatgcatctacaagatagagaccgaggcaggaaaaggcatccacctcaggacacgatccttccaattgtttgagggcgacaccctgaaagtgtatgacggtaaggactcaagcagcaggcccctgggtacatttacaaagaatgaattgctgggcctgatcttgaatagcacctccaaccacctttggctggagttcaacacaaatggttctgatacagaccagggcttccagttgacctacacgtcttttgatttggtgaaatgtgaagaccccgggatcccaaattatggttatcggatccgcgacgaaggacacttcacagatactgttgtcctttactcttgtaaccccggctacgcaatgcatgggtccaataccttgacgtgtctgtctggggatcgcagagtgtgggataagcccctgccttcctgcatcgctgagtgcggcgggcaaatccacgcagctacttctggaagaatcctgtctccaggctacccagccccatatgacaacaatctacattgcacgtggatcatcgaagcagatcctggtaaaaccatttctctgcattttattgtgttcgataccgagatggcccatgacattcttaaggtttgggacggccccgtggactctgatattctgctgaaagaatggtctggctccgccctgccagaagacattcactcaacatttaactccctcaccctgcaattcgatagtgatttctttatttcgaagagtgggttcagcattcagttttcaacctctatagccgccacctgtaatgatcccggtatgccgcagaacgggactaggtacggcgactccagagaagctggggataccgtgactttccagtgcgaccctgggtaccagctgcaagggcaggccaagattacgtgtgtgcagttgaacaaccgctttttttggcagcccgatccaccgacctgtattgccgcctgcggcgggaacctgacgggcccagcaggagttattctgagccctaactacccccagccctaccccccagggaaggaatgtgattggcgagtcaaagtgaatcctgatttcgtcattgctctgatcttcaaatcttttaacatggaaccttcctatgacttcctgcacatttacgagggcgaagactcaaattctccactcattggttcctatcaaggatctcaggccccagaaaggatagagagttcaggaaactctttgtttctcgcctttcggagtgacgccagcgtgggtctgagcgggtttgctatagaatttaaagagaaacctcgggaggcatgctttgatccaggtaatatcatgaacgggacaagggtgggcactgacttcaagctcggaagtaccattacctatcagtgtgattctggttacaaaatactggacccatcctccatcacttgtgtgatcggcgccgacggaaaaccatcatgggatcaggtgctgccttcctgtaacgccccctgcggcggacagtataccggctctgagggagttgtgctttcaccaaattacccgcacaattacacagcaggtcagatctgcctgtatagcatcactgtgccaaaggaattcgtagtgtttggtcagttcgcttactttcagaccgcactcaacgaccttgccgaactgtttgatggcacccacgcacaggcgcggctgctgtccagcctgagtggttctcacagtggggaaacattgccactggccacctccaaccagattttgctgcgattctccgctaaaagtggtgcgtcagcccggggcttccactttgtttaccaggccgtcccaagaacaagcgacacccaatgcagctctgtcccagaaccccgctatgggaggagaattgggtccgaattttctgctggtagcattgttcgctttgagtgcaatcccggttacctgctgcagggcagtaccgcactgcattgccagtcagtgccaaatgccctggctcaatggaacgatacaataccttcatgtgtcgtgccctgctcggggaacttcacgcagcggcgcgggacaatactcagcccagggtaccctgagccctacgggaataatctgaactgtatttggaagattattgtgaccgaaggttcaggcatccaaatccaggtcattagtttcgccactgagcagaactgggacagcttggaaatccacgatggaggtgatgttacagcaccccgactgggcagttttagcggcactaccgtgcctgcactcttaaattccacttccaaccagttgtacctccacttccagagtgatatctcagtggccgcggctggcttccacctggaatacaagaccgtcggtctggccgcatgtcaggagccagccctgccaagtaattccataaagattggcgaccgctatatggtgaatgatgtcctctcctttcagtgcgagcctggatacaccctacaaggtcggtcccatatatcttgtatgcctggcaccgtgagacgctggaactatccctcacctctctgcattgcaacttgcggagggactttgagcacacttgggggggtaatccttagtcccggcttccctggttcctacccaaataacctggattgtacatggagaatctctcttcctattggctacggggctcatattcagtttctgaatttctccacagaggccaaccacgattttctggagattcaaaacggcccttatcatacatctccgatgatcgggcagttttccggcaccgatctgcccgcagcacttttatctactacacatgaaacacttattcatttctattctgaccattcacaaaacaggcagggttttaaacttgcttaccagggcgggtccggcaacatcgggcccgccttcccctgcctcgatacgccctttcaggctcgatgccagggcgaggagcgcaccttcaattag

SEQ ID NO: 184106 - DNA, 10164 bp, Artificial Sequence
  Description of Artificial Sequence: Synthetic coding sequence
atgaccgcctggcggcggttccagagcctgctgctgctgctgggcttgttagtgctctgcgctagactcctgacagccgccaagggccagaactgtggcggtttagtgcagggacccaatggcacaatcgaatcccccgggttcccccacgggtaccccaactacgcaaactgcacgtggataatcattacgggcgagcgaaaccggatacagctgtcattccacacctttgcactggaggaagattttgacatcttaagcgtctacgacgggcagcctcagcagggaaacctgaaagtcagactcagcggattccagttgccatcctccatcgtgtccacaggctccatactgacactttggttcaccacggacttcgctgtttccgcgcaaggcttcaaggccctatatgaggttctgccctctcatacctgcggcaaccccggcgagatccttaaaggggtcctgcacggtacccgcttcaatatcggggataaaattcggtactcatgcctgcctgggtatattctcgaaggacacgccatcctgacctgtatcgtgtctcctggaaacggcgcctcttgggatttccccgcccctttttgccgcgcagagggggcctgcggtggaaccctccgaggcacatcctctagtatatcttcaccacatttccccagcgagtacgagaataacgctgactgcacttggacaatcctcgccgagcccggcgacaccatcgcactggtctttacggactttcaactggaagagggatacgatttcctggagatctctggaacagaagcgccttctatatggctgaccggcatgaacctgccttcccccgtcatttcctctaaaaactggctccgtcttcacttcacatccgacagtaaccaccgcaggaaaggatttaacgcgcagtttcaggtcaagaaggccatagaattgaaatctaggggggtgaaaatgcttcccagtaaggatggctcccacaaaaacagtgtgctgagccagggcggagttgcactggtatcggacatgtgcccagatcccggcatccctgagaacggaagaagagccgggtcagattttagggtgggcgcgaatgtgcagtttagttgtgaggacaactatgtgcttcaggggtccaaaagcattacctgtcagagggtcactgagactctggctgcgtggtccgaccaccggcccatttgtcgcgctcggacatgcggctccaatctccggggaccttctggcgttatcaccagccccaactacccagtacagtacgaagataacgcacactgtgtctgggtgatcaccaccactgaccccgataaagtgattaaattggcttttgaagagtttgagctggagagggggtatgataccctgacggtgggagatgccggaaaggtgggggacactcggagcgtgctgtacgtgttgacagggtcttccgtaccagatctcatcgtgtcaatgtccaaccagatgtggctacacctccagtctgatgactcgattgggtcacctggatttaaggctgtatatcaggaaatagaaaagggcggctgtggcgaccctggcattccagcctacgggaagagaactgggtcaagtttcctacacggagacaccctaacttttgaatgcccagcagccttcgaactggttggagagagggtgatcacttgtcagcagaataaccagtggtcaggcaacaagcccagctgtgtgttctcatgcttttttaatttcactgctagttctggcattatcctgagccccaattaccccgaagaatacggcaacaacatgaattgcgtgtggttaattatatcggagccagggtctcgaattcacctgatatttaacgacttcgatgtggaaccacagtttgatttcctggctgtcaaggatgacggtataagcgacatcacagtgctcggcaccttcagtggaaatgaagtgccaagccaactggcttcaagtgggcacatcgttaggctcgagtttcagtcagaccattccacaaccggcagaggcttcaacatcacctacacgactttcggccagaacgaatgtcatgacccaggaatccctatcaacggccggaggttcggcgataggtttctgctaggaagttccgtgtcattccactgcgacgacggattcgtcaagacccaggggtctgagtcgattacatgtatcctccaagacggcaatgttgtctggtcctctacagtacctaggtgcgaagcgccgtgtggcgggcacctaaccgctagttcaggcgtgattctgcccccaggctggcccggatactacaaagatagcctgcactgcgagtggattatcgaggccaaacctgggcattccataaagattactttcgataggtttcaaaccgaagtaaattatgacacactggaggtgagagacgggccagcatcctcaagcccactcataggagagtaccacgggacacaggctcctcagttcctgatctcgacaggaaatttcatgtatcttctgttcacgactgataatagcagatcctcgattggcttcttgatccattacgaatccgttaccctcgagagcgattcttgcctggatccaggaatccctgtcaacggccataggcacggtggcgattttggaatccggagtacagtgactttcagctgtgaccctggctacacactgtccgatgacgaacctctggtatgtgagaggaaccaccagtggaatcacgcactcccgtcgtgtgatgctctttgcggagggtatattcaaggaaagtctggcaccgtcttgtccccaggtttcccagacttctaccccaattcactcaattgcacttggactatcgaggtcagccatggaaagggagtacagatgatttttcacaccttccacttagaatcctcccacgactacctactgattactgaggacggctctttctctgagccagttgctcgcctcactggatcagtgctgccccatacgattaaagccggcctatttggtaatttcactgcccaacttaggttcatttccgactttagcatctcttatgagggttttaacatcacattttctgagtacgacctggagccctgcgacgaccctggagtgccagcattcagccggcgaatcggatttcacttcggtgtgggtgactcactgactttctcttgctttttgggttaccgtctcgagggcgcaacaaagcttacgtgccttggcggcggccggcgcgtgtggtcagcccccctgcctcgatgcgttgccgaatgcggcgcctcggtgaagggaaatgaaggcactctgctgtctccgaatttcccttcaaattacgacaacaatcacgaatgcatttataagatcgaaaccgaggctggaaagggtatacacctgaggacccgctcctttcaactcttcgaaggcgacacacttaaggtttatgacgggaaagactcttcatccagaccactcggtacatttacaaagaatgagctcctcggtttgatattgaactcaacgagtaatcacctctggctggaattcaatacaaacggaagcgacactgatcagggattccagctcacctacacgagctttgacctcgtgaagtgcgaggatccagggataccgaactatggctatcggatacgcgatgaaggacactttacggataccgttgtactgtattcatgtaacccaggctacgcgatgcacggatccaacactctgacatgtcttagtggcgataggcgcgtgtgggacaaacccctgccctcgtgtatcgcagaatgcggcggccaaatacatgcggcaacttcaggacggatcttgagtcctggttacccggccccttacgataataatctccactgtacctggatcatcgaagccgacccgggcaaaacaatttccttacacttcattgtgttcgacacagagatggcccacgacatactgaaggtctgggatggtcctgttgactctgatatattactgaaggagtggtccggcagcgcgcttccagaggatatccattcaacctttaacagtttgacgctgcagttcgactcggacttctttatctcaaaatctggcttctctatacagttcagcacctccatcgccgcaacgtgcaatgaccccggcatgccccaaaatgggactagatatggtgacagtcgggaagcaggcgacactgtgactttccagtgtgaccccggctatcaactccagggccaagccaaaattacctgcgtgcaactcaataaccggtttttttggcagccagacccaccaacatgtattgccgcctgcggaggaaacctaacagggccggccggtgtcatcctgtctcctaactacccacagccctatccaccaggaaaggagtgcgattggagggtgaaagtgaacccagattttgtgatcgctcttatcttcaaaagcttcaatatggagcccagctacgacttcctgcacatatacgagggggaggattccaacagtcctctaataggctcttatcagggaagccaggctccagagcgaatcgaatccagcggcaattcactgttcctggcctttcgctcagacgcatccgttgggctttcagggtttgccattgaattcaaagagaaaccccgcgaggcctgctttgacccggggaatatcatgaacggtacgagggtggggacagacttcaagctgggatccaccatcacttatcaatgtgatagcggctacaagatcctggacccaagctcaattacatgcgttatcggtgcagacggtaaacctagttgggatcaggtgctcccgtcttgcaatgccccctgcggcggtcagtacaccggctcggagggcgtggttttgtctccaaactatcctcataattacaccgcaggacaaatctgcctctactcaattaccgtccctaaggaatttgtcgtgtttggccagtttgcttattttcagacggctcttaatgatctcgccgaattattcgacgggacacacgctcaggcccggctgctatcttccctgtctggctcccactcaggggaaaccttgccactcgcaacctcaaaccagatcttactccggttctccgccaaaagcggggcaagcgcacgtggctttcacttcgtttatcaggccgttccacgaacatctgatactcagtgtagcagcgtgcccgagccacgctatggcaggaggatcggttccgaattttcagccgggagtattgtccgatttgagtgtaaccctgggtacctgctgcagggttccaccgccctccactgtcagagcgtgccgaacgcactcgcccagtggaacgatacaatcccaagttgtgtggtgccgtgtagcggcaattttacccagcgcagagggaccattttgagccctggataccctgagccttacggaaacaacctgaactgtatctggaagatcatcgtgacagagggctctgggatacaaatccaggtcattagcttcgcgacagagcaaaactgggactcacttgaaattcacgacggaggagatgtgaccgcacctcgactcggaagcttctctggaaccaccgtgcctgccttattgaattccacttccaatcagctgtacctgcatttccagtcagatatctctgttgccgccgctggctttcacttagaatacaagacagtagggcttgcagcctgccaagaaccagcactgccaagcaacagcataaaaatcggcgaccggtatatggtgaacgacgtgctcagctttcagtgcgagccaggctatacactacaaggccgctcacatatctcttgcatgcccggaaccgtaagaagatggaactatcccagtccactgtgtattgccacttgcgggggaacactcagtaccctgggcggcgtgatcctgtctcccgggttccccggttcctacccaaataatcttgattgtacctggcggatcagcctccccatagggtacggtgctcatatacagttcctcaattttagcacagaggccaaccatgactttctggagattcagaacggcccataccacacgagtccaatgattggccagtttagtggaactgatctcccagccgccctgctttctaccacccacgagacgctgatacacttttacagtgatcattcccagaaccgacaggggttcaagttggcctatcaggcatatgaattgcaaaactgccccgatcctcctccgtttcagaacggctatatgatcaattccgattattccgtgggccaaagcgtgtcctttgagtgttaccccggatacatcttaatcggccaccctgtcctaacgtgccagcacggtattaacagaaactggaactacccgtttccgagatgtgatgccccctgcgggtacaatgtgactagccaaaatggcactatctacagtcccggctttcctgacgaatacccaattctcaaggactgtatctggctcataaccgtccccccaggacacggagtgtatatcaatttcacacttctgcagactgaggccgtgaatgattacatagccgtttgggacggacccgatcagaattcaccacaactgggcgtcttctccgggaatacggccctagaaacggcatattccagtaccaatcaggtactgttgaaattccacagtgacttcagcaacgggggattttttgtgttgaatttccacgcgtttcagctcaaaaaatgccagcccccgcccgcggtgccccaggcggagatgcttaccgaggatgacgatttcgaaatcggggacttcgtgaagtaccagtgtcacccaggttacaccctcgtcgggactgatattctcacgtgtaagttatcatcacaattacagtttgagggaagtcttccaacctgcgaggcacagtgtccagcaaacgaagtgaggaccggatcctcgggcgtgattctcagcccaggttatcccggcaactattttaattcgcagacttgcagctggtcaatcaaggttgagcccaattataacatcaccatctttgttgatacatttcagagtgaaaaacagtttgatgcactcgaggtgttcgatggctcaagcggccagtctcctctcctcgtggtcctgtctggaaaccacaccgagcagtcgaatttcacaagccggtccaatcagctttatcttaggtggagtaccgatcacgctactagcaagaagggcttcaagattcgctacgctgccccatattgctcactaactcacccactgaaaaatggtgggattctgaatcggactgccggggctgtcgggtcaaaggtccattatttctgtaaacctggctacaggatggttggccacagcaacgctacttgcagacgcaacccactcgggatgtaccagtgggattcgctaacccctctatgtcaagccgtcagttgcgggatcccagaatcgcccggcaacgggtcatttactggaaacgaatttaccctcgacagcaaggtggtgtatgagtgtcatgaggggttcaagctcgaaagtagtcaacaagctacagcggtgtgccaagaggacgggctttggagtaataaaggcaaacctcctacttgcaagcccgtggcctgtccaagcatcgaggcccagttatctgagcatgtgatctggcggctggtgagcggatctcttaacgagtacggggcacaggtgctcctatcttgtagtccgggatactatcttgaaggttggcgcttgctgaggtgccaggctaatggaacctggaacatcggagatgagcgacctagctgcagggccggacattgcggctccccagatcctatcgtaaatggacacatctccggggacggatttagttacagagatactgtggtctaccagtgcaatcccgggtttcgtctggtaggcaccagcgttcggatttgtctgcaggatcataaatggagcggacagacccccgtatgtgtcccaatcacatgtggtcatcccggcaatcccgcccatggtttcacaaatgggtccgagtttaatctgaatgacgtcgtcaacttcacctgtaacactggatatctgctccagggcgtgtcacgagctcagtgcagatccaatgggcaatggtcatcacccctgccgacatgtcgagtcgtgaactgttctgacccagggttcgttgaaaacgccattcgtcacgggcaacagaattttcccgaatctttcgagtatggtatgtcaattctttatcattgtaaaaaagggttttacttactgggatcctccgccctcacttgcatggcgaacggcctctgggacaggagcctgccaaagtgtctggcaatctcctgtgggcatcctggcgtaccagcaaacgctgtgctgacaggcgaactgtttacatatggggccgttgtgcattactcctgtaggggtagtgagtctctgatcggcaacgacacacgcgtatgtcaggaagacagccattggtctggagccctgcctcattgcaccgggaataaccccggcttttgcggcgatcctggcactcctgcccacggaagtcggctgggagatgacttcaaaacgaagtctttgctcagattttcatgtgagatgggccaccaactcaggggatcgcctgagcgaacctgtctgcttaatgggagttggagtggactgcaacccgtgtgcgaggcagtcttgtgtcctcaaccacctccggtccagaatgggactgtggaggggagcgacttccgttggggatcttctatctcctactcttgtatggatggataccagctgagtcattctgctattctgagctgtgaaggtaggggggtctggaagggagaaattccacaatgtcttccagtcttttgtggagacccgggaattcctgccgaaggccggcttagcgggaaatcctttacgtacaaatctgaggtattttttcagtgcaaaagcccttttattctggtgggcagttccaggcgcgtgtgtcaggccgatggtacatggtccggaattcagcctacttgcatcgatccagctcataacacctgccccgaccctggcactccccactttggcattcaaaatagctcccgaggatatgaggttggctccacagtattctttagatgcagaaagggctatcacattcaaggatccactactaggacttgtctcgcaaatctgacctggtccggtattcagactgaatgcataccccacgcctgcaggcaacccgaaactccggcccacgctgacgtcagggcaatcgaccttcctacctttggttataccctggtctacacttgccatcctggcttctttctggccggaggctccgaacatagaacatgtaaagcggacatgaaatggacaggcaagtcccccgtctgcaagtccaaaggagttagagaggtgaatgaaactgttacaaagacccccgtcccatctgacgttttcttcgtcaactccctctggaaaggctattatgagtacctggggaagcggcagccggcgacgctgacagtggactggtttaacgcaacttcgtccaaggtgaatgccaccttttccgaagcttccccagtggaattgaagctcacaggcatctataagaaagaagaggctcatctactgttgaaggcatttcaaataaaaggccaagcggatatctttgtttctaagttcgaaaatgacaactgggggcttgacggctatgtatccagcgggcttgagagggggggattcacctttcagggcgatatccacggaaaagatttcggaaagtttaagctcgagaggcaggaccctttaaatcccgaccaggattcctcttcacactaccacggcacatcttccggtagcgtggccgccgcgattctcgtgccgttttttgctctgattctgtccggattcgccttttatctatataagcatagaaccagacccaaagttcaatataacggctatgccggccatgaaaacagcaacgggcaggcctccttcgagaaccccatgtatgacaccaacctgaaacccacagaggccaaagctgtgcggtttgacacaacccttaacaccgtctgtactgtggtttag

SEQ ID NO: 184107 - DNA, 10464 bp, Artificial Sequence
  Description of Artificial Sequence: Synthetic coding sequence
atgcggctgatcagcatcgcccccggcccccggtggcaggtgcagtcacatcacccccgctccgccggacagaattgtacatttcagctgcacggaccaaacggtacagtcgaatccccgggctttccttatgggtatccaaattacgccaattgtacttggacaattacggccgaggagcagcatagaatccagctggtgttccaaagtttcgctctggaagaagacttcgatgtgctgtctgtctttgacggcccaccacagcctgaaaacctgagaaccaggttgacaggatttcaactacctgcaacgatcgtctctgccgccacaactttgagcctgaggttgataagcgactacgcagtatcagctcagggctttcatgccacgtatgaagtgctgccatcacacacctgtggtaatcccgggcgtcttccgaatggaatccagcaagggtcaacatttaatttaggggataaggtgcgatacagctgtaatctgggtttcttcctggaaggacatgctgtgttaacctgccatgccggctccgagaactctgctacttgggactttccactcccttcatgccgcgccgatgacgcctgtggaggcaccctccgtggccagagcgggatcatctcaagcccccacttcccatcagagtatcacaataacgctgactgcacatggacaatcctagccgagctgggcgatacaatcgccctggtgttcatagactttcagcttgaggacgggtacgatttcctggaggtgaccggaactgaggggagcagcctgtggtttaccggcgcgtccctacctgcccccgttatcagttcaaagaactggctgagattgcactttacaagcgatggtaatcacagacagcgaggtttctccgctcagtaccaggtgaagaagcagatcgagttaaaaagccgcggggtgaagttgatgccctcaaaggataatagccagaaaacctcggtccttacccaggtgggcgtgtcacagggccacaacatgtgtcctgaccctggcatcccagagcggggaaagcgacttgggagcgacttccggctggggtcatcagtccagttcacctgcaatgagggctacgacctgcaaggcagtaaaagaatcacatgtatgaaagtgtccgatatgttcgctgcttggtccgatcacaggcctgtgtgccgtgcccgcatgtgcgatgcgcatctgcggggcccttcaggcatcatcacgtcgcccaattttcctatacagtatgacaataacgcacattgtgtctggatcataacagctttaaatccatccaaggtaatcaagttggcctttgaggagttcgatctggagagaggctacgatacacttacagttggggacggaggtcaagacggagatcagaagacagtcttatatatactgacaggcacctctgttcctgatctgatagtgtctaccaaccatcagatgtggttactgtttcaaacagatgggtctggcagctccctcggctttaaagcctcttacgaagaaattgaacagggatcatgtggagaccccggaatacccgcctatggcaggagggagggttctcggttccaccacggagacactttgaaatttgagtgccagcccgcttttgagctcgtggggcaaaaggccataacctgtcagaaaaataatcagtggtcggcaaaaaaacccggttgtgtcttctcctgcttcttcaatttcacatctccaagcggagttgtcctgtcgccaaattatccagaggactatggcaaccacctccattgcgtttggctcattctcgcacgccctgagtccagaattcacctggcgttcaacgacatcgatgttgagccgcagtttgatttcctggtcatcaaggatggtgccacagcagaggcccctgtgttgggcacattttcagggaatcaactaccaagctctattacaagttctggacacgtcgccaggctggagttccaaactgatcattctacggggaaaagaggctttaacatcaccttcacaacttttcgtcataatgagtgccctgatcccggtgtccctgtgaatggcaagagattcggcgatagcctgcagcttggctcatcaataagcttcctctgcgacgaaggatttcttggaacacaggggtccgagactattacctgcgtgctcaaggaggggtcagtcgtatggaactccgccgttctccgctgtgaggccccgtgcggaggccatttaacatccccttccgggacaattctgtctcccggatggccaggtttttataaggacgcattgagctgtgcctgggtgattgaagcccaacccggctaccccataaaaataacctttgaccgtttcaagacggaagtcaactacgatacgctagaggtgcgggacggccgaacttacagcgctccgctgatcggagtgtaccacggcactcaggttccccaattcctgatcagcacctccaattacctgtacctgctcttcagcaccgacaagtctcactccgatattggcttccagcttcgctacgaaaccattaccttgcagtctgaccactgcctcgatcctggaattcctgtgaacgggcagcggcatgggaatgatttctatgttggcgctttggtcactttttcctgcgattccggatacacactatccgatggagaacctctggaatgcgagcctaacttccagtggagccgggccctccctagctgcgaggctctgtgcggagggttcatacagggttccagcggtaccattttgtccccaggcttcccagatttttatccaaacaacttgaattgtacttggatcattgagacatcacatggaaagggagtcttctttacattccacacttttcaccttgaaagcggccatgactacttactgataaccgagaatgggtctttcacccagcctctgaggcagctgaccgggtccagactccccgctcccattagcgctggcttgtacggtaatttcactgcccaggtgagattcatctccgatttcagcatgtcatacgagggctttaatatcaccttctcggaatacgatttggaaccttgtgaagaacctgaggtgccagcgtatagtatccgaaaaggccttcagtttggcgttggggacactctgacattctcctgcttcccaggataccgtctggaaggcacggccaggataacgtgtctgggtggccgtagacgcctgtggagtagtccacttcccaggtgtgtggcggagtgtggcaattccgtgacagggacccagggaactctgctttcgcccaattttcccgttaattacaataataaccacgagtgtatttactctatccagactcagccaggcaaaggcattcaacttaaggcccgggctttcgagctgtcagaaggcgacgtgttgaaggtgtacgatggtaataataacagcgcacggctgctgggagtgttttcccactccgagatgatgggggtgacactgaattccacatccagttctttatggctggatttcattacagacgccgagaacacttccaagggattcgagctgcacttcagtagcttcgagctcatcaagtgcgaagaccctggaacgcccaaattcggatacaaggtgcacgatgagggccattttgctggaagttccgtgtccttcagctgtgacccaggctatagcttacggggttccgaagagttgttgtgcttgtcaggggagcggcggacatgggaccgccccctgcccacctgcgtggcggaatgcggaggaacagtccggggtgaagtgtcaggacaggttctgtcgcccgggtatcctgcgccctatgagcataacctgaactgcatttggacaattgaagccgaggctggatgcacaatcgggttacattttctggtgtttgataccgaggaagtacacgacgtgctccggatctgggatgggccggtggaatctggtgtcctgctgaaagaactgagcggacctgcactgcccaaagatctgcactcgactttcaattccgttgttcttcagttctctaccgacttcttcaccagcaaacagggattcgccattcagttttcagtatcaacggccacatcttgcaacgacccaggaatccctcaaaatgggtcccgctccggagattcttgggaagccggcgatagcactgtttttcagtgtgaccccgggtacgctctccagggaagcgccgaaatctcatgtgtcaaaatcgaaaaccgcttcttttggcagcccagccccccaacatgtatagctccctgcgggggtgacctgaccggccctagtggtgtgatcctctctccgaactaccccgagccatacccaccaggtaaagagtgcgactggaaggtcaccgtgtctccagactatgtaatagctctcgtgtttaatatattcaaccttgaacctggctatgattttctgcatatttacgatggaagggacagcctgagcccgctcataggatctttctatggatctcaattgccgggcagaatagagagtagcagcaatagcctgtttctggcttttaggagtgacgcttccgtgtcaaatgccggattcgtgatagactacactgagaacccccgggaatcctgcttcgatccaggaagtattaagaacggaactcgagtaggatcagatcttaaactcggcagttctgtgacttactattgtcatgggggatacgaggtggaaggcacgtcgacattgtcttgtattctcggcccagatggtaaaccggtctggaataatcctagacctgtatgtaccgcaccctgtggtgggcagtatgtgggcagcgatggtgtggttttgtctccaaactacccgcagaattacacaagtggacagatttgcctatacttcgtcacagtgccaaaggattacgtggtgtttggacagtttgccttcttccatacagctctcaatgacgtggtagaagtgcacgacgggcatagtcagcatagccgcttgctgagttccctgtcgggtagtcatacgggagaatctcttcccctggcaacatccaatcaggtattgatcaaattctctgctaaaggtctggctccggccaggggctttcacttcgtataccaggctgtccctcgcacgagtgcgactcagtgctcatcagttcctgagccccgctatggtaagagacttgggagcgattttagtgtgggggccatagtcaggtttgaatgtaacagcggttatgccctccagggcagtcccgagatagagtgtctgcccgtgcccggagctctcgcccagtggaatgtgtcagcacctacgtgtgtggtcccctgcgggggaaatctgacagagcgtcgtggtactatactgagccccggattcccagagccatacctaaactccctgaattgcgtgtggaaaattgtggtgcctgagggcgctggcatccagattcaggtcgtgtccttcgtgaccgagcaaaattgggactctctggaggtcttcgatggcgcggacaacacggtgactatgctgggtagcttttctggcactacagttccagcattactgaatagcactagcaaccagctgtacctgcacttttactccgacatctccgtatccgctgctggttttcatttggagtataaaacggtcggcctaagtagctgtccagagcccgccgtgcccagcaatggggtaaagactggtgaacgctacttggttaacgatgttgtgagtttccagtgcgaaccaggatacgcactacaggggcacgcgcatatcagctgcatgccaggaacagtaagacgatggaactatcctccccctctgtgtatcgcgcagtgcgggggaacagtcgaagaaatggagggagttatcctaagtccaggctttcctgggaactacccaagcaacatggattgctcttggaagattgctctcccagttgggttcggagcgcacattcagttcctcaacttctccacagagccgaaccacgattacattgaaattcgtaatgggccttacgaaacatcacggatgatgggacgatttagtgggtccgagctgccttcatcacttctatcgacctctcacgaaacgaccgtttattttcattcggatcacagccagaatcgccccggattcaaactcgagtatcaggatctgacatacagccaccagatcagctcctttcttcggggatttgatctgtcagaattagagcggactaatagtacccccccagtcgctgccagttacgtgtgggatctcgaccccggctgcgaagcttatgaacttcaggaatgccccgacccagagccttttgccaacggtatagtccggggagctggatataacgttggccaatctgttacgttcgaatgcctgcccggttatcaacttaccggacacccggtcttaacctgccaacatggcaccaatcgcaattgggatcaccccctgcccaaatgcgaggtgccctgcggcggaaacattacaagctcaaacggaaccgtgtattccccaggctttccttccccctactccagcagtcaggactgtgtgtggttgatcactgttcccatcggtcatggtgtgaggctcaacttgagcctgcttcagaccgaaccatcaggagactttatcacaatatgggatgggccccagcaaacggcacccagattaggtgtgtttactaggtccatggctaaaaaaactgtgcagagtagcagcaatcaggtgttgttaaagttccatcgagacgcggccactggcggcattttcgcaatcgctttcagtgcgtaccctctgactaaatgtcctccaccgaccatactgcctaacgctgaagttgtgaccgagaacgaagagtttaatatcggtgacatcgtgagatacagatgtctcccgggcttcactctggtgggaaatgaaatcctcacatgtaaactcggcacatatcttcagtttgaggggccaccccctatttgcgaggttcactgcccaaccaatgaactgttgactgactccacgggggtcattctgtctcagagctatccaggaagctatccacagttccagacgtgtagttggctggtccgggttgagccagactacaacatcagccttactgtggaatacttcttgtccgagaagcagtatgatgagttcgagattttcgatggaccctctggccagagccctctacttaaagccctgagcggcaattatagcgccccactgattgtcactagctcttcaaacagcgtgtacttgcgctggtcatccgatcacgcttacaatagaaaggggtttaagatccgttatagtgcaccgtactgcagtctgcccagggcccccttgcacggcttcattttaggtcagactagtacccagccaggcggcagcattcactttggctgtaacgctgggtatcgtctggtggggcatagtatggcaatctgcaccagacatcctcaaggctatcacttgtggtccgaggccattcccctgtgtcaggccctgtcctgcggactacctgaagcgccaaaaaacggcatggtctttggaaaagaatacacagtggggactaaagccatgtattcatgtagtgaggggtaccacctccaggccggtgcggaggcaaccgcagagtgtttagatacaggcctctggtcaaaccggaacgtgccaccccagtgtgtgcccgttacctgcccagatgttagtagcataagcgtagagcacgggaggtggcggttgatctttgaaactcagtatcaattccaggctcagcttatgcttatctgtgacccaggttactactataccggccaacgagtgatccggtgtcaggcaaacggcaaatggtctctcggcgacagtacgccaacttgcaggatcatctcctgtggggagctgcccattcctcctaacggccataggatcggcactctctcagtatacggcgccacagctattttttcttgtaattccggctacactctggtgggctccagggtgcgggagtgcatggctaacggcctctggtcagggagtgaagtccgatgtttggctggacattgcggaacccccgagccgatagtgaacggacacatcaatggagagaactatagctatcgtggaagcgtggtctaccagtgcaatgccggattcaggttgatcggaatgtcagtcagaatatgccaacaggaccatcattggtctggcaaaacaccattttgtgttttggtaagctgcgggcacccagggtctccacctcattcccagatgagcggggatagctacacagtcggtgcagtggtcaggtatagctgcatcggaaaacggacacttgttggcaattccactagaatgtgcggactggacggacactggacaggtagcctcccccattgttcgggtactagtgtgggggtgtgcggggacccggggatccccgcccacggaatccgcctcggcgactccttcgaccccggaactgtaatgagattctcctgcgaagcgggccacgtcctccgcggtagctctgaacgaacctgccaagcgaacggcagttggagcggctcgcagcccgaatgtggagtcatctcttgcggaaatcccggcaccccttccaacgcgcgggttgttttcagtgatggcttggtgttctctagcagcatcgtgtatgaatgcagggagggctattacgccacaggacttctgtctcggcattgttccgtgaacggtacctggactggttccgaccctgaatgtcttgtcattaactgcggcgatccgggcatccctgccaacggccttaggctgggtaacgactttcgctacaacaaaaccgtgacataccaatgcgtccctggatacatgatggagagccatagggtgtcagtactgagctgtaccaaagaccgaacatggaatggcactaagccagtgtgcaaggccctcatgtgtaaacccccaccgctgattcctaacggaaaagtagtgggctctgatttcatgtggggcagttcagtgacatatgcatgcctggagggctaccagctctcgctgcctgccgtatttacttgcgaagggaatggaagctggactggagagctgcctcaatgttttcctgttttctgtggtgatcccggggttccgtcacgaggacggcgggaagaccgaggcttttcataccggtcttctgtaagcttttcatgccacccccctctggtcctggtggggagcccaagacgcttctgccagtccgacgggacttggagtggcacgcaaccgtcttgcattgaccccactttaacaacctgcgccgaccctggagttcctcaattcggcatccagaataatagccaaggataccaagtgggctccacagttctattcaggtgtcagaagggttatctgcttcaggggagcacgactcggacctgtctccccaacctgacctggtcaggaactcccccggactgtgttcctcaccattgtcggcagcccgagactccgacgcacgcaaacgtgggggccttggacttacccagcatgggttatactttaatctattcttgtcaggaaggtttcagtcttaaaggcggatcagagcatcggacatgcaaagccgatggatcctggaccggtaaacctccaatctgtcttgaagtgaggccctctggaaggcccatcaatactgccagagagcctccgctaactcaagcgctgattcctggcgacgtgttcgcgaagaactcactgtggaagggggcttatgaatatcaaggtaaaaagcagcctgccatgctgcgggtgacgggtttccaggtggccaattctaaggtcaacgcaactatgatcgatcatagtggcgtggaactgcacctagctggaacgtataagaaagaggattttcacctgctgcttcaggtatatcagatcacaggcccagtggagatatttatgaataagtttaaagacgaccattgggccctcgatggccatgtgtcaagtgagagctcaggggccactttcatctatcagggcagcgttaaagggcagggctttggtcagtttggctttcaaaggttggacctgcggctgcttgagagcgatccagagagtatcggacgacatttcgcttccaatagctcctctgtggctgcagccattttagtccccttcatcgccctgattatagctggctttgtactgtacctttataaacacaggcgccgtcccaaagtgcccttcaatggatatgcaggccatgaaaacactaatgtcagagctacctttgaaaatccaatgtacgatcggaacatccagcctacggatataatggcctctgaggccgagtttacagtttccaccgtgtgcacagctgtatag

SEQ ID NO: 184108 - DNA, 678 bp, Artificial Sequence
  Description of Artificial Sequence: Synthetic coding sequence
atgtgcgacgcccacctgcggggccccagcggcatcatcaccagcccaaacttccctatccagtacgacaacaatgcccactgcgtgtggattatcactgctctgaacccctccaaagcgggcggagatcccggcaatattcaatgcaacaaggaaggcctcagcgttgaaacgcagtcactcaggctcagaaataggtcttgccttctcggtaactctaaggataatgggtgttgcgtgccaaatccagtccatggaaccggcctacaggtaattaagttagccttcgaggaattcgaccttgagcgcgggtatgatactctgactgtgggcgatggcggccaggacggggatcagaaaacagtgttgtatatcctcacaggcaccagtgtgccagatctgatcgtatccacgaatcaccagatgtggctcctgttccaaaccgacggcagtggatccagcctcggcttcaaagcctcttacgaagagatcgagcagggcagttgcggggatccaggaatccccgcctacggccgacgggagggttcaaggttccaccatggggatacacttaaattcgagtgtcagcccgcctttgagttggttgggcagaaggcgattacctgccagaagaataatcagtggagcgcaaaaaagccgggctgcgtctgcaagtag

SEQ ID NO: 184109 - DNA, 1281 bp, Artificial Sequence
  Description of Artificial Sequence: Synthetic coding sequence
atgctgggcagcttcagcggcaccaccgtgcccgccctgctgaactctacctcaaaccaattatatctccatttctactccgatattagtgtatcagccgctggattccaccttgagtataagaccgtgggattgagttcctgtcctgaacccgcagtaccttccaatggcgttaaaacaggggaacgttatctggtgaatgacgtggtctctttccaatgcgaaccagggtatgcccttcaaggacacgcccacataagctgcatgccgggtacggtccggcggtggaactatcctccacccctctgcatcgctcagtgtggcggcacagtcgaggagatggaaggagtgattctgagtcccggttttccggggaactacccatctaatatggactgttcatggaagattgcactgccggtcggcttcggagcccatatccagttcctgaatttctccactgaaccaaaccatgattacattgaaattaggaatgggccatacgagacttcacggatgatggggaggttttctggcagtgagctgcccagtagcctactgagtacatcccacgagaccactgtttattttcactccgatcactcacagaatcgccccggtttcaagctggaatatcaggcatatgaactacaagagtgccccgatcctgaaccgtttgctaacggcatagtgaggggggctggttacaacgtgggccagtctgtaacgtttgaatgccttcccgggtatcagctcaccggccaccctgttctgacgtgccagcacggcacaaacaggaactgggatcatccgctgccgaaatgcgaagtgccttgcggcgggaatattaccagctctaatggcaccgtgtatagcccggggttcccttctccttacagttcctcgcaggattgcgtctggctgatcaccgtgccaattggtcacggagtgagactaaacctgtccttactgcagaccgagccaagtggcgatttcatcacaatttgggacggcccccagcagacagcacctcggctgggggtgttcaccagaagcatggccaaaaagaccgtgcagagttcaagcaaccaagtcctgttgaaattccaccgcgatgccgccacgggtggtatctttgctatcgccttttctgatcactgccgctactttaaccagaagtcaggtaagctggacttcacacctagctctaccctcggacagctttgcaaaaccctgcacagatctttgccacatttaaggcttcagtttctgcatttatag

SEQ ID NO: 184110 - DNA, 3504 bp, Artificial Sequence
  Description of Artificial Sequence: Synthetic coding sequence
atggtgatcgtgatcctgttccccgccgagtgcggcaacagcgtgacagggacacaggggaccctgctttcacctaatttccccgtgaactataacaataaccacgagtgtatttactccatccaaacccaaccaggcaaaggcattcagttgaaggccagagcgtttgagctgtctgagggcgatgtgctcaaagtatatgatggaaataataactcagctcggctgctgggtgtattctctcacagcgagatgatgggggtcactctgaactcaacctcatcttctctgtggctggattttatcaccgacgcggagaacacgtcgaagggattcgagcttcatttttcttcattcgagctcatcaaatgcgaggaccccggtacacccaaatttggctataaagtccacgatgagggtcacttcgcgggctcttctgtctctttctcttgcgaccccggatactccctccgcgggtctgaagagctgctttgtctgtctggggaaaggaggacatgggacagaccactccctacatgcgtggcagagtgtgggggtactgtgcggggggaagtgagcggacaggtcttgtcaccgggctatcccgccccctacgagcataacctcaactgcatttggacaatcgaagccgaagctggctgcaccatcgggttacattttctggtctttgatactgaggaagttcacgatgtcctgcgcatctgggacggacccgtggaaagtggggtgttgttaaaggaactcagcggcccagctctccctaaggacctccattccacatttaattccgttgtgctgcaattttcaaccgatttcttcacaagcaagcaggggttcgctatccagtttagcgtatccacagccacatcatgcaacgaccccggcatccctcaaaacgggagcagatcgggggactcatgggaagccggcgacagtaccgtttttcagtgtgatccaggttatgccctacaaggctctgctgagatctcttgtgtgaaaattgagaataggtttttctggcagcctagtccacccacttgcattgccccctgtggaggtgacctgacaggcccttctggggtcatcttatcacctaactatccagagccctacccccccggcaaagaatgcgactggaaggtcactgtgtccccagattatgtcatcgcgctcgtgtttaatatcttcaacctggaaccaggatatgattttctccatatttatgacggccgcgactctctgagtccgctgattggctcattttatggttcccagttgccaggaaggattgagtcatcttcaaattccctgtttctggcctttcgtagtgatgcgagtgtatctaacgcaggctttgtcattgactatactgaaaacccaagagagtcttgttttgatccagggtcaattaagaacggtacaagagttggctccgatttgaagttgggcagctcagtcacatactattgccacggaggctacgaggtggagggaacctcaaccctaagctgtattctcggccctgatggaaaacccgtttggaacaatcctcgtccagtatgtacagctccatgcggtggccaatatgtagggtctgacggcgttgtgttgtctccgaactatccccaaaactatacatctggacagatctgcctatatttcgtgacagtaccaaaggattatgttgtgtttgggcagtttgcgttctttcacactgcactgaatgatgtagtggaagtccacgatggacacagtcagcactctcgcctcctttcgtcgctttcaggcagccataccggggaatctctgcccctcgcaaccagtaaccaggtgttgattaaattttctgccaagggtctggctcctgctagagggtttcacttcgtgtaccaagcagtcccacgcacctcagccacacagtgctcaagcgtgcccgaaccaagatacggcaaacgccttggctccgatttctccgttggagccattgttaggttcgaatgcaactccggctacgcactccagggatcacctgagatcgagtgtcttcccgttccaggtgccttagcacagtggaacgtgtcggcacctacatgcgtggtgccatgtggagggaatctgaccgagagaaggggtaccattctgtctcccggattccctgaaccttacctaaatagccttaactgcgtatggaagatagtcgtgcctgagggagccggcatccaaatccaggtggttagcttcgtcaccgagcaaaactgggactcattggaggtgtttgatggagccgacaacacggtgaccatgcttggctctttcagtggaacaacggtccctgccctgctgaactccacaagtaaccaactttacctgcacttctacagcgatatttcagtgtctgcagctgggttccacttggagtataagactgtcggactcagttcttgccccgagcctgcagttccatccaacggcgtgaagactggtgagagatacctggtgaatgatgtggtctccttccaatgtgagccaggctatgcccttcaaggacacgcacacattagttgcatgccggggaccgttaggagatggaactacccaccacctctttgtattgcacaatgcggcggcaccgtggaagaaatggaaggggtgatccttagccctggcttcccgggtaactatcccagtaacatggactgcagttggaagattgcgctccccgtcggattcggagcacatatccagttcctgaacttctcaaccgagccaaaccatgactacatcgaaatccgcaatggaccatacgagacaagcagaatgatgggcagattctccggatcagaactgcctagttcactcttgagcacctcccacgagactaccgtgtacttccattccgaccattcgcagaaccgccccggatttaagttggaatatcaggcctacgaactacaggagtgcccagatcccgagcctttcgctaacggcatcgtacgcggagccggttacaacgtaggccaatccgttacatttgaatgcttaccagggtatcaattaacaggacaccccgtcctcacctgtcaacatgggacaaacagaaactgggaccaccccctgcccaagtgtgaggtgccctgtggtggcaacattacatcgagcaatggcaccgtttattctcctgggttcccttccccctattcttccagtcaggactgcgtttggctgatcaccgtacctataggccatggcgttcgtctgaacctatccctattacagacggagccaagtggagacttcatcaccatttgggatgggccccagcagaccgctccacggctgggtgtgttcacaaggagtatggctaagaagacggtgcagtctagttcaaatcaagtactcctcaaattccaccgcgatgccgccactggcggaatctttgcaatcgcttttagcggccatcttgcagccgtctgcacactttag

SEQ ID NO: 184111 - DNA, 10896 bp, Artificial Sequence
  Description of Artificial Sequence: Synthetic coding sequence
atgccccggagccggggccgggagctgggccggtgcggctgccccgcaggacgagccaggggcgagaccgggatttcagcccttgtacccggggccggctctagatgggggaggccccccccacctactccccctcccctgctgctgctccttggttgcggccttctgagcgtcagcgccgcagcgggacaaaactgcacatttcagttgcatggccctaacggcacagtcgaaagcccaggctttccatatggctacccaaactacgccaattgcacctggaccatcactgcagaagagcagcataggattcagctggtatttcagagtttcgctctagaggaggacttcgacgtgttatccgtgttcgacgggcccccgcagcccgagaatttacgcaccaggttgactgggtttcagctgccagccaccatcgtatcggccgccacaaccctctctctgagattaatttcagactacgcagtgtctgctcaggggttccacgccacctatgaagttctcccctcccatacttgtgggaatcccgggcgcctgcctaacggaatacagcaggggagcactttcaatctgggcgataaggtgcgatactcgtgcaacctgggattcttcctggagggacatgccgtattgacctgccatgctggaagtgagaactctgccacgtgggattttccgctcccttcatgccgggccgatgatgcctgcggcggcaccctgaggggtcagagtggtattataagctctccccatttcccgtcagagtatcataacaacgcagattgtacctggactatattggccgaactcggagatacaatcgcgctggtgttcatcgatttccagctggaagacgggtatgacttcctggaagtgacgggaaccgaggggagtagtctctggttcaccggagcttcactaccagctcccgtgatctcctctaagaactggctgcggttacatttcactagcgacgggaaccacaggcaaaggggattcagcgcccagtaccaggtgaagaaacaaattgagttgaaaagcaggggcgtgaagttgatgccttccaaggataattcccagaaaaccagcgtgctgacccaggtcggtgtctctcaggggcacaacatgtgccctgacccagggatacccgaacgagggaaaagactgggttccgacttccggttgggaagtagtgtgcagtttacttgcaacgagggatatgatctgcaggggtcaaaaaggatcacctgcatgaaggttagcgacatgttcgccgcctggagcgaccacagacccgtgtgccgggcgcgcatgtgtgacgcgcatctccgagggcctagcgggattattacaagccctaatttcccaattcaatacgataataacgctcactgcgtctggatcattactgcactaaatcccagcaaagtgatcaaactggctttcgaggaattcgacctggagaggggatacgataccctgaccgtgggcgacggcggtcaggatggcgatcagaagacggtcctttacatcctgaccggcacatctgtgcccgacctgattgtctctaccaaccaccagatgtggctgctcttccagaccgacggctccggatcctctttaggctttaaagcaagctacgaggaaattgagcaagggtcgtgcggggatccaggcattccagcatatggccgacgggaggggagccgtttccatcatggggatacactaaaattcgaatgccaacccgcattcgagctcgtcggccagaaggccataacttgccagaagaacaaccagtggtcggccaagaagcctggatgcgtattcagctgtttttttaacttcacctcgccctcgggcgtcgtacttagcccgaactatcctgaagactatggcaaccatttacattgcgtctggttgatccttgcaagacccgagtccaggatccacctggcctttaatgatatcgacgtggagcctcagtttgatttcctggtcattaaggatggagccacagccgaggctcctgttctcggcacattctccgggaaccagctgccttctagtattacttcctctggacatgtcgctcgcctggaattccagaccgatcactctaccggcaaaagagggtttaacattactttcactacatttagacacaatgagtgccccgaccctggcgtgcccgtgaatggaaaacgcttcggggattcccttcaactcgggagttcaatatcctttctgtgtgatgaggggtttctgggcacccagggatcagagaccatcacatgcgttctgaaggaaggcagcgtcgtgtggaattctgccgtgctccggtgtgaggctccttgcgggggacatttgacatccccttcaggcaccatactgtccccggggtggcccggattttacaaagacgccctttcctgcgcctgggtcatagaggcacagcctgggtatccgatcaagatcacattcgatcgctttaagaccgaggtgaactacgacaccctggaagtgcgtgacggtcgcacttattctgccccactgataggtgtgtaccacggcactcaggtccctcagttcctaataagcacctcgaactacttgtatcttttattctcaaccgacaagagtcattctgacatcggcttccagctcagatacgaaacaattactctccagtccgatcactgtttggatcctggcattccagtgaacggtcaaaggcatggaaatgatttctacgtgggcgcccttgttactttttcgtgcgattctggatacaccctgtcagacggagaacccctcgagtgtgagcccaatttccagtggagcagagctctgccttcttgtgaggccttgtgcggaggcttcatccaaggatcctctggcactatcctcagtcctgggtttccggatttctacccaaataacctcaactgcacgtggattatcgagacttctcacggaaagggggttttcttcacattccacacattccacttggaatctggccacgactacctgctcataacagagaacgggagcttcacgcaacctctaagacagctcacgggcagtcggttgccggctccgatctccgcgggattgtacggaaatttcactgcccaggtgcggtttattagcgacttctcgatgtcctacgagggattcaacattaccttttcagaatatgacctagagccctgcgaagagcccgaggttcccgcctatagtattcgaaagggcctgcagttcggcgttggtgacaccctcaccttctcctgcttccccgggtatcggctggagggcaccgcaaggatcacctgccttggcggccgccgccgcctgtggtcatctcccctcccccggtgcgtggcggagtgcggaaatagcgtgactggcacacagggtaccttactgtcaccgaacttcccagtaaactacaacaacaaccacgagtgtatttactctattcagacccagccaggtaaagggattcaattgaaagccagagcttttgagttgtcagagggggatgtgttaaaggtttatgacgggaacaacaacagcgcaagattacttggtgtgtttagccactccgaaatgatgggcgtgacgcttaattcaactagttctagcctgtggttggatttcattacagacgccgagaatacatctaaaggctttgagctgcatttttcctccttcgagctgatcaaatgcgaagaccccggtacacctaagttcggctataaagtgcatgacgagggacacttcgccggaagttcggtgagctttagttgcgatcccggttattcactgcgcggatcagaggagctcctgtgtctgtcaggcgagcgaaggacttgggataggccactgcccacatgtgtggctgagtgcggcgggactgtgaggggcgaagtgagtgggcaggttctgtcgcctggttatccggctccctacgaacataacctgaactgtatctggaccattgaggccgaggccggctgcaccataggcctgcattttctggtgttcgataccgaagaagttcacgacgttctgcgcatctgggatggcccagtagagtcaggagtccttctgaaagagcttagcggtcccgcactgcccaaagatctgcactctactttcaatagtgtcgttttacagtttagtacagactttttcacaagcaagcagggctttgccatccaattctccgtgtctacggctactagttgtaacgatccaggtattcctcagaatggaagtcggtctggcgactcgtgggaggccggagattctaccgttttccagtgtgatcctggttacgctctgcagggttccgccgagatatcttgcgttaaaatcgagaacagattcttttggcagccgtctccccctacctgtatagctccatgtggaggagatctcacaggccctagcggcgtgattctgtcccctaactacccagagccatatccgcctggcaaagagtgtgattggaaagtaacagtgtctccagattacgtgatcgcccttgtgttcaatatcttcaacttggagcccggttatgatttcctgcatatctatgacggtcgggattccctttcacccctgataggttccttctatgggtcccagcttccgggtaggattgaatcctccagtaattcactcttcctggcttttaggagtgatgcttccgtgagcaacgctggttttgttatcgactacacagagaaccctagggagagttgctttgacccgggatcaatcaaaaatggaacccgcgtgggtagtgacttgaaattaggctcttctgttacatactactgccacggagggtacgaggtggaagggaccagtacactttcatgtattctggggccggatggaaagccagtttggaacaatccacgtcctgtctgtaccgctccctgtggaggtcagtatgttgggtctgacggcgtggttttgagtcccaattacccacagaactacacaagtggacaaatctgcttgtattttgtgacagtacccaaggattatgtcgtattcgggcagttcgcttttttccatacagccctaaacgacgtcgtggaggtgcatgatggtcactcacagcacagcagactcctttctagtttgagtggctcccatacaggagaatctctgccccttgccactagtaatcaggtgttgatcaagttctccgccaagggactggccccagctcgcgggtttcactttgtgtaccaagccgttcctcgcaccagcgctacccagtgctccagtgtgcccgagcctcgatacgggaagcgtctcgggagcgatttcagtgttggggcaatcgtgcggtttgagtgtaattccggctatgcactccagggcagcccagagattgagtgtctgcctgtgcccggagccttagcccaatggaatgtttctgctcctacatgtgtagtgccctgcggaggcaacctgacagagaggcgaggtacaatcctgtctcccggttttcccgagccttacctcaatagccttaactgtgtttggaaaattgttgtcccagaaggcgccggaattcagattcaggtggtgtcgttcgtgaccgaacaaaattgggactctctggaggtttttgatggcgctgacaatactgtgacgatgctgggctcattctctggcaccacagtgcccgctcttctgaatagtacatcgaaccagctgtatctccacttctatagcgatatttccgtgagcgcagctgggttccatcttgaatataagactgttgggctgagctcttgccccgagccagcggtaccatctaatggcgtgaagaccggtgaaagatacctggtgaacgatgtggtctcatttcagtgtgagcccggttatgccctgcaggggcacgcccacatcagttgcatgcctggaaccgtccgacgttggaactatccacctccattgtgtattgcccaatgtggcggtacagtggaagagatggagggggtgatactctctccgggatttccgggcaactacccttcaaatatggactgtagctggaagattgcccttccagttggttttggtgcccatattcagttcctcaacttttccacggaacctaatcacgactacatcgagattagaaatggaccctacgagacaagccggatgatgggacgttttagcggaagtgagcttccgagcagtctcttatccactagccacgagacaacagtgtactttcatagtgatcacagccagaatcggcctggtttcaagttagaatatcaggcatacgaactccaggagtgccctgatccagagcctttcgccaacggcatcgtgagaggtgccggatacaacgtcggacaaagtgttacctttgagtgcctgcccggctatcagcttaccgggcatccggtgctaacatgtcagcacggcacaaaccgaaactgggatcacccccttcccaaatgtgaggtgccttgcggtggaaatatcactagttccaatggcaccgtgtactcaccagggttcccaagcccctatagtagtagccaagattgtgtctggcttattactgtacccatcggccatggggtgcgtctgaacctgagcctgttgcaaacagagccatccggtgatttcattaccatatgggacggccctcagcagacagctcccagactgggagtgtttacacgctctatggccaagaagacagtccaatcttcaagtaatcaagtgctgctcaaatttcaccgcgacgccgcgacaggtggtatttttgccattgccttttctgcctatcccttgacgaagtgtccaccccccactattctaccgaacgctgaggtggtgacagagaatgaggagttcaacattggggatatcgtgcgctatcgctgcttacccggcttcactctggtgggcaacgagatcttaacttgtaagctgggaacttaccttcaatttgagggccctccccctatatgcgaagtgcactgtccaaccaacgaactgctaacagatagtaccggagtgatcctctcccagtcttatcctggatcttacccccagtttcagacatgctcttggctcgtaagagtagagcccgactacaacattagtctgaccgttgagtactttctgtcagagaaacagtacgatgaatttgagattttcgatggacctagtgggcagagcccccttttgaaagctttgtcagggaattactccgcccctctgatagttaccagtagctcgaacagcgtgtatttgagatggtccagcgatcacgcttacaatcgaaaaggattcaagatccggtattctgctccctactgttcactcccccgagcccctttgcacggcttcatcctcgggcagaccagcacccagcccggagggtctatccactttggatgtaatgccggttacaggcttgtgggtcattcaatggctatttgtacaaggcacccccagggataccatctgtggtctgaggccattcctctgtgtcaggctctttcctgtggcttgcccgaggcccccaagaatgggatggtgtttgggaaagaatatactgttggcaccaaagctatgtattcctgctcggagggatatcacttacaggccggagctgaggccactgccgagtgtttggatacagggctatggagcaaccgtaatgtcccaccccagtgcgtgcccgtcacatgtccagacgtgagttctatcagcgtggaacatgggaggtggcgcctcatcttcgagacccagtaccagtttcaggcccagctcatgctgatttgcgacccaggttactactataccggccagcgggtgattaggtgccaggctaacggtaaatggtccctgggcgattctacgcccacctgccgcataatcagttgcggcgagcttcccatcccccccaacggccatagaatcggaaccctgagtgtgtacggagccaccgccatattcagctgcaattccgggtatacactcgtcgggtcacgcgtgagggaatgcatggccaacggcctgtggagtggttccgaggtaaggtgccttgccactcagactaagctccactctatcttctacaaactgctatttgacgtcctgtcttccccttcactcactaaggccggccactgcgggacgcctgagcccattgtgaatgggcacatcaacggggagaattattcctataggggctctgtcgtgtaccagtgcaacgccggattccggctgatcgggatgagcgtgcgaatctgccagcaggatcatcactggtccgggaagacaccattctgcgtgcctattacctgtggacaccctggaaatccagtcaatggcctgacccaagggaatcagttcaacctgaacgatgtggttaaatttgtgtgtaatccagggtatatggcagagggagccgctaggagtcagtgcctcgcctctggacagtggagtgacatgctgcctacttgtagaatcatcaattgcaccgaccccggacaccaggagaattccgtgagacaggttcacgccagcggcccgcacagattctctttcggaactacagtcagttatcggtgcaatcacgggttctatttgcttgggacacctgtcctcagttgccagggggatggcacttgggaccgacctcggccacaatgcctccttgtgtcttgtggtcaccctgggtctcctccccactcacagatgtcaggcgacagttataccgtcggggcagtagtgcggtacagctgtattggaaagagaacactggttggcaattccacgcgcatgtgcggcttggacggtcattggacaggatctctgccacattgcagcggaacctctgtgggagtgtgcggcgatccagggattccagcccacggaattcggctgggtgattcattcgatccaggcaccgttatgcgcttctcctgcgaagccggacatgtcctaagagggagctctgagaggacctgccaggccaatgggtcctggtctggttcgcaaccggagtgtggcgttatcagctgcgggaatcccggcacacctagcaatgcccgcgtcgtgttctccgatgggttggttttcagctcaagcatcgtgtacgagtgtcgcgaagggtattacgctactggtttgctgagtcgacattgtagtgtaaatggcacttggacaggatccgaccctgagtgtctagtgatcaattgtggagatccaggcatcccagccaacggcctgagactcggaaatgacttccgatataataagactgttacctatcagtgcgtgccaggatacatgatggaaagccaccgggtatctgtcctgagctgtactaaagacagaacatggaatggcactaaaccggtgtgtaaggcactgatgtgcaagccacccccgttgatcccaaacggcaaggtggtcggttctgacttcatgtggggaagctcagtcacctacgcgtgcttggagggttaccagctctcgctgccggccgtgtttacatgcgagggcaacggaagctggaccggagaattacctcagtgcttccctgtattttgcggggaccccggggtcccatcccgggggagacgtgaggatcgcggtttttcctacaggagctctgtgtcgttttcttgccatcccccactggttcttgtaggttcaccccggaggttttgtcagtccgacggcacctggtccggaacacaaccctcgtgtattgaccctacccttactacgtgcgctgatcccggcgtgccgcagtttggcatccagaataactcgcaggggtatcaggtgggatcaactgttctgttccgctgccagaaggggtacctgctacagggcagcacaacacgaacctgtctccctaatttgacctggagcggcacccctccagactgtgtcccccatcattgccgacagcccgaaaccccgacccacgcaaatgtaggggcgctggacttgccgagcatgggttatacactgatctattcatgccaagaagggttttctctgaaaggtgggagcgagcaccggacatgtaaagccgatgggtcctggacaggcaaaccccccatttgcctcgaagtccgtcctagcgggcgacctattaataccgccagagagcctccactgacccaagcactgattcccggggacgtctttgccaagaacagtctgtggaaaggcgcttatgaataccagggaaaaaaacaaccagctatgctgagggtgactggattccaggttgctaattctaaagtgaatgctacgatgattgaccacagtggagtggaactccatctggcaggcacttacaaaaaagaagacttccatctactcctccaggtgtaccagatcacaggtccagtggaaatctttatgaacaaattcaaggatgaccattgggccctggacgggcatgtaagtagcgaatcttctggcgccacattcatctaccagggctcagtgaagggtcagggctttggacagttcggtttccagaggttagacctgagactgctggagagtgacccagagtcaattggacgacacttcgcttctaatagctcaagtgtggcagctgcaatcctggtcccattcattgcactcatcatagctggatttgtgttatacctctataaacacagaaggagaccaaaggtgccttttaatggctacgctggacacgagaacactaacgtaagagctacttttgagaaccccatgtacgaccggaatatccagccaactgatattatggcgagcgaggctgaatttactgtgtcgactgtgtgtactgccgtatag

SEQ ID NO: 184112 - DNA, 1281 bp, Artificial Sequence
  Description of Artificial Sequence: Synthetic coding sequence
atgctgggcagcttcagcggcaccaccgtgcccgccctgctgaactctaccagtaaccaattatatctgcatttctactcagacataagcgtgtccgccgcaggtttccatttggaatacaagaccgtgggtctgagcagctgcccagaacccgcggtgccgtcaaacggtgttaaaaccggtgagagatatctggtaaatgatgtggtttccttccagtgtgagccaggatatgcccttcagggacatgcacacattagttgcatgcctgggactgtccgcaggtggaactacccaccgccactgtgtattgcccagtgcggaggaacagtcgaagaaatggagggcgtaatattgagtcccggatttccaggcaactacccaagtaacatggactgctcctggaagatcgccctgcctgttgggtttggggctcatattcagtttctgaattttagcaccgagcctaatcatgactacatcgagatcaggaatgggccctatgagacttcccgcatgatgggacggttttctgggtctgagctaccttcttcactcctgagcacaagccacgagaccaccgtatactttcacagcgaccactcccagaatcgacctggcttcaagttggaatatcaggcctacgagctgcaggaatgccctgatcccgagccttttgccaacgggattgttaggggcgccggctataatgtaggacagagcgtcacgttcgagtgtttgcccggttaccaactgaccggacacccagtgctaacatgccaacatggaactaatcgaaattgggatcatcctctgcctaagtgcgaggttccttgcggcggaaacatcacctcctcaaacggcactgtttactctcccggatttcctagcccatattcctctagtcaggattgtgtatggctgatcactgtgcctatcggtcacggggtgcggctgaatctgtctctcctccaaacagagcccagtggcgacttcattactatctgggatgggccacaacaaaccgcccctaggctcggcgtgtttacccgctccatggctaagaagacagtgcagagttcttctaatcaggtgctcctgaaatttcatagggatgccgccacaggcgggatctttgcaattgccttttccgaccattgtagatatttcaatcaaaaaagcggcaagcttgattttacaccatcttctacactaggccagctttgtaagaccctgcacagaagcctgcctcacctgagactccaatttttgcatctgtag

SEQ ID NO: 184113 - DNA, 11124 bp, Artificial Sequence
  Description of Artificial Sequence: Synthetic coding sequence
atgaagggcatccggaagggcgagagccgggccaaggagagcaagccctgggagcccggaaagaggaggtgtgcgaagtgtgggcgtctagacttcattctgatgaagaagatggggatcaaatctggcttcactttctggaatctggtttttcttttgactgtttcttgcgttaagggcttcatttatacttgtggcggaacacttaagggcctaaacggtactattgagagccccggcttcccttacggctatcctaacggcgccaattgcacatgggttattattgctgaagagcgaaatcgaatccaaatcgtgttccagagctttgcactggaagaggagtacgattatctgtcactgtatgatggacacccacatcccacaaatttccggacacgtttaaccggattccaccttcctcccccagtaacatccacgaagagtgtgttctccctgcggttgacctccgatttcgccgtcagcgcccacggcttcaaagtgtattatgaggaactgcagtcctcatcatgcggtaatcctggcgtaccaccaaaaggggtgctgtatgggacccggttcgacgtcggcgacaagatcaggtattcctgcgtcaccggttatattttggatggtcaccctcaacttacctgtatcgctaattcagtgaataccgcctcctgggactttccagtcccgatctgtcgggccgaagatgcatgcggcggaaccatgcgggggtccagtgggattatatcttccccttccttccctaacgaataccacaacaatgcagattgcacatggacaatcgtggcggaacccggggatacaatctcattgatcttcacagactttcaaatggaagaaaaatatgactatctcgagattgaaggtagcgagcctcccaccatctggttatcaggtatgaacatacccccaccaatcatcagtaataaaaattggctgaggctacacttcgtgaccgatagtaatcaccggtaccgcggattcagtgcgccataccagggtagctccaccctaactcatacaacaagtaccggggaactggaggaacataatcgtaccaccaccggtgccatcgccgtcgcctccactcccgcagacgtgaccgtttcgtcagtgaccgctgtcaccattcacagactttcagaagaacagcgtgtccaggtgacatcgctgcggaattcaggactggatccaaatacatccaaggacgggttgagcccccatcctgcggacacgcaatccacgcgccggcgtccgagacacgctgaacagattgagcgcacaaaagaactggcagtcgtaactcacagagtgaagaaagctatagatttcaaatcccggggcttcaagctgttccctggcaaagacaattctaacaagttttctattctcaatgagggaggaataaagactgcatctaacttatgccccgaccctggagaacctgagaacggtaaacgcatcggaagtgatttctctctcggaagcaccgtccagttttcatgtgatgaagattatgtactgcaaggcgcaaagagtattacttgccaaagaattgccgaggtgttcgcagcctggtcagaccacagacctgtttgcaaggtgaaaacatgtgggtccaatcttcaggggccttccgggacatttactagccccaacttcccgtttcagtatgacagtaacgctcagtgtgtgtgggtgatcactgcagtgaataccaacaaagtgatccagattaatttcgaagaatttgacctggagattgggtacgacacgctgactatcggagatggaggtgaagtgggcgacccacgcaccgttctgcaagtgttgaccggaagcttcgtccccgatctcattgtgtcgatgagttctcagatgtggttgcacttgcaaacagacgagagtgtcggaagtgtgggcttcaaggtcaattacaaggagattgagaaagaaagttgtggtgaccccgggacccccctctatggcattcgcgaaggtgatggattcagtaacagggatgtacttagatttgagtgtcaatttggcttcgagcttataggggaaaagtccattgtgtgccaggagaataatcagtggagcgccaatatccctatttgcatattcccttgtctgtcaaacttcacggctccaatggggacagttttgagcccggactaccccgaaggatacgggaacaacttgaactgtatctggaccattatcagtgatccaggttcgcgcattcatctgtcattcaacgactttgacttggagagtcagtttgacttcctggcagtgaaggatggggatagccctgaatcccccattctcggaacgtttactggcgccgaagtacctagccatctgacctccaacagccacatcctaagactcgaatttcaggccgatcattctatgagcgggcggggtttcaatattacatacaacacttttgggcataacgaatgtcccgatcctggaatccctattaacgccagaaggttcggcgacaacttccagctcgggtcttctattagtgtgatctgcgaggaaggctttattaagactcagggcactgagaccattacctgtatcctcatggacggcaaggtgatgtggtctggacttattccgaaatgtggggcaccctgtgggggtcatttttctgcgccttcaggcgtgatcctctcgccaggctggccaggttattacaaagatagtttaaactgcgaatgggttattgaagccgaaccaggacattctataaagataacctttgaaaggttccagacggagctgaattatgatgtcctggaagtccatgatggcccgaacctactgagccctttgctcggtagctataacggcacacaggtcccacagtttctattctcctcgagcaatttcatctatctgctcttcactacggataattcaagaagtaacaacggtttcaaaatccactacgaatctgtgaccgtgaatacgtattcttgtctagacccagggattccagtccacggcagacgttacggtcatgacttcagcattggttctacagtgtcttttagctgcgatagcgggtaccgcctctctcacgaagaaccactgctgtgcgaaaagaaccactggtggtcacacccactgcctacttgtgacgcactatgcgggggggatgtccggggcccgagcggtacaatcctctcgcctggttaccctgagttttatcctaattcgctgaactgcacgtggactgtggacgtcactcacggaaagggcgtgcagttcaacttccacaccttccacctggaagatcatcatgactatctgcttatcactgaaaatggcagctttacccaacccttggctcgactgaccggaagcgatctcccgcccactatcaacgctggcctctacggcaacttccgggcacagttgcgtttcatctccgactttagcatcagttacgaaggattcaatatcaccttcagtgaatataacttggagccttgtgaggaccctgggatcccccaatacggctcccgaattggcttcaactttggcattggcgacacactcacattctcttgctccagcggatatcggctagaaggtacgtccgaaatcatctgcctcggtggcggtagacgggtttggtccgccccacttcctcgttgtgtggcagaatgcggtgcaagcgcaactaataacgaaggcatactgctgagtccgaactaccctctgaattatgagaacaaccacgagtgcatctatagtatccaggtgcaggccggcaaagggatcaatatttcagcacggacattccatttggcccagggggatgtgttaaagatctacgacggcaaagacaagaccacacatctgctgggggcctttaccggtgctagcatgaggggactaacactgagcagcacaagcaatcaactctggctcgagtttaactcagacacagaaggcacagacgaaggtttccagctcgtatatacctctttcgagctcagccattgtgaggatccaggcatccctcagttcggttacaagatcagtgaccagggtcactttgcgggcagcactatcatttatggctgcaatcctggttacactctccatggttcatctctcctcaagtgcatgaccggagagcggagggcttgggattaccccctcccttcctgcattgccgagtgcggcggtcgtttcaaaggcgaaagctctggacgcatcctgtcaccaggatacccttttccatatgacaacaacctgagatgcatgtggatgattgaagtcgatccgggcaacatcgtgagcctgcagtttctcgctttcgacacagaggcgtcacatgacattttgagagtctgggacgggccacccgaaaatgatatgctgctcaaagagatttctgggagcctcatccctgagggaatccacagtacccttaatatcgtgactattcagtttgacaccgacttttatatcagcaaatcaggtttcgctatccagttctcctccagcgtggcaactgcctgtagggatcctggtgtcccaatgaatggtactcgcaacggggatggccgcgagcccggagatacagtcgtctttcagtgtgatccggggtatgaactgcagggcgaggagcggatcacatgtatccaggtggagaaccggtacttctggcagccttccccacccgtttgcatagccccttgtggaggaaatctgactggtagttcaggttttatattgtcgcccaatttcccccatccttacccccactctcgtgattgtgactggacgataacagtgaatgccgactacgtaatatcgctggcattcatctctttctcaatcgagccaaactacgatttcctgtacatctatgatgggcctgattcaaattcaccccttatcgggagctttcaagatagcaagctgcctgaaaggatcgagtcaagctctaatacgatgcatttagccttccgcagcgacggctccgtgtcatacactggttttcacttggagtataaggccaagttgcgggagagttgttttgatccgggaaacataatgaatggcaccaggctcggcatggactataaactagggtccactgtgacctactattgtgacgccggctacgtcctgcagggctattctacactcacgtgcattatgggtgacgatgggaggcccggatggaatcgcgctctgcctagctgccatgctccgtgtggctcaagaagcaccgggtcagaggggactgtgttgagtccaaactatccgaagaattactctgtaggacataattgcgtgtattcaattgccgttcccaaggagtttgttgtctttggtcaatttgtattttttcagacaagcttacacgacgtggtggaagtctacgacggacctacccaacagagcagcctcctctcatctctttccggatcccactctggcgaatcccttcctctttctagtggaaatcagattaccatccggtttacctcagtgggccctatcacggcgaaagggtttcacttcgtctatcaggcagtgcctcggactagtagcacacaatgtagctcagtgccagaaccacggttcggacggcgtattggcaacgaatttgcagtcggctctagcgtgctgtttgattgcaatcccggatatatcttacatggctccatcgcaattcgttgcgaaacagtccccaacagtctcgcccaatggaatgattcactgccaacatgcattgtcccttgcggcggtattctcactaaaaggaaaggaacaatcttatctccaggataccctgagccatacgataataatttgaactgtgtatggaaaatcactgtgccagaaggtgctgggatccaggtgcaggtcgtatccttcgcaactgagcataattgggactctctggatttctacgacggcggcgataataatgcacctcgcctgggaagttatagcgggaccacaattccacatctcctgaatagtacgagcaacaatctctaccttaactttcagagtgatatctccgtgagtgctgctggattccatctagagtatacggccattgggcttgattcttgcccggaacctcagactccatcgagcgggatcaagattggcgatcgctatatggtaggtgatgttgtgtcgtttcaatgcgaccaaggttattccctccagggacacagccacatcacttgcatgcctggccctgtccgtcggtggaactacccgattccaatctgtctcgctcagtgcgggggagcaatgagtgatttctccggggtgattctgtcgcctggattccccggcaactatccatcaagcttagattgcacatggactataaacttacctatcggtttcggggtgcatctgcaatttgtgaattttagcacagaaacaattcacgattatttagaggttcggtctggctcgtctgaaacatcaaccgtgatcggccggctgtctggtccccagatcccttccagtctcttttctactacacatgagacttcattgtactttcattcagattatagccaaaataagcagggcttccacatcgtgtatcaggcttaccaactgcagtcctgtcccgatccaaggccattccgaaacgggttcgttatagggaacgacttcaccgtggggcaaactatctctttcgaatgtttccccgggtacacactgatcgggaacagcgcccttacatgcctgcatggagtgtctcgaaactggaaccatcccttgccccgctgcgaagccttgtgcgggggcaacatcactgccatgaacggcacgatttattcaccagggtacccagatgagtatcccaactttcaggactgtttctggctggtgcgggtgcctcccggcaacgggatctacattaactttactgtccttcagaccgagcctatctacgactttataacggtctgggatggaccagatcaaaatagtccccaaatcggacagttctccggaaacacagcacttgaaagtgtttacagtacatcaaatcagattcttatcaaatttcatagcgattttaccacgtccggcttctttgtcctcagctaccacgcctaccagttacgcgtctgccagcccccaccaccagtgcctaatgcagagatcctgaccgaagacgatgaattcgagataggcgacataatccgctatcagtgtcttcccggctttaccttagtgggcaatgccatcctgacctgcagactgggagagagactgcagatggatggagccccccccgtctgccaagtgctttgccctgctaacgagctccgcttagattccacaggagttattctttctcctggataccccgattcctatcccaacctccagatgtgtgcctggagcatcagcgtggaaaagggctacaacataaccatgtttgtggaatttttccagaccgaaaaagagtttgacgtccttcaggtctacgatggacctaacatccagagcccggtactcatttctctgtccggtgattattccagcgcatttaacatcaccagtaatggacacgaggtgttccttcagtggtcagcagaccatggcaacaataagaaaggctttcgaattcggtacatagcattctattgttctacccccgagagccccccccacggatatatcataagtcagaccgggggacagttgaacagcgtggtaagatgggcttgcgacagaggcttccgcctggttgggaaatcaagtgcggtctgcagaaaatctagttatggctatcatgcctgggacgctcccgtgcctgcctgtcaagccatttcctgtgggattccgaaagcccccactaatgggggtatcctcaccaccgactacctggtggggacaagagtaacctacttctgcaacgatggatacagattaagtagcaaggagctaaccaccgctgtgtgtcaaagcgacggaacctggtcaaatcacaataagactccaagatgtgtggtggtgacgtgcccgtcaatcaactccttcatactggagcatgggcgctggcggatcgtgaacgggagtcactatgagtacaaaactaaggtggtgttttcgtgtgacccaggatatcacggccttggaccggcttcgattgagtgtctgccaaacgggacttggtcatggcgcaacgagcgcccatactgccagatcatttcttgcggcgaacttccaaccccacctaatgggaacaaaataggcacacagacaagctacggctccactgcaattttcacttgcgatctaggattcatgctggtgggaagcgccgtcagggagtgtctttcctccgggctgtggtcagagtctgagacacggtgcctcgccgggcactgcgggattcccgaactcattgtgaatggccaggtcatcggcgagaattacggatatagagacacagtcgtatatcagtgtaatcctggattcaggcttataggttccagtgttagaatctgccagcaggaccataactggagtggacaactgcccagctgcgttccggtatcttgtggccatcccggttccccaatctatggacgaacatccggaaatggatttaactttaacgacgtcgtaaccttttcttgcaacatcggatacctgatgcaaggtcctactaaagcacaatgccaggctaacagacagtggtcccatccgcctccaatgtgcaaggtcgtgaattgctccgaccccggcatccccgcaaatagcaaacgtgaaagcaagattgagcatggcaacttcacctatggtactgtggtattctacgattgtaaccccgggtattttctttttggaagcagtgtgttgatttgccaaccgaacggacaatgggacaagcccttacctgaatgcattatgatagactgtggtcaccccggcgttccgccaaatgccgtcctttccggagagaagtacacttttgggtcaactgtacactactcatgtacagggaagagaagtctcttagggcagtccagccgcacctgtcagctgaatgggcactggtccggtagtcagccacattgttccggcgatgccactggtacatgcggagatccaggtacccctggacatgggtcccggcaggagtctaacttcagaactaagtcaaccgtccgctacgcatgtgacacgggatatatccttcacggtagtgaagagcggacctgcctagcaaatgggtcctggaccggccggcagccggagtgcaaagctgtacagtgtggtaaccccggaaccactgcgaacggaaaggtgttccgcattgatggtacaactttctcatcaagcgttatctattcgtgcatggaggggtatatactgagcggaccaagtgtcagacagtgcaccgctaacggtacctggagtggaaccctgcccaattgcaccatcatttcgtgtggtgatccaggcataccagcaaatggactcagatacggcgatgattacgtagtcggtcagaatgtgtcgtacatgtgccaacctgggtataccatggaactgaacggtagcagaattcgcacatgtactatcaacggcacctggagtggagttatgcctacgtgccgtgccgtaacatgtcctacccccccacaaattagtaacggccgcctggaaggcacaaacttcgattggggattctctatatcttacatttgtagccctggttacgaactcagctttcctgccgtcttaacatgcgtggggaatgggacttggtccggcgaggtacctcagtgtctccccaaattctgcggagaccccggaattccggctcagggaaaacgcgaaggaaagagctttatctatcagtctgaggtctcgtttagttgcaacttcccctttattctggttgggagctctactcgcatttgtcaggctgatggtacatggtctgggtctagccctcactgcatagaaccaacgcagacatcttgtgagaacccaggcgttcccagacatggttcccagaataacaccttcgggtttcaggtaggttcggtggtgcagtttcactgcaaaaaaggtcacctgcttcagggatcaacaacaagaacttgcctgcccgacctgacatggagcggaatacagccggaatgtattccacacagctgcaagcagcccgagacacccgcccacgctaatgtcgtcggcatggatctgccaagccatgggtacaccctaatttacacatgccagcctggattcttcctggcgggcgggaccgaacacagagtctgccgcagcgacaacacctggacagggaaagtaccaatatgcgaggccggatccaagatcttggtgaaggacccaagaccagctttgggtactccttcaccaaagttatccgttcccgatgacgtttttgcccagaactacatctggaaagggagttacaattttaagggcagaaaacagcccatgactttgacggtgactagttttaacgcttctacaggtagagtaaacgccaccctgtcaaattccaatatggagctgcttctttcgggcgtgtataagagtcaagaggcccggctcatgctgcgaatctacctgattaaggtacctgcccatgcgtctgtgaagaagatgaaggaagagaactgggcaatggatggatttgttagcgccgaaccggatggtgctacctacgtattccaggggttcatccagggtaaagactacgggcagttcggtttgcagcgcctagggctcaacatgtccgaagggtccaattccagtaaccagccacatggcacaaacagcagttcggtggctatcgctattctcgtccccttcttcgcactgattttcgctgggttcggattttacctgtacaaacagcgcacagctcctaagacacaatacactggttgcagcgtgcatgaaaacaataacggtcaagccgccttcgaaaacccgatgtatgacacaaacgccaagagtgtggaaggaaaggccgtgcggttcgatcccaacctaaatactgtgtgcacaatggtgtag

SEQ ID NO: 184114 - DNA, 11004 bp, Artificial Sequence
  Description of Artificial Sequence: Synthetic coding sequence
atgtggagctggttcctgtgctggaagcccgtgcagctggaccggcagaccgcctccggcttcatctacacctgcggaggtaccctgaaaggacttaatggtaccattgagagccccggctttccctacggttatcctaacggggcaaactgtacctgggtgatcatcgccgaggaacgcaacagaattcagatcgtttttcagagctttgcattagaagaggagtatgactatctttcactctacgatggacatccgcatccaaccaacttccggacccggctgaccggcttccacttgccgccaccagtgacgtcaaccaagtctgtgttttccttgcgcctcacctccgacttcgcggtctcagcccacggttttaaggtttactacgaagagctccagagcagttcatgtgggaatccaggagtcccccctaaaggtgtgctctacggtacccgctttgatgtgggcgacaagattaggtacagctgcgtgactggctacatccttgatggccatccccagctgacttgcattgcaaacagcgtgaatactgcatcatgggatttccccgtcccaatatgccgtgctgaggatgcatgtgggggaactatgagaggtagttcggggattataagctccccgagcttccctaacgagtatcataacaacgctgactgtacctggaccattgtggcagagccaggggacaccatctccctaatctttaccgactttcagatggaggagaaatatgattatctggagatcgaaggctcagagcctccgactatttggttaagtggaatgaacattcccccccccattatttctaataaaaattggctacgactgcactttgtcacggattccaatcaccggtatagaggttttagtgcaccttaccaggggtcctcaaccctgacgcacacaacaagcacaggtgagctggaggaacacaaccggactacaacaggcgcgattgcagttgcttcaacacccgcagatgtgacagtcagtagcgtcacagccgtgactatccatcgactgtcggaagaacagcgtgtgcaggtcacatcactgaggaattcggggctggatcctaacactagtaaggatggcttatcccctcaccctgccgatacccagtcaacacgaagacgacctcggcacgctgagcagatcgaacggacaaaagagctcgccgtggtaactcacagggtgaaaaaggctattgactttaagtctagagggtttaaactatttcccggtaaggataattccaataagtttagcatcctcaatgaagggggtataaagactgcctccaacttatgtcctgacccaggtgaaccagagaatggcaaaaggattgggagtgatttttccctgggctctactgttcagttctcttgtgatgaagattatgtcttacagggagctaaaagcattacgtgtcagcgcattgccgaagtctttgccgcgtggtctgaccatcgacccgtctgcaaggtaaaaacatgtggcagcaacctccaggggccatccgggacattcacctcacccaacttccccttccagtacgactccaatgcccagtgtgtttgggtcattacggccgtcaacaccaacaaagttattcaaattaatttcgaggaattcgacctggagatcggttatgatactctgaccattggagatggaggcgaggtgggagatccgcgtactgttcttcaggtcttgactggatctttcgtgcctgacctgatcgttagcatgtcttcacagatgtggctacaccttcagactgacgagtctgtgggctctgttgggtttaaagtgaactacaaggagattgaaaaggagagctgcggagaccctggcacccccctctatggcattcgcgagggcgacgggttctctaaccgtgatgtgctgaggttcgagtgtcagtttggcttcgagctaatcggtgagaagtccatcgtgtgtcaagagaataaccagtggtcagcgaacattccaatatgtattttcccttgcctttccaacttcactgcgccaatgggtactgtgctcagtcccgactacccggaaggctacggaaacaatctgaattgcatttggacaataataagtgatcctggctcccgtattcatctctcttttaatgatttcgacctggagagtcaattcgattttctcgctgtgaaggacggagattctcccgaatccccaattctgggaacctttacaggcgccgaggtgccgtcccatctcacaagtaattcacatatactccgtttggaatttcaggccgaccactccatgtcgggccgaggctttaacatcacctacaatacatttggccataacgagtgtcctgatcctggcatccccattaatgctagacgcttcggggacaactttcagctgggaagtagcatcagtgtgatatgcgaggagggcttcatcaaaacacagggtacagagactatcacatgcattctgatggacggtaaggtgatgtggtcaggactgatcccgaaatgcggggccccttgcggcgggcacttttctgcccccagtggggttattctttctcctggctggcccggatactataaagatagcttgaactgtgaatgggtcatcgaggccgagccgggacactccatcaagatcacttttgaacggttccagacagagttaaattatgacgtgctagaagtgcacgatggaccaaacctactgtcgcccctcttgggcagttacaacggcactcaggttccacaattcctctttagttcctctaacttcatttacttactgttcacgaccgacaattcccgcagtaataatggatttaaaatacactacgagagtgtcacggtaaatacttactcctgcctggatccaggcatccccgttcatgggagaagatacggacacgactttagcattgggtccaccgtctcatttagctgcgatagcggctacaggctcagtcatgaggaaccgcttctttgtgagaagaatcactggtggagccacccgcttcctacctgcgatgctctctgtggcggtgatgtgcgcgggcctagcgggacaatcctgtcacctggatatccagagttctatccaaattcactcaactgcacttggacagtcgatgttacccacggtaaaggcgtgcagttcaacttccatacatttcacttggaagatcatcatgattatttgttgatcacagagaacgggagcttcacccagccgttggccagattaaccggctcagaccttccccctaccatcaacgccggactttacggcaattttagggcacagctgaggtttatctccgacttctctatctcctatgaaggattcaatatcaccttttcagaatataatctggaaccatgcgaagacccaggcataccacagtatggatccaggatcgggttcaacttcggcatcggagacacattgacattttcctgctcctcaggatatagattggagggcacatcagaaatcatttgcctgggcgggggacggagggtctggtctgcccctctgcctcggtgtgtggccgagtgtggagctagtgctaccaacaatgagggcatcctgttaagccctaactatccgctgaattacgagaacaaccatgagtgcatttattcaatacaggtgcaagccggaaaaggcatcaatatctcagccagaacctttcacctggcacagggtgatgtcctgaagatttacgatgggaaggataaaactacgcacctgctgggcgcctttaccggtgccagcatgcgcggcctcaccctgtcttccaccagtaatcagctgtggttggagttcaatagcgacacagagggcacagacgaaggctttcagttagtgtatacatcattcgagctttctcactgcgaagaccccgggataccccaattcggatacaaaatttcagatcaggggcactttgcaggcagtaccattatttatgggtgtaacccgggttacaccctccacgggagcagtctacttaagtgcatgactggggaacgcagggcatgggactatcctctcccctcttgcattgccgagtgcggaggaaggttcaagggagagagcagcgggcgaatactcagcccagggtatccgttcccttatgacaataatttacggtgtatgtggatgatcgaggtggacccgggtaacattgttagcttgcaatttctggcttttgataccgaagccagccacgatatcctgcgggtctgggatgggcctccagaaaacgacatgctcctgaaagagatatccggaagcctgatccccgagggcatccatagcactttaaatatagtcaccattcaatttgatactgacttttatatctcaaagtcaggcttcgctatccaattcagttcttctgttgcaaccgcctgtcgggaccccggtgtgccgatgaatgggactagaaatggtgatggacgtgaaccaggcgacactgttgtgttccagtgtgacccaggatacgagctgcagggagaggagcggatcacctgcattcaggtcgaaaatcggtatttctggcaaccctccccccctgtctgcattgctccatgtggcggaaacttaacgggtagctctggcttcattctcagtcctaatttccctcatccttacccacatagccgagattgtgactggaccataacagttaacgccgattatgtcatcagcttggcctttatctctttctccatcgaaccgaattatgatttcctgtatatctatgacgggccggacagtaatagccccctgattggtagttttcaggactccaagctcccggaacgtatagaatcaagttctaatacgatgcatcttgcattccggtccgacggtagtgttagctatacaggatttcatttagaatacaaggccaaattgagagagtcctgtttcgatccgggaaacatcatgaatggcacccgcttaggcatggactacaagctcggctcaacggtgacctactactgcgacgctggctacgtcctccaggggtattcgacactcacatgtatcatgggagatgacgggagacccgggtggaatcgtgccctgcctagttgccatgccccatgcggctcgaggagcacgggatccgaaggcacagttctgagccctaattaccctaagaactatagcgtgggacacaattgtgtgtacagcatcgccgttccaaaggaattcgtggtttttggacaattcgtgttttttcagacgtccttgcacgatgtggtggaggtatatgatgggcccacacagcagtctagcttgttgtcttccctcagcggatcccactcgggcgagagcctgccactgtcgtcaggtaatcagataaccatacgcttcacgagtgttggccctataaccgcaaaaggatttcacttcgtgtaccaggctgtgcctcgcactagcagcacacagtgcagctcagtaccagaaccacggtttgggaggagaattggaaacgagttcgctgtgggatcctctgtgctgttcgattgcaaccccggttacatcctgcacggcagcatcgctattcgttgcgaaacagtcccaaactccctggcccagtggaatgatagcttaccaacctgcattgttccatgtgggggcattctgaccaagagaaaaggtaccattctcagtccaggctaccctgagccctatgacaataacctgaattgcgtgtggaagatcaccgtgccggaaggcgctggcattcaggtgcaggtggtctccttcgccaccgagcacaactgggattcgttggacttctacgatgggggtgacaacaacgcccccaggcttggcagttacagtggaactacaatacctcacctcctcaattcaacatcgaataatctctacctaaattttcagagtgatatatcagttagcgctgccggcttccatttagaatataccgcaattgggttagactcatgcccggagccccagacacccagctcgggcattaaaatcggggaccgctacatggtcggcgacgtcgtgtcatttcagtgtgatcagggatactctctacagggccactcccacatcacttgtatgcctgggccagtgaggagatggaattatcctatacccatctgcctcgctcagtgtggcggggcaatgagtgatttctcaggagtgattctgtctccaggattccccggcaattacccctccagcctcgactgcacctggaccatcaatcttcccattggatttggggttcacctgcagttcgtgaatttttctaccgagacaatccacgactatttagaagtacgttccgggtccagcgaaactagtaccgtcattggccgtttatcaggtcctcaaatcccatcctcactattctccactactcacgagacttccctctactttcactccgactacagtcagaacaaacagggattccacattgtgtaccaggcataccagctccagagttgcccagatcccagacctttccgcaatggcttcgttatcggaaatgatttcacagtgggccagacgatttcttttgagtgttttcccgggtataccctgataggtaattccgcactgacttgtctacatggtgtgtctagaaattggaaccaccccctgcccaggtgtgaggcactgtgcggtggtaacatcactgcaatgaacgggaccatctactctcccgggtatccggacgaataccctaacttccaggactgtttctggctggtgcgtgtacctccagggaatggtatttacattaattttaccgtactccagaccgaaccaatctatgattttattactgtctgggatggccccgaccagaacagccctcaaattggccaattcagtggcaatacagccttggagtccgtgtactcgaccagtaatcagatcctgatcaagtttcattcggatttcacaacgtccggcttctttgtcctgtcttaccacgcataccaacttcgtgtttgtcaaccaccccctccagtgccaaatgctgaaattttgactgaggatgacgagtttgaaataggtgatattattcgttatcagtgcctcccagggttcaccctggtgggcaatgcaatcctgacatgcagactgggggaaaggcttcaaatggacggagctccacccgtttgccaggttctgtgtccagccaacgaactgcggcttgacagcactggcgtgatactgtcacctggctatccagattcatacccgaacctccaaatgtgcgcgtggtcaatttccgttgagaagggctataacatcactatgttcgttgagttttttcagacggagaaagagtttgatgtgctgcaagtctacgacggacccaacatccagtctcctgtcctgatttcgttgtcaggcgattactccagcgcctttaatatcaccagcaatggacacgaagtgtttctacagtggagcgcggaccacgggaataacaaaaaggggttccgcatccggtatatcgccttctactgttcgacgccggagtctccaccgcatggctacatcatcagtcagaccggcggacagctcaactcagtggtgaggtgggcctgtgacagaggattcaggctcgtgggtaagtcgtctgcggtatgccggaagtcatcttacggttatcatgcatgggatgcacccgtccccgcctgccaggcaatcagctgcggtatacctaaagcgcctactaacggcggaattttaactaccgattacctcgtagggacacgggttacttacttctgtaatgatggatacagactgtcatccaaagaattaaccacagccgtgtgtcagtcagatggtacgtggagtaatcacaacaaaactccacggtgtgtcgtggtgacatgcccatcaattaactctttcatcctggagcacggaaggtggcgtatagtcaatggcagccactacgagtataagacaaaggtggtttttagttgtgatcccgggtaccatggcctggggccggcctcgatcgagtgcctcccaaatggtacctggtcctggcgcaacgaaagaccctattgccagatcatcagctgcggcgagttacccactcctcctaacggaaacaaaattggaacgcagacttcttacggcagtactgctatcttcacctgcgaccttggattcatgctcgttgggagcgccgtgcgcgagtgtttaagcagcggcctttggtcagagtccgagacccgctgcttggcaggtcactgcggcatccccgagcttatcgttaatgggcaggtgattggcgaaaactacggttatagagatactgttgtataccaatgtaacccgggcttcagactcatcgggtcgagtgtaagaatatgtcagcaagaccacaactggtcagggcagctgccaagttgtgtcccagtatcttgcgggcacccgggaagccccatttacggccggacgtccgggaacggcttcaacttcaatgatgtggtgacattctcatgcaacattggatacctgatgcaggggcccacaaaagctcagtgccaggctaatagacaatggagccacccgccacccatgtgtaaggtagtcaactgcagcgaccccggcattccagcaaactccaagcgggaaagcaaaatcgaacatggcaattttacctacggcactgttgtgttctatgattgtaatcccggctattttctgttcggatcctctgttctgatctgtcagcccaacggccagtgggataagcctctcccagagtgcatcatgatagattgcggccaccctggtgtgccaccgaatgccgtgctgtctggagagaaatatacgttcggtagcacagtacattattcttgtaccggtaaaagatccctcctaggtcagagctccaggacttgccagctgaacggccattggagtgggtcccagccgcattgtagcggagacgctaccggtacatgcggcgacccaggaacaccgggacacggatcccgccaagaatccaacttccgtaccaaatccactgtgagatacgcctgcgacactggctatatccttcatggaagtgaggagaggacatgtctggccaatgggtcctggactggccggcagcctgagtgcaaagctgttcagtgcggcaaccccggtaccacggccaacggcaaggtgtttcgaattgatgggacaactttctcctcctccgttatctacagctgcatggaggggtacatattatctggtcctagcgtcagacaatgcacggctaacggcacttggtccggtaccctgcctaattgcaccatcatcagttgtggtgatccaggtatccctgcaaacggactgcggtacggagatgactatgtcgtaggccagaacgtgagttacatgtgtcaacccgggtacacaatggagcttaacgggagcagaattcgcacatgtacgattaacggcacctggtccggagtgatgcctacatgcagggccgtgacatgcccgacaccaccccagatcagtaacgggagacttgaagggaccaacttcgactggggcttttccatctcttacatttgctcccccggctatgaactgtccttcccggcagttttgacttgtgtcgggaatgggacatggagcggagaggtccctcagtgtttacccaaattctgcggagatcccgggatccccgcccaggggaagagagagggcaaaagctttatttaccaaagcgaagtctccttcagctgtaacttcccttttatcctggtaggctcttcaacaagaatctgtcaggcagacggcacttggtccgggagtagtccgcactgcattgagcccacgcagacatcctgtgagaatccgggagtgccccggcatggttcccagaacaatactttcgggtttcaggtggggtccgtagtgcagttccactgtaagaaagggcatctgcttcagggaagtacaactagaacctgcctcccagacctgacttggtcgggcatccagcccgagtgcatccctcatagctgcaaacaacccgaaacccccgctcacgctaacgtggtgggaatggaccttccaagccacggatacacccttatctatacatgtcagcctggttttttcctggccggggggaccgaacatagggtgtgtagaagtgacaatacatggacaggcaaggtgccgatttgcgaggccgggagtaagatactcgtgaaagatccaagacctgcactgggaacccccagccccaaactgtccgtacccgatgatgtcttcgcccaaaactacatttggaagggtagctataattttaaagggcggaaacagccaatgacattgactgttacctcatttaacgccagcactggccgcgtgaacgctaccttgagcaacagtaacatggaactattgctaagcggggtctataaaagccaggaggcgcgactcatgttgagaatctatttgataaaggtcccagcacatgctagcgttaaaaaaatgaaggaggagaattgggccatggacggtttcgtgtccgccgaacccgatggggccacatacgtgtttcaggggttcatccagggcaaggattatggccaatttggccttcagcggttggggcttaatatgtccgagggctctaattcctctaaccagccgcacggaactaattccagcagcgtcgcaatcgctatactggttccatttttcgccttaatctttgctgggttcggattctatctgtacaagcagcggacggctcctaaaacacagtatactggctgttcggtccacgagaacaacaacggtcaggcagcatttgagaaccctatgtatgacacaaatgccaaatccgttgaagggaaggcagttcgcttcgaccccaacctgaatacagtttgcactatggtgtag

SEQ ID NO: 184115 - DNA, 10914 bp, Artificial Sequence
  Description of Artificial Sequence: Synthetic coding sequence
atgaagggcatccggaagggcgagagccgggccaaggagagcaagccttgggagcccgggaaaaggaggtgcgcaaaatgtgggagactcgactttatactgatgaagaagatgggaatcaaatctggatttactttttggaatcttgtctttctgctcactgtgtcttgcgttaagggtttcatctacacttgcggcggaaccttaaagggtttgaatggcactatagagagccctggttttccatacggatacccgaatggcgcaaactgcacctgggtgataatagcagaggaaagaaataggatccagatcgtattccagagcttcgcacttgaagaggagtacgattacctgtcactgtatgacgggcacccccacccaactaatttcagaacccggttgacgggttttcacctgcccccacctgtgacctcgaccaagagcgtgttctccctcagactcacttcagacttcgcggtgtctgcccacggattcaaagtctactacgaggaacttcaatctagttcctgcggcaatccaggggtgccgcccaagggggtcttgtatggaactcgattcgatgttggtgacaagatccgttatagctgcgtaacagggtacatactggatgggcatcctcagctaacctgtatagccaactcagtaaacactgcctcttgggatttcccagtgcctatttgccgcgccgaggacgcatgcggggggacaatgcgggggagttcagggattatctcttcccccagctttcccaatgagtaccataacaatgctgactgtacgtggacgattgtagcagagccaggagacacaataagcttgatttttaccgatttccagatggaggagaagtacgactatctcgaaattgaaggctccgagccccccaccatatggctgagcggaatgaacatacctccacccattattagtaataagaattggctaagactgcatttcgtgacagactctaatcatagatacagaggattctccgctccatatcagggttctagtaccctcacacacacaacttcaactggcgagctggaagagcataacagaaccacaacaggcgctattgctgtcgcttccacccccgccgacgtgaccgtttcttcagtgacggcagtgacaatccaccgtcttagtgaagagcagcgggttcaggtcacctctcttcggaattctggactggatcctaatacctccaaggatgggctcagcccacaccctgcggacacccagtccactagaaggaggcctcgccatgctgaacagattgaaagaacgaaagagctggctgtggttactcacagggtaaagaaggctatagactttaagtcacgcggttttaaactgtttcctggaaaagacaacagcaacaaattctccatcctgaatgagggtggcattaagaccgcatcaaatctgtgcccagatcccggagagcccgaaaacggaaagaggatcggatcagacttctccctgggatctactgtgcagttttcctgtgatgaggattacgttctgcagggagcaaagagcattacgtgccaacggatcgcagaagtatttgccgcgtggtccgatcaccgccccgtttgtaaagttaagacctgcggctctaatctgcagggtccgagtggtacctttacctctccaaatttcccttttcaatatgattctaatgcacagtgtgtgtgggtcattactgccgtgaacacaaataaggttattcagataaactttgaggaatttgatctggaaatcggctacgatacactgaccattggcgacggaggagaagtgggggatcccaggactgtccttcaggtcctcaccgggagttttgtacccgatcttatcgtgagcatgagttctcagatgtggctgcaccttcagaccgatgagagcgtgggctctgtaggattcaaagtgaactataaggagatagaaaaggagagctgtggtgatccgggaacccctctctacggaattcgggaaggagacggcttcagtaacagggacgtcctgagattcgagtgtcaattcggcttcgaactgatcggagaaaagtctatcgtgtgtcaagagaacaatcagtggagcgccaacattcctatctgcatcttcccatgtctgagcaacttcactgccccaatgggtacagtgctctcccctgactatccggagggctacggaaataacctcaattgcatttggacgatcatcagtgaccccggctccaggatccatctgtctttcaatgattttgacctggagtctcagttcgacttcctggcagtcaaggatggtgacagccctgagtcccctatactgggcacgtttacaggagcagaggtccctagtcatttgactagcaatagtcacatactgcggttggagttccaggctgaccatagcatgtcagggagaggattcaacattacgtacaatacatttggccacaatgagtgtccggatcccggaataccaataaatgctaggcgtttcggcgacaattttcagctgggttcctccatttccgtcatatgcgaagagggatttatcaaaactcagggcactgaaacaatcacctgcatcctgatggatggcaaggttatgtggtctggactgatccctaaatgtggggccccatgcggtggacacttctcagccccgtccggggtgatcctgagtcctggctggcctgggtactacaaagatagtctgaactgtgagtgggtgattgaggctgagcctggacacagtatcaagataacctttgaacgattccagaccgaactgaattatgatgtcctggaagtccatgatggccccaacctcttgtcccctttactgggatcatacaatggcactcaggtgccccagtttctcttcagctcttcaaattttatctatctgctgttcactacagataactccagaagcaataatggcttcaagatccactacgaatccgttaccgtgaatacctattcctgcctggatcccgggattccagttcacgggaggcgctacgggcacgacttctctatcggcagcacagtttcattctcatgcgatagcggatatcgactgagccatgaagagcctctcttatgtgagaaaaaccactggtggagccacccactgccaacctgtgatgccttatgtgggggggatgtgcgcggtcccagtggcaccattctctcacctggctatcccgaattttaccctaatagtctgaactgtacctggaccgtagacgtcacacatgggaaaggggttcagttcaactttcacacatttcacctggaggaccatcacgactatctgctgataaccgaaaacggctccttcacccagccgctggccagactgaccgggtccgacctgccacccaccataaacgcgggcctgtacggaaatttccgtgcccagttgcgcttcattagcgatttctcaatcagttacgaaggctttaatatcaccttttccgaatacaatctggaaccttgtgaagatcctggcattccccagtatggatccaggatcggctttaacttcggtatcggggacactttgacattctcctgttcttctgggtacagactggagggcacttccgaaattatttgtctgggcggcggcaggcgggtgtggagcgctcctttgcctcgatgcgtagccgagtgcggggcctcagccaccaacaacgagggtatactgttgtcaccgaactatcccttgaactacgagaacaatcatgagtgtatctacagtattcaggtgcaggcgggtaaggggatcaacattagcgcgcgaacgtttcacctggcgcaaggcgatgttcttaagatatacgatggaaaggataagactacacacctcttgggagcgttcacaggagcctcaatgagagggttgacccttagttccacatccaaccagctctggctcgagttcaactctgacacggaggggacagacgagggatttcagctggtatatacatccttcgagctgtcacattgcgaagatcctggcatacctcagttcggttacaagatctctgatcaggggcatttcgcaggttccactatcatttatggctgcaaccctgggtatacccttcacgggtcttccctactgaaatgtatgactggggagaggagggcctgggattaccccttaccctcgtgtatcgccgagtgcggtgggcgctttaagggggaatctagcgggcggatcctctcacctgggtacccattcccttatgataacaacctccgctgcatgtggatgatcgaggtcgaccccgggaacatcgtcagtctgcagtttttggccttcgatactgaggcctcccatgacattctcagagtctgggatggcccaccggaaaacgatatgctgctaaaagaaatctctggcagtttgataccagaaggcatccattcaactctgaacatcgttacaatccagttcgacacagatttttatattagcaaatcaggttttgccatccaattttcttcatcggtggccactgcctgccgggatcccggagtgcctatgaatggcacacgcaatggcgacgggagagaacccggggacaccgtggttttccagtgcgatcccggctatgagctccagggggaggagcgaattacttgcatacaggtggaaaataggtacttctggcaacccagtcccccagtgtgcatcgccccatgtgggggcaacctcacagggagttcaggatttatcctgtccccaaactttcctcatccatacccacacagtcgggactgtgattggaccatcaccgtcaatgccgattatgtaatatcccttgctttcatttcttttagcattgagccaaattacgactttctctacatatacgacgggcctgattctaattcccccctaattgggtcatttcaggactctaagttgcctgaaaggattgagtcatcaagcaatacaatgcacttagccttcagatctgacgggtctgtgagttatactggttttcacctcgagtataaagccaaattgagagaatcatgctttgaccccgggaatatcatgaacggcaccaggctcggcatggactacaaattggggtcaaccgtcacctattactgtgacgcagggtacgtgctgcagggatactctactctaacatgcatcatgggagacgatggtcgccccggttggaaccgcgcgttaccctcctgtcacgcgccctgtggctccagatctaccgggtcagagggcacggtcctcagcccaaactaccccaagaactacagcgtcggccataattgcgtctattctatcgcagtgccaaaggagtttgcggtgcctagaacctcttccacccagtgtagtagcgtccctgaaccacgattcggtagacgaatcgggaatgaatttgcagtgggatcctctgtcctgtttgattgcaatccagggtacatcctgcatggcagcatcgccataaggtgcgaaactgtgccgaacagcctggcccagtggaacgatagcctccctacatgcatcgttccctgcgggggaatcttgaccaaacgcaaaggaaccatcctgtcacccggttatcctgagccttacgacaacaacctgaactgcgtgtggaagatcacagttccggagggcgcgggtattcaggtccaggtagtgagtttcgctacggagcacaattgggatagcttagacttctatgacgggggcgacaataacgccccaagactgggctcatatagtggtactaccatccctcatctgctgaactccacgagtaacaatctgtatttaaacttccagagcgatatttctgtatccgcagctgggttccacctcgaatatacggcaattgggctggactcttgcccagaaccccagaccccatcctctgggataaaaatcggggacagatacatggtcggggatgtggtatcttttcagtgcgaccaaggatatagcctgcagggtcatagccacattacctgcatgcccggtccagtgcggagatggaattaccccatcccaatttgccttgcacagtgcggtggcgctatgtcagatttttctggagtgatcttgtccccaggtttccccgggaactacccttcttccctggattgtacgtggaccatcaatctgcctatcggttttggcgtccacctacagtttgttaattttagcacagaaacgatccatgattacctcgaggtgagatccggctcctcagagacctcaacagttatcggccgcctgagtgggccgcagatcccatcctccctgttcagcacaacccacgagactagcctttattttcatagcgactactctcagaacaagcaagggttccacatagtgtatcaggcgtaccagttgcaaagttgtcctgatccccgtccatttcgaaatgggtttgtgataggaaatgacttcaccgtgggccagaccatcagttttgagtgtttcccaggctacactttgattggaaatagcgctctcacctgcctgcatggcgtaagcagaaactggaaccatccattgccaaggtgcgaagcactgtgtggggggaatatcacagctatgaatggaacaatatacagccccggctacccagacgaataccctaattttcaggattgtttctggctagttcgcgtgccgcctggaaacgggatctacatcaacttcaccgtactgcaaacagagcctatctatgattttataaccgtttgggatgggcctgatcagaattcaccgcagatcggccaattttccggtaacacagccttggagagcgtctatagtacaagcaatcagattctgataaagttccatagtgatttcactaccagtggcttttttgttctgtcataccacgcatatcaattgcgagtctgccagcccccaccgccagtgccaaatgcggaaatcctgaccgaagacgatgaatttgaaattggcgacatcatacgctatcagtgtctcccgggctttacactggtcggtaatgccatccttacctgtcgacttggagagcggctccagatggatggcgcacctcctgtatgtcaggtgctgtgccctgcaaacgaactcagactggacagcaccggcgtgattctgtctcccggctatccagactcatatccaaacctgcagatgtgtgcctggtcaataagcgttgaaaaagggtataacatcactatgtttgttgaattctttcagaccgaaaaagagtttgacgtgttacaggtgtatgacggtccaaacatccagtctcccgtgttgatctcgctgtccggcgattacagctctgcttttaacattacttctaatggacatgaggtctttttgcagtggagcgccgaccatggcaataacaaaaaaggctttagaattagatacatcgccttttattgctctacgccagaatcaccgcctcacggatatattattagtcagaccggcggacagctgaattcagtggtccgctgggcttgtgacaggggcttcaggctggtcgggaaatcttctgctgtctgtaggaagtcgtcatatggctatcacgcgtgggacgcgccagtgcccgcatgccaggcaatttcctgtgggattcctaaggcccccaccaatggagggatcctgaccacagattacctagtcggaaccagagtgacttacttttgtaacgatggctaccgcctctcgtccaaggagctcaccacagcggtctgccagtctgacggaacatggtccaatcacaacaagactcctagatgtgtggtcgtgacttgtccttcaatcaacagctttatcttggaacacggtcgctggcgtatagtcaacggatctcactacgagtataagacaaaagttgtgttctcctgtgatcctggctaccacggcctcggtcctgccagtatcgaatgtctgcccaacggaacctggagttggcgcaacgagagaccatattgtcaaattatctcatgtggcgagcttcccacacctcctaacggtaacaagattgggactcagactagctacgggtcgaccgccatattcacatgcgacctgggctttatgctggtgggctcagccgtgcgggagtgcctgagctctgggttgtggagtgagtccgaaacccgctgccttgctggacactgcggcatcccggagctgattgttaatgggcaggtcattggagaaaactatgggtaccgggacactgttgtgtatcagtgtaatcccggatttcgccttatcggctcctcggtcagaatttgccaacaggatcacaattggtccggacagctcccctcctgcgtccccgtgagttgtggacaccccggtagccctatttatggccgaacatcaggaaacggcttcaactttaacgacgtggtgacattcagttgcaatatcggctatttgatgcagggtcccacgaaagcccagtgtcaggcaaaccgtcagtggagccacccaccccccatgtgtaaagtggttaactgttctgaccctggcatccccgccaattctaagcgagagagcaagatcgaacacggaaacttcacatacggaacggtggtgttctacgattgtaacccaggatactttttgtttggctccagcgtcctcatatgtcagcccaacggacagtgggataaaccactgcctgaatgcattatgatagattgcggccaccctggagtgccgcctaacgctgttctatctggtgagaaatatacttttggatctaccgtccattatagctgtacaggcaaacgttcccttctgggacagagcagccgaacctgccagctcaacggccactggtctgggtcccagcctcactgcagtggtgatgcgactggaacatgcggtgatcccggcacaccagggcacggtagtcggcaagaaagcaatttcagaacgaaatccactgtgagatacgcgtgcgatacaggctacatcctgcacgggagcgaggaacgtacatgcctggcaaacggctcttggaccgggaggcaacctgagtgcaaagccgtccagtgcggcaatcctggaaccaccgctaacgggaaggtatttcgaatcgatggcacgactttctcatccagcgtgatatacagctgcatggagggatacatactgtcgggtccatctgtcaggcagtgtactgccaatgggacctggtcaggtacgttgccaaactgcactattatttcatgcggtgatccaggaatccctgctaatggtctgagatacggagacgattacgtggtgggtcaaaatgtttcctacatgtgtcagcccgggtatactatggagctcaacgggagcaggattagaacatgtacgattaacggcacttggtctggagttatgccgacatgtagagccgtgacctgtcctaccccccctcagatctcaaatggtcggctggagggaacgaattttgactggggtttcagtatctcttatatctgtagccctggatatgaactgagctttccagccgtgctgacctgtgtgggtaacggcacgtggtcgggggaagttcctcaatgcctacctaagttttgtggggatccaggcatccccgcacagggtaaaagggaggggaaaagtttcatttatcagtctgaggtgtctttctcatgtaacttccctttcattctggtcggctcatccactcgcatatgccaggctgatggcacatggtccggaagttcaccccactgcatagagcccacacaaacctcatgcgagaatcccggggtgcctcgtcacggctctcaaaacaacaccttcggtttccaggttggttccgtagttcaatttcactgcaagaagggccatctgcttcaagggtcaacaacacgtacctgtctccctgacttaacgtggagcggtatccagcctgaatgtatcccacactcctgcaagcagcctgagacccctgcacatgctaatgtggtaggcatggacttaccatcccatggctacactctgatttacacctgccagccaggtttctttctggctggtggaacagaacatcgcgtgtgtcggtctgataacacctggactggaaaagtgcccatatgcgaagctggttcgaagatcctcgtgaaggacccaagacctgctctggggacaccctctcccaagctgagcgtgcctgatgacgtgttcgcacagaattatatctggaaagggagttataactttaaaggcaggaaacagcctatgacactaacagtcacctccttcaatgcatctaccggacgagtgaatgctactctctcaaactcaaatatggagttattgcttagcggggtgtataagtcccaagaggcccgcctcatgttgcgcatctatctcatcaaggttcctgcccacgcctcagtaaaaaagatgaaagaggagaattgggcaatggatggattcgtttctgctgagcccgacggcgccacttacgtgttccagggctttattcagggcaaggactacggccagtttggcctccagcgcttaggactgaacatgtcggagggaagcaactcctctaatcagcctcatgggacaaattcctccagtgttgctatcgcaattttggttccattctttgcacttatcttcgcgggctttggattctatctgtataaacagagaaccgctccgaaaacccagtacaccggttgcagcgtgcacgaaaataataacggacaggctgctttcgaaaatcccatgtacgacacaaatgcaaagtccgtggaggggaaggcagtcaggttcgatccaaatttgaacacggtctgtactatggtttag

SEQ ID NO: 184116 - DNA, 10617 bp, Artificial Sequence
  Description of Artificial Sequence: Synthetic coding sequence
atgaagggcatccggaagggcgagagccgggccaaggagagcaagccttgggagccgggcaaacggcgctgcgcaaaatgtggcaggttagacttcattctgatgaagaagatgggaatcaagtcgggatttactttttggaacctggtttttctacttactgtgagctgtgtgaaaggcttcatttatacctgcggagggaccctgaagggactgaatggcaccatcgaaagccctggcttcccgtacgggtacccaaatggagccaactgtacctgggtcatcattgccgaggagaggaaccgcattcagattgtcttccagtctttcgctttggaggaagaatacgactatctgtccctgtacgacgggcacccacatcctacaaactttagaactcggctgacaggattccacctgccccccccagtgacctccactaaatccgtgttttccttgcgcctgacatctgattttgccgtctctgcccatggttttaaagtgtactacgaggagctccagtcctcgagctgcggaaaccccggagtgccaccaaaaggagtgctatacggaactaggttcgacgttggcgacaaaatccgctatagctgtgtgacaggatatattttggacggccacccccaactcacttgcattgcgaacagcgtcaacacagcaagttgggattttcccgtcccgatttgtagggctgaagatgcctgcggagggacaatgcgcgggtcatcaggcatcatctcttcaccatcctttccaaacgaataccataacaacgcggactgcacatggaccattgttgctgagccaggcgataccatttctctcatcttcacggactttcagatggaggagaaatatgattacctggaaattgaggggagcgaacctccaacaatatggctctctggcatgaacattcctccgcccataatttctaacaagaactggcttcgtttacattttgtgaccgattcaaaccaccggtacaggggatttagtgcgccctatcaggttaaaaaggccattgatttcaagagtcgcggcttcaaattatttcctgggaaagataactccaataagttcagtatcttgaatgaggggggaatcaaaactgcctctaacttatgtccagatccgggagaacctgagaacggaaaaagaattgggtccgactttagcctgggtagtacggtccaattcagctgtgacgaagactacgtacttcagggtgccaagtccattacctgccagcgcatcgccgaagtgttcgctgcttggtcagaccacagacctgtttgtaaagttaaaacctgtggaagcaacctccagggccccagcggaacatttactagtcctaattttcccttccagtatgactcgaatgcgcaatgcgtgtgggttataacggctgtaaacacgaacaaggtcatccagatcaactttgaagagttcgacctggagatcggctacgacacacttaccataggcgatggcggggaggttggggaccctcggactgtgctacaagtgctgacagggagcttcgtgccagatttaatcgtctctatgagtagccagatgtggctgcacctacagaccgacgagagcgtcgggtcagtcgggtttaaagtcaattataaggagatagaaaaagaatcttgcggcgatcccgggactcctttgtacggaatccgagagggggatgggttctctaacagagacgtactaaggtttgagtgccagttcggctttgaactgattggtgaaaaatcaatcgtatgtcaagagaacaatcaatggagcgccaatattcctatctgtatattcccctgcctgtccaactttaccgccccaatgggcaccgtgctcagcccagactatcctgaaggctatggtaataatttaaactgcatctggaccattatcagcgaccccggcagtcgcattcacctgtctttcaacgactttgatcttgagtctcagttcgacttcctggctgttaaagacggagacagccccgaatccccgattcttgggacatttaccggcgccgaggtccctagccatctgactagcaactctcacattctgagactggaatttcaggccgatcacagtatgagcggccgaggattcaacatcacatacaacaccttcgggcacaatgagtgtccggatcctggcattcccatcaatgcaaggcgattcggagacaactttcagctgggctccagcatatcagttatttgtgaggagggttttataaagacacagggcaccgaaacaataacctgtattttaatggacggtaaagtgatgtggtcagggctgatccccaagtgcggggctccttgtgggggccactttagcgcgccatcgggcgtgattctttcacctgggtggcccggatactacaaagatagcctgaactgtgaatgggtgatcgaagctgaacctggtcatagcatcaagatcactttcgagagatttcagaccgaacttaactacgacgtcttggaagtccatgacgggcctaacctgctctctcccctgctcgggtcttataacgggacccaggtcccgcagtttcttttctcctctagcaacttcatttacttactgtttacaacagataatagcagatctaacaacgggttcaaaatccattatgaatctgtgactgtgaatacctactcctgtttggacccaggaatcccggtacacgggagacggtatggccatgatttcagcatcggatctaccgtcagtttctcttgtgacagcgggtatagacttagccatgaggaaccactgctttgtgagaaaaaccattggtggtcccaccctctcccgacctgtgacgcgctttgtgggggcgatgtgagaggacctagcggaaccatcctgtcaccaggatacccagagttttacccgaactcactgaattgtacatggacagtggatgtgacccacggtaagggggtgcagtttaattttcacacatttcacctcgaggaccaccatgactacctgttgattacggaaaatggctctttcacccagccactggcccggctcaccggttcagacctaccacctaccataaatgcaggactgtacgggaacttcagagcgcagctacgcttcatttctgacttctctatcagctatgagggctttaatataacattcagcgagtataatcttgagccgtgtgaagaccctggaatacctcagtatggcagcaggataggatttaatttcggcattggagatactttaacatttagttgtagctctggctaccgacttgaaggaacatcagagataatttgcctagggggaggccggagagtctggtctgcccccctgcctcgctgcgtcgccgagtgcggagcgtcagccaccaataatgaaggcatactactgagcccaaattacccgctgaattacgagaataatcatgagtgtatctactctatccaggttcaagctgggaaaggtattaacatctccgcgagaaccttccatctagctcaaggagatgtgttgaagatttacgacggtaaggataagaccacgcatctgttgggggcgtttaccggggcaagtatgcgggggttgaccctttcaagcacaagtaaccagctgtggctggagtttaacagcgatactgaaggcacagacgagggatttcagctggtgtatactagtttcgaactctctcactgcgaggaccctggcattccacagttcgggtacaaaatttctgatcagggacactttgccgggagtacgatcatttacggctgtaatccaggttacacattgcatgggtcaagtctgctaaagtgtatgacaggcgagcgacgggcatgggattaccccttgccttcatgcatcgccgagtgcgggggacgctttaagggcgaaagctcaggaaggatactgtctcccggctatccctttccctatgacaataatttgaggtgcatgtggatgatcgaagtagaccccggcaacatcgtcagccttcagttcttagcttttgatacagaagcatcacatgacatccttcgggtctgggatggcccccctgagaatgacatgctgctgaaggagatatctggctccttgataccagaagggattcactccacactcaacatcgtcacaatccagttcgacactgatttttacatcagtaagtcaggatttgcaatccagttctcctcttcggtagctacagcgtgtagggatcccggagttcccatgaacgggacgcggaatggagacggacgggaacctggggacacagtcgtgttccagtgcgaccccgggtatgaactgcaaggggaggagagaatcacctgcattcaagtggaaaataggtatttctggcagccatctcccccagtatgcattgccccctgcggtgggaacctcacaggctcaagcggtttcattctctctcctaatttcccacacccgtacccgcacagcagggattgtgattggacgattacggttaatgctgactatgtgatttctttggcctttatcagcttctctatcgagcctaattatgattttctgtacatatacgacggaccggactccaattccccgctcatcggctctttccaagatagcaaactgcctgaacgaatcgaaagcagctcaaatactatgcatttggccttccgcagtgacggtagtgtcagttacactgggtttcatctagaatataaggcgaagctgcgagaaagttgctttgaccctggaaatatcatgaacggcactagactgggaatggactataagcttggttctaccgtgacatattattgcgacgctgggtatgtgctacagggttactccacacttacctgcattatgggtgatgatggacgccctgggtggaacagggcccttcccagctgccacgctccatgcggctccaggtctaccggttcagaggggacagtcctgagtcccaactaccctaagaactattccgtaggtcataattgtgtttactcaatcgcggtccctaaggagttcgttgtttttggccaatttgtgtttttccaaactagtctgcacgacgtggtggaggtgtacgacgggcctacacaacagtcaagcctacttagttcactgtccgggtcacactctggggagagtcttcccctctccagcggcaatcagattactattagatttaccagtgtcgggcctattacagccaaagggttccatttcgtgtatcaggctgtgcctagaaccagcagtacccagtgcagctctgtgcccgagcccaggtttggacgcagaatcgggaacgagttcgccgtgggttcttcagtgctgtttgattgtaatccagggtatatacttcatgggagcatagccatcagatgtgaaacggtccctaatagtctcgcacagtggaatgatagcctgcctacctgtatagtcccatgcggagggatcctcacaaagcggaaaggcactattttgtctcccggttacccagagccctacgataacaacctgaattgcgtgtggaaaataacagtgccagagggcgctggcatacaagtccaggtggtgagctttgcaactgagcataactgggactccctggacttctacgacggtggggacaacaacgcgcctagacttggaagctacagcggaactacaatcccccaccttctcaacagcacaagtaataatctgtacctgaactttcagagcgacatcagcgtgtccgcagcagggtttcacctcgaatacaccgccattggactggacagttgccccgaaccccagaccccctcgagcggcataaagatcggggatagatatatggtgggggacgtggtcagttttcaatgtgaccaaggatacagcctgcagggccactctcatataacatgcatgcccggcccagtacggcgatggaattatcccattcccatatgtctggcacaatgcgggggggccatgtccgacttctcaggggtcattctcagccccgggtttcccggcaattatccaagtagtctggactgcacttggaccatcaatctccccattggcttcggagtccacctgcaatttgtaaatttttccaccgaaactatccacgactacctggaagtgcgcagcgggtcaagtgagacatcgactgtcatcggccgcttgtccgggcctcagatcccttcctccctgttttccacaacccacgagacctccctctacttccactcagattatagccagaacaagcaaggcttccatatagtgtatcaggcttatcaactccagtcttgtcccgatcccagaccatttaggaacgggttcgtaatcggcaatgattttaccgtaggccagacgatcagttttgaatgcttccctggatatacattgattggaaacagtgccctgacctgcctccatggcgtgagtcggaattggaaccatcccctcccacgatgcgaagccctatgtggcggtaacattaccgccatgaacggcacaatttatagcccaggttatcctgacgagtatcccaactttcaggattgcttttggcttgtgcgtgtccccccaggaaatgggatatatatcaattttactgtgctccagacggaacctatatacgacttcattaccgtttgggacggtcccgatcagaactctcctcaaataggccaattcagtgggaacacggctttagaatccgtgtatagcacgtccaatcagatactcattaaatttcattctgactttaccactagtggattcttcgtcctctcataccacgcgtaccagctgcgtgtgtgccagcctccccctccagtgcctaacgctgaaattctgacagaggatgatgaattcgagatcggcgacataatccggtaccaatgtctccccggattcacactcgtaggcaacgcaatactgacctgccgactgggggagcgactgcaaatggacggagcacctcccgtgtgtcaggtgctgtgccccgcaaacgaactgcgcctggattccacgggcgtgatcctgagccctgggtaccctgatagttatcctaatctgcaaatgtgtgcctggtctatatcagtcgaaaaaggatataacatcacaatgtttgtcgaattcttccaaacagagaaggaattcgacgtgctgcaggtgtatgatggccccaacattcagtcccccgtacttattagcctgtctggcgactattcatctgccttcaacataacatccaacgggcacgaagtgtttctgcagtggtccgccgaccacggaaacaataagaaaggattccgcatacgctacattgcattctactgtagcacacccgagtctcccccacatggatacatcataagtcagactggcggtcagctcaacagtgtggtgcgatgggcttgcgatcgggggtttaggctcgtcggtaagtcgagtgctgtttgccgcaagtctagctacgggtaccacgcatgggacgctcccgtcccggcgtgccaggctatcagttgtggaattccgaaagccccaactaatggcggcatcctgaccacagactatctggttgggacgcgcgttacatacttctgcaatgatggttaccggctttcttcaaaggaattaacaactgctgtgtgtcagagcgacggaacctggagcaaccacaacaagaccccgcgatgtgtcgtgattagctgtggggaacttccaacacccccgaacgggaacaaaattggaactcagaccagctacgggtcgaccgcgatatttacatgtgacttagggtttatgttggttggtagcgcagttcgggagtgcctgtcatccggactgtggtcagaatccgagacaagatgcctggctggtcattgcggaataccagagttgatcgtgaatggacaggtaatcggagaaaattacgggtaccgtgatacagttgtataccaatgcaaccctggctttagattaatagggtccagcgttagaatttgtcagcaagaccacaattggagcggacaattaccctcatgcgtacccgtcagctgtggtcacccgggatccccaatatacggtcggaccagcggaaatgggttcaacttcaacgacgtcgtgaccttctcctgtaacatcggatacctgatgcaaggtccgacaaaggcccagtgtcaagctaatcgacagtggtcgcacccgccccccatgtgcaaagttgtcaattgttctgatcctggtatccccgcgaactctaagagagagagcaagatcgagcacggaaacttcacttatggaacggtggtcttctatgactgtaatccaggctacttcttgtttggctccagtgtcctgatatgccagccaaatggacagtgggataagcctctcccagaatgtattatgatcgattgcggacaccctggcgtgccaccaaacgccgtcttgagcggcgagaaatataccttcgggtcgaccgtgcactattcatgtacagggaagagatctctgctcggtcagtcgtccagaacctgtcagctgaatggacactggtccgggagccagccgcactgctctggggacgccaccggaacatgtggcgatcccggcaccccaggacacggttctaggcaggaatctaatttccgcaccaaaagcacggtgcgctatgcctgcgacaccgggtacatccttcacggaagcgaggagcggacatgtctagccaatgggtcttggaccgggcgccagccagagtgtaaggctgtgcagtgcgggaatccaggcaccactgctaatgggaaagtgttcaggattgacgggaccaccttttcatcatcagttatatattcgtgcatggaaggttatattctgagcgggccatccgttcggcaatgcactgctaacggaacctggtccgggacccttccgaattgcaccataatatcctgtggggatccgggaatcccggctaatggcctaagatacggagacgattatgtagtggggcaaaacgtctcttatatgtgccaacccgggtacaccatggagcttaacggctctcgaatccgtacctgtactattaacggaacttggtctggcgttatgccgacgtgccgagcagtgacatgccccacacctccacagatttccaacgggcgactagagggaacaaacttcgattggggattctccatcagttatatctgctctccgggctatgagctcagctttcctgctgttcttacatgtgtcggcaacgggacctggtccggcgaggtcccccagtgccttcccaaattctgtggcgatccaggtatcccagctcagggaaaacgcgaaggtaagtcattcatctatcagtctgaggtgagcttttcttgcaatttcccgttcatactggtaggatccagcacaaggatttgccaagccgacggcacttggtcaggatcctctccccactgcatcgaacctactcagacatcctgtgagaaccctggagtaccgcgtcatggtagtcagaataatacatttggctttcaagttggatcagtggtgcagtttcactgcaaaaagggacatctcctgcagggttccaccacacggacctgtttgccagatctcacatggtctgggattcagcctgagtgcataccccactcttgtaagcaacctgaaacaccagctcacgcgaacgtggtgggaatggatctgccttcacacggatacaccttgatttacacttgccaacccgggttttttttagccgggggcaccgaacatagagtgtgccgttctgataatacctggactggtaaggtgcctatttgtgaggccggttccaagatcctggtgaaagatcctagacccgcactggggactccttctccgaagctgagcgtgccggacgacgtcttcgcgcaaaactacatctggaagggaagttataacttcaaggggcggaagcagccaatgactctgacggtgacatcattcaatgccagtactgggcgagttaatgcaactctgagtaattctaatatggaactccttctctccggggtttacaaatcccaggaagcacgcctgatgttgcgcatttatctcatcaaggtcccagcccatgcatcagtgaagaaaatgaaagaagagaattgggccatggatggatttgtgtcggcagagcctgatggtgccacctacgtgtttcaaggttttatccagggaaaagattacggacagtttggtcttcaacggctgggcctcaatatgtccgaaggaagcaactcttcaaatcagccccacggcaccaattccagctccgtggctatcgccatcctcgtgccttttttcgctctgattttcgctgggttcggtttctatctttataaacaaagaacagcccccaagacccagtacaccggttgcagtgtgcatgagaataataacgggcaggcagcgttcgagaatcccatgtacgatactaatgctaagtcagtggaaggcaaggccgtgagatttgatcccaacttgaatacagtttgcacaatggtatag

SEQ ID NO: 184117 - DNA, 2511 bp, Artificial Sequence
  Description of Artificial Sequence: Synthetic coding sequence
atggccggcctgaactgcggcgtgagcatcgccctgctgggcgtgctgctcttaggggctgcccggctcccaaggggggcagaggctttcgagatcgcactgccacgggaatctaatataactgtgttgatcaagctcggtaccccgacattgctggccaaaccctgctatatagtgatcagcaagagacacattacgatgctgtccataaagagtggggagagaatcgttttcacattttcatgtcagagccccgagaatcacttcgttatcgagatccagaaaaacattgattgtatgtccggcccatgtccattcggtgaggtccagctgcagccttctacttcccttctccccactctgaaccgtacgtttatttgggatgtgaaagcccacaaatccatcgggctggagctgcagttttcaatccccaggctgaggcaaattggaccaggtgaaagctgccccgacggcgtgactcacagtatctctggacgcatagacgctaccgttgtgcgtattgggactttctgctcaaatggcactgtgtcccggataaagatgcaggagggcgtaaaaatggccttacacctgccctggtttcatccccggaatgtgtcgggcttcagcattgctaacagatcctcaattaagcgcctttgcatcattgagagcgtgttcgagggtgagggatcagccaccttgatgtccgctaactaccccgagggatttcccgaagacgagctgatgacatggcagttcgtggtgccagctcatctgcgggcttcggtatccttcttgaactttaaccttagcaactgtgaacgcaaagaggaacgcgtcgaatattacattcccggctctacaactaatcctgaggtgtttaaattggaagacaagcagcccggaaacatggccggaaatttcaacctgtccctccagggctgcgaccaggacgcgcagagccctggcatcctccgactgcagttccaggtgctggtgcagcaccctcaaaatgaatccaacaaaatctatgtagtagatctctctaatgaacgagcaatgtctctcactattgagccccggccagttaagcaatcaaggaagttcgttccaggttgcttcgtctgtctggagagtcgaacctgttcttcaaatttaaccctcactagcggtagtaagcacaaaatcagcttcctgtgtgacgacctcacacgcctgtggatgaatgtggagaagactattagttgtaccgaccataggtattgtcaaagaaagagctattctctgcaagtaccgtccgatatcctccacctccccgttgagcttcacgacttttcctggaagctcctggtcccaaaggacagactcagcctcgtgttagtgcccgcccagaaacttcagcaacatacacacgaaaaaccctgtaatacctctttcagttatcttgtcgcctctgccattccttcacaggatctgtattttggtagcttctgtcccggaggaagcattaagcagatacaggtgaagcagaatatctctgtgacattgcgcactttcgcccccagtttccagcaggaggcttcccgacaggggctaacagtgtcctttattccatactttaaagaagagggcgtttttacggtgacccctgacaccaagtctaaagtgtatctgcgcactccaaattgggaccgaggcctcccatcattgacctccgtgtcctggaatatttccgtcccacgcgaccaagtcgcctgtctcacttttttcaaagagcgctcaggagtggtgtgtcagacaggacgcgccttcatgattattcaggaacagagaactcgcgccgaggagatcttttcattagatgaagatgtcctgcccaagcccagctttcaccaccactccttctgggtgaatatctcgaactgctcgccaacgagcggcaaacagctggacctgttgttcagtgtcaccttgacccctcggaccgtggatctgacagtgattttgatagctgccgtagggggaggggtcctgcttttgtcagccttgggactgatcatctgttgtgttaagaaaaagaagaagaagacaaataagggcccagcagtaggcatatataacgataacattaacactgaaatgccacggcagcctaagaaatttcagaaaggaaggaaggacaatgatagtcatgtctacgccgtaatcgaggacactatggtctatggacatctactacaggattcctccgggagtttcttacaaccggaggtcgacacgtaccgaccgttccagggcaccatgggtgtttgtccaccttctccgccgaccatttgcagccgcgcgccgactgctaaacttgctacagaagaaccaccaccaaggagtcccccagaatcggaaagtgaaccgtatactttctcacatcctaacaacggcgacgtatctagcaaagatacagacatccctcttttgaacactcaagagcccatggaaccagcagaatag

SEQ ID NO: 184118 - DNA, 1032 bp, Artificial Sequence
  Description of Artificial Sequence: Synthetic coding sequence
atggccggcctgaactgcggcgtgagcatcgccctgctgggcgtgctcctgctcggcgctgccaggttgccgaggggagccgaggctttcgagatagccctccctcgagaatcgaacattaccgtgcttataaagcttgggaccccaaccctactggctaagccttgctacatcgtgattagcaaacggcacataaccatgctatccatcaaaagcggcgagcggatcgtgtttacatttagttgccaatcccccgaaaatcactttgttatagagatccaaaaaaacatagattgtatgtcaggcccatgcccctttggggaagtccaactacaaccctctacctctctgctgcccaccctgaatcgaacattcatttgggatgtcaaggctcacaaatctattgggctcgagttacagtttagtataccacgtttgcgtcagatcgggcctggagaaagttgccccgacggggtaacccactccatcagcggccggatcgacgccacggtggtgaggattggcacattctgtagcaatgggaccgtctccaggataaagatgcaagaaggcgtgaaaatggcactgcaccttccttggttccatcctcgcaacgtgtccggctttagtatagcaaaccggtcaagcatcaagcgattgtgcataattgagagtgttttcgagggggaagggtcagctaccctcatgagtgccaactaccctgagggcttccctgaggacgagcttatgacctggcaatttgtggttcccgcgcatctgagagccagcgtatctttcctgaacttcaacttgagcaattgtgagcgaaaggaggagcgcgtggagtactacataccgggatctactacaaatcccgaggtgtttaagctagaagataaacaaccgggaaatatggctggtaacttcaacctatccttgcagggttgcgatcaggatgcacagtcacctggtatcttgaggctgcaatttcaggtcctggtccagcacccgcagaacgagagcagcgagtag

SEQ ID NO: 184119 - DNA, 513 bp, Artificial Sequence
  Description of Artificial Sequence: Synthetic coding sequence
atgatgaacatgagcctgcccttcctgtggagcctgctgaccctgcttatttttgctgaggtgaacggagaggctggagagctggaactccagcggcagaagcgctccatcaatctgcagcagccacgtatggccaccgagcgcggcaatctggtgtttctgaccggctcggcacagaatatcgagttccggactggctccttaggtaagattaaactgaacgatgaagatctgagcgaatgtttgcaccagatccaaaagaacaaggaggacataatcgagctaaagggatccgctatcggcctaccccagaatattagttctcagatctatcaattgaactcaaagttagtagacctggaacggaagtttcagggcctgcagcagacagttgataagaaggtatgttccagcaacccctgccagaatggtggaacatgcctcaatcttcacgattccttcttctgcatttgcccaccacagtggaaggtatcccatctgctgtttggttag

SEQ ID NO: 184120 - DNA, 10872 bp, Artificial Sequence
  Description of Artificial Sequence: Synthetic coding sequence
atgatgaacatgagcctgcccttcctgtggagcctgctgaccctgctgatttttgccgaagtgaatggagaggcaggcgagctcgagttacagcgccagaaaaggtccattaacctccagcagcctagaatggccactgagcgcggcaatttagtctttcttacaggtagcgctcagaacattgagtttagaacaggcagccttggtaagatcaaactcaacgacgaggatctgagtgagtgcctgcaccaaattcaaaaaaataaagaagacattatcgaactgaagggcagcgccattgggctaccccagaatatttcctcccaaatctaccaattgaattcaaagttggtggacctggagcgcaaatttcagggtctgcagcagacagtggacaagaaagtgtgcagctccaacccatgtcagaacggcggcacttgcctgaatcttcacgacagtttcttttgcatctgtccaccgcaatggaagggtccactgtgtagcgccgacgtgaatgagtgtgaaatctatagcggtaccccactctcctgccaaaatggcggaacgtgcgtgaataccatggggtcttactcatgtcactgtccccccgaaacctatggaccccagtgtgctagcaagtatgacgactgtgagggcgggagtgttgctcgttgtgtacacggaatctgtgaggacctcatgcgtgagcaggctggggagcccaaatattcatgcgtgtgcgacgccgggtggatgtttagcccaaactcgccagcctgcactctcgaccgggatgagtgctcgtttcagcccggaccgtgcagcaccctggtccagtgttttaatacccagggctcattctattgcggtgcatgcccaaccggctggcagggaaatggctacatttgcgaggatatcaacgagtgtgagattaacaatggaggttgctccgtagccccaccggtagagtgcgtgaacacccctggtagcagccactgtcaggcatgcccccccggctatcagggggacggtcgggtgtgtacgctcaccgatatatgctccgttagtaacggtggctgtcatccagatgcgtcctgcagtagcacccttggcagtctgcccctttgcacctgtctgcccggatacaccgggaacggctatggtcctaacggatgcgtgcagctgtccaacatttgtctttctcatccatgtctgaatggccaatgcattgataccgtgagcggctacttttgtaaatgtgactccggatggaccggagtcaattgcaccgaaaatatcaatgaatgtctttctaacccgtgtcttaacggcgggacctgcgtagacggtgttgattctttttcctgcgagtgtacacgtctgtggactggcgccctctgccaagtgcctcaacaggtttgcggggaaagtctttcaggcataaacgggagctttagctaccggtccccagatgtaggttatgtccatgatgtgaactgcttctgggtcattaagactgagatgggcaaggtcctcagaattactttcaccttcttcaggctggaatccatggataattgcccacacgaatttctgcaagtttatgacggcgatagcagttctgccttccagctggggcgcttttgtggaagctctctgccccacgaattactgtcctcagataatgcactgtacttccacctgtactctgagcatctcaggaacggcagaggttttaccgtacggtgggagacccagcagccggagtgtgggggcatccttacaggcccctatggctccattaagagtcctggctatccgggcaactatccccctggaagagactgtgtgtggatcgtggttaccagtcccgatctcctggtgacgtttactttcggaacccttagcctggaacaccacgacgattgcaacaaggattacctggaaatcagagacggccctctctatcaggatcccttgctgggaaaattctgtactaccttcagcgtgcctcccttgcaaactaccggtccttttgcacgcatacacttccactctgactcgcagatcagtgaccagggattccatatcacctacctgaccagtcccagcgacttgcggtgcggcggtaattacaccgatccggaaggcgagctgttcttacctgagctgtcagggccttttactcataccaggcagtgtgtgtatatgatgaaacaacctcaaggtgagcagatccagattaatttcactcacgtggaactgcaatgccagagcgacagttcgcagaattatatcgaggtgcgcgatggagaaactctcctgggcaaagtatgtgggaacggaacgatcagccatattaaatcgataacaaattcggtttggattcggttcaaaattgatgcatccgtggagaaagcgagctttagggctgtgtaccaggtcgcatgtggggacgagttaacaggggagggcgtgattcggtctccattctttccaaacgtatatcccggggagaggacatgcaggtggaccatacaccagcctcaatcccaggtgattctgctgaattttacggtgtttgaaatcgggtcttcagcacattgtgaaacagattacgtggaaatcggttctagctctattcttggctccccagagaacaaaaagtactgtggcactgacataccaagctttataacatccgtgtataactttttgtatgtcacattcgtaaaatcgagtagcaccgaaaaccacggatttatggcaaagttctcagcggaggacttggcctgcggcgagatacttacagagagcaccggaacaatccagtcccccggtcacccaaatgtgtatccacatggaattaattgtacttggcacattctggtgcaacctaaccacctaatccatcttatgttcgagacttttcacctcgaatttcactataactgtaccaatgactatctcgaagtgtatgacacggatagtgagacaagcctagggaggtactgtggcaagtccatccctcctagtttaacaagctctggtaacagcctgatgctggtctttgtgacagacagcgacctcgcctacgagggattcctgattaactacgaagcaatttccgccgccacagcctgtctacaggactacactgacgatctgggaacttttacatctcctaactttccaaataactatccaaacaattgggagtgtatatacaggataacagtccgtacaggacagcttattgctgtgcactttaccaacttttccctggaggaagcgatcggcaactactacactgatttcctcgagatccgcgatggagggtacgagaagagtccgctgctgggcatattttacggctccaatctgccccccacaattatctcacattccaacaagctatggctgaagtttaagtctgaccagatcgatacgaggtcaggctttagcgcttactgggatgggagtagcacaggttgtgggggaaatctcaccacctcatccgggactttcatttcacctaattaccccatgccttactaccattccagcgagtgctactggtggttgaagagcagccacggttccgcatttgagcttgaattcaaggactttcatttagaacatcatcccaattgcaccctcgactacttagccgtctacgacgggccatcctctaattcccatctgctgacacagctttgtggcgatgagaagcctcccctcatcagatcatcgggagactctatgtttattaaactgagaacagacgagggccagcaaggacgcggtttcaaagcagaatacagacagacctgcgaaaatgttgtgatagtaaaccagacgtatgggatactggagtccattggctatcccaatccttactctgagaaccagcattgtaattggactattcgtgccacaaccggcaacactgtgaactatacctttctggcattcgatctcgagcatcacattaattgtagcacagactatttggagctttatgacggtccgcgccagatggggcgctattgtggtgtagatttacctccaccaggtagtaccacgtcttcaaagctgcaggttctgctcttgacagacggggttgggcggcgggaaaaaggattccaaatgcagtggttcgtttacggttgtggaggcgagctcagtggggcgactggatcctttagcagccccggctttcccaacaggtacccacccaacaaagaatgtatctggtacatcagaacagaccccggctcctccattcagctgactatccatgactttgacgtggaataccactccagatgcaacttcgatgttcttgaaatttacggagggccggattttcacagcccgaggatcgcccagctgtgtacgcagcgaagccccgaaaacccaatgcaagtttcgagcacgggcaatgagctggccatcagatttaaaaccgatctatcaattaacggccggggtttcaacgcaagctggcaagccgttaccggcgggtgcggagggatcttccaggccccctcaggagagattcactcaccgaactaccctagcccctaccgctctaacaccgactgcagctgggttatccgggtggaccgaaaccaccgagtgctgttgaactttactgattttgacctcgagcctcaggactcctgcattatggcttatgacgggttgtctagcactatgtcaagacttgctaggacatgtgggcgggaacagcttgcgaacccaatcgtgtcttccggcaattccctgtttttacgcttccagtcaggccccagtagacagaatcgagggttccgggctcagttcaggcaagcttgcgggggccacattttgacctcctcttttgacaccgtgtcttcaccacgcttcccagccaactaccccaataatcagaactgttcttggatcatccaggcccagcctccactgaatcacataacactgtccttcacacattttgaactggaaaggtccaccacctgcgcaagagatttcgtggaaatcttggatggcggacacgaggacgctccgttacgcggcaggtactgtggcactgacatgccccatcccattacgtcgttcagctctgctttgaccctccgcttcgtgtccgactcctccatctctgccgggggtttccacacaaccgttactgcttcagtctcggcctgtgggggcacattttacatggccgaaggaatcttcaacagccctggctatcctgacatctatccgcccaatgtagagtgtgtgtggaacattgtctccagtcctggtaatcgattgcaactgtcgttcatatcattccaattggaggattcccaggactgcagcagggattttgttgaaattagagagggaaatgccactggacatttagtggggcgctactgtgggaattcgttcccgctgaattatagcagcatagtcggacacacactctgggtgcgtttcatcagtgatggaagcggtagcgggaccggcttccaggccacgtttatgaagatcttcggcaatgataacatcgttggaacacacggcaaagtcgcctcgccgttttggccggaaaactacccccataactcaaattatcagtggacagtcaatgttaatgcctcacacgtggtccacggtcgaattctcgaaatggacatagaagagatccagaactgctattatgataagctgagaatctacgatggcccttcaatccacgcccggctgatcggcgcttattgcgggactcagaccgaatctttttcctccacgggtaattccctaacgttccacttttattcagatagtagtattagcggcaaagggtttctcctcgagtggtttgcagtcgacgctcccgatggggtgttacccaccatcgctccaggagcctgtggaggttttctccgtaccggcgatgcacccgtgtttctgttttcccctgggtggccggattcttatagcaatagagtagactgtacatggctcatccaggcccccgactccactgtggaactgaacatactatccctggatattgagtcacataggacatgcgcttatgatagtttggtaattcgggacggggacaacaatctagcacaacagttggccgtgttatgcgggagagaaatacctggacctattaggtctaccggtgaatatatgttcattagattcacatccgacagcagcgttactcgcgccggatttaacgcgagcttccataagtcttgtggcggctaccttcacgccgatagaggcatcattactagtcccaagtacccagaaacttacccttccaatttaaattgttcctggcatgtgctggtgcagtctgggctcacaattgcagtgcactttgagcagcccttccagattccaaatggcgactcatcttgcaatcagggcgattatcttgtgctccgtaatggtcccgacatatgtagcccccctctcggaccaccgggcggcaatggccacttctgtggctcccacgcatcgtccaccctttttacaagcgacaatcagatgttcgtacaatttatcagtgaccatagtaacgaggggcagggcttcaagattaaatacgaagcaaagagcctggcttgcggggggaacgtctatatccacgacgccgatagtgctggctacgtcacaagtccaaaccatccacacaattatcctccgcatgctgactgtatttggatattggctgcaccgccagaaaccaggattcaactccagttcgaggaccgttttgacatcgaagtaacgccaaactgtacgagtaattacctggaattacgggatggtgtagatagcgatgctccgattctatcgaagttttgtggaacttccctgccttcgagccagtggtctagcggcgaagtaatgtacctgaggttccgatcagacaacagcccaacccatgtgggcttcaaggccaaatactccattgctcagtgtggcgggcgggtcccgggacaatcaggagtggtggaaagtattggccacccaacactgccttaccgagacaaccttttctgcgaatggcatctgcaagggctgtccgggcattatctgactatctcatttgaagacttcaacctgcagaattcctccggatgtgaaaaagactttgtggagatttgggataatcatacaagtggcaatattctgggccgatattgcggcaacactatccccgactccatagacactagctcaaacacagctgtcgttcggttcgtgaccgatgggtctgtaacagccagcgggttcagactgcggtttgagtcaagcatggaggagtgtgggggggatctccaaggctccattggcacatttacttcccccaattatcccaaccccaatccccacggccgcatatgtgagtggaggatcaccgcccctgaaggccgaaggatcaccttgatgtttaacaatctgcgtctggcgactcatcctagttgtaacaacgagcatgtcatagtgtttaacgggattaggagcaacagccctcaacttgaaaagctgtgttcttctgtgaatgtgtcaaacgagataaagagctctgggaatacaatgaaggtgatctttttcacagacgggtcgaggccgtacggaggcttcaccgcttcctacaccagctctgaagatgccgtgtgcggcgggagcctcccgaacacccctgaggggaacttcacctcacctgggtatgacggcgtccggaattacagccgcaatctgaattgcgagtggactttatctaacccgaaccagggtaatagtagcatcagtattcattttgaagacttctacctggaatcccatcaggattgtcagtttgatgtcctggagtttcgagtgggagacgcagacgggcccctgatgtggagactgtgtggtcctagcaagcctaccctacccctcgtcattccatacagccaggtatggatccatttcgtaactaatgaaagggtggagcatataggttttcatgcgaagtactccttcacggactgcggtggaattcaaattggtgatagtggggtgattacttcaccaaattatccgaatgcgtacgactctctcacccactgtagttctttgctggaggctcctcaggggcacactatcacactgacctttagcgattttgacatagaaccacatacgacctgtgcatgggatagtgtgaccgtaaggaacggaggctctcctgaatctcctataatcgggcagtactgcggaaacagtaatcctagaacaatacagtcaggctccaaccagctggtagtaactttcaacagtgatcattcactgcagggtggcgggttttatgctacatggaatacacaaactctcggatgtggcgggatatttcattctgacaacggcacgattcggagtccacattggcctcagaacttcccggagaattcccgctgcagctggaccgcgattacccacaagtctaagcatttggaaatcagcttcgataacaattttctaatcccgtcaggagatggccagtgtcaaaatagctttgtgaaggtgtgggcaggcaccgaggaggtggataaggctttgctggcgacaggttgcgggaacgtggcccccggccctgtgatcacgccatcaaacacgttcaccgccgtgttccaaagccaggaggccccagcacaaggattttcagcatctttcgtatctcggtgtggctcgaatttcacgggtccttctggctatataatttcaccgaactaccctaagcagtatgacaacaacatgaattgcacctacgtgatcgaagctaaccctctgtccgtagtgctcctcacattcgtgtctttccacctggaagctcgctccgctgtaaccggatcatgtgtgaatgacggcgtccacatcatcagaggttattcggtaatgagcaccccttttgcaaccgtgtgcggcgacgaaatgccagctccactgaccattgccggccctgtcctcctgaacttttattccaacgagcagatcactgactttgggttcaagttttcttatcgcatcatatcatgtggcggtgtcttcaacttctcttcagggattattacttctccagcctacagctacgccgactacccaaatgacatgcactgtctttacacaattaccgtgtcagacgacaaagtgatcgagctgaaattttcagactttgacgttgtgcccagcacctcctgttcacacgattacctcgccatctacgacggcgcaaatacctcagaccctctgctgggcaagttttgtggatctaaacggccgcctaatgttaagtcctctaacaatagtatgttgctggtctttaaaaccgacagttttcagacagccaaggggtggaaaatgagtttccgacagactttaggacctcagcaaggctgtggagggtatctgactggttctaataacacctttgcaagtcctgactctgacagcaacgggatgtatgacaagaacttaaattgtgtgtggatcataatagctccagtcaacaaagtgatccatctgacatttaataccttcgcactcgaagccgcctctacacgacaaaggtgcctgtatgattacgtaaaactatatgatggggattcggaaaatgccaacttggccggcaccttctgcggaagtacggtgccagccccattcataagctctgggaatttccttaccgtgcagtttatcagtgatctgaccctcgagagagagggattcaacgcgacttataccattatggatatgccatgtgggggcacttacaatgccacatggaccccccagaatataagttccccgaattcatccgatcccgatgtacctttcagtatctgtacatgggtgatcgattcaccacctcatcagcaggtaaaaatcactgtgtgggctttgcagctcacgagccaggattgcacacagaattacctgcagctgcaggattctcctcagggccacggaaactcacgatttcagttctgcgggcgtaacgcatcagcggtccctgtgttttattcatctatgagcaccgcgatggtgattttcaaatccggcgttgtgaaccgcaattcccgcatgagtttcacttaccagatagccgattgcaatcgcgactatcataaagctttcggtaacctcagaagccccggttggcccgataattacgacaatgataaggattgcacagtcaccctcactgcgccccagaaccacactattagtcttttcttccattcgctcgggattgagaattccgtggaatgtagaaacgactttctcgaggtgagaaatggtagtaattctaacagtcccctcctcggcaagtactgcgggacacttctcccaaatcccgttttttctcagaataacgaactctacctgaggttcaaatccgattccgtgacaagcgaccggggatatgaaatcatctggacctcatctccctcgggatgcggcggcaccctatacggagatcgcggttcattcacttccccaggctaccccggtacttatcctaacaatacctattgcgagtgggtcctggtggcgccggccggccgcctggtgacaatcaatttctactttataagcatcgatgatcctggcgattgcgtccagaactacctgaccctgtatgatggacctaacgcaagctcaccatcgagtggcccatattgcggaggagataccagtatcgctcccttcgtcgccagttccaatcaggtgtttattaagtttcacgctgattacgccaggcgaccctccgcttttagactgacctgggactcttag

SEQ ID NO: 184121 - DNA, 318 bp, Artificial Sequence
  Description of Artificial Sequence: Synthetic coding sequence
aacagcaagctggtggacctggagcggaagttccagggcctgcagcagacagtggacaagaaggtatgctctagcaacccatgtcaaaatggcgggacttgcctgaatctacacgatagcttcttctgcatctgccccccacaatggaagggaccactgtgctctgctgacgtaaatgagtgtgagatctactcgggtacccctctctcctgccagaacggtggcacgtgcgttaatacaatggggtcctacaggaatccctgctctaatatccccaaagaacccgaagagggaagccgagactggcaccgtgagtag

SEQ ID NO: 184122 - DNA, 267 bp, Artificial Sequence
  Description of Artificial Sequence: Synthetic coding sequence
agcaccggcaacgagctggccatccggttcaagaccgacctgagcattaatggcagggggtttaatgctagttggcaggctgtaaccggaggctgtggaggaatcttccaggccccaagcggagagattcattcccccaactatccaagtccatacaggtctaacaccgactgctcctgggtgattagagtcgaccgcaaccaccgcgtgcttctaaatttcacagattttgatttggagccccaggattcatgtatcatggtgtag

SEQ ID NO: 184123 - DNA, 1395 bp, Artificial Sequence
  Description of Artificial Sequence: Synthetic coding sequence
atgagccacagctggaacgtgctgtggctgaccttctgcagcgacagcaatggcatgtacgataagaacctgaattgtgtgtggatcattatcgccccagtgaataaggtcattcacctgaccttcaacactttcgccctcgaggccgccagcaccagacaaagatgcctgtacgattacgtgaagctttacgatggggattcagagaacgccaatctggccgggactttttgtggctctacagtccccgccccttttatttcatctggaaattttctgactgtccagttcatctctgacctgacccttgaacgggagggcttcaatgcgacttatacaatcatggacatgccctgtggcgggacatataatgcaacctggacaccacagaatatatcatcccccaactcgtccgaccctgatgtccccttctcaatctgtacctgggtaattgatagccctccccaccagcaggtgaaaatcactgtctgggccctccagctgacatcacaggactgtacccagaactacctccagttacaagacagtccacagggacatggaaattcccgtttccagttttgcggtagaaatgcctcagccgtgcccgtcttctactcatcaatgtctacagccatggtaatattcaagtcgggcgttgtcaacagaaactccagaatgagctttacttatcagatagccgattgcaaccgcgactatcacaaggcctttggcaaccttaggagccctggatggccggacaactacgacaacgacaaagactgtacagtcaccctaaccgctcctcagaaccacaccatctctctgttcttccattctctgggcattgagaatagtgtcgagtgtcgcaatgacttccttgaggtgagaaacggatccaattcaaactcaccactgctgggcaaatactgcggaacactgctgccaaaccctgtattttcacaaaataacgagttatatttgcgttttaaatccgacagtgtcacgtccgataggggttatgaaatcatctggacttcttcgccatctggctgcggtggcacgctgtacggggacagaggatcatttacttcaccaggctatcctggaacttatcccaataatacatactgcgagtgggtgctcgtggctcctgcgggccggcttgtcactatcaatttctacttcatcagcatcgatgaccccggggactgcgtacagaactacttgaccctttatgatggccccaatgcatcttccccatccagtggcccatactgcggcggtgacaccagcatagcacctttcgtggccagctccaaccaggtgttcattaagttccatgccgattacgccaggagaccctccgcgtttcggctcacctgggacagttag

SEQ ID NO: 184124 - DNA, 864 bp, Artificial Sequence
  Description of Artificial Sequence: Synthetic coding sequence
atggagctggagcggatcgtgagcgccgccctgctggccttcgtgcagacccacctgcccgaagctgacttaagcgggctagatgaggtcattttttcatacgtgcttggcgtacttgaggaccttggcccatctggaccatccgaggaaaattttgacatggaggccttcacagagatgatggaagcctatgtgccaggattcgctcacattccaagaggcacgataggagatatgatgcagaaacttagtggccagctgtctgatgcaagaaacaaagaaaacctacagccccagagctcaggagtccagggacaggtgcccatatcaccagagcctttgcagcgtccagagatgctcaaagaagagaccagatcatcagctgctgccgctgccgacacccaggacgaggcgacaggtgccgaggaggagctattgcccggtgtcgacgtcctcctcgaggtgtttcccacatgctctgtggagcaggcgcagtgggtgctggccaaggcccgtggagacctggaggaggcagtgcagatgctggttgagggaaaagaggaaggacccgccgcttgggaaggccctaatcaagatctacccaggcgcctaagaggtccccagaaggacgagctaaaaagtttcattctacaaaaatacatgatggtggactccgcagaagatcagaagatccatcggcccatggcccccaaggaggcacccaaaaaattgattcgatacatcgataatcaagtggtctccacaaagggggagcgtttcaaggatgtacgcaatccagaggccgaagagatgaaagccacttacattaacttaaagccagcacggaaatatagattccactag

SEQ ID NO: 184125 - DNA, 1365 bp, Artificial Sequence
  Description of Artificial Sequence: Synthetic coding sequence
atggccgccgcccccggcggcagcgcccagcccgccggccccggcccaaggcttggcttcagcacagcagattccggggtggggatgagcggattgaatcctggccccgccgtcccgatgaaagaccacgacgccattaagctgttcgtgggacagatacccaggggtcttgacgagcaggatctgaagcctctcttcgaagaatttggccgtatttatgaactgacagtcctgaaggatcgccttacgggccttcataagggctgtgcctttttgacctattgtgctagggattctgccctgaaggcacagagcgcacttcatgagcagaagacactgccaggcatgaacaggccgattcaggtgaagcctgccgcctcagaggggcgcggcgaggacagaaagctgttcgtgggcatgctggggaagcagcagggagaagaggacgtgagacggctcttccagcccttcggccatatcgaagagtgcacagtcctccggagccctgacggcacctctaaaggttgtgcttttgtgaagtttggcagccagggagaggcccaggctgctattcggggccttcatgggagccggacaatggccggcgccagcagtagcctggttgtcaaactggcagataccgaccgtgagcgggccctgaggagaatgcagcaaatggccggacatctcggggcattccacccagctccactgccccttggagcatgcggggcctatacgacagctatcctgcagcaccaagctgccctactggccgctgctcagggaccaggcttggggcccgtcgcggccgtcgccgcacagatgcagcacgtggcagccttctctctggtggccgcgccgctgttacctgcagctgcagccaactcacccccgggctcgggccccgggacacttcctggtctgcccgcccccatcggcgtaaatggcttcgggccattgaccccccagacaaacggacagcctggcagtgacacactatacaataacggcttgagcccttaccccgcccagagtcctggcgtggccgaccctctacagcaggcctatgccgggatgcaccattacgctgggcccgaggggtgcaacctgttcatctatcacctcccgcaggagtttggagatgccgagttgatccaaactttcctccccttcggcgctgtggtcagcgctaaagtgtttgtcgatagggcaactaatcagagcaaatgctttgggttcgtctcttttgataaccctacttcagcacaaacggccatacaggctatgaacggtttccaaatcggcatgaagcgtctgaaagtgcagctcaagagacccaaggacgctaatagaccatattag

SEQ ID NO: 184126 - DNA, 1398 bp, Artificial Sequence
  Description of Artificial Sequence: Synthetic coding sequence
atgaaggagcccgacgccatcaagctgttcgtgggccagatcccccgccatcttgaggaaaaggacctaaagcccattttcgaacagttcggaaggattttcgagttgaccgtgattaaggataaatacaccgggctgcacaaagggtgcgcattcctcacatactgtgctagagattcggcacttaaggcgcagagcgcccttcacgagcagaaaactctgcctggcatgaacagacctattcaggtaaaaccagcagactctgagagcagaggcgaggacaggaagctcttcgtggggatgcttgggaagcagcaaacggacgaagacgtgcggaagatgttcgagccattcgggactatagacgaatgtaccgtcctcagggggcctgacgggacaagcaaggggtgtgcttttgttaagttccagactcacgccgaagcacaggccgctataaatactttgcacagctcgaggactcttcccggggccagtagcagcctagttgtgaaatttgccgacaccgagaaagaacgcggtctgcgcagaatgcagcaagttgcaacacagctgggaatgttttctccgatagcactccaatttggagcctattccgcatatacgcaggccctcatgcagcagcaagccgccctcgtcgcagctcatagtgcttacctctctcctatggccactatggctgctgtccagatgcaacacatggcagcaatcaatgccaacggcctgatcgctacacccattacgccaagttcaggaacctctaccccaccagcaatcgctgcaactccagtgagtgcaattcccgcagctctgggagtgaatgggtactcccctgtccccacccagccaacggggcagccggccccagacgcgctgtaccccaacggggtgcacccctatcccgcccaatctcccgctgctccagtcgatcctttgcaacaggcctacgctggtatgcaacactatacagctgcctaccccgccgcctactccctcgtcgcaccagcgtttccacagccaccggcacttgtggcacagcagcccccccccccaccgcagcagcaacagcagcagcagcagcagcaacagcagcagcagcaacgagaaggccccgatggatgcaatatcttcatataccacctgcctcaggaatttaccgacagcgaaatcttgcagatgtttgtgccatttggccacgtaatctccgccaaagtcttcgtcgacagagccacaaatcagtccaagtgttttgggtttgtctcattcgacaaccccgcgagtgctcaggcagctatccaagctatgaacggatttcaaataggtatgaagcgtttaaaagtgcaattgaagcggcctaaagacgccaatagaccctactag

SEQ ID NO: 184127 - DNA, 1248 bp, Artificial Sequence
  Description of Artificial Sequence: Synthetic coding sequence
atgaaggagcccgacgccatcaagctgttcgtgggccagatcccccggcatttggaagagaaagaccttaagccgatttttgaacaattcggcaggattttcgagctgactgtgattaaagataagtacaccgggctgcacaaagggtgcgcattcctgacatattgtgctagggacagtgccctgaaggcccagtcggccttgcacgaacagaaaaccttaccaggcatgaaccgacccattcaggtcaagccagccgactccgaaagcaggggcgaggacagaaaactgtttgtgggcatgttgggtaagcagcaaaccgatgaggacgtgcgtaaaatgttcgagcctttcggtacaattgatgagtgtaccgtactgagaggtcctgatggtacatccaagggttgtgcttttgttaagttccagacgcacgctgaagctcaggccgccataaacaccctgcacagctcgcggacgctgccaggtgcctcttcaagcctcgtagtgaagtttgccgacacagaaaaagaacgcgggctcaggcggatgcagcaggtcgcaacgcagcttggaatgtttagccccatagcactacaattcggggcttattcagcttatacccaggcgctaatgcaacagcaggctgcgctggtggccgcacactctgcttacctgagcccaatggccactatggccgcagtccagatgcagcacatggccgcgataaatgcgaacggtctgatcgccacacccattacccccagtagcgctcagagtcctgccgcccctgtggaccccttacagcaagcatacgcaggtatgcagcactatactgcagcgtacccagcagcgtacagtctggtagcacccgctttccctcaaccacctgccctggtggcacaacagcctcctcccccaccccagcaacagcagcagcagcagcaacagcagcagcaacagcaacagcgcgaagggcctgatggctgtaatatctttatctaccacctaccacaagaatttaccgatagtgaaatccttcagatgtttgtgccgttcggacatgtgatcagcgccaaagtgttcgtcgacagagccacgaatcagagcaagtgctttggattcgtgtccttcgataacccagcctccgcccaggcagcgattcaagctatgaacgggtttcagatcggaatgaagaggctgaaggtgcagcttaagcggcccaaggacgcaaaccggccatattag

SEQ ID NO: 184128 - DNA, 900 bp, Artificial Sequence
  Description of Artificial Sequence: Synthetic coding sequence
atgaaggagcccgacgccatcaagctgttcgtgggccagatcccccgtcacttagaagaaaaagacctgaagccaattttcgagcagttcggtcgcatctttgagctgacagttatcaaagacaagtatacgggcttacacaaaggctgcgccttccttacttactgtgcaagggacagcgctctcaaggcccagagtgcgcttcacgagcagaagaccttgccaggcatgaatagacctatacaggtgaagccagccgactctgagagtagaggagacagaaagctgtttgtcgggatgctgggcaaacagcagacagatgaggatgtgcgaaagatgttcgagcccttcggcaccatcgatgaatgtaccgttctgagaggcccggacgggacctctaagggttgtgcattcgtgaaatttcaaacacatgctgaggctcaggccgctattaataccctgcacagctctaggacgcttccaggggcatcgagctccctagtcgtgaagttcgccgacacggagaaggagagaggcctgcggcgcatgcagcaggtcgctacacagctggggatgttctccccaattgcactgcagttcggcgcatatagcgcctacacacaggccctgatgcagcagcaggccgccctggtcgctgcccacagtgcatatttatctcctatggccaccatggctgcggtccagatgcagcacatggccgccattaacgccaacggactgatcgctacgccaattacaccaagttctgccaaggggcatggctacgcatccctcgccccccgggcccactttttgctggacgccctcctcgcattcgtcagggagaggggtacagggtccaaagccccaggctacctgccatctgccggcctgttgtag

SEQ ID NO: 184129 - DNA, 783 bp, Artificial Sequence
  Description of Artificial Sequence: Synthetic coding sequence
atgcagcaggtggccacccagctgggcatgttcagccccatcgcccttcagttcggagcttattccgcatacacgcaggctcttatgcagcagcaggctgcattagtagccgcacatagcgcctacctctcacctatggccaccatggccgcggtgcaaatgcagcacatggccgcaatcaacgctaatgggctgatcgctactcctataacacccagttcagggacaagcacaccacctgccatcgctgccactccggtgtccgccattccagccgcacttggggtcaacggctactcacctgtcccaacgcaaccaaccggtcagcccgcccctgacgcactttatcccaacggtgtgcatccgtatcccgcagcttatcctgcggcatatagcctggtggcccccgcttttcctcagccaccagccctggtggcgcaacagccccctcccccaccacagcaacaacaacagcaacaacaacagcagcagcaacaacagcaaagagaagggcccgacggctgcaacatcttcatctaccatctcccccaggagtttactgattctgagatactgcagatgtttgttccctttggccatgtcatctcggcaaaagtcttcgtggaccgtgcaaccaatcaatcaaaatgtttcgggttcgtgagctttgacaatccggccagcgctcaagccgccatacaagccatgaatggtttccaaatagggatgaaaagattgaaggttcagctcaagaggccgaaggacgccaatagaccatattag

SEQ ID NO: 184130 - DNA, 1401 bp, Artificial Sequence
  Description of Artificial Sequence: Synthetic coding sequence
tgagtggaggagagcgccgccggcgagcagagcagcggcacccagattcccagacatctcgaggaaaaggatctaaagccaatcttcgagcagtttggcagaatcttcgagctgaccgtcatcaaagataagtacacaggtctgcataaaggctgcgccttcctgacttactgcgctcgtgacagcgcgcttaaagcacagtcagcactgcacgaacagaagacgctgccaggtatgaatcgccctattcaagttaagcccgctgatagcgaatctagaggtgacaggaaactgttcgtcggcatgctgggcaagcagcagaccgatgaggatgtgcgtaagatgttcgagccttttggtaccatcgatgagtgtactgttcttcgcggcccagatgggacaagcaaggggtgtgcattcgtgaaattccagactcatgcggaggcacaggccgcgatcaatacactacattcatctcgcaccctgcctggagcttcatcctctctggtggtgaaattcgctgatacagagaaggagcgaggtctgcggcggatgcagcaggtggccactcagctgggaatgttcagccccatagctctccagttcggagcatattccgcgtatacgcaggcgctcatgcagcagcaggcagccctggtggccgctcactccgcttacttgagtccaatggcaacaatggcagcagtccagatgcaacacatggccgctatcaatgcgaatgggctcatcgccaccccaattactccctcgtctggcacctcgactcctcccgcaattgccgctacacccgtcagcgccattcctgccgctttgggagtgaacgggtactcaccggtaccaactcagcccactggtcagccagcaccagatgcgctctaccctaacggtgtgcacccgtacccagcacagagccctgcagcacccgtggaccctctccagcaggcatacgcgggtatgcagcactacaccgcagcgtaccccgctgcttattccctggtggctccagccttccctcagccacctgccttagtcgctcagcagcctcctccccctccccagcagcagcagcagcagcaacagcagcagcagcagcagcaacagagagagggccctgacggttgcaatatttttatataccacctgccacaggagttcaccgactcagagatcttgcaaatgtttgttccatttggacacgtcatatctgccaaagtcttcgtcgatagggctacaaatcagagcaaatgcttcggattcgtgagctttgataatcctgcatctgctcaagctgccattcaagcaatgaacgggttccaaatcggcatgaagcgattgaaagtccagttgaagcgccctaaggatgctaatagaccgtactag

SEQ ID NO: 184131 - DNA, 1347 bp, Artificial Sequence
  Description of Artificial Sequence: Synthetic coding sequence
atgtacatcaagatggccaccctggccaacggccaggccgacaacgcctctttaagtacaaatggactgggatcatcacccggctctgcaggtcatatgaatggactgagccattcgcccggcaatcccagcacgatccccatgaaggatcatgacgccattaaactgttcattggccaaattccgcggaaccttgatgagaaagatcttaagcccctgttcgaggagtttggcaagatatacgagctgactgtgttaaaggataggttcaccgggatgcacaagggttgcgcattcttgacatattgtgaaagagagagtgccttaaaagcgcagtccgccttgcacgagcagaagacattgcccggtatgaaccgccctattcaggtgaaaccagcggactccgagtctcgaggtgaagaccgcaagctctttgtgggaatgctcaacaagcagcagtcagaggacgatgtgcgcaggctgtttgaggccttcggcaacatagaagagtgcacgatcttgagaggtccggacggaaatagtaagggctgtgcattcgtgaaatattcatctcacgctgaggcacaggccgccattaacgcattgcatggcagtcagacaatgcctggagcctccagttccctggtggtgaagtttgccgacacagacaaggaaagaactatgcgccgcatgcagcagatggcggggcagatggggatgtttaaccccatggccataccgttcggggcgtatggggcctacgcacaggcccttatgcagcagcaagcagcgctcatggccagtgtggcgcagggagggtatttgaaccctatggcggcctttgctgcagcccaaatgcagcagatggcagctctgaacatgaatggtctggccgccgcgcccatgacgcctacctcaggcggaagtactccccctggcataacagcacctgctgtcccgtcgatcccctctccgattggtgtcaacggttttactggcctccctccacaagccaacggacagccggcagctgaggccgtgtttgccaatggcatacatccctatcccgcccagtcacccacggcagcagatccgctgcaacaagcctacgccggcgtgcaacagtacgcagggccagccgcataccctgccgcatacggacagatttcccaggcgttccctcagccgcctcccatgataccccaacagcagagagagggcttcgtctcattcgacaaccccgcttcggcccagacggcaatacaggcaatgaatgggtttcagatcggcatgaaacgactgaaagtgcagctgaaacgtcctaaggatgcaaaccgtccatactag

SEQ ID NO: 184132 - DNA, 639 bp, Artificial Sequence
  Description of Artificial Sequence: Synthetic coding sequence
gtgagcgccgagggccccgagcgggccgcccgggccgaggacagcgccagagatgagccggcagatccgggcgaagcttgcggacaacgcgagcctaaggaccgcaaacttttcgtgggaatgttgaataaacaacagtcggaggacgacgtgcgtaggctatttgaagcctttgggaatatcgaggaatgcaccatactgaggggtcctgacggcaacagcaaaggttgcgcatttgttaagtatagtagccacgctgaagcacaagctgccattaacgctttgcatggcagccagacaatgccaggggcctcgagttccctggtcgtgaagtttgcggacaccgacaaggagagaaccatgcgccgcatgcagcaaatggcaggtcagatggggatgttcaaccccatggctatacccttcggtgcatatggcgcatacgcccaggcccttatgcagcagcaggccgcattgatggcttcagtggctcagggcggctatttaaatcccatggctgcttttgcagccgcccagatgcaacagatggccgccttgaatatgtggcctggagggaggacttatgaccctaacttgaggtggcagcacccctcaggccaccactgcacttcacgggcctag

SEQ ID NO: 184133 - DNA, 1461 bp, Artificial Sequence
  Description of Artificial Sequence: Synthetic coding sequence
atgtacatcaagatggccaccctggccaacggccaggccgacaacgcgagcctttcaaccaatggcctgggctccagccctggttctgctggtcatatgaatggcttatcccacagcccgggcaatccgtccacaatccccatgaaagaccatgacgcgattaagttattcatagggcagattccgcgcaacctcgatgagaaggatctcaaacctctgtttgaggaatttggtaaaatctacgagctgacagtcttaaaggaccgtttcacaggaatgcacaaagggtgcgcattcctcacttattgcgagagagagtcagccctaaaagcacaatccgcattacacgagcagaagacgctgccgggaatgaataggcccatccaggttaaacccgcggactccgagtcacgcggagggtcgagttgcttgcgccagcccccctcccaggatcgaaaattgtttgtgggaatgctcaataagcaacagtccgaggacgacgtccggcgcctctttgaggcttttggaaacattgaggaatgcaccatactacgaggccctgatgggaattcaaagggttgcgccttcgtcaaatacagctcccacgctgaggctcaggctgctattaacgctctgcacggcagtcagacgatgcctggtgccagtagcagcctggttgtaaagtttgccgatacggacaaggaaaggactatgaggaggatgcaacagatggctggccagatgggaatgtttaatccaatggcaattcccttcggggcctatggcgcatacgcccaggccctgatgcaacagcaggcggcattaatggccagtgtcgcccagggagggtacctgaaccccatggctgcttttgccgcggcccagatgcagcaaatggctgcacttaatatgaacggtctagctgctgcgccaatgactcccacctctggcgggagcaccccccccggcatcactgctcctgccgtccccagcattccttcgcccatcggtgtgaacggatttactggactccccccgcaggccaatggacagcccgctgcggaggccgttttcgcaaatggaatccacccgtatccagcacagagtcctacggctgctgacccactgcagcaggcttatgccggagttcagcagtatgcaggcccagccgcttaccccgccgcttacggtcagatttcacaggcctttccccagcccccacccatgatcccccagcagcaacgagagggaccagagggctgcaacttgtttatctaccatttgccccaggaatttggggacgcagagctgatgcagatgttcctgccattcggattcgtatccttcgataaccccgcctcagctcagacagcgattcaggctatgaatggcttccagattggaatgaaacgacttaaagttcagctgaagcgacctaaagacgccaatagaccctattag

SEQ ID NO: 184134 - DNA, 1458 bp, Artificial Sequence
  Description of Artificial Sequence: Synthetic coding sequence
atgtacatcaagatggccaccctggccaacggccaggccgacaacgccagcctgtccacaaatggtctcggctcctccccggggtctgccggacacatgaacggactgtcacattcaccgggcaacccctctaccatacccatgaaggatcacgacgcaattaaactttttattggccaaattcctagaaatttggacgagaaggatttaaaacccctatttgaggagtttggcaaaatctacgagttgacagttctgaaagataggtttacaggcatgcataaaggctgtgcttttctgacctactgtgaaagagaatctgccctgaaggctcagagcgcattacacgagcagaagactctccccgggatgaataggccaattcaagtaaagcccgctgactccgagtcccggggagggtccagttgtctgaggcagcccccttcccaggacagaaagctgtttgtaggcatgctgaataaacagcagagcgaggatgacgtgagacgtttattcgaggcattcggcaacatcgaagaatgcactatactgcgcggcccagatgggaactctaaaggctgtgcctttgtgaagtactctagccacgccgaagctcaggctgctattaatgctctccacggttctcagaccatgccaggggcaagcagctctcttgttgtgaaattcgcagatacagacaaggagcggacaatgcggaggatgcaacagatggctggccagatgggaatgttcaatcctatggcaatccccttcggcgcgtatggcgcatatgcccaagcaatgcaacagcaggctgcactgatggcctctgtggcccagggaggttatctgaatcctatggccgcgttcgcagcggctcagatgcagcaaatggcggcactgaacatgaacggcttggctgcagcacctatgacccccacgagtgggggaagcaccccgcccgggatcaccgccccggctgttcctagcattccctcgcctatcggggtgaacgggtttaccgggctgccgcctcaggcaaacgggcaacccgccgccgaggccgtcttcgcaaatgggatccacccttatcccgcgcagtccccaacagccgcagatcccctacaacaagcctacgccggtgtccagcagtacgctggacctgccgcctaccccgcagcttacggccagatttcccaggccttccctcagcccccccctatgattccgcagcagcagagggaaggccctgaggggtgtaacctctttatctatcacctgccccaggagtttggagacgcggaactgatgcagatgtttttgccattcgggtttgtgagctttgacaatcccgccagtgctcagaccgccatccaggcaatgaatggctttcagatcgggatgaaaaggttgaaggtgcagctaaaacggcccaaggacgctaaccggccgtactag

SEQ ID NO: 184135 - DNA, 1455 bp, Artificial Sequence
  Description of Artificial Sequence: Synthetic coding sequence
atgtacatcaagatggccaccctggccaacggccaggccgacaacgcatcattgtccaccaatgggctcgggagtagccccgggagtgctgggcacatgaacggcctgtcccatagtccaggcaacccctctaccatccccatgaaagatcatgatgcaatcaagctgttcatcggccaaattccacggaatctcgacgagaaagacctcaagccactgtttgaggagttcggcaagatttacgaactcactgtgctcaaagaccgctttaccggcatgcacaaggggtgtgctttcttgacctattgcgagcgggaatcagcgctgaaggcccagtccgccctgcacgagcagaagacgttgccgggcatgaaccgcccaatccaagtgaaacctgccgacagtgagtcacgcggcggatccagctgcctgaggcaaccaccgtcccaccggaagctatttgtgggaatgttaaacaagcagcagtctgaggatgacgtacgtagactctttgaggcctttggaaatatcgaggagtgtacgatcctcagaggtcctgacggtaattcaaaaggatgtgccttcgtcaagtatagctcccatgctgaagctcaagccgctattaacgccctgcacggcagtcagacaatgcccggagctagtagcagcttggtcgtcaagtttgccgatactgacaaggaacgtactatgcgtcggatgcaacagatggctggacagatgggaatgttcaatccaatggcaatcccattcggggcttacggtgcttatgcccaggcaatgcagcagcaggccgctcttatggcatccgtcgctcaggggggctatttgaatcccatggcagcattcgcggcagcacaaatgcagcagatggccgcattaaacatgaatggtttggctgctgcaccaatgacgccgacaagcggcggctccactcccccagggatcaccgcccccgctgtgccctcgatccctagtccaatcggcgtaaatggattcacaggactccctccccaagcaaacggccagccggcggccgaggctgtttttgccaacggcatccatccgtaccccgcccagtcacccacggctgcagaccctctgcagcaggcttatgcaggtgtacaacaatacgccggccccgccgcctaccccgctgcatacggacagatcagtcaagccttccctcagccaccacccatgatccctcagcagcagagagagggacccgagggatgcaacctgttcatctaccacctcccccaggaatttggggatgccgaactgatgcagatgtttttgccatttggctttgtcagcttcgataaccccgcgtctgcccagacagccatccaagccatgaacggcttccagataggtatgaaaaggctgaaagtccagcttaagcggcccaaagacgccaaccgaccctattag
